United States Patent 9,328,346 (POLYCOMB-ASSOCIATED NON-CODING RNAS) - sequence listing, part 60

SEQ ID NO: 12331 - RNA, 54647 nt, Mus musculus
cuggccucagaaauauuugggauguuuuauuuaaaugucuuguguucccuuuuaaccaacaccaaaaagagaaauuaaaaauuuuuuuucuuucuuucuuucuucucccccaccccaccccgcuauuccaaacaggagagccacuucagugaaggguuggcgagucucugcaauuggguggggaguguguguguguguccuguccggcuggaguguucuucccagcuuggcaacccuggguagacagccaaccccggagguggcuuccugggagucucauccugagcagaccuggucuuccccccagggaggguugggcuugaggacuggccgugacuauggggcccaguguuccagagggaagggaagggauggaggagagaaggucagaucuggaauguuccauggagguugcagggucuggagaauauauuugguagaaaaauaaggugcuuugggaaucugugcagucugugucuugccugcccaagagagaaaccugcuggccaaagggcaauaacuagggaauaaaggcagagccaggaaucuggcccauggaggauuccagauacaggcaaggcagauagcgaacuucuguuccugcuggaaguugccuggaccucucccuugagugugggcugcccgguggugggccacaaaaggaggggagcuggcuguccauugcgggcuugugggaccugcacccucagaacagggugcguagggagagcacagccaguggaagcagcagggccccuggggagggugcgcucccagagccggcccaggcacaguggucaagguuggccccaaugcaggaggcauacgccaucacauggggaauguaguucugcucauggacgccgugaagcaggugugccaucgggcccuuggcaaagaccgccacgucuucuccaccgugggucucauggcgcaggggaacagcggacugggccugguaguuguugugagcuguaggucagaaauaucuuuugagugccuaucugaaccccagagcugugagagaggaaaccuuuuccucacccucaggguggcuuggaggcccuuuuuacaggagagggaagccaggguucagcaaccagggggagacauuucaccaaacgcaacuggcuucaaaccaagacugccucacccaggagaccacgcucucagccccuuacagaggauuuaucgaauaaagcacaugugguaccuacacaaggcaggcaucaagcuaggcucaccagacccauggcaucuuccaggguaaaguccccagaagguaaaaguuguucaauggagaaaucaggugugcaaggucagaguuacucaaguacaggagagagcccaaacugagguucugacucaaaucuggacuccuccaggaccccgucagcccagccucgagggauaaagacccuuuccccucccagcccuggccucugcagucucaccguaaucuaccauggagacauuuucccguucaccguccaccaccuuguagccaggcccguuaccauauaggauggccgugaagggcuucuuguccgugucgcucaccaugggagccagaccugcguagggaaggggcccaaggucacaauggagaaguggcagccuggcccuaacccagcuccccggggucuguggcuugguauuucuugugauccuccuuaggagucagagcuaccuccaugaagacagcacacaaaugccaggucuuucauccuuccaaugaucuccuuccuccccaugccccucccccauguucucuuugcugcacacccacccaucgcccagguguucagcucucuuggauucuccccuccccuuccaguaucucaacugucaucaguucucaugggacaggcugcuucgcuguaucccagggacaggcuacucaccaaagauggaguugccccgggggguguauccaccgaaugugaaaacgugggaaugaucagcaguaaccacagucaaggugucuuucugggaugucauggcgccugccuugccaauggccugguccaucuccacugcuucaugcagagccugcuuggccuuacccucaugauguccguggucaauccugccuccuagggacaucaagacaaaggccucccaugaggcgacaggggagggagcccugcccucacaggccccaggacacugucaucagauuaacaucuccuugauaugggaugacagcgaccuucaccagggacucccugugccaggucuaccucaggcaucucauggccaaguggccuucagagggugagcaaggagaauguagggggcggggcauguggggaaagcagagccacagagaagggagaaccacgggauccaagccuggaucucucccacaagccucggcuccuggcucagcauccuuagcuguuuuaaggggucgcugaagccuucagcagaggggaagggagggaagggcaggggagcaugccuaagucccuauugugugcuuggcacgauaaagaagcaucguguuugauuuuacaacaacucuggguauggggugucuuagauggagugacuaaggaagcguggggggggcaggaagaauucccuugggaguacuggauaggggcucagguccaacccauuccaaagcccaguuucauuucgucaugaacauaucacuauaagcagaaagcauggagacgucaccccagcacaaguccccagugccggggcaguguuacaguggccuugcagaaaggcuuguggaagguugaauuccaugaugcuagaccccuggagaaggaauaugcaggccugaacuuucugcaggacgccaccuaguggucacucgcaguucugagggucgugagcuggggugcuagguggugcucccucuccacuaacuucauucacccucaccgcggccuggccaguggguuggcagggcgggcaggcuggccuucccuuuguugugguugugggagcagcuggccuggcaggcugaccuggcccuguucacaaagaggaccacucccaggggacccgugcucaccaccacugguuccuggcgcuuccucagaucagaggccugcuuggggccaggccgagaccgcugugcuggugggaaccccagggcuuggcaagaaggcagccuagcugggcaggcggccacuggccucuggaggguggaggggcccaagcggcuauguguauauuggggacccgugguguguguguguguguguguguguagacaugcccauaugucuucauggaguaagaauaugcauaucucagcagggccacccaagggaccauggagggcaagggcuguagaaauucuggaagauucuggaaacucuguuaccuccuauuguugcuuuggcuacuauguaauuacaauggucgcaauggaaacacugauggguaagguuuacucucugcucccccagggcuuauggaguugcuggcuacucugugcccugugcgcauggccccacgugggugugugcgugucuucucucaaccacuuucccccuuuauuuaguuuuaagcauuuuauuauuuaauauuuauuguuuuuuguuuguuuguuguuuuguuuugagacaggauuucucuccuguagccuugguuguuuuagaacucacuauguaggcuggccucaaauucagauauaucugccuuccaaacgcugggauugaagacuugcaccaccaccaccuggcuugguuuuauucuucucucuguuucugucugucuuuauucugugucucugucucucucuaucucucucugccuguguguauggggugccuguaagggccagaagagggugucugauacccuagauuggauuuuuggccaaaaauuuaugcccaguauuuucacaauuuuuaaccacacuucugugcccagauaauuuacauaaccuuuaucccaggcucucucgccuggacagagcucgacguggucgugaacugucugauaugggugcugggaacugaacuugggucuucugcaagaacuggaucuuaacugcugagccaucuccccugccccuccaccuuuucuuuuugaggcagggucucucacugaaguuagcuaggcuggcuggccaucaagucucagggauccagcuguguccacgccccauaaccccgugccugacuuuuucacaaagguucuaggaucugaacugaaguccugauguguguguggcaggcaccagggagaugacugagccuccucccucaauccuuugugcucgcuucugagcaagauggggccaagucaccgcucuaggacaggggacaaguuuuggucucauuuuuacaaaaaugcuuagugauggucccacggccauggaugguagcauguggacaagaacccaaugucaucucccuggccggugacagccacagugcauguggaacuucuuuugcaugggugacgcuuacaggcuggaugguccuccacagccaggacugagagaaagacgucucaaaggaagauggcuucuccucugccaggaagccccccucuccucugaauucccaccaucuuugccaggagcauccuccgcauccacucuucaacccgaagcuggcaguucccuguaccguuccaucgccuaacccacgucauguuucuggaaggguugucuccaccacuuccuaccuuccaccagcaagaagaagccuuugagguuuuuggucaggauccggagggccaccuccaccaucucggagagcgaagggucagucagguuguuccgauucaauucauacugcauguccccgggcucaaagagaccuguggacauggcaagaauaugggugccaagagcuccccgagccuacugugaggaccccaagaaacccagggugucacagaggauacaagaccccuacacucaacuuggaguagauacuuaccugggaagcucuguggauccagaaauggacucaaaguuuucauucucuucacagccuacuuccccaggagcauggggccuucaaccccaccccuaccaucagggcuacagggucugcagcucaccucaccaguagcacggggucuaaagaacaccuuuaccaggggcauggggggcauagccuaccucaccaggggcacaaggccuacagcucaccuuggcaagggcauggggaccuagagcucaccucaucaugggcacagggaccuagaauucaccucaucaggaacaugaggccuacaggccaucacacaggggcacaggaucuauagcauaccucaccagggccacaggggccuagagcccaccucacaggggccuagggcaggggugccuauggcccaauuugcagaggaagaggaaaaauaggagaaggagguaauggugguggaggaggaggaggaggcuccaagggacccaacaacuugcuguuuucagcgggugaaagggcagaucugugacucaaccccaagagaccgcagcaccacaucucugaggcagugaacucuggacugggcucagugggggacaacauaagcaaugugcauauuuacacgugaggucugaggguacaguggccugugcagugaagcggcagaaacccaggggucacugucucuucugcucucugucucucaucucgucaccaugcagcggccaaacagcagcuccaaagagcccagcgaacccucugugccaugccaccuugcaccagcaggagcugaccuccaaggcgaugugagccaccaggcuccgaagugccccucccuuugcuggccccuacucucuagggaacagggguuacucaaggaccagcagaagcuugccuggcugguuucacccuggugugcugugugcucucccuucuccgaacuuguuggguuuuuuuguuuuuguuuuuguuuuuguuuuuuaugacaacuggggcucaucugcugcacagcuuaacuccacaaaccaaaccuuuccucccuccacacccuggaaggucucgcaauuggagacuaucuccuacaacugcagccgagggcucgccccuucucuacuuaccuaagagguaguccacccuggaggggucaagggccagcaguucagugcgguuccagacauagugggaaugcugagggguggaaggggcugugucagcagaggcccagaaggccaaggaaaagccccagcuggccucagagucaggguggucccauucuccugcaucguuuaacauccugcccugagcaccuagcaucucuguacucaagaaaugacagauaugcagagguuguuggauacaacccagguauauguggguccuggagaguggaucaaggagagcuuccugguggaggugacacccuuucggagguucuggaggcaaaguaggaacugaucuaucugggaucagagaauugcuuuuccugugaggguguuacagcauaggucacagagaacaugaauaccuacaaaaaggaauugagugguguuugggggucucuggagagccaggagggagugaaggccacuggcugugucuggagaaccccaucuaggaggggauaaaggaggcacugccucccccaggacauagaaugagacagccuggauuauccagggcacaauguaugggcccagcaucgcgaggaauuugcugugugucuucaagacagcucuugccuucucugggcaguggccuuagaggugguuuuuuuuuuucaauccucuagguugcucugggggggggggaggaggaagggaagaauccagcucagauccccagggcccugcuaugacauccaguauucacaguagucucucaagacuguccccauuucacagauaaggacacugaggcacguacacaucaggguuauugagaaacacuucuagccccucuacugauguccagaaucugggacccaacagugacccuaccggguagggcucauggcaguaguacgggacccucccugugccaggagucuauacagagucccggggcaagaggauggcuuccugguccugaucacagcaacugaagccaagaggaggaugucccuuuggugugccuauccaagcugccccaggaggggaaagaaagagaagcgagucccucacucccacacuccuauacagccacggggcuguccccagcccugcccaucuuacucuuagcucagccucucaugccacugagccucccuggggaaccauggaacccugagaaacccaaccccagagugacaucaaagcggcugccaggcuucuccccacugucuucaagccugaccacagucauuuccagacccagcugcccggcuggcccacaguggcacauuuaaagggccagaggccucacagaggaaccagagcuuggccuaacccugcuccugccucccucucagcccacuggugcucuggcccagggguguacucugagggcuuuacaccuccggccucagccagcacacuuuugcugagccauguucucccaucaucugcucagcgcugccugcccacacccucccauuccauucguucaggucuucuguuguauccccucugcgugccuccaggucccaacuuccugccguccaggcacacgacauucccugugucagguacccagccugucucggguccauccaggugacucccugacucugucaccauccccacgugugcccuuccuacagggagcaggagugucugucagucacaggucaguacgguagagcaaacagaggaacaucuggacucucacuggcagagaacauuugaugcguggaugggggugucccacggcccacagaaccauagccgaguccaccugcagccuugguuaccuugugucuggguuuaaagcucuuccaaauacugaugagauccaggccaucuagccuuguaccccuggccuucucauccaguucguauuccacaucaguucuguucuucggguacauguauuuccggccgccacccaugaucaccugagggacaaaggagccaucacacccaggguucuaaauuguccagaagccccagggguuccgacuuggaaaguagacaugagagucuggguggagguguggacgguuguccagcuaggcaagggcugggccagggcucccucucugaacgauuuauucagauuggaaagauaaaaucgcugaccuagcaggacuguggcuuggggcuucuggguggaaucuuaguguucucgaauagcuaacauccccuacccccauaggaaagcccauuugcuguguguccugagccaguaagaccgaguaacucacucaaucucccaaccaagccgccaggaaagugaucuacgcucucucgcuauagacacagaaaagggauuuccugccccucagccacacagcagugcauggcacagauacgauucaaacccagaaacccacugucucucuaccagaagccccccugagugcucugcuguaugggugaagccaggaauggggccuccggagugucuucuacagugaguggccucagacagggaggucuuggggcagcccagcugggaaccagcccacugccugggcaaacaccggccgccucacgucuauguaaucacugccaggcuaauuuuagccacuguggcuggcaugcaaggguggacggauggacgcgggguuguuuguuuuccuaggaaauccauguuugaaguccuaacuauuuuuaaagcaggggccaagaacauaacagccauagcccauggugaccaccauacuguguccuucugucaccgugggcaccagcucgacuugcugccccuggcugacaccugagauccacugucuccagaugggccaaaguucucucucuauucuauuucccauggcaaaaaucaggguucgaggggguaaggggagagccggcgguggacaugggaaagguacccaggaauagccacggguacccaggaaggccaaggacacugaaguaaagaucuaauucuacugcuuaguaaccaugggucuauuucuuugaucauacaggacuucaguuuccuagucuauaaaaugguaaugacuauccagagaagaaaagcagucauccaauguugcugcuggucccuacaauggaagaugucccucuggaagggaacaaugaagacagacaggaggggagggucuuacucccaucauguggcaaucagcuuggauaguucagacugggucugggagaaaggacuccaggucacuggcgccuucuccuguucccauagaaccugaccccuuggcauuuucagcauggaacugaagcccccaaucuuccugcccggauagcaugguucccagcccagcggagacuucacacgggcucauuaaacucccaaauaacagacuugcuguuugccuuugggguuuggguuucucucucucucucuaaagcggaacauauuuauuuucugaguggacaccagaauuuuugauucauggacggucuggggaguuuuggggguagccgugacagaggggcaaauggaauugggagagugagggcagagggggcuuugggagguccccuuugcacuccuuggcucaugcccucaugacucuaggagaccccagccccccucacugccgccaaagcuuuuuccuccaaagugccucucccugccucagccaauccugccucagcuggcuaaagaguuacuguaaucaccucaucucccaccucuugugcuacaggacccauguucuccacaugaccucaucugggccucccgcagccuguggguggggcacaggggugggaaaugggagggcgaaggagggggagagcugccuggcagguggagauaaagccagauggguggcugugucccggguggcucucaccuaagaggcaucaacagggcccagugauccugaaagcagcgcucaccggcuacuugggcuacuuguaaaagagccacgggguuggagacauagagcagagagcuauggaaccugcgucugagcucucucucagccucacuggccccauacuucagggucagggauucuaagucacggucaacccucauagcagagaaagagcaauucagaaauucuccccaagagcugagaagccugcguguaagaaccugccuggguguugaggugucagcacugaggacggggacggggacggacggcuuacauaucacgcugcugcuugagugcucccgggggccaggcucugugccaaacucaacugggauuuucuuacuuaguucuuccagugagcuguuggagcagguccagugggcagaaggcuuguccaaggggaggcucagagagguuaaguaacagcccaaggucacacagcuagcaaaaggcagagcacggaugggaaagggagagcaugaucuagcucuuuucuggacaugucagcucugugugcaggcaugugccacucugugcaagugucaauacauagggccgggcagccccuaagaacauacugugagugcgugugugugugugugugugugugugggguauuacugcaugcuguguguguguguguguguguguguguguguguguguguguguguguguaucaguguacacuguguguggagggugcaccaucagguucuaauuuacagaauaaucucugagcauuuggggcauggcagccacaugagacuugaccucauagcuccacugcagagaaaccuuacaagggcugccuguuccaaccacaaaucccuuaauggguugggagcucuuccaggugugugggguacccgggccuuccuaggccacccuggggcuaagaccccucccccacccuaucacauccuaugccugcugcuccacucacgucgauauccuugauauugugcauuagcugauaugcgauguccuugcagcccuggcucagagccucugguggcaucucguuauccgaguaccagucccgaucggccgagugugcguaggcugcacuggguguggcgugguucacccgagugguagucacaaugcccacggacuucccugaagugaggacaggagagguuagcaccccugguagauaaggaagucccugcacacguaccucucccucccugccauagguaaucucccgucaaucaguuccucugguugccugggccucaguuucccuagguuacaugaagacagaugcagcugaacgccuuuccuuguacucagggugggcuaggguccucuccuccuuccaugacuuauggagccuaugccuguaagaagcccuagguggccccgaagggacgucaaguggagagaagagcucugucaaccugccuucaaagugccugaggcagaaggaguguuagggauugguucuaaugcuuugaauuaauccagccccccaaaauugggaauccacguguccaaauguugaagguccuuguccccaguuggcuuuuuuuuuuuaauuuuuuuuuaucuuuuuugcucccucccucccucccucccucccuccggcaaccgcccgccugccccccaguuggcuuuugauagaucaauaaagagccaacagccaguggcugggcagauagacugaggugggacuuggggauuugugagggcuagggacuuggagagaggaggauccgucaugccucggagggagacugaucagauuuagaguugcagaagaaaauccauccgaaauguagguggaaagggaaagccgcccuaugggaggggcugcccagaagguaacagggcagcaaagauaaaacauagauuuagaagcuguugagccagaggaguacuggagggaaauguaugcuaggaggaggaggaauagaacuguccagccuuugagccuuuaaaguuaacggguguguguggugugugugugugugugugugugugugugugugugugugugugugugugugugugcuauaaaggaacaccacucugaaccucugcaggcuggcccuggcuugguccuuugaccuucucucaaaaccgugcaugggcuucacguccugcacucuguagugaagcgcacgaacccaggugcuccacgcagucucuguucagcaggagucccccugguuccuuggccugauuccacccugccaugcacgaacgaggagacugcaauccagacaacccaggagucugccuucgauggcucaccagcauccuuggcccagcgcaggauggaugugaccucauugcccugagugguguugcaucgcgugcgcucuguggcugcgcucacucccacugugcccucguuggccuucacgccacacaaguaggcaguggcagugcccgcgcugucagggaccugagcguugguguuauaugucugcaaguggaagagucaggggaugaguacccaccgaggcaaccccacuuccauuuccaucaagggagcagggucuaagggacccugcugcccauggaggguccccagaaccacaaggucaccugacugagcuguuugcuuccuauacccuggcagaacucaagguuucucuccgaguauuggaacuacggaaccagcaagggugggccaagcagguagauccagcagagggaaguguaugucucugaggaaaacagacugggaggggaggguggaccugagaguccagccuggcuuuucugaugccccugaaaauggucaucacuauguccagacuucccagggaaaucgcacaggcaggccuaccucccuggcccugaugagccugacagcucaucaaagauccagaaacuacacuccccucccacuccacuauaagaagcuggaaucugacacuggguggcuaggaggugcuuguuacauacacacacacacacacacacacacacacucacuccagaaaccucuccucacuacccacauguaggguaaugaaugauucacacugggaaucuaaccugggaggugugaacuaagcugacucuuguuuacaggaaacacaagaguaagcacaagccauccauggugugggggggucaggacgguggcugcugucagugcaggaagagacaaagacaagacauggcucaggggacagccaguccaugugcagcuacaacagccaggcgcugguuacacagacaccagcagcuugggaaggauucaugcuguccugugugcacucuuucuuggguauguuacacacacacacacacacacacacacacacacacacacacacacacacacgcaaguacacacaugcacgcgcacacacacacacacacauacacaagagguucuacaucgaugaacuaaaugcuugggaauggcuccugguuucacccugggaccacgggaccaggaggucugauggccuugcaguuccccaggucaagaguggaccuggugcagggcucaccuuggagagggccacaaaggggaauuuguccaucuccagccgggucuccucgcccguguugugguguagcuggcccuuaaggauucgggcagcgguuacuguggagacgcccauaccugugggagggacagagaacucaggcucucagacccuucagucagcuuucccaggcucccagagccccucucuucagugcuaagacacaggcaagggcaguggguagcagacagaaggacaugacaugucgccgcacggucucucuguucuuucauauucucagggcgguagguuagucccuuucuccuaaucuaucucucagagcccucuuccacaaaguccuuuuaccugauaccaggagucaugcuuuccagccacccauggccucaggcuccaaaggccucaggcuccaaaggccccagcggcaaggcccccagcucgacugcucccagccucccuaaccccagcuucccauuccuagccuugcugcccccaucucccuccauuccaagccacacugcccucagccccuccauucccagccucaccaucucccaggaacaugaugacauucuuggcuacauugguguugagcuuuuggaguuucagggcauuuuucaaggucucuugggcuugcugucgccaguaacuggggucucucucuuucucugcagagacaggugguuauuuggcaaggugggggaugggcuauccauccccagaauuacagacaccccaguaguucauugcuggggggcugagaugaucuaaaccuggagggcggagugaagguuugugaacagguuccaggcaaaccccguaagccagcccgaggacaucuucacacaucgcaacaggaggacaccaaagaccagggacacuaagugacucuccccaagacacaaagcacgaacagacucagacuuuggcagagcuggauuucccuggaaaucccacacgugcccuucacccgcggggagcagccauugccagcaagcagguagcagggaaaucuuuaaccucuucacaggcauuccuagagguauucagcuauagccaugauaaacuccaccuggcuuguucaucacagcugguucagcaggcuagggccuucuuggugagaacacugcaggcagagcuagaaagcaagccuagcccuuggcugggauacauuacccaaggagcccuuguuaggguaguggggaaggcaagggcugaggcuccaucaccaccucucuaacacucacugccccuacucagaccagccucuuagaguaaaauaagaccuggaguuccuccucuuccuccaucucucucccugucucugucuuaaguaguaaucaauccacagccuugguacccuggguaaaccacuuccccaggccucaguuuccucaccugucaaaugggacuuuuuaaagaccacacuaauuccagaaguggcuggauucacagagagggcccagagaugcccuucaccuuuuuccaucccugaacuccaaggagauggcuaggguuccaucucuggagcugacaauggggcuccacuguuuuacaaagcuuccucucuguggaucucuggccacaguagaccugcccacagaaccggaagcccaaggcugaaggcucccuguagaugccuccuucaaagaccucucucucuugggacagggugagguagagacagagguccaaagaggugaaggguccaguguaaggccacaguguacgucugugggcuaaagauauggucacgggcuccagccuggucagaucuacucuugccccucaggacaaugugcugagaagccucucaguccaagcauggagcccagccugugugccgagaguucugaacacaugaagcuucuguggcuugugugaggggcaaaacuuccuccccgcaggaagggaagagagcaaaauugagcagccgaggaggagaugagagcauccaaacaaccaggcaauggccauuacagacagccuaggcaggggaaccacacugaucucaaaucguggguccgccaggccucuagcccuccugcaccccaaacaccugccugcugucuucaccccuaagcuccaggcccuccucuuuuagaagugucuucuggaacccccaguuucagacuccacaguauagccugcgcucccagaggaagcuggaggccugggccuugcuguccaccucuguccauugaguaagugcuuuguucuaguuucuggccuaggugaauagaggggggggggagcuggugauggaagucauaaggcuuuaacagagagacccacuugguguuugagacagggucucucauuggaccuggagaucacuaacuuggcuaagcugaacagcaagccccaggaauuacaagaaucugcccccuacaacgagcuuugucacacacccagauccuuaccaacagagcccucgucuccccagccccugggucgaugguuuaaaugacugguucuguaaaccuggcugguucuaaccucuccagaauguccugggucaggaagcauuugcuugugugccaguuggggguugaagaacuucagcccauccuaaccacaugcccauuacccccagcagucaggcagacaccaggccugacugacgccagucugccccaucuuucucaauacccacucugcugccauucuaaccggucucugcuagauggagaaucugcugaggauucagagucuguuccuaagagggucugagucaguaccaaaccgaccuccuuaucugguaguguuaagcaauaaugguuuggacaaugaaauaccaggagaccauuauuccaggggguaaacggcagggaccaaugcccaggauguaacauguccuaagguacugauuaguaccuacggcacaaauccacucccaugcuuccagaacauacagaaugacacccagcaucaggauggcaauguugggaaaggcacugagaaacuggccuggccugugccuaggaauguccuucugaucuggguggugacuuuacaaaaacaaguguguguguauguguguguguguguguguuguguguuucuggacaucucgccuagaauuaguggaugaccugaggcaugaaaaggguuaaacacaguaaaacauuguagaaaugcuucccuauaggaacauggaccagcaguuaagaacguguauugcucuuacggaggaccagagcgauucccagcacccaugugggguggcuuacaacagccuuuaacuccagcuccaggagaccugggacaggcauucgugcaugcaugcucgcaugcacacacacacacucacucaugcaucuaacucuucccacugaagaccaguucgaaagcaagcuaagagaucuugcuuugagcaccuggcuuccagcucuuaacuacuuuguuuggguccacaaucucgagcccagaccacacucucaucugaccuugcccacccucuccuuccaccugaguccagcaguccuaccuggcacaaaagaguugguaaggcaggugccgauggccaguacuaaaaauggugagaucaugguguacccugagauucgucccucgcuggagcccagauggugggaagaggggggggggggcagcgucagauguuaauugacguuaauugacguuccgauccuagaaguuagaaaagaauaaaaaagagguaugugagcgcagcucuggggcaguuuguuccuccccgccuuuguuccuugauucuuugagcaagaacuuguugaguaccaaaaagccauuguugggccaccacccugggaagaaaaccccaaaaacaguuguguaagcauaaacgcgucuguacugcaaacagauaccaccccacuugcuggugugcccgaccugcccugaggcaggcuucucaggcugaacuguuuugacagaggacagaauuggcgucucuuggagggcugugcuccagccagcccuaggcucagcccagagucucuuagaauucuaaaagcucucaggugccacucgcuccuggacaacacauuaagaaguaaagccuacaacugaguccacagccuccugacccaccccugugccucacaagccagggauaaaacagccuugaauuucuucacaagaauacuuguacccaggacaccaauauuugcccacucuuuccaaugccuuaccaguuuuugguaagcgauuauaaacaaaaguaucuauguagcccaggguggcugagaauaaccuugaaccccugauccuccugccuauguccuucacauccugggaucacagggcaaagccucagcagcugacuuccuuugauauauauauauacauauacguguauauaucauacauauauauauauguaugguguauauguauauaucuucacuucauuuuccccaaaauuauuuccauuuuuguuuguuuguuuuuguucuguuuguuuguuuguuuguuuuuguuuuggucauugcuaggaucaaacccaggaccucacacaagcuggacaaacuuuggcucaaauucuugaucugagcuugcaugacuaacacgcuaagcaucuucccaggggcuccuuggccaugugucucuucugcgcuggcauaucuguugagauauucugccuuggagcugggagguagcuuagcaaugaaaaacguuugccagacaggccuggggaccugaguuugaugccuggaacugacucugaaaguuguccccugagacuguggaggugacccagaggguaaaggcacuuggcucaagccugauuucaugguucaaucccugaacagaacccacaagguagaagguggcaauuaauucucacauuguccccaaccucccuacaugcaccgugacacuccugaacucauacacaacaacaacaacaacaacaacaacaacaacaacagcagcagcaacagcaacacauuugaaggaugaugcucccccucccccaugcuggggaugacacccagggcaccuccuaccgcugugcuauauacccucagccuacuuuaaaaauauuuuuuaggggcuggugagauggcucaguggguaagagcacccgacugcucuuccgaagguccggaguucaaaucccagcaaccacaugguggcucacaaccaucuguaacaagaucugacgcccucuucuggagugucugaagacagcuauaguguacuuacauauaauaaauaaauaaaucuuuaaaaaaaauauuuuuuaaaagaaggaaucuuuuuuuuuaaaggacugaaggaaacacggcaaacauuaauuggugguuugcuuuggguggcaagaccaggaauaauuauuuccccuuauaaauguguuuccaaguugccuaaaaucaguguaugaauaccuuaagccuguuuuuaacugggcucauguuguugcaagcacaccgggacagccgcgcccccccccccaggcgacuaguuagcuacaagauguccaaacguccaaacgucaggguagagauguuaccgaaggagaugcgguuuucaauauggagaguuuuauuagaaauaauguuaccagcugggcgugguggcacaugccuuugaucccagcacucgggaggcagaggcagguggauuucugaguucgaggccagccuggucuacagagugaguuccaggacagccagggcuacacagagaaacccugucucaaaaaaaaaaaaaaaaaaaaaaaaaaaagaaagaaagaaagaaagaaagaaagaaagaaagaaagaaagaaagaaagaaagaaagaaagaaagaaauaauauuacccagcuagaaguaauguuaugggaaacagaaaugacuccgcggugaggaaggacagauaagccaccaaucuaccaccugcauaaggaacuuuaaaagaaaguuuuaaaggcucuguugaaggaaggguggguagggauugggaggcaaugugcucuaucuagugucuaacugaacuuaaugcugaggucuguuucaggugauugugagguagcucagcagguaaaggcucuggcugccaagauugaugcuagccccgaguucgaucccugggucccacauaguggaaggagagaacccgacucuugaaaauuguucuuugaccuccagacagguaaagcagcaggucauccaugauccucuuccucuuaccacccccccacacacacucguaagcacacacaguaaaagcacugugugcauaccaugugugcguguucguauacacacguauauggauggcgcguaucuauagaggccagaggucgacauggaguggguacuucuauggcucuccauaaugguuuccggaagggucucucaacugaagauggcauucacugguugacuagacugucugggugccaagccccagggauccuccugucuccauccaugcuccccaccagugucaaugccaugccuggccuugcacauuugcccacuggaugcuccguguccaggcuuccauucucacccguuacacagcaugagcuuugcccacugagaaaaaaaaaucuauuuuuguuuuguuuugguuuuuuuugagacaguuucuccauguagcccuggcuauccuggaacuugcucuguagaccaggcuggccuggaacucagagagauccaccugccucugccucccaaguacugggaucaaaggugugcgccgccgccaccgccaccaccaccaccggugucuacauuuuucauucuaccuuggaagccaaauaguuuuguagcaaauuguaagaucagaaagucacgaaguugacauaaacuauaacugcauuguaauacuauccacaauauauauaaaauauaaagucacuucuuucagaugaacuauaacacguuucccccaacuucacauggccucaaugguuggcgcgcacuucucuguuuucaaaauaguucuuuccuggcccuucccagucacuacacuagcaaccuccaaccuuccuaaugcugagacccuuaauauaguuccuuguguugugguacacccccaacuauaaaauuauuucuguugcuacuucaaaacuguaaguaucuacuguuaugaauguaauauaaauaaaucucugauacaugauccccaaagggaccaagacccacagguugacaacugauggccuaagguuuccccucccuuaucugugcuccuacaggggacuggggugcucauucccugucagaagagcguccccggauacaacuuugggcaccugacgacacccaccacagccgagcaccaugcggcugccgugagaccccguuuacuccagccagcccuuguuuccuaucuccaucccgacacacacaguugagaacucauggcuggcagugccucgagugccccuccccacguguggcggagccagaaaagccagacccaugggcacacauggaagacaauggcacccagccacguaggcugcagcaucccuugggcagacccccucuucccuuuguuuuggguacuagguacagagagaguggaauaagacaggacaggggugucaaugggacuucugaggugugggagcuuagcuucaaaauggaacagucuccccccccccccccguauggggacuucucugcauguggguuacuaucucuaaggucagagcugacauuugggaacacagucaaccugaggcugggugggauuuccacugggguucuugcuaauaacuucugcagcaaggaaagaggaaaaaaccgucucccaugacagacgagaagaccaugguguagagaggagacauaauuagccugugcuugcgaacaagcaggcggcaaagcugaaucuugaccacagggcuuuugauuccagaaauaacggcaagauuacuaugguaaccccaaccccuccauuuccucaacuguaaagcaaggcuuugaagucugacacaagaauagaguccuccaaugcugccacgauuaggggagacccgccuugccacccaagccuguauggucuccuuguaaucaagcaguccccacugcuaaacccggcuucccugauugguccucuaucaccaugugacgagcaccguauauucagcuagugagaacucagcggauacggguacuugccaccacaccugacgaucugaguuuaauaccuagaacccaccacccaccagcaaguuguccccugaucucacacaugcacugugacaugugugcacccacgcugucucacacacaaaaucaauauaaguaaguuuaaaugaauagaggggcuggagagaugacucagugguuaagagcacuggcugcuccuacagaggaccugaguucgagucccagcacccacggcaguucacaaccaucugcaacucuaaggacaucaaacgaacauguggugcacagaaauaugugcagacaaagcacucauauacauaaaauaaaaucuuaauauauauaaagaaaguuagcgggguggggugggguagcgcacacguuuaagcacuugggaggcagaaaaagauggaucuccuaauuugaggcuagccuggucuacagaguaaguuccagggccuugucucagaaaaaccaagccccauaaaaagagccauugauuaguaggaagagucguugucuguacagugcugacucuccugguccuuugacugaucggcagacagaacuuagacagguuuugugacacuuauacauaugcuuuucucucaugugugugugugugugguuaccauacaugccuugguuuuuuuaaugcuacuguaaagaaauauuguuuguuuguuuguuuguuuacgcuuugacccuauaugcuuagcucacuuaaacucaaaauguuguguguacaugugggaauuccuuggcauuuucuauguagacaagcacauaauuuaccaagagcuuaaguaagggcagcaaaaaaguucuguggguaaaggcgcuugccaccgaggccugacaaccugaguuccaucccagggaaccacaggauggaagaagagaacugauacccgaaagguuccucugaccucugcacaagcauguguacaugagcagacacacacacacacauacacacacacacacacacacacacacacacacacacacacacacacacacacacacacacacacacaggcacacacaacacugaguaaauaagauguaaggacuuaaguuuuacuuucucuuuuccagcccugugacuuuuuccagucucccccgccccucccccaucuugcuuuacuccacuggccggaacuucuagugugagagggacagaaaggacaaaauaaaggucucuuccuuguuucugauugcagggugaaagagcucaucuuucugcacugaggugacauuuggaagcgugagguggaauggguuuugugggggcgacucggggacuuugauuugaugcagcaaguuugaggugucauugggaaggacagacagcugcaguggagacuggcaggucuuggcuaaagguagaaaauuugggaucaaggguaucugguggcgguuauaaccuugaugagacucgacagguucaccaggcauaggagacacggugacagcacuuagaaagccaggcugaaaagaccuuagggguuuucuuucuuuuuuuccucccucccucccucccucuucccccaucuccuaccuucuuucuugcuucuagaaagaacccaaggccucacuuuggcuaggcaacuacucuggcccccaaaagaauuuuuuacguuggcagaauggcaaaagccuuaugccaaaaaccuugcagaaagccuagagagauggcucagcgguuaagagcacuggcuguccuuccagagguccugaguucaauucccagcaaccagaugguggcucacaaccaucuggaauggaaucugauucacucuucugaggugcaggaaaacugagcacucauauacaucauauacauuaaauaaacagacaaucuuaaaaaaaauuacagaaaccauuguggauaaacgcgcaaauucuccauaagacuuaauucauuacccagcaagcucuugcccacaauaaggaucaaucaugucaguaacaugacguucagucuaugguugugauguaucaguccuagcaaaaguagcugucaaacaugccacguggacagagcuugaggaaggaacacaaaggaucaaacacuguggggugaugcagggcacagggacgggaaaggcaaggggugaaaacugaggugugacacauguggccugagaaauggaauucaguccacucucucugcaccuagcacccaaaacaaagguauaaggagggggccuacuaagagggcuccugcagccugcaugguuugucugaggcucccgggucucuggaaacugaagacccagacugugaaagucuugcacccugagccuagagccuacaauagaugcucaggcugggaugcugagcucuggccucagggcccugcacugagacggccuaacugggagauaaaucuaugaggcacugggagagggaaaauccuucagccuccugccucugcucagacuccucccuucccccaccccagaggcuucaggcagcucgggugagaggcucuggugggcccagucugggggagcccuggcuucccaccacccauuguuggaguggaugcugguucacaguccccucccacugcuuagccuggccuuucugccaggcucccagcuacgugaucugauuauuuaggacaagaacgcaaugguuccagcugggcuguggcuuugggugagggaacagcuacuuggcaggccagaagagaggcuucgaggcugggccugggccuugacaauggcauuggggcagcggcuccagaguuugggagaacgccagucucuggcuggcgucaauagagucaggacaaucugaaagacaggaccgaagaugcccgugacccggcacucugucauguccaccugggaacccacacgcccccccccacccccagucacagguucuccugaccucacaagacaguucagagaacugagcugggguccagcuagcuggccagcacuuacauacccagacaggcuccgccugcuucuccagggaggggauggcucucuucuggccucaguuuccccaccagagacaagagagagacuagugcccaucuucuuucuguccuacaugaacagucauuugggggcagggcacuuggaaggggcagagguuagggucuccuaccugaguggccuggccaggcgacaggugaagaaacagagcaggcccagggccagcacgaacagaaggaagcuaccaacugcugugaccaccaaguccagagugggcgacaggagggccaucuuggagugaagagagccuucagaugugauugucacacaaacccacuagcucugcagccuggggucaguggcugugaccuggccuuacuccugaguuaaucuccugggauuaggcaggaaggaugaguuccccucccccaccccggccccgggagagguuuggggggagggcugacgcuguucacuaaacuuuguccuuucacuccucccuccagaacauuugcugagcaccugcuauaaacccaacuccguucuagguucuagagagaugacugaccagccaguguagacaaagcaccuaccaugggccaggcacuuggugagguaaaagcuaaaagggccagagguagggcucacaugccuagaaugcagaaagcucugggcuccgucaacaucacagcauaagucaggcgugauggcauuugccugccauuccaguacuugggagcuggaggcagaaggguccaggaguucaaggacauccugagcuacuguguugucaacagacuccagaaucacccaggagaugggccuuugagugugccugugggggauuauuaagauuaaacuuaauuucagagaucuggugacagcauucccaggccagaguacaggguaaggagaaagaacuucuugccuggggguucaacguaauuggcugcuuccagcucccugcggucuucacuuccccaccuuaaagcucugugcuuggaacugugagccaaaaugaacccuucuguuuguuuguuuucugagacaggguuucucuguguagcccuggaugaccuggaacucgcucuguagaccaggcuggccucgaacucagagauucgccugccucugccuccagagugcugggaucggcugugugugccacgacugcccagcucaacgcuuccuuucuugagcugcuuuuguggagauauuuuaucacagcgacagcaaaagaagcuaagacugcuacacagcgaggcagccuggacuacgugagacccuuucucagaaacccccaaguuagaaaauuaauaaucaguaaaguucagaaaggaaggagcucgaaugaggccugacaccagcuguugccaccuuuaccccauccacaagccagggagacaucuagaacaaaguaccuacuguguggccaacaccaugugaaccagguauuagcaccuccauuggcagacaaggaaacagguacggcgguagggauggaauuucggccuaggaaccagaauagcaccaggccagucaggcucaaagcuggcagucaccuaggaaucccucaggcuggaggccgccuaucugagggccugccggucuccuaucuagccucuuaugguaucuuguacugucagcaaagugaaaauggucccaucucacagacugaaaaauggagacucucaguccccgugugcacauguugagugcgcguacacacaccacacacacacacacacacacacacaacauaaauaaaaaaauauaaugaacauuuaaaagaaucaccuugcucugccuccccuuacuguuggggccuguguauuggcuuccagacaauuccacuagacucuucccuggaaccuagcaacagcuuacaucaucaccugcugccaggugcgagccaaccuggcauaugagagggacugcucaucuccccgccuccccccuugccaucucuguccuucccuuuuccagaucccccucccuuuacuucuccugcaauaaaucuuuauucuaggcuugucagugggugugauuccugggggugggggugggggcaucuuggcagggccuucugaggugcucccucccccuccugcugcaauauaccacguuacacagcauaacacugugagcacuuaguggacaggauuaaagggacacuggggaagauggguuuacuggagagauggccaaccucaaguugaaauagacgggauagauacaguaacacacaccuauugucccagcauucaggaaguuagugacucuagccaccucccaggcccccaggaagaacagaagugcagcuagagacagcucccuugucagcugguucagagcucucucugaggcuaaggcuggagaaaaccuagcagagacaguagcuuacagccacugugccaagcggcucugcggaaggccauggcuuuagcugcagugccugggagaggaucuggaccugucucacaaccaagccaagugucuuugauaguccuuuuuggccagggcauuauucagucacuggcggaaguuauuuagggucacccgcugugaagggcuggggaaaggacgugggcuguggucagaucccaaaggaacuucuguagaugaagguuaagccagacccuggagggacagaacauacuucaggucuccaggagcugacaucccuucuugguaggaaacggacuuaggagaacaagguugagagggugcauugagucuucaggccucugagagaacaccagccaucugggaacacccucagccccaggacagcuguagacugcccucccuguucuggaaaguucucugaaguccacccaaagacucuucuuguucccuccgcacuuuccccucagcuccccugccagcuuuccucaccccagccccagccaggcaucaccuccuaacauggcaugaaugucucugcccuugggcagucuguggcuggagaggccggggcagcagccaggaaaggucugccaggccaacaguggguguuggaagaggcagcccggcagcccgagggcaacaccgggccaggcugcaggggugaaccuugucucugccccucaagcuagauaaccuggggugagaaaucucacccuuucugcaccgggccacucccuuguggaguugagagucugagagagacuugggguugccauaaagauuccggccauuuuaucuguagcaaaggcucaaccugaacguggggcaggcaggugugaguguagggaagugggaagggagaaugaaggagacagaggagagcuggguagacacacacagacacacacagacacacagacacacagacacacacacacacacacacacacacacacacacagagcuugcccacggaccugcucaccugaggcugaaauggucuuuccugcucuauaaugcucaacguucagcaucuggaucgaggcaggucacaggucccuguccccuauguccccuuucccaucucauucucacuggguucuucucacaagccccaggcagugugaggcucuugccuguuuuagagaacagacuaguguaaucuaaaaggucaccggggagccuggcaguguagcuacguuagaggagcagccaggaugaugggaagccgagagacaggaugugaggaauuucagucaggggcaauggccaagcagagagcaguugucugacgacagagcagccuggagcaaccccaaaagagccaaagcaggagcuggcuugcgucuucacucacccuugucaccagucaggguguggcugccagagcuggaaaucagaaggcacugggcaugaggucuggggcuaucggaggcucacucaccgggacaccagacagccucauggguuggagccuaagccuaggaucucagugggaggagagacggggccaggagggagguggaaggcccagggcaucacuuuauagguacacaggcuuccuuccacccauggagaggacacauccugccuaugggcuggaggcugagcaugggagggagagguugaaaggggccaugcaucacugagggguguuucaguccccugcuccuuccugugcuguacccagucucugucccacucccuagccuccccaucccccaccaggaaacacagcagucccauccuaacaucaaaaacugaaaggcacagagagggugcacgaccuuccagagucacacagcacccugacacaucuucuucccaugggaggcgaugguuagaggccuaaggugacgacggucugcaaggcugggcggcgaugcugguguuuagaaacugugcauuaaggacacugacugaggagaacaugucaaccauagcauuagaggacauuccuuccacacccugucccgaacuuacagggucuggcuugggaagcccaggcuagcccagagagagcuuugcgggcggagugugacggugcaugcaugucuuuuaucccgggacuuggagccagaggcagguugaucucucugauuucaaagcuauccuggucuacauaaugacuucuaggcuagccagggcuacuuuuaccuuuauuaacucauuuaauccuacaaugcccagcaggauaaacacuccagcuuuucccauuccacaaaugggaaaacugaguacagagagguuaaguagcuugcccagagucuagcagcaagucacccugucagaauucagucuuccauguggguguuuugggcuuuuggaaguccucucaggaugccggcguaaccucugauaggagcacccugacugacuggaacuguucggcacaucacauacgcaauagggaccggacgauaccaugacucaggauccuugcuccccaaaucccaguuuuggaguguuucccuuggauuccuuggggaggggcuccccuuaccccagagagagaugaggucugccaaugucacacguugggaaauggguagagucacuucuuggauaggcuggguuuaggucacugacccagcaacuauagccagcugggcuguggaaauccuugugagacuugggcaggauauugacccuagauacacccuacuucucccacaaucuccagcuucaguccauccuccuaggacucugagacacccuccccacccccagcucuguccuggcuguguucccccugggaggaccugguuaguccugagacaacccuggggaggaggcugaggcagcccuggcuauggaaacuggccuugaacuuguaacgcgcugggugggccccgacacaagcagagucccagcuagcacacacagggagugcacagaugcugguagcuggcagcggggccuccacagcauccuucccacauuccgaucgagcuugugaccagcugucgggcucucagcagcuggggugugugaggcucuuaguagugggggcgagagaggcaggaacaugggcugguaaugagcuaauccagcagggcguggugucuuaggucugucggccccagcgcuugcugucucuccagucaguucaaagccaaccuggacuacaugagcuccugacucaaaaacugaaacccacgguggugugcuagaccaauggucacaaugugccuugacauugugccuuagaaugggaauucaacaggacaagggacgaugagagaaaccaccaucacccuucguggcagaggcaggaagucagccagcagaguucugauugguggaugcucuccuugcucccagggcacagggcaaggccacacagcaacuaauaggaugaggaggaugucuccacagggcaccuacuaugugcuaaaagcacagggcaccuacuaugugcuagaagcuuucugugcuaucucccaaggauccaaugugggcagaacucucaggaccaagagcacaggagcucauggcuuguacugcaaggugugggagagccaguagccacccaagccugguggacuccucaugcgaugccuuugccacccuagcaucuagcaggacugccuccacauggacuggggcugugacacgggcugugacucaugaccacugaguucccugguucagccuaggcugggggucuggcagaaagcacaucuccgaccacgcaggcucuccuccagcuccuccugccuugaauauuuauuaccuguguucugggggcuggggggacuaucucaccuaagagucugguagcacucccagacuucccucccacccugguccacuccucugugauuaccauucugcagagagagggagccacgggggcugucucaggcugcccucuccaucccuuguaucagggaugaucacuccacgaagcuuccaaugucaguuucugagacaggaccucuuuaguguucucuguugccaccacagugacauggugacacccgcugucauaucuggcuacucugaguccauuccccuccccaacaggggaagcccucuuccuuuugguggcugcaggucgggugacuggcagaggcugggacgguuuccaucuggauaccagagcauugugggugugaagugaggaagccccaggggggaacacggccugggugauggacuagaaaccuacagaaaaacccaugaguaggacgcuggauccagacccuggccgcaggcaugccugaagcucaccucugaguggaagccaguacauucuccuauuguuugcuuugguuuguucuguugcuuagagcccaaacucugcccucagaacuccaguccagaggguuucccucagcucucacacuguaaacaaucacaccgggucggucaugcccagggaagaaacgggacaaacucgucaaaggugggcagacacacugugugcgaauucacacagguggaauccguggcugugcauggcggugcgagucugcgaccccaaguucucuggaagcagaggcaggaggauugcucaaguucaaggcuagcaugggcuucaaagcaaguuccaggccagccagggcuauauaaugagaccaugucagaaaagaaagacagauggauggaaggaaggauguauguauagaaggaagaaagcaggcaggcaaggaagugggggagagggaggggaaaagaauuagaggaaauuccugaauuccuggguaggauugccuagaauagagacacacaccuucccacggguugguaugggcuccauuuaacauuaguauuaacaggcccggugccugaaagcguccuugucugcccacugggcccuucagucaaguggucagucagucccugggaagucaccaguacagaacuguaagaaauccaucucagaggagaagucagaugcacaggagugacaugagucaagugacaugcccaaggucccugaacugaagaggggcagaaccagcuauguccuagauguuccuggccccaagcccagggccuuugccccuggucccuggguagcaggggcagggcuaagcuggcuguccucugaggcuguuuguuccaccugacagccuucaaaacuguuuaaaaguuaaaaggaacagaccugcacagcaggaacagucccccagcgcccagggacaucagcagccuccuguguccuagggcuuuaaugguauuuaaacaauggcuccuagcugcuguucauugagcagcuaaugcccaccaggggccaauaggucaaagcccugacaggguugaggugaugaacaaccuugcugaagugaaguccucugcgaugcaggaagagacagaagaggcagggagggaaggcaggcucagagaagggcuggcccgggacccauauuccagagcccuacaguucacacugcggcccucagaggcugcuguacucacaccuacagaagaggaaacuaaagagggaggcagagccacaagcccaggcaauccagagcaagcagcgggagugaggucccuggcauugcuucugggcucuacccauccuuccagcccaggcugggggccuccuuuccuggggccucuucugccccucuccacagccucaaaaccccuuaggcucuauccgagaucaugugagcccuaaacugccaacccacucuuguucugucuccaccauuaacuucuggcccaucaccaaaguguauuugcauaaagccuaccaugcacagcuggacugcacaugugcggggaugugugugugugugugugugugugugugugguguguggggggggggggacuuccaaccggcuuccccuaccgggcucaagugauagucuucccaguacuggugugggugaaagagaaucuuggucuuagagcugguagaccuggggccccgugugauacccgccccaucccacagacgugaugcagagguauacacucuaaggcucaguccauaggauguagguggaaagugcaugccagguuuuauuauuuccugaauucuacaguguuagacugaaacccagggccuagcccagauaggagaacacucugccacugaguuauaccaccacuggugcuuugaggcagguacucauguggucguccucaucuuaggguacacagagcggugaaaggacuaagaucacgcacaggagcagcagagcuagguccaaaguuuucaacuccaaaguucaaaaacuguuugccauugugcugggcugaaacggcugagguuuuaggagacgccacucaacacaggccagcaagggggcagaccaagacuuucggguuuuuccccaaagagguuaugggaccuuuacacauagucacauaagucacacagaaugggggcaaguacucagggucucuguugccaggguguugaagucagcaggcaagacugagugaaccagaggcaggcagcugguacaaaagccuggaggccacgaaagacuggaaggacugugagugacccagugugugucauggcugaggaggagacugugugugucuucuucuaugguuauuauuauuaagacaggcucucuauauuauuauuaauaauauaggaucucucuaucuauaucccuggcugcccugaaacucacagucacucucuucagacacaccagaagagggcaucagaucccauuacagaugguugugagccaccaugugguugcugggaauugaacucagcaccucuggaagagcagucagugcaccuaaccacugagccaucucuccagcccugucuuacucuaucucccaccuugggcucucaaaugugggauuacagaugugaaccucuguacucacagguguuaggauuacagagaaaacuaggcuuuccuccagguuuaauuugcuaaccuucuuuucugguguugucucauuuguaauguuucuaaugucaaaaauucaaggcaaggggcuggagagauggcucaacgguuuaagagcacugacugcucuuccagagguccugaguucaaauuccagcaaccacaugguggcuucacaaccaucuguaaugggaccugaugcccucuucuggugugucugaagacagcgacaguguacucauauacauaaaacaaauaaacuuaaaaaaaaaaaaaaccagcagggcagugguggcguaugccuuugaucccagcacuugggaggcagaggcaggcggauuucugaguucgaggccagccuggucuacagagugaguuccaggacagccagggcuacacagagaaacccugucuuggaaaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagaaagagagagagagagagagagagagagaaagagagagagagagagagagagagagaaagaaagaaagaaagaaagaaagaaagaaagaaagaaagagaaagaaggagagagagagaaagaaagagagagaaaagaaaagaaaagaaaagaaaagaaaagaaaagaaaagaaaagaaaagaaaagaaaagaaaagaaaagaaaagaaaaagaaaaaaucuacaaagugaguuccaggacagccagggcuauacagagaaacaacccugucuuggaaaacuaaaaaaaaaaaaaaaggaaaaagaaaaaagaaaaagaaaaagucaaggucuggauucgaggcacagcucagugguggagcacuggcccuggguuccauccuggcacugaaaaaguaaauuuguuaagggcacaggucugucucuucuagacugagcuagauuucagggcugaugguuccgagugcuugugacucuacucuggaggucaggucacugugcucagagugugacaggacacaccugggccugcucaccuucaucaaaagugaacaguguggccuaagugugucucgguugguagagugcugaccuagcauguagcaggcucugagcuggauccucagcaccacacaagcacagcacagugguccaugccaugccuguaaucucagcacucaggacaaucauggguuccaggucauccuuagcuauagagugaucugaaagugagcaugagaccagacugggucauaucagacccugccucuaagauagauagauagauagauagauagauagauagauagauagauagauagauagauagauagauuuauaaauagauaaacaaauuuacaaauagagaaauagauaaauaaauaaggcagggcuuagacaacucuuuuuuuucuuuuuucuuucuuuuuuuugggggggggguuacgagacaggguuucucuguguagcccuggcuguccuagaacucacucuguagaccaggcuggccucgaacucagaaauccgccugccucugccucccgagugcugggauuaaaggugugcgccaucaugcccggcuagacaacucuugagaagacagaagcucucugcagauggagcugggccuguguguucucagaguggaggacacagaugcauggaaaccagacugacuucucagcucuccuuuugccaagaugcccauauucuugagcaugcacgcacugccccuggaccaccauagccagcacccuuaggaaugaauagccuagacauuugucaaagaugugcagggucacaaggagaagggaacccacagacacagacacccuacacaucccuuaucagacaagugaggauucugaccuuggugaauggcuccucccuggggagaaagcgaugcucagaccugagguaucagcagagggaacugaccugaccaagccugaguauagucuguccuuuucuuggggcuaaagacaggauuuaagccuaucccuuacccuaaaacaguacccacaaaacagguggaccccaaauaauacauauuggucacaggaacauacaacaacacugucaguuuuuguauguggguguaagaaacggguuuuugaaacaggauucuucuguguagcccugacuguccuggaacucacucuguagaccagucugccucaugccucuagaguguuggaacuaaaggccugccccaccacuacccacccuguaacuuuucuuagauugggucucuuuauguagcccuggcuggucuggaagucucuguguagacuagguagaccuuaacucugcugggauugcacauuuguacauuacacauggccagcaccaguguguguguguguguguguguguauaggacagugacagccucagguguuugggacaguguuccccugugaacaccaggcuagcuggccugugagccaaggcuucuucuguucaagcuucaugucacccugcaggaguacuggagauggaugcuacuguaaccaacuuuaccugcuuucuggggaggguuugcccuuccucgugagcuagacagguguguaucaauuguguaucacaauguagcaauucuacccuaaguacucaaaaggaugaaagucuaucugcaugagaaucccuauaggagcauugaaaggcuaauuuguaacagcccaaacuggacaggagaaacacccaagagcaagugaaggaauggacaaagauguguuguugccaucuggaccaacugcacaauagaagaaggagcuucugacccaacgggcgggaaugcauuucagaaacauaaaagaguggcagaguuugcgcaggcagacagacagacagacugccaucauagacaagagaaaauguucaacuuuuaugugaauaaauguucaaauguagauuaaaugcacacauuccuaaaacuagaauuugccgacgcugacaaaggcagauguaaaagaaccugaacggagaccacgugaaaaaucucuccacaaggcaaaugccugcugaagaugaucucaucuguaaaugcuaccaaguuucaagaaacaacuguucuugauuuuacucgaacuugggcagagggaggguaaaaaacaaccauccagggugaugaccaccaucaccacaacccucaagcccagagggauggaccauccuagacaauaugucaccggcgcaagcggaaugcacacucagcaaaaccagucaggucccccagcuagguccgucccgggagcgugcauguucagggcuucaugggaaagucuuuuauacgacgggugacauuaacagaucaaaugagaaaagccauguaauuaucgcgagcaucucaaaaugauuuuuaaaagcauuuaaugcacuccaaacacaaauuaagauucuuuuaaaagcucccaguagaggcugcugggguagcgggguagcucaguugcuagagcaacugccuagcaggcacagagcccuggguucugugccagcaccacauuagccaggggauagggagagugcucacuggggucccagcacgugggagaggagggcaggaaggccagaaucucagucaaggucacuaaucccauaugcauaugaguucaagaaccuaguagcugggugugguggcgcaugccuuuaaucccagcacuugggagguggaggcaggcggauuucugaguuugaggccagccuggucuacaaagugaguuccaggacagccaaggcuuuacagagaaacccugucucaaaaaaacaaacaaacaaacaaacaaacaaaaaagaaccuaguuauaaccacugugccacugugugcauucaugcaugcaccucucucucccucucucucucucucucucucucucucucucucucucucucucacucuguguguguguguguguguauacacaagcaugugaguauguggaggacaccgguucucuccuuccacaaugugaguccugaagauugaaaacucuucauucaggcuugguggcaaaugccuuucccagcuggcccuucucucacccccuccaccuuucucuuuugaggcagggucucucccugugaccugggaucacugacuaggcuggccagcaagccccagacucaaccugucucuauccucacaacauuggauuacacaugugucaccaagccccacuuucuucaagggcucuccgacugaacucagaggcucaaacuugcguggcaagcacuuuaccacccgagccaucuucccagccccguguucaucaggaguuccuuccacaucagcagcagucugagaaccaaagccaaggaucauaaauagagguugggaguguagcucugggaaggaguguuugcaagcuugagauguugcauuccauccuuagcgcaagauaaacuaaauaaaugcuguggaaauagucauccacgggagguuuuaagcagaagagaaggaaugagucacagauacaugcaaaaauauggcugagccucagcaauggaagacugagagagagcaguuagaauuuacaugugguagcuauggcacuccuucauaaagcugaaugaguauuuuguagaugcauaccacugcgcauaugauucuaaacacuaaccccucaaacaaagcagugcaugggaggaaacucagugaguaaggugcccgccugcacagcauggggaccugagcucagauccccagaacucucugcaaagcaagccaaccaaccacaggaaguggcagcgugugcugcaaccccagaggagaggauacagagaugggaaaauuccugaagccuaccggccagccagucuaugaacuaugaguucagugagagaccucuugcaaagaggaaagauggagagcaacugagaagacacucgaggcugaccucugacuuccacauguguacauacacaugugcacacacacacacacacaugcacacaaccacacacacacuaacaaauauacacacaccauacacauacauacauggaugcacacauguaagcauacauacaaauauauauauacauacauagaaaaaauggauaagaagccaugcacaugguaucuaccuauaagcauacaauauuaucacuaauaacaauaaagacuacucaucuggccguggaggugcaugccuuuaaucccagcaugugaggacagcguauagauaaauauauauuaaugguguaagagcuggaugucaugccacacaccugcaaucccaacacuggagaggugucagcaggaggagcaggagcuccagaucagccucugcuacauaaugagucugagcucaaccagggcuacaugagacacugucucaaaaacuagggcuagcucagcagcucacaguuguaaaacuaauuuaaacccuuuuuuuccccccaaaagacuugggaguuuuagagagccuggauuuuuuuuuuuuuuuuuuuugauuuuucgagacaggguuucucugugcagcccuggcuguccuggaacucacucuguagaccaggcuggccucgaacucagaaauccaccugccucugccucccaagugcugggauuaaaggcgugugccaccaugccccucugagccuggauauuuuuaaagagaucacuuuuaaaguguuugaauuuguaaggcuguggggccuuguaaguuuguaaauuguuuggcauugugaugucuucauuaauguggaaucucagggacaggaaaggccguugcuuaacagugacacuuuuguguguugaguugacaaggggccagcagugcuggcuagcuuuaugucaacuugacacaagcaggagucauaagaggaggggagaaaugcuucuauaggcaaaccuguaggauauuuucuuaauuggugauugauaugagaaggcccagcccauugugggcggggccaucccugggcuggugggccuagguucugugagaaagcaggcugagcaaguccugaggaacaagccggucagcagcauccuuccauggccucugcaucagcuccugccuccaaguuccugcccugugugaguuccuguccugacuuccuucagagaacagcaaagugggaaguguuaccugaauaaacccuuuccuccccaaauuccuuggguccugguguuucauuacauaauaaccauaguaacccuaacuaaugcaugaauuuauccaugcauuguccauaacucaguuguggagcaaugggaagaaugcuuggagauagguuggccauuaaccuauccauagagucccugguccauaaggaaacagugaagagacccucagcauguguaugcacugugccaagcagacacaagaaaagccugcacucauccuggcucagagaggcccaauccuagauuauuaauccuaggaauuaauaaccaauccuaggaguuaaaaaccacguuguucucacuguuucugaggcucaguacagacaccacacagaucccaagccaggucacuaaaucccacacuccaccugcccagcacaaggcuugcccuaaauacuuagcagccauuuugacccagagaggcaguguggaaagagacugguaagugcgaggaggccuagauuuagucuggucucucuuuucggggaccauuucucucccugggcuuugcugucccaucuguaccugaagggggcaggagcagugagccaccaaagccacucuguuguuaagaggucaccaacaagcaggaggccacucaccucugcagucacccggcagguccuguccaucugucauccaucugggucaaaagccacacaugugcuccagguccuacccgucuuucugacaucaccccuagcuccacccucccgaccucugggccaauuucucuucccugacauuuuaucuuuuccccucccuuuugcuuuguuucauuucugagguauuuuaagguagggucacauggaaccucugaggauggccuugaacgucugaucuucuggcugccaccuugaaaugcccagauuauaggccugugucccuaugccugggcuauucuccucuuaugauuuaggguuugcucuugaccuccuagaacacucuuuguacaggucuuugugugagcuccuucuugcucacucuccaggucaagggccgccaccuccagaaccuaccccuaacuccccaccaguuccagagucccuagcgcagggaauccuuuagucguuaauaagcccgucuccuccgccccuauugauuauaaacuguuaccuucucuucugucuuuucccaggugauggggcucaaacagagucaggcauuacuguggcuccuaaaccagacuuauaggguaaaagccaccuucccugggggcccuuucugcuuauacugccacaggccaguuagguggccucucuuguguuuccuccauccaaagcucugguuuuguguagguugccggaccuggucagcuccccugagaugggaacugccacauuugcuggcaaugaacuugcaggcacugggcuagagacaagucuguggauguagcucaccugguagaggacuugccuaaaauguacaagggccuaugucccaucugcugcgcugaauaaaccagguguggguggcggacaccugugagcccaggggggaagaggaggcaggaggaucaggaauucaaggucacggucaacuacagcaugaguuugaggccagucuauguuagacauuucgucucaaaaaauaaaacuaggaacuggagagauggcucauugguuaagagcacugacugcucuucuggaggaccuggguucaauucccagcacucacgugguggcccacaacugcuguaauuccaguuccaggggaguccagcauccuuuucuggcuucugugggaccagacauacaugugguacacagacacccaugcaggcaaaacacucacgcauauaaaauaauacaauaaaauguaaaaauuaauaaguaauauauauaaaaauaaauguuuguugcuuggcuaaaugaagguccucuuacagucuccuccucccuaccuccugauucuucucccuucuuuccauucacaggugccagaauacuggcacccacugaggggccguugaaaugucacgcagcaggaauuucucggaacaagugugucuugcuuccuccaccuaccagagaggcacuccagauggagagggacaaagcccuaccuagcagggcuaccucugucccaggcacccucugggcuuaggcuuccacagccacuggaacagacauuuccccuggaguguacccggggcagcuggaaugugccacaggacacagaggcuggcaaaggucuucacugugagcccugcuuggccaagagccaccgagaagcacuugguuauucggaugggguagcugcccagggggaaagggugcccuucccccaccgcagggaagcagggcagccaguccugcacagccugagaacccauagcgggaggaggaaauuggagagcaaaacucuugcauaagucacugcagggagauucccugagcccaggaaaacucuggaagcaggagacagaaacucggcagaaucaggcccaaagccagaacccugacuggaggcugggccagucccgccacucagacuccugaguggccucuuccugacccagagacaccaggauugcccuaccgggucugcacccuccccaccagaagccccaggggacagauaaacucugccugucagcucugggcuagggggugguucagugacuccuugggguauuguguagucuaauccuggggcuugcucaacuccugucccccuuaggucuggcuccugaagaagcaacagguucaagaaagcaggcauauggcccacagagauuuugccaggggcucugagugagcccagcccagaaucuggagccagguugcuaccauucaauuuuggauuaacauuucuggaacaacauggccucggggggguugggggggauaucccuuccuuucccauguuccuucaccuuugaagagagggauucuaggaccuacuucuuggagauauuugaagcuaccgagaaagcacagacaagcccucuuggcaggcugcaccguauggggcuuuagugaaugacagcucucaggagucacagcauuaauaaacagauuagggagagccagauugggagcucugcaccaaacauucccaagggagauguaguaucucuuccccaaagucaagcccagacugauacaaauuaacccaggaaccagagcagaaagaguucaaacuguaaguucaaaucccagcaccaccacuggcuagcccugcagcccugggcauuucaggguuccugugugacacaccuugcagggcuacccacccaucuugagacuaucagaccuuccuucccccagcuuaaagacaagacagugcugugcacugucagcccuggguggugccggggaaccuacaagcuggcacauugcauugggucugccccauacggggagaggugacaggucaguugucuucuguaacaaucucucuggacccagccuccaagaauauaagggaggggccucacggaaucgaggguacugucccccuuccuucccgauguauuuauuacacagagcccugacucugcucuuacccggaccuaccugccugagggcagcccagugaggugccaggaagccagcaggaagcucccagaauccuccagaugccauagccuaauagcugugguacacacccagaccuaccagucaccugccauugacugaccaaguccccacaagugagcaaaaauagugacggcaacaggagcccuccucccaggagaggcaaugagggggucacuaaguuacuacaccuaccauacaucagagcggcugugacaguaugucaggaccucuguccuuucucuucucacagcguuccugguuugcagauggucucccucugccagcuucuacccaggcuaccacugcagcuuguuccgaugauggucacaagaucuaccuugugcucuucucuggacugggcauguguucucuuggaggaguuacagggccuggggcagcuggagugcacaccucacacccucacgcucugauauuugaacucuugaaucugggguggggcucugcauuaagggaccugaaaagcgagagggcuccuauauuguguuccuuggagcacacacagccuugggggauaguccagauggccagucuuuguacucgauaccuacugccugaccuggagaauacguacucaauuucucugagcucugguuacaagaaauaaaugaauaacucuccguuaauaggcuuagaacaaagcuggguuccagaucuaccauaauuuaaacaaacaugcacagaugaauacaucaguuauuccucugcagaccuaugauggaguuaaucgguaugugagacccgagaccaaaagucacacaaggucacuuaaaaaauuaaucucuguaaaaucuuauucuucaaauauuuauucauccaauaaguauguaaugaaguaccuaccaugcacgagggaacagguacagguggguucagcaaaugaucccugggacugacugucuaucuaucuaucuaucuaucuaucuaucuaucuaucuaucuaucuaucuaucuaucuauugaucuaccuaucaucuaucuauugaucuaucugucugucuaucuaucuaucuaucgaucuaccuaucauguaucaucuaucucucuaucuaccuaccuaccuaucaucuauuugucaucuaucuaucuaucuaucuaucuaucuaucuaucuaucuaucuaucuaucuaucgaucuaucuaucuaucgaucuaccuaucaucuaucaucuaucuaucuaccuaccuaccuaucaucuaucugucaucuaucuaucuaucuaucuaucuaucuaucuaucuauugaucugucuaucuaucgaucuaccuaucaucuaucuauugaucaaucuauuaucuaucuaucuaucuaucuuugguuugucaaaccacucuugcuuugucuccugggcuugccuaaacucuuuaucuuccugucucuaagucccaauggacaggccagggcuauggagagcuuaugucauggacggagcaaggaaggccacaguggagugagaagggcggccagguugaagccaggaguggcucagguuguaaauggaagucuucacagguccuuaggcugcagagcuggcaggcuaugggaagccugccagggguguggccuggaaguucgaggcccucgcucuuguuaguguucucuauggggcccugaccuccaaaagcucacacuuaagccaggcacccgugugagaacagaucuuacccaccaggcucgagagcucugaccaaggucuagccuaauauugaagaggccauagccccagaagagcacccugcagggagccugggcagggaaggacagagcaaaacgcuggggucugagaaggccuuuggcugggcuccugacuuaaaguugaggguggcuuuaacaaucacucugaucucgaacaaguugcccugcucucugagccucgguuuccccuccugcuaaaugaagacauuacuuucaggcaugaccaaccguuugacacuguaauaagacauugucaucuaaaaaauucacacucgaaaggcccauaauuacuuuuuuuuuuuaacugcaaaauguuccauaacuuugggccacauucuuagcuguccccagcuauucaccaugagcaaucuauggcuguagacugaacaugucuguaaggcccaguauggugggugguauaccuuuaauuccagcacucaagaggcagagacagaugaaucucugugaguucaaguccagccugaucuacauagcaaguuccagaucaaccagagauacauagugagacccugucucaaaaacaaaauagaagaggaagaggaagaggaagaggaggagggagaggaggagaagggggaggaaaaggaggaggaggaagaggagggggagaaauggcuuuaaaauuugaugguaagccgggcguggugucgcauaccuuuaaucccagcacucgagaggcagaggcaggaggauuucugaguucgaggccagccuggucuacagagugaguuccaggacagccagggcuauacagagaaacccugucucgaaaaaccaaaaaaacuugaugguaaaagccugggaaggcaggcuaaggauguuaaaguggcaaauucaucuugugugguggacugaaauaaaccgggcauucauccaggaaacaggaaacaggaaacagggaacaggaaacaggaaacaggaaacaggaaacagggaacagggcaggcccaaccccacucaaguuaaaucaacacuccuguaccccaaccccaccccaggcggaaagaauaagcaggcacucccugugugaucccuggcccaccaaacucccucucugagccucagugguccccuugugaauccacagagaggcccgcacugagcuguggcuuuauaaugaagcacaugcucagaacacaugaggucuuggauucaggcacggcaccucauuggugacacuggugacccaggaagccugacugucccaggacugccugggaagcaagcuggagucuuaagcaaugcaguuccccugagccguuuuuuuuuuuuuuuuuuuuuuuuuuuuuuuuuuuuuuuuuuuggcuaaagcccugggcuguucuuauaauuaacugcauggauguauauaaacaaggcuagcagaggggcuccuggaugagacacacaguagguguucgucucuguuacuauuauuguuacuacuguugauguuauuagggaggggagggcaaccuucagcucuuuccaggaaagugugaaacagacucuucuuuaccccucuuacuuaaaccaaagcaguugccaggcccacaaaccagaaagccucuuuaggcuaagugugggguccugcuguggccccauaaaaggucuuacaccauaccaaaagccaguucaggccagugaaugucauaguugguucuuccugcacucugacugaggggcaccaugacauuugaaccagugccaccuggcccugccccgccuggcccugcccugcuucuacgacaucacuaaauuaaucugguucuggguuguccuuuccucucaagugccaguucucuuuuagugacucauggcuaucuggcguacuaugcuguagcggaaggaacuucagcaggauacagagcauugguugauaaaugaugucugacacaggugcagagcaggggcagggcagcaugcgugucagcuuugugucaccaaggagcuaggagaguccuaaggccccaucucauuugcaugaaugauguuuuucaggaaagacacuagaaaccgagacaaccaagacaagaggacaaagccagaguugcugauccaugcccucuggguacuaagggugauuccucugagaacugcaauggucugcuggaccaggaagggguguggccaggcugagagucauuugucuaggagagcagaugcugaugcauaaguaauucccccguggugcuugguccccuccuuuuggggaccccaacccuauguugcaaaucccagaggcagaugguucaacugaaaauauguacagagacguugucugcagacugacauccaaacaucaaagcuccaaucaguccgcuagucugauggggcaugagaccuaagcacagcggugcccacacuuuggaacuaugugacuuucagaaaguuacauaccaacucugagacaaaagagcaaguuagauacaauaaagacacugaagguaauuguuccagcuucuagcccagaauauaguccuuacaauuagguauagggauggaucaaagcacaaauaauauuauuuacaagaaauaaggucugagagaagggcuugaacaagcugcaagaaggaacgcuugauagccaugcucaccagaaacugagcuacugaacuuaguggauucuacauaaauaagccacuggcucuuccgggaaggcaguuuauaccacucauggcucagggaaggaagcaacuugaauggguagguugccuuucccacuucucagugaagggaaucugggccucaguauccagaacugucacaggaccacacacaugugucaucagcguuagagacaauggacuaggggaaugagggcguguguuaacucagggacucacauuucuuugagcuaaguuccaacacuaugagacaggcacucacguauugccugggcaggccuugaauuuauccuccugccucagcuccugaguaacugggauuauaggcugacagcaggccauuuuucuuuuuuguuucuuuccuuccucccuucucuuuuccuuccuuccuuccuuccuuccuuccuuccuuccuuccuucguuccuuccuuccuuccuuccuuccuuccuuccuucguuccuuccuuccuuccuuccuuccuuuuuccuucagauucacauaauccagguuggccccaaacuuaagacauagcuaaggaugacccugaacuucugugugcugggcucaccaugccaccacgcccgguugacauagcauuggggaugucucuguaccugguaguagauaggcacaauguagcaaugagcaugccuagaagcaaggagccugggagagggagcaggacuccaaacacaccgaugaaacagccuugacuuagcaccaaagguguguuaguccuaagcagacgucaggccagccauuguggcuaggcuggaaggagaugagcuuggccaacgcagccagcagggugaggggaguccaagggaaagagucucuucugaggacgcaucugugcgugcuacugacaaaggaagcggcugcuaggguagaacucagccgcuggggcaggccgagcaagaaugagugucuggguccuauucccugcccugcaaaugaaauaaaauaaauccacuggguagaucuuuacaaaggucgcauuuaggguucuccaaauaaaagcaauuugcucuggcccuugcagacucacuucuaaaggucaguaugaaacacuggcagaccucugcccaacagccuacugaccaccagacgaaggacagaacgucacucuuccaaccagacauccgagaggaugaggaccaggcucaaaccuaagcccaggugagguugacggaauuacaguacuuggcaggcugaggcaggaagauugccaacagcauggggccacuguaagacucugucagaaccagaaaaauaacaaaagcuugggguuacagaugaguaaggggcuggggggcucacgacagggucucucuggucuuucuacacagaaacuaccuuccagacccuuccacaaccgggacagggcgcugccugaagaucacaaccucugagccucuucagcagcaaggggagagaauggggaggguaugccugggagcugggagcucaggguggaucgaagcaugaucuuauacaguguuaugucaaucucugccagugcaaggcacaggggccugauagaacacucaggaaucgaggucccccaaguucacuuugugucccccaaacagcuuauucauguagacguagaggcucaugccugguuguacccugagagccucacauuucuccaccagggcccacagcaucgaugcuacccuccagcucacacagugauucuuuuuuuuuuuuuuuuuuuuuuuuuuuuuuuguaccagcaaagugauaaagaugagagcuguggccguagguccugcuugugacauggacaugaggugaggugacagacaccauggcagucccuucucccugggcugcucaggcuccagagcguagguaugucuugggcaggcccagaggacaaaaugucuacagguagauauugaugucccauuccccacacugcuggagccccuagauucuccugaagcaggaagagguuucccaccuagccagugucuuucagagaugcaucuaggccauagaagcagacuagcuggggugggggguggggaauguauccaugcuuccaucccaccccagcccccugcaggcuggccccagccauccauagucauucaaauaugaugccuuuccacugugccccuaaacuacaaacacagaggcagcuggcugugcuugggaggcaagugggccgugcaaggaugggagcgccaggggaaccagagcggcugccucucagcucccaccauuuggccaggcaggggcguggcucuguagagccuacaucuucugaucuuucaagagaagccagaaaccaguguuuuuguguaaaacgaaaccacccgggguuuaacaacaccagcgacuaaauugaagcuuuuaacucaguguagaugccaagucuccugccccugcccaccccacccuccccagccccccuccuaggcuuugggcucuccacacucaguaggccagaggugagggaccucaguuagauccauuccaauuucaggaaaucccauccucucuccucuucaggcaucuugguuuacagauggggaaacugaggcuggagagaagagguaacuuguccaagcucacacagguaauucaucaagacagaucuuucccaccacccacagaguggguacagcuuuucaaacaaaggccaaggauguggcucaguugguacagugcuugcccaauacgcaugaagcgcuugcuucuacucucagcucauaaaacaugccuggagguacacaccuagacuuccugaacuugggagguugaaggcaggaggaucaaaaaauucagggccgggcuggugagauggcucaguggguaagaguacccgacugcucuuccaaagguccggaguucaaaucccagcaaccacaugguggcucacaaccaucuguaacaagaucugacgcccucuucuagugugucugaagacagcuacaguguacuuacauauaauaaauaaauaaaucuuuuaaaaaaaaauucagggccauccuuugcuacauagcaaguuucaagccagccugggcuacauaagauccuguuucaaauagauuaauuaauuaauuaauuaauuaauaguaaauuaacaacauacuauggaaguaacacacuaacacaagucauggcacuugugugcgcacaugagcgcgugcgugcgugccuguguguguguguguguguguguguguguguguguguguguguguguguguguguguguguaagagccaggaggcugagccuaaacagcuauaugccucugggcaagcuguuuucccucucugggccucaaagauaccaauggacacagccagggucugagccuggccagucuucaauucuaggcaucucugaggucuccucuucagccagcaguuuguggccucugaugacuauaaagcaauaauaauaauacugggugagcaaguccacaccagccaggaaagaacaccacaguuuuuagagaaacccgacucuugguuacuggaauucaaaaggggcaaugguaauaacauggggggggguguaguuuaaccaccauccuccaguuaaacaaaaacacaucugcuuuaacuucaucuucucccccagccucuacccucagcucaaauuuuaccccuucauuggagacguuaaaucaaaugcaaacaauugauuucaugccacagcgaggcugggguuugaagcauggaaaacuuuaggccuggguuuuuuucugggagcaauuacaaaauguugguggagagggggaaugagaaggcagauaaauauagagagagagcacucuggcauguucuuuggacauggagcaucaauaaugaugcuggagacgauuaugagcugucauucaagagagggaaggcauuuuguuuccugucacagagcugacaauuggaaccaaagcacuggcuguccuggaacucacucuguagaccaggcuggccucaaacucaaagauccgccugccucugccucccaagugcugagauuaaaggcgugcaccaccacugccugguuuaaguuacuaacucuuuaacaauccauguagguggagccuaauguucauagacugcuugugaucuugcuggcccucugcaacugguauccauguuuauuaccccacaucacagaugaggaaacagaagagaggaaagaagcuugucuggggggggucacacagcaggacagauaauaaauugucaaucuacugccucccacucuauucugaagguuagaacagcuacagaaauaugaggggggggugacaaaauaacaaacauaccacacagcccagcccuggugugccaaugucgaugggcuguugugcuccgaagcucagucagcauuccuguggccacguggagaauucugagcccaaguucucagcccagucugcuccgcuacccacaaggcucuccucaagcuccaggguuuuuguguuaauagcccagucagauagacuucgcgcugagaacuucaaacucuaccccuggauuccacauccuggauucacccccaucucuccugccccgaagccugaagcccagauaugcucuggcagggacaucacugaaccuaucacagaaccuaaacuuguagguacuugggcccagccccagaugcccaaguggcuuguagaugucccagggcaggucacugucccuucaagagguuucuucauaugcaagaaaggauaacaucuccugucugugcaggauagaacaggaaaggaccuggugcugggcuuugugggcaaugagguagagguggguggcaggagauuccugggcuauucccagccgggagcuccaggcuccccucccaggcuguguccgggagggaggaggacacccaagugacaguaaggaaggcugagugcuuccucccuguccagcccaucaaggaaugggcagagccugggcaaaggugguugacaggaucgcaggguucagaggcagugacauaacccuguacacacugaugcaaucucugcugagacuggagcuagggacagccacugcuuucuaaaguaugugaacccgcuaaacauguugcaggcuguacagcaugcuccccaccaauagggucuacagaccaaagacuuccagcuccuguacgcccucaaggagaaucccgagccaccgugagagcagagcuguggccagaucacacaguuucaccccaucuuguuaguacuauguacuggcugcucacugugacaacagugugacaucuugaucccuuuuuugggggaacuacgucaucuucauucuaccaugugacacucaaauuuucaaagccugaaaagaauuuauuaugccaauguucgccucaaugaguuggguggggggaaggggucguuauuuacuguucccuucucagcaccucgaucagaguuuagcgcacaacugaugccugguaaguauguguggaucgaagacacucacugucuggccuaucgggucuuuugauucacuguagucuuaacauauagaugggaccaucacugacauggcugcgaaccagcccagaccugucucacuccaccaguaggcuucugagaagcuguguucuccccuaagggaaccagagacgguucaggaauuggaaaaggaggcagagacaggagacggccagggagugggagaggaaagagcugacuggggagaccagagaggcuuggagggugaagggcauacugggggggggcucuccuuaaucuccugggcuguggagaaugggcaacaggguucaaugccuaaugucauugccuacauugucuaaaacucucugucccuauuuguagucugucaggugucagagcaguccuuauccagcauuuaauaaacaguugcccuaauucucaaccagacugagaaucugaggcugccugagggggggucuuugaauucuucuuggagccaaacguucuuucaggccugagaauaaucccucuguuauauguauguguguguguguguguguguguguguguguguguguguguguguguguguguguguaugauuuugagaccuaaucuuccuagaguguuagaguggccucgaacucacagagauccucagccuccagacugccagcaucucuccagaguugccgcgccagcuuuccuuuuuaaucaggauucacaggcauaccccagaguccuuugcaagucuuccuuccucaggcccauuacgcguugaaaaggauuaccauggacaaugugggaguaagaaugagguuuuuuuccuccgucuuggguccugccgcugugacugugccuuuaacccuuucuuacccgcgcugggcaaggcagcagccccacucucaccugcacacagccuggaaccguucacaggcuccuuccguuuccugggcucccccacucucagacagacacuagcacgcggucuccgaucucucccgccaaagaucgcagcacgugccuucuuccugcugcuccccaacuacuuuagacaccaacgggacagagugccaagggaccacgaagggcgcagcuguggacuacggaggcgcgugggcaccgggagcaggugcuuagcacgagggugagguccuggguagcggcucagcgggcgccacguccaucauccugccaggccacaagagaugcgcgcggaguccggagcgggaggucguggguccccagggagccugaccuuccacguguccccaccguggcugggacagucacugcgggaccggcggagcgcgcgcgugggagucgcgcaagccacgggcgcagcaugcuuuccuuaccugcaggcacucguggggagggucuguuccggcucgcgagcggcagcccuaaggagcgcaguggcgggagcguacucuggcggccaccucccccgccugcuuaugaaggcggccuggccgagcacccgccggccuc

SEQ ID NO: 12332 - RNA, 17923 nt, Mus musculus
ggagaaaccggaagcggccuuccacucguuggcgcuuaggcggcuagcgguccucagggugagaggccggcuucccaccgcgguguucgacgggaugccggaggggaagggguggggcugacgucaggagccaaaauggcggcgacggucggggucuccuugaagcgcggcuucccggcugccguucucggcagagucggccugcaggugagcccgggagccgugguucaguggggagccgugcccgucaccgaggcugccuggguagagaggccgcggagaggcggaaggagcccggguccaggccucgggggaggacuuaacccggcauccugcucuugagcauccuuucagacagccauuccgcgcuucuccaucaccggagagagaggcgcggccgggaggagguuggaagagagaacagaaagacagaggucugggaggaggacagggagaggucaaggucauaggaugagcgaccuguggucgggacccagaaucaaauccugcuaguuguacuccgccaggcuugugugaaagggaggccugcggggugucuggggugggacccgggaggccaggucgcaccuccagguuaggcuggucuggaucggucaggucggagggcgguggacucugcaaggcaaugcacuugacccgcagaggaagggagacaugaaagaaagcgaccccgaccccuugaaagauccguacuguggaagucugcaggcaagacccgguucccugaagcgugcuuauucagggguguguagcggcacugaucucauaccgcuggcaugggaugacaggcagagccuggagcugcuuuuguuaauaauucuguaguagcucugucauaggucuccccacacgcccuguauccucgggagcugcacaguagaagcauuuagaaaggcgagaaaaacugccucuccuuacuuuacagauaccauucaguccuccucugggcuucuggauaguccuucacaggcggacaacaggaacucccauuuuguuuugggggguuuuguugguuuuuuuuuuuuuuuuuuuuagauuuguguguguguguaugagugugugcuuucauguauaugcaccaugugcccguggagaaaagagagcuguauuuccugaacuggagucacaggugguuaucagccgccauaugcgugcagggaacugaacucugcuccuuccaaagugcuaagaugaaucuccacccugugauaauuuuaguguuguuuugguuagguuuugacuuuucggacagugucuuuaugcaacccuggcuggccuggaacucagagauucuccggcuucagccuucugggugcugggauuaaaggugugagccaccaccaccacccgacuugugcaucccuuugcaugcacaccuaucacaccagcacuccaaaggcugaugcagcaagaucaggaguuuaaggacauccucagccccacacggaauccaaggccaaccugggcuacuugggacccugucucaacaaaaacagacagugccuuaccagagccucaggcuggugucccagauauucaguuaaugauucuguuuuuguuguugagaauguuaugcaugaguacuguauuuaaauaauuuccacccccucucuccucccaugccuccccucccuuucacacucaugacuucuuuaauuaucauugcuaaauauauacauacacaaucucuuaagugcauuuaguguuccuuaugcaugacgaguuuagggcugagaacaugggaugaauaaucacaacaccaguccgugccaaggggaaugggagaaauuucacaaggccccaccccuaguugaagagcugcagcaaucaguggcuaacaaagggggugugucgguuugggggaggagccacaugauagguuguccaguuaaugguucuuggugaccuuguucuucagccucuuuccucguugcugaggcagcaguugaguuguaagagcccugcuguaaggggugacuucucaggcucaggcugggcuuucugaguguagaagaggcuggcuucaaaggucggacucugguaggauuucaggagaggccuuugccuacuuuccagaggccuccugucugugggaaugcauauuugugcucaaacagcgccauccucaguucugguucucaguccugugaugugcaccucuggacugcaguccugccugugggaguuuagcugcacucgguuaacuaccaguagcauccuuauuucuccgucuggacuaugaacuccaggagggcagacgccuggaaugcccgccugcagucagaacaauacaaauacauauauaagccaguguugaaaagcacagaucggggcuggagagauggcucagagguuaagagcacugacugcuuuuccgaagguccuaaguucaaaucccaacaaccacaugguggcucacaaccaucuuuaaagagaucggaugcccucuucuggugugucugaagacagcuacaguguacuuagauauaauaauaaguaaaucuuuaaaaaaaaaaaaaagaaagaaaagcacagaucauuuccugagcugugccagcaguuuggcuugcuccuugugaaguagguaucggcuccacccuccccuuugcaaaggggaaagugggaccagacuggcuaagcgauucucuaaagaaaacacagcucaaagguaacagggcuggauuggaagcaaacacacuaacacacuucagauacaagcuugccccuugagucuguguggguuuggcuucaugcugccuuugccuuccugccuucgcccaccuucccucuugguggcugugucaucugucuagcuucaggcccaccccugaagaagcuagaggaaguucgucuccucgcagauugucuagagauguucuucccacauagcacgcucacuagagucauagauugagcugcagauguguucagucuccacucccauggggaacuuggcacauaaguugcuggacaaggagggagggaaagaaggaagucucacacuuuggcccaucucccugucugcacagucuuuuuuuuuuuuuaaagcaaaaguuuauuaggaaaaacuccgagagccaaggagaugacucugugcauguuggucaggccugaugaccagagccccgcccccagagcccacaugaaggcagaaggagggacccuacugcaaaguguucuucugcccuccacacgagcgcauccucaccucugacaucaugcacacaaucggaauaaauaugguuuuguuucaaacaaaaguuuuaauauagauuuaggcacacacauuaggggagaggacaaaaacugcgaggggacacaggcuucucaugggguuacucauauuccccuuccuaauacugggcagcacugagguuccugugagcugcuguucugcaucuaaugucagugugcacgaugcuacacagcauccauuagggaagaaucgcaauacggaugcauguggucguaauuaccuggagaguccagaagagggcgcaggaugugucuguauuauccccagcaccugcauaaaccaggcauuguaggccaucccugcugacccagcaugggggugcagaggcaggaggauggggcuucauggccaucggcucagggucauuguccccggcugucugacucacauggcagagacuugguuuugcugagaugcaguggaacacagcagaacuuguuuguucccuaauuugauuuguguucagacauucuucaucuuguuuucuucaccagguuuccucagugugagcuuucacuggguuugggaggagugcuuucuuuugaaaugcauggucuuagccuccucuggccucaacugcaugauccugccuucaccucccaaguguuuuucgagaguccugugccaguuugaaaauguuaccauguuggguuuuugguuugguuugguuugguuuugguuuugguuuugguuuuuagacaagguuucucuguguagcccuggcuguccuggaacuugcucuguagaucaagcuggccucaaacucaagagauccacuugccucugucucccaagugcugggauuaaaaggaugcaccaccacccuagcugucauguugggauucuuuacaaauacuuaaugcugggcaguggugguacauacuuuuaaucccagcacuugggaggcagaagcagguggauuucugaguucgaggccagccuggucuacagagugaauuccaggacagccagggcuauacagagaaacccugucucgaaaaaccaaaaaaaaaacaaaaaaaacaaaaaacuuuauucuguuuguaugaugagggaaguagcccaugccacuguguggauagucaguccugucugucuguccaucuuaccuggcuucuggggauggaacucgaguuuuuaggccaccauagcaaucacuugacccucugagccaucucacuggccauagcauccuguuuuaaaagcccaaguagcuuucugacugguuucuucagaucucauguaauaagucucccuuuuaagugucauuauuucacguacauacauaauacaauguugucaccaccuugguuuaaagucguauaggccagucguguggcacacaccuguaaucucagcauuuaaaaggcugagggagaaagauugaaaaguuugcguccagccuggacugcaugugagacccuguaucaacugauguuucauugugcuccaugacucucaggacaaaaggaacccaccgcagugcucucgcccucacgucagccuccccauccuagcagccucacuccugccuuuccuccugccuacuaacacucugcucaucgggcuccaguuaaacccuaggcagggcagccaugaccccagcucaccuccucaggaucccuccaugcacuuugucacgcaggucccaccucacuguaggucaccacagauaaguucuguggagcgaagguucugucugugucagaaaugaagcucgguguggugucacuacagugcagugucacugccccuggacccauagcugccauaucaugggggauuaacaucuguuggguguugaugaccgugccuuccaaggaagcuggauaccagcguguuugugcccagaagugccaucaucaugcuugauaagugggggagugccuugcaguuuuuaaucaaucaaucucucucucccucccucccuuuuuguggcuuuuucaaguuucaggccugucgaggggcacagacagcugcugcugcagcucccagaaucaaaaaauuugccauuuaccgaugggacccagacaagacuggagauaaaccucgaaugcagacguacgagguggaucugaauaaguaagugucugggccagccaggcgcuggcgaaggagagcuugggaggguuugcugggcucucaguuaggucugguuucugccauuauuugcggugcuagggauuguggugccuguggggucaugccuuucaggucuugagagauguaaaauccgauucccuuaaugauugagauaaucacauguuuucugucuuuagagucaguuagaugucucucaauaacuagcuugcgugagcgcgcucgcacgugcgcucgcgcucucgcucucucucucucucucucucucucucucucucucuccagucuuuuguaguccaggcuuaucuugaacucacuauguagcugaggaagaccuugcauuucuaaucuuccucucuaugccuccccaauucugggguuacuggcauggcucgugugagcugccauaccugguguaugaggugcugagguugagccuguagcuucgugcaccuuguaugaguacuagcuagcuguuuuauuaaggaaaaaauuaaaaauauugccagauaauuagaugacaaaaauuuugcaacucaaacucaguaagaugggcagugguggcguacaguuuuaaacgcaaugcuugggagacagaggugggcagacuucugugagcuugaggccagccuggucuuugugagcuccagaacagccagggcugcgcggcaaaacugucucaaaaaacaagcaaacaaaacagcagaagcccaccuuggcaauauguggcuaaaguuauaaaauuuaaaaaauauauaaagccguuaaagaauuagcuuuaauauaaauguaagcagugaauuaaucugacagcuguauuucuuuacuuuaugcucuuccccauuagccacacagagaaaccaguguaauucaagcuacaccucaauagcugagcaguuaacugaucuaccuuggccuccuaugcuaauccggcucccucccagccccgcccugugacaccugcauaguauuacugaccuggcucuucgggcuccaggaguguuuucagggccucucuaaaccccuuccuuauggcucaaauccuccauucuccuugaagauccgaaucccccccaccuccccccccucuuacucccucucccucccucccuuccuccuccuucccuaccccccaugugaggauugauccagauaugagggccgagaacucagcauuugaauagcacaaggguaaacuuuaugcaguguagauaaacaucuugccuuccugaggccuuccuguucccucuugguaaugauagagauggcuuuccucagugugaccccagggagugugggaugacuguuggcacuggagagagccuggccuugagaacagggacucggcgagcgggcugcaugguucuccgugaggucaggcccuaaccucauagcagcagaaagauugaaacucugggaagcagagcacaugacgagcauggggccugagccaucucuccagccugagucaggacacacuccaguuuuagauuacccuggaacacaagaagaaacggccuaaaccuggcggugguggcacacgccuuuaaucccagcacucgggaggcaggggcaggcggauuucugaguucaaggccagccuggucuacaaagugaguuccaggacagccagggcuacacagagaaacccugucucaaaaaaaaaaaaaacaaaaaaacaaaaaaaaaaaaacaaaaaaagaagaagaaacggcuuaaaaccagucaucuaagacuuuaccuuaaggaggugggaaggagguuggagauacagcucagucugaguggggcuuagccuacaggaggccccagcgccacagaaacagaaugaagucagagccaggcacagcugcgugcgcccggcaucccagcugcugaguccaagguagagccggcaggugugaggccagccuagcagagcacgaggccuuguuuaaaugaagucaacgaggcuuaagacacagcucaauaguacaguaguaccaguuggccagccuuguguaaggcccuggguucaagccccaguauuuaaaggggagaaaaaaccaaaaacaaaaaacaaagaggaaaagaauagaagaauagcaaagcaaauccaaagaaaacauaauaaaguuaacagaaaaggccagaaaugaggauacacagcacagcaggggugacuucugcuguaggauuuaggaagccagcagccuguguaauagcaagucaaagccagcccaagcugucaucagaccuugucuuaaaagaaaggaaggaaagaaggaagaaaagaaagagaaagagagugggugcugggaugaggcuugcuuaguacacaugagcccuuggcucuuaguucuagcacuacaguaaaacagcaagauaaaaaucccacuaccggugcaggagagauggcucagugguuaagagcacugacugcucuuccaaagcuccugaguucaaaucccagcaacuacaugguggcucacacccaugagaucugacgcccucuucuggugugucugaagacagcuacaguguauuuacauauaguaauaacaauaacaauaauaauauccuacuaccaagcagaggauaucacuccagaccuuauaaaguuagauuauuguaagugacuguacugagacuuucagcuucagcaaguuugaugaagugagcuaaguccuuaaaaacuacaacucacagugacucuguguaagauuccugccagcaccgggacacucgucguaucuggacuacggcacuuuguacuauuacugugugggugguuuguuuuaagaccuaauuuuaguuguguguuugugugugugugugugugugugugugugugugugugugugugugugcguguguguguaccugugugcaugccugccuuugcauaagugcugcagggcagagagccuuagcuccagcacagcugagucuugggggcugggacugaacucagguccucugugagaacagcaugugcuccuaacugcucauccaucucuauugcaguuuauucucuuuuauuguauuuaucauauuuccuguuacuauuguguacuauuuguuuuuaacuuccaaaucagaaggauccuaaauucaaggccagccuagaugacauaguaagacaccauuucaaaaaaagcagaacaagccgggcaugguggugcacugcuuuaaucccagcacucaggaggcagaggcaggugaauuucugaguucgaggccagccuggucuacagagugaguuccaggacagccagggcuauacagagaaacccugucucaaaaaacaaaacaaaacaaaacaaaacaaaacagaauguuuaaaaaaaaaagcaggacagacaagcaggcugaagaauggaugcguggugaagcgugagcuuugcaagugugaggaccuaaguuuggagcccagcauucaugagaaaagccaggcagugcugcuugcuccuguaaucgcagcucuagaggagaggagcagacaugggaggguccaggucugggggugacuggcuaucaacccagcuaaaaaacagcagcuccaggcucaguggaagacccuaucucaagggaauaaaacugagcaauacaggaagaccuggacagccuccucuggcauccacaugcaugccuguguaugugugaagcggguaguuuuugcuacccugcuuuaagcuccugucagaccgcgcugccagcccugcccagguuuccucagauccgaggauaacacacauacacacauacgcacacacacaggcacacacacaaacuuauuuacaaccugccuucuuggcucaguugcugagugcuucuaaucucccucagccagggugcccuucccaauauucuuagcucagcacccuaaaucugcccucagcuuuaguugcuaccccaggcccagucgggcccauuccaccauagaucucacaugacugguggccuuuucuuucucagaagcauggcgaaaauccauuucccucugugugucuucucgccuccuccucuuuccuucugccuggcaauuggcccuuggcaucuuuauugauagauuaagaaccaauuggggaacaagaccuuagcaucaaaacuacccccuucauaugugcaccugcauauauacauaggccugcacuacacacacacacacaggguaggugguggugcacaccuucagucucggcacucaagaggcagaggcaggcgaagcucuugaauucgaggccaucuugguguacagagugaguucuaggacaaccagggcuguuauauagaaaaaccguaucuggaaaaaaaagagaacccacacaaggaauaaauacauacaacugugcaguagaugaaccuuaagcacgucaaaauaaaacuguaggaaagaaaucuggugcugauaggagaguaaaugggccccgcauccagguacccugacugcuguacaguggugaagccagaugcuggccauaauagaacugaguucuuuucuccaucaggugcggaccuaugguguuggaugcuuuaaucaagaucaagaaugaaguggauucuacuuuaaccuuccgaagaucuuguagagaaggugagcggggcuuucuuuaucaccagaccgagacuugguucagacuccagugaggugcggcucccacugaugggagcaccccgagagcugcaacccugcaagcugaccuuuacugagacuaguacagcguuagggauugaaggaaaggaaggagggagggauacacagacacgaaggaagcuuggagcagguaggccaugcuugcucugauggagggcagcagcuccacaacccagaaccucagguuguuuguuacacacagcacagggaugagguuagcucguguagguaggcgagggcucuguggggaguggucucagauggcagucaucugagaagcagcuguguccgcuacacugcucagucacucauaagcacuuagaccaaaggaagcuuagccagccugcgccucaccuggaggaaggccuugccauuuccacagguauaagacauugugguccuuggcacagccacacacccacucagcaccccuccacuccccacacccugcuguacaucaccucuuuguucguggauguggcuuccaaaguuugaacugugaugcaaguucugauuuccccuggggagcuuugucucgagguuccuggucccguggugucugucagucaccacgagccuggcaggcuagcuggcaucugcagugagcucuuuguuuaguggagguggaaguuucuggcugaggcgcucgugcugggcugcugagccggugagaagacaacgcccuucucuggggcugggugugcacuuagucugucugagaacgcggagaguguggagcauggccguuuccggcaacucagugugaggcuuaaggccagagcauuguccacaucuaggucuggacgacauaucgagaccaugccuuaaaagaaagaaagaaagaaaggaaggaaggaaggaaggaaggaaggaaggaaggaaggaaggaaggaaggaaggaaggaaggaaggcaggcaggccaggcaguggcgugcacaccuucugucccagcacucaggaggcagagggagggggagcucugagcuugaagccagccugcucugcaagagugaguuccaggacagccaggaccacacagaaauccuaucucagagagacagagagacagaagaaaaauaauugcuagugauaauacaacaaagguaauauuuuaaaauaggauuuuaaguaaaaaucaaaauaauuuaauaauaauacuuaaaacaaaaaacuuaaaaggcucugaaacccaaaggcucuuguggcuguggagucugucugucaggcagagcuguugugugagguaggugggugacuguguggauuuaguguguagggggugggccugcugaguuaggggacucugcaaggacauguagugagcuggaaaccagaagucaggcacagaggcagucuccgugucugcucagccgcccauagccuucgcauccugggauuaagcaaagacggaaggagcuagccaggccuucgggggacagguuguagcuuagaggguggagggcuuccugguucaaggugaggucuaggcaggaaagaaagcggagagaagguacauccucuguuagcgcagcuacugaugugagcaguguggcccggagggacagauggggagccucaggucacccgcugucuccccaggcaucuguggcucuugcgccaugaacaucaacggaggcaauacucuggcgugcacacgcaggaucgacacggaccucagcaaagucuccaaaaucuacccucuuccacauauguaugugaucaaggaucuagucccugugagugugcggcucucccaucuguggcaggggugguguccugcugugcuguuuggagugggcuaggccuggguggccacagcuucuuugguggacgugauggaacagucagacacuccgauguuuauggcaagggguuuccagaguccacagaggcauuaggaaccccuucccagauccacacagugaggcgugugcgacauaacaggugaugugcauggagauccugaggcucagauggcacguuugcuugggcauaggacuuagaauuucagagucaggaaggauuuagccauagcugcaaaguauuuguguggaaucuugggggggugggggugggcagggaggcuugacucucucaguuccucccucugcugccucgggcgccugcccugacuugaggcagcaggagaaaggaccgcagguaccaugacuucagcugguguggagauuucccagcucuguggcuaacacugaccguguucccuuccagaacugucauuugucacagccucugaagaguuugguuucugucugucguggugggaaagugcacgguuggaugugaggugauaggaagccagcauccgaaggcccugccaggaucugaucccucuccuuucucucuccuuucuuucccucaggauuugaguaacuucuacgcacaauacaaauccauugagccuuaucugaagaagaaggaugagucccaggagggcaagcaacaguaucugcaguccaucgaggaccgggagaagcuggucauuacuuaaaccuauugucaugguuggcagggugcuuucuggaaguaagagggugggggagcaguagagugacacagaacacuaaucgugcucugaaagaaauuggggaguaucugacccgaggggcagugaguugccaggcugugggcggggcuggugugcucaagacccugaguccauccccaguacuggagagggaaggacaaagagcagcuggcccgagguuggacacccucccucaccaucggguggccagcgauuaccugugaaggcccaaguggaccaaggagcaggcacagccaagugcugcccucagggcaggcguugccguguggcagaagagagcaguaucuaagaugccugcucugucgaggcugauggccaccaccaagcuguucucucucgggggaggggagguuaauaacacacacaugcccgcgcacaggcacacccucacgcacucacucaugcaugcaugcauguaugugaauggcacgugcuggccauucagucucagcaccaccacuucagacagagggcaggaggcuggagguugucuguggcggugguggggggcgggcaggacugaaguagagccuugccgucugcuccuaagcuugcugagucugacugaugcuggccuucuggaguugcugcucuugagucagagcuacaucacaagcugacccugcugccucccccucccaugugccccaucuaguaucugcacugcuggggcuccaucccagggcccugugucuguacaauaagacugugccaacugagcccguccccagcccugggcugugacaccuugaguggaggguuuagcauccagcuuuccacugccguuccuccccgagaaguccucucugaugggcaagcacaccgacucagcgaguggcugagugggccgagccuucuggcccuggauauuuugccagugucagggcaugagugcuucauggaucucuuaucuuuaaagucacagaaagcauacugguccauccucacugauggucagugagagugagcguucucacgaggacaucacugcccuucgccauuucuaccucccagucuuacacauuccaacccacacuggacacagcaagggagccucgccuugagguggcuuuauuaagaagugaaggccucugaauucccaauaauaaagguuuucucauauaaauaccuacaugggaaccaggcauagugauucaugccuguaauucuagcacuuggagucugagccaggaggauucucaugaguucaaggccagccugaacuacauaguaaguuccaggucagcccaggcugcagaguaucacaaacaaauacgcgcgcacacacauauauacauaccaacaugaagccagagcuguaacucggugguagaggccuugccuggcuugcacaggcccagaacccuaucaccagcaccacaugaaacauggccauaaguaacagacauuuguguagcauuuguuuguuuucuuaauauguuacauggaacaaauaauugaauauaguaugaacuacuuuuaauuuuuuuccauuucucugugugugugugcaugcgcacaagggcacaggcgugcgcgauguauagcugagggugaaaucucagacuugcagucugaguuugcuguugauccacuugcgcugcaucagguuuuugccacaugugcuaugaagccauccugcuacuguugcauaaugccaguauggcugaccucuuaccacaaacccagucaaggcagucagccucugccuccagcgagucuucagcuguagugugggcuguccugucuccaucggcuguccuuguccaucccucuggguggcugcuuguugccagaaucaggaaguccaacuuuugggucacagagaagacuugaggaaccaaguugaccccuccuuccucccuggaguucaagggucaguguaugagacauggaagguagcuuagggugcuccugaggccccaagggaaacuugaggacugcccagcucgacagacacuagacagacuaccagagagcuucagugccccucacugcagccugcacccccgcugggaacuccuuguucauggcucuuagguccgugggggugguuagagauucuugaaucuacgugcauuguuguuggacuuaaggcccuggucucugguccagaagagguuucucuugcauuacaaggucuuuuuuaugacucuauuacacugccacaaauaacccuuggcaugucaccaagaaagcacacagauaggcgacccucugcugugcacuggcaccuggucucugaccaccuuucucuccacacaggacgggcuguacgagugcauccugugugccugcugcagcaccagcugccccagcuacugguggaacggagacaaguaccuggggccugcaguucucaugcaggugcggcacuccccaccucaaacagccagagguccuagaagaugguggccugcuagaggcagcuaccugcagaaggcugcuggccugcgccagacaccggggacaccagcucacugggcucacguagcucagcgaaucugaagcuucaccuuccuguaccuuuguaguggggagggagggucaccccaaagggagggacccagugugagcuggaucccuguguggaugggagaagcuucgggaagcugggcugggggcugcuuagaaagaagcauuguuguuauuaccugucacauguguacaacucagggcaaaaaacccuguccauucccagggagcugcuuuucggauauguggucagugcuuuucagacaguguuaggcaacucaagauaacuugauguuucuaacuuuccgguaaaagggaagucacuggcuaugugaccguacaguagugucgaccuugccgugugcaagcaggugugcucacacacggugcuugcuuuccaacaucugaguuguugagaaccacacaggucucagugacacagcuggggccaauccagggcccugugguaaacuagugugaguuugcugcucucagggcauguguugauugacagaaaguagacaaacugucuaugacggcaucauagcucauuaaccuguaagcccuugcacuuggggaggaggggguggaaguaggaagauuaugaguucaggccaggcguugcugcagaccuagccuuaaaaugacaagccaggcccugucacuuaagcacucaggaguuagagggaggcagaucucugcguuccaggccagcuaggacuguccagugagaccccgucuuaacagcaucuauuuagucagcgcagguccuagcacggcagcacaggcugaaaggagggaaaggcguuugcacacacagcccaccuuuccuaauuagagccuggagggacaugaaaggugcugacgcccagucaguaccuuaaacaccgaggugccaagcacaggguggaucaaaggcucauggacaccugggguuaggaaagagcuaggagccuucccacaaggcaagaacuccagagcaauggcaggcuucugcccugcugagccugccugggcggccccuggcucagcugacacgcccugcuuucccaggccuaucgcuggaugaucgacuccagagacgacuucacagaggaacgccuggccaagcugcaggaccccuucucugucuaccgcugccacaccaucaugaacugcacacagaccugccccaagguauggcagggguggccgggccacucgagauggaugccugauguuucaguugggguuuggaauggcucucucagucacagacuccaccaggucccaagaggggcaggccuuaccuguggguccauagagauggaaggggcaagaugucuccaggacccaacgcuguggggggcagguggcucugggaggcagggucccucagcuggugucacagcucuggcuacugauguccuucauccaguguggcaggcaggcaucugcucugcagagcuaccuuggacucaggccaugggccucccugguccccacccucucauuucuuuuguugcuguguuguccuguuugagacaaugucucuauauagccauugcuguccaggaacucacucuguagaccagucuggccuugaauugagccugccucugccuccuaagcacugcgacuaaaggcguccauauaauuaauugggggaaaacucugcuacagugcaccaccaccgcccggcacccacuccugagagagaacucuugggccauuuguggguuggcugcuuucugaucuggugccagcuguggaugugucagccuuggucaagaacuaugagggcacccugacugcccuucagucagggacugggcagcaagauaggaagcgauaggguagccacuuagcaggauaaagagacuuccagcaugucuuggagaccuuugcuagaagggcccagccuccagcaucagggcaggcuagggcugcacgggagaggguggcucugcccugugaaggcagccaugcagcacacagguguacuaugucugccccaccuuucccgugccacaccccucucuaccuuuucaccuuguguaccuuggagaucaauggcucuguguugacaugugaagagccugcccugucuugggucauuuucucuuuaauacuuuaguuucugaguuacucuucuaaagugagaggcccucccucccccaaccucagauaagucaguccugccuggcacccgucauuuccuuccccgcuuuugcaaggcuggcccugacuagaugcuuaucgguccugcaaacaagcgugguuuuuugguuuuuuugguuuuucaagacaggguuucucuuuauagcccuggcuauccuggaacucacuuuguagaccacgcuggccucgaacucagaaauccgccugccucugccuccugagugcugggauuaaaggugugcaccaccacgcccggcuccagggcuguuucuuacauugcuuuugagaguauguagucucugccgucucugauuuacucucagcaguaauggcaggcaucuggcgaauccugaccuuggcuuguguuccuagaggaagcaccaugcuggguguccugagcaguuaggggcugccuaccaugggucaucgugggauaggccuggggcuggggcugcacaccacccuccugggaaggggcuuugcugccgcuguucccucccaccaugccugguacugaagcucucucucccuccccuccagggucugaauccggggaaagcgauugcggaaaucaagaagaugauggcgaccuacaaggagaagcgagcauuggcuuaacccaguccgugcugagugugccugucaacucuggugucaaacagcuggagucucccuaaguacagcauauguaauaaacauuuaagauaa

SEQ ID NO: 12333 - RNA, 105319 nt, Mus musculus
uucacaaucgcucagcacuuuuauuguucacugucuucacauggcagaauacugaaucuucuucacugggacggaaauccgcuagcuugggaagaccgccacugaccaggaaacaccucgucugacaaaacuuucucuuuguuuuccugacaaucugggaaguguugaagggugacccagcacaguuugcacaugcaaagagagggagggagggagggagggagggagggagagagagagagagagagagagagagagagagagagagagagagagagagagagagagagagagaaucccccacgagcccagcaacauuuuccaaguuugacugaaagcaguuugcuaaggcuuuggguucgugcgguuuuucccggcugcagggcguggcugggauacagugcacgcgaccagcuguaggacagacugugucagugggguuggcgacagccaugaguccaugcuuucgaggacuaacugcagggugcguagaaggagaaaauuccaguugaagaaauaaaagaggggcacgccagagucuggcuggguggguaaaucggaaaacugugacacuggacguugauggauguuuuccugcccaugugagggucuccagggacccuuuuuccuggaccagucaguccccuuacugcagccagucaacugauuaauuaaauaacacauguuauaaaacuuuaaaaauggggcauuuacagcaggguccauaaauacgugcuuuuaaaagugucuacauacauaucuacagaguugcaauaucaaccauaguagcccugaaaaagacagccccucucuugugugacaacucucccaaguucuguccucccacuuugacagguagggaccagaucggagcugaggaaacauuaccaaaaucgucucaggcauccuccgccccaaaggcacaaaacccaaggaccucagugagcaagguccguguuucugccgggcuccaacuguccaccacagcagaggucagaggucagcccugcccuccccuggcaagcgguuuuauggcaucugaaaaucacccguucaaauccuccugguuuuuguuuguuugaacccauccauauacuuuuuauuucccuuuuuauuauuuuuuuuccuuugcuucacuuugcagcuaacuugcaagggucagaugcuaaugguguagugggucccaccaugggagacaaagaagggcacaggagagucacaucuccaccccagcgucccuagacacugcuucuacuaaaugagagaccaggucugagaacggccgcggaggcugcauccugagcgcgugggcuccgggguucccaguggagacuucagagcaguggacuccugaaccucaaaggaggaaaugacuugaaagcuggcagcuccaguugcuuagggagaaaagggggugggguuuccuagugcuagggccaaggcucaggcucagcccugauggaucuauaugcuauuugcuauugauucccagagacagugugaggaaaaggucggugggggcgguggggagggguggcaugaggggcagcuugaccucugaaaggucauccuuagcuaggaccccuccccaccccucggggccagaucaaagucccagcgauggcaaacgcacagcucaagaagcacgaagcagggccaaggaacucuuuuaaaaaauugcauagaaggagacgccccucccgggcaggauggcugcaccacagagcacgguucugggccauguccaaggaucauccagaggaugacaugaagguccugcuccugaggcugggaccacacacaugcaccagcacacacauacaugcacacaugcgcucuccucucucucucucucucucucucucucucucucucucucucucugauccucucucaugcucacucucucacucucacaacugggagaggucagugcucucugcagggcagacugcuggucccuuuggcuucacugauuccaggucacuucaggugcugaggagagacaaaaagaaaaugacaaugucagccaguacucgcugaacuuccgaugugaucuaugcguuacauuaagcaguuucuuaaaguaugauggacauauggauaaaagccccacuggauaucuuugaggcauauguccagcaucagaugaagaugcagaaugugaccccaacccauccugaaccaucccccucaggaugccuccccaugcacagcaucacuuuagacggcuugcccuugccugucucccugacuuccuuccuuccauccuggccuccugccucccacacucuagccgcgcacccucaccacugagcaacauccucaaugccucuuuacuuuauuuugagacacuuucacaaugugguccaaggggacuucaaacucugaaauccuccugcaucagcuuccuacgugucuggaacuauaucuugcaccaccaagccuagcucauuuuuaaaaacuuagacaacacauugggcaccuaaggcucugugcuucaguuuugcaugucugugaaguucugggcaugcaguuauagcucugucugucugaauaugcuguguuucuguccaucugaccauguggguguagcuuugucuacaugcugcucuauaauauguggaaacaugccacaucugucugucugucugucugucugucugccccacugcugacgcacaacucagauguuuccggugggucagugaugcuccuggcguggcaccacuggaacuuccugugugggucuagaagccauggaugauguaccugugccaaggugaugcuggcagaggcacugcuaagcccaaaggagccaggaggucaguuuugguggccacuaauggcugguucucccugugagccagcguuugccccuugcuucccucaacgguucacacagccucugcggcagacagcgcagacgcucaugcaucaugaaggaaacaggcucagagaggacuaacuuuuccugagaucacaggacguuuagguccuucucuccuacacgcacaugggcagcucucccucccugggcauagucaccuaugguucaccuccauccaugccagaacucagaggaccagaguucugaugcacguccuacccauccaauucccucuugaaacaggagggugcggaccugcgugcuaucaucuugagcugagauucuaugucucagauguccaaaccuuucuguaccugugucugguagguucuacaaugaauugugucucccugaaagcccugcguuguagucaaaucccucagugugaaggagcaugaccuuguagagaugauuagggcccaucaugugcggacaugguaagaaacaagauacugucuacaauccagaaagaguguccucaccagaaccgacuguagcaauccugaagguuguccucugaccucuacauacacgugugcauacacacaaugcuuuggaauauuagauuuguuauuuguuauuuccuuacguguauacgaggcacgcuggugacuacuacccucccuugaccucccuugucuccucccacccacccccccuuuucgagccccucucccacuaaguuccuuuuuagucuuccugaguuguuuugagacccauugaguguaaccagggcugucugugugauuguggguuugaaccucuccacuagagacaucuaguggagcucaccaguggguacucaacugacggcacuagcuccccauuucccagagucucccaguggccaucgcuucagcagugggaauacaagggccgugcaaccucccuuccaugguugaggguuggcaggccuggugugggcaagcauaugcacugaucucaucgcuggaccaguuguauuacacaauguuaaaagaagucucuuauugccugagucuguuugggaugccauagcaaaaauaucauccaaugggcaacaucaacacagaaugguuuggcauucuccccucuggaggccgcaaguccaccuuuacacauacggaaguugagacuuggagaaauugacuuguagcccuacagccaguaaauggugaagcuaggguuugaacccuggugguccagaaucuucuugcuaagcuauaaaacucaugccugcagaaggccccgugcuagccuggagggugcuugacacaccaucucucccgcuuacucacucacccaagauguaccuggaccccacccucggacccaagagccaggagauggugccagggcgccucugucuccuaccuguuaaggagcagacaaagugccuacucuuugaagaagggucccuggaacugaguugcugcugcagccuugaccuuucugcauugucuggugauauaaggggcuguugaugaggcgcaucgcgaugccaggcggaggcuguagcuguauggaaagaagagcgcaggucaucagcagcaaccaguuugggccucuggcaucacugaaggggcggggauaucuuugccgcccauaucucccaggcccacgcaagguggcacuuccugcauguucgugccacguaccuggaggggugacagaacuuccuaauggaaaugucaguccagggcccuuuguguuuuacuuuuaaagaaguguuggaagagagaugaucccacccacuucuuuuggcacacagacugcuugugcccagcugggcucccaccuccucugggaaggcugcccucuuugccuccugugagugcaccccacgccucauccccacucuggcuccccauuuccgucucuggcaucccaaacugcuauugugggacacaggagcugcucuccuccuggggcacuaagagcucaaggucauggcuccuuagcugcugcugcaccauuggcuuagcaugacaagagccagaauggcuguaugugccuguaaccccagcagcccaggaggcugaggcaggagaauggugagauuggagcuagccugacucauacuauugacugugcuucauauagaccagcucucuucuucauacaagcgacugacucagacucauauuauccugaauugacagaagggaaaauggaggcacaaagagcccaggagccaucaucaugggaagcagcauuauuuaaccagggcaugugcuugucagugucugguaguauuuggguugucacacuggaggugugugugugugugugugugugugugugugugugugugucuguuacacacacauacauacacauacugcauauguuaagcaaugcucaggaaguuaugaaacaccccacuaugcacaaggcagcaaacagcuauacagccagagucuaacacaguagcacccgccccuuagcaacaagggaucuucuccaggacacuccauccccagugggcgcuugaaacuacugagcccaguacugaaacaguccugagcucaguacacagcaugguuacacauacaagcuguaguaaaguuugacuuagaaaucaaaugaagccaggccugguggcucaugcuuguaaccccagcacauagaagcugaggcaggaggaucacaugaguuuggggucaaccugugcaacagauuccuaucagccuaggcuagaauaagaucgcugaauguucuuuuucucuuaauaucucaccgcacguucagcuucccucugagaagccuugacagcuacucucuggcaucugauaccacccuuccuugugaaucuacccaacauucaaaaucagccccuagacacagaagucuuugcaggccccaccuuccucucuaggcggccccucuucuccaggaggcagcaaacacagacauuuccacaagggggcgcacccucucccccgcccaggguuucuguccuaguguuucccagcaaccugcaggaacggcccauucugucauuaccccugggcaucuuuggcaggaagggaagacaauuucagccacacucccaaggccucugugaauuccacauccuuucucucuggauccuccaccccagcagucaaaaagagcaaaugauucuauguucauuucacagauaagaaaauggagacaugacucaaggacaggggcuuauucuuggggguggcagagcccaggucuugcgcucccugacugugguggacaccaggucaccaccuaggugacugucaugaagucugggguuaagacucaacugugagauagacuccuuccugccuugggagguugagugcccacagcaacucuggaccgaguugguccccuguuuaaccuaaggauuauaugaguuccugagccccacugcaggugaugaccaccucaagauccuggagguaagcuuggggggcugaggucugaaccuagggcugaccccaagccugacauuucucagcuaagucucccagaggggacaucaccuggacauuugggaaaccccuugaguucagauccugaccucaacuugugacacacaucaucucuuucuuggugacugguacucucuugacauccugaaagccagacccacgggggucuuccuguccccuccucggcugcuguuggaggcuaucugguucaccuuccucccucagucccccaccguggacaccucucuccagguuuccugccauguuccuuccucauggggcuuuuccuggccacacgggccucccuccagucuguucugcagaucugugaucuuucccccaaagggcacacuagaccacgacaccccuucaccgcaccucucccucccaccacccucaggacaagccuacuuuuuuucuaaggauguacaggauccagcucuucugaccuccuagccuaccucagucgguucagggcucacugcuucagcuaacccggccggaggguuugguagaagcuggguuuggacagcuaagaaacagagccauguuuuuaagaguuccuuucaagcaucugacuucccugagauugaagcuguguugggggaugggagggcuuucucugugcuucacacgcacuggcucugcgcaaggggggugcaccacccguagcuugcacaagguaccuuccagaagcugcacuucaggaaacaaaguccauaggccgcacacgccaugcagccuaccccagucuguacggacagacggcacagugcagagcgccuuacccacaccuggcacuuaggcaaggcucggaaaaggugagcaggcaggacacaaccauucgaccgggcagccauuucuacuuccugugugugcacucugccaggcuguucagucuaucaggacucucucccucucaagacuccccuuccuuccucuggaucuucacucagaugcuucccuguuaaagccuguauccgaccccuccgggaagaucuaucggugauuaauagcugccggaggacauggagacaugcuauacggugguguagccacugucgaggugacagugaucccguacauaguccucgcccauacuccuaucagcaacucuaaugacucccaaugaaugggucacagaagggaggggggagggggaaaaagaaggagggggaacgaggggggaggggaggaggaggagaagaaaagacgacagcuaguugggaagagaaaggggaccagugagagucagaaagggagaggagaggacaaugggagacaaacaugacuaaauuacacuauauauauguaucaaaacaucaucaugaaaccuauuauuaugcaauugugcauagcuaauaugugcaaauaacucccaccacccccagcauccaggcuucugcccuauggccuauagaggaacagcucuguguccaagggagcuggguucuagggcucaggccucaggcugccaaagggcuauguucccuuuucagcucccaggaauccgugugaaaggaacccagguaagacgguuuguacaggagaaaugggaggaaguucagaagagugaguguagggggagauggggauggagggaagugauacaggggcacagaggagcagccaggagcagccaagucucaggcuaucagcaacacaugguccccgagggaguuagucugcuuguuuguccuggugacagagccccagugguuaccaccaagccuuggggagcaagggaaaagguuaggucacaacaccugagcuuucucggggacagggaaccugagaccaaggugaaauaaagccauagcaagaacuacaaagacaacaacaacaaacaaaacccucagaagggggcuggguguggcccgguuggcagcuugcuggcagcuauggguucaaaucuaccagcacauaaaacccaacguucuggugcuggggaggcaaugagaaagccaaagucauccuaagcuacagcaggaguucgaggccaccuugggcuacaugaaacccuaucccaaaauaaauuaaguagaagauagguaacucuaucaagaagucguuuuaauaaacgacuuaaaauuggcaaaagauaccaagucacugaacaaauuucaaauauaaacacugcuaaguggcagagcaaaagaacagcacauaccaucaccuucaaaagccagaacgaagcggccuuugcaugcgaggagacacggcaaacccaagaacaaaccccagcuuccaccagaggucccgccacaacuccugaagucugcccacggcaccccucuugaagccacauucccagaccugaugcagacacagaucgcuguccagcacagcaaggggaccggaagcacagcacacacagggugucagagccuggcucccugggcucaugugugcuagacauagccacaaggcaaacgggcacccaggacuccucagcccauaaugguuaagugaucgcuauguacagaaaugaaggcaggagagaguccgagaccaugcagagggaaggcaagggccgcaaagucagaggacggcugugugugagcugccaaauguggaucucaaaacacuugguucuuacagaugcuugggcagaggcgugucuaaaacaccagagagguggaggggaggggaggagaggggaagggagggaaggggagaggaggaucuuguaggcccugggugaaaugagagcuugcuugucccugaugggacaacuguggguuuccagggccagaacugagaagaccagccaccaggcacuugaugccauccaggaaaaagugaugggggcagagggcuggccuucgugaacuccuggaggcugagcagugaaaagccccagcuuuacacaaacugggaucaugguaggagaagggcagguaacgacaggguuggacaugggugugugaagagaacaugcaguuuagcuuagcuccaaagcaggaugaguuuguccugcugcuguggggaagggacuccagggagagccaggccaguuaggagcagagccaccacacauuuagucucucagaggccaguguuaaccuugggagcugugauucccacaacugauggacacaaauguucaacagugacuucaagagaaggccgagaggaaagcacguguaggcagacacuaggucaugggagcaaagugaggaccuuggagagagcaggugacguaaagggacaggagcucuccaaggcaugaggguggcugcugggucucucuaccuggcuuucaccuggcuccucucucucucucucucucucucucucucucucucucucucucucucucucucucucucucuggcacagaugacauugggccucacacugaugccuuaccuaucucuauaaauuuguggcucaguucacugacuggcaaucaguucuggagcggagguggaggggaaggccaaaggcguggaagcuggugucaagggaagacaagccugaaaccucugcugaaauccucuguguacugagugaagaagccaccagacaccuccagcaaugccggucaccuggcauuucccauuaugggcaccugggugauccaggaggccccucucauucagagccuagcucugccucugacuugccuuggggccuccacaagauuccucaaccucucugagccacaggagacucuccugcaaaguaaguaccucaagaagaggugguggcaucgggcgugguggcgcacgcuuuuaaucccagcacuugggaggcagaagcaggcguauuucugaauucgaggccagccuggucuacaaagugagcuccaggacagccagggcuauacagagaaacccugucucaaaaaaaaaaaaaaaaaaaaaaaagaagugguagcaugacagcguuugugaccugaacacugggggucgggggagggugcuauuuuggguccuuugcaggaguucuuugaaucaccuccccugugaggcagggcgccaugauccugucuuauuggaggggaaagaagagguucaaaggaguggaggcaccagcuagcaaaguucacagggaagcagucacgauacgaauccagaaccgugugcucccaagccuauuugcaccccugacauaggcccagcagcaguagcgaugaaggguucuucaguguggggcuccucugcccuagaucugcugacagaccucaaggagcaugcuuggucugcuuugaguugucccuuuccaggcucagaggaagcugggaacagaggcuuucuaacucagaugcccugguaaugcagaaaacacccaagauagggcucagagccucagauauuuggacuuggcuccccccuccccccaauagcucagcacugggcaugagagcaggcuugaagaguuggugagcucuguacuucugcucaaaaugagguccacggaugggcagcacaguaaccauguaggugggaccuacagacgcucagaaccaacagaaaucuuagaagaaacugacgggggugggguugggggugauaugcugaagcugcgaggaccugcagcugaggacagguagguagagccagauguacaaauauuuucugaucuggguuggggcugguguccagcagcuguaaacaagucccucuaauaaugcaggaguggggaagaaaaggcagguggucccagagggccagaaaaacgcuggcccuccuggguggcccgauggcucagcagguuaaaaugcuugaauagcuuaaugggauugcugggauuuacacaaaaaccccagaaguaguggugcauaucugcaaucccagcacuccuacagggggaggagacaggagacucacuagcaaggcaacuagacacuguuguggaaauaagagcaaucuugucucaaaaugaaguggaaugcaccaugaaaugaguacaucuacacaaacacacacacaaauuuuucaaaaaaaaaagcagaaagaaaaaauucuugggccuggaugguucugagucuuaugauacuggggcaagcugcaguugacaugggcagucggcaagcacagccuaggcgccugcuuuuggggucucuuuuaguuucgucuccucuuuaacacuguaagacgcccguacccuuuugauggaggaggguuucuguuccuuuccaacaggcccacaaggaccuggccucuuucucaccuaaaaggucuuaucuauugggcucuguccuguuggggcuucuaggucaaaccuguuuggucugagcaccacuacuggcguuuuaaugucuaguguguagcaagcuccuaacacuugacccaguuaacaggaaggcuggcaggccagccaggccugaggaccucagccaaggaaguugccaguggggaaaucccugugcggacgccucccuuccagcaagcagaggaagaggccagcagugcagugugguaaggaagcugccacuggcuucuguuucaccagggcaagagcugguggaguguagggagcccuaggaacacagaaggaagcuugggagucgggagucuuaacuggauagacucuccuuucccuuccagcugaaccaaaacaaccaacugcaaaaacgccaaaggacagcuuguaucuguccauuuccuaccuauggggccaucacugcugggggcacaaaggggcgcccagaacgcgcauccuaaacaauaaggaacaaauccacauccgagcucuccaacaugcaggucccuacucccaagagucaaauucuccaagcacuugcaucccagagggguucacucacugccagaguccugcccagaacaugggucaaggugucuguuuugaacaacucugugaacacaucugaagauucagaccucucccacagaccccacccccaucccaccuagugcugccucuuacauuucagggacaucaucucugcaggaacccugcuaccgcuugagccagcacaggaaugaucccccugacuuucuccucucuacaucuacuuccagguucuuuuuuuuccuccaguugagugaaaacacaccauuugcaauaaagcugagaagagaaauaaauacacgugccaggaaugcugacugccagaaaauuaagacaaccaguguggaaaaccuaaagagggaugcucuucccuggacgguacaugggauuguucuugucagugacaacguccuuuggagaugcugaaaacaucauuaggaccugucuuuuaaagaugagcuuagccaaagaugucaaaagaggugaguuccagggccaagcagggcucaaccuucaugggguuugcuauugguaggcuucaugugaugucaguggugaagaugguuuauccuaagaacaagcccagagguaggugugcagcucacgaaggccuuacugcccccaccuccgugaagccugguguuccuggcuggcagugagucccagacacacggcuggcacugucacuggaaaggcaugcuuaccaugugaacgcauggcauuagucaaugagaauggagcugccaaaagagcagggauaucgugggaugggggccaggucccgccuucgcuucugugccuucccccaaaguccucacccugucuggcgccaaccucaacaguuuaaccugcucuacaaacuggaggagacaguguggccucaggucaccugucccacccugggcugcuucuccagcucacuggguggaggccuucuagaaaggcuccuccuggcuggggacagacaaccuggcccagcuacaugcugcuucuaacuuggggaauacacaggcuugcagccacauguaggcagguauagaauggcauucucuccauuucuucccuuaccugcccuugcuaacggcaugcugggggccuuguuccuggagauuuauucaccaagaacugugagauggguaugccagcauuucacacaggguaagcaccuugcccaaacccagacaccuggcuugaagaaccaggguugaacucaagcaguauagauucgaaaggauaggaggcagcucauuacugacccaacuucuuucccccauuuaucuaacuuguuggcacuaugugauguagccuugagccaggcucaaacacugcauacccgggaaggcagagaaggauguucuccaaggagacggauuugcucagggaccuaugcuaagccucaagaagaccaauguauaguuuaguuuugugugcucaugugcaugucaaagacagaggacagccucagguguuguucgccuuauuuuuaaagacaggaucucuccuuggccuggaagucaccaaggagucuuggcuaucuggccagggagcucuaagaagcuacccaucucugccuccucuggacuaggacauaacugaaucacacuagcuuucgggaacaauguuuucauuaaugacuacugggaagcaaacacuggcucagugguggucaagauuuacagaggcaccaagcuguaaccauuggguacaguaugcuggggugacacuaaaggcaaaugagcucaacugugucauucaguccauagcuggugucauagcaaaaagucagaguguuucuggggccuccccaccuugccagcuccugugcuucaacacuuuaggcaacagugagcauucgacacacucagugacugagaccaguuuucuucaucugcagccaucacccuuugauucugccaguugcuuuauuacagcaauucugacucaugggcgugauggagaaaucacuaaggugagugacauuaggcuguggaacaaggcuuuagagacauguucaaacacagcucagccaaguggguacagcacugugcaaaucagccaacguagauaucaacagggggcuuccuuauucuggguuuaaaacaaacaaaaaaaaaaaaucagaagacacaagagcagugucugcaauguauucuggguggcaauacuggaaaggguacccacagaugccaagugucaggacuaaaguaggagaugauccuauuugcagcucccaaacuuggaugaacauaauggaaaaccuuguaagccuauguggcuagcucaacucccuacguucagguggcuuggcugaggucacaacuuuccuguaaggcuucagguggacuguggagacagcagccaaauguacccgucucugaaugaaugaaugaaugaaugaauggugcuacgcuguucugccagcacaugcagccucugcagauuguggaucagcugucauguuuuucaaguaugaacauguguaaguacacaugaaagccagaagacaaacuugagggucauucuuagaaguguucuccauguccugugaaauagguaauucucaauggcuucuagcuugccaguuaggcuagacugaaaggccacccaccggguugaaauguaccuguuucugccucccuguaggagggucuggggauugaacucaggcacuugugcuuacaaagcaaguucuuuacccacucugcuaccucccccagaccacaccaugaggguuacagucugggguacaaacccuuagugggguuggucaucaccuggcucuacaaaguagcccuucucucucaguagauucuaauugaucauugcaacagcuccaauagucacauuuuaaccgaaacuuaguggaguuaguuuccuuagggggucuuugaaguggaguagcuuucuuuucuuucuguuaucucaccagcugcguuucuguauagcugucagggcuguggcaggugcugggauagacacaugggauaggcgggugcuacaccaagcugacccaaguaaugauucaaguuccuauuuccuucucaggaaacugcaaaaggacagacaagccagagaacccucaguucugacuuuaggacagcccuggacuuuaacacugucccugacuugccagucacuagaggguuauaaagacgaagagaaaacaugcaugaaagagccugacaacugaacucuauaccagggagagacgguaaaagcaagaggaauacagaauuagaacaugaaggaaaguaccugaagaguaauauauaucuuuuaagauggaaaggaauccguagucuggucacaacucauuugggaagccgauuucaaagucucggggguuaugguuuagcauaucuagaaccuuccauaagcuucccggggcucugggucagacacagaaugguaccauucaacacuccagcaaaacauuccccucaccuaagcaggucacuuagagcucggaaugucaccccagugagacgguggcucccagugccacuaaugggcuuuugagaauacacaugcuuaaggacagcaacagaagugauuuugcacagcaguuacuuugauccccacgacugggcucaaccugaccaccacuggagacaagcagcagcagggguuucuucagcagccccuucccuccaaaaguccuucagugaccaucgccacgagacugcucaaagcacuuccaauccacuucacauggagacaguuccugaaugucaccuggcagguacucagcgacaccacccaagauuacguuacuuugguacuugacaccaaguggguguugacagccgcuaccaggccuucccaggagccugugucaccuuuauuaacacucgaggccaccacgaguggaggccuuguccuuacugacagaaccaagggaaucuuagucguucagcuggaaccagcuccaacuccucucuacugaaacaaaaccgagcuccagacagugauguaugugucaagcuuagagcuauagaaaugauuuuaauacaacuguggcucagcacagcagcuucaucagacuuuuggggugugggguccccuuacaguaguguggaacaggauccaagugcugucaccucucccucuggguugccuguacugagaaucuacuucccccagaucccaggagaacagagagugagguuccauuauacacuuuauacaaggaaacacacuggcuacuuuugcucaacaggauuagugcauuccaggcaucaucucuaagcccaggggcacagggaugcucuccggcuccagaguaagauauagaauauagccaaauaccuggugauccacgccauguucucugacuggcaggagcuagaggccagacugaacacauccagucaguaaaugaaaacagaagccaucugaaaugccacugcuuccuagcugcgcuggcaguggcuggcccugguuauaagugagaagaggaugcuacgaccacaaaacuaaauccaagaggcuuacaugacuuuaccccagcaaggaauacugaaauaucucucagcagaaaacagcucugaaaacaauacagggauuauacccgaagguugacauacauucuugcugcucaugucugcugcaaauucuacgucuccaugacaagaauccgguuuaaaauuuacauuuagauugaugccgacucaauacauuauuaaaguagaacuccaguagauacagucaaugucuaaauacugacaggagaucccugcucggaacauaaacguacgcuucagagucccagacucuguggcucccuaccuaaaugacauuacaggucuugcuccguucgucuguccaacaccccaaagagcacuuaucacaagauccccagagaagcgguuucuuuagcaagcuuucggcucugcuuuguuggcuaaugucuucuuuaagauguuuaugucccuugugacaucugccuggauuucuuaucacuuuccuucagaggcuuucgaaggacaccaagccagcacaagugaggcagaaaacacaaguauuuucaagaccuucauggcucaaaauugaaugacuuuuggaaucacuuuaaguacucuaaugcagucacauaagcgugaccccaccccaucucuaguucucaagauuagugagaaaguaagugaagcuuacagagacccuuaaggcccuaacacucuuguuacaauacaggggagggaaaggcugguuuaguucccagcacaugacagcucacaacuguucgaagcacaggcaggcaugcacugcacauacauaaacacagguaaaacccucacaagacaaacuucaaaugaccuuuaaacauacuauaggcagaucugaguuugcacuaggagcaguuucuggggugggaggcggcucuacuggccuuccuuugggguuaacacacagcugacuaucaucuucgggcugacuucuuaagaaucacugucaaaugcaaaaggugugaugcuaacagacuugauuauaugcgaaugcacuugguuccuguugcagucaacuguugaugaagcaaaggguucccccugagaaggacaguguggugacagaccaccuagucugaagggaggacaggaggacaagggagguggggcagaacugccaccuagggcagucccucagccauaguguuccuuuaagaugacccaaggggauggcuccuagagcaacccuaauacuucuggaaaagggacgggguacagggaauggagcaccauugaguaagaaaugagcaguggccccaaggcacaacugagacuacaguuuacagcagcugaugccuucccuaaucacacagucacaaaccccagguuuuguccuauucauuauuccccuguaugacacggacugcuucuuaaacgggaucuuaaugcaacaaagaugucaucuucacccucaaucuggaucuauuauuugauacugcacagcacuguucacuuaagguccuggcagguagaccuaagucugaggaggcugugguuguccacgcuccccuaggcucugcacacacacccuagcccugugccaccaaagcauguacacccccacccccacccccgguucagaauccagaguucaagaaugacuccugcagagcucuggcucuccagacauguccugcaggauggccacgaggcaccaggagguucuagagcccagauccccaaggacugagcuacacacucaacucguguguguguguguguguguguguguguguguuggcugagggacagcucuucaagugaacugcagaagccccaggcuaggccagaaggaaugugguucucucauaauggccugcccacacauucuagcagaaaugucacugagcaugcgauaguggggcaucagggaacaaaggcuaaaggccuuucucugcaucuggaaagccaacagagaagacucuucuuggucaucaggcaaguccugagggcaccugaaagguggccugcauauucacaggacccucuucaucuagcgagguucuaauccauuuucaaaguaaacugccugcccucuauaaaguuucuuauggacaucagucaagucaaagugaagcucaauauccaaaugccgcaaguguaaaaugagcuucgaugucaguaagcauuuugacccaaguaugaacaucugcauuucugggacagcaacacucaaacauaaaaguugguuacaucuuuccugucacucgguuuugggacaauacuccaaauacuaagaauuuaguugacauuuaauuaagaggaacggccacuaggaaaaacacaggcucacagcaguuuugcuuguuuuuccgagacagggucuuaccauguacucuuucuagucucaaacacagaggucugucgucuccccacccccaccccgccuacggaaugcugggguugaugaugugcaucauggaccuuccuggggcaaucugaacucaucacuggaaaugacaugaggagccuucaaacagugaaagggacagaaggcuccaaucacugagcuuucuaauguuuagaaaauauuucauucugcauaaaggguaagagcucuggaacggagcggcuccuccagacggacauggauggcauaguuucuggggaacuauuccaauuuggcaaaugcgugugaggauccagcgccugucagagcgagggaugccauggagacagggagaagaagcacacccugcucuguacuagugugggugggaccgcaugcagacccaacagcgauccacucuuugcuuucugcguacuggaaacguaaagaucuagaaaacagcacucacccaaggcuaacccagcauacaccaggaaagcacgagggugccacgaguggaugcuaagcaggcagguggaaggggcgcugcuucucuuucucggaugaccucccagaucuggcuuccuggcggggcacugcaacgcaccugcaugcaucuagguacaaugccacaagaacuacugcugaagacauucccaauuuccauuacccuccccuccuccucaccggguuuccuggaaccucguagguagccuugugacuaucuggacacauugucaggccugcaguccccucccuagaggaaggucagacagugggcucucggaugagagaugagugucaagacuacaggaaaugccuccuagccacacaugaaaacaguccuuggaagaaaguuaacacaagcguccuugauuccugucagucugcaaacuaaacugcaggcagcacagaagcagcugagaucugagguuaacaacucccccaguccucuguacucuuucacacuccacaagguacuucuugauccagcuaaguaucuaccaucaaagaggaagcaacuacaauuagcaaaacuugguugaugccacgcagacacagguggagagaggucccaggucaacggcugacuacccgucuacauaccaaacaagguccaaguggccuguuuccccuuuauggacaaaaugcaguccuuucacaaguguuuacaaaguguuuauucguuacaaugauauagauuguaucauccaagucuccccuaguuaucagguauuuuaaauaacaugaaaaaagagcuuucuuagacaucugacaaacagaggauguguccaugcuaacagggcaaaguagcaaacaucacucuugugugucuguaauaaaaacucugucaaggcuacauugguuaaaaacaaugaacaaucccuuuuguaugucaaauuauaaauuuuaauguuuucauuagaauaaucuuuauagcacuuugcgacaagaagcaauaaaauaacuaacagcaaacuucaguacagcagacaccuuccggauuaacaaugcaaacacaaauguaagcucuaaaucacagaauacaauugaagcacccaaaacaauuuaaauaauuuuaaauauuuuauuuuuaaacugcuacaaaugcuuuauacaguauuccaacauaaagucuccugaacagaaagguaacaaaaugggaaugguagugaaagguuaaaguggcacaaauucaucacacaaguauucaacuacaaaguguaagagguagauuacuuuuaagguugaguacaaaacacaguaugaauaaaauguagccguuuuccaccaccucggucauuacucugggggaagcaucagcacucauggagaaguggugcugacccgcuacaaaaggaagaggcugaucuguugcuuugaaucuacugagacaagaguaaggccuggugugcagauaacaaacagcuauacaggccuggaugcuuuccgugcacugauacacugcuacacagcaucucguaauauaacagcuauaaauuagugccagacagugagaggguaacguccaguuggacacacaaacacuaacagaggcaugagaaggaguccuauccaaucugggauccucugcauuacgcuggcaaucugcuuaugauuuuuuuuuuuuaaaggggagagggauagggaucaacuaaaugccucucuguauaauucacaugaaagaaggcaucgagggcugguguaacgcaagcguuuugaggugggcacacccgaucugucaucccugaaacuaggaccacucauaaaacaagggcacuugcuuugcaagguucaguucaauugcucucuuagcugcucucugccagacucaagggccacacucagagcugagcugccaguccggugaugaggaagagccaguccaucuagcccaucuuauggcacccuucucuuuggauuucaauccccugagagcccagcacacacgugagcuccaccaaagagacggaugccugacacuaaccagggcaagaagccugucgguaagcagcuguauguuacagcuuuugagucagcuucaacuggucuugcaagcuggguagauuucguauccuuugccguagugcuuauccuaaguugagcaugcaauaucuuuuagucaguuaagguuuguuuugugggggggacuuuucuacaggaaguuccuagaaaauaagaaaacugaagauaaaugacaacauacacaaccuuguaugaacugaccaauuaaagaaaaaggugaggagacuguacgacaaaugucaccaagacagaaacacauaaacaacucuaauaguuagaaacuccacuccugcucccaagacacagggcaguuucccacgcacaguaugcaguggggguaggggcaccuggugguggcagugaagaaccugucuuggacuugcuucuucucuaacuucuggacacagggguagugggcaucaugaaaaauggaaacguugcuuggauagaacagcucucuuuggauuacagggaagaacauggaagagucugcucuucucucuagaaaggaaccaagccaaaggcaauagcaggaagguccaggcagacugggacagacucagggagaggcucaccggcuuuucugauggcucuuuauccuggaaugguaaaccagcuggugcuucaggaagugaccaaccggcaaccuguggagccugugcucaaugcuguucuggcuacagcuauguccuugaaaaucugcagaacccuaugcuggcuuucaagugucaagugucugauacuggacaugacuuauaaccauaguuugcugcaaucaacaggcagggaaggaacaagcuauguguucuacagagcugaggacagaacauggaagcuccaggcaugacagcuccuuccauuagucuccuuuaagccaacugagacaaccaccggagcugaggaccucugucaguaaacacuccucccuagucagcacaaaacacacaagcacugaaaaugagcucaggcuagucuguagcagcccugaguuagaggacccugguguguggaugcuaguagccaggaauccuacuguugccuauauguuugcuagggguacuaaugacugaaauacacucugcagaaauaaauacccacucucaugucuagauagucaaacacgauguucaauuggacauuugguuuuuaauuguccaaaacaacucacaaggucauaaucucuuggaaaguuaucuuggaugaugucucucauucugcagaucugucuaaaacacagggcaguaacucgccaaggaaaaggauuagucacuaggaacaacucagugucuguaacugagcacacuauucaugauuucguuaucuguagcuuuaaguggugcuuuuuaagccaacuuuuaacuccagcaauauaauucuguuaacuaucaaaauaguuuaaaauccacuggagcaagagaagagacauguuuugggacacauuuagccuuagggagucuuuaaaacaccagguaagagugaagcaagugaacuuuauacaagcacacucagcucuuacguuuucauacguuuaccccugaaaagucuacaggaucuaguacaaaacaguuaauucuuuuagaaaacacuggaagaaagcacacucuaaaucaucagucaccuacaugcuaauccaggaugguucaaaaugcuaaggugguguggaauucccuagagcagaggccaguagcagguaaggagcacuggcggcugaaagcagugcuguuccucacuacagccaacucaaccaugucgcccaagcaccuguguggcuaaauaugaccagaucgacagcaacuaacacucagaacguuucgaagugccuuccaaaagagcucaauccuucagcacuacagggaacuguugugcccaaugucuagaacuuucuuuugcuaugcuucaaggcacacagcaccaagaacuuuaccugagugacacuggaaccuugguaugcuuaggucuucucuccaaaacaagucacuccacagcugucccuaacucuguuugcuuccaauacccagaauuacagucaugacaacccagaaucaagacaggcugcauagguguccaaauauuugcagaguaaccuucugaugauggccacuaaccuguggacauuauuugggaauaagaaggaauuccaaauguauaucaacucagcuugagaagucaauauaacaggcuauccuagggccacaucacugucccugagaaccauguguauauggggagaauauggaauaaggcaguaaggucagcucagaucuaaacugagaaaccuaacauuauaggagaagcacugagccccagggccuggccugcucuucuuccccauuagaaccucaauugcuagucucucuauugcuguaggcagagggcuagaggggaauauaaggcauuuuaaagauauauggugauuuuauuuuaagcaacguggaaaaaauuuuaaauucaaacacuagcaaauggaaguauuaacauuagauauuuagacaucauuaacuaugcuuaagucacaaacuacuaaacaagagagcacugagguugcuacuggacuugucgucacccacuuaacccuaaggagcaaugcaggaccaggaaccaacacagguggccuuggaacacugcccaagauguaaauuaagagaacuucaucuuuucacacagggaacuggguucaagcuccauucagaaauuaaagaaaugguaccacuuugugagcacuaagucugaaaucauuguauuuauucaucaguacagcaucaaaguagcaaggguaugccacaagauuaugccagugccacucugcuaaaaggacagacguccuccaggccagcuacagcucuccagcaguccucaccuccccgagcucugggcuuaccucaaguccuucagcucaugccuggcacugcuguccucucuccugcuuucacucagguccgcagcagcugccagcugaaggcuucgggugauugggcccccgcuccgcucucuagauuuuacuaugaaccggucuguucuuuucuugcuggccagggcagucuugcuuuguagaacagcuuugcucuucugcaccuucacgugcaggcuucgggaugcuuugcuugagagcugaguagaaugacucuuggcaacagcuuuggauuuuuugcccucaacaugaguaaucuuagccauucuuacgggacuagaauuccucaaggaugaagagcuugcuuuuuuggacuugacugaagcugcaaacuugacauucugucuggaucugaaggaugaggagggcagcgaggcuugggcagggccuguacuccgagcucgggucuugcccaagggugccugcaugcucugcaucuugaucuccguaucugcggugcgccuccggggauugcuacuacuguuucugucacugcuggcagaugauguguggccaccuuucuuagaugaaugagaaacuuuucuuuuggaaggagaaagggguuuuuuaggacagcugaaagcagcaugcuuauucaggcugccgauguacgugaacucccugucacaguaagggcagauaugugaggacgccucggaagugucccucaggucugccuucugcuucgcagaucuguucuucugaaggaucgcuuucuguaccagcugauuuuuuuucuucaaugcauuuagcuugagcuuauuuggagacauuuugcugaguucaacauugaagcucagucucuuaggcugccccauccgucugaaggcauuuuucccagaguugucuaaaaccagcacuccauuuuugggcugcaccgucugucucagcggcacuggguuuuucuuaggaguguaccucuucuugucacuugcagaugcacacgccaagaugugcuuaugcagcucaggcauguuaucaacacucuugccacacuuugugcagcggauggcaguagugaaagucugugggauauuguggguggugaaguuuguggcuguuaccccaauccccauaggguuucgauggugguacugaaauggagguggcuuaaagcucggguaaugcugguugagaccaagucgaacaucuggcucuuucgucuuuauuccggaagccauuauuuugauggucguguaaagcucuucagaggagucauuuaacuccuccucucuagaagcuuccgcaggcucuucuggcaaacucggcauaugcuccacaugggccuugcuggggucugugaaguucuggggccucagggucccacuuucaaacucguggugugugcauaacucaucuggguggagaucacgcugaugcugcuguaaauugcauaagaaggcaaauucuuucuuacauacagaacacacaaagauauuuccgacuccaugaagcagaaaucggugcucugauagaucggucuuacccuuaaaaagcugcacacaaaacucacauuugaagggccauucuucagcauggacagacaaauguuugguuaggucuuuaauggaaagaaaaggugaugcgcacacauugcagacgaaguuucugcugaaugucucuuggacagcgcucugcccaccugcagcuggggccucuuccuugcguuucagaccuucacucucugacuccuccuguuugagaguuauugcagggagagaugcuuccagguuguccccagaggacaccacagaugacacugcugagagaggggguggugagggggaggaggaggaacaugaagaggaagagaaggaagaggaggaagaggaggaggaagaggaggaaagugucggaggaccaggggaagcagcagacaugaguggcucuacaggaggaauaggagagggagagggggacacuguuggggagagaaucggaagaggagacugagcaguggcauuugagaauggagaggggcacuguugaggagaggcaucacaagagggguuggggagagggacagucggaaggaggggaggugguggaguggcaacaguuaacacaggagggcagggcggaggggaagaaggcucuguggggaucaagagaggaggcagcugaccagaggacagggaggcugccuggagagggggugaugaagggccaacaaccucagguggagacucagcagugggggcugagcaacucgagucaguagcaaguucaggaucuggcugugugucuggugauuuacaaggacuugggcuccuggucgccucuggugugcuuucuguagguaagcuaacaccauuauauucauugagaagaaccuuuuguagcaugcaggugguugguuuuuucuucuuugcagccggcugugccaaaugguucucuuugaauuccuugccuucagaaucacaaggcuuuuuaugcacacugagauccaauacagauucccaugggacuggagucuugccugugcccucugacuucuguuugacaccgcuggauaaauccaacggcuguugguugcacacgcugcugaaaguagaacuggcugcccauucuuuugauauuuuguauucaucaaaacaaggagggcuuccaguuucucucucaucucucccagacaaacuccacgcuggugagucacuacgacuuucuaacuucgguuucuuggaagucagagcugugucuguccaugcugcuuucccaucacucuguuucccaaagucucgaagggcagggcugugcuguggagaacuggggggagagcuggugcgucucuuaaaccuacuagaagucacagcuaacauggaugcaggagcagauacacacacgggaccuaacuuaggaaucucagcuguugaaaucccugcaggaggagucaguuuguccugggucugaagaagcugcuugagcuuugaagacaaauagacacccuucucuuuauggaaagacaccaccucuguuguugauaugcucagaggcagacuuaaggaacacgagggugccguggaaucagaaucugucucugcuuuaauuuuagggaguacagguggacuggcaguccuccguuucuuagacucgcaauuugugcuacugggagacucuuuaagaagaucaucugucacagagcccugagugcucuuuauguuuugaguaaucucuacaguuacuggagugagcagacagucuaugccauacaagugugcagaguuagacuccaucucaaucacaucacaaucacuagugcuguuguuggucugaaucuuaccaucaauauaguaauuuagguucucagagauguugcuagaaauguccaugauauacacaucaucugcguccccguccuccucgggcucugugcuugguacauagacauucugggagggcggggccugcucugcagguggcugcggcucuucuaggaggccuccuuuucgccggacaccuuugggaaucagguggcguucgugaacucuacgcugaugucgucucauauuggugugaguuccaaauaccuuuuugcaguauuugcaugggugaaguucuuuaacuucaccauucucuuccacaaaagaugaauucaguauuuccugugagguuuucucugaguucaauaucaaacagucuugcccaaguugagguggacucgacucaucuuuagaaguaacauuuucccccuugccaucgucuggguccucugaggauuguaaugccaugcugggucuucucuucaacccuguuucguggcgccuuucaugccgccuccuguugaucugugugccaaaugguuucccacaguacuugcacuugaaagcgugguugauuguagaaauguggaugugcaugugacguucuagccccugcuucguugcaaauuuccuuucacaaugcugacauggaaacaugaauguuucaagccccucgccguuggccuccucucuagcccugggagcguggggaggagggguggcgccuggggagccuucagaaguuucaguuggcacacuccguggcucuuccaguaaaucuucuggcuuuucuucacaccguauuucugguucuuucacagagcuuucauucggcaugucugcuucuuccuccccaucuucucccaacuccuccuccucuucuuccucuuccagcuccuccuccuccuccuccuccucuuccuucauauuguugaccucacagucugugacuucuuguuucccaucugccccuggcugugacucgcaggcaggaagagggauggccaccuguggaacugcauccuggcuuaccaccucuggcagaagggcuggcugcucaggugcagaagccaaaggccucucauccucuucuuuuggaccuaaggagcagaagcacagagaugaagacacagcgcuugcucuguaaucaacuccuaugacucgauugcuagaagcugcuaagauaugugaacaaaauuauuucauuuggagguugagcugggugcaaaucccuuccauuaacuuaauuaacaaauguagaagacugcuaaggaccaggcaacacucuauagacacaucaugacaagcaugcccacaggguacuaagcuuuucggcuuauaaaaacuagugccuauaacuguguuggaauagccaacauuaacuaaugagccugguuacaaauuccaauuucucaugauucaaacuaucagauuagauucuugaugguguaccugaaggauggaacuuguucuagaugaugaaauccacucugcuagucaaacaaacuuccuaucucucagcagccuaaggagcaguuuacugaguaaaacagccauccccaaucacuugucuauguucaucccccugaauuagacaggccagagagggcuugcuaaugaggccacagcugaucagagacauuuaaaaaaaaaaaaaaaaaaaaaaaaaaagccaugcgggagccggaaagauggcuuaagagcacugacggcucuuccagaggucuugaguucaauucccagcaaccacaugguggcucacaaccaucuguaaugggauccgaugcccucuucugguaugugucugaggacagcugcagugugcucauauaaauaaaagaaaaauaaaucuuuuuuuuuuaaaaaaaguuaugcaaucaccugguagacaaaaugccuugggcagaggaagcagcaaauaaaauaccaugagcuaucucugagucaagaugacccuaagcagguucaaagucaggaaggcuguagagaagaguuggaaaaggccaggagaugagacuagggugagccagugcugaggauaagauaccaugagaagcugcucacugccccgagucaaagaggaguucuaacagagaagucauccagccccacugggaagaaaauggaagcccuauggggagaagggaaggaggugggcaacaagagcucacugcuccaggagaggugcagguagaaggcuagggaaguugguagaaguaaucagacccugagaacuuguauuuuggaaaugaagcugacaaaaugugcuugcugaccaggugugaugagaagccaaagaggacugcaagaaacugcaauaauccugcuuaccaaaccaaagacugcaggaggaacaggaggacuauaaacacauggggcagaaaaaaauuaacuuaagaugagcugaugggaccucauaaaauugcaaagcuucugcaaagcaaaagacaccgucaauaagacaaaaaggccaccaacagauugggaaaggaucuuuaccuaucccaaaucagauaggggacuaauauccaauauauauaaagaacucaagaagguggacuccagaaaaucaaauaaccccauuaaaaaauggggcucagagcugaacaaagaauucucaccugaggaauaccgaauggcagagaaacaccugaaauaauguucaacauccuuaaucaucagggaaaugcaaaucaaaacaacacugagauuccacuucacuccagucagaauggcuaagaucaaaaacucaggugacagcagaugcuggcgaggauguggagaaaggggaacacuccuccauuguuggugggauugcaagcuuguacaaccacucuggaaaucagucuggcgguuccucagaaaauuggacauaguacuacuggaggaucccgaaauaccucuccugggcauauauccagaagaugucccaaccaguaagaagaacacaugcuccacuauguucauagcagccuuguuuauaauagccagaagcuggaaagaacccagaugccccucaacagaggaauggauacagaaaaugugguacauuuacacaauggaauacuacucagcuauuaaaaaaaugaauuuaugaaauuccuaggcaaauggauggaccuggaggguaucauccugagugaaauaacccaaucacaaaggaacucacacaauauguacucacugauaaguguauaauagcccagaaacuuaggauacccaagauauaagauacaacuugccaaaugcaugaaauucaagaagaacgaagaccaaaguguggacacuuuacccuuucuuagaaaugggaacaaaacacccauagaaggaguuacagagacaaaauuuggagcugugacgaaaggauggaccaucuagugacugccauaugcagggauccaucccauaaucagcuuccaaaugcugacaccauugcauacacuagcaagacuucgcugaaaggacccagauauagcucucucuugugaggcuaugcuggggccuagcaaacacagaaguggaugaucacagucagcuauuggaugggucacacggccccuaauggaggagcuagagaaauuacccaaggagcuauagggaacugcaacccuauagguggaacaacaauaugaacuaaccaguacccgggagcucuugucuucagcugcauauguaucaaaagauggccuagucagccaucacugcaaagagaggcccauuggacuugcaaacuuuauaugccccaguacaggggaacgccagggccaaaaagugggaguggguggguaggggauuggggggguggguaugggggaccuuugggauagcauugaaaauguaaaugaggaaaauaccuaauaaaaagaugagcugaaauuuaaaguaugguaguaugugucucagugaggagauuuaguagaauuucguaagaucuuaggucaauacagaggcugcaguaccugccucaggagagagaguucaugaacagugaauggcacacuaccuagaaaguggacagacaaggaaggauuauaucccagacgcugagaggcuaagcaucuuucauagcuugccuuaccugggaagagggaaucucagcuggggaagagccucuauaacaccagccuauaggccugucuguggguauuuuccugauuggugguuaaugcuggaggguccagcucacuguggucccaggcuaugugaguaagguagcagacuaucagcucuaaagccagccaacacagcagggguccuccacagucacugcuucaguuccuuccucggcuucccucaauaauggaccauaacucacaacccaaauaaaccaguucuuucccaaaguugcucuuggucacuguuuuaucauagcaacagaacacaaacuagaacuuaagaaugaggaauggccaagaaacaagucacaaggaaggguaauaaacaucaaggauagagaaaaaggcaaaaggggguaaucaaaaugugggauaaagagcauccagugcgccaucugaauacagcagagucaucugggacacgaacuacgcgguagauuaagagauugagaaaaaggcuugaauacugagaccaaggagagcgugguacuguuggacaauacuccaugagacaaaggcauaaaagaguggcucaacugucaugauacaacaggcuguccacagacagggaacagugggggagaagaugcuaaagaguagccaaaugcuacagucucuacaaacacgaguuaggaacauaagcucacuuaaacacccagaccucagcccucuugcuguuuccuagaaugagggcccugccucuaccaucuguggcuacuucauuagcaguuagccucuguuucuaaauagaaaucaaaauguucucccuuggacacauuugauacuuucuaugugcuuucaauaagccaggacagcagucaauggcaguaauagcacauuucaaaugugcucuuagacacauuuucaacagacacccaacacuggacaaaaaagccaacaaaggauaacagaaauaggcuagcucaagaugucuuucuagaauuuguuuucugugauaaucugugguuuccuuaguuuuaaaagcugcucccuacaauuggugaucaaucugauuugaaacuauuucaaugguucucaaccuuccuaaugguguugacuguuuaauacauuucuucauguuauggugacuccuaaccauaaaacuauuuuauugcuacuucauaacuauacauuugcuacuguuaugaauaguaauauaaauaucugauaaaccggauaucuaacacgcgauccccagguuaagaaccacuggucuaaaguaaggaauaggagcuuaagguguacaaccuuacuaacaagccaggucccaaagcacugccuacuuucuugggcuuucagacacagggcugggagaccuccggucaucagcuacauuaggcagagcagcccuuauguugacccagugccaaacacugggcccgagcaucaaauaacuuuuucauuaugguagagggaaaaaaaaaaaaaagcccagaacucuugaguuacuaaagagaucucuuaaaauuucaagcucuauuuuuuguuguuguuguuuauuuuuugugucucaagacaugguuuguguguguguauggcccuggcuguccuggaacucgcucaguagaccagacuagccucuaucucccaagugcugggauuaaaggcgugugcuaauccgugcucaccuucaaagucuaccuuuuuaaaaaaaaaaaaaagauuuauuuauuauauguaaguacacuguagcugucuucagacaacccagaagagggcaucagaucucauuaugaaugguugugagccaccauguaguugcugagauuugaacucgggaccuucagaagagcagacgcugcucuuaaccgaugagccaucucuccagccccagagucuacuuuuaaauaaaaauuguuuugcaucuuuuuguauugcucaaacaaaugucuuaccaaauuugcugcucucaggaggcaaaaguuagaccuaagacuaagaaacauacuugucccacuuccuacaccgugucaagcacagaggaagggcggggguggaagggcggggcugcccuccuuccaguuaaauccuguuuaaaaaaaaaaaaaucacacugaccuucuaccugacucccucagccauacuaaaggccauguacacaucacucacaaugaacccauccauucuugauucucaaaagggcauaaaaccuaugauucuuuugauguuaucacaaacagggcaaauuaaauggccauaaaagguauucaaaauacugaccuccccacugcucacacacacacauacacacacacaguguguuuucguuuuuguuuuuuuuuucaagauucacaagucuauauucugaaaucugccugucugugucacaaucaacaacccaaacaagcuccugucucuguguaaauucgucuguaacaaacugaggcacacagacgucccaaauauggagacucagcuaugcugagcagaguaagguaagugauuuaacuuucaaacugcuucucuguaaaugcucacaucaugaaagaucuagaguaucaauguucagaggcaaaaauaacauacaauuuuaaaauucuggcacuaaguagaagcacuuuucauucugcuauacgguauggaaaaugucugauauuuguaaguaaauguuuaacugacgacacacacacuaauacagauaaaccacagcuguaucacagacaaauuguucccuauguaaauacagcccuguacucacugagcagguaggucagucagaaugccacacugcuacuagccuagucuuuguuuuuaaaacagucaacauaugucugcccgucuaucuagaaaaaauguguagucggucucacuauauaggccuggcuggccuuggacucagacccaccugccucugccucucucgugcagggagucacucugccuguuucccuuuaugaaaagaaccacguuuaaggggagaauacuuucauucugaagaggaaguaggguuuggaaaguucagcuuacuacaguaaacacguguguucaccaagcauggccagcacugaccuucugcagagccccucauguuugcagagguggaguccagcucgcucgccuuccgcgcugcagccuggguucugacgccuuuguuuuuauucuccugugauuucuucuucccugaaacacagcauauauuuauuuacucauucauucaugauacucugguccuugagacaauuaacccaagcaaaguagacugaauuuguagacaacuaucauuuugauuuccaaagaaaagaaugaauagugacuaaaaauaucaucaaaucugucagaaaaaaaaaacaaaaaccaacaaacaaagcucguagguccugcauuuuuagauguuugguccuuaguuucacagcauaguagcuaucaaguuaaugaacacuguauucucaaaaaguuaauaauacuaauauaaaaaacucuagaaucaaaaaaauuugaaaucauauaaauaauauggaaaauaccuauuagagagaaacaauaugucacaauuuaaaacauuuuauugguuaagauaggauaauccaggacuacaacuucaacuuugaaaguaggcauugcacugcauuauaagggauacauauggucucucucaaaugcagagaaaucacaagcauggcuccuauugaauuaauaacauggaggcacacaaaguucagaaaauacuaacuacacgcaaaugaucccaaacuauagaaaguuaaauuaaaccaugaccucucuugagaagcuacaacaaugaacugaagccccaaaggaacacaguauauugcaguaguggucccaaacuggucaccaagguuaccagauccgggugagucucacgucccuucccaagcacuuccuucucgucuggcacuauucuccucacacacaagccaccuccacuccuagagaucccuaggacaagcucccugcuuuuccugagcaagacuucugccuccuccauaaccaccuuauccaaagacaggaaagacaccacucaugacuauggaacacagagaaaucaaauucuacagagucugaauaguggaugaucaugagagaaacacgaucagcuaaaaugaagacaacggauaguuuuaaugucagaaacacaaaaaugucauaauugagaagaucauuagauuaaaaguacagaaaucaaccauaauauaaaguacuaguuuaaaggauuuugauaaaaaucuaacagacauaacaagaaaacaauuuguuagucuuuuaaggggaaguacuaauauaucauuuuaaagugcccaauuuuuuagcuaguaagaaaacaggcuugguguguucuguuuccuuugggaguguguguguguguguguguguguggggggugucaacaauauguucccaacaguauggucacauguuccuuuccacaugcaccuuaagaacauaagcacacacaugaccaaaagcucaucuacucugauaugaagcagagggcauggcaaugaaugaacgaucccaucuccagaugaagacucauccuaucugguaccacacgaggcagauagauacacaggcaccuuccacaguagcucuucacacucuccugucaacuuccuccuguuuagugugagccugguaauugcuggcucaagcuccugaaggauacguguugaacagaaucuaauucucucccuuccugucuacgucuauacccuuccugugugugugaugcucagucugaaugagauuaguaacuccaaacgaaacgcaugcuaaccacaaacaaaaacacaaaugacaaucugcugauauagugcaaccgaacggcugagugucacaaagccagcagcagaacccucagacauuccacucaaaaguagaagagagauccuuuuccccaacccccucccccaaucaaaaccacaucuuuuucuaacuaccaguacuucguguaaucaguacuaccccacauucucacacagaccaagaaacaggacccuuuacuauaacuguuuacagguuuuuaaauggaaaauuauaauuuaaacaugcccucugcaauaagcuucagauacauuaaaaauaaagcacauuguaaaauuuaauagaaacagguaucaauuuguugaccaaaauacucuggcgaguauauuauuauaauuaaacaaguaacaugaugaacuaaaaauguagcugcuuaagcaugugaaaggcaaaugcuauguuauaccauauucuguaccuuaaaacaaaacaaacacccuuacuacaacuaggccgugccacaugucccccucugaacuccucagcacaggaggaguuuacuacuccccagguauccacuguaaagccacagccaccauggaaaugcaauccauugugaggacagaucuaucaagauaggcaucaggaugaguacccaccuccugugccuuucucagaggacuaacaagaguuacaaacagagaguuaaccagccugguuucucaagcagaacacaaaugacacucuuggucacacaacugucuguuguggggauugcugauucaccagaguuuguuucacagcauacugcagagggaaagggugcucuacccaguaugugacagccucaaauugaaaacacagcaaagucuccgcggugcucucucuguggggagaucucucaaauaucagagcacuagacuaauguacuuacuauauuugagguuacuacaaacauauguggcucuacagucuacauauuuauuaaaaaucaugcuaaaaacuaaaauaacaccaauauaaaaauucuaaagaugaagaaaugaaaccaccaaaguaacuuaggaacaacaaugaauuuauguggcaaaagaaaucuagcaaaacuaucauggagcuaugacaucaaaauuuucucaaucagagccauuuaucaagauacuuuugaagcccucugacuggagaugauaggacuaccaaaaagaaccaaaaaacaaaaaacaccugucugucccaucagagugcuauuuuguggaugaaacugaaggcucagacaacaaacaaaggaacaaacacaucugugacaaagaacaaauuaaacccugcuccaacugauuugagugccugguaccacaccaguacuguuggauacauuuccuuaaacaguaaaguucuuuccagguacuugguuucggugugcuacauugaaagagcuuaaaagagaaaacaauauugucuaucaggacuuuucuaaagggaaaaggggacuuguagcuucuuagaggcaagagguaccacuggguggcuggcaaguacacaagugcacuuaccagggguuccugcaggguccuacauggcgcuacugccagcuggcugcuccacuuggucuagacaagaaagauacaggaaugaaacaugaggagagugaaauggaaaugacaaagaguagcaugagacauagcauguguagaggaagaaaugugcacauaaagaugaagaaaaaacaagacagagcaauuaucuacugcaucaagucucuuauauauccaaaaaaggccacuccuauguucuuaauugcucaaguuaagauccauguauuaggcucacugucagguuuauaccaugccuauguuauaagacaugaugcucacgcuaccuacaaaccauucuucuagaagaccuuaaaguaccaacccaugccugaaauaaagacacccacagaucagagaugagaggugucuacccaggucucacaacuauagcucuagcaccauaauuaaugaagauaauaccacucaaagugcuccuucuccugcagccaucuccucaugccucagucagcacaccccacucuuggcacccauucauaaccugguacacgaagcagauacauuaagacuucuacacacucagcauaaggaugccagucaaguuggaagggagcacucuuccauuuucauuuuaccuuauaucaaaaacuaucagucaacagcacagaucucuguuccaaacaaauaugauucagcaaggaaacaggcguuucuaaucaaacagcugccauauaaagacacucaacagcugaaauggcugcucucuagacaauggacagccuuauacugcuaguguccaaggugggaguugcaaaaucaaaauugcuuaaggcagcacauuaauaauuuaacccagaucuagacuauguucuacuauuugaauaaacuagaaaacaacaggaaauacuagagaauaauguuucacuuaaaaauguucaggcagcaaagaaaaugcaaaauuccagguuugcucaagcaacauuaaaaauucagcacaacagugaaguuccugcauacgaucguuuaagggaacuaauuuuagaaauccauagaacucuccuuguguguugccuccucacugaggaguuagccaucucuucaguaucaacagaauuagggcagcacaaaagccaggcccauggaucuuucuuuggaguucauacuguccccguccuuggauacaaacaguuaaccaggauuauugugagacucuacgcuucaccauaaaaggucacugaaggucugaguggagaccaacaguaucagcagaggccaucaaccugggcuguccacugccuccaguccucaccauucagccagaccaacuucucagcaacucaacuucuguugccaccacuccagcaaaguccauuucccguaauuaccacuaaagucauaauuucaaguucaaugucccuucuguuucuuuugucuuguauucuuccacugacaaugggguaaauaaaguaucuuccaucccuagaaucccucuuccuaaucucacagcauuaccauccacuaucuccagcuucugcaaggucuuucuuucuuccugucccucggggaaaucugacaacuggaaguaugcuucccuaguaggcuacagaaagacuuccacaaacacauagagcuaggcuaagagaggcacaaaggcucagugagcacacagaggguaauaggugugggagagcuguuuagucaaaggugagagccaacagagcaccaugaggaacuuugaagacuauuccagcuccccugaccucaaacacagcuuucaacuucacauuauugugugaacugccccaagucucagcacaucaagucaggaccauccuggaacuuugauucucauccaauucuccccuucauccuuugcguuccaagagucccguuaaugacauuuuccagguucuaauuucacucuuaaaaaaugagacacaaugaauccuucuauaucucaggcaaagugugagcaauucauuaaaucacuuaagcucauuauacacuuuuucccacauuucuguacagcaacgucggcugaugagcagcacucaggaaauauagcuaagauacaaacuuggguucugaaaaccagaugaaaaguuuaacugggaaaaagcacuaaguacuagcucggguggacuguuaaaaguaaagcuaccucugaucauguuaacaagguagaagacuagacagguaauggcgacaucaguaccuuaaguagccaguuacguuagagaguagugagcaggagggaaaacaaugucagcacugucuuccacuggaggugacugaauggucuacaguggguauagagacagcagaaaagcugggaacacuuaugaaacuaaguucuucacaaagaauuccagccaauuuucuguaucuguagacuuguaggucaccaaaagccacuggaaggagacucaggaagcugagaugacaggauugauggggcccagugucugagauguggugcccagagggcucuguaaaggucaccaaacagcacuaugucccuggaacaaggucagaaguagcucccagggaagaggcccugucagucuacccgcuuagcuugacacugcuaagaggcugggacucgcuuuucauguuauaaaaaugaaagaaacaugcuacacacgucucagaauuuuuuuuuuaacuuaacuucuaauuuaccugagaguaaaaaacugguaagcuccuucagaacaauuacaccucuuuuucuacagcuaaggucacuaagagcugccuguaaucacugaggcaaauuaucaaaauaaaaccuucaugacuuuaacuuuguuccacauauuaaacagaucucuccaacagccuccaacugccuaagcucugcagcuuugcuguguaaauuucuaaugugccugcuccuuccagggugcugcagagccuaugugagacuucaggcucccccacuuccacacaagcauacauagauagaugcuucuucuucuucuaccaaucaggauaaaggagagugcugacccuaagggugggaggaagacuaggaugaaggcuugccagaccagguuuagaacacaaggggccucugaggcccgugcucaugguugagggaaaggggcucugucauucucaacccaggcccucauuuuaccuguucccaguagauguuccauguacaaggccauacaucuuucucuuuaagaacugagcuaaaucaagggggcacacuuaaucaaaaggucuucagaaaaaauaaccugcaaacccgaauggacauacugcaccgcagcucuugggcaugaugagagaaguaagaacugaccccauucauugcaagcaaacaggaacuaccuggguacagguuggugguccagcaaucugacccugacacugagaggcaagugagaccaagcauacaaaggaagccuguuccacccuguaaacagaaucaccuguaagagcagggcagugguggcgcacgccuuugaucccagcacuugggcggcagaggcaggcagauuucugaggccagccugcucuacagagugaguugcaggacagccagggcuacacagaaaaaaaacaaaacaaaacaaaacugucuugaaaaaaacaaaagaauaaaaaauaaaaaaagaaucaucuauaaggaguacccaucagauucuacucaaaaaacucuggaauccuccgaacuuagaacucuaaguugucagccuauguucugucauaugcacccucuagcaaaugucuacgucagccguuuguguugguccuuagguuuacacugaauaggaacagagguaauuauggauaugugugagucuaaugaggcaggaaagaaaaaguauucccaauacccauaaacacucuaucagugcaggccaaugcuuuagcaguauaagauacaagugcagucuacuuuuacaaguauaagauacaaguacuaucuauucuuacggauuuuauuacucuuaacaaaucuuucaaucugcuuuucucuaucuugaacauccguuuuacauuuauuuuaaugugugcaaugugugcgugugugugcucaaguguguguggacuugagaggacaacuuucaagaguugguguucucucaccaccacgugcauccacagaugggacuaaagucaucaggcuuggagggaaacacuuuugugugcugagcugccucuuuggcccccaaccuaaguucuuuguuuuguuuuuaaauuaaacauauugagguucacauuaguaguuuuuacucuuuagagaaggacacccuggacaccuuugaaacccagguaaaaccuaaggccucucucccaaguuccuccauuacuauggaauaaacaccuuagucaugcugggcaugagcacauuuuguaguccacacuaaggucugggccuccucuuacuggaaagcggcuguaagugcacacaagcagugcccacuccacagaagcacaccuguguagucucuaacuucucagaaccgucaaaucccuuugcuccccucaaagccagauucaacaguaacuucuaagaaagugguucuucacauuugaguacaaaaaaaucugaaauguauucaguuacuuuuaagacuaaugauuucugagaaaauguauauaaauuucauucaaaaugucaaacacauaaaaccugguuaaaaggcacggcagucaggaguguugugaacuacacaggguagaccacagaagacaaaccuucauccaacaagccaacgauguucgacacauacaucaaaugccacaggucaucuggccacgcccaagcagcacaggugagcaaguuaagguaacaaguacaaccaggcagacuacaaguaggacugcagguaagacuaccucucgaguaguuaaaccuaauaguuaagucugugucucaaaagcaaaacuguccauuucuaaagagcauguuaaaaaauguugaagcuugacuuguuagaugugugcugguaaacccaagcacugacagucaguacagaauugugcugcuuccuccauuacuguggaauaagccaaggaucaggagaugcacagcgagcagcaagggaggagccauccucauucugcggcugcugcuauucugaggcaaaaguucucccuuuacauccuaggccggcucaggggccacgagcuaccacaacgugcucaucuaucuuaccccagcuuacagggacuuucacuacaaggcaagaacauggaaagcaacacuguuacuaaaacaaagagucaauuuggccuucuuuuuauuuucugguuuuucaaucuggcccuacuaauucuaaggcuaugcuauuuaugcucacugcaaacaguccauucuucacauauucaacacuugagguacagagaucugcaguaccccuaccaccacuccccacacacuucagacgccauuugaagaaguuacucauucgcaaaguauagauuuguauucaacaaggaagcagccaacagugaaucugugcaucccugcaaugugcauuucugcuuggcuuaggauaaaaaaaaauauuuaggucauuauuuuaacuuguacuuuugacaauuacccaagagauguguaagacauugucuccucaaagcuuaaccagaaacagaguaaguacauacaauuuaauacugucuacacuacauuggaaauauaugcaacuaugaauuuacuaccuuagcauacagaauagguuuuuuuaaucuucaacaguuuugaugcaauaguaacugcaaugcgacacuuagacuccaucuuaucauuaagcauucccauaaccuaaguaacaagcaaaagauauuuccuggaauaauucguguaguugcugguaaaauuccuaauggugaguacacauggcacuuugggucccuaaaaagaaaaaaaaagucaaccaacugcagcuaaugacagacuaauccuccuagaucuagaaugugugggugccauugugaacugcauaguacagccucugaaaacacaccaggagacugucccacauuggagaaaucacaagacaaacugaccgccagggccacucauacuucaaaguugucuguuuauggacagacuccacacugcccccugccugugagcacucacauccucacagcaaaggacccaaggaggaggcacagagugaagcccccauucuucuccuagacuuuggacuuuaacuuauagccagcagucacucuaucccucaggcaaaggggcucugacaaucucagauuaaaaacacuaacagcuagcagguccagaaaggcauauucuacaucucagccuggcaagaaaaugaaaacuaaaccugagaagucaguaaaaacaacaaaagacccaaagacugaaucgucguccauucucaacuguacuagaacuucaaaccgugcccauaauacuguucuuagaucuaaauacgggcaaacaaaccaguuugccuucaaccaguuugccuucauuuuuuuguggcacgugaugucaagaaaccuacaaaagacuguaccccaagaggugggauuauaaacacaggaguaaagauuaucacuauagcgugcacacucacucucucacucucucucucucucucucucucucucacacacacacacacacacacacacacacacacacacacacacacacacagagcuuaagcauauuuauucacuguguuucauuuuaaccaaugcagagacaaaccccuacuuaauuaacauaguguccauucauuaaaugugaaauuggucuugggcaagacaccauuaaacuaguaauauacauuugaaaagguccaggguaucaugugagcaaagacgccaccucauuucagaaaccagagaauuuuuauauaccacacuaauacaauaucauugcuuuaucauaaaauuucuuggcucugaaacuauauuccugucuauucaaaauaagugugauaguauacuuugaauauauaacacguaagguaaccauccauucaccggcugauaauuaaaacgucuaugaagaaguacucugaagacagaguggcaguagaguacacaucuuuaauauccacacacugggggauggaggcuggagaauuucaaguucaaggccagucugggauaacaaugagucaaaaaaaaaaaaaaacacuuuauaaauuuccagaucaugcccucuuuccuuuuugucaccgccaugccauccagacuaaggaagaccuggaaacuccggggccacaugagccacagcagcaucgguaagcacaacaagcacccaggaggccauggaaaugcucgaggagugcauuaccacagacucaacuuugacaaauaucauccagguuacuuugggaaaguuggugugaggcguuaccacaugaagaggaaccagagcuucugcccaacugucaaccuggaugaauuguggacguugggucagggagcaggcacuggucaaugcggcaaagaacaagacuggagcugcucccaucacugauguugugugaucaggcuacuacagaguucugggcagggaaagcucccugagcaacuugucaucaugaaggcuacgugccucagcagaagagcugaggagaagauuaaggguguugaggugccuguguucugguggcuuaaaagccacucugaagguuaaaugcuaacauuuuccauguggucugaguagguucuuugcacccucccuugucuacauguuuggaaucugccuaacauucuaggaagacgugaggugugggcccuugauagagucagucugugauaauaaauguagcccaacuucacacaauuguaaauuccuacaucccugugggcucuauguauggucuugauguucaaagaauugaugaaugccacuacuuucagcucggcaugaagaaaccuggucucagaaaauccugagaaccagaagcaagauggguuuuccugaaaauguaaaguucuaagaaaaaccuugccauccagaugcuagcaguugccuggcuuuguaagcuuacuguaauggacugggccacuuauuaccggacagcuuaguauggaaacuuaggggaggagguaguggcugcauccagcuucacuuucugauggcauccagguguuguuccuaggagcacgccugccugcaagaggacaucagcacagcacacugacugggacacuugacaaccaaagcuguggccuuugaacuacuggcaagaugaaacuuuauguagagaacuggaggaaauaaaacugagacccugaucgucuacaucuuuaaaucuggaacauuaaaccaaaguuaacuccugagacuuuagggagugagggagacugggcgugcuuaguacugacgcugcuuuaguagucaagugcaugcuaagaggcaucacuuaauacggaaaaaaucauuuuaggagguuuuggaggauaaaagccuucuggcucuagagcuauaguacugugugucacuccuaguacuacuagggguccagaugguguaucuguuaugggauggauaagcauguggcagucaggacaacuauagggucuguaacaugacauuuguguaaccauaguaauucucuauaugaagguuuuagacauguggcuucacuguuaucuccuaaauaaagcauauauuuaaacagguuuuuauaacaaaacacuaaaaaaauuuuccagaugguaaccagaguuggaaauaauaaacagcuacaaucacugguucaaaguuccccgaguucucucgucucccacucacauucuacuagggcuuaacaugcacuacuucugacacuguaagcaauaucacuuccucagaccuucuggagaaaauaacagaaaggaaauauuuaagacguuuagaaauugagugcaaagcuaccucugcgcugccaaucaggcacggcugccacaggaucgggggggggggggggggacacgacacacaacugaacagucucagccggaguucccagauucacguuuaucacauuguauuauuuaagcaagaaaaagauaaagacucuacagugggccaagucaggauguaaugauguagucaguaccccagcagcaugguaaaguacuucagcaugucuaagccuagaucugaguccaagguccggugcuccaaacaaacaaaacacuaugcacacagacauaagcauauaaugaauuaaaaacaauuucucauuagcaguguacacugugaucacagcaaaugggaaacuuauaaauuaaguuguucauucuuuugaguauccaaaaguaaacaguuuacaaaauacuugcagcuuacuucugcagacacguuugcugaugugggauuuguugacuacuuuguauugucucggcccugucuacuuccuggcccgcuuuacucuuacugauuaguucaaggaagaggugcugaugcgcgcagucuccuccucugcagcacacugaggccuugucacugccgcacugguucaugaacuuuaagguuuccuuaggccaaacauuaaggacccugaacaggaucuaauauaaaaauuaaaucuagaaacugauuuaguggaguucuaauucauuuuguggcuguaguagaaggaaguaaugaugguugcuucuuuccuucccugccuuaggauguagguaaguguucugguuuuucuguuuguuuugucagauuauuaauuugugaaggguagugucucgugguucauuuuggcuuuuuggaacacaaaugcacuauuuugaaguggcaucuccaaagguuugguuugcugacgaagcuggucccguccuagcugccugacucauucuguaggaaaggcaggagaguggacuuguuaggaacaguuuccccagucuggacccaggcacagcaccccuucuuccucuuuauuuucucucuuauugccuuccucuuaauggacuucucacgcaguccagacuggauuguaaauuucugaucugccuccaccuccuaagugcuuggacaauaggcaugugcuguuaggccuggcugaacuaacugcaaagguaacugaguuuucuuaaggagugcuggaguucauuucuucauugugcuuauccuacaguacauuuuguuuuugaagaugaucucccuaugugguuccugcuagccuagaacuccaggacagccagggcuacacagagcgggagagggaggauggggggcacaagugcuuucaguaucuuuuucacuuagaggaagcucuugcuucuguacuguaauauaagcuccccuaaacuauuaaugcuacuaaagaccaaacuccagaucucucuggcagcauguaauacacauagggaauccaaacuacacagcuccaggcuguuaaccuggacugcagcuuucagcucugcaugcagccuucacucaaagugcccaucaacagucaauccccaguuaaccaaccaagcuuuccauccaaucaauuccuaguuaauuuuuauuuauucauucauuuguuuacuaagacauggucucucuauguagcccuggcuguccuagauagaacucucuuuauagaccagguuggccucaaacucagagauguaaacucagucucugucucccagauacugggauuaaagacaugcacuacuacaccuggcuccugcuuucguuagaggcaacuucaaauaugaaacuacacccuccucuguuagguuccacgcucaggaacaccaaguucccguaucuaaacaccaucugugaacuggaauacgaaacugccuaggggagagaagcacagcuaguuuuaaaccaauuuaaaaaucaguuauuuaagcaaagaaccugguguucauauauuuaaggaaacaacaaaauugaggguuuuaacauacaaguuauagucagauuaaaaaaacuaaacuaauuugaacucauuauaagggucuucuagaaaaugcaauuauaaucaaacuuuuuuuucugguuuagacaagucauagcuuccaauucccuuuuagacagaauacacggcagcacaugucaagaguuccuaacacacuccaucagaugucucaaauaguuuuuuuauauuaggauucuaggcuggcaagugagauggcucagcagacaaagaaagguacuuguucccaagccugacaaacugaguuuaauucccagaacccacauuguuaugaucuuuacccuacucugccucuggccaugugcacaggcacagacacaagcacacaaacauaaagaaauguuugugaagaacauuuuauaaaauucuggcuaauccacacaauuuuucugugaacaaggcuacacauaauuaagaaucaaaggcacagaaacaguuuccaacauuuagcccaaaucuggagccccucagugauggcucaaguaaacagaaaaaguaacacaaguuuucucccuccuggugaaaagcuuaacugaaaccauccugagcauagacacagcccacagcaggaaaggugggcaggacaugcacugcucgaugaaggcaucucucagauggauggcagcuagggcuucaggagacaccgcuguuaagacucacuauacacuuugccugccacacagccugacuuaacaagucugaggccacaagcacaggaacacauugcgucuggcuccacaccugucaagaggugagggcccaguuaagucuaccuaagaacugccuaccaccaucaggccucgaucacucagcuccagucaggaauaugcaacagagcugccagcugcuagaagagaccaagugaucguuucauguaagccagccuguucucugcuuuuauaaaguguacuuuugaauagcuaacuucaaauccuguacugcugcccacugcauuuacaaaagcauggccaccuccccagcccaaaccaucucccaacccauacuaaguugauauccuucagcagaucaccaaucucaaacaugcucuugacgcucgccugagaagugcccauucuucaucuggagcuaggacaaaacacuccagagaugcaagaugagugagaacacuggugggggggcucagcagucugcaacucucuucaggaggcugggcacccaccaccugcacaccuuuccuucuacacauuuccaacaagccuaacagucuucuuugaugccauauaucccucacagggaaaauucauucauugcucuuucucaagauccuucucaugacaaccaggaagccucaaggggccccugcugacccacaugaacaaggagagacacuuaguauggcuugcacuugauugcaauuauguagacgaggaacuucacagggcuggcauuuaaugccuaauuuagccagcuccugaaucuccccaaccaaugcaaacaugguaccuugcagaaaagaggccaauauagccauguauagagcugaguuucucaguucaagaaauucucacaugcauggaguauaagcuugucuagaucauaugccucuucucugccuggagcccucagcccccuggaacuucaugucacuuaugacacaggugaaggaaggcccugacaggaauugugccacaccccacacagauguuaugagcccuuggccaucggacccugugagagcagaaaccuuaucucaucugcccccgccccuaccuggacugcguucucugcaugugaaacuuuucagcuguucuaaccuggccugagcugcucagcaccucuggggaagaaugucaaguaugcucaauuucaaaacacgucagugcucuucauuacaccaagaguauuccuuugaacaauuccaugcagagacagacgaagcaauuccuucuuaagguugacuguaauuuaaauguuguauguuaguugaaagucaccagguaacuagcugauauucucagacaggacagaaccuuaaugaacauaauccugugcagcccauuaaaggcuauaaacuuaagucuucaaccacccagcucucagagccaagggacuucuugcuccuauaaauaacucuucucuccuaaccugccugaaaugggaggucaguggguuagauagcuacuaauaagggugaaugggagugaggcugaaccuagugaagaaaacagggaagaauccagcacuuagguagagcucuagguggucauaaacauucacuggcuggaggagccaccagcucaguaaguccucaacaagaaacccacaagccacauuagaaucuaguuuccagcccggcaugguuggcgcacgccuuuaaucccagcacucgggaggcagaggcaggcggauuucugaguucgaggccagccuggucuacaaagugagcuccaggacagccagggcuauguagagaaacccugucucaaaaaccaaaaaagaaucuaguuuccaagugucuucaauuuucagaaaacacccucccccuuuugucaucccacguguuccucagugaccaagagguuaaagaugaagcuacagcuagagcucauguggcuucacaaucacccacuguuaaagcuggaaaagugcaccucagaacagugucagacugggccacagucccacaccagggagagugagcccuagguaccucacgucucccauuccuuccagcaaacccaucugugcaaugccacugaugcuccuccuucagguagguaucucuguacacacacugcgacugcagugaaguuccaaagccgcacuccccacaacuggguuuagugcagugccgcagcgcuugcuuauuagcaccacaagacccgagucucaucuccagugccacuaaacaagcaaagaaagauucauuaacaguuauuacuuaugguuagcaaacucaauugcauuucucagucaugaguaggagacagaaaucaagaaggaaauaaaaauucucaauguggccuuuucuguuccauuauaaucuauacaacucauacuuaaauagcuggagaccuucaacacuaaaccuuccacuuuucuaccugaaagcuuuaaccuguccaaaccaagccacuucugacauucaagcuuacagaggcugcucagacaugcauacgauucagcagaaauagaaagcagaguuccagugaaaaaugccuagugcauguacaccugcaaccacgggaaacacugcaugcuccuuggucagguacaauaugaacugccaucucaaagcacuauguacuguucuuccuuuauacauugucugaguguuggcugagggccagccaaccccucaaacacugaucacugccuuccuggugugcccauuucccccaagucuagguuacccaaggaacuacacaaauggccagaaaguccagcacauggcaggacuuaacaaacauuaaugagagaaagaaacaaacaaaaagagagagggaaagggagggagcagggaaggaaaguagaaagguagguagguagguagguagguaggaggcagguagcagacacaggaaccagggcuucuaacuaccuaauacacccaaaaguccuuaugauccaccaacaaucugaugaugaguucugaaaggucccucuuggcaacacacagcugccaugcaaaggagcuaagguccagaaccgugaagaacucaguccuuuguuuccaaaguacaagguuaugccaaauaucaaucuacuagacagcuguagauucccaacaucuggcuuucagaaauaguccacacugucuaugaaucaauuuacuuuuauucucucugauacuauuauuuaaaaugucuaaaguuauacaauauaaaaaguucugccuucagaucuuacaagcuguuaaguuagauuucacagcauaauuuaaaaggcuugauucauuaaguucuccaaacucaaggucacagacagcaaacaggccuuuucugagauaagcugccuagagaagagaggcuauauguucuaagaaugaacuccacacgagucuuuucauuaaagcucaacaaagacucagugagcugucugcuacucagacucuuuaucaaaauaauggggcagaaagaaauauaauuacugccaagugguggugguccauggccuuuaaucacggcacucuggaggcagaggcaggcagagcucugugaguucaagccugguuuacagaaugagucccaggacaggcaggaccacacagagaaacccugacucaaaaaaacaaaaacaaaaccaacagacagacagacaaaagaaaagaaaaaaagggcaccaaacaauauaaaaccagcaaucuugccacaaaauguguacauuuguguaucacuaauaaaacaaaaagauuauuuucagguuuuuccuccacacugaauugaauuuccacaguaaggacuaauaauaauaauaacaauaaaaauaaugaaacaguucugaauacacacaccaaaguuuacacaaagccaaguaugacuaccaucaaauuacagaucugauaaaaugucagaauuaaguauagcugcacaguuaagaaaguccccauauccccuaguuuucagccuccacaagucauaccuucucuaggaaggcugguagcaugacucuugcuuacaaauauacauuaaguacagaaacaaggcaaauaauggcguggaaucaaaaugcugagccuuggcccaacaaaaccucaauguagaguuaaaacacuugagagagggcuggaauuuucuggacucuuucuuaucuucugacccagaaucaaaguauuuacugaccuaaaacaacaacuaaaucaccgucaauaaacagaaaaaauguauucagcaagcgacccaccagccuucccuugggugagccuauuucacuuugcugugaaaugcaaaggauauguaauugaaaagucacaaugagcucaucaaauauggcuugagaguuuuccaaaaccauguuuaugcuuuuauuuauagccucacucccacaaaauacaaugucugggaaaagaaaaggcuuguucagauuuaccaagauccaaggggagagcaaaaaacaaaaaacaaaacaaaaaaaacccaaaguucuuaucaaaagcgaccaccacaucgugccuuggccuguauucaaaguagacucaaauaaaagauccccaaauucacauuaaaaguuuuucguaaaaauauuccagcgacguaucggcaugccagcuggaaauaugauauagccaaacuauuuuccuacccacaaauuauccccucccuuuuauaagugacugacuacacucuagcuucuguucaaaacaucuuuaacacagaucugaggggacggcaagccuccuaaacuuccacaaagcccaacacauucugugcggcagccuaccucccucgguucccggugcaccccaucuuugucucucccagguccgguucucccuucccgucucccuccucugccgcguccugcgcugucagccgggccggaaggcgcaggcggcccucccucgcggcgcggccagcccuauuccgggagcagggccgggcccgcacucggcggccgcacgcgcacuucccgccgcgcgggcgcucaggcacaaguucgcaaacagcccgaacgcgcugggauugccgugauucagcagcgggccggguggagacggcgggcagagcccggaaaaggucaccgcgacgcuacgggcaacgcccggaccucgacccuuacuuaggccggcgcgggugcggcccgggcccggcggcggcggcggcgauuccuaccucuccggcucuucggggagcuccgcuugcuccgggcgcuggcucgcucuuccucaaucgcagcugcuaucucgggguugucuuccccauuguaccagaccaggagcuccucgccaggcgcgauuggcuaccaaagagaagagacaaggggcagaccaaucagaaacgcgguuguuggcgggggcggcacgacagcgggcaagagcggcgcgccgaccgcaaacagcugucgggagggcgccgccgccgcgggcacgcgcggagggaggcggggccagggcgcgcgcggggaggaggcggacccuacgacguaggcggggcagaaggcggagccgcggccagggcuagcagaaaauuccuuggcuggcaaggccaaggcagggcgcuccggacaagcaggacaaccuggcagcuugucacagaggcucgcaggaaugcacgcaccggcugaucugggccuagugcucagccuccaucaacagauucuuuuuuauuuuuuucgagguaggguuucucuuguguugcucugccuguccuggaacucacucuguagaccagacucccucugccucccaagugcugggauuaaaggcgugugccaccaccgcccggccaucaauagauucuuacagcuagucccaagccucaugccaacaaagcaaaagagaaaacaugagaccauuuugcccaugaaauuucauugaaugagaaauguaaagugcuacuaagcaaauggcaugagagcuagcagcauacguuuuagauuccaagcacaaguuaagcaggaacguugugcaccuuuauccaugcacacaaccacuauguuaaguauuuuaaagcucugagcucagagccuaagauagcauucucaaugcagagucaucaaaguagcgcaggccucugaaaacacaucaagaguguauaucgcaacuucuaguuacagaaauccuaagaauaccuuccaugaauuaugcuccuaaaacauuaaauucuucacagucacaccaucauauaacuacaccugcaacauccugaagaaauauuuugaguagaaaagugaggccuaaacagaacugggaagguagcuaauaguugucuuucauugucaggaacccaucuguucagaaaguucaaguaaagcccaucuaaacccacaugcugacaccgaugaucacaggaagagacacacaaaagggaauguuuuugcuuaguguagaaugagugggaaugaggcaauuaaaauaacccauauugcaaucaucaacacagauugauccagacaaggcuccccaguggaccuacuguccuugggugagugugagaaguaucagaacauuugcuuccugucaaagccucugcccauaaacagcuaucagccacagauggaggaagagucuuuauaaugagucagauggacagccccugccuccugagaccacgcagaggacagagcccgucuuggaugcccaaaggcauaaguggaaucuaaucaaaaggaaggccaaacugagucuccucagaacugaaaaguuaucaaagaccaaaguaacugcccaagccuaggagacaaaugagagccagagcucugucuccaaggaugugacugaguaggcagaucagcugauagaauacugccauggugcuggcuuccucgugugcagcauacuggggcuauggaagaguuugguccuagagguuuuguuugcuguuuguuuuggcuuuuugagacagggucucacucaacuauguaaccuggacuagccugggaacucuaguagaccaggcuagcuuugaauuuaagagauccaccugugcucuaccucccaagcucuggcauuaaaaguguguacacaacacucaguccuuauuuuuguuuuaaagcagaaauucaaacagaaauguucaguuuagacagugugaugguuuguauaugcuugguccauggaguggcauuauuagaaaguguggccccauuggaguaggugugucauugugggugugagcuuuaagacccucucucauccuagcugccuggaagccaguauucugcuagcagccuuccuuggggcaagagcccacccagcuaauuuuagguucaggcaugguaguacaaaccuucaacaccaggaggcaaagacaaauagaucucugaguucaagaauagacugaacagagcaagcucuaugcgagaauaaaaaaacaaaacacaaacuuaaauccagguuugguggacuacaacuuuaaucccaguguuuaggagacagacaugaagaucuccaaguucaaagucauguacagagaaaguuccagggcagccaagcuuagguaguaaaggaguuggaaaacagaaagcuggugauaauguaauagaacaagggggccauguuccaaccccugcaagcagcagaauuuggcagcuuuggacacauggcucuggcuugagaguccagaauagaaaggaauacugggacaauugaagcugguuagcugcagcuaaaaaauuaguggugauuaagaagagaccaguaccagucaaugguggcacaugccuuuaaucccagcacuugggaagcagaggcagguggauuucugaaucgaggccagccuggucuacagagagaguuccaggacagccaggacuacacagagaaacccugucucaaaacaaaaacaagagagagagagagagagagagagagagagagagagagagagagagagagagagagagagagagagagagagaacacagcaucucuggucuucugggaaaucuucugggaacuauuucugagagcucaaagaagcuguguucuagagauagucaagguuguuuuucauaguacagcugaacuugguauuguguaagagucacccaaaugguacugguuuugaaggcaugaaggggucaugaagagcagcugaggcuaggcacugugagaggccagggaaggccauggugaagguacagcuucaguagcaguuaauggcccaggacuaaagggggucaugcaaggaguugagacuuggaaucaugaagaaagccuaugagaggcuauuggugaagccuagcugcagcagaagaccccagcguauuggaggucucagcaccaugagaugaucaccaagaacagcaacagcaguggaguggaucaaccugagcuuagagugcuacaaagggcagagcuggagaagugaugcuagcccuuuggagaaggcacagaagaucauauguggaucccagacacugaaacaagauguaacacuuaaguugccuuggagacccaaagauuuuugagaugccagagcugugggcuaucugcugaagaaagcugcuaacagggaguggaaccagcccaggagaaagaaguuugcugcagucaacaaaaguaaaaaaggaguuggaaaucugaaggcugcuuugacaucagccuuaaagauucaaaguuugaaguuugcccaguugguuuccugucuugcuuuggggauuacaguuaagugauugaacaaaucucagaagagacuuugaacuuugaacuuuuaacauuguugagacugcuauagacuauggagacuuuugaaguuggacuaaauguauuuugcauugugcuguuuagcuuuggcccucuuagacucaaguguaugaacaagccuaugggggccagggaguggaaugugaugguuuguauaugcucagccuagggaguggcacuauuagaagguguggccuugugaauuaggugugucacuaugggugugggcuauaagacucucucauccuagcugccugcaagccagauuucugcuagcaaccuucagaugaagauauagaacucucagcucugccugcaccaugccugccuggaugcugccauguuccugccuugaugauaauggacugaacaucugaaccuguaaaccagccccaguuaaauguccuuguauguguugccuuggucauggugucuguucacagcagaaaaacucuaacacuuuguuucacugucuacagaacucucauuauuucaaaguauucaagcugaguucaauucccagcaaccacauagugacucgcaaccaucuguaaugggaccugaugcccucuucugcugugucugaagacugcaacaguguauucacauauauaaaauaaauaaaucuauaaaaagaaaugaaaaaauuaaagaaccagacacuguuuacuuuguuccuccaaaaauagcuaaaaucuaccacuuuacuguuuuugaaccaaugucucauauguuuucuugagucagcuaaacuuaaccaaaaucccuacuuugacaauccauucaugagcuaaaacaaccaucacaaacaccuuuuggcacucugaugagcuaaucugauuuguuugccuuccaaaauuaaauuguuuuuagaucauauaaauuuuaguucaguucuuuuuuuuaugccauauauaauagauaguauuauuaaacauuaucugaaaugauuaggacccuagaaaauauaaaauacaagcaaaguuuaaaaguaaaggggaauuucucucuccagcagccgagcaagaugcccaaagggaagaaggugggcccggcccuggccgucgucaagaagcaggaggccaagaagguggucaacccucuguucgagaagaggcccaagaacuucggcauugggcaggacauccagcccaaaagagauuuaaugcgcuucgucaaauggccccgcuacaucaggcugcagcggcaaagagccauccucuacaagcggcucaaaggcccuccugccauuaaccaguucaaccaggcgcuggacaggcagacagcuacucaacugcuuaagcuugcccacaaguacaggccagagacaaagcaagagaagaagcaaaggcuacuggcccgugcugagaagaaagcugcuggcaaaggcgacgucccaacuaagagacgccuguccucugagcaggagucaauacaguuuccaccuugguggagaacaagaaggcucagcugguggugauugcccaugacguagaccccauugagcuggugguuuuccuaccugcccugcgucgaaaaaugggggugcccuauugcaucaucaagggaaaggccaggcuggggcaccugguccacaggaagacaugcaccacuguugccuucacacagguuaacucggaagacaaggguguucuggcuaagcugguggaagcuauuaggaccaauuauaaugacagauaugacgagauccgucgccacuggggaggcaacguccuggguccuaagucuguggcucgcguugccaagcuggaaaaagcaaaggcuaaagaacucgccacuaaauuggguuaaauguacauuaaauuuucuguaccuacauauaauuacaaaauuaaaaaaauaaaaauaaaaaauaaaaguaaaggggagccuuuaaucccagcacucgggaggcagaggcaggcaaauuucugaguucgaggccagccuggucuacaaagugaguuccaggucagccagggcuacacagagaaacccugucucgaaaaacaaaaaaaaaaaaaaaaaaagcaaaggggaaugaggacaaauguauaccaugguuuccaucacagcacagucagaacucuggccagaagcaagcaggagacacccaggccucuaagaacaagaguccuguaccuagcuccuggcuuccuuuucauugcucuuggguaucagcagagauagcuuuacuucacacagagaaaaguuaaacaucucacagagauaggggugaagcccuggguuugagccuugacaccaaagauggagagggcagaaauaaauacaaacuccucauacagaagaauacuuauguccacucaaguuagucuuaauggaaaacacaaccuagaaccuguguguacugcaaaucgaauaagauaaccacuuacguguugguagacuggggaaaugcugaggggagcccagugugcucuguccggaacagcuuucagugcugucagugacugagauggugcuaugcuauggagcugcaugcuaauagacacucucuuacaagaaagaaaagagguauuuuuauuuuguacuccuuagcauuuucaagaucucuugcaauaaaccaaagaagaguucagagccauuccuuguaauucauuuacaaagccugccucaggaaugcugaauccuggagaacacagcagcagagcacagcugagggauccaaaaggucucaaacauaccggaacaacugccaaaggucaggccuucaggugcacaaagaucagcuaugcucuaccaguacagcucauuagcccacacguggaauaguuauuaacacccuacacugaccacagcauacugucugcaacuauaugaauuaauuuuuuuauguuaaauaucuacucccaguacaaaacucugaagccggaaaugcuccaaaauuucaaaguuauauguggugauauaacccccacaaucaaaaccaggacaauagagccccugcauaaaguuccaguauguccacuugucucagauguaucugagauauaagucaauucuguauuuucaggugggucccauccuaaaaaacuaaguguaugcagauguuuaaaauccaaaacacuuugauacuaagcagugcaaauaaggaacgcuuuaccuauacagcuaucuccauccuuagcuuacuuuacacagcugucuccaucccuaguuuacacugccuaucucacagccacguugucucuacaaggauucaaccuugccaacagaaccaguuguaucuccugcuugagauguaugugauaaacaaaaugaauccuuagugcucuuugaaaccaggcagcaggucuauuagaacagccuauagcuacaauucagcagaaagaaauggaaaacaaguuuugggcugccuaaguaugaacauggggggaaaaaauccaaauucugcaaaaccuagaagccagguuuagguauaaacaugucacagcggcaaaguuaggaaaauacaauugaagaacauuuaacagcuacacacuaacucaacuugcagaaggccuuaugcuacuacacacaccaugaacucaggacacugcccgaaaugcucaagaguucucaacucugugaagauuuaaaaaaaaaaaaaaaagaaagaaagaaaaaaaaaucuauagacuuguccuugacuuguaacauagauagaggaaccaagugaaugaagaacuauuuguuugucacagcaauuuggacagagguaucuauuccaaaagaggcuaccaucaucuaucuuuccagccccaagauuccauucuagaacauuccauacauggaauguagaucuaucugcuacagaaacaugaccagugaaaaccaaagagggagccagaaucuugcucgccacagaaacaugcuaauaugaaaagcauccuaguaguaaggucccaaaugcacuggguaccuucaucaccagcucugaguaugguccucuucaccucugcaaucaauuuucccaagaaauauuuugacaggaagaacuaaaucccaaauucuauccugaauauaaucaaaggaaaggaaaagcuaauccaaggcuucacgcacucuaaacacugcgagugcgcuuucuguuacaggcacuaccaugguaccacguaacagcgacgcacagugggcuaaaccugccagucaguucccagugcaucugugucagaggaagaggaggggagcagaugccacagauaaucaauaguaugaagaaagaugcagucuauaauuacucaacacagucuucuugcucuaguucuccaauauaugcaaggccucaugaaccauguguuuaacauagaguuuuagguguguggaugaaccacuucaaacacaauccauucuaggucugggaaguuguucuuuucaguuacaauuagacugcauuuagagaaugcaugcaaaguagcuaggaguagacuaacacuaacacuguuaccuuuaagguuuuauaguaaauggcucuguugauuuccaguggaaauaaauucuguucuucuccugagcaagcccaguucacauagcggagccaguugcccuucuccggaucaguggcaucaaugcacauccaccccaaauuuggguaguacaccuagggauggagaagaacaagcguguauuaagauaggaaugccuaaaaacaguuucaucuucaacuuuccaaacagcuuuucucacuauauaaaagcacucuaaaaagcacuucauagaagcaauauagaaaaauacaagcagaaaacagaagcugucaaaucuuagucuuucuuuaggcuugguuuccccucccaccucccgccaccauaugagggacugaaggccacuugcuugaucuacaaauguucccugggcauggaaauaaguaaccacuacauucucucaagugugacuuaacaacaugccuucuaagauacucuauugguccaauccaggucuguacugcugaggacacaguucaguggucucuuucuggcaugauuuacagagaugucagaaaauggacacacgugaaucaaucauguaggugauaacuguuuucuaaacuucacugucccuuaacaccuacuccauccagcauauguguuagaacuaagguucagcaaacaucuuugcaaaguucuaggaugcagaaaaaaacaaaagaacaaaaacaaaaccagaaaagccaggacacgggaacauucaugcuuguucaacuccuccucugagaugcugccaacaaacucauagcuggucaugccuucauuugaaagaacaugaacucugcaaguagucugaaguuuacucccucuuucucacugaacggaugaggcaguaauucuucuucaagcagagcauaaaugucccacaacuuaauuuuaauucuaugaauaaugcagucauuuuaaaauaugugcauacagauacguuuauaccccaaaaccagacugcaaaacaccuaaguaaauugaaccagaacuacaaauaggcauucuuuuuaggaagaaaggacucucucucucacacacacacacacacacacacacacacacacacacacacacacacacacacacacacacacacacaccuugacuccuaccauuuacuccuucuuuucucucccaccaccuucaucacugucauuaggugacuuucccuuagaacaaagguccugcucucagcugauggcuaggaugcugacuuccugagcaagucugggucccugagguuucuucucuucccaccagcaaccaagccucccucagcucuuacaggaguagacagacagacagacagacagacacagacacacacacaccgagucugucucucucccucucucccccucccucucucuccaaaucaaaggacccccucaaaugguauguuugaagccauugcaaacuucaauguuaaacauaguacacaaaaugacaaaagcugcuuuccaguguuuaagagcucugauugucccguuugcugaaaguggagugaaggacagacacaugaagguuguaaucaagccucugguuagcucacugacucacacagguauuaguauuacuuugccccuggccucagagauagucuuuuucuuucuuuuaauuuuaauguauauuggcagacaccagggucucacuggaucaccccccacacaguagcagugcugacagguaucaaugggacuacagagagagcaguaggaagccaggaaacccacggaauagaaggcaaagguggcaccuugacuacacgucugcuguaacaacaucugcuagaacuuccuggcucuuaagucaaaacaaaucguugcaaaaauaacaauguuccaguugaguaaacucuuuauuuaugcauauuucauuguaacucaauggaaagugaggaaucuucuaaggcacaaugauguauauaaagaaaaaagucccauagaagaugaauaugucaggggauuuaagagagauguguuugcauuuggggggcauguuucaguuucuguuuuguuuucugagaaaggaucucacucuguagugugcccauccauacacacacgaaaucacacaaugcugacuauguaaaaccacucauugauaaaaaugaucuauuuauuuuuaccuaaaauguaagaauauagaagaauauaugaagagaaaauaauuuaaaacuaaauaacaguuuucucugagaaaaugaaauaauucagucauuuuuuucuuuugcuuauguuaacuuucugccuuuccuccacuggaauaccauuacacugagguggggugggggaaaaggcagugcuauccugaaggucuacaucuacaugaugucugcuggaugcccagggaaaccacaacaugguuuuccuguugcucuacacuuuaaaacaacaacaaaauaaaaaacaaaaacaaaaacagcagcagcagcagcaaugacagcaacaaaaaacagcugggcuugguggugcacaccuuuaauaccagcacucagcauuugggagguggaggcaggcagaucucugugaauugaaagccagccugggcuacauaauauguuccagaccagccagagcuacauagaccaugucuuuaaaaaauuaaaauuaaaaaguuaaccccuccagacccuaugaaaugcuauuagucccuuuugaaaaugaggaagcauagcagaugggcaauuuaggagaauaaacaagccacugaaaaucacagccaagacucaaacuugauccucucauuuauuccuuacaccaaaaugaaacagauaagcaggcagagagcagggaaggggagcccuuacgaacacuccuaaauccuucuucugaugguuaggguguaacucauaguaaaguguuuguucagcggcugacccaugucaccuccagaagcacugaacaaaaggacagaccuuucuccccaacuccugauaccuucagguuaggguugaggaaacccuacuccgcugggcgugguggcgcaugccuuuaaucccagcacuugggaggcagaggcaagcggaucucugaguucaaggccagccuggucuacagagugaguuccaggacagccaagacuacacaagagaaacccugucucgaaaaaccaaaaaaaaaaaaaaaaagaaaaaggaaacccuacuccuucccucuuucucacugaacagaugagguaguaauucuucuucaagcagagcauaaaugucccacaacuuaauuuuaauucugugaauaaugcagucauuuuaaaauaguucuagaauaaucuaaauucaaaaugcaguacacaugcccacuuggcaugcaaccuucccugguaugcaggccuauguuuucugugaagauuugcaagaggguacuaaggucuggaugagaaucaaagagccauauguauuguauagucacagucuucuagcaggugcuacugaggaauaauggaccuucaagauguggggccugguagaaggaaggcccuuaggccauuggcacucagaaggaacuguaggacccuaucuauccuucugcuucugcuccagucugagauagagaacuuuggcuccugcaugugcuccugccaggagacaccccuguuaccuuaccagaagcccagccugcacgacugcccaauuguggaugguuacucaucaaaccgugcgccaaaacaaaccuuuaaaauuucagauaacccgucuuuggcauccugucacagugaugacgauacacaagggucuacauuacaaaacacucuaugaucuuugcuacaggaagauuacugauggcaacccagaggcuuagucugauuuugacuccgguauagcagcuugaaguccucaaggagcuacuaggaauccaaacuuaucaucuggaugauucucagacuccagaccaacuaccuccaugagauagagccaggcuagaagcacauguugcuaugccaagaucaaugcugcaaaacacacagaaaaaggccuaaugaagagacauuaaauggaugaguaaauaaacucccaaggggggaaaaaugcaccauacuaagaugcuaaccuaagucaaaguaguuaaauugugagaaauuauuuaaucaucucuacuucaauacccucaacuauuauaaaacucuugaaacagcauauauuuggcucugcuguuacuaugacaaccauucuacaguugaaguaccaaguucugcauagugcuguaccccacuggguaaaccauaacaccagacaccuccacauucacuccucuggcuuguuccccacacugccaagacacaguaaacuuuccauagaguaaugugaaaguauuugggggaggggggcagacaggaaauauggcccaggaguuaaaaagcucuuccagaggacccagguucaauuccuagcacccacacagcugcucacaacugucuguaacuccgguuccaggagaucugagacccucuccuagccucuucaggcacuauacacaaauguugcucaggcacacauguaagcaaaacuuuccucauuaacugaaauuuguauuucaugguaucuucaugugccaugguguuuaaaaauauaaagaugcuccuuagguuuuuuuggguguuuguuuguuuguuuguuuguuucaagacaggauuucucuguagagcccuggcuguccuggaacucacucuguuugggagcuuuaaaacacagugcgcaaguuggaucuagagacacucugacagcuggacaacagcagcgagcaugacaagcacccugugaaaccaggcucugcagaaccaacuggcagcuuccaaaugacauccaacuacaaggacacagccagcacuagcuaucgagcucacacacuaacauuuauucacaauguuaacuuauaaaaaagggggguuuugcuccugaaaaaaaaaaaaacccuguauuacgaacuucucaguaugcagugaucauuucuguaucaauuucuauugauaagaguucuagcucuucccucuguccucuagaauuuauugccaagaugaucaaaaugcaauagaagcagucaguaaccauucacauaaaagaauaguuuuuuuuaaagacuauuaaaaagauaagcaauauuaaguuucaaaggccuauaaaaauauacucuuguuggucuuauaagucuuucuaagugcuuuugggcaaaaccgaccaaaaauguacagaaguuuacauaacuuuugauuuaacauuuacacuucuaggaauguaucuuaaagaaaauaucagacaagucagaauauugcauguauagugaguuuauucuuggaagaacuauacauacucagcaaaggauuaaagccauuuaaauguucaacagaagguaaauauggauggcagacagacaaacgaguuaugagcagccacacacacacacaaaaggcaaacacaaagcaccugacacaggcagagacacaguccugggacaugguuaggaaaaagcauguuccacuccuacaagugguguggggauggguacuaguguugaagaggcaagacgggagaggcacaaggcagagaaaagacagccuguacuacaugagauucugacccaggcaauuccucacuagcuuaguaaacucuuacuguagaguuaagaaugcucaucaaugccgggugcuaggaguuuacgugagcuuuaccuuucggugagcuuuuuauauacucucauacaguuuuaugggaaguauauauuuuucuuuuuuguuuucuaauuucaguguagggggggucuucuuccaucaugugggugcagcgauggaauuuaggucauacaguuggguggcaccaucuucaccuagugagguaccuugcuagcacuguuuaaauuuuuaagacuuauaacuggaccagguacacacgucaugaaucccugcacugaaaaagggguuguguacugaauaccagagauacugauggauggaaaaccuuugaguauucaggucaacuggguagaaauggcuuccaaaugugugugcuguguagagacacaggguguaaugggcguucggguuguaggagcucuggcucuguggauggaagggugcagguuauaaauggcuauagcuuuccucucaagcucugccuucaucuguaauagauuaagaagcgcucaucagauacauagcgcucuuuguucuuggaccucucagccuucaugaugagcuucuguacguuacacaggcucugguaccuuaucauagcagaacaaaacaaacugaaacagaaguauccaaucaauuuuucucugagccuaacacuguucuaaaacaaaucuaauuaggagcuggaacagugguaugugccuauauuaucagcacucaggaggcuaaggcaggaggaguuugaauuuguggcuaauuuacaaccaaggcucugugucaaagcaauaaaagcaaaauaaagcaauuuauccuuaaaggguuauuagaauaaaucuugcucaaaaaauucuuuuuaaaaaaaucuguuuuuggcaaucacaugagcccaaaacuugaaaggcuuuuuaucagcuccaggcauacaguaacccgugcucaaaauucuagcacaugggagauagaaguaaaaggagaccaguucaaagucagccuaggcuacaaagcaagacucugccuuucaaaaggaggggagaacuuuguaucgggaaugguuucaaaauccuguuacugcucaacacaccaggauggucaaaagaaguguuacagacagcccagcaugucagguccccacaguccugcugagagcaggucaaagcaagcucuccucucucuagagcacccgcuccaugcacucaccccgagcauccuucaucuucaucuggauuaagagggaugugaaugcuuucagugaaaccuuggggccuggcaagauggcucaguggguaagagcacuaacugcucuuccaaaggucccgaguucaaaucccagcaaccacaugguggcucacaaccacccauaaugagaucugacggccccuucugguguuucugaaaacagcaacaguacuuaucuaaauaaguaauaaacagauuucugggccugagggagcgaggcugacuggagcaagcaaaggucugaaauucaauucccacaugaaggcucacaacuaucuauacagcuacaguguacucauauacauaaaauaaaugaauaaaaucuuuaaaaaaaaaaaaggaaaccuuggagaacuuaaggagucagacagucaagggcucaagaaaggcaacugaacacuuugucuuaggugagcacacaauggucuacgagaugggacguaagauuccacugcuaagguauuuuaagcaggucuuaaggggcuuugauggaagaacaaucaccaagaugcaguucugaugauaaacucuuucuauaauauugggaagagauuuucugauacaagucuggggauaagaccaauaaguuaauuuuucaauuuauuuaugacaaauaugcccauuacuguuauuauuccugauacuuugccauacacaaaaauauacaccuaugucaccuauauccuaucuuaacacuucuuaaaaauaaaaagcccucucagaugugagaccuaagugagcuucugacuuuucuuccuuguaaggaaagucagucuucacaagaacaagauguaaacuugaaccugacuauaaagaagugguauuuucacaaggaguuccaaacugaagccuaucuaugcaaagaaucuuaacuaggaugcuacguguagaggaacaugagucccuaggaguucucggcugcacaucacaauucugagcacacuacacaugaacuugaaugcaggugauaauugucauaagacuugagugauggcuuacacagcauggccaauaucacacugcuacacugguuacaaggugccgcugcauccccuuaggcaaugguggcaucugcucuacucggcacuauccacagacuguaaauaagcaugugauucccugacauuccucacuuagauuacuaaccaagccaagcuucccuguuagcuucuuuugagaaacuuuuuaaauuaauaaagugcuuuauuugagagcaauaucguacaagcaauacauuuuuaauaauacuaaaauaaagguauuaucuuuaguaaugaagacuuuuugugaccaggccauuuuuuuacaauuacaaagcucuuucacuuccaaacaguccugauccuugagguaaauucuuguuucccaaagcucccaggguuugcagucagauacuaucacaaacaacuaacucuuaagaaagaauacaaaaugaugaaacugucagaccaagcuauaaccuuuauagccuuaagaacugcccccucccgaugcccugagacucuugggagguaccugccuacacauuucacugucaggcuuauauaugucaacaaguaugagacagauaugacuccuucucauucaaaacggaacuuguaaaggagccaccccgaggugcuucccaugcaacacccuagugaaacguuuucaguaccccacucuuuaauggaaggcuucacggcaaaguuaagucagagaacugcuguagaagcagaauccgccccggcaaucugggagaauaugcguaacugucccacuguuuccaggagauguguguggcucugacuacaucugcccuccucaggccugaacguagagagcaaagguugccuccccaucacugaaagcuucuauaaaaggcugccugccacuucccugcuuuguccuccgggauuguugaagauaugugaaguagaagaaaauccuuucauaaaaaaaaaaaaaaaaaaguuguauguaaaugugccaugugcuauacaugucuaccuccgaauauuccagggacauagaaacuacuuucuaacauacagagacaaaucuaagacuauucuuugcagccuuuggaguauguuuuaugguguaucugugucauuuauaaaugacacagaggucacggucucagguauaaggcaaaaugcccugaacaaaaaguacaaaacacagaugugccauuuaccaucaaagacaauggggcagcuucaaacuacacagacaugcaaacaacagucuacccagaaaagucauuuucucuuuaacgaaaaacuuuuaaagaacacauugaaauuacuguuuuaacuuuaacccaucagauccugugaaaacagggagugggcucuugaaagugcuugaaacucucuuaccucccacauguauacauuauuccuaaccugggaucucuucuucuuaucaccaacaaauggcccaaacuuuuucccuuuuaaaauugguuuaguggcccagacaccuagaaaauaaaaccaguauuuuuauaauguaaugugguuauuuuaaauaucgaaagcauuaaugucauucaguuuuacaauacaauuaaaaagcuagguugcuuaacagcaaaguaacugaauucaguucaaucaaaucaacuaaaguccuccaggggauucugaguguccuucuguacgcccucagcagcuucucaauagucuguaaaggaucugcauugauuacaacuuuuuaaaagcuuauauuaacuuucauguguaaaauagagcauauguaguacaaucauaaacacuugaaaauuaacauaagagaaaauaugaauggaauaaagcuauaaaucauucaaacucuucauucuaucucucuacagaccucaaacuguccuuacuaaacaaagucauucuuacaauucucuuauaaucaggguuaggacuuggguuuuauaaauaaauacuucugaaguugauuugccuaauuacaguggagacauaguuuccacucauuagcuuuguaacacaucguucaugagacaucuugucuugcagaguuucagagucagcauacaugcuaaccuauggcaucuccuauuuaccugauauaaaaccuaucagaaaguacagcaaaccaaugaagaugcagucaguagaaccucaggaccccugcagucaagaacaacacauucuguacggaacaggaggcagaggcuagucuugcugcguguggcugggacauacacaccccacucccaccuaaagucagcuaggaauugcaucuauaaacacuaacaaccaguuaaacugugagacagaacaauauaauaaccccagugcucaguaagcaaaguuccagugagaauuagaagacaugcaagucauauuuacagcucucaucagaagaacaucuaaaugacaaaagaauagaagcaugaccuauucaggaguguguucuuacaagagcucuacaacuuacucuuaguguuguaucuaaaucuuacaucacagacacaaaaaucaaauacaaacaagcuuuuauacucaacaagaaauucuagccagcuuauaucauucauucaaauacccacaaaggguccuuaaguggaaaugguagggcaauggguaaggcagacugucaguaacagaaacagauguaaagucaacugaaaaguaaggagauaaaugugucucaaggcucagugaaaucagaggaaaccucccacuguguaggaugaggcccgcggagaugcagaggagggcacacuggaacacagaaccuaggaucgaauaugcaagaggaagcugguuuccuuucuauaacccaugucuacccuggauucuuauguagaaagugcacacacaccacuuaaucuuuuaagugagggucaagcuuucccuuuuuuuggcauaaugccuaucuagcaugauccuugcucccccagaaagcagucuacucuuugcuaccugacuccuacaacaagaguacucaccaauccgagucuugucgaccgcagaugguaaaagucuuacuuccucuggaaguccucgaagcacguguucagguaccucagccagagucucagugacugccacagacucaguguucugcaaggcaaacagcagaagggucauagcaaaaggaagaaaaccagcaguguuuuuuauuuugcuuugcauugcucuacugaaccuggagugcacaaagcagaaggggacaggucuggagcugcuguaucacuugcugagccuaguagugaaacacuagcaaccuucgaaccagggucuggucuguuccagccaccuguauccacuuucaaaauauguaaguccccaacacugcacugcucucuaacagugcucccacagaacugggcagcagaacacagcuuccaccuguuacuaaaucaaaggcuaccagcaauacacuacaacccuaaaaggauaauuuugccacacuccaugaaggccauuugacccaucagaugcugccucccuccuguaucccuccagcaaccugaguagguuggacauucuauagagagugacagcucacuguuagcccucacuucaagugggacuuuccaaggagcaauagcugaccguuguguaucaggccacugaacagcaaagaucacaauaucucagaguugacagaaauacagaauuaugccucaaaacuuagcuggaauucaucagagucuuaaauaagauuaguauuaaauguuuauguaaggaauaaggauacugguaucaacaaggaaaaccaggauguagcuuuuagaaucauuuccaaaucagacugaaaacuaaagacuaauuuucuuacagcaaugaagcauuuuuaauuuuugauuguuuuucaagacaaggguuucuccguauagcccagaguauccuggaauucacuauguauaccaaauugggcccaaacucagagauccaccugucucuucaagugcugggauuaaaggcauguguaccaggcuugguggagcacgccuuuaaucccagcacugggugacaagaggcaggaguaucacugugaguucaagaccagacuguucuacauaucaaguuccagacaaacagaaacauagaacagaaauaccuugucucaaaaacagcaacaaauguuaggcgacaaaccaaagcaaacaaacaaagaaaaacaagccacccaaacucaaaaccgccugaguuucaauauuuauauguauauauauauuucaauuccaacaauuccaaucaucguuggcuguccccuggcuggcuuggagucagaaagcccaagagggcaucuauagcuguaucaccucuggggcaaggccgagcuaccagugcgcuugcuucagaagcgcagauacuuucucugcuaugacuuacauccuuuucccaacaaauccuccaacauacuuucuaaaaauagaaguuucaaauugcccccagcaaauagccuccuguacuucuaauuagcuaaaaauaucaauaaacuuaacagacauuucucacuucuauauaugcgauucccauuuuaaaauguuuuaauacagaagcuagauauuuggaaaaaugaauaagcuuuuucugccaaaaggggaaaaguacugaccugacaauauccuauggcaccaauaaacagaauaauaccaauaaauauuagccagaauuaugaguguguguguagggcuagccacuuagaauaaucaaugagagccuucuucccuuuccucagcuguagccuaccuauccucccugagagguagccccuacagacagacagacagacagacacacacacacacaccuacauacacacauacacacauacacacacacacacacacacacacacacacacacacacacacuucuagaaaacugaggcuuagaaaaguggcguaucugacucugaacacuaguuuaacuuuaaagcccaaauccauagucacuguggguuuccauuaagacuagcuggaaucaucagagagccucugcccucaauucccagacucaugggaaggcagcagaagguacccaaggcacggauggucuuccauaggaaauguguggcuucacuggagacuuacuaaaacuccugaaacaccuguaaauauagaagaccccagcagagcugcuggggggcgggagggggguugagaggaacuguuugugggucaaccacuuaucuagggugugucuuauguuuugguuugcuuauggucuugcaaauagccuugacucaagauuuucccaccucagccgcugauguacugggacgaggaagaugagacgccacaacuagacucaaccacgauuuuaauguggguucgucuuuauaguagaagcucuuuuuucuguucacuguacuugucuucagugaaaauaagaugcaacuaaacucacagcagaacacucuagaaacugucagccauggcuucccccucccaucuggcuaauugcuggaacaucuccacggcugcaaacugcucaacacauucuuagaaaagcaaaggcuugagaaguagaaggcaggcucaauucaaacacccccucucucccuauuuuucuuuuaaaguucuuaggcaauuuuucauaaugauuuguauagcuauguguugaauugugcaucccugugagacuguagcagacacacucugugucucucauucccacuguuggaaagucgaaauaguuguugcauuuacauaauugaauaaauauaugauucucuauaaaaugauuaauguaaaaucuuucuucuucuucuuuucuucuuuccuccuccuccuccuccuguaugcgugcuaugaaccaaacucuuauauuuuugguuuuguuuuguuuuuaaagauuuauuuacuuuauauauauauaugaguacacggcaccuaccuucagacacaccagaaaagggcaucagaucucauuacagaugguugugagccaccaugugguugcugggaauugaacucaggaccucuggaagagcauucagugcucuuaaccacugagucaucucuccagccuccaaauguaacauuuuuuaaaaaaaaauauuugugcugggcagggugguacacaccuuuaauccuagcacucaggagucagagguaggcagaucucuaugagcuggaggccagccuggccuacagacagagcuccaaaacaacuagggcuaaacgaagaaacuggcuccaaacaccaaaaccaaaccaaaccaaaccaaaccaaaccaaacucuguguguguguguguggguguguguguguguguguguguguaugggugugggugugggugugguugucuacacguauacaaaugcaccucaugugugcuuugugaacagaggucaaaagaagaugccagaugccuuggaaccagaguuacagacaguugugagcugccaugugugugcugggaaucaaacgcagaccauccccaaaagcagcucuuaacugcucagccaccuccaucaccaucacccgaccucucuuaagacagacagacuuaaacgagcagggucaucucucagaauacaguuuucaauguaugccagaauguuuuggauuuguaauagauaauccauagggcugauacaguuguccccaauugguccagaaucagaacuuauccuacucucaaccacacaucugcaguaacaaaguccaaaagugcucaaaguuucuuauaugaauagcacaaaaugugcauaugaucugcacacaucuucuuauauacuuuaaucugcucaguguagguuaaacacuaugucaguacaugguauaccuuauuauuuagggagcacaggcaaaaacaaaacaaaacaaaaacaaaggcuguauguguuaaaugcagaggcaagcuugccuuccaaauacuugcaaucucaacuugauaaagucuagaggagcagaaaccauaaauacugagacuuacuacacaaaaauccuuuuuauuagaaaaugcaguuuuagccaggcaguggugccuuuaaucccagcacucaggaggcagagacagguggauuucugaguucaaggccagccuggucuacaagugaguuccaggacagccagagcuacacagagaaacccugucucaaaaaaccaaaaaaaaaaaaaaaaagaagaagaaagaagaagaagaaaguagaaagaagaaagaagaaagaagaaggagaaggaagaaggagaugaagaagaaggaggaggaagaggaagaggaagaagaagaggaggaggaagaggaaaggaaaggaaagaaaagaaaauaaaauacaauuuuagaaacaaacaauucagaaauaaaccuuuggagcaaaagaauguuuuuuaaaaaguugucuccccacucgggaggcagaggcaggcggauuucugaguucgaggccugccuggucuacaaagugaguuccaggacaaccagggcuacacagagaaacccugucucgaaaaaaaccaaaaaaaaaaaaaaaaaaguugucucccgaagcacuuuuaagcuagacacuuuuguacauuuacuuaagacaauauuagauguauuuucauacuuugaacugaccugccuugguucuuacaugaaacaaucacaacuguuucucuuuccagucuuaaucuaaaagaaacuacaauaucuaucuacucaauauuaaugcaucacuauauuucugagucccuucugggcguccccuuugccccaacaaugccucuauguaguaagaagagucaaaaaugcaaaauccaaaaaguacccaaugcucagaguccagaucaaguguagaagaugagcggggaggggacugaaguccaggggccacgucagagaaaaugcuucaagugugacgaaugcagacagcaacaguagaaaccaaaucacgauuaggaagaagccuggugaacucagagagcagaaaggcaaaaaggucaauguguucccaacggaggacaugagagagagccggagcuaaggcaggaaccgccagaggcgagccuggagagcaggauccaccagcaugcagcgaaaggcaaaggaggcaaacagaauggaugugcucagcaagccacccacggcuuccuuagacucgcaggccuaaagugucugucuguccuugcugcugcugacgauaggcaugucccugcuuugggguuaaugagaccucuguguucuagauggaagaugucaccagauuuuucuuucugcuuuccuauaaugaggaucagcaagccagaaguuuaaugugguaaguuagugaguuacugagucuuaacuaauugacuaauauuugucaaucugaugcccucaacuuucuacucccucaaaccaaagagagccaguuguccccaacugauggucacaggucucccuucuucauucaaucauuaacaaauccuuccaugcuggcauugugcugaguaggaaggaaacaauggugaguuaacaccugccaaccuccugcucauuaagccaucuaugaggaaccucuguccccacugccuaacauacaaaaaaaaaaacccaaaaaccuuaaaaaugugauguuccaggucugaccucacugcaaagugugaagaaccauaugcuuuucccugcaucuaucccuuggcccagguaacuuacucauguuacaucauacaugggaugauguaggauuccauggugauguugcuaaucugagagaacaaauuagaacguucuaggauguacugcuauguuccagaguccuaagcacagugaucuuucaucagggcugcagucaggcccaggagagacgagaaaacaacacaaaagagguccccuuccccgcugucaggcccaggaaggaagccauaccucacaccagaaccagcaccuaaaggugccgauuuguauuuguacugcagccucuacgcuuccccaggaucagccaggccucaagucugucuccacuuuccucccuacaagacuccuggggcuggaauuuagugagcccuuacuggccggugugucaaucaagagcagguuuaaggcauguacuccucugucuggugucuuccccaggcuaggagacacagaaaagggagggcuaugaacaaaugagcaaagguccagcuucaacugccaaaaggucugagacacaaagggauagaugaagaguacguggauuccuggaagugcagaaagaguucaugggaaguagagaacucaagaugccauuaucccagagugaagcagacaaagggagaaauagguccuuguauuaggagccauggcagagacagaggaauccaugaaauaacgucaucaaagcagaaaggaauuccagaaguaauguguccacaaaccaagaugacugaacuuuuucaaucuaucguaccugaugcucuuauccacuccacugcccuaacgccugaaauagcaaggcaaucucuacuacacccacacaugcacagugagugucccaugagccaaugaaguagggcgggucugaccagucugcagcacccaggcugacacacacacacacacaagauccugccccacggaagacaaggucuaaauugauacuuuaauuuuaaacuauuuuuaucaagggcagcaaacaaagucuacagacacauugucagauggaguuugcuuggucuacugugugcuuuaaagagaaaaagagaaacaaacaaaaaucccacaauucuguggggggaaaaaaagguugccaucuugcucuggccggugacaacagcaggcauagccucuguguucuuccuccucuggaucaaggagucuaucacaaggcagguuuucaugcugcugcuucuccuaagccuccauccuuccagccagucagugucuucuucaucuuuccaaguucaguuugaaucccagcuuacucauaaagagaaacaacucacugugacuacuccuuuugaguuuccaucacuuuucuaucguagacacacaggacacaagggccauggagaagcugucagcagcacaacuguaccagaacaagcaaaggucugaguucacauccaccaugacauguaacaaaaggcauuagaggguagcaagacagcucagcagggaaagcucuugucaugcaaacauguccugaguucaaaccccagacucuacaguggaaagaaaucagacuccucagaguuauccuccaacuaccuguugcacgcauaccuccccaagcacacaguauacaccuacacauaguaacaauaaagauuguuguugucaacaacaagguacuaggaagcagaaccacaauguagcugcugcuggcugaaguagcagcaauaaucuacaguguucccacuucccaggugcagcccagaggcuucgcuuacccauuuaccaugacuguaaccaccggccuaaccuuuaccuaucaggaugcaagccugucagucacagagggagugaugcucacaguugagcauggggaaugaaucaaggaccauaaagcuaaggcagucaaacagcccuaagucuugucuaccauaauccaugcccaaacaacacaaaaaagcaaagccuuccaauuauuuaaagaaauacaauccaaguuguuuuuuuuucaauuuucagauaaucuaaucauuucauuaaaaaaaaucacacccauguuuauaaagauuauuauauaucuagcagaauacuagauuuaaaaggagauuuaggugccauuauuagaauacaaauuucuuaagauaauauuuauugagaucuaaaucauaacaacuaggaguaccuuauggaagucuuuuuaaaucugaaaauuuaaauuuguaucuauaauuauaaacacuucuuugcuccauaauuagcauaugcugaaacagucuauuuuuagggucagaaaaaaaggaagaagauaaugaaaaugaaaucaagaagucgccacaguguuaaccaccugguagaaucauaccuuugaacggagugggccaaacucagacagucuuuaaaacauaaaaaaauuaaaaauaaaaaaauaaaccucugcaaagaaaaugcagccacuaagcagcaacaacccggauggaugaccaagucaugggaagauaaacacaggauguacuccgugggacugcauagcuaugacacuagagaacaggacaguagagacaccaaguucgucagcagcugccucuugugaaggacuaaucagcaagggaagccugggacauugcaaugucccacagccagcaaauggccauaucuccuugagugcagaugugugucaaauggguacaccaugaggcacacaaaucacaccucagggguuaaaaaaucuagaaaaaaacuggccuaggagucucauuuaauaucaaacaacuuaaaauuuaagcucagagauaaacagcugagguaaaauguuaacaagauacucagaaaagagaaaaccagaaaugacauacaacuacaauggcaagcuaaggcaaacaacaagaguuuaccuaacagcagaaaaacaguagcccagagggcagaguucagcagcccuacaucuuaacaagaacuaaaaugaugggaaaauacuuaaaacaugaagagggaaaagaaaccaugaaccagugucaaacuguaaaaauaccacgacuggaauaaacacagugucuauaguauuaaaaaagaaaggaaaagaaaacccaaguauguucauuuaacaccucuuugcagcaaacacuaaaccgggcuggagcuggcucuggacgccagcguccccagcaggaggcucggaagcaucuguagcuccagcugcaaggccuccagggcaucuacauacagacacaugcacacacauacaaacaauauuuuuuuuuuuugagacaggguuucucuguauagcccuggcaguccuggaacucacuuuguagaccaggcuggccucgaacucagagauccaccugccacugccucccgagugcugggauuaaaggcgugcgccaccaugccuggcuacaauaaauauuuuuaaacguaugaaacuaagauagaguuuuaaauacuuucuauuuacagauagaaaggccaacuuacaaacacaugaaaaucuagcuaaccucauaauuaauaauccuaaauauuuauuaaucauuaaagcaaaaugaaccuuuaagucaucagacuuaaagaacaggaauaucaguauaacagaacagaauguaucauuuuaauuaauauuuauuaacacaauucaaacauuccuauacucagaacugucccaaacucccccaucccucaagcaaacucuccuccgaucuuuaacaaggcccaugaaacugaccuuguaccucuuugccuggcuucauguggccucaggaccagccucuccuucccuaccacagccccucucuucacacucucugccagcugacagcugcuacugguaaaauggcuauuauagaagguugcauucacuauuucacauaagcaauauggauuaauggcucugauuuuuaaaaauauaaggacuggguauggugguacacaucuuuaaucccaccacuugggaggcagaggcagagggaucucugugaguucaagacuggucuggucuauauaguaaguucuaggacaaccaaugcuauguagagaaacuuuuugccaaaauuaaaaaauaauaaauaaauaaacacccagaaaacaaacauauauacgaauauucauacauaauaagcaaauuuuacuggcuuuucaugagaagaaauauaaauaagcaaauccacgucuauacuuuacccauuugcaauaaaauauaaugaagcacggcccugcccuuugcacacuguguuucuuucagucugcccauuacuuccuuuccuguauuguugugcaccuggauucuggcugugucccaccuugguucugagaucaguggcuguguaacacagagcacuuccucuagcccucccugccacuccuccucacagggacucgcugcuucacagcacuuucacuauccucuggaaccagccuugccugcuuuucugagcaucaagacugcagagccucauccacgugguucucugcaguguccaugacaugcugggagggguucugugcaugggaacaaauaaacacccaggacagcagagcuacgagaacugcagauggauuacaacggugcucacaagcuucuuuccuuguuuuacuggucuuuaaaacuagcacagaaagcaaaacuccccugcuacugguuaauggcaguaguaacacaggccacugcuuagaacagagagcuguugugacuauaguuccuauacugccagaaaagauuccagggggggaaacuauguaacucaggaaauuaguaauaaagguagucccaggaaauccucauagcuguccucaaauacuuugguuuuucucugcuaccagaugggaucacaccccaccaccacauuaauuuuaaaugacauaugccaacgugaguguggccaauuaaugucacauaccaaaaguccacgaucccuuguuccuguguaacuacaauaggacagcaccacgacaauccagagugugcagcaaagaccagggaauaagcuggggcuguguuaagccacugagcugggcagcuguuugccacuucugcaaaccugaguauaccugggcugcuacagugagaggcuuuauacaucugacugcugcugacugcaaagcuccuuuuuucacucuggaaugaccaucucuugguccuaaagucuuccaucacaaagugggaauucuaaugccugcauuucauagguuguuuuuauaagaggagaauauauauacuuaacaaagagcuuggcaacugugcuaagaacucaacagauacaaaauggaauuaaacuguagcauaucuaagcuaggcuacuuugagccuauuuacauugugccacuaaauaaccuaggaaacaggaaaauaucacagagaugaucucuaauucacaauagucuaagauacaaaagaaaaaaguuguaauugcguuggcuuuaccuugaguuuaguaggauguaaucacauuguaagucuaggagcaacuguauuggguuaguguggaauaguagugaggaaacaaaggauagcuaugaccuaaaaacagaaaauacaacaugagggcaaaggugacuccgacugccagcuaggcacggcagugaggaggaacaaggacucaccugcauagcaaacuaugcucccucuugggaggagagagacagcaagugaguggguacugagugacaaacaggggagagaaggaaaaacaaagaacucauguucuggggguguauggagccccagaaauggcugcagagggagagccuaacaagcuaccucuggagggggaacuugggacacgcccacacagaagagggguguguucaacacgggcaugcuuugagagcuaucaccccuccuagaggauucucauaagcaacaugacccgacccagaucauccccgugccucaacuggcucauucaugggaaagaaaagagucugugcuagugucucagagaccacagccaucauaggacagcgcuaccugcuaagccgcaaccgagagaugcuaaucauuuccuggagagaaaauuccacccaaccaagaauaacuucacgauuuuaauuauaaguuaguuuuacucaaguucaaacuuuuucuacccgaauugugucauguaguuauuuagaaauuuuuaguacaaucugacugacaacaagagugauaagugcaggaacaaaacuauaaacuacucugaauuuuuuuaauuacaagaacaauuguggaugaauguaguguuccaauuuaauaaagaaauuugaaaguacuaaaaguuuuagucagaaaaaguuaaacagucuuauauucaaaauaaaacuuuccuuauugucagagcauuucaaucacacacgagucagacaugcgcugcuuguuagagcacuuacuuuccuccugauccuuggcgucaaaggaagcccugcacaaaucuaagacuaagccuugucacagguaacaugagauugcuagagagccaaaagcugcaaggguuaguaugacaccucuccugaaauagcaugcacacuuuuuguuugacacaacugggauguacguuaaagcagaaguauaaaauaucagaaacuaauaaagucuaaacacacuugguucguauagacucaguaggacaugagaaucaauggacaguuaagccuaagcuuaccgucagcuccucagauaaaugagcacagaauaccacaccaagaacaaagucugcauucaaauuccacuuugggaagucaccaucacuccgcccagaacugacuccucuaacgagccccagacgcugaaaagccaaagcugaugaccagguucacauuaagaaucaaucuuaaguuaggaaaauaaaugaaaugcauacauaaauauaccucugauggaugauccccaaaaacacauucugcuuuuuuccuaacugcucaccauuucaacuauaagcugccuucaaaagcacgucaguaaaucuucaccuauuacuguaauggagaccaugugcccaugugcucgccagauuccuguuuaugagguacauacaguccuguguauuaaaauaaacuuaucauugauaaugaaagcaaugaaaagaaaucaaaaugacccacuccaacaauucaucucucucaacgcaacaugggacagaauuuauuaaacuucaucaccucauggaauuaugcuugggcuuucuaguuagaaacaccuggaaaugauuuuuuuuuaaguaucuaaaguuucaauugauaagauacaaaauguuuucaagucuuaaaugguuuaagcuaugaaguaauauauauauauauauauauauauauauauauauacacuuuauauuuuuauuuuucacaucuuuuaaaaauuugcuuauaaaaaauuuuaggauaauguuucugacauccauauuggauuucuuuuuuuguuuguuuauuuguuugguugguuugguuuuuuugagacagggucucucuauucuguagcucugguuguccuggaacuagcccuguacaccaggcuagccucaaauucacagagaccuaacugccucuaccucccaaaugcugggauucaaggcaugcuuacaaaaacuuuuaggagauuguuucugacauccaugucuguaacuaugagaaugagacaaaaaauaagaaaauugcucuagaaugcauuaaaaucacauagcuaauaccacugaggcuacguuacagaaauaucccauagcagaauaguuuaaucuccugguaaacacacauccuccugcaaaagaaaacaucuuacauuucaguaucugcauucugugcuuuauacaaagaacuuucaagaacaagauacuugaaaguuuguuugagcauuagugucucuaaaauugauuuuuaaucucaguaaauuacaaaauaaaaaguucagagaacaaaagauugauauguaacaaacaaacaaacacaaaaacccuaauucuaagugcggcaaaagaggaguuaacaaaggaaaucugagcuaaaguuccugaguuagucucccucaggauccaaagaaacaccaacacacuucaaguaaugcgcaugcuacaccacacacaacucacacuacgcaaacaaaggcagggggguaacgguguuaggaaacaaaagcaaacauacaggaggaacgaaugaaggagugugccuguguugcuaucuuuaaaaaucaauagcuuaccuaacaucuaggucaugaauuuguauaaauuuuuauuuuuaaacucaccugaugcauuuucaauuccuguuguguucuguaaagauacacacaacaaagaaacuucuuugauuacaugagcccuaaaaagaaaaacagacaauuguaauauucaccugccuauaaguuuacagugauuuaaaaccacauaugaacuacagaaugugcugcaagggcuauucauaauccaugccaguuaagcucaguccacacugacaacuaacgucucagauucauuauaacaauagauaaaugcccuucucgcuaaaccuuacuaggauuucaguguacucuaucaucaaagcaguaucaucaggaugacauauuuuuuuuauuaagaauuauaucacuccuuaggagaaaucaauuagcuguguuaauagucagaaacacaaagccugaaggagggaguaaguggugugcaaugaagauaaccuucuuuugcuuucaguauuugcuacaugcaaacacaauuagacuccauuacucuguuuuucaagcuccugaagcaguaagguggauugacuacauggaauucucuucaaagggaagaauaaaaagcagacaguaccaugcaaaggcuuuuuuaaaaaggucuggaaagagcuacaauuauaucucuagaguguuacguuugacauagucagacaugacaacgaaaguucuuguaaauacauauggcauacagucauauaccucauaacaauaaugcaaucaaccacugaccacauauacagugaggagccuaugagauuguuuuguugugucgugguguagcacuggucucagcaaugguguaccaguacauacugacaugcagaaacaaaacugcccaugauacauugucagaacauucccuuaagucacuuaugucacuguauccauuucuaaauaauaaucuacuagagagguauggugucacauugugauuccagcgcuuagagacaggaagauucagaguuuaaggucagccugagcuauguagcacuguuaucuuuaaagucaaugcagggcuggagagauggcucagugguuaagagcaucgacuacucucccagaggaccuggguuacauuccuagcaaccacaugguggcucacaaccauguauaaugggaucuaauguccucuucuggcacacaggugcacaugcagaaagcacauauguguguguguguguguguguguguguguguguguucauauacauauauguguguguguguguauauauauacaucgccuacaggguaacuguccgaugugacuauaaauaacgcaggggcgugugauauaaugauacacauuuuagacgggaaggguaagaaggaacagugcuuugauaagcuguguguguguguauauauauauauauauauauauauauauauauauauauauuuuuuuuuaaaguugauacaguuguuucuauauaauauaugccauuauaggcaugaugguucauaccuguaaucccagcauuuaaaaaguuaaaucaagaguucaagguuauccugaguuacaugagacagcauccaaaaaauaaaaauaaauuaauuuaauuaagaauuaaaaaaauaauuaaaaaauguaaagcuacaacauguuuuaagugaauuuaugauucuuauauacaaauuauaacuauucaguagacucuccacuguagcacuguaaaugucuccaguaagcacauauaaacauaccaugaaguauaagagaccaagacacaggauuuuucccuguccaauuacauuacuuccuugaucuaggagacaucgccuacaggguaacuguccgaugugacuauaaauaacgcaggggcgugugauauaaugauacacauuuuagacgggaaggguaagaaggaacagugcuuugauaagcuguguucuuagcuaguucuaaggggaguugccuuucuguucuucccugagcuguugggaaccaucauggauggcuuuuuuuuuuuuuuuuuuuuuuuuugguguuuuugagacaggguuucucuguguaguccuggcuauccuggaacucacuuuguagaccaggcuggccucgaacucagaaauccgccugccucugccucccgagugcugggauuaaaggcgugcgccaccacgcccggcucauggauggcuuuuaacaagcaaggucuuauaguuaaaucuggacaugcucaucugaacuaaguuuuauguuuacugugcccgaggaauguauuccacagcaugccaucuuguuacaugggucaguucugguuauauucaauagauaaaaugugaagguaacuuaaacaucuuucucauagauauucaauaagaccuucccuaggauauguauaaugcaguaaacacaacugccccuauagccugagacuuaaucuguuauccuauuugaauguggcucugggguaugaagaaguccuaaggcccauggucucuuagauaugcauaccugaggucacuggcuacuaucaguuccucuaggacugugugacaucuuaggcuccaguuuucuguuaccuucuucaagcuuuuacauaugaguuuauaaauucugccaugggaacuucuuugaaaaaugagaaaaauacuaccaccaacuacaguauuuugcugagagauauuggaagguaagacaccugugccauuuuccuuagugucacuuuucauucuccuaagacucaacagcaucacuguaacuaucacaaaugaagcuucuuccagggacagcaggccugugccaucuucacacgcuuccuuuguucugagggaagcauuggcgucuucagcuucaggcagaauuagaaaaccuggccauuguguacaaaccugcuuccugcuauuaguuaauuguguggugcugcuguuugauuuuguuuggguuuaugcugcuguaauuuaacagauuuccugggcuauucccgugucaugugacugacuccauugaaauguacaguucaagaguauuuauggacugagagaugauggcucacuuguugcucuugcaaaagauucagguuccauucccuauaccuaaaaguggcucacaaccuucuauaacuccagaucuaagaaauucaauacccucuucugaccucuguagacaaccagacaugcacauacacauacauguauauauguacauagacauacaugcaggcaaaacacucaucauccacauaaaaugaaauaaauuuuuaaaaaagauuuaguuuauguauaugaguacacuguagcugucuucagacaccccagaagagggcauuggaucccauuacagaugguugugagccaccacgugguugcuggaaccucuggaagagcaguuagugcucuuaaccacggagccauaaaucuuaaagagaguauuugccauacuuauagaguagugcaacugucaccacaauccacagauguuuuugucaacacacacacacacaaaaccuuagcagugacaacaccugccccaacuccuccugcgcagccugcagcaucagcaacaacugacaacuuccugucauauauaguuaucaguucugaacauugcacuucgucaaucaagagaagucauggcaaugaaugaccuuaaugggcuuuaguuuacauuccagaaauuagacagcacuuaguuccacacaagcagguaaguggcccuucaccugcgcacuacuccuuccauccugagcacuagugggccacaaacaggaaguucccugaccucuagagaaggggcccgcaaugagcaaauaccugaaauguggagaaagugcuauacagaaaagcagagaaaggucugcaucacaaucugccuguccccacacaggcaacugcugccaauccaacaagcugcucuggagacaggaagaagagcugggaccugagaaggugugggaagaaagaggaagaacacaagagacuccagaauaugagcucgaagucuacaccaagguggucacuacuugcagguggcagugucaggggcaaagacagugcagagugcugguuauggcauggugaaaaagaaggaagaagugacuggguccuggauaaguuuaccaacgagccuguaacuuuagcugccugguuagagaugaguuaggaaagaaaaagcaaguggagaugaaccuggguccccacguuccguucccagaagggagaauguggcugcugcuugcaggggugcugcccuccccuugugucuggguugcaguugguuuccccucuuuauuucacauuugucuucuuuccuuuccuuacccuuuguaguuguuaacccacaggcacaauucaaauagcagaauuaucugcuaucugacacuggacagauaaaacaguacaguguuuaaaacauuucuuuuugaugcauuuagcuuaauaaauggcaauuuuuuuucuaauuuaaaaaaaaccuaccguguaauaugaguugguacacgaugaagcacagucuaagacuuccuauaccucccccuccauguccaaacaaaaacccauucaucauuucuuguuggaaaaaauaaggaucuuaaccuuuucuuuccucuuuucuuugcuucucuuucuuucuuccuuccuuuuuuuuuuuuuuuuuuuuuuuuuuuuuuuuuuuuuuugguuuuucaagacagaguuaguccuggacgucccaagugcuggggcuaaacguguguaccaccacaccacaccacuggcuuauacuuucacuuuuuuuguuguuguuguuguuuuuuuguuuguuuuguuuuguuuuguuuuucgagacaggguuucuguguagcccuggcuguccuggaauucacucuguagaccaggcugaccucaaacucagaaaucugccugccucugccucucaaguacugggauuaaagacguacgccaccacuaccuggcucacuuuuuuaaaaaaauauuucuuuuuaaaugaguacacuauagcugucuucagacacaccagaacaggguauuggaucccauuacagaugguugugagccaccaugugguugcugggaauugaacucaggaccucuggaaaagcugucaguguucuuacuuaaccccugagccaucucuccagccccacacuuucuuuuaaaaguucacuacauagucauguuuacuggacccucuucucuguuacuucuaauccuaaccauuagaaaacucaucuuuguagguaagggcacuugcugccaagccugauagccugaguucaauccccagaacacaagugaauagaaagaaccaauucucucaguuguuuugaccuacacagacacacagacacagauacacacauagacacacacagggggagggggaggggguacucaugcacccauacauaaauauucacaaauacaauaaauaaaucuaccuuuaaaaaaauauuuccaaauaacagaauuauuacaaaaccaauaguucuuagcugauuuuuuagcauguguacaugcauaguauauacaagcaugugcacacacauguucacaugugaggagcacaccaguauguaagugucuauaaacuugugugaacacacacauggaggucaacagguugacauaugaugccuuccuuaguggcucuccacuuuauuuacugagugaggauuucucacugggcccagaacuugguaaaucagcuagucuaaguaucuggccugcccugggauccugcgagcacuuccugagggcugagauuacagagaggcgagccacuauuuuuauauuggugcugggaaucugaacuccagcccuuacacuuuugcagaaagugcuuuuuauccacggaggcaucuccccagucuuccuuuaaaguaugcuaaaguaaagccauguaugguagugugugccugucacccuagcuacucaggauagcaagaucacccuugagucuaggaguucaagacaagcuagaacaaccuagcaagacccuaucuguaacaccaacaccaacaacaaaaacaacgggaaacuguacugaacugaacagcuccuagccugagacugugucuuucauuaugggcauuuagcacuacccuaggccaucaaugccagcagugccucaaucauuuucacaacugaaaacaaaacaaacaaacaaacaaaaaaacccaaaaaacuaaauaccuuccuaaacacacgcucaggggcucagaauaaucacgugacuaguauaauaacaucacaugugcuaccuauagcaaugacacacugcaaacacuauucugaaguauccuucuuaaggguccaccagcacugcucacaagcccuaaggcccuggcgguacucugaguuaacacuggcuaagacagcaucacuuucacauucccacuuagcuaguguauggcaucucaaagccaaaguaauccacaagagauccgcaauggauccuaucaggacagagaagaaucuucucacacagaucaucaaaaccauuccagcaaaugcuuuuuauaauuuuuuuaagauuuacuuaugggggcugguuggcucagugguuaagagcacugacugcuccuccaaagguccugaguucaaaucccagcaaccacaugguggcuuacaaucaccaguaaugagaucugauguccucuucucgugagucugaagucagcuacaguguacuuacauauaauaauaaauaaaaucuuuuaaaaaaaaagauuuacuuauaugugagacuguuucaccugaaugcaauguaugacugccacaugacugccuggcacccacagaggucagaagcaggcaccggauugccuacaaguauaguuacagaugguugugagcaccaugugaguacugggaaccaaacuccaguccuuugcaagaacaagugcgcuuaacugcugagccaucucuccagggcaucaaauucuuuuuuaauacuaaaaauucagugcuucugauuuucuauuuacuagcaaauacugaaaauagguagaaagggaacaguaagcagauacauaagcuuugaaccugucaaucucagucaucaguuguucacaaauagcauagaagcuugaaauggcacaagcuucaacaccaccauagguuucuaaaguucuaaccacaugcacacacuuacucuuuuuagauauacuuauuucauucuauguauacggguguucugucugaacguauguauauaccauguaggugucugguguucacagagauuagaaaagugucagaucccuuaaaauuggaguuagggguggcuguaagccaaaucuggguccucuccaaaugcaauaagugaucuugaucacuaacccuuuucuccagcaaucuuuuuuuuuuaaauagugucuaaccuaugcuaacaguucugaucccccuaacucugacuucugaguguugggauuacaggaguguacugccauuaguaguuuauagugcuagggagaaaacccagagcuuuugccaugcuaggcaaagucugggaacuuggcagcauucagcuguccuuuucaaagauauuguuuucaaauucugcaacaaucauccuuaccaauauuaaccuguuaauauaagggugacuugauuacugaaggucaguaccaaaaaaacaaugaaaaacgacucaguucucaguaucaaaacaaucugaacaacuaaaaagaugcuccaaagaccugacaauggagcugaguggcuaucuugacccugggugugcacagucaccauccacucaccauccucugaaauuagaccaaucuaggggaagacacacuagcacaaaccaaacagauguggcugguuaugcugucuuugugcacaugugcaaacuugggacuuuuacaaagcuaagggaaaagcaauuauuuuuaaaguaccaguuuaugucuaggagaaaggaagaaugaugaaaauauuuaauauauucaaccauaaaucacucagcuauuuuuaagaccagcuuagaucucuuguucuuauuugaaaaauacuguaauuaacuucaaacuguuauuuuaaaauuacauuaauuuauuguaugcauguguauauguauguaaauauguguuugccacuaugcguguguaggggucagaggacaaccugcaagagucaguugauucucuccuuccauaaaguuccaggaaccaaacuuuuguugcccaagauaauggcaaaugcccuuacuugcuaagcuaucucucuggccuaaaagucauuccugccacacguguaccaccaaguagacaauuacuauauauguuacagagcucugaggucaacagcccauggcucuagagggccuuaagcaauuaaacaccaucauauuaaaauguccaguaggagaccagcugauaucauaggaaaguacuauaaaucugcacuuagacugcgggcacccagggguuuuccaaccaaauggaauuuuuuucuaacuuuaaaacaaugguucuugaccugugggucacgaccccuugaggguugaauaacccuuucacagaggucaccuaagaccaauggaaaauacagauauuaaauuacaauuacaauuauggaaugcagcaaacaauuuuauggcuggggucacugcaacacuaaacuguuguaaaggaccacacacugacaaagcugagaaccacuaccugaaaacaaaaugggcuggggaucacucaaucgauaaagugcuuguugcugcauaagcauggggaccugaacucaaucacccuuguuuaaaaagaaaaaacaaaagcccagugccacagugcacacacauacaauccagugcugauacagugccacagugcacaugcauacaauccagugcugauacagugccacagugcacaugccuacaauccagugccgauacagugccacagugcacaugccuacaauccagugcugauacagugccacagugcacaugccuacaauccagugccgauacagugucacagugcacaugccuacaacccagugccaauacagugccacagugcacaugccuacaauccagugccaauacagugccacagugaacaugccuauaauccagugcugauacagugucacagugcacaugccuacaauccagugcugauacagugucacagugcacaugccuacaauccagugcugauacagugucacagugcacaugccuacaauccagugcugauacagugccacagugcacaugcacccacuugaaugcaccuaugagugcaaacaugcacaugcacacacaugcgcguacacacacacaaucaauccaucaaucaauauaaaaacaauuaaugggaaauucuucauaaaacauuacucccaagcuggggauggagcucggugggagaguacuuaccuaagaaguaugaaauaaugaguucgauccccagcacugcaaggggaagaagaguuccuagcauccguuaauagaaaaggaagagccugccuuuucuagaagcacugcaguuguggcugccauguccuauacgcguuggguggcagagaggacagaagcuaugucuaugcucaguguucugacugaugaauaucuaaaugauuaguagccuaaaauuccuugaagaaaggcaaaccugagaggaccaccggucuagcacugcacaggccuugauggcucccaggacacagagcaagccagugacuagaaaaacccugcccugggucugaggcccugggugguaaugagccccagaucccucacaugugaucacuugaggucacugggcauggagucaggcaggcagagcaaggaacaaaccugagaugaucgccagaccggcgccauggggccuggacagggaucuagccuugaacaaccaccaguugggcacugcacaggccuggagguaggggggaugacaccaugcccaacaugaccccuguccaacacuauaauucauaagucaggcacuccugagcuaacccuagacacucagagagcccaggcaccaccaagagaagcaagugguggagaaagggaagagaaaaagaaacagaaggaugugggcacaugaagagaggcagauuuagagaccugaagauaccugaugugaauagcuggugauaccaccuaggaccauggugggguccuagccuguucugccacuggagagaccaggccugggaucuauuaccgcccucuuccuucaucucuugccaucuacgacaggcacaagagcuggccccagggucgugagagucggagaacugaccaugccccucaccaacugcagcacucagaagagugggcccuguaucucgccaggcagcaggauagagcuggcccugguugggggugaggagguguugcuggugacccagacccaaaggcaugagggcaugagagcaggagagcuggugggcuaaccagcucggauacuuguccagguaucuuugaauuguaucuuugaauuggcccaccucaacaucuaucccauggaugagugcaugaaggggccaauccuacagauccaaaacuauacaaucuccaugaccagggcaacaacaggauauccaacaggaguaauagcagggcuccaguaucaaguagaguagcaaaagcuagaggccacauacaagccaucacaaugaacaugugcaagcaaggaaguguggaccaagggggauacugugggacacacugugacacacuacagcuuccaucagacuuuuuuccucuguugcgggggagagguugccagggugaagagcggguauggggagacugggaugcauggugugaaauucacaaagaaccaauaaaaaguuaaaaaaaaaaaaaaaagaaagaaagaaagaaaagaggaaaaggaaguaaaaucaacucuucacuaauccucaaaauccagccucaagaagaacgucuaaagcaaggagugauguuaaugcucauuccacaguuaccuacaaagauuuaguugaucacuuugagugaccuuuucccaucagaguucccaaaacagcacuacuuuugugguucgacucugagaaauauucaggauucuugccuaagcguuuccugaaaagcaaaaaaaaaaaaaaaaccuacagcaacacagacauggugaacaugauccacauaaguuucauuuggucaugcuucaaacacuacaugcagcccuucagauuuguccaacauacugcagaaugcaagacagcucaucuuggacauaacucacaccugugaugggcuucccuacacuauaggugaacagcugagaacugcagccgacaccagacacaucaccacuggcacugugcuugcucaagguacuggccacguggacaccacaagguucaccuaccacuuuagugacuagauuuuuuuauuuggagugggaguuaacuuguauaaucugagguuuguauuuaggcaauaaauguguaacaacuguucucaagaccacuuacacacaguaacaguaccuacuguuuacaaaguguauacacugcucuacaguuuuaaaaagcccuugaaugcauuguuguuguuguuguuguguuuaagaaagacgcauuucuucaaaauaacuuauuuguaauucucaauucaacauaaaagcaaaugucuaggaauuuaugauaaaaacaugaaaaaagucucuucauauugguccacuauuuucaauaaaauaguauccccgaugcaagggucuagaaaguaagaacaaaacagguagggacaguucuaggggccuuuggaucucagguuaaaucugacuuugaccuugugguaaguguccuaguuugcuuucugaugaccaaacuuggggaggaaaagauucauuccaccuuacagcacacaguccaucaccaaggaaagucaggacaggaacuuaaacagagauuguggaggcaugcuauuuacuggcuugcucauuuuggacuaccuguccaaggcuggcacuauccacaguguacuggcccucccacaucaaucaguaaucaaauaaauguuccacaaacauaccugcaggacaaccugguagaggcacuuuuuugauuaagagucucucuucccagaugcccuuagcuucugucaaauugacaaaaaaaacaagcagcaccauagaacucaucagagaguguugcccucugccugcucccaagcccuggagauccaucuguaggcuaagucagaggugggaaugcugaaaagcagagccagcaucaccuacaggacaaauggcuugggacagccauaaggaaggucuuauccaccugggaggaucaacaaagacuuucuggcugaggauaaacccuaaacaaaauaaagccucauauauaaggaaaauguaagcaaggaaccccaagcuaauaagcaauuagagccguuuuaaaccauggaagguaacuaccaaggagggccauaaaaacaucuacaaagcaagcagccaggaacagggaugggacugggguggcaugugggauccaugcuggcaucugaugcucagaaggcaaacauccccaaaaaaagccacauccaucaaaggggaaaacugguccccacacagaagggcauggaggucagagauagagaugcagacauuuuuagucucccuaggguaccugaaggaagagaacugccaagaggagaaauaugucuauaguaaguagaugcaggacuugaaaucgugaaacugaauggaggagucaccucacacuauauccagagagggaaauauccuaacaaggucuaaggacaauucucucaacaacagauaaucucucucaagaccugcugugcuggaaauaucuaaggaaauguuaguuuuucaaaaauauuaaacuacuugcgggcuggagagauggcucaguggugaagagcacugacugcucuuccagagguccugaguucaauucccagcaaccacaugguggcucgcaaccaucuguaauaguguccgaugcacucuucugcugugugucuaaagucagcuacaguauacucacauuaaauaaauaauuuuuuuuuaaaaacuacuugcauuuuuaaaauuuccuaaaucauauaguacguguacgugugugugugugugugugugugugugugugugugugugugugugaaggcaucucaggucaaaggaacaaaucuuggguuauucucuuuccuucugcuggauccuggagagccuuaacauacuaaccuaucuugcuggccuugcuugcauauucuuuaccuugucagcucaaaauaccccagugaaaggcaaaaguaguauuuguccccaguuugcaaacauuaagaggucagaagaaaugcuaccuacaucccccucacacaccaccaccaccaccacacagagcuauguggucccaugauccugucauucuguaugcugagguaggguucugcuaaguaacacagggcuauacgcaaacacugccuccaugucuucuaacauaaguacacaucuacauuuaucccaagagccuucauuucaaaaccucuacuugcaaguguaucuuaaagccaacauuugcugaauuauggcaaagucuuuaagucagaaaaucaaucugagugucauuuguaugcuuaacauacauagucugaauaaggucuugaaaaauauacaggauucaugcugaaguauguacagguuuggagaaaucucacaguccuuuucaaauuuugaaugcaucauuuaaauuucccaugagaguuuaagaaaaucuuagaaaaacuacauguagguacauauaaaauauguagguuuuaccaauuuccagaugggcugcccacagcaaucaagcuaacauuuccacuuaacuuuacacauuucagacaagcugugccaagaaauaauucagcucuuucaaagcaaagccuaacauguaauuuguuuuuucaccaaaauagcugaaaaauauagacagauucagugaaccuuuuuucccauguucuaaggggcuaguaaguaagaacacaguguaaacaggacauggaccaagaugccacuaguaaauacuacacggaauuaagggaacacacacaugcuuauaccauugcaauuaccagguuuacuauacacaagggcucugugcacgcuccagggaggugagguagaaaggaaaagcauuccuuuauugcacugaaaucauuuagauauuccuguaaguaaaaccacucguuaccaaauauggcuccaauagcagauuuuuuucacauguuguauuuaauggugcauucucaauaguauuucacagccaaaacaaacaaacaaacaagcaaacagauaggaaccacagccaauaccaucucuacuuagaauaauuagaaauaaagauuaggagacauauuuucucccccagcagaaaguacuucaaugacauguuuuccaugaagaugcauuaaacuaaacauuucaaaaguaagccuucuuuccuuaggacaaguuuagugcauaaacccaacugguucuuuuugggguuuuuuuuguuugcuuguuuuaaaaaaagaaggaaaaaaguaguuuagaaaaguacaguuuagccaaucuucaaggaguugcuucaagucucauuuucuggaagaguuauuucugugcuauucagcaucauggaccaaauaauuaaauuaugcaucuacucuaugcaaauguauuuaaauuuuauaauaauuuaaucugcauacugggaaugcugaucccaugucaugaaaacgucauaaucuccagccuaccucacacugccauguuucuucccauaaaaggacgucaauguucaacuacagagaguuacucuauaaccacaaaagcaaaagcuagaagaaauuuggaugggaagacaauucccuucuucaaggucuaacccauagcaucuguccucagaguucuuggagacaccacagcugcuucugugauucaaccauccaacaaaggaaguuucauuuaaugagcuaguuuagaaucauuccauuuugucccuccauggcaaugucuggugacuucacagcuugucauaacuaaaggagggaccacugccacuuguggguggaugaggggagcugcuuaagcauuccaccauggacaagagugacauccccaagaaaacuaauccagcccacacaucagcaguagaguggccgaggaacauuguuaacucaccaugcuaucccuaccaacagacuccaguuuccccugaccugcucuaagaaaaucauuuuuuuauagcucuaacuaaaaauuucuaacugcaaaaggcaagcacuaggacaugacaccaggcccaaucccaagcacugugacugcuaauaggcagcaaucaaacuaugaagcccuaaaugcaugucagcaggagcagaagugcucagcaggugcucagcuggugaugucccgguugcaucuagcauucccugaagauucucugcaggugcucucugcaugcaggucugacaugcagcauucccugcagaugcucucugcaugcaggucugacaugcagcauucccugcagaugcucucugcaugcaggucugacguauccccucaaggcccacauacacuuccacuauggaguuugcuagugaaagcugcauauuugcuguuggguuuuuccccuuuacauauauuaaaacuaacacgaaacuagucagaagacaugaaaauagcaaauacuccacagugcucuccacccuggagacugugauuuaacacaccccugaaaggugucuaagucagaucuaaaguugaaaagauaucagcauucugaaaaaagaaaaaaaaaucccauuaauaaauaaauagccaguauaaaauaaucaucaaaaggaacugugugcagauaugugugagcuacagacaccacagagaaaucagggagguuacuucuuagguagcugaaacaaacaaacaaacaaaaaaagauguaucaucagacacuaccaaagcagauuuuccaguuuucacaucuuaaauaguugcagaauuuuuaaauucaucacagagaaaaaacuuccgaaaauuaaugaaaagaaaugucagacuuuagaagccuugaaaaucaaugugggauugguuaaugaaugauggcccauccacauaucagccauuaaacaucaaauugaagaacaguuaaagacauagaaacacacaacagcauaaugaaagacaagccucaucgauauacacaacauaucaauucucuauagacuauuauacagaagugcaugcuucuauaaaugaauguaugugaauaaagaaauacaagcaggcacaccaugagggacugacuagugacaaucugcuacaauguuaacaauggcuaucugaggaggcggaaguuuacaggcgguuucuauuccuucuuugugcgccucuguuuuccaacugucuuccagugcgacuguuuugcuguuuugugcuuacagagcuaauacauuauuacaaaguuacaccuucuuaucccgagcacugcauagaaaauguaaaacaaaccaccucaaaccucaacgaagccaagucuuccaucaacaaacagcgaacauucauugagcauucucauuaugucccugguucuaauaacuuuguaaaugcaucgacggcuuuuuuuuggggggggggggcagggaagggucgagcccugaaauaacaccaaaugcagcugaguguugcuuccaacaauggauuuacagcucucuucccauggcuuggaauaaagggggcuuauuaaaugaucucugaagguuuucaaagcuauggcgagauugcucaugaaaaagaaauuucaucaaauaaagugugugaaagagagcuuggaggguggcagcugcgugcaaucucaaaaacagaacucuauagaacaggaaaacaacagaauaaugucucucaguuccuccucuuaauauccuaaaaccucuuuuccaauaucaucgugggcagaaugauccaacuguagucugugcuauuguagguaaaagaaaaacaaaaaccaaaaaacaaacaaaaaaccauugggagguugucuuugcuguauauauuacuuuaaagaauaaccucgaaguaaacaaaaaaacuuugagauacaauuuuagucauguucuggggacacuguguacuagaaacaaacauucccguguuucauuaaaggguccuaagggcaaggcacuggaacuuggcaaaaggcaguucacgugucaaauacacccaaauccucaauacaugaaaugcggggggugaagggaaaccccauuucucuagguguaaauuccagcuggguaguaagaggcaacggggcuucccggcgaucugugggauuguuuccccagcucgaggcccgaccuaacgguaagugcuaggccauuggccggugcuucacgcguggaucguggaagaacacugaccuguuaaggucuauuucgugucucgcucgucacccucggagacauaguagauggaucuuuugacgaacgcaaaccaguccuauguaugcuagcgcacaccugugacacaugcacguaugcaccagugggucgaugggggacacucgaggagcccacuggcagguuuauagcacacggaaacuauacgggggugaaaaacacaaaggcucgaggcacagaaccaacucgaggauugcagaugcgcucgcacauucaacccgggacacaaaagagcagagaucagcgcagcccugcggauggggaccgcccggggcccacgugcgcuccccgccgaccccgcagccgcgcaccccgaguccgccgcgccgucaccaaacggacccgaaacuuggccgcggggacuuaagagccgcggagcgggagccuucgcgccgccucgcgucggcgccagcgccagccaccgguucccggccguucggaggaagcucgaagggggcgcgucagcccgccccgcaauccccuuagcgcccggcccggucgcccccgccgcgguggccacacuccucacugacaccaagggacauucccccgaggcccgcccgcccuccccggcuccgccgcuccucaccagagcgcgacgugccaacgcuucagcgagcccagagccgcagccgccgccgucgcucuggcgcccgcggccgcgccgccgccaucuuggcuccg

SEQ ID NO: 12334 - RNA, 18329 nt, Mus musculus
caaaaagccaagguccucccagcugggcacuguuauccaucccuggggaugugggccucagaggcuggcugcgugaggcuuucugugccacccucuaucagguagcugucgccuacgauccgaucugugagcugaaggacccaagagccgcucagugggagguggucauacaaagaggcagacgacagcaggggcgugggggggagggcaaagcucuuggagccucuggguaggagcugcaagacucucacccgugcugacugaugaagcagugacugccaccggagccgccugcucagguguugggugugcaugggguuuggcuaccagcccucuaauacccccggcccccacccucuacagcaggaauccagccauggugaacgaggccagaggaaguggcagucccaacccgcgaucugagggcagcagcaguggcagcgagaguuccaaggacaguucaagauguuccacccccagccuggacccagagcggcacgagagacuccgggagaagaugaggcgcagaauggacucuggugacaagugguucucccuggaguucuuccccccucgaacugcugagggagcuguuaaccucaucuccaggugaguagggagguuaaucgcgggggucggcaggcucaggggagcgugagcugcccuuuaacccggcaggaaaaggcucuggggagggaggggaggcaggaagaagcagaggcgagacagggaguuuagucugugacuuauaacuucuugucugugaaagucccucugaagcagcauuagauaaguuuggacgaacucucagugagccaaaaauguucauuuuucaggcugcauucuuuggcagagcuuggggcuggcucaugaggagcuuaggaagucaacaaaccgcaauucagggaauguguugagcuagcuggacacagagagagugcuuuuccaaaucaggaaacaccacauguuuugugauagcacuuucugaauuccaguuccuuuucuucaagucagagagugauuuguagaccacaagaccccugggcuacguccugcagcaucacaaaaaugagagaaaggaaagucaggcacacugguauccuuaauaccaacacucagaggcaggaggauaaauaacugugaguucaaagccagccuaagcuaccuagaauccaggccagccagccaggguuauguaacgaugcccuaucuuuaaaagagggaggaguguagcugaauugauggaguaaauagcuugucagaaaucuuaaauuugauuccuagcacugcauagacagggugugggaacaugacugcaaucccagcacucaggaggcaaaagcaagcagaucugaggucaaggauagccugguagagagccaggcaugguggcacacaccuuuauuccagcacuuaauaggcagaggcaggcagaucugugagucugagcucagccuggccuacauagugaguucuaggacagccagggcuacauagugggacccuugucuugaaaacaaacagcaaacaaagaaauacucagcuacauagggaguuugaggucagucuggacuacacgagacccugucucagaaacaaccacaaacauuaaugccuuuuaauccguauuugucacaugcuguuuucuggguccugaaaucaagacccugauguuuaaacacaccauuauagcuuuaacagugcugaugcccacaaaagcuuuugaaucuaguucaggaacugagccuuccucggcaggacucuuggcugaugcaaagaggccaugguggcaacacaagagucuguugauuucucucugccuucccuaaagugaggcucucugcccacccacuacugagauuccugaacccucagcugucaagacucuuaaaaagcuaguguguuccacucugagaagcgcagaaugcuguucacacaaaauagugacauuguuauacaucagugugauaaccauugaggcacucacugagcccgggcccugcucugaggaggcugcacagccaucugacccagaacccugauggcuguccaguagguacugucaccugccacaccugacaaagaaucugcggcuccaugcauuacuaggucaugugccugggaaguacugcucugauaccaacuugccuucucugagcuccuauuuaccccaggagccuacuuaaggaggaaauccccuacagguuugaccggauggcagcagggggcccccucuucguagauguuaccuggcacccagcuggagacccuggcucagacaaggagaccuccuccaugaugaucgccagcacagcaguaaacuacugcggcuuggaaaccauccugcauaugaccugcugccagcagcgcccggaggagaucacaggccaucugcacagagccaagcagcugggccugaagaacauaauggcgcugaggggagguguggcgccagcaccccuccucuuuggguucuugcuuuccugaaggcuucuccuguccccagacaaguccuuuacuuuccuugggcucugcacuaagcacauccagggccagcuugcugcaggaggaucagugaucaaucgcuguggguaaugaguccauugugggugucacacaggugggauggccgugucuacagcuugaccugucuacaguucagcugggacauggcuugugcccaauaacccuguuagaauuacacagggccaucaaucgguuguggcacugucugaccuagucauagagugagugcuguguuggaauuucccaggagcacugggagcuugcuauccucagggcacucaagaguggugggugggagccugggggggggggagaucuguggcuuccgcucccaccacagagcuccucuugaugaguagaaaauccacccaaaacccaggagcucuuccagagcagagaggugggagagggugucugaccacacccagggcaucagggcgaggccaggcucaguggagagccacaccuccucuggucccaccaccaauggggcaccugcagaguaagccuuaguaggcauuugacaacugaccacugcccugcaccuccuacuugccaggugccaggcuagacucacauaauaggaagucucggccuuugagggacccucagccaaguguaggcauagauagagggaacaagaagacucuggaggucaagggacacccagugaccaugaccuccagcaacccugcagacccuguaggugaccacugggaagcagaggaaggaggcuucagcuaugccacagaccuggugaagcacauccggaccgaguuugcugacuauuuugacaucuguguggcagguaagugaggacagagaagggucaggaugagaggauagccagcuagucuuuaguucaggacguguugauuggguggauacagaguggggggacacagaggugaacugaauggcaccaguccuggccaccugcugccccacagccccacacuacucccacuccaaagcuuuccccccucugccuucuguacucaaucuucucgugggggggggaggggggaagggggaggaugugcuauggaagacuccggggacaggauucauugagcccugaaaggugucaggaacugugguccuucauucccucuguguccacaggguccugggcuggcuucucacugugcaucugcugcaugagaggcccucauagacgcacuguccuaggccugaguccugcuucuguguguguguggugucagcuccaggcagcccccacucuaacucuucucaguguuagcucucaguuucuaggaaaugaaacucacacuggcuuagcucuaauccuugcacuaagggaugaggaaguggguagaagagaaggauacaaguucagggccagccugaacuugucuuagaaauccaaagcugaagagggaagauguugguguaggccuuuaaugccagcacuugggaggcagaagcaggaggaucucucugaguucaaggccagccuggucuacauagcuaauuccaggacagccaaggcuacacagagaaacucugcccagaaaaaagaaagaauccagagcuguaguuuggugcuagagagcuuguaugugcuagagguacuaaugugugcuagagguacuagugugugcuagagguacuagugugugcuagagguacuagugugugcuagagguucuagugugugcuagagguacuagugugugccgggucccggguuccaucagagcuugccucaccucaugugugccaaguucuggguuccauccccagcacugacaaaauagauaaaugaauaagugccuaaguuauggaguaacauaucaaguaguaacauuuuauucagcguguguguguguguauauucgugugcucacgaguccaggucagaggccagccuucaggaacaguucucuuucugccaugucaguccugggauucaaacucagguggucaugcuuaacagcaagcaccuuuaccuauugagcaacccaugggcccucaaauaauauaauuuaaaaacaaaguuugcagcuuuagaauauugucauaugagaaugggcuuucuccaaccucccauucgcgcaugcuccucucagcuggcuacauaaccggcuaggaagcacugcuaaagaaucaaaggagcaggcauugccggcagcucugauggucacugcuccugcuggcccagaugcagcaaucuggggaccugugcccacgggcucuagccgugggugugaggaggugaggggagccuagcagagcugcaagcucacaguugucaagugguuuugugcuuugccuauuguaaacugagugguaacacuggcugguuauauuuaccaagcuugggggaugagcagugggucaguggcuaaggguacuugcagcuccugcagagaacccuucuagcacccauacccuguggcucacagauaucuguaacuccagcuucagggauccaauacccuggccuggccuucaugggcccugcacacacauauacacagacacauacacauaaaacuaaaaguaaacaaauaaaacauuuuuuaaaugggcuggagagauggcucagugguuaagagcacuacccucuucuggugugucugaagagagcaauggugaauacauaaaauaaaaauuaaaaaaaaaaaagcgcguuuuuaaacuaccaagcuggucauggcaagaaaagaacauagcaggugauggcagcccagcugugggcccauauggauuugccugcugaugcucaaacugcuuaacugugugguuucagaagcuucccacuggaaagagcuuugcuguucaaaguugaguuucuggcaccuaaucuccacacaauaguuuucccuaucuacccguggugacugugguuucuuaagaacccugaccuuaucacaggaaagcagcuuagcucccggacugcucuggcuucaggcuggcccucugcuuagcucugcuccugguggagcucaggcagaggguuaucucugccucucccccaccccucucugucucucuccuccuuccccucugucccccugccccacucugaggcuaccucaaagcugugccuuccuaccuuucugccuggguaaggcucuucucugccccuuauccuccccacccccaccgaggcugccacaaagcuuuucugccuguuuaaggcuucuaaugaguuuaaucauugagagauggcguuguagaguucacaggccaccagugguccagccucuggugccagucucuguagauuuggaaaucccaucuucuacauggucagcuuaagaucauccuacugucccaacccaacaccgcccauccccuuguguaauuagacugcaaugaaaacaauacucuuugccucuuuauuuuacguguguguguguguguguguguguguguguguguguguguguguuuacagaagaguaaacacucaacugcugagcucucucuagccucucuauucauuucuuaaagcaagauuuuacuuucuucaauucuucacauagugugaauuuuaaaucauuacuuuauacauauguuuguccugucugcauauaugucugugugucaugugcacgccugaugcccacagaggccagaaggggguggucuguaaaaguagugagugcuucuaacugagucaucucucuagccccaacgugauucccauccuuucagauggauuuuagugucauauguacuuuuuuuaaaaauuaaaaaaaaaaaaauacuguuaaggcuggguguggugcuguuuuaggcacagcauuugggaggcagaggcagguaaucucuuugaauucagguuagcuuggucuccagaguucuaagccacucaaggcuacauagcuauauaaugagacccugucucaaacauacacacacacacaaacacacacauaagaaugcuugcuuaacaugcauaagauguuagguuccaaaaaacccacaugaaccaacuccuuagguccaaugcucagagucacaucuggcucccuagaaacaacacaguuaggauucaaugucuugucuguggccacaaagugcaggucugaccugauuugccuagcugagugagacaggacaguguauagcauuuaaaacaguccaccccucuccuagaggcucguccacagggucugugacacagcaguagcuuggacacccacaauucagcaguccaaacuguuucugggaagaccaccgcaugcagugccugggcugaggacugcucaggccccgggcucucugaugucuucacuccuugagcagguagguugagaccagccucccuacucucuugucuccuccugguagguuaccccagaggccaccccgaugcagagagcuucgaggaugaccugaagcauuugaaggagaagguaucugcaggcgccgacuucauuaucacucagcucuucuuugaggccagcaccuucuucagcuuugugaaggccugcacagagauaggcaucucuugcccuauccugccugggaucuucccuauucaggugaggggcuugggaggaccugauucccuccguccagugcaugcggaaguucuuccucagugaugcucagugcccauugggaauuguccacaugcugcauuuggucaccucaucugucaccccuggacagcaauggugucugucaagggcuuguacggagaacaguuauuaacucuugagcggaaguuuugguuaagccgaaccugagguacuuguuaucccagcacucuggagcuagaagaggagcaggaguuugaggcagccuugccuccaugagacauuaucucugagucaaagaggagucccacaacugaguccccagaguccacuccagaaucuaggcaaucugaugagacaaccugugaugguuuguauaugcuuggcccagggaguggcacuguuuggaggugugccuuguuggaguagguguggccugguuggaguagcuuugucacuguggcaugggcuuuaaggcccuacuccuggcugccuggaaguuaguauucuacuagcggccuucagaugaagauguagaacucucagcuccuccugcacugugccugccuauuccgccuuaaugauacugaacugaaccucugacccuguaagccagccccaauuaaauguuguccuuuguaagucuugccuuggucauggugucucuucacagcaauguaaacucuaagauacaaguugguaccagggacugagguguugcugugauaggccuggcugugcuuuucucuggaagaguguggauuuugggacuuuggauuuggaaagcaguggaaugcuuuaaguggggcuauccuaguaggaauaugaaaggcuguuacugagugauuucaguugcauggaccuggcccaagaaguuuccauggagaauuucaguaugggcuuuagagacugcuuuuguagcauuuuggugaagaacguggcuacauuuugcccuugucucaagagucugccugaggccaagugaagagacuccgauuaauugcauugucaaaggaagucacaaaaugcccaacagagacuuuguucuuugguuaaguucgaugaagaacauuuguagcaaacagaggaaggaaaaauacaaaauauauaguuugaguauuaaaggcacaccaagaagagaaauggagcugaaucuuauguucaaagauauuaaauugaauuaagggagaagugaccuuggggcaagaucccacccagguaaguuuagaucuagacaugguaguguaagccuuuaauacaaggaggcaaagacaaccagaucucugaguucaaggccaaccuagaacagaacaaguucuaggugaagaaaaacuuaaccccaggaguggugaaccacauuuuaaucccagugcuuaagagacaggcaugcagaccccugaguucaaagucagucuaugaagcuuaggcagugagggaguuggaaaacagaaaacuggugauaauguaauagaacaaggaggccauguuccagucccagcaagcagcagagcucagcagcuuugguacauggcucuggcuuuagaguccagaauaaaagggacuacuggaacaacugaugcuggucaacugggacuaagaacucaguggugguuaaaaagagaucagcaucacugaggugaaaacuucugagaaacguuuucugagagcacaaagaagcuguguuccagagauagccaagguuguaccuuaugcugcugcugcuggacuugguaauguguaagagucacccaggugggacugguuuugaaggcaugaaggggucaugaagaccacugugaggggccaugaaaggccauuggugaagguacaguugacacuucagcuguaguugauggcccaggacugaaggagucaugcaaaggagcugaggcuuggcaccaugaagagagccugaagggcuauuggugaagccuagcuacagcagaagacccuaguguauuggaaaugccaguaccaugggauaauuaccaagaacugagcucgagugcuacagagggcagagcuggagacgugaugcugcccuuugcuggagcccagaagaucaaguguggaucccagacacugaaagaagcuguaacauugaaguuacauuggagaucgaaagauguuaaagaugccaaagccaugggauacccgccaaggaaagccguaacaaggaguggaaccagcccaggagaaagauguuuguugcagucaacaaaguugaaaaaggaguggagaucugagaccacuuugacaucggacauggagauguuuggaguuugcccagcugguuuccugacuugccuugaggauuacaguuaagugauuggauggaucucagaagagacuuugaacuuuggacuuuuaacauuguugaggcuuuggaaguuggacuaaaugcacuuuuuuauuauguuuagguuuggcccccauagacucauguguuugaacaagccuaugggagccagggaguggaaugugauaguuuguauauguuugcaccagggaguggcacuauuuggagguguggccuuguuggaguaggugugucacuaugagugugggcuuuaagacccuacuccuggcugccuggaaguuaguauucugcuagcagcauucagauaaagauguagaacucucagcuccuccuguaccgugucugccauguuccugccuugaugauacuggacugaaccucuagaccuguaagcuagccucaauuaaauguuguccuuuauaagucaugccuugaucauggugucuguucacagcaguaaaacccuaacuaagacagaaccugaggugggaccuaugaggugggaccuuuaguuuggcagaugauuggcuggugaggcuuaggaguaacugaguuagaugacugcuguguugaacucaaggccuggcuugggcugauggcaggaaugcagcaggccacucccagacucuacaaaugagagagaaaguagggcgggccaaguacugccuugcaauaccaccugccucucccaggcccuuccccaugaaacugacuagccaagagaccaggaaggagauacaguggagcauaggccagagaugaccccaugccccuugugucucggacagggcuacacuucccuucggcagcuuguaaaacuguccaagcuggaggugccacagaagaucaaggauguaauugagcccaucaaagacaacgaugcugccauccgcaacuacggcauugagcuggcuguaagccugugccgggagcugcuggacaguggcuuggugccaggccuccacuucuauacccucaaccgcgagguggccaccauggaggugcuaaagcaacugggcauguggaccgaggaccccaggugagcgguggaagcuggaggcauacccaugagucagagucgcgcaggugcagcaccaaccauacauugaggaugcccucaggaguaacuagagucacccaguuccagccuccaccucagagagagcuuccacaugcaguaauuaauguugagagugaguggggucgcaguggccgagcuugcugugcuccucuagcucagucuaccuaagccuuugucuuuucccucuuccuucccaccaggcgucccuugcccugggcucucagugcgcaucccaagcgccgggaggaagauguccgucccaucuucugggccuccagaccaaagagcuacaucuaccgcacacaggacugggaugaguuuccuaacggccgcuggugaggagagaagccacccccuguuaggaauugcuggugccuggguggaauagggacaagauuuacaacaaagugccuuguuccuuauacuccugccagggguaauucuuccucaccagccuuuggggagcugaaagacuacuaccucuucuaccugaaaagcaagucccccagggaggagcugcugaagauguggggcgaggagcucaccagcgaagagagugucuuugaagucuuugaacacuaccucucuggagagccgaaucgccauggcuacagagugaguggggugaggaggaacggcccagcuuugucucagccuugggcuggacauggggcugagcuaucuccccuauaugagaugugcgccucaggugagggaggcaggguaagagaucccacuuaggagcccguggagacagagauagcugggucucuagaaagacuguacaaaggggaaacggcccagucccagacucagugcugcccucgcucagcgcacccugcccugcagguaaccugccugcccuggaacgaugaaccccuggcagcggaaaccagccugaugaaggaagagcugcuccgcgugaacaggcugggcauccucaccaucaacucucagcccaacaucaacgcaaaaccauccucagacccuguugugggcuggggccccaguggggguuaugucuuccagaagguaugcuaggaugcaguacucucgauauccccagggacugacacagaacccuggccuuucccccgacccugcauucugaaugacuauagagcagggcaaguaacaggcucugugagccccaguuuguccuauaaaauggggcgaggagguauuuuacauucuggggcaaaauaaaaugaagaauaugacaaggucugccuggaggaagaacaaauagucagcucccaggagcucugaccguuaacgagaugagaccacuaacgagaugagaccgcuaacgagacugacuuuaguuccagccccacuggagcuaaauuacuauugagcaagaccuguagccuuggacugggaggaccuggauuuaggugugaccucugcuguuucccuugguaaacacccugcaguauucugaacauucuaaagaaugaaggcagaggcccucugcagacugaagcaccuugcccagcccuauggguguuguucucauccaauuggggaggcuggccugugcuaggccccucccucauccuaagcuugucagaguggcugccucuguucggcuccuaacaggcuucucuuuaguggcuggcugggagagguggcuuguacaaccacuuggaccacuccacacagagacgccucuuuccuucugcauccacccaacuccauggucugcagugcuaccucuaaucccaaagccuucacugucccacacuuucuugauggucuucucccuggauggcuaggaggacgggcaucuggcugcuggcugagggauggcgugggcagaucuagucagauguggagacagauuggagcaggcugagaaggcagagaacuuggcaaguagugggguugacauguuggguguauucucccucaggccuaccucgaauucuucaccucccgugaaacuguggaggcgcuucugcaggugcugaagacauacgagcugcgggucaacuaccacaucguggacgugaagguaagccagcucccuccggcuuagacggcagcaaggcuugaaaacaccuacauuuauucugacaguccucaaaugcccagccuaagccagacauauuguacaagacagacagaccagauggaggcaggcccccagacugugagguagaugaauauaugccgugacaaaucuguguaaguaggaaaggcagauucaguguaggaugcuacaggcuccagaggagagaugucucacugcagagguacagggugucuaugugugcacacacacacacaugcauguucucucaaauggaggccagagaaggaugucugguauccugcugugucacucuuugcuuuauucccuugggacaguaucucucacugaacccagagcugugaucaccagugcuagggugacgggcacaugcagagccauacacagcuuuuuuacaugggauccaaacaugcgcagcaagccucuuacccaccguaccacguccccaggcccuggucugaaucuuuguaaggacaaagacuaagcaggaggagaggcucugcccugcacugccuguggagaaacugcagauggcaggacgugguggcugucaugcuguccugucugaggccuggagacuaccaaaagcaaagggagcccuccuccccagggcacagugccuggcuccacuucuuuuuuucuuuguuuccuucuuucuuuuuuuucuuguuuuuuuuuuuuuuuuuguuuuuguuucuguuuuuguuuuuuugagacaggguuuuucuguauagcccugguuguccaggaacucacucugcagacaaccaagcuggccuugaacucagagauccaccugccucugggacuaaugaugugcaccaccacugcccagcgccucuauuucuuuuuacaaagaucacagcaggcaacuaggagaguggcaaggaccacgggaccgcauggggacccuuguggcccagguagaaagccgggcugcuacuguaggucuagauaagaagccgcagaaaagccuaauaaccccagcacuaggucagccaauugcuggacgaucugaguucaaggccagccuggguuauaagcaaguccuuguguguguguguguguguguguaugugugugugugugugugugugugugugugugugugugugugugugugagugcaaggcagaauagaaguucagucaggaugccucuaggcucugauuuaagcagagggugauggguuuuggcagaccaggagggcuuaugagcagugggagguuucggucacccuccucagcccugccucuguucucagggagagaacaucacuaaugccccugagcugcagcccaaugccgugacguggggcaucuucccgggucgagagaucauccagccuacugugguggaccccaucagcuucauguucuggaagguaagggagugggagggaguggaggacccuggcuaccgugagagcccuggccagacaauagucccaaacacguagccgaaaaccauaccccaggcaggguagacuuggcccugaaggccguauguuagcacaugguguuuauuucugggcuagcuuggaguggcucugucuugcuguuaccuggguggccugcagggagacagcaggggcccagaccuggagguaccagccgugcugacccugcucgugugucucuguccacacguaggaugaggccuuugcccuguggaucgagcaguggggcaagcuauacgaggaggagucgccaucccgcaugaucauccaauacauccaugacaacuauuuccuggucaaccugguggacaacgaguucccgcuggacagcugccuguggcaggugguggaggacacguuugagcugcucaacaggcaucccacggagagagagacacaggcuccaugagccugcaucucucaacaggcacaccauggagagagagacacaggcucugugagccugcaucccucaacaggcacaccacggagagagagacacaggcuccgugagccugcaucccgguaucuuccucaccuggagccccucucccucaucucucuacacaggauaauggcagcuagacuagcaggaagcgucccggcucuggcuggaccuaagaugccccgucgaggaggcugaugcucucugcucaagcccagagcccguguucuugcuguggcaagcgccuccauccucagggggaggagaccagagauugcccagccacugcaccaaggcagccucuaggaggugaacuuugaccuggggucugugugagacagacaguaggcacugugaaauacugaaggagguaggaagagaugugcaaaugaggguacagaaaccuccucccugcucagcggacuacacaccagguccccaagagaggccuggcugguaacacaagccuuucuugccaucuuaggccaaagagugcaggaguucugccucugcagaagguugguugugucuguucuguggcugggaagaaagugccccuucaggguuaaaagcguucuguccucaauggaggcuugcucuuggccuuguuuucuguccucuuagcgagauuuaccugggcagggcccagcucuucccguggcuguaugaagccugcucccuugcuucugagcagacuccugccagcugcaccgucuucucuguugggccuagacuaggggcugucccuggcacuccuccccagucagcccucaggccuggcugccuggggcagugacuggcaggcacagaugacugcucccagccugcuggucuuguuugagucagggaaugggagaaagcgguccguagagcaacuuagggagagcaggggguuccugcccucgucucccaggccugggugacugcaguggagagcagccuuggagagaaugagcagaagcagccaggaggaggagguccuuuuauugucccagagcuccaggcgcuggccccuccaacugugggccuguucccucccucggaaggcugggcuugguucucuuauuucucaggaauauuucauagcugcugcuggccccuacucaccccaugccugcuacaccugagccacuguaaacuguuuccaggagcacaggcugcugcuaguucuucucaugggcucuuggcuaccaaacgcuggugccacuuuucaaaggcuuggaggcagggcaggaaguacugcuugucucaggcucccuccagggucuguacugggccugucagacuugacaccuaagccauguucugugugucucaaccagaggcccuuuccuuugcccuggcagccagcccacccugucucugcccaaauaucuaggcucagaauagacuggacuugugacccgggaagcuaugccccgugaccugcaaacaagacaucuguucuggacgcaggcccugcaaggaccagcauggggagccacugccacaaacagacugguucucugagugagugaaacugauacuuggcugggcuugaggccccuagucaagggcucuaauguccaggcugugugcucuguaaccaauggccaauucaacugaaugaggauagcgcaggguggugagcagggacacccuccccucucccuggcucagccuggagguggcacuggucuuggagggcuggcugggugaaccaagguaaagucaccuggaaaaggacccggcucucuucucucugguguagcuguugagccacccggagcugaaggaccuuuuucugccauguccuccacgccuguuccaggugccauugucugagcuacagagagaguugauagaaaagauccucugccauccugucagcccuggcccuucugcugccaccccagggugaaggagaugugacaaggggccaucaccuaagaaauguuaauaagugaucacaccugagcccaucccuaaggcuuugggcaugaggugcaauuaguaguuagugccuccagcuagccaagggauacauaggaugaguggggaguuguucccagggccucugcuugguacagaggagcugagccucccuaccagagcccaagacagcugcuccacccagugaacaucuacccagcgcugccaugcccuugccaggcuccaggccugcugggaaaccugacuaugccaacacuauagguaccugucccugcaggccaagaacaucuaaccucuucaacagcaaagaacaagaggcccaggcucggccauucugccagaguugaaaaaucccuugccugaagggacugaccaccccucccaugcacagcugguccaccuuugaggagccuggccuuggcccuucagggcccuagucucagagcugcagggcucaccuauuccuguagggggccaguggagggcccgugcaggcaguggcagccagaacucgagggcugggcagaggggucucucugugacaccugaaaaggagacuugggucaggagaggaugaugccuugauuuaaaagaacagaagccccacccaccuaccccucaagucuccaggcugugggcuggcccaaggcgcuaaugggaaaagaagggaauucuucaaguagcugggacacucaagaagagauggacaggggcauuguuucaaaggguguggccugaggacugagacucaaagcccagguugugguccucugugccucuuccauguggccgugccaggcugagcagcacauucucuacagcagguggccagcagcugugagucugaaggaagagcagggggacaaggaccaacugcaaugggcuugacccugcugaccacaaggggguccugccugccuccugccagagcaggcucccaccugcgugcauaauggggcgcuucaccugacacucaggagucccaagacccccagaugaggcaagccacccguaguggcacagcucccucugaccauccuccccguuggcugaaaacaucuaagcagaggcuggcucaguacugcgguggagcucaggccagcccugagauugacauuaugcuccugaauuaagcuuuagauguugccgaagccuugccucucacauguggccugacuccaaggucugggcucccaacuaaugcagcauacacaggggauucacagcaccacagaauggcucgccaccugcacguguugccaggggaaggcuaccugggcaugcaugaaccugugguaaagagcaggacccuggguaccauucucagugucugcguguuucuagaaaccucaguuuaucagcauaucagcccugccuucacuaacaagaagagaaugaaaguacauauacuuuuaaaagguucuaguguacuggugaaauuucacgacgcugaggcaagagggcgagaggcugccucaugagcuugaagccaccuggacuguauaagcugggucuacaaagccuguaacaucaacaagcccaacagcaugaggcccauggugugccagcacccugagcccguacgaggauucugaaacccagcaacgcuagucuugcaauucuguuucaaaggcaaagccacuuugaugccuuauguucuuuccaaaguuaauucuguuccucuggcaucugagcaagagucuuggugaggccagauugucuuugggaacacugucuagccugccagggacuugggcugaguccccuaguuacaucugcagaccucuaggcaguguuguuucuugcaccuggcauuugugauuaucucucuccuccugauaggccuucagccucucacuguugugucagagcuaagaacuucuggucugaaggugacuuuuugguacagaaaagagaaaaacccaaauuucuacuuuauuuucuaaaaugagcacauugcauuuuuccaauuaaaaaaaaauugcugucucca

SEQ ID NO: 12335 - RNA, 109078 nt, Mus musculus
ugcuuuuaaaauucugaugucauuuauuggcacaaaauuuacucagauacaacguggugucuagauguggcuuuacuuuauacuuuguguauuuaguuggauauuuacuuugcuuauaacucacaaccugcucuagugugucccucugugaucagcauuuauguucugagucccugcugcaaauacagcauaucccucccucacugaacacaguagagccaguguggccccgcauggagauccuuggcacaccugcucaugcccgguggccaggcuucugaacaaauguccuccuggaagggcaggucuugugaguuucagcaucguggggucaggcggaagacagacucucuuagccauguuggcccauccugcaaaugucgccacugcauccagggacgggugagguaacaggauaguggagugccgaccucuguguccuugccguuggagccccugguugagaggaccaacuggauuauucugucagcaauguuuaugaugaguuuucuuguaaguuaagucaaaacccguauuucucaguuacccaucuucuguucucccaaaauccaaggcuuggcuucugaaggauuacuguguuucacuguccugggaacugaaucaagccuuguguuucugacagugucuuuucaacagcagcuaggagguuggcggaagccaacuuugaauauacaguaguucuuuucauauacauuucaaaauauuuaacaaguccaacugucuguccaugguuuuaguccacuggaagcacagacaagguacuaaagccugggaggagacgacgugguuuuccaggccucaguuaccagaagggacaccuaggaaggugacagaaaggggacggucagucagagccccgugggacucagucaguaucacuagucaagggcuaacgggccugagcucccagagaucucucugcccagacucgauuacaggauuaccaaucuucuucuucccuuuuucucucuagucauugcucugacucuuccugugcccuucuacaucucaggagugacaacaaaaaucuaaagccaccacagaaagucacacaccugcccauucuaaacuguagcucugaagcagcugugacuuccagauacagaucacagcucucaguuucccguuagacaaggagcauucucagauauuuuugagacaugguuucaccacuauagccuuggcuguacugaaacuucgaguuuugccugccucugcgugcccagugcuggggaguaagggcaugcccaccaugccuggcugaggaggcuccucugcaggcucacucaccagccaauguagcacuggcagagguucucgugagauguugccugcuugauaagcagcuccacuuggguuggaacauccaaagugucaucaugagagaaaucccgaccuaggaagcagaaagacugucaucugcacuuggcaacaacacagcccauguucuuguuuggcucagcuagagcaggaaggacagaccacaucugcagugagaaauucaccucugugucaucugcaggcacacugaucucuuaauauagacccaguucuaagaugugccuaauagcgcuguuccgaaaucagauuugaggcgugaacaaggucauuuagcuugaaccccacaaauuuucaucaguguuucuacuggacaguuaagaucuuguccccacacaggcucagcagccuaacuagccaauagagcuucuuugauaauaugcuuuuuuuuuuuuuaaagccaaauucauuuacuguugguaaucaauagcccagacucccaaauaucuaaacuucgucgacuaaagauaaugcacgguaugauuaugcauuucuauuugauuuuuuuuuuaauuauuuuauuuauuuaguccccccucccagaguccucugcaugucauucuugcucaggggccaugcuaauccucucuguaucauuccaacauuaguauauuugcuaccgaagcgagaacgguuuuguuuuauguuuuagagauuuuuaaauuuuaugugccucaguguuuugcccauauguguaccauguuugugcucuuggaggucagaacauggagucaggugcccuggaauuggaguuacugauaggcaugaaccauauauggaugcugggaaccaaaccuggaccacaaggauaacaccugcuuuucaccacagagccaccuuuccaggcccaucccaccucuuuuucuuuucuuugagaugggggugggggggagugggucuugagagagacuucauguaguaucagcuggccugaguagguaguuguaccugcccaucugauuauuuuugaguauuccuagaacucacuguuaugacccagccagcugcacuucugcuuuguuuuacuacugggauugcaggcaugagccaccacgccuagcuggcaaagcaccuuucuccuaccucaaugacuguuuaagucuuccagaucuccauaaauacuaggguuucuccacuugucaugguucaguucuagcccugaggcuaugcugggcggcuugcagacuggcuucuuuucaucagucuccucuucucccaaaccuaggcaugcguuccucuccucugaccauccugccuugugcucaggguccaacauucaaaguacugauuauguagucucaaucucuccuugauuacauccuucucacagguuuuugucucuguguuugagacagggucucuuucucugccuaugaagcccuggcuggagccugucugacuuuugaacaccaagauuaaagcuaugaggcgucacgaugcccuucucaguuuucugaacacacuccuuagagacaugggguguggcuaagugaggguccuucugugccaucgccucagacccaggacuccgcaguccacagcuucuauuugcucacuuaggccucuccucccugcagagacugcucaagaguucugcagcaucucaccuuucuuugccuccaccucauucucuucaacaacuuuagucuagcuaucaggcuccacacaggucaccagugaugucaucuuugaccgacucaugcgucgggugucaaagccaucuuuguggguuuuauuuuuugcacuguacugagacgauuaccuagguucugugaguguaggcaauaacuuuaccacugagccacagcccuagcccagccuuugaccugccuuccucaagaccucugcaucgaggucuucaauucaucagugguugucuugucugcacauuagagcauuuaaacguccuccuucugaugcaagaccacccagccagugcaugugcuaucacaacacaaagcaaucaugccugguucuuccccauugcaccuaccugccuccggugggugcccugggcugauggcagccugggaucuuccuuuuaccaucccucucaucaaggguuccagauccacugcuuccucugccugacacagccuuaacgucugcuagguaacuccuuguggaggucuggaugauggugguccccagaggcucauauauuugaauacuuggucccuagcugauggaacuauuugggaaggauuaugagguguagagcugcuggaggacagugucgcuggagcugggcuuugagguuucaaaagccuaugucauuuucaguuaguuuucucugccucagaguuguagaucaagauguaagcucucagcuacugcucaggcaccacacuugccugcugcugcugcgcucagcaccaugaugcuuuugggcuaaccaccuaaaaccgucagcccaaucaaugcucucuuuuauaagugagugucuuaucagcagcaauagaaaugugauuuauaaacuugugcuccaguuguuuccuuagggagacuuuucugggccuuuguaauuaaguuaaacccugccaucacaaggcaucacagccucugcucuacuuagugacaauguuuccccuucgagucuaaggguggcuguuucuccugugcgguuccuugauugaguuacuggcuuaagcacccugacuacugaccuggcuggcugaugccugagccuggaaucccauguuuacugugauguucauauucucuguuaggguuucuuaccaucauucagacagagaagaguucagaggcuacauagacaugaguguggaauggggucuguggcuaauuggcucccacucucuuccccacaggagaaagaggauccauauggauugccugcuucuuccgaaagucauacauggcuuccucuuuguccuuccacugcaugccaguagccauaguaaaucgaaguggucaggcacccuccagcaucucaccgcgaggccaguaacuugccccuggaguuggcugguucuggaauucauccagguuccaauagagucucccucccucauccccagagcuaugaggucaagggaugucaaguaguacuaaggguuuucagcaacaggagccagaggagugcuucacuguugcuuaaagcuacucaugaaccaugacagcuggcuggccacccacugagagaacacucuccucaucaggcuucaugucccuuuagucccaaacacucaccagugagcuuaucucgaacccuguuaauaaucugaauagcuuucuuguuuaaggcuucugguuucaccaaaccgucuccaacuggaagacacaagaguagaaacaguggguucgaggcugcccugcuguuaugagacuuaccccuacugcugaccaauccugugcauacaucucuguccucagcauacaacgcaaacuucaugggccccucccucccaaaggcagcucuguuacuugccucguugaugcccuuucuggcccacuguucacuguagcugcuaucugugcacugagugaguuccucagaguguggacuuacugaaugaauggauggauucuggcacaguggucccugcuuucuuaugggcugguucuccaaguucuacaccguccaaaauuucuaggggaaaacaaacaaacaagacaucucaauuagcagacgauucaaauagugaggaaccaacaguuucucauacguuuucucuugagagguuucacguaucugaggcugcccuugaagucucuacauagauaaagaugacuuuaucauugguccucaugucuaccuccaagugcugggauuacagccaugggccacaacaucuggcugucauuauuuuuaaaaauuauuuccauuuuaaaugacguguauguguguauauguauguaggcauagccauguaagguguuggguaccugaagccaaagcaguuggaucuuccuagagcgggaguuacagacaguugugauguaggugccgggaauugaacucagauccucuggaagaacaguaugugcucuuaacuucugagccaucucuccaguccucaaacugacagagguccauacuugccuuugauucccuagugcugggauuaaaggugugcaccaccaccaucuggcucuguuaaccuuuuuuuuuuaaacaauuauuuaucuuauguauaugaguacaguguagcugucuucagacacaccagaagagagcaucagaugguugugagucaccaugugguugcugggaauugaacucaagaccuauggaagagcauucagugcucuuaaggucuaggccaucucucuagccccuaucugcuauucuuuucaaaauaaaaauuauuuuuaaucccagcacuugggaggcagaggcaggcggauuucugaguuugaggccagccuggucuacagagugaguuccaggacagccaggacugcacagagaaacccugucucgaaaaaccaaaaaaaaaaaaaaaaaaaaccaaacaaaaaaaaaacaaaaaaaaaggaaaaagacccccccucaaacaauuauauuuauuuauguguugucuguguuggcgguagggaggggagguagcauguuugggaggucagaggucagcuuuuaggaguugguucucuccuucuacgugugucuaggggaucaaacuuaggugguuaggguuggcccuuaccacugagcugcccugggguuagacuuaggggucacucagucuaggcaagcacccuccagagcuccauccuaagcagugccaucagagaagcccaacacagcgcuggagagguggcucaguggcuaggaguacuuguagcucugguggcagccccgauuugauucccagcacucaugugguacacaagcaucuguagcuccagccccagguggcccagcacgugcuucuggcguccaccaggcaugcauggacugcacagacauacaugcagacaagacacauauaaaauacacauacaaauaaaaaggucauagaaagcuauuaguuucuaauuauguuaaaauuuauuaucuguugcuguugugaccgucugaggggugggguggggugggaggagugcaugccccggcucacgugugcucagaggacagccucaugggccaguguccccucccaccucagaucaccaggcuugagugacaagcaucuugccagcccccucccccuuuucuuuuuuucagacuggguuucauguaauccaggcuagccucaaacuugcaacauagguaagaugaccucagccacucugggcaaacuaaugggggcccccauuucccuggguguacccaccuacugacuggccggcagaguaggagucuguccuuguccgggaccgcuuauugccuuugguauuugcugggaggagaaaguacagguaggaagcacuuuagacggugacaugaaaggaacuugguugcaaagguauuuucuuaugaucacagaaacauaauuuuuucuuuuuuuuugagacaugguuucucuguguagccaacuguucucuggaacucacucuguagaccaggaugaacucacaagcaaccauccugccucugcuucccaaguguggaauuaaaggcauguaccaccacccacccagcuaaaauuuauuuuuuucaaaagcugugaugcugaaucugcaaccuggaugcucucaccacaggccugacacagacaggucagugccgguuuacucagaauauccgaagccucuugauuuuagaauccucacuccagggaguagagggcaaagcugcugcugucucaauccuaacugucugugcuucucacuaaaauacuagcuuccuacuuuacagccaaacagacaaaaaccaacaagguacacuuuauccagaaaaccaucuucauuaaacagcuaagcuagaguguuuucuagcucauaaauauguuugaaaugccacuccagcucucagaacugcucuguaauugucagggacacauacauacauacauacacacacacacacacacacacacacacacacacacacacacacacacacacacauuuaauuuaaauagcauaggcaggcuuggaacuuagagaaccuaucccacguauuuggagcuuacuguccaucagccuccaguugagcagugggucauagacaaaggcuuccagcacagccaugacacuguccuuguguucccggagcacuuccaucacgguguggcaugugguucuguaguugccauccagacccguaaccugcacaaaggucagaaaacagcggcacaagucagugcagacccagacgcacauguagugcugaccuucacaggucauuucuaacacaguacuggggaccugcuacagaaaccacgugggcaccuagggagcugaugcacccuaacaagcauacugcccucagagaagggcaucucuauauuggcuccauuuccaaucaguguguauccaggauccacucaccuccauagcauuggucaacauucuuguuagucuaaauggaaucuuuucuggaaauuucucucuggucauagcgaccuguagggucauuagaggaaaagcaaauccgugguuagguuauauacucuagcugaggccaggugaaggugguggccucucuugacauuaugugcucuuauuuacaucacagcaagaaaagaguucccaucaaauucagugagaggacguuuaucacagggauuugaaagauggacguaagaaaacaaaaacagagaugagaaaagggacaagugcucacugccuggccuuggccagcaugcagcagggggacaggagagcccucuuggaugacagccuauggagagaggcaacaggaaggccuuugggacuugaacugcccaaacugucaggaggguuagcauguucaccucaaagcaguccccaaagucaaugugcaggaucuucccacucagccgguccagcaucagauuggaugggugccugcaggacaggcgagagcaggagggucaggaaggcaguccugaugaucagugaaucacgagggcuccgggccaggggcuggcaaaggcccacccucagcugugcccugcccccacaugccuguguuacacaggguuagugggagcuagccuuacucaguguuuucugcauugcugcaugcugcuuuggggcuacauuguggcagaggccacaugacccacaaagccuaaaacauguauuaucugcccuugcauuuauacuuucuuaggaucuugaguuccuagaaaaauaguuucuuucaagaguagcccaggucuaucauuccuaccaagcugcuugaaccuguggacuaaggcuuucuuaguccgucagucuuuaaucaaagacauucugguagaauuucagacuacugguuucuagagcucuguauuuugauuuacauuaauguguguguguguguguguguguguguguguguguguguguguguguauuuaugcaugugcauguguacuccauggcucuuguuuggcagucagaggacaacuggcaggaauugguucucuccuucuacgaguuccagagaucaaacucagguugucaggccagugguauaagguauaaacacuuuuaccauugagcuaucucacuggcuguuuuuuuuguuuuuuuuuuuagauuauuuauuuauuauauguaaguacacuguagcugucuucagacacuccagaagagggagucagaucucaucaaggaugguugugagccaccaugugguugcugggauuugaacucaggacuuuuggaagagcaguugggugcucuuaccugcugagccaucucaccagccccucacuggcuguuuuuugagacaaggucucauuguguaauccuggcuucauagaacucacagagaucugccugccucugcuuccaucuccugacuacuagagucaagggcuuuuccuccacgcauggcccacugucuuuuaaagauaagaucucauuugcugccgaggcucaucucacaagcuuaggcuugggaccaaucaucaaaaccaagguuucagauucaggagauauucccaccucagcucucacgugcugggacuauagcuaugugucagagagccuggcuagagcuuuuauuuuggaggcagggggucaaaaaugauuauuacacacaauugcaugagacacaauuacaaaagaaaagcaguaggcuuguuuacagucuuauuagucagugucugaauaguccugauuuuucuuuuucuuucuuuuuuuugguuucuuuuugggggcggggccauaguacugaagaucaaaccaaggacuacguauuagcuauacagugcucucccacugagccucccugaaucgucucuuuggagauaauuaccuacugcacucagaaguguauuuuguacaguagaguugugcuuugguugguuucccugucaucuuagcucagugaugauuggccacuuuguuaaguuacuuugagggcccuuccucccuacuggagguacaguaauccuacuuuucaauaaaacugugcuuguuugcccuucaaaauauauaguuauuuauucaauuacauauugcacuagaaaacaaaaugagaccauucauaauaacuggagaaagaaauucaaagaaacaaauuaaauucacucaccugucuccaaggccuaaaauguauccgaccaucgacauaacggccagggagcggguauaguugguucuucggucaaaccacaccuauggcaccagagcacaugugacaguauucuauaaaucagcagugucagcacaguuauagcccaggucugcugcucugagcgucuaccaauggcagucagaaugguaacguaacaaggacccagccaucguuguaaacucugccuucagauccacuuuaucagaacagagcggggccgcacuuggauguauaacgagugagcucuucccuaggaaugugagccuguaagugaagauggccaccucaggcuccacggcagacugaagacaacccuucuucccaagucauuugguacauuuaaugucaauggcaguguuuuugauacaucaauacaaugguccucaaauuuauguggaagaaaaaaauacagaaauagaccaugugaggagacuuguauuaauggcugguuuucaagacacauacagacagcaguuagauggcucuaaagugaacuccauggcgagacuggggccagugugugagccaggugggggugggggcggugggggaggauggauauucugguaaacagagaggcaguagcugaucauuaaacacgcucugaaaaucauacuuauuugugugugcaggugcgcaugccgcagugccccagcagaggucagagggcagcuugugugggcugguucucuccuuccaccacgugggcuccagggauugaccgcagcuugucaggcuuggcagcgaguuaauuaaccugccaaggcaucacuccagcccacguuuauuuauuugcaugugugugaaugcauguauguguuauguaugugugugcaccacauacaugccuagugccugagauggccagaaggauguuggauccccuggaauuggagccacgggaucucauauauaguucaggcuguccuaaaacuuuacauaguaaaggauggacuugaauucaugaugaucuuccugccucagcugggauuauaaggcaugaacuaccauucucaauuuaaucagguuucaaaaaacuuuucaugaaacacagugaaaauucuucaguuaaccacaacaaaaaggagcauauauccugccguguguggugucuguggacauaccuccgagcuggggcuuuuuagccacaguagcuuggccaggucguccccagcuguguuguugacagcaugcucaaacaccucuaccuucugcaucaacgucagguggucauagucaggagccaucugaaucagaucagacaaaaccaguuagugagagaggagccuacgauaggcagcccaaauguagaccaggcuagggcuaggcagagcugggcucugauuucaucagcaaagcgaagagagaaaggacauaacaugacaaagggaaaaacaacgugguuuauuuuuuuaaaacaaggucuuauuauguagccuggcuauccugggacucaguucuguagacgaggauggccucgaacucagagaucugcuugccucugcuuccugagugcugggauuaaagguguaugccaccauacccaacaacuuaaaaaaauauauauauguauacauauaaacacauauaauuuuauauauguauacaaugcauauauuauuuuauauuacauauagaacuauauguaguauauauacacacacaugcacacauauacacauauguauauauguaaauauaaugauuuuguaugcauggcgaggacaugucagaggacaacuucugggagucgguuuucuccugucacugugggcucuggggcaucaggccuacauagcaagagcuuuuaccuacugagcuuucuugcuggcucuucuuuguuucucagagguuauuuguuuuaugaguuacuucauuaagccuucuuccacagugauuuccucagauagcuuucucaguggugccccaccaggcaggaguauggugcccacaggcucaaggguguuggcauggcggcagcacauacccgcagcaugaugcgaugcucgauguucaacaggaucuucuucuucucucuguagucccggaugagggcaugcagugugucacaguggggcacccagccaaugaggcccgaguugguggacagagggaugacagcguaucucuggaugcugguggucacagggaaggagggggucauuguacagugaccagcaggacagcuuuaaucagcuuaggacacauagugccuccacugagcucccagcugcaguacgugggcuaaggggcccucugugaagaaggcaucccagacagaugccauggaagucacagcgguccucagcuugccucacaagcucacugccgaggcagcaacuacuuauaaugcuaaaguaaccucaguggaacagcaucggcuuaagagacagaggcgccaccagaaggguuccacuggccuuaguccaaggggaaaacaccaaagguauagaaucuagucuaaaucuugaaggauuccugucugagguuuguuuuugcuuuucuuucuuucuuucuuucuuucuuucuuucuuucuuucuuucuuucuuucuuucuuucucucucucucucucucucucucucucucucucucucuccucccuuccugcccccccccccccuguuuuuuuuuuugagauaagguuucucuguguagcccugacugcccuggaacucacucuguagaccagguuggccucaaacucacagugauccgccugccucugccuccugugugcagggauuaaaggcgugcaccaccaugcccggcuagccugcccuuguuucuugagugcugggauuauagaagugugcuaccauacugaaguuuuuuuguuuuaagacaagaucuuguguauaguucaaguaggccuuaagcucucuauguagcccaggcuagcuuugaauucuugauccuucugccucuacaucccaagcuacaggacugcaggcaugugcuaccauaccuggcucaggugccuaacuuucaaaaguuaguaacaacacauacuaaauuuuuuacuuggacugcaugggaugaaaugccaaugucuuaagaguucagcuaggauacacaguguucugaguaccugagguucuugcgaagagaaguggggucauuggcuaggaguguguucaccaggccaaagagcugcaucacucguucauccugccgcagaucuucauggccuuucaggaggaaaacaaacucaugcccauugcugccugcgagaaacggggagcaaaagaaacagaucagagcugugcacauuucuacccaagaccaucagcaguucccaagggauccaccccuucccucaucacacuguccccagacaagcacauacacacccuacaacugagggaaagaaaaguucugcucugauuaaaacaaaaacuguguuaugaggacugagaguuauuaugugcugagacccucucuauagguuccuuauuccauucuccuuuccugacuccuacaggccacauccccuggagccucaguguggaugcccaaugggaguaccaauaggguguuagagaacaugaggagguguugagagaacuuuuggguucugagaggacugaucaaagaaaagagagccaugcaggaugaauuuaggcuucuuagccacaggagaaucagccucucagaagcucuuuuuauuguuacacaaaaggcaccuuuagcaagucaauuucugcauaccaaaacuuuuuaucuggggcuggagagauggcucccugguuaagagcacugacugcucucucagagguccugaguucaaaucccagcuaccacaaccaucuguaauggaauaaaaugcccucuucugguauaucugaagacagcugcaguguacuuccauaaaauaaguaaauaaaucuuuaaaaaaacaaaacaccucuuaucccaucuaggaguugucuugagagagcaguucucacucauaacuucuuaguuugcuaggccugucugaaccaaguuuuuaugcaaagaccccaagaauccgucaaaaggauaaucccauaaaaccucagauaaaaauuacugacaaaagcuuccuucuaagcuuauucgccaucacuccagauucacgccagauacaucaguccugcuaagauucugcuacagugaaggacaggucaggggauuugccccacagcuggcugggcaagaaggucuagggagcggccucucugcuagcacuucauucuccugugucugugugugugugcgugcgugagugaguguguguguguguacagacacuggucuuccugcuguucaaagcuccuaccccaggaccuuugcacaggccgcuccagggccugagauguucuuuucuuacauaucuucccuugguuccaccuccacaggcucuuaucugucacuggucaguaggguugccauggagacccugugaccucccccccucuuccccucccccauuugauuuuuagagacagggucucauguagcaccagcuggucgcaaacucacucuguagccuagaaugaccuugaauuucugauccuccugccuccagcacacuguagugggugggagugcuuggauuagagacauuugacaucacaccagcucucaaaauaaaauugcaaucccagaguaaauguccaugcagucccugccuguuacuuggggaguguacgacacagacccauccuguguguguguguauguauguguguauauguguuuucuagacaggguuucucuguguaccuugguuaucuugggccuggcuuuuagaccaggcuggccuugaauucacagagggccauuugccucugcuuccaaagucuugcgauuacagguauguccaccacuguccagcuaacaguucacucuuaagcuucucuucuuuaaagagacagucgcauguagcccauucgggccuugaacuuguagucaucuucuugcuucugccuccugagugaugggauuauaagugugugccaccaugccugguuuauauggcgcuauagguccaccucagggcacuguacaugaaaggaaagcaccuaucaacugaacaauauccauagccccuccauguuuuucauauuaucaagaccaucauuuaugagaccgugacuaucugacgguggugaguaaucacuaagaaacaagcauuuuaaaaaugcuuuguuauuugugauuguggguauguucaggcuuguagaagccaaagguuucugaucccccuggagcuggaauuacagacagcgugauguagaugccgggaauggagcaccucugcaagagcaauaugaguucuuagcuacugagccaucucucuagccuagaaacaaacagaaagagcaaggaaggaagcugggcagugguggcgcacaccuuugaucccagcacucuggcggcagaggcaggcagaucucugugaguuuaaggccagccuggucuacagagugaguuucaugacagccagagcuacacagugagaccuugucuuagaaaccaagccgggggcuggugagauggcucaggggguaggagcacccgacugcucuuccaaagguccaaaguucaaaucccagcaaccacaugguggcucacaaccauccauaaggagaucugaugcccucuucuggugcgucugaagacagcuacaguguacuuacauacaauaaauaaauaaaucuuuaaaaaaaaaaaaaaaaaaaagaagaaaccaagccaaaccaaacuacaaauaaaugaagcacuaaauagauacauugagaaaggacaugagagcagucugagacauguucaggguuaguuugacugaucagacaucucucucacugucacugcuccaugggugucucucuugaauguauucauucugucaaggaggaguagcuguguucccagauagacacaagcucuuaugagauagaaagccagggguggcuggagagauggcucaguggguaagagcacugacugcucuucccaagguccugaguucaaauuccagcaaccacaugguggcucacaaccaucuguaaugagagcugacacccucuucuguugcgucugcagacagcuacagauauacuaauaaauaaaucuagcugggcagugguggcgcacaccuuuaaucccagcacucgggaggcagaggcaaguggauggauuucugaguucgaggucagccuggucuacagagugaguuucaggacagccagagauauacacagaaacccugucucaaaaaaccaaaauuaguaaauaaaaaguaaauagauuuaaaaaaaaaaaaaaaaaagccgggcgugguggcgcacgccuuuaaucccagcacuugggaggcagaggcaggcagauuuccgaguuugaggccagccuggucuacagagcgaguuccaggacagccaggacuacacagagaaacccugucuugaaaaaccaaaaaaaaaaaaagaaaaaaaaaaggaaagaaagcccucuucagcuaagagagcuugugauacaugaggcuggugagauagcucaguggcugguuguuucuccagaagacucaggcucaguucucagcacccacgugauagcucacaaacauuaauaacuccaguuccaaggaauccaauacccucuucuggccaaaaggcaugcaugugguagugcacgaccacauacaggcacauaucugcacacacuaaagggagggugugcuugcugagugaucaugaaggaccugaggccccaucccagcacccacauaauaacguagguguccuagaacccuaguuccaaguggggcagggacaggaagauugcugggacugguugcuuucagccuaggggagaaaaaugagggacccagaggcccauauucauggagguauccuguuuuaaaaaggaguugacauggagugacaaacacuucgugacccucuccuaucucuggcaccuacaacugcauguacuuagaaacagaaccagaaacacacacacacaccccaucaguuucccacggcugccaaccacaugggugacagaucgucugcuacuucccuuguaaaacacagcaggaggagauuuacuguccucccuuucucauccaacagacaugggggagugcauugggugagauggcagcaggugagaugacuggcaaucauuucagaagagaggaggcgugcuccguucuuacccaucagagucagcuuccgaggccucugcuuggaugugaugacuugcaaagacggggcuauggauugaaugcgaaugauuggcugguuggggucguauguuccuggcacagccaacucaaggucucggcacaucagaaguuugggggacacauacugcagcuccagggaugugagcuuugaacaguuagaaaaggacuuagauuucugccacuccaaagaaaccgaaaugcaguuuaauugauuguucuuucaguaaauggcuacaagcaaugauuuuucuauaagucuccagcagaagcgagucuggaugcacagaugaacccaggaugccucgagagccuaccugggguagcugcuuugagauccgucugaacacgugauaguagaggucccaggcuugcgugagguccuugacguuccccgacuucauguacuuucgacaccauucuugugccuccauuaaaucucggccauaugccugagagggaaagcagaacaaaguuucaagcuaccaagguggccaugacugcagaaggcuaaauccccagcagucuacacuaguucugagggugcccgaggugugggcaccaggagggaaugcgcucccagggcaugaagauggccuaccccuaaagagaugcagggagagguaagggggaauccugcagugaaaaucucaauacguuucaagagugaucgagggcuugguagggcagugccugucugguaugugugaggaccuggguuugaucccucuagcauguuaugaacgugaacauaucguaaguggcuagagaggcaguucagugguuaaguacaauggcuguucuuccaggucuugaguucaauucccagcaccaaaugcagcucaaaaaauauauaacugcacuuugaugggaucugauguccuauucugguuugcauagaugcagacaaaacacccauauacauaagauaaauaaauaaaucucuuuuuuuagacaccaauaaguuuauuuaaaaaaagagggguuggagcuggagagauggcucagcgguuuagagcacugacugcuuguccagaaguccugaguucaauuccuagcaaccacuuaguggcucacaaccaucuguaaugagaucugaugcccucuucuggugugucugaagacagcaacaguguacucauauacauaaaauaaauaaaucuuuuuuaaaaauuggguugcuacaacaauuacauuuaaaaaaaaauauggagcacgucacgaaucugcacaucaucccuguguggggcugagcuaauuucucuguaguguuccaauuuagugcaugugcugcugaagcaagcacaacaguuacauuucuauuuuguuuuguuuuacuuuauuuuucugggcaugaguucuaggucuacgcuggccuugcauuuguaauucugcacagagcacuaagaugacaguuuucuaugcugugacuucuacuggguaccacuuuuaaggacaguagaaagguggaggaaagcagucuggggagguaggauaauguucugucacucugaucucauaccugauuaaaggauguuuccuucagagucuggggaccccguuccaucauagcaugcaggggcuccagcaccucaaacaugccuuucacguuccucuccccaaaguacaagcgagaugccucuuccaggccuucaugccacaucucaugccagaggauggcuacccgaaucagcucuucacucaccuggauuaaagggagaaagaaagauacaccacaggaagcuacgauugggaaggucuggcuuggagacagaagacacagcaugugccacgagggagagagguaaucacuaacaccccuggcugcugccucaagaccgacucaccaucauggccugcuggaccagcguguugcuguguucacacauguucuucaagaucuuguuggcugcauugugacgggcuguggugguagacuuagaagccaccgucaggggguagaugagggccuaagcaaacagaggaacacuuguaaaggcgagccaccaaagcaacagucaguggacucacgagaagcugcucagggucugcauguaccugugggugguaccgaccaauaucugugagaagcuggugaaugagccggcccaccaagggucugggugugucaauucuugcaaugagcugagguauaaccugguuuggaggaagauagagcaagcagcacgugagacguaggaaaggugacugauucucauguuuucuucuuuguguucuagacaaggccccauguagcccagggcagucaugcgccuuuugccucuaccucccaugcacugggaucucagcguguacuuugguuuagcaggucuugaaaugguguacccauucaguuuccuagcguaggcaagggggaguaucugguuuggagcuuggaaccaagcugugcuucugugaccacuggugauuuccagaggaccgcgacccauccucaccgucaccgaguucucaccuguaaccaagugucaaucuguauggccuucaccccuuccaccaaggcuucauugacaucuggccagugaccauaaucaaaccacagggugaggacucuggaaagacaggacaaaguuacagagaguuggguuuccugguucuuguucauuuuucaccagcaaggcagugaaugacugugacagguagcagagcucugaagcccaagugcuucaccacagguuggccagggucaccgaggcacaaacuuggcuguagaagugagcugggcagcucuguccgugcuggggaggugccugucugcaggaugggcagcagggaggcugaugggacaggccucgacccuucccucuccucuuccuccauccucacgggugaggccugguaagcuaucgggucucauggcccaggaggaaaaaaugucccuaugcuggccugaacuguacugaccagagagggugacuuccuuuaguuacauccuccccacuuccuuuguaccuuaguguauccuggagguuguugccucuugacaaggagauagaacggaagaagccuugaacagcagggacaguguacaacaagagaguuuuggauaaauccuguugaaacacaaguauauuauugaaacucuacucucuuaccuguaaaaugggcacaguugaacacugauggcacugccucagaggguagguaggagugugagacacugaugcuugaggagccaauggcauauagaaugacuccacaaaggcaccuguuuucauaaugauaguuuggcauaguauggcuuccugagcagggcaguagggguggagcuuaaggcucugaacaugcuguucucuguacuuucuggcugcccuguuacagugugagcugacaggccaaggggagaagacagggaaagaacagggcagaggacauauccgcaaggcccuggccucaguggcccuacagcuguggcagccacccacccacaggagcccugcacugagagaaugugcucauugcugggagaaggagccuugcuucagucugacggugcacacacgccugcacccagggagcacagcuucuggcauacaaugaggacggccaggcaguguguccagccuguguacccugucucagagaaagcccagaguuucacagccaucuucugugcagagccgugccccagccuguucugagugaggggaguuaccucagugaccuucuucugcagaggggacgggguggggcuguucucauugcucucagcuucacucucacuguugcugcccucugugcugguggcagcagcagcagaggcugcagugguggcugcagugguggcauuggugauguuggccccgcuggcaugacgcagcuucuucuucucaucacgggcuugguucugauguuuguaguguagcacugcuucgaaguucaucacugcccaugcaugccaagccuaggugcauggggaagagucaaaggcagacacaggcuaguucacgucuaaugcaaagcccagcgagguggaaggcuggauucugagugugccuuaagaucagcagaaugcgucuccauugcuacauacucccaggaagugggccuuacuacgaucaauguagcucaucuugagagcaguaacggcacugggcuuuuuggugagcacugugaggucacaaccagagggucaguguaagcaaaacuuagggcagguaggggcuagauaaggugggcagugggauaccagugaucugaagggcuccauaaaaaagggauuuggcuaagccuugccuugaacaaggagggaacagagacaggcacuugguguuccuggcagggaaaaaagaaaggcacauggagggcaugugugcagcuugaggcccgcaagagucagggccgcuggccaacugcuagagcaccagacaguggagucugcaugcuaggccaaggcagcuggcuucaucucaggaaguggggcuuccugagguccccgcccccaauuauuuuauauuaauggaugcuuugucugcauacauguucuguguaucacauauaugccuaguacuuaggauagccagaagagcauaccagauccccuggaacuggagcuauagguggcugugagcugacuaacaagcaaaccuucacuggauguauuugccagcucuggauauguagcuaucaauagaggagaaucauagccugcacucugugugugugcaugugugugugcauguugcuggagauggagccccuugcucugugcauguuaggcaaauacucucucacugagcuacaucccaagccaaagugcacaauuuucagaucagugugaagcaucugcagaggacaaacacuuuuuauuccaaauguuucuauggucuucaaaucaacuuugaucccagagggaagaauuuauaacuuccuaguaaggaugaagauuuuggaaagaaauugauggcauuguuauaccaaacaucuauuaccuggaagccuuuagaaaaggaauauauauauauauauguauaugcgcugcacuaaaaauacacacuuccuuccagggauagccucugcacccgcuggucagucagcuagccacuuucauacauuuucuaacuguuugucuuuuagaaagguuuccaguaacauaacaucauagauguuccuaggaugacaggcaucugugagaccaucagacacgguggcccuagagcuccuaaaacaagggcaucugucacaggaagugucccucaaagcaaagccucugucagcuucucugcuuuccugggcuuccugaaggaagauccacauuucuugggcuucugacagacuuaggcauuccagggaccuggcugugaccaugggaacaugggagaacucaagcaggguacaggcuuucucuguggagaagcgagggucuggggcagcaccagcccucccucaccuuguaccagcugcggucaugcucuguggcggcacuguaguacuguagcaccuuggggauggugcucucguugaugcccuggagguucagcugccacuccccaaguuucagaaaacaccugaaaacagaagagcaaggccccauguuguucucuucuaucaaaggccccgaaggagaacagcagauugcgagaguauccuaaagacuuccgacaguuacucuugcuuucaagaggcaacugauggauguucagcccugugaaaggaaggggaaaggguucuguagaaaacuuuggcggugucuuuucuucaggauuuaugucuuccagucacagcagaaaccuggugccugggacagguguaccugaacggaccccacuauguuuuguggaggacaguucugacuaccuuuuuccucacugaucuuuucugccucuguacuccuccauugcagacagcaacaaggcuaaugcuagccucuguugauugcuacuccaggcacugcucucugggcucgguucugggcuccuauaccaccucacaucacucuaggaaaccagggcacagagagacuaaucuaccuggagucagagcugucuacaccuggaauuauuaaaacaagacaccccagucagugagaggacucagcagguaaaggcacuugccaccaacccugaugaccugcccuccaugcuugggacucguaggacaggagggaacugaccuuuguaagcuguccucuuguuuccacaugcaugcugagucugaguaagugcacacacauacauagguacacagaggcaggcgcgcgcgcacacacacacacacacacuuaaaaauguguuuggaaauauggccagaugccaacuggaggcuggcacaggagugcuccugcugccaaagccuugggaaguaaggggcagagacugcagcagaugagcuaauggcugccugggauccuucugugggaaagugagaggugccagcagcaagcuacucuaggcgcccugaguggccuugcagagggcaggguggugggcagggcucaccuggccaugagcuuaugcagcuccugcuugugcugcugguccucuguggcgauggcaugcugggccugcugcugcauggucugcacaaaguguugcaugugcuggaaggcgucaaucuguagcaggacaaaggcacacagagccacugggcacacugcccacccuggcagggcaccuaagccagcacucucuaaaaggagcacccugggcugcauggugacgguccuacugcacagagaccagggcgugcugcugggagagggccgggcuaguccagcaaagucaugacucagcagcgguugagagcacugacugcucuuucagagguccugaguucaauucccaacaacuacaugguggcucacaaucauccgaugcccucuucuggugugucuaaacacagcuacaguguacucauauaaauaauaaauaaaucuuuuucuuuuuaaagacagggucucucuaguucuggcuguccuagaauucucucuguagaccaggcugaccucaaauucacaagaguuaccugucucugccuuccaaauguugggauuaacagcaagcgccacuaugcccugccugaaauagguuuuuuuuuuuuuaaagauuuuauuauuauacauaaguacacuguagcuguuuucagacgugccagaagagggcaucaggucuuauuaugggugguugugagcuaccaugugguugcugggauuugaacuccagacagucagaagagcagucagugcucuuacccgcugagucaucucuccagcccugaaagaggguuuuaaaguuauacaugguagcauaugccucugaucucuauauuuuaaaggcugaagcaggaagacugaaaguuugaaaucagcccuacucuuuuccaacuauugguauugauagacucugcagaggggaucacuauccacagcugguaccccuguugcgccuuagguaucagguagauacauacacacacccuagacagcuccaagcacacagcugcacacugcaguagguccuaagacagacaugaacgugagagagagauuuguggggggaaagagagugaacuggggggugguagggagaaugggagaagguaggggugagcugggucaucaucauauauuguacacaugugugaauuauuuaugaacaaauuaaaaaguaaaaacaaaaaccaaaaauaaacgcuaggcggggcagugaggugggguggggaagggagguuuaagccagggucugagugacagugacagauuggugagccaugaaugaggauggugcagacacacagacaugucuaaaagcagugaaauucuugcuuccuacagacauugcucucccagcuccacuguccuguacuggccuugacaauggauuagcaucuuucgugucucuuugguuuguuucuaggagggcuacacuguggacuuaaaugugacuuaaaacaaggcaggaggagggagcacugaaaagccugacugacauggauagcgaccucagcugucaaguguucucaagcaggcggcagcuacaccagaggcuccgcagccagggguccagugcucagggccuacaugcucuacgucacaggcaaugcagacaguucaaaguuuucuuucuucuuccuuuuuggugagacaggguuccuauguagcccuggcuguccugucacucacucuguagaccaggcuggcuucaaacucacagagaucuaucugccugaguacuggaauuaaagacauacuccacugcugcugguggcagucugaaugcuuugcuguggccuuuacaaagaaccagaacagggcugcugguauugcuguggggcugcccuauguauggcuaggaaccaugggugaacucaccaucuuucuacucuccagagcaaaaaacugaaaauauucuauuuaaaauuuucuuuacuucuuuagaaauaaagagggaaaaguaauuucuucccuucaguaagugaacuagcaguuaugaaaggaaggggagggccucucaggccccacacuagguggggguggggagaggaagaccagcccgucucuagacuuugucuugugucuuagcaaggaacacacaccuaucugaugccuuccugagggcaagaacugcuagucccuacuuuguguuuggaaaggcagagagaaaggacccuggugacaguacagggagggcuaugcagagacagcuugggcugucuccuugggcaaauccagcacucacucuuggcuugaagucuaaacacauccuucagguagguuucuagaucuuuaaccucaccagaguuugugugacuuagaaaagucaccgauggucugggcucugcuuauuacagugaaguacgucaguccuugguuaaggcaucucaaaggucucugcucucugcaggaaggcaaugcauaaagggcacacacacacccagcaccaucuguuauugucacuugccugcaaguguuaggucagggcucagagaaggaaaacaaaggaauccuccaacagugcgcucugggaggacagggccaucagugaggaggcaaaggcaguuacagagcagacagacaggcgacugcucacuucauucugagugucacucaaagucacaccagucaacuaccuuaggagaaccacuuuaagacugcagugggaacagaaggcuaaguucucuccccuuuugagaacgaugauggggaaccccaaacagguaugauguugccuucaaggccuguggguuuguaaacugccaccagcauccagagauuguuucaaacaaaaaacaagagcauaucuguuucccaaggacuugucuguaaacaagaaggaguucuccacuggcuucaggaacucccucuguguuuuagcauuucucccugcacgcugcugcauuugaguccaaaucgaugacaggaaaggagaccagaagucugagaagcuaauccagcugguucuauaaagcucuagucuggauuucaugaauaugggacuaugugccaaguggccggccuucucucaaggcccaggacuuuucagauacuaaagacuacaacugugacuucaugcacuggagucucgacuuggcugugacucccuugugaaacuggaagaagcccaacacuguaggugggugcgaccucugcugggagggcaggaaccuaccuuccgagcacuuuuccacauguucuucauguaggcauaggucacuugagggugagcgguuggcagaggauggucaaguugccgagauggaucaacucccaagagcaacacuaagguuuuaugagcaagagccuaaaaaacaagagggcaaguuacaaacagaacaggggcaggguaccaccccagugcugggguuacucaccagucugccacucuugccacacaggcuugcguacuugagccagguucucauguccucaugagggcugaccacaagggaccggaccaugaggauuuucugccaguccucaacaauacgcuggcagcccuggaagguucagaaaugagaguuagaccuguccucugcuccaccugaaaucucgcaccaacagccauguuuucuccaaaaacagggaaucacugugaaggaacuugucaagaaucagagaagcacagggugugguggccggagcugaguccuggugugccaaguacucuguggcuuugagacaguuaccaaaccuuucugacugaucuguggauuaaaaugaaaaugccauuaacuucacaggacugugguaauggguaaauuaaauuauuuagauucuuuguggguugugaguguauucuuuaaaaacaauuuuuuucuacacuuacuuguuugcauguacgaggguauguauaagccacaacaaauauguggaggucagaggacaguuugugggagacccauguggauuuuggggacugaacucaggcauacaaacauagcagaaagcacuuucauuccuuaagccaucuugcugucuccaauguaguguuugugugugcaugugugcugcguguucaauucuaggcaccgucucucagcugccuuucuuuucauacucuguucucuaaggcaggucuaucucaaaccuugagcgagacugguuggccacaaaaugcuggaugcucccgucuuugucuccccagugcugggaguacuagugcaggcuaucaccacauuaucaugguagcuuuucacagaggaacuccagucuucaugauugcuuaccaacugaaucaucucuccagcucccagguacugaauucaaagucaguguucuguuucacuugcccuuuuguuuuugagacauggucucacuucacagcccuggcuguccuagaacucacuauguagauuggaugaggcuggccuugaacuuaccgagaaacuacaggucucuaccuccuggaugcuggaauuaaaauaaugugccaucauucuggguucacucacuccuuuuuaaaauuuuauuuuauguguacggguguuuuaccugugugugcaugucuguguacaugugugcccaacccccacagaagccagaaggggacaccagaucuccugaaacugaguuacuaacaacuucaagcugauacauggauggguacuuagaauagaaccuguuuccucuaaaugaguagccagugcuuguagcuguugagccaucucuccagccauauauuguuuuaauauuaaguuuuagucacuggugaagaagacuauuacugaccaaaaauuaaauuuaaaauuuauuuuuaaaauucaaaagacuaagcguauaagacauuaaauaauuaaacuuuuaagugguguuauugauaaguugguaauauuuacauuucuaaaguuagugaggggcuggugagauggcucaguggguaaaagcacccgacugcucuuccgaagguccagaguucaaaucccagcaaccacaugguggcucacaaccaucuguaacaagaucugacucccucuucuggugugucugaagacagcuacaguguacuuacauauaauaauaaauaaaucuuuaaaaaaaaaaaaaguuagugaggccgaggcuugcaucuuuacagguauaguuucuugguguggugucacuggcuaccuuauauucccugcucguuuuauuaugucugaucaaaacugcaucuagaaaaggaaguggcuauagacuugauagcacaugccucuaaccccaacacuugggaggaagaggcaggaggauuucugugaguggucuucauggcgaguuucaggcuagccagagcuacauaauaagagccugccucaaaaaucaaguaaacaggagcuggacaguugguucagugguuaagagcacaggcugcucuuuaggggaccugagcuccauuccaagcacccaacagcagcucauaacugccuauaauuccaguuccaggggcgcugacaccuucuucuggccuccacaggagccaaacacauacauggugcacagacacacaugcagacaaaaacacccaugcacacaaaauaaauaaaucucccuucccccaaacagaaagaaaugcaacauaagaaaggacaugauuuguuuacuuacaugugaauccucugucauuagaaaaccugauaacugggcuggugagauggcucaguggguaagagcacccgacugcucuuccaaaggucaggaguucaaaucccagcaaccacaugguggcucacaaccauccauaacaagaucugacucccucuucuggugugucugaagacagcuacaguguacuuacauauaauaaauaaauaaauauuaaaaaaaaaaagaaaaccugacaacuuaauguuaucacaaagaugauguucuuccaccuuagcauagugcuugcugcugugugcauuauguguggaaguuaguggacagcuugugggagucggcuguuuccuccuucuaccauguacguccccgggacucaaacucaggacgccaggcuugguggcaagcaccuuugccacugggccaccuugccagcuuacacugauuuuuguaucaaaugacugguaggugaauuucacaaauccaaaaccuagugacagagaccucuagcuucuguauguuucauggggcacacugggccugaccugggaaccugagacaaaagacaugagcuacggcugaccuuuucaacugcccagagcccaacagugcuucugaggaucugagaugacuugaccacacguguggcggcuguccagccccagcagcucacugaguguuuugucugcacaccaccuuccagagccaaguuuccagcaggacaacucuauuuccagccuuggauaacagcuucccagcccacaagguugacaaugauuuggaaagugaggaaaaaggacaccgagugauuacucugauugccucucaccaacagcgagcuuuuucccucaugcugcaaucauuuggcucccuguaggcugaagagcaucuugcuguuuggagauagggcucaggaaggugauggcgauacucugaacuuggggaagcuagcacgagccacccccgccaucuaauuccaucaugcuccuuccaacucuguauuuccaaguucuccauacuggaaugucgagaucaucagcucccuaauuuggaagcuccacacccuaaugcaggcacuuaaaacaccagggcguguacaagccaagugggaagugcuuuccuuguggaauucuuucugagacaauuuuccaucaaaacauucacugggcauuuuauaauuacuaauaaaacauguagaagaacuguaugugcucacuucagagccauggaugacugugcccagugcucuuuccuguccaguggaaugugcccugagcuucccagacaggaaggcauccuggagucagaguuugucacagccuacuaaaaaacuuggaggcauaaaccuugauuggucuggagagaaagugggaauuagguguggaugcagccaagaagaaagaguuuaaaacuaaaggcauuaauuguaacaacaggaagaccagugguuuccagagcaguauaugaacacacaugugugguuuccagagcaguguguguacucauguacugucuuuagagcagugugugcuugagcaugugguacaggagguggaccucagggccccgggaugccaggcgagugcugggucacugagccacaccccuagugugcuucuucuuugcugaugaucuuucccucucauuuuucaaggacugggagacaggcugcucuuuccaggggcacuugagacccucccaggucuagagauaacagcuccucagguugccacgauuagaaugccacacugaaaugcuggcagaagccuuggcaaagucucucugagaucugaccagaggggcuaggaugagacuaaccuaagaguugucauaagcaggaguucugacucaaagcacucagcaacucugaugaaaacacggugccugugucuaguaacuguacucggaggggugguucucagcuggggucacacuguaaagucacuugagagccaggagagauucagauccuagguguauauauaugccaauguggaaagguaagugccucuccgagugaauacacuguggaggucucagcuggagcaucgugagagaaccagugagucccagguuaccauuuccaaguggagggucccaagugucacuugcucaaaacacacuuucuuccauuucuggaaaggccuggaaggagcugcuaaccggucauucccucagagccacagcugaggugguaagccuuugaaggcucugcuugggagagguggcagagcagagcacagcagaaaaggggugagggugcaagcgccccgcaggccugggguugucuccagcuuaccugcagucucucccaccagaucugccggaugaucucccgacgcucagggacaaguuuguacuggauaaccucuuccagcucggacagcauguggcaagaaaccauggccugacggaagcagaacauauuccagccuaauuuucauacaaacaacccccaagcagagugaaccugaaaccagccucugcugucaggauaucugcagaccccagaaacagcaaguucucagcaacuuguugcguccucaacagcccacucauuagggcuguagauucugacaacgugcaguugacucaacacucaccccauaggcucggcuguagcucucuccugccauggcagucagcucugcauccagcaggucccuggccuugucaaugcacuaggaaagaaaccaggaagcucuagaccugggcucugcauuuggggcuucauagaaguuaucuguaucacucuagugucacucaccacaggagggcagaaaacccgcuuaaucuggauggccagagaagagcacucacuccccagcgucucaucaaagacugagcggcccauggcauuggcaagcagaagcucaaggaaugcucacaagcuuggguggugaggagggaacgugugcuauggggcagaauugcugcacucuugcacaguaaugggcuguccuugggcccugccuucguuucauucccuugaugggcauguugugguaacagacuggacacggaauuggcucuaagguggggucaaggagugcuucugcaaugcucucuauagcaaugggugccucugucucugacccgggagacccagguguggaauccugucaagcacucuaucuagcacagggcuaccacaggauugcaucugcaccuucucugcuaccacuuaaaauaaaacuccucuuguggaguuuuucuuuuuuugaauguuuuaggcuaauuacuauguuggcaucucugagguacucagaucauuuacugacagucuggugucugacaagguggagacaaccacuucauuaugcauucugcaaguuagaacagugugugcucucuggguccagaagauccccacacuggggaucuggcucuccaaauccucgcuuggugaaacuuaagagcuccucucacuagacuagaacuuaggcaagguguuuacaagggccgacaaugacccaagaagcuacugccaaagcagucacaauccacacugcccaccuccaaccucccuuccaggaacacuccagaagccuagccuacucuucucugugguggaugcuaugugugaaggccauucaauaaagaaugcagacgagugcuuaggaaucaaaagacacacagacacacagacagacagacagacagacagacagacagacagacacacacacagacacacacacacacagacauacacacacacacacacacacacacacacacacacacacacacacacacacacacacacacacacacacgauaacuuuguuuccuuuccuuugcugacagucaggaugcgcauuuuucaccugcugggccaaggagaagagauccugauguagagccaacacugcccuguaaaaggcuccaucgugggugucccgugggaucaugcagguguacuccuccaugcugucccacugaccuaggaaaacaaacacacgacacagagucagggggacagcuggcucaauuggaggcaccaccaaaucuugucauugauaccuucacuuagcuugagauacacacaagucaaauggacuggggccugauguaccugcugagcccugcaaucuacugugggugguucacuuaacaaaaccacaucugucuucuaagcgagggacucugcuggugccccagggaguaucauaagacaagaagcagggccuaaaugcaaagccagcacaucagacaggcuuaaugcuaccccucauuaacccauagagcucccuucacagcuucuccagguaagacaaaaucacauucuucccuacaagugagcaccucacagcucaaugaaauacugggaaauuacauuuuccuuuaagcaauugaaaauggccaucauacaauuagaggacagguuuugacaaacuguuugcccuuuucacuguggcaauauccuagccacaaauauuuaaaaauaauccauuacagcagagagacgggcuggucacugcgcagugaucucuugugucauguuagaauggagaaauggcugccccagggagagguauguacuuccuccccuggugcugagcaggcacccaacgucaguccugccaacaccaucugcagaagagauaccagccucauuaggugcaaacugcagggcugcuguuuuuacaaggcauuuuccagcauuccacucccaacuauugguucauccauuaccaaugccucugggcaaaagcagacagcaauagaugacuccucaggaagcaauuuguuuuuaaaagccauucuggacgaagcccagggcuuacgacagcaaagcauagaagcgcagugacuaggggggcuguggggcaguugcuacucugcucuaggcuccggggaugguucugcacacgccacauccugucucuccucuccugucccaucuagaaaugcagaguuggaggcuagaggaauggcucagcagugaagagcuuauacggcucuuggagggaagcagaguuugguucccagaaccuacaugagguugucucacaaccaccccuaacuccagcuccaggaggaucugacccuguggccccucugacaccugcacucacaugcuuagagcuacagacacauaaacacaauuaaaaaugagcaaacagccaagcaugguugcgcacgccuuuaaucccagcacucgggaggcagaggcagguggauuucugaguucaagaccagccuggucuacaaagugaguuccaggaaagccagggcuauacagagaaacccugucucgaaacaaacaaacaaacaaacaaacaaacaccaaaaaaaagagcaaauaaacaaaaagaaaaagacccggaagccucaguuagguggugucaaaagucuacauaucuggacaggcaaggcagagugcaccuuuaauccagcacuggggaggcagaggcagguggugaguuccacgacagccagggccacaagaugaaacuccaucuaaaaaauaaacaaaauaucuuuauaacaggcucuaguagcagggaaaaccgauaaaacgugauugaaauguuugugacuguuggagaaggugguggcaugugggacauuauugucccagucaguuauacacguagugaaagaccuauaaacauuaagaaacaaagugagggggcuggugagacgguucagugaguaagagcaccgacugcucuucugaagguccugaguucaauuccuagcaaccacaugguggcucacaaccaucuguagcgagaucugaugcccucuucuggagugucugaaaacagcuacaguguacuuacauauaauaaauaaauaaaucuugaaaagaaaagaaaggaaaagaaaagaaaagaagcgagacaggccuucuauccuaucugaggcacaggggauagguggugcucuaacaacguacagaucacguggugaaaagguaccgcacacacagguggcagggaaagcuaaggcaagaaagccaagugccaaauuccaccacgacauaaauacaucuacuuccuuaucccuguuuccugucacagggcuucuaaaacccuggaguuuccuguggggcaagacuguuuuuuuuuaacaagauacuaggacuggggcuggugagauggcucaguggguaagagcgcccgacugcucuuccgaagguccagaguucaaaucccagcaaccacaugguggcucacaaccauccguaacaagaucugacucccccuucuggugugucugaagacagcuacaguguacuuacauauaauaauaaauaaaucuuuaaaaaaaaaaaaagauacuaggacugcaacccacccacaagcuggugugcugcagcaauuuccucugagauaaagaugccaucuccgaggaaagcuccuuaggacuuaggauguuuugaaggaggguuggguguggggugguccaagcugccaggaagcucugaaaacuccugaaguaaccaaacucgaaagcuccaggaaguuccugaaacucaucaucugcaccagccccucccuccauccccaagcacuaagauguuuugacacucaagacaagcugagcugccugccagagacuccaaccuguuuagcuaucugcaaauugugcagugaacguuuucaugagcugcuaccuagcuggggugggcuuuuauaagcuaccccugacccauauugcuauaagggaugccacaggcauucacagagcuggacuuuggaggcauccuguuguuuccuguaagaggagagcaaugccacuggugucaaacaugaguguaggcaugugggccugagucccugaacuguaaggggugauagcuuacccacaucucaaucccaaucucgcuuacugagcuauuuuuacccaugccucaggaguuugucaaaaugacagugaaaauggacugauggaaggcaucaguacauuggcagggauggccuuuacauucuuacagacuguuaucccugcaucauggcagcucauucuuugauauaccaaagcccccaacuuggcuuaccuaaaccccacgcugcagcagcagccauccgggccaucuuagccugggucucaucauuaaccagaguccacuuuucacagcacugcugaugaagcuggccccuggaguaagagaaacgugcagucagguuagcagaacuuuacucuacaacccaugaauuucuucugggcuagccaggguccacaguaacugguuguuugaacuugggagccucaaaacagagaagugaaugaauuguuugugguuucuagggucuagugagaguuuauaaagcagaaugcagugucuaacucugugugauauaaaauaucuucaacaucuggugccuuaauaacuacuaaguuaauuuuuguccucucaguacaggcucgggucuuuuuauguggcaggucuacagagaaagcaaucuaagagaaacaucugaacauuccuuuugagggcacagcuacagagaaggccggcucuuacaaguacuacuaaugucugacuucagucugagaugaacucaauguaugcagaaauaaggucccaucaaccaaacaccaggaagccacuugcucucagaguggugcacaguuauuaaggguauaggaaaggacugagagggucuuacaguuuuauuuuaauuuuaauuuauuuauuuauuuauuuauuuauuuauuuauuuauuuauuuauuuauuuauuuauuuauuuuccgagacaggguuucucuguguagcccuggcuguccuggaacucacuuuguagaccaggcuggccucgaacucagaaauccaccugccucugccucccaagugcugggauuaaaggcaugcgccaccacaccuggcuuaaaguuuuauuuuaaauuaagaaacaaaauaaacugagcauuuguaugugugacuuuugugcaagugcuuguggaggccagaagagguguguguguccucuggagcuggagcaggccgugagcaccuccaugcgggggcuugggcuccgugcaagacugaugagccaguccuucagcccucucucgagcuaucuguuuuugacacagaauuuuauguagcucaggauggccacaaauuuacugugcagccaagguuggccuugaaauccugauccuuaggccaacagugguggugcacgcuuuuagucccagcacuugggagacagaggcaggcagauuucugaguucgaggacagccuggucuacagugugaguuccaggacagccagggcuacacagagaaacccugucucaaaaaaccaaaacaaaaacaaacaaacaaacaaacaacauucuuacccucuugucucuaccucucaagugcugggacuacuggcacacgcauuaugacccagacacugaggugugggcagugcuuaagacauuccaacagggcuggagagacggcucagugcguaagagcacuggcugcucuuccagaggacccggguucaguccucagcacccacacggaagcuuacaacugaccuaaagacaucuuggaaccuuuauggcuacaaggcacaaauguggugcguguauauauauauauauauaauauacacacaaagaaaacacucagacacaaaaauacaacuuaaaauacaaauuuaaaaaguccuaaaauaaaaacagaaccacaccaagaauagugauuuucauuuuguugagacagggucccacuuuguagcucaaacagaccuacaacucacuauguagccuaggaugcccucaaacuugaggcgauucucuugcuccagccucucaauuaucacagguguaagacaccacgccugacaagaaaagaaaccucuauggcuagcuaagaaugugcccucuuagggucugcaguguggcucaacgguccugggcucaaaccccagccaaaaagagaacaagugaacaggagagaaaucacacagcuguugccuccacuucccauguccgcacugcgcuagggcaagcccugaguucacaggagcuucaagaugcagcaaggagccucuuccaccucuccuuuuggagagacacacagcuuggaagucgauucaaaggaaacagcacaaguuccaaggggccugcccaggcuggaagccugagaggacauaggccacacuguuacuacucaaggaccaacuucuuucuuuaaaauaaauaaaaacguugacauugaauuuauuuauuugugugggucagagcacaggaacaacugacuggugcguuuuuguuaggacaacuccagggucucccaaagaaagauaucaccauuaucuguaaaugauccuaccaggcugcguacauuuuuauugcuguauauucacuguccaguguggcacuucauaaagacaauggaggcugauacugggugucuuccugucagauagucggccuccaucugguguuagagacaggucucucuggacccagaacucaguccccggccggucugcuggccagucagccccagggagcugccccuccgucucccagcucagcugcggacacgggugcuacgcguccaagagcaaggcucacgcuuacaugccagcuacuuuacugagccaucuucccagcucagaauuccauuguucuuaugguuugguggcuacaggccaguuagccucccuccacugcugcgaugccaggggcugagggauuuugcuuuuucccuuuucaacgggaggcaagcagaagugaacacagagcacaugccccccacuacagcgcaacaggcagggaucccucacuugcuuacaaacacuggcacugacuggagcagagagcacugagggugggggaggggauggcuguagacugagucugagccccuugagaagaaaagagaagaagcucuaggagucugaccucccacccagugcggcugcugcagcaggaggcuuagcaagcccuuucauuuggaguacuuucccuagcuggccgcccugugcuuauuuuaacagcacugacuguuccuggagacucugggcugggggaguguggaggugggugugucucuccugcuaaggugcugggcuccaucucuaauuagcacccagaaggcaaaugagcacagaaaggggcaauuuuacccucacugcugagucccugugguugauucugauggagccuucaguggaugccugccucaggcagguucagaauacugcucacacagaaagacacucagaaaaugcccacuaaacagaacggauuaauaagccuuaucagaaaccuggaaagggcaggaaggaguucugcuucucucaucuccuuuaaugucucuuuuagauuuccacauccuuaaagcccucucuugcuucgucagcacuacuaggcccuguagacuuuguagguaauuauaaaacuggaaagaacccaagagacaggagguguaugggaguggaaacugugggggaagaggccaguggcacuugcucucgggagaccucaggcugugagccugguauuuaagggggcuggacaaaaccacaucucugcuuuuccaaggcauccacgcugucccuacuugguacagucaggggaaguauuaucucuaauugaaaaggaagggcaagagaaaggaaaggccaugaaagaguccaaggaaaagaaacugugguuuuaaagauagagcaggagaagacagggauggcagcagaagggaaggaaggaacaagaacaaacacuuaagagaaugaccaggcagcucagacacaaggacaggccacugaggaacaggugaaggaagaaguggguaaggcuacaaggcagacaggucaaaggucacuggggagcacgaaagccuuucagagccgaucagauccaaauuuuaggaacauuuacaccucuuuuacaucucuucuaagcaaugguuguaggacagcagaguuaaaaugagaacaaacaaaucucuguuuuuagguagcauggcucacucugaacaucacuuccuuccuccauccggaucagagcggcccagcagagcuugccgugaagauggaaaguucuggguacacugugugaugaaggagccaucagccacgugugcuucugagcacugaugugaggccagcaugacuguggaacugacuuuacaucuuauuccauuuuaaaauagccaggcguagccagcggcuacuguugcagggaaugagguucuagaugcccguuaguuguauaaacuagggaggcagguuugauagaauacgcuuccuccauucacugaggaauaaauauaaaacguucauuuggaaaauacauaaaacaguaauuuuuaggucucccaguucuagauaauuagacaaacaauuuucaauuguuuuugucuguucacucacccaucuacccaucugccaucuguguguauauaauuuauuuggauccauguguguauacagaggccagaagucaaugcuguucacgcacacacaugggaguguacugaguguguguguguaggccaguggaggaugucaaguguccugugcuaucacugucugccucaauuacuuggauacagugacuuuuuuuuaauuaaacaaaaaguuuuauauguauggguguuuugccugcauguguaccagguguaugccuggugcccacagagaccagaagagggcauuagaucccuggaacuagaguuccagacaguuauaagcugccaugugcgugcugggaaucaaacccagguucucuggaagagcagucaguguuuuaacagcugagcugccucucggucuccccaaaaagguuuuucccugagccuggagccaggcuggcuguguuaagucuggcaaagcucuugucucucccugccacagugcuuggccauaccagcccuucaugugccacgcccagcucuccauguggcccugggauaugaaggagcccucaugcucugcagcucauguucuuacaagggagccuucucuccaccugccgccuugccccuuauuuucugaaacaggauuucuuucugagcccagaacucaccaacagggcaggacuggcaggcagaggcacuagagauccacggguuuguuucucuagcucuacgccucugccugggcacugggggucugaacucagaccccugugcugcuuguacagcacacacuuuacugacugacccauccucccacucucugucuaucugaaacucucuuuuguuguuguuuuucuauguuguacagcacacacuuuacugacugacccauccucccagccucugucuaucugaaacucucuuuuguuguuguuuuucuauguuguacagcacacacuuuacugacugacccauccucccagccucugucuaucugaaacucucuuuuguuguuguuuuucuauguagaguuggcuguccuggaacucacucuauagaccagguugaguuugaacucagagauccaccugccucugccucccaagugcugggauuaaagaugugaaccacuaucacccaggugaaauucuuguuuguggcuaaauuuauugacauuaaauuaucacgcaaaaccacuaugcuauguucuauccuggggauuauagcuaccacuauggagaacuaaaagccacagugacuuucccaaagagugauagguaauuagcuagauggaacuuacuauguagaccaggcuggccucaaacucacagagauccaccugccuuaaaggcagccuagcccccaaagagcugaucauuagaaucuguuuuuuaaaacguaugauuuacuucuuucuauuuauguguauggguauucugccugcaugugcaugucuguguaccaugugcaugcagugcuugaagaggccaaaagagggcacuggauccuuugguagaagauugccagcugcucuggaugcugggaagagaacccaggcccucugcaagaguagccagugcuuuuagcugcuaagccaucgcuccagacccaagagcuaaucauuaaaaaaauuaaagcuguaaagugaguucuuuagcagaucugccaaugucaggagcacaagagaacagauggguggagagagugcagugcccagggucacauggcucuucugccuggaccauuuugcaggguaagaaaccaaaaagcauaaaacagcgaagcugcagacaguggcucacagccccaauucuacuacuaggguggcugaggcaagaggacugccacaaguucaagucagucuaggcuagacaaguuccaggccaguaugggcuauaaggugagagugacucaaacaacaaagcaaaccaaagaaagcaaacccagaccaaggaacaccacaggucagaaacaccacagcuguggaugcuuccuggaaugcaucgggugacacagagcaggagucugaggugagaucgguuaggggcagacucacuggcaagaugagccuagccauucaacucaggucaucacuccagugaagcucaccauucccccaaggccucgaggcagcgcauucggcccagcaucagcuccgggucuuccuuguuuguguccaucuucuugucguaggccacgagagcauccucccacucaugcagcuucucauaccagguggccuggaucuccugcagagagcaaggguacgcucugaguccucacacucuccuacacugcaccauacucaucacacgcuucccuaucagcaugucccagcugagaccgacaagcacuuaucuggaccuucguuguucggcagagguagggaugcuaguuccuacacacacuaauggcugauccugaaugccaagauacacugagagcacguggugaagaguccagccccauccccaucacuuugguacauaggggacaccugcagggagagugggaccccaaccacagguccugcacuccagucugcugcacugcuaacuccgggcugugugacaggcacagcagcccaggccacagcugcuucuuuguagaagccuuugauucuccgcauucuuaaugcauuucuaaacuuucaggaaauaauuuaaaauacaacacaaugcuacuacuuaaaauucucuggacaaccuuuuauccuucuacagucuuccauccaacauucccaacauucccuccuguguaguacuuggcaccucuaccucugucaaggccaaaggagggauuccauuauucuggccgacagagugccacgcugauggugagugguguccacaggaguaagggaaguuccucagccuggaaguuccagacagaaucaucagagacuguuuuaugaguuuucugucugccuuugaguuucuucaucagcucaguggaagacuuauuucuguaucagggcuauaagcucuccagacgguccuuaaggaacaacaugauucugagguggaacuuguacaugauaaauacagggcccacauuaguuuucccugcuucuuucucgccuuucuagauaaaacugauguuuauagagcagauacagaaaaaaaaaaaucaauacucugcuguguggccugaagagcaucuuccugaacccagguaagagccauugugcaaugcugacggcauuuucuuccaauauucccuuugcccacgcacuacugccguaucagccuuagccccacugccagugggguuuguggagaucagccuaucuaagguaaacuaaacuucgucuuuaagccaagaauaaugccucuauuuugccuacauauaaaaaagagcuuggagaagaauggcuuagagacaguguagagggaggacacuggggaggaauggcuuagagacaguguagagggaggacacuggggaggaguggcuuagagacaguguagagggacauucuaagaugaaggacaucacagauaaaugucccaggcugagcuucugcucgaggagccaguggcugaugaguggcacacucugugaaccagcagaaaguagagggagcagcauauggugcaggucaagcagggggcaggacauuuugaauugcaauggguuggagaaacucuaagguuuaagcaaugaaucacacaaauucuaaugagauugcuguuacauaaauugugcugagaaagcacaggcucugccaagaaaaggcaaaccauugucaagcuuaauacgauucagcuaccuaaauauaacagaaauccugccaugguuuagcaauaaccccgagcuaauggccaccuuuagaaccuggagauggagagccuuucauuuauggcucugagcacuggagcaugagccaucugcuggcagaucacccaagcaccagaugugugaagagcucuuguuucccucagacucaagggggcccaagcucuggggauauugcagcagaguacagccuggucugaggagcacacagugugcuuucugcuuccgcaaacaaagacguggcaaagacgcugagaugucauucuuuguguuuuguugucaucuggagagaggcugcccucagucuguuuacaggcaauauguguuuaagauggugaaagaaagccuguuguuccaggccaaugaggcacagugcuggacaucagacagaagagccugccucuugauaauggcaaagcacuguaagugaccuacacaauuaauaaaaggcuccacaucaaauauauggacccggaguuuccugaaccuccggggucccaguguuaaacugauuaaguuagugcuuuauaaauucaugguuaaucaaagcacccugucaaaccacaaggaaucaugggaaugauuuguuuauaauagacaaggacggcagcagagaagcaccuacaugaguaagaaugcaacagucccuggguaucagauagaaauuaaaaggaugccuuuauuguccccuuggggaauuagccaguuucuaacgcacuguagugagugugaacucagggacaggcacagggcucugccauggguagcacacaggucaugggcuaggcugaaugguggucuugguccuggccugcccagaaaauguccuggcccugccuuguuuugcucuguuagcucagacagguguucauccugcuggguccauaguccccucacuugagaaaggggauaaugauaauagccacuucguagugucccugugagcauggagccaaaugaagcagguggaguauccaucccagagugaagcccaugcuaggaguucacagcacucgccacugcggguuucuacuccaugugaacgaguuuucccuugcauugcacacuucauccuuaagagucaggggaagccuuacagacugaagaaaaacccccagaaauccaaaguaacuuucucaagguagcagccaacugacuuuggagccaagucucuacuuuuuaccuuucuagaaagaaacagaaggugggcuggagagauggcucagugguuaagagcacugacugcucuuccagagguccugaauucaauucccagcaaccacaugguggcucacaaccaucuguaaugagaucugauacccucccucuucuggugugucugaagacagcuacaguguacucauacauaauaaaauaaauauaucaaucuuaaaacaagaaaagaaaagagagagagaaaaagcacucaccagcucuccgaaguguuucauggcguauuccaacaccccagaagcugccucaggcugcuggagcuuguuguuaaugcugaggggaaagaaggaauaguuacacccaugcaucugagggcaaaggacuggggacacuacaggcaagguggcucagcagcaccugaggaugaguucccacagacucaaggguuauuugucaccugucacuucccagaaagcuuggcuugaaucugagaaaggguucugguuuccugcccccagucaggacaguccaugcuaguaugugauccucugggcuuguucuccugacaccagagacuggcucccugcucccucucgugcugucuggcaggcagcguguggccaaagccucccucuagcaagcuaggcaugugcuuuacuacugaacuaugcccucagccaugcaucuacgcauuuuaaaacugggacuggagcgauggcucagggaugaagagcagucccugagucuucuaucugagaggaugcauguuugcccuugccgaggauccagguuugguuuucagcacccacaggucagcucacaacugccuuuaacucaaguuccagggggauuuacacucucaucuggccucucugggcacugcacauacaucgugcacauauauacccacaggcaaacacucacugacauaaaauaaagcuaauuuuuaaaaugacagaguuccuaggaucuccauucacgcugacggcuuaucauccagggcccacuauuuucaaacccacagccuucuuuggucucucuuaggaacccacccccaccuccccgcagucagucugcaaaagcagagcuucuagugcuggccgucaggauauggauaauuuccacugggauucugcuuuacugaugucaucugcagguggugcuggggcccacaggacuggagaccuguacugugugugggcugcugaguagugccucuggaaugccugguccccggagugaagcaaucagaggcuucaagauggcccuaaauuugggaggagagccacagucccuuagucugagaggaacuugugcaacuaagccaguacugaagccaaccugcuacugagauggaaggcagggaaucggggagagcaucaggcaggcaacaauggcuauauccaguuacugggcagcaaagaccaacaugggacacaccaacuugggaagucuugcugauuaaaccaacauggaucuaguuuacugcagaguacaaacuguccacuugaguagaauuaauuuuuaagugguuuugggaaauuucaggauuugggcuccaugugguaauauggcaaaagguugcuguuauuaauacauuguuuuuaauuccacuacuuuuuuuccaauaaaacugaaaggaacugcccagaaaucugauggacuagagaaguuaacaucugugcauguaauaauagaaugucucauguuuacgaagcacaguuguaacaauccuuccagucauuuccuuuggcuucacauagcugagaaaaucaggaaagaaagguuagaauuaguucucucuuauuaauguggaugccaagucaaagaaaggcaaaaagccccuaaacucacacugaaucagaaugcgcucccccugcccccccccccagaauauugggagcaacagaauaucucuauuaauaagugagagugggcuggcaagacggcgcaaggcacuugcugccaagccugacaucugagcuugacccccagaacccacaugguaucaggaaaaacggacucuuggaaacaacacaucacagcacgugagccccucaucucagugguccacugucacaggggaggguggacugcacugcuaaccaacacuacucugucuagcucugucucuaguucucuaacaagguaauaguuuuguuagucuaagacaacaggaaaaaggaagcugguacacacuccccgaguccucaguggacuccugaggaugccguggugagaggaacccugguaggaagaugaagugcucuaaccagagugcuaauucggagaaacagauuaaaaacaaaaacaaacaagaaacuaccaccucccacuuuuagcagcuguguucuaaagcuuguguucuggaacacacucuauuuaaagaacaaacuacaaacaguuacaaaguacuugguuugcuuugagacucacugacauugugguuaaagaaaaaaccaaaaccacacaugccuuugccuaauccauuuugccacuaauuaugcacaaaagagaguuuaacaauaacucaucagaaucaggaagugacaaaccaaauguuucacuagugcuccgacucagcaacguagccuugcuggacagagcaguauagcacugcgcauggagggugugcauggucauggagucgggaagcuucuugcccccacagguuguucuuguguaguggaaaggaaaaccacugaaaacugccugagagagacagccaugaagaaugaaugggcacaaccagcuaagcucagucuuggaucugaggccuacaggacccagaccuugcuccagggagccuguguuuuagagguuuuaacgcuuccuuggccuucugugacccuaccuucaggggcaaugcacugugacagcucccuucgucagacagagcacucacuucaugggucaaguacuacauuucugugugggaucucagcccuaggcagcugacaguuauuaacagacccaguaacuacauaaagaaaggaggucacagucuguggagugccaugccaccauuucaaagcuaccuuagagucggugagaaggaucuugacgaccugaguucaaucccugggaccaacaguagcaggagagaaccaaggucugaccgucauccucuguacaccauguggauauaucacuuugugagaauaaaagaauagggcauguguucugcgcuugugaaggagucaccuuugaucugaaaaacccauuuuauggcaccuggguaugucaugaagccccuuccauaagcccuuccugugugccccuggcccccaaguguuaaggggcaacugaucugagacuuggccuagcagcagggagugcuugcuacaaagcagcucucacugaugccgguggaagacaggacagcaugcaacuccagagacugguguuccggugggcagcucgcagcucuacacccacgcccacggucccagacacgacaggccaggcagacuucccauuauacucugcaccgcucaugccgaggccagaaugcaggaguuuucugagccaagaggucugaacuuaagcugcaggguacgucuguagccuccauuuuccuugagauuacucgggcgcugucuuacauaguuaugaaucuacaaagcaagucaaaacugcuuaccugcaaauaaaaccagaguccacaaacagaccugauuuuaggaaaugaaaaaauaacugggaaagaggcuuauucauucuguucuuuucuuuuuaaaguggggcugaauucaagagcuagaaacugggggcguucuugccaaauuaggaaagcguucucuggagcugaguaggcuuagugaguaagacaagacgcugccucaauguccuucacagacuagaucacacauggugcuucuucucuaggacucaaacucuuuccugaggcuggaaaagcaggcuggugagacuccagaaagagguucugaagugaggggaauuauugcugccacagggagagaugacugagacuccaguggagcaagagggucugacaccuguggccccccacucaaccuggcccucuguucuuuuucuuaucuuucuauuuuaauuuuaauuuguuuuguuuaguuuguuuugcaagacagggucuuucuuuguagcccuggcugaguuaagaggcucagggagagcuguccacaccaagccugaagcgagagaugcccaggcugacuggagcaucugggcuccaucugaaaugcuugggcuuccccugugcuccaucagaaauuuaugagaauguuacugcuugcuuccacauggccccaggccuuccuucuaaggcagacugcugucucccuuucacuugguuccccgucaaggaaggauucucugaauucccuuggcaccgugcugaugacacaugcagcacagcuggcaggagauggguggaacaggguguccugaccagccacaaggaacaccgcuuugggucccuaccaccucaucacaccuugccauggcauagaacugcuuccgauuccccugcuacuucucccaggacugagucuuaguucugugcccaacacggauuaacaucagaaugggcugaugccccccgcccacccacccacccccacccccaccccucgagccaggaucaaagggccgguuaacccugauguccucacugggcagagucucggaacaagagaauggucuguacagggaccacagccacagucucuuucuuccccuggagcugaggccugagcccagggcagugcccugcacuagaccagugagcuaaaucccugaccccaaccuucucuucuggaauagauuagcuucaagauggaaggacagcagugcagacagcaagcaaagggucauuugaaacuuaacacauuagaggugagguggggucacguaaaugaagacaggaaggaauacguuuggaaacucuaaggucuuugaauuaaucaccugaaaaaggugagaugcucgguggguaagggcucuugucaccaagacuaaugacucgaguuugacuuccugaacucacguggcagagggugaaaacugacuuccaaaagcugcccucaacuuccacaugugugauauacuacacagaugugcuaacauucucuuucucucucucucucucucucucucucucucucucucucucucucucucucucucucucucacacacacacacacacacacacacacacacacacacacacacacuuaacuaaauuuaauuuuuaaaacgcuuagggaaagaaaacuuuggcauuuccccuacauaaaagcaaggacagacaggccccaucauagguauucaaacuagggcauuuugguuccguuugcaacucuuggggaaucuguguuacgaagacuuaaaaaugguugaaugcacagggcagugguggcgcacgccuuuaaucccagcacuugggaggcagacagauuucugaguucaaggccagcaugguuuacaaagugaguuccaggacagccagggcuacacagagaaacccugucucgaaaaacaaacaaacaaacaaacaaacaaacaaagaaaaacaaacaaacaaaacaaaacaaaaaaaaggaaguuugaaugcuugcuacacaaucaugaagagcggaguucagaucccagcacccacauaacaagccaggcguccugggcacgccauaacugcucugagugggaugcaaacauggcuggcugggacuugcuggcuucuagucuagcugaugaaaacacaaaccccagguucagggagagacucugucucaaaggaauagugaagaucgauagaggccaccaggucuuccugugugugcacaggugugugugccccaccucaugugugcacauucucccuucccucuccucaaaucaaucuuuauuaaauggugggugugcuaggcacaguagcacaugauuauaauccuagcguuuaggacgcugagguaggauuguaaacuaaaaaaaaaguucauguaaaccauaugguuauguuucacaaagguuccugaugucuuaaucccagaguuuccucugaaggacaagcucuccagcauucuccucccucgcuuugggcagcuacuaugugucugucauauccagaagauguguuaagugcacuugagacugugugauccucauggcuaaagagaguaacugguaacaggcaucuaggugaggaaaacagauaaaagaacuuugccuuuagaaguugaagaagagggcuagagagaugguucagcaguuaagauugcucuuccaaaagguccggaguucaaauaccagcaaccacacagugguucacaaccaucuguaaugagacaggaugcccuguucuagugugucugaaaacagcuacaguguacuuacauaacaaauaaauaaaucuuaaaaaaaaaaaggaaaaggaaguugaugagggugaauguaucuucuauaaaauuuucauuugcuuauuuuauuacuugguuuucugagauagucuuccuguguagccaaggcuggcccuugaaagugagugcuauucauaggucagucagagugcugggaacacaggcauaagcuaccaugcuugacaaagcaucuuuguaauuugguggggaagggagacacagaggccaacaugguuuuugguggcccaaggugcuggugacugaacccauggccucacacgugaguuaggcagcgcuaucccacugaccuccaucucuagccuucccagcccaaauuaagaaauauuauggguagggaagcuccuuacaauauaauuuuaacugcaaaauaauccuggcuauacauauuaaauuuauucugcacagugaugcccagcaaaugccccugcauucugacuuugcacauaacaaagggauuuucuauuuacucagauacuucauacuucucguuuugugaguuuugaaauggucucacuacguagcccagguuaacuuugaauuuucuauacucuugguucagucucugcagugugggcuaucacaauugcucucacaauucuuuuuaaugcuaugccaccaagccaccaccaagaggauccagcugacuggcaguggugcccgguugguccaggacacaaggaaagccgaacauacacacacaacuccaugcucuccccgcucagugacugcuccugcacaagagggcaggacugccucuggaaacuguccuggaggcuaggcccugccugcccauaggcugcagacauccccuggcuggaggugggccucauaccuaauacagcccagcguguggcacagguugguucaagccucagagugucaaggcacaggaucggcgcgggccaguuuuccaacugcgggccuguuggaggcacgcuguaaaagugaugaauggcugucacauuuccaaggcucuggcugauuuagugagcuauuggcaggcacacugcucccagcgugucagccaguuaauuacuuccaacuuuaucuuuuuugucagugcuucuugacaaauuggcuguuaucuuuuuauucugcaacaucgagcacugccccucuucuggggaugccuggaggguuuccuccccuuccugcuucuuccuguccagagugaaaugaggagcuuagagagagacuuggaaagaagcugauggagagggcuccaaaggucaaccugaagcuaguuugaucuaucuggaugcaaaacacacuggguauuuugugugaagucuuaucuuggcuucuggacagccaaggucugggacuuggucuagcgaguggaugcaguugagaaacaaacggguuggcaugguaugaucaggcagcuucuacauauaccuucuguaaaagcaaugugggcguuagggacagggccacauuguaggaauacugaugcccuucugaggucagaggaaagaagguuuuuuuuuuuuuugauaaggaggaagcuuaggauagagagguggcacaccauaccuggauagcaagacucacaggcagugaaaugucccaaagcauuuuggagacaccaguggugucaccccuccaguauuccaaggccauggagguaaacaccagagagaggacguaagacccagaacaggaauuagaggaagcacguguccccgagagucccaccuccaucugacaaguuccaguaagguauuccaccuugggcuuccugcuaagugccagaugcagcuaccauagcagauagacagacaaggccuguccuucacagagcuuacagcagacaggaaaacggcaaaccaaagaaaaggcauggugauggagacaggggaaaggagaacgaccgacggcugccaggcugggaggcagggaucacccccaugagaugccgccuccacucaggcucgucccugcguuguauaugcaccaucuacuuuuaaacaccuuucuagaagagggagauaggaaagaaugucccuaagugcacagguagaugggacuuccacuagaccaagaaaccacagggcagugcacugucgcucccaggugcuuccuacugcacaucccacuccucagggcaacugucaccgacuucuagcacacaucucagggcaacugucaccgacuucuagcacagcuugcugcucuguuuuuuuaaaaaagacuuauuuuuauuuuauauguauguauuugucugcagagauaucugugcacauucauauaccuacugaagucagaugagggcacuggagccucuggaacuggggccgugaaccaccauauggaugcugggaaucaaacccugguccucugcaagagcagcaagugcuguuagcccccgagcugucuccccagcacuuugcuuguuaguuucugaaugcuaugugagcacuccacaguauguuuggucagacucaccacgcugauauauguaugucacggcaguuuuuccuuccuacugugggacagcuauuucauuggugaggcaguacaguuugccaugagacaaacugcugacggauguuugaacagauuucagugccugguuacugugaguggccuuucuaugaacaccccugaaugcgucuuucagaguacacgugcuugcaggucacaggcugugcucagcucugugagacauacugcugguuuuacuguuuaugguuuccucaguaguacaagaaaacccagaaaacucaggcaaucuauuuuccuguuaaaaugugauauuuucagcuuuuccaccccugcucuucuggcugguauguaguggugccuuguuaugguugaaaugugaguuuccaugcugauucaugagauggcagagcuugcacauguuuaugcaccuuucagaucuccuccaucaugaacccuagcuugcucccaugcucugcuggguggggacaucuuuauucccacuggacccgguauauacaagagcacacacugcaaacacugccugacuucauacuccuuuucagggcuguaggcugaaaagaaaugacuacuuucuuacuuuuuuuuuuuuuuuuucgagacaggguuucucuuuauaacucuggcuguccuggaacucacuuuguagaccagcuggccucgaacucagaaaucugccugccacugccucccgagugcugggauuaaaggcaugugccacuacgcccggcgcuauuucuucuuuuuaaacauaugaguguucugucuguauguacaccugcaugucagaagagaggaucagguuccuuuauaaaugguugugaacuaccaugugguugcugggauuugaacucuggaucgucagaagagcagucagugcucuuagcugcugcacagucucuccagcucuuccguuucuuucuaccaugcagcucuugccaugcuucuacuugcuguguaguucagguggucaaacccuuacaauucucuugccucugccucauuaggagagugccaccacagcuggccugcacaccuucacguuuucccugauguugccaguuuuggugucuggcuuaucucaugaugcugaagguaauccccuacaccaguguguugugacuuugccuucuaccuccagaauuuaaaugcagaauugagauuuuauguauggugugaugugaagaucaaaaugcgaaugcuuucugcuugaauauuaagcagcuggcuuacugugcucacugcaaagguugaccuggcccuggugcucacucuccucugcacuaagacacuguaguuccagggcaggagggucagcuaggaugcuacuuauaugaucauuugggacaugacuuaaauacagccucacuggauagauaugacauuaccuuaaagagcuccacagaguuuagcagacucugaugcugaacacuaauaaacuccacagaaccaacaaaggcucuacagcccugcuaaacuagcuauucccugagaaaacuaagaaagagcagggacuagcacagugccaucacccagucagauacucugagaagguagcuaagaagauguuaguaacaaccuggugcccaaggaggcaaaaaagacaggagugagaggaaacagacagucgucugucugagcacccaaugcuuauauucagaaaugggucccugcuaaguaacuccagcugucugagcagaaaucacuuuccgaggagccagaaacccaucugggaaagacucugagggaucaggguaggcaaagcuguaggacccacacuauaaagucagacagagcuccugccauaaggacagagggaccuuuguacaguuauagggaaaguuccaucuuuuacaugauuucagaagagcagugcccuucaauuaaagguaugaaagcugccaucaccccguuuucucagacacuguguacguagguauaggggccagcaucaagcugcaaaccacgcugcaggcacagagggaaucgagccuucugaucugcauguacuagggaaucuucucucugagucugagccuuggguaaaggucaggcccacucacugcugcccagacagaaccugacagaaguguggaugaccaaccccagaccacgccuggcauggcugagacuuucucucugccccaaacuaugacaacuccuuguaaauguugaaagaucguuuuagaaggagaauguguaaagaggaagacagccccacagaugcaaaccaccugacgcccaaggaucagguucaacaggauuuugaagaacaccgaaugauggccagacaaagcccuguuaagacucaucucagcccagauaaaccaggaccuggaguaaacagcaugcauuaccuuagccagccucccuggcucagcagucuccaguccaacucuuucuugcuaccucacccucaaucuguguuauauaaccuucagacaggaguugggaaagucuuccacucugccugucugcugauagagcugagccaguggcuggcaggccauaaucuaauaggcgcaacuggaaacaaguucacagcuccugucugagcccagagacuguacagacgaggaaacaaacacugcccugucccccuccuccucuccucuggccuagguuuacgcugacuucacucaacaggcaccugacccucccagaugaggugggaggggcuuuagcacacagggcccucguagggguggagguacagcagcaacaauauuuaagaugcugccuuggugggguauucagacuaaggaaggaaagaguuccauuucagaaucucuagcuuuaagaaaggcuaagcaagcacacagaggaaggagaucacggggaaggaagaaaacugccagugugggucagagaaagaagcuuccuacuucuccagggacagacucuaaggggaacaggccugcacaccaugcugagggagaccuggcuauguguuauccuuguagccuuugucagccacccaguguggcugcagaagccucauaaacgcaagacacagcucaaagcagcgggcugcugugaggagaugagggagcucaaagcccagguggccaaccucagcagucugcugggagagcugagcaggaagcaggagagcgacugggucaguguggucaugcaggugauggagcuggagagcagcagcaagcacauggagucucggcucagcacugccgagagcaaguacucugagaugaacaaccagauugacaucaugcagcugcaggcugcgcagaccgucacgcagaccucggcagguaagugcugccuccacacuccucaccgugcgccugcucaaggucuccuggccccagcucugcuucuggauagccugcucaacaacuucgggggcuuuugggaauguacgaucuaugauugcacaagcuuugggcuagugauauccugcgaguuuagccaggacauuugaagaaaaccuuuguauucaacaaaggacagacuccucguguucuucaauucugaucuucuuucucccaugguggcuaauaaaauucuuccaaauaauagagagaacaaguaaauguaaugcugaagugcugaccuuuuaguggcugaaaauaaggaaggcacacgcagugaguuauuugagaaaaaaacauucaguuguugguuaacuuggcacagaugagcuaauaaaugaaucgcugcucagaugaagaucuaauuuucugagguuacuggaaaacauuuggaguaaguauauuuuauagaugaagcauuucuuacuaaugcuuacugcacaauaaaccaagucaagaagacaugauuagcuucuugugaguaagaccuuggcuaucauugguucagacaaagaaaaaguuuugcugaaaguuaagccugaaaagucuguuagcuaauuaaacaaaaacaaaugauuucagagcuugggccuccugacccucaguuugaaaacagaaaguuagggguucucauuuaccaaaaggagggagagagagagaguguguguguucauuuguucugugagauggaacuggucauguuggccaggccagaugcacgcagggcugacuguaccacuucuugcuccuagaagucggcugggaggaagggcagguauccucauuccucccccccccccccccccccagcacgcucugcagaggaaauaggcacuuuggcaucucccacuuucaucuaugcucccuaagucuccagccaaggggcaccaaggaaaaagucucaagacaugcagaagugucuuggggcaacagccacagagucugcuaaaaacagcugcuucuuugaagccccaggacagagccucaaggcggccauggaagcuuucagaucaagcccaaggggaaguggggaaacuucacuuccuggauuuuuuaaaaagaauuauuuauuauuauacauaaguacacuguugcugucuucagaugcaccagaagagggagucagaucuuauuaugggugguugugagcuaccaugugguugcugggauuugaacucaggaccuucggaagagcagucagugcucuuacucgcugagccaucucgccagccccacuuccuugauuuaucaaaguuuuaggaacagucucaagugcugcugguuuucauuugagcaucuagugaugugagacuggggagggagaagauuuccaaucugucucccuuaaucugaguaccuguuggcugguagcugagaaacaacauaaaaccaaacucccugaaauacucuggaguuugccucuagcucaagccugaagcuucucucagggcagcugccacgugcccuucgcagaccauaccauuauuguuucuggaauucacagccuggcacuucagcaggaugucuuacuuagacuuagcccgaagcuuccugcuuaacggucccuuggcacagguuaagaauccccuuacucuacugccccauaaccaaggcggccugagcaggccucucagcccugaugcccacuucucgacaucgguaccccaggggaacuacccacgggcacgcugagguacaaaucaagucuugguuuuuaauccagcucagaugcaccaggcaugucugaccaaccucaaggcccaaaucucuguuuacucugcgucccucacagaugccaucuaugacuguucuucccuguaccagaagaacuaccgaaucucuggaguguacaagcuuccuccugacgaguuccuggggagcccugagcuagaggugaggucacuacugcccugcccuacccuuuguccuccagcccugaaagguacauggauaacaggacuucuucuggucuauggaaagggaaguucaagaaucaaauguaccccaugauggacugugagaaugcucaguuuacgggccccucccuccacuccagcccgcuacugucugcagaaucagcuguccuaguucuucccgacacagaacgagaucagcucucucuaggaggagggaagacacuagaaggagacacguggaaguaccugauuuucccauuuacauuguguucacacugccugcccgccaugccccacugacacucguucccaagcuagccaccaccgugcccccgccuccacguugggggcaguguuucugcuagagaaugcagagagcacaaggaucacugacucacuagauagauacagcacacagcuugggaagucuguccuuaagcuccugccccugcccuugcgccugcccagaggguccucucugcuucagguguucugugacauggaaacuucaggaggaggcuggaccaucauccagagacguaagaguggccuugucuccuucuaccaagacuggagacaguauaagcaaggguuuggcagcauccgaggugacuucuggcuggggaaugaacauauccaccggcucaccaggcagccaagccggcuucguguggagcuggagguaagcucgagcugcaaggccccgucuggcccaggcccacugcacacaugguucauaggcaucaccacagucuacucacucuaggugugcucagucagugcagcaaugcuccugaaagcuuucuguuuuucugucuccaagcgagguccaggaagacccagggcagaacaggguaaaugcauaguuacugggauggaaagaaaacaccaucuccuuugcucugggaucuuguuaaguacaagccacagugaugcugugugguggccccuuuagauggcuucaagcaugauguccucacuuacuccuaccgcaucucaggaugagauuuaacacaaaccacacaucugccccuucagacagacaugaaggguugcagacaagcaauccaggccauacggugagaccagacccaaguuugcucucagaccuucguuugcugacugcuagcuaacauggcaaccugcaauagucuuaccagaguuccaccucugaagaaauguuuagccguggcgcucaugagagaggaagggaccgaggucugcagaaacgaauccuuuaugguuucccuaaugcucugcuccuccuuuucaggacugggagggcaaugcacgcuacgcagaguauagcuacuuugcguugggcaaugaacugaacagcuaccgccucuuccuggggaacuacaguggcaacguggggaaggacgcccuccucuaccauaacaacaccgucuucagcaccaaggacaaggacaacgacaacugcuuggacaagugcgcacagcuccgaaaaggugagaccugggcggcagggagggcugggcccacuaaggacagcagugagcuacagaucuguugcugcugcucuggccgugcuguccccuucgcuuuaaggccacccaucagcccuagucuagggaggacguccccagccuacuagccucaucugucucucaugccagguggcuacugguacaacugcugcacagacuccaaccucaaugggguguacuaccgccuuggcgagcaccgaaagcacauggauggcaucagcugguauggcuggcauggagccaacuauucccucaaacguguggaaaugaagauccgcccagaagccuucaagcccugagagaaggcagacacugaggagggagaacagcaugggaggaggagguggacacaggguaggagggaacaguuuaucauccaggagcacaauauaacuuuaccugugugagcacacacacacaauagaaccacacgugccaacagugcacacuagcagauggagccaggcggacccaguggggccugccacggugccucacgggagaacucauggacaacgguaacccugaggucacuuaacccauuuucccuaacugaggcuuagaugacacgagggaaaagaacaaauaaaaaccuggugugauucucagcggagaggcugugagaaaugaaagaaagcaggugguggagaaggggcuuccaagucuuaccccgcgacacuuccuugugucuauaguauuuguuuuguuuuucuuuuugagacagggucucucuacacagcucuuucuguccuggaacucacuauguagaccaggcugaccuugaacucacagagaucuaccugcuucugccucccaaguacagggauuaaaggcauguaccaccauacccaguauauauaauuuuuaagacacaaaaaacauggagauagagagcagcugcccaggugucuccgggggggccuuguugucagaguccugggggagagaggagcacuggacaacaugcugcgggucugacguggcgagaacaccagccggaggugagcacagacucugggugaucacaauacugccuucaaacauccucagucaaaaaccaaaagauccccuuuaauaaaaaugcuuggaaaaugaagguagauggcgcugugguuuaaaacuugugauguauauagaagcaucuuccuuguaaaaauaaaauauuguaauuccuauuuuucuuuuuuuacuuuuuauuagguauuuuccucauuuacaauuccuauuuuucaaaauaucuuuuucuauuacaauaaauacuaucaaaauuugaugauuuucuuuuaaauucuuauuauuaccacugagagcggggugaaaacugcaggugagaagucagaaugagcggugacccuggaguuuguucaaggaaaccaaagaagcaggacacuccccccacacacauccuaaaaacugggaagaggaaagggggggaaagggcagcgggguuggggggaggcagagggagaggaguggaaagggcagaagccacugcacagcaggagcagagcccggcacugacagccccacaccaaugcgcucucaggacacuuuacagagagauguuccugcuuccucccuucaccaucgggauguccagcgguucugcccuuuacacaaaggaccgcccucuagaggaagucaguacaagauaagccaugacucccacuuaacuucugugacgccaggaaucuccuuccccucaugagcacuaaccuuggggauuuucaaagacaaaagugagcaaagaagcugcaugagguaggauucccaggggagagcuauucaagcacaaccuuccccaggcaggcaggaggcaggagaaggcagugcccagaaccacaaggcaaggaggauggggacaggcugcacaggcgggugcagaggaaggcgcccacucagaaaagcugauaauucuccuuucauuuagugugauccccauaaugaaaccuucucagagauggcaaggggccgggguugggguguggagaauggacaaggcacuccuagcuccuccauuucccaagcacauacuggcugauggguggacaccaagcauggcgccccacagccucuccccagagagaagacagaaccaccaggaaccagaagcagaguugggcguugcugagacaaagggcauuuuguucugacggggucuucuagaaacgaacaggaguuacacagaacaggaguuacauccagaggaugcucacaaucagucugacaagaagaucugcccagugagcaccagucccugcuuuucacuaugcagaccuuagagcagggcagagagcacagagcuuagcugagcuccucuauuguacugagcaaggacaaggcugggcacuguggugcaccucuuuaaucccagugcuugggugcaagaggcuagcagaucucugcugaggccagccuggucuacacaaagagauccugucugaaaaccaccaccaccaccaccaccaccaccaccaccaccaccaaagguagaccaacagacucugcccuugagugcuggauaacuaaggcgagucccacagcuguuaugcuaugcuccuuagaguccaauuccuucuaauccacuguccccugagaagugaugacacuucucaucuaugugagcuucaaggagcuuaaauugucucaacagugacccagcucggagauuacauguaggauuuaauuugcccucagacugguaagaaauccaacacauaggaaacagacugaaacaaagcagaaaauccucccauaucggccucuugaguccugagauuacaggugugcaucagcacaucuggcuaaaaaggcaauuugcuuuuuaaaaacaaaaccaagagaaaacugguuaaaguaaguguguguaucacuguaagcucugagaauaaguaaauuaacaaggggaauauaaguaggaaaaaaaucaaccuauguaugugagagaaggguguuacccuucagcuugcuggggagaggggcagguacucaggcagugacuugagaggcacguccucaggagcacacagccggcacacaacucaaaguggcaagaccccgagaagagccagagaccucuccucucuaacucugcggggacucuggggcagcuucccgacaucagcuuugcccaagacuuucccuuacaacuuucucagcaagcuggguauggaggcauaucuauaaucauagaauugaggcaagagcauucuaaguucauucugugcuacauaggaagaaaugaaauaaccaaaaaaagauccaacaccuuccagaagcaauaaaacaaccugcccuaguaaagauggcacucagugcaagccaacugucacuggcagggaaugcugcaggugaaggcaaagaaggggcuaagaggcucaggaggcgccuaaggggcagacggaaggggacugagcuccaucagcugaacaggcuugcauagcuuaaggcacaugauucccuaagaacugaacuuacaaauaaaaaacaaaacaaaauguaucccaucaaaccaacaaucuauucaaccauucuauucuuacgacaucuuucugcuaaaaacugcaucagcuucaauguuuguaugauuaucucaaauaugagaaaaagucaagggugggaugggagagcugcaaacaggucagaaaagucagugaggacccaauagacaaagcagucugagcucacacgccccagcagcagccuccguucugucagcuaucacaugaagcugugcaagggagaggaggcacagggagagacacaaguuuuuguguuuccuauucugaagcaggccucaagggauggcacaucuguaacuguucccauagcgcaccucagaggucaucauucucugugccgguggaucuaggcagaagcaggauuccacuucgaccuuucagauccugccacagggagaaugaacacugggcucggcugcugaagcacucugcucggcaggcucugucugcccucccgcccagaaacuuaucagcuguugauuuuuccugagcucucuacaguuaaaugaugaaccacguuaggaucuccauggagaugauuagauuccagaguuaacauucuccaggcucauuaggggaagugagcagcucucuaggagcuggugcuaauguuuccgguugcuuguaauuccuaaaagcacacaauuuauuaaacaacuuccuuuuccagacccagaagacucaaaaccaucuuaagggaggagggaggagaggacaaucagggaaauggaggaaaagaucaccgcaucucggacuuuacgcuuuauacucacaacuccaaagaaggaagagugggcaacugaaagacaugcucuguagaccugacccugacucuggguggcccccgaagccaggaaccaggguggccuaauccugcucagaagccucgccuaacuuagacgcccugugcuguggucagagcugcgucccacugacuucacugggacaaaaaacacagacugggaaucaacggagugaagguggugaggacggacagacaugacaggcguggcuuaagugcuggcaguaccaucagagugccaucuggaccauggauuuaaugugccagccagacccaggggcagcuuucacacagcugaguucuccaccugaccccagugaacgggacaagcaaugggagaugauaacaaguguccauggccuaccugaugagggacucaaguauggcaggcgugggcccuuucuggaacuccaguucuuuguagugcagugcuuuggcauaugcccggcacuuggcagcucucucacccaggagcacgaugccauugucaucucucagcggcagggggcccuacagaguaaagcacagaaauacaguagcugggcacacacaagaggaggcuguguggcugcuccccuucugccagccaguuuccuaucacuguccgucgggacaaggggggcagagucucaccuugucacuguguuccaugaacucagccaaguucaggaggguuugugugacuucagcaaugucuugagaagugagagccaacucaauacuccugaugagcucaucuugcuggucuucauucagcucagaccagcaggacacaaaggcagcauugaagagaucccuguaagcacagggacagacaaggaugcaccucugcugggugccaccagcaccaucaacccguuucuggcacugcaguuugguugcaagagcaaugcugucggacagaaccuguuggaugguaccuaaaccuuccucaagaggcagaggaacgaaacaccugaccugaacaaggucgggaacuuuaaaguaaaagcagcacgugugccuacugacgaccaaucuuuuuguuuguuugagcaaggucucacacuguggccaacacuguuucaaacucacagcaauucuccugcuucaaccucccaacugcugugcuuuuuaggcccacaucaucaucaagccaagcaaugacaacucucucuuuuagggcagguauagacaugauauacagggaacugugggagagugggguggggaagagaacacgcaaacaaacuugucuucacagugauguuuccuggcaguuucugccuuguuucucuucacugggaugaacagaaagagaacuucuaagugaacagacugaggaaguagcaguccuuaugugauccuuggaacauuuccuggacaauguccaaauucuuaagaucaaaaacggccaaggcagcaucugcuacacugaugacuacguaagagaaggcuacacgcucaaggcaccagcagaaaauaaacacgaagguaugcgaggcucuggccagccuccaacaccaaaagagcuagcuacuuccaaggcaguaccaccaacuugaaaucgccacagugucacauggaugaacucucccacccccuagccccaccuuccacucuacuuuucuaggcucuguggccugugguggcagaggagaggacaguguaacacgucccugcagugauggguuuagaacuaugcuucuucaaucgccauuacacauuucaagguuaaguuagaacgaguauaauuuuggaauuugauaggaaaaaagaaaaccacccaaaauuugaaauucuaaucagacugacaagucuaguguaaaugaaaaauaaggggcuggugagauggcucaguggguaagagcacccgacuguucuuccaaagguccagaguucaaaucccagcacccacaugguggcucacagccaucuguaacaagaucugacucccucuuccggaaugucugaagacagcuacaguguacuuacauauaauaaauaaauaaaucuuuaaaaaaaaaaaagaaaaauaagcuuuccuuaucuauccagaugugacaguggaucuccaguguuuacauuugggacuaaguuauuaauaaauggccacaguuucucuggacauggcauugugcucagaggugaccuggguagaaggugacacagacgaucagcgaggcaugugugagccuacaccacagacagauacacuagagaacuucuagacgcggcacuuuaaauauuaaagacacaaacaaacaacuugagauaaauuagaggaagcaaaucaugacaaacuguaaucuuggagcccacgacuacugcucaauacacagcaagccagcugugcugaugaaacugacauaaaauaccuugcuuguaaugucuguuaauaaaaauggcugcccauuaauuaaauuaccauuuuaugccucacuauaaacaauaaauguccacugugggguuggggaggagccuugagcaaagggaagagagccaggucggagcucugcgugccguaccguaccuggccaugggguuguaggccugcgccagggcccagcaugagcgcagggagggcgaugaggaguccuucagaagcuccagacucaagcgccucagccacuccagccagucguccuuggagacccuucuggcagcuccccaggccugugauaccauaggugacaaugagaaaccaucaaauuuaagggccaguugugaggcgcaaccauggcaaccuaugucaccaccauucugcucugauuaguaaauucauaccuacuaugauaaagcucucccagaacauaagcaaagcagugauguuucauuaaaauacauaaagcaaaagugguggccccaagaacauagcacagugugggaaaggccaccugcuggugcuggacucuccagaaccaaugugaccaggucugucacauucagagcgugugccuucaaugaagucuaagggccacugcaguacagaagugagcugggcauucggcgcuauaguaagaauucuggaauuuugguuucuuuaaaaacaagacagaaauacuguaagaauauauuuuuguggccaucacuggaaagagaggcccacuggacaggcaaacuuuauaugccccaguacaggggaacgccagggccaaaaaaugggaauggguggguaggggaggugggggugugggaggcuuuugggauagcauuggaaauguaauugaggaaauauguaauaaaaaaaaaaaaaaaaaaaagaauauguuuuuguuuaaccccaggugugggauaugggguugcuuuguagcagcugacuaugauuugacuugugcucuagaagaggaauggcuuugucagcugcagauaguuuuugugauugugugacauuugggaguuuuucagaggguguauaaaugcuagagucccacuaggugggcuugguugcaguuuguuaguaguugagcucaaagaagaaacaagggaaagaaauuagaucaaagaucucugucugucugucugucugucugugucuccccccaacccccauccuccuuucucuccuaucuagugguagggggugaaaccaggaggaauaaagaaugugaaaaagaagaacccacggagaagcgaagagcagcugcacagcacaaccugugugcagaagagcagaagagcuaacuccuagagagagaaacugccaggcuacaccagcggacggaccagaagcuuccucaaagcccugaccucuccaggcagcaagugagcucuguggagcucagguauggcuuaguggcugagaacaucauguaugagacccuagguuccaucccuggccccacaaaguauuccuggaacagccuggguagguaaguggaggcaucaggcucuggaagagucuaguguagaggccaaagccacacccaggaacucaagggcuugaauuuaaaucucaguuauguaacuuuuggcucccugaucuuuggaacuuaaugcccugugucugucuucuuauuuauaagugaacuuuagcagugugggcauguuguuguuccugaagccugaaugcugguggaaucccaaccuggccacucagcuacaacacugagccucaggcuucuuauaacuguauccaggcggccuaccucaaagugaugaacaaaaugugucaagacaggcaaaaagcuggcuacauuccaggcucuggucagcagagaccauucaguacuuacuagcaaaguucuaagagcuagauauucaaagugugguccacggccagaccugggagcucuuuacaguuaucucccaugaccucagacauuucacagcagaauaaauauuuuaauaagaucccuagaaauuaggaagcccaaugaaaaggagaagaguaaaacucacugcuuuaaacagcccacguagguuuuaugcuaaucagggccuuaccagcuucugugguuugcauaugaaaugccuccgacugauucaccuggcucccagggugguggugcugaggaagugacucagugggugaggauccugcagauuuauagcccagucccacuuccugcucugucucugcuuccugagcauggaugcaaugugaccagccggucuccugcucccacugccauaucguaccugccauuauggacuaugucccuuuggaacuguaagcaaaaauacacccgaucucuucagguugcuucugugggagucuuuuaccacagcagcaggaaaagaaacugagacaccaacuuuguucucaugagagcgcuuuuucuuuuuucuuuuuuuuccacaaagguccuacuaaugaaggucugagcaaacacaaaagauacuuuauuuucuacaugaaaaaaaaaaaacaacucacagcugacuggggcugaagagcuggcucagcaguuaagagcacuugcugcagggagcauggggcaggagguuuacacguuuaaggucagccuagacuacguagugaguucaggaccagccagagcugcaaagugugacccugucacagagcaacagcaacaaaagaaaaugaaguaaacaaaaaagcaaagguaacaagcaaaucaauguaauggccuaaguucaugacgcugagguucuuaggcugauagcuagcugguguacauucaaggugcugagagaugaagguuuugaaugagagaaaaaaaacagagcccugcuucccaaucccccuggaaacaauggaccugccuuuuggagguugauggugcugacaugcaguuucuucauggguccugucucaacugguccacuggccagggcaucucccuggcugcuccuuagcauucgaugcugguaaaucaaagggucuucuuccucaucagcaaguguguaccccugcaagcagagauguacugaaaacacccgcaccuccacauaugaucccagcuuauaaaacaugcacgaaccucaggagaucccuaccugcaagagccaggauuucaacaagcaguaugcauggcaccuauacacaaaauaaccaugugccugaacucccugcuggggucacggacaaaccuuuaauggguaagucauaaaaaagccagacaaaggcaaacugugagcacaaauaaacgaucagcuauuuagggcaccaauggcacacagcuugcugccuguuuccauacagccuaggagcuaaaaacaauucauuucaaucucaaguagucaaaauaaaauuuaauccuuuacaauuuaugaaaauugugagaaacucaaauuucaguguccacaaauaaaaucuaacuggacugaggccagacucauuaguuuuguguuauguggauggcuucaacagaaaccauacagagaagccauacagccuauagugcugaaaaacacuacuucuccagcagccugucugccaguccuagccagggcugaaaagcuggacauggccugcccuuugcuaugacaaaaugccaagaaggaaagaugcugaagaccucagggcagaagggugccugcucaccuugacgauucugcagauaagcacaucauagcgcuggugguugauccggugucgcacgaggacuuuauucaccauuggaaugaagaucugguacuacaagaggagggaguaagacagcaaggacucuuauucuggagagcagauggcagaacacacugcugugcacuggagggcagccacuucccuguaaaagucccuacaacuccuuucccacuccagauguaauuccaggccaauuccccaucacccuccacuggcuuuccucaaugcccagguuucuuucucugcaguccauucugaauauaucacugacaaucaucauguuaaaauaucaauucuauuuguccugugaucaaagucucccaagccuucuagucuugcucagcauaaaagacaaaguccucacgaugcugcccacagugacuucacuuguuggacacugguacccagaggcuuaggacacagccuacguuccugaaucugcagcuugagcccaagauccugcauucccaaaacgcuuccagaacaaggaugcugauggugcuuaucucaaggucacauuuggggacucuuugcuucaaauuuagucucuccccuaccuagcccuguuuaaucucucagaccuuagcuaccaguaaguacuccuacauuacuuuugggguuauccugcucuugagcuauaccauaaacucuuccugccuaccucgcccuguacacauggugcuaagugagucuucaggucacucucuggagcugggguuacuggagucagaccucuguuuaacagcucaucaggaaagucuuuccuaucuaccuaagugaauggcauuucucuccauuuucacucagcauucucagaguguguggagagaucacucacuuuacgcccuagaauguauguucuauaagaacaagaucugcuuuucucuuuuccucuugaaaaagaaauuaaaacuguuuauuuccccagacaggguuuccuauggcucagguuguaguugaagguguucucaaauuccugcuccuccugcuuguaacucaccaagugccaccauauccaguuguaugcaguccuggggacaaagcccagggauuccugcauuaccuagguaagcacacuaccaacugaguuccaccccagcuauuuuccacaguguuaccucuagaacuacacuucacccacaugggugcuccaguuaaaacugaugaacaaaggaagaacaacaaaaacuggaauaauuucacagucuccaauaguggcugagacucacacuauguacuaaugacuggaaauauucauaaguucccagcuaagguauaaaaucacggguccacgcaggggucuccucuuaccuucuuccccaguugaaagacaagcgaagacagaguguccauggcuguggagcgcagcucugggcucuggucuagcguacgaacuauugggugaaugaugcgggaggcguagucagugaagucuagggacucugucaggcgguccaccgucuccagcgcugcccugcaacaagagcaagccaagggcuaccuuaacaacggcagagaggaaugggaaggaauggcugugagguccugugagugacaugaauccaagaucuacacacuaggagggcagcaguaagaucuccauaaucuggaacauuugugaacuaaaauaaugagagacggaaaaaccccacaaagauggcaaaauagggugcuuacuuucuugauggcagcgggacuucaggggcaucaaacaauuucacaaucggaggcaacaacaagugcagauagucauccagguuggcgccaaacagcuggaucgcggcuaacagcugcaaaaaugagcaagagccugguggugcacagauacagaaagguaucaagugcccgggacacagcugggccgcauauggaacacucaaaguucuguagggaugcugaagagccuugucaaacagcucuggccuacacaaaaaauuuuuaaacagaguugucccuuggcuguccuggaacuggcucuguagaccagcuguccucaagcucugccucugcauccugagagcagggauuagaggugugcaccacggccuggcuggacuacacucuuuauggugccucuuuccccugauuuuauguugaguacaugcuacauugcuuucuuucagccagcguauaacaggugcuagauaauaaagcuggccugagaugaaccuugaccuugaaccuugaaaggagacaaaacagaaagauaaucaagaggagacugugaguauucuggaaagaaaccgccaagugcuaggugaccauguuccugggcccacacaucagcaugccacccagaacagggucucacagcucaguuaucauccacggacucugaggcaaccaggaaccucucugggccaucccagcugcucaccuugauggagacgauucggccuuggcuguugucaugcaugaagacccgcagcaugugugggaucaacuggggcagauaaagcuuaaauuccccuccgagagccaccacaaucugcucaaugagaagaaugauugugcucuggauugacguguucaugacccaaaacuccugcagagggguagagagaagggcagaggcagauguuugucugcuggacagugaaccuagaaauaagauggcuaaaaaggcagaagauguaaugaguccagacaagccccucccaucuucucucauugcacagccacagccacagccauaggcacgggacaaaugaugcugcacuuccagauguggugcccugacuccuccaagcugugaggugcagucccucgccuagaagcccacugcuggcuggcaugcccuccacugucacgcccucacguguccugcucugcacucacccacuuuggaucccucuguaguucuucuucccagcuuggggcuaauuugcccugcaaggcuuuccuguuagacuugggcuauuuaagagcaagagacuacuuaaacuaaccucugaccccuagaaccaauuagaguaccugaaauacucuagucaucaagcuguuuacagaacagacagauuuuuacaccugggucacuccaagaguuccgacaagguguugguccauacguuacugggguacugugugaucucuacaagaagaccacuccagguuacuaagauuucaugcccaaucaggauuucuuaauuggcugggcaauaccugauaccuguucccuaaaaaucuguccaucaggccuggacacugcaacaaaguagguacucucuccuccauguacugacaauccacaaaaauuacugauauaaauacuggccaauggcugcauauucuguagaaauagcugcaaggcaaacaggcacaagccucucacacuccaugaaagcagucauuucaagucacuucaaagucaggggccucuagcuuucuuuacggccucuggagcaggagacugacuacucagggacccucugcugcugcuggcagcacauccauagcaacgcucuugaggcccuaacugcacaggccucaguaaaaccaagggaaaacagacugaaaagugcugcuuaaacuuucugucagcuagaaaacacuacucucuagaaaaccuguguuuacucucaauaauaacugcaggugaacuagugagauggcucaguggguaagagcacugacugcucuucugaagguccugagcucaaaucccugcaaccauaugguggcucacaaccacccauaaugagaucugacgcccucuccuggugcaucugaagacagcuacaguguaccuauuuauaauaauaaauaaaucuuuaggcaggagagaacuggaacugagugagcagggccgaccggagugagcagaagucauaguacaauucccaacaaccacaugaaggcucacaaccaucuguguacucacauacauuaaauaaauagauaaauaaauaaaucuuguaaaaaauuaauaacugugcugguuuuuaggccuugguuuaucugauguucauucacuuggacuacacucugucuucuucagagaaaguuuuccaauucuaucaccaugggcucuucacagagguuucuuuacucagaagccagcagccugccuggggauguaggcuacaucucugcuuacagacugcucuccuccugggcuccagggagcucauuaaaauguccaggaucaacagccacaggaagagcaccugcugcauccccuccuuugggacagaacugaaguugcauuuugcaggcaaggcuccucaaaucccugagcauuggucagacuucuuuuagggaggugggggugagucagagggcuucagcuuccuacccugagcacaguuuccuuccugccuucccugccccaaggccauccauugggcagucaagcauuugguucaagccuucuuuguacugaguccucugugguagagaaugggaacauagcagcuuuucaugauuuauacauguaagggcuguucaguucugaaccccggugccgggaaauuccucugggggagucagacauuuugaaacuggcccugcugcuaccaacaagcuaacuacaaagcaacccucuucacaaucauuuagauugcauagaacaguaaaaugguguuucuauuaucugggugucuuugagcacuuacuuaaugcauguuauaaaaugccaggcacugaucccugccuugggugccacugaagucaaaugacauuuaagucuuuggagguugcagggcaaagugucaccuuggucuucagagucugacaggugacucugggaaaaaacaauccccuauccauucccucuugugcuguggguucauggguagugagaagggcuuuugugggggucagaaagcacuguugcaauacugacauaaacugcuuugcugcguguuaggcaaauaacucaagaaugucuuuggcagaacaaugauuucaggauuucuuugcagacuucacacauauuguuguacuugggagcugggagcagagucaaugucuaucuacccugcuccucagaaccuaguggcugacagucacuguagagcccauuuucuacagucaguaacagcucuacggugacccggaaagggaauagccaugggauucaaacucauuucugugcaucccucgacccaaaugcaaaugagcaggguaagagcuguaacuucugcuuacucucaugagagugacuauuucauccauguagggacggauguggcucuucacaaaggacaccagcauccccagcugcuggaacagaaacugaaacagacaagagaucaacaaguuggcacaugaaggaugcagaacucacaagcuuacccagagacaggaaaagacagcuaugggguugguuuccacagcagcccaucaacagaaugcaugcuccaacuuaaccuauaguggcgaaggggacuaggacuauccccaagugcuacuguaggccgcacauggaaagccccagagcaggggacggaguguugcuccacucacuaugagugucaggagcaugggauucuggucauuaaauacuuaaccaaaauggucacacagccaggcaugguagcucaccccuuuagucccagcacuugggaggcagaggcauuuguaacucugaguuccaggucagccugguugacauaacaaacuccaggacagccaguacuacauagagaccucccucaaagcagacaaaccuggcaugaaauuauuaccaacuacaaaugcaccuuggcccuaauuugcuacuacuuacuuuccaaaauaugggcgugguggcgcacaccuuugaucccagcacucaagacagaggcagguggguuuuggaguucaaggccagacugaucuucauaguggguuauauaguccagccagagcuauauaguaaaauuuuguuucaauaaauaaauuaauuaaaauuaaaugccucauuguagauagaauauagucaauuuauaaguaauaaauuaaugacugcuuuucuuuuguagacauaucauguagcccagacugggccugacccugccauaacuaagggaauucuaaccuucuauuguuauguuuugauuucccaaguguuagagguugggcaugccguuacuauauacagcucucagguccugagauauggcaaagaaauuaugagacaaaacaagcagcacacuuagaaaggaacagaauacucaguagcccaggcuagccucaugucuuagacugacacaaugggaucacaggugugagccaccaaucccagcagguggugucucuuaaaacugucagaaaaguugccaccaucuaaguaaagcagggacuaugaagggcucgaguaaagaagcccugaucuucaaguuaaagauucguugucagaagaguuaguaacaucauguuugaauaugacagaugacaguacuaacuuccuguucccuagcccaggacuuuccaguaacgagccuggacagaaccauucauuuuacucuucucuucacugggaaacucggguggguuccuuggggcuuaguuaacagugcugauuugaauugaguacagcaucccugugcucacaguacucgggaggcugaggcagcagaucagcaguugcaggccagcuugggcuacagugagcucaagguuacuauuuagcaagacccuaucacaacaaacaagauuuaaagcaaucggaucuugggguacauugcuauaaagcaaucggaucuugggguacauugccugcagaagugaggaacagacagacagaaucagauucacagacagccuguucccucacagggacaccaugucugccaaaauguuaggaccuggucaccacauggugcagagugacucagcagaaccauccuauaccuauuguagcauguccuucacagaaucauugcugacaccuuuauggaaaagcuccagggacaggaacucuacauguaaugaaugcuugcuagcuaaaucuguuacaggacccugaaagaagacagcaaaccuaaaagcccgagacaaagcacaguucugggguaccugaaaauaaaaggcagacgggucaggaaaaaccacuagacagaaacaaggaacgagccuccuguuuccuggccacaggagagaagcuugauagcugaugccuaaggaguggaagacccaggaccaccaccuucccuucucagauucuacccaagcagaauaaagagaaaggaccgacguuacugauuuauuagugacgugcuaauaaccugcuuguacugcauaucugugaagcacagacaagagcucacuggaacagaacgaccugagaaauggcugagacaacggguuguaugugggaugcuguuucugaaaagcauggcagacuaaaucucugaauucuccucccacugugaaaaacuggaaauuaaugcacgagaaagcagaucaucagaauccaacuguuuuucguaaacccauaauuuuaaugggauacaucuuaagagaaacagugaauuucaacaaaacaaaacccccuccuacuggcaaaaggagacaaagaaaucaugaguuuuaauguaacuaacucuccuagaagagcugaccaccuaaggcugacucucaaaugggcuaacuacccggguggccugggaacaagccagacacugacuucaaguuguccugggucacuugcacugaagcaaaagcacaccugcuccuuuccgcucuucagagcagauguuccaggcugcucuggggacugaguagaugaagauggccacagaacacccagagagagcaagggaccagagaaacaaaaagcagugaacuaggcgaacccaggccuuagagaaaauagcuaucaucacccuaaaagcguaaaucuauuuaagaugcuuacagaaaucaaaauaggaauauaaaacacaagacagguugauggcacacgccacuaaucccagcacucaggaggcacaucucuguugaguuccaggcuagccugaucuacagagugaguuccaagacagccaggacuccacagagaaacccugucucaaaaaaaccaaaccaaagcaaacaaacaaacaaaacccaaagagccaaaccaaacaaaaaagaaaaguaaaaagaaaauuguaaaauaauugaaauacaaaguuuauaaaauaaauuuguaaauaaaauuuauacuuaauacuguuuccucuggauugaaacuuuccgaccuaaagggagacuccugaaacucacaaaaugcucucaagacucaagaaguucagagaacuuuagaaaggggagaauuugcuuacuauggcccuguugugaagggaccugggcugugacccaugcugggguggggucuuaggaggugcggcugccuggagucacccacuguuucucuaaccucaauagucacuacuguaccaagguggguuggagggcaucuuuccauugcucuguugcuacccuuucagaugaacacaagagacacucaguuguaauacaguaacacacacauaaaagcaaacuugauguacucugucccuauuagaagggguuaacaaagacuuaauaagaauagaagacugaggaaguggcucaaagggcaagaauuuuuguacaaggacuggauuauaggacacgaguauccaugaacguacaagcaggcgugguguucacuauacaagauggagagcuacacuugcugcaucagagagcucuguacucaaguuagagaucccugccucaaaauauaaaguggagagagaaagaggaagauaccugauaccaaccucuagccuccaugggagugugcacacacgaacaacaugcaccccacacacaugugcuccaaaacauguuaacacgcacacaugcacacucauuaacaaguacacauagcacacaugaacaugcauacauaacccagacaaacaugcagucauaacacacagacaugagaccucaacaugguauaguucuauauauguaaaaccuauggaugacaguggcaagcacaagcaugcgagaaaucugugaaaaucaagggaacaacgaaaccauucgggccacuucagcaaacacaaaagaaugacaaauccaaugcaguuaguguagaaucaauacugucuaaggaugcagacaaacuacccacuugugaguaagucaaaagugaaagaagaaaccguaaaguuaaaacacagaaaggagcugggcagugguggcacacgccuuuagucccagcacucgggaggcagaggcaggcagauuucugaguuugaggccagccuggucuacaaagugaguuccagaacagccagggcuacacagagaaauccugucucaaaaaacaaaaccaaaaauaaacaaacaacaacaacaacaaaaaccuuagaaaggacugacuuuugaacacugaugagaauucauguuuuucagcaagaagggagcaagcuacuaauauauauuacagcccggaugaagcccagaguaagcuagccagaguaagcuaccccaggucugcagaugcagcucaguugguagauguuugucuaguauguacagacuccuagguuccaauccagcacugcagaggccagggcugguggcacccagcuguaagccaaccgcucaggaggcagaggcagguggacagaaagaucaagaccacucgggcuacaagaugcucuguacuaaaaaaggaaagagagaaagaagcucauguaccaucaauuacacggagucuucagaaguagcucuaagaggcagcaggaauggaaaugacugcuaacaggagagaaggaagcuuucuggcuaaaguaauuucuggaaacuuucuaaauuuagacuguuacugguaacugcagacucugaauacauugaaagccaaggaacuucauauuuucagauagcaaacuuuacaguaugucauuuuuaccuuaaagaauuucugagggguaugcguaugugagugguauguucgcacaugaagacgcacauggaggaauguggagaguuggcucuuccagaggacauguguucaaucccauauggcagcucacuacugucuaaaacucaagugccaggggauucaaugcccucuucugaacuccaagagaucaggcacacacucuugugguacacaugcacacaugcaaacaaaacacucauacacauaaaaagacguguguaggguuaugugugcauaugugugggugugcauguggagaccacagguugacacagcuugucuuccuugguugcucuccaccuuacacaucgaagcaaagccucucaauuagcccagaguuugcggauuuugcuaaguuuguuguggggagucccugucucugccuuguaaguacaaagaucacaggagcugccaugccccuguggccuucuuuacauggguucugaugauccaaauucuggucuucaugcuugcauagcauggcacucuuacaaaauguggaaucuuccuaaaccccuaccucagacuuuaaacaguacuguguguguguguguguguguguguguguguguguguguguguguugcacacgucucucuguaccuggaacuugcuguuuuucagcuagguggucuggauagugagccccagccguccuuccucugccucaaccccaacauggaguuggcaauccaaacagccacauguauguguuggggacccaagcccagguccacaacacaaacuugcacaaccaaguccucuuacccacugcaccaucucccuaguucugaaaguuuaaaacauuuaaaaagcagcugugcaaagcaauacuugagacuuuaccuccccaaaauuuagaguucuaccagacugaauuacaaagaaagaaagagaggaauagaagauaacuucuugacuucuugguuaagaggcccacaaagcuugcagaggacccacuauggcuuccagcauccauguuggguagcuuacagugggccuguaggccucuaacuccgguuucaggagacccaacacccuuugcccucccuaagaacacuucuccugacacacacacauuuuuuuaagaaaaauuuuuuuaugcugggcagaggugguguacaccuuuauucuggcagaggaagguggaucucuaugacgucgaggccagccuggucuacagagugaguuccaggacagccagggccacacagagaaacccugucuagaaaaaacaaaaauaagaaagaaaugaggguaacagagaccuacuugucuaaccuaacauaaggcucuugauguaccugcaaaucaacauguggaccacgcuggccuuagacuguugauccuccugcaccaucaauacuaggauuacaggcauacaugacugguuugucuuugucugucugucugucugugcaccaccacugcccagcacaugacuguuuuuuagugugugaguggguaugaggauggcacacagcaagcacacggaggucagagacaacucuagggagucaguucucgcauauuaccugugcaggguaucugggaaugaaacucaggucacgaggcuugugugacaaacauuuuuaucugcucugucauuuuaggaguaccaacuuuuuaauuagaaaaaaagcagaucaaggaaaguaauaauaaagaacagauuugugagauuaaaaaaagcaagauauaagacagaaauacaacagaaguggcuaucuaaaacaaaacaaaacaaaacaacuaaggccaaucucuggcaagaaauggagacauaaauaagacaagagcauucucacaaugacaaugcucccauuuauauagagccagugcuccacagaaaaggcugaagcuguuguaagaccccuugacaagaaugagaaaaaagcuaaauaaaucuugugucuguaguuuccaaacuacagauaaagucuauuucauguaaaaauucuaaauuuaauauuagauacuguauugauaagcuaaaaaaaccugucagccgggcggugguggcgcacgccuuuaaucacagcacuugggaggcagaggcaggcggauuucugaguucaaggccagccuggucuacaaagugaguuccaggacugucagggcuacacagagaaacccugucucgaaaaaaucaaaacaccaaaaacaaacaaacaaacaaaaaacaaccugucauaaccagaguggcuguguuucgacauuagaacuuauuucaacacaaugaaacaagacauuaaaggagaaaaaaaaauccuggaugauuauuaaaacaaaggaaaggcauuugguaaaucuaguaucaacucaugauuaaaaagaaaagaacucuuuuaauaauugaagacuguaagggaauguuuaaaaacuguaaaaaacauuaacccaaacccuccaacaguagcggcucuaacuagcgguaaaacggagacagcagcuaaagucagcaggaagagagcccugagcaaaggucugcagccuccccugcugaagcagcacugcaguggagacccagaggcacucaaagcaguaaugaaugauuuacaguuuacaaagaaaaacauccaagcucccuuuauuuucagagcauguaauugucuagaaucaaagucugggaguguuuguagcgaauggagugaagaaucuaacgaggcugacaacuguuaagaacaaagcacaaaaguggacugaaagccaggcaugguggcacagaacucaagucacaguaccuggguggcuaggaagauucccucaagcccaggaauuugagaccagccugggcaacacagagagauccugucccaaaaagggauuaaaaaacaaaaacaaaaacaaaaaaccauucuauacuucagccacaaagucaggaagcaguuuauaaaauguuacuaccuaccucuaaguaugucacugagggaaagauaaugaauuuaagcauagucuuccaagcagagcgcagccuguauacccucagggucauucuaagacuaguaaggacugugugcugccuugaaccccuagagugagguguguuguugguacacacaccaugcaugcauggguacagacgccacgaaccacucuuuauaucacagaacuacauagucacgaugcagccaccagcuuagcaccugacaaggauuacggaggaauucuaaaagccacugggugaaagguagcuggggaauagcauggucacucuccagagugaccucacagacuucccaucagugacaaagcaagaaggcaagccuugcccaggagagggcucgcucccagauacugaucacaugcuccaauucagaaccaacaauaauaggacaggcugguaccauucgaccuaguaaggauuaugcguguucaucuacauaguacugucacuaaaaauggcugauucugccuugccuuccucagcuaccacagaggcuaaagcaagaggacuccacguuugaggcugaucugggcucagagcucaaagccagcugacagaauuuacugagaucuucucucagaauaaaagggcaagggauacagucagagggcagaguccuugccuagcaagucagaggccuugaguucaaacaaaagcaguuuggggcuggaaagauggcuuaguagauaagagcacaccuuugccaaaguaccccaucagcucacaacagccuguaacugcaguuucaggggccccaaugcccuggucucuaugggcacauguacacaccuccacacccacaccuacauauaauuaaaauuuauaaaaauagaccuuaaaaacauacaaacaacaacaaaacucagccugauuuaaaucuagccaucuacaguacugagaacaaugcugucucuucccacuggacuauucaucuucuaguuauccagugggauggaguagaacuggacagacccagcuccacacuuaggugccagaggccaagggaggagaggcagugcucucggugcaggccaaguguguugccgagcaggcgagcagggaagggcugaguacuuacuucccggauggccccaucacagacucggaugacauuaaggaaugugggcaugaccuggggcaggaacugcacacacuugagccccagggacuugaagaugaaggugauggccugcaccaccauggugugguggugagagagggauugaucucggaagauccgcaucaaggccaccauggacacagcgggguagaacucguccaggggcagguuucccauguugaccagcauuucacuggugcuguagucagcuaggacaaggugacagagagagucguaaguauugguggcgggccuccgaugugaggcaaagcauggcuaguagcaaacaaagccccuucagaggccucagcaugcauguguucuccugcauguucugacagugcugugaacgccgagcgcagggcuauuaggaagcggugaauaggcuccccugucaggagcagagcucauccgagcuuuucuacuacccaaagcaccaaagccugaaacagugcaugauggguuuucucuaaauuccuagguuuaacguagcuucucagcgucacaguucacaaccucagagcuggaaccaucaauaaaaauaacuacuccuccaaaugaaaggaaagggaaguaaauuaggcaaacaucuguugcacagauggcuagucccacagggacuacagacauguuagcaggcauaugccauacccugaacagcaaggacucuguccuggccauggugccaugcagugaggaggugagaugcaggggaugagagacaggacgucaggcgcugcugaggaacacgaguaacuggccugggcucugcucuucacggucagggagcaaaggggagccacacaguacacucccuuaccccagaugggagaaggaaauaaauggagaaaaccaaacaaccagccuaaagagcuuauagggaacaaacaguuucauuguuguaaaaucauauucugcuacagcauugaggagaccauuguugaaccuucaauuucaucaacaggcuuuccccaguagauggugggcuagaaacucauauucuacccucguucccaaacgcucggguccuugucaaaaggcaaugggucucuauugucagacuagaugcaaaaagaaggggcccaggucuuguggggcuacuggucuuucuauguccugauuucauucaaaugaaacagagaaaacaagagcuauccucccccuucaugagggcccaggaauaaaagaagaagaaaaaaaaaaaaaagaagcacuaacaaaagacgacacagacgacagcggucaaaaguaacccagacuuagccuguuaacccugacaaagacccugggcagagacaggacugguuagacgcagggacuacaggcucuucauucacaaguugccaagagauucaguaccuaucaguucccugaccaagguuguuccuaccauggacaggaggacgugaguccuaacuuacaggaauccugacuugacuuggacucugacaggcugacagcggaagcgucccgggacuggucgaucaugccgauguucacuuugugcuuguagggauccaaagccccaaggagccccaacacucggauagccugagcaggcaagggaagacaacaauaagcacuuaccccaacauccgauuaaagaggauuugagguacaacucuccuguccuacacaccacaccucccacauaaacuaucaucucaucaacagagcagagacagacaggacgcccucccagugugggcuggguuacugccaucauguccucaagucuuugcagagcagguggccgugcuguguaccucucuccgagugcccugguucugcuccgucuucaggaaauucagcagcacuucaagcaaagugggguacuuccuguagggcuccaccacauagccagugcuggccaccaacugucccaggguccacaaagccaccugaaucaacaaaaggccacaugcuuauugaaccaguacaaaaaaaaaaagaaagcacaggcauucucuuuguacugagagggaacugagaugucaggaccaaugagaagaccguuaagucacuaaccaugcauggaauccuagagucagggcauacuaacagcuggucaagcaugagccuacagucacugcaucaaaggugaagaauagagcgggagucauggcuuccaauguacucuccguaccagggaggcucaaguuggaggacagccuuugguucagggccaguucuaacuacacaguaaguaacuugacuuacuuauugacuacagaguaagauguugccacaaaaaucaaagaaaaaaaccauacagaauauucccacauuucucagaggaaaugugguucuuuuguauccugaaugacuaacaggagcugcggaaggaagcuaagacuauucuccgcuuuggacuacuucucuaguaacccccaguggcuggagaacgaggggaagcugucugccuccacaagcaguguccaagccugcuuccucccccaggagcuggggcucgacaagcagagugcauuucccucuaugcagaggaaagggcgacgcucagcccggaucugagcugcacaggaggacagccaaagcuuguuccgagauucuguccucuuuccccauucaaagaaaaugucugccaagcucugcaaagaccuggcuagggccacuguggugcccccugguccuguggcacucaccugccuuuuggccagcagggaggaguccugcagcauguccaugaugaugauaaagagcucguccacccacuuccgcauuuccaggccgcucaccugcagagcgagcagacgaaggcagagggcugagacccugggauaaagacgcuguucuaggaagggcgugguggcuuacaccuaggauguccaaaacgccagaaagugaggcagggggagcucugugaguaugaggccagccuggguggcacagcgagacgcugcuuguaaaugaaaauaagaacaaacaaaaccagacacgaaaacgaaugaagagaaaaaccagugcucugccuuucccaggcuaaagagcgugcuuccacccguggaaggccaguugcucccucaccugagccaguucuccuauaguggccaacacguuauugaucacgcccggguuugggucagggucuggaucuuucaguuucaaaauuaaagccuacagaagaagguauaagaaagugaguguggacgggaaucuguaagagagcuaucuuaucccuagagggcagcacgccccccaguacacacaaagcucuggguuuaaucccaaacacgaggaaacaaaacaaaaccuccaagacccucuaggccauacagaaguuacuucuaggcuuugugaacgugggcggcucuggacuguggauuuccaagcuuuucuugaaaccaaacacaagcccagcauacaccccaggcagcagcacaauuugaagacguuucucaugugcccuuucaacucugccugccgacacacgugucagacacagaaaacgucacaugacuaaagcucaugugccuuccucuggggaaagugcacacgcuguuucccugcaucuccuucccaagcgcguuggugccugaagcgugaaggggaacucgguccugcaacgggugaggcuccuggcaccuuuaacucaaggugcuguguguggcccuuguccccagccugcaccaaaacaccugauguacuugguucaguguagcagugcugaaggccccccacccccaggcacagagagggagagccccacucuggccaucugcccugcuucaccuucaggauaggcuccauguaggggcggaugagccggggggcguuggacaccaggugccccagcaugcgggcgcucugcuccuugauucucccaaugccgcugugcuccagcucugucaggaucuguagggaagaaagguaacacaugauggcacagggcagaacagagagccgaguaaagggagaggugucagcagcuggggaaaugaagcaggcuuccagugaaucaagucucuacugggcauuuggcgagcauggggacccguaacucucaacagccuuggcugucacagcagugcggaguccugcaguacugcagaagcaacaccugucagagcugagacuuugguuuuccagacugaagagagggcuccggaggaaaaaccucuguccagacacaaaguucccaagacguucuauaacgacgacaaaggaguggaaggacaaacaacuaugaaacagaaggagagcugaaccugcacagggagccagacacaucuccaugaaggaagugcuagugucucuagacaccacugagcggagcugcugggcuuguucucacaccccuggaacacuagcauagcagcauacaugggcuucuggguacggcugaggggaggagauguaagccaugucaaagugaacacuccaaggcccaguuagucagggguccggcagaauuaagacuuguguccuagcugcugacuugguaacugauguucugugugaccuccacagccugugugcuccagucacacaagacagcaguaaauuagcaauacacaaugacugugugaggugcuggcuggcugcagcgauguguccccggaagcagaggacaacuagcagaugucuugcaggccaggcuagagucagccaucuguaccacugugacauacaccaaugcccagucaccagcccucggggcaaggccaagucacucaaugaagacacacaauucaacuagggacaauccauaucaaaacuacuuuuuuccuuauuucagaauuuaaaggcuauggauauaguucaguaauaguauuuuccaaauacauacaaggcccugguuuucaauuccucugaauagucuaaagaaauauuuuaaaaauucuuagcugggcgugguggcggacgccuuuagucccagcacucgggaggcagaggcaggcggauuucugaguucgaggccagccuggucuacagagugaguuccaggacagcuggggcuacacagagaaacccugucucaaaaaacaaaacaaaacaaaacaaaaaccaaaaaacaaaaaaaaaacccaaaaucuuaguuauuuauuuuuaaguuucaagaguuaaguccagcacauagucaacuuaucugauggaauuucauucuccaacaucaggagagugagcuggccugguggcugaguaugggcuucccaaggacaaaagcuacaucuggcuuguucacccacauacugccagugcaguggggcggggcgggugagcaucagguccugacugaaugaacaagcccacgcucccauuagcugucuccaugccuaaguuagcacagucugaaccggcaggcucaguaguggcuguuucugcagucauguuuuacuauagcaaacagcaaacaaaucacacuuuccuaggguaaguugcauauguggcauucuguguuuaaguucuucauguguuaugcaaccugucuauuucaaaagagguggaaggacacagcaaggcgggaggguuggaacaagcacugcuguuggaagccaagaaacagugaaggcaaaaaccaaggacccagguugcagcaaaaaggccaaccuggaucucucuagagaacauacacauuucacaucacuuaaaaaugaaugucaaugagccccaaccaagugcagugaccacaggaucaugugguaaucacaccauguuaagacagccagccccugugcuugucuacuauuagaaaagaaugacagaagcaauuagagaagagugggaggcccgaguccuacucugcaaaagcagugagugccaagacacuggguugcugaaaacuugccacagagacagaggagcugccugagaggugagucuggacccaaaaagcaccucacauccugcggaugacaggcucacacucggacuguaacccagagcugggaaacccagacucuuggugcaaacaugacgugguaaagggucucccuccuucuucccucccuguccccagggcgccccucgcuguggaggucugcuccucccugccggccagccauuaccuggaugagcaucuugcgcaggaaaggcaugacgaaggcuggguucaugcugcuuagucggcccacagugcagauggccagcucgcggaucucaaagaccuggucauucagagccacaaacagagcuuguaaguuuucugccugggccaggugggcaucaaagcgcucguccagggaugccaagacacaguagcggauaucagggucugcaagagcaaacagggcuuugaacaccucuucagggucccaucccuccagccucuucucuguuucuaccuccacagcuauugcccuuguguggugucucaacccuccuaacaccccaacacuucaacacucauguuguggugacccccaaacauaaaacuuuguuuuucuuuuuucuuuuuuuuugagacagguuuucucuguguagccccggcuguccuagaacucacucuguagaccaggcuggccucaaacucagagauccaucugucucugccucccaagugcugggauuaaaggugugugcuaccacugcccagcauaaaacuauuucugaugcuauuucauaacuguaauuuuguuacuguuauaaaauguaauguaaauaccuaugcuuucuguuggucuuaggugaccccugugaaaggguuguuugacuccaaaaggggggauugugacccacaggucgagaacuacugugaaacucgugggagaacccugaaagaucuuuuucaccuaaucuacuguacgcauuuuaaaaagcuauucagaggaauaaaagagaaauuuaaguaaaaauagauuaucuuauaccaacaggcuacaggagccaugccuuagcagagauauggcuaacuaugaaauuauuaguguuggugaucucuacagaccaugcaaacaccucaagcuccagggucccccagaacugcucugucacaagauuuaccaggaucuguuaugccaaccacaagcagcuugcugagcacaucugccaccaccugcacugcagucuggcuaaccacgugggcauggccgcugaugagguggauggagggugugagcaggcgggagcaggugcgagcagcuuccaugcggaucuccuugugcucgcuguucaggaagugaucugcgcagugucggacgaacugggucagagaguggccuaggcacaaagggaaaggagaggaauggacgccgcugccugggacaggacuccacacaccgucacaggaaugggaaugugcagaaacccugccagacauucuaaagcaguaaauccccuccuggcugcaaaucagugggaugguaaggaggguggagcgccauuccgaguuucugccucugaugagcuguucuucugaagcagugcacacuuuuuaacaccaucugccccagagacaggagacgaagaacaggcaggaaaagcccgggaaggaggggccacuauucgccucguguccugcaugaagacccuacagauccugaaaucuagcugucacaucccuuccucagguccacuccaucccucgacaccucagcaagagccacagugaccucuuaccuucaaauucaaagcugccaaggguucgaagggcaagagugaugcuggccacgucgcuggccucagggaggguggugagaccaggggaagccagcuggugagccaggccuuugggcaugccugggugccggagggguuugugcauaaggaccagggacagcaucuucagaaggccguccugaauaucuuucuucagcuguggaaucugccggcucaggucauagagcacagcagugagcgcggggcuguggagaaggaaaccguaaggacucugccagggcguggcagucucucacuagcagcuagggcaccacacugucugccaccgacaaccucagccuugucucaauuucagaauaaucuacagauuucugguuuucaccagagagaccuucuacaaugcaguucagccaccagagacaggcgcagccaaugagcagacgcagaaggagagcauccuccuuauuucaucagggagggagcgaagcuuuggaaggcuaaccagacuucccaggaguaacaugcaugccuaccaaguacucccuuuaugccccgccuugugcuaauggcucucacuuaaucccuacaacuacccuacccaguacacgcucuucuuuuucagaugagagagccgaggcaccaaaagcugccuuaguuaagaucacacaagauggcuggagccagacccauuacugaagagggguggccacaggccucuggcacacaccucaggcccacugccaacaugggcuccagcagcuccuugauguccugcuggaugcccggccccauugcucgugccaacaugcugaugcacgugaauacgguggcauccaccugcacgguuuucugccuccugcaaugaaacacaagggcuucguuagacauagagacacucauaauaaugucccaccucaaagcuacuuuggggccaggagggcaaguucuuuaggcagggccagccacaagugaguguagagauuauugcaaaauucuacugggugcagcccaucagacacuguguacguguauuuaaaagaccacuccagcagauggcaguaauguguugggaagcaaacugaguugugagugcucaucaggagccacggggugauguacaggugucccaugggaaggacugucucccuauggugagggugauccaccagaacaacccuugcuacaccauauguggaaacacagaagcaccgacuccccgggaucagccaggccucuccaucuggcaagaugccaaaggcuuugcuguguucuauucagugacgggaugacuugggacguguuagagcuaaggaaaaagaugaccaucuggucagggauuccuccacaagcauucugucagcagaagacuugaacgcccgagaacagucaggcaggagaacgcuguggucuccaacaucaagguuucuaccuuucuaaagagcuugaacucagugaggagggacuguccuccaccuggcgugccucagagguaacaauguguggaaugggcguaagcugugagucucuccaccuaggaaccgcucagacggagaaauccuaucggaggugcuuacuugugggcaaaguccuuuggaggaagcgcugcucggaugaugucaaguacacggggcaaguagaccuuaaacuccgaccucacggccacagaaagcagccccagggccuggaacgccgcaguccguuccuucuccuucuugacacagcucaggacaugguucaugguguccuggagguacuggguaucugguacagacaagaaagaacauguggccaaggucagagucccuaccagcacucaaauuuaaggcagccaaauggaaggaugcuaagaauuuaaugaauuuuuuuuuucgagacaggguuucucuauguagccguucuggcugucuuagaacucacuuuguagaccaggauggccucgaacucaccgagauucaccugccucugccuccuaaaugcugggauuuaaggcgugcgccaccacgcucagcuuuaaaggaagaauuuuauaggacacuuuaagcuucgcgaucccuccuuagguaugucuucugggaaagggucauagagcugucuccuagucuaacuccgcagcaacuacauuuguguggggagaggugggcugagguucuugccaaugcgcaugcagaagcuggcggacaacuuguggaaugaguucuuuccucgcaccuuguggcuccagggauaaaacucaagucaccaggcuuagugggaagcaccuuuuccucgaagcuaguucguuggacccuccauuaguguuacucuggagguagaguacauuuucuucaaaaacuguuaaggggccacaacuugagaggcagagguugguggaucuaucucugugaguucaaggccaguguggucuauacaagguuucuggcuagccagaguuacaaggugaauccccccaacccccaccccaggccucaaaaaaaaaagcuaaggcacugaagagaugaggauccaaguucaauucccagcauucauacaauggcucacaacuguaaaacuccaguuucaaggggucuaacgcccccuucuggucuccacagguacuagacacuuauguggugcacagacauacaagcaggcgaaacaccuggacacauaaaauaacuuuuuuaaauuccaaaacccaaaguaaauaaaacauaaaucuuguuuaaaaaacaaagauauuaaucaaauuaucuuacaguaaguauagugacauugaaaguaguauuaagccgggcgugguggcgcacaccuuuaaucccagcauucgggaagcagaggcaggcggauuacugaguucgaggccagccuggucuacaaagugaaggacagccagggcuauucagagaaacccugucucgaaaaacaaaacaaaacaaaacaaaacaaacaaacaaacaaaagaaagucguauuaaguauuauuuacuacaacuaaugggcauuccacucagccaaagucuggaagucucucugccauuaccuggagaucgcuacuguggcuacaguagaguaagacuuagucuucaaucuggacaggcaccugcaucucuguguuuacaucagcgcaugcaagagcaggugcuccugggcacugcgagccggaacgguuuuucuuucucacccuaccccagaacaaaggacuuuccugauuucucugccacugaggcuggcuggcccuuaggugugguggcccugagggugacacugugauguaguugugucauuaugcccagcuuguguuuguacccuccaccuucgggaagugaggacuuccacacugugaguuuuacuaacaagggcuucagcaaggacguucacaaucagggugacucucggacugaguuucccugacggacucuaacgugacguguaacaaagcaacaagcccucaucaaaagaacacacagagccugugccuuugugcucugcugcuaggcagcccccugagcacagccugguauguuucuauagcaugccagcuuuucaucaaacucaaccuacuugcuaaguuucuuuugaaccagagacuuucaacccaagcccacguaaagcccugcugcccagaggcaugucugguccccgagaaagagagagcugcuggugccaggcaggcaggagggaaauuucggaacuuaugggcgaucuucacucccccuucucucuggcucagcaggucucugugcccauuugguccucagccagcacacugcacuugucagcccagccugcuucgccccucaccauccacagcaccuagcccuccccagccuccccuggcccgggaaccagcacauacugcaggucaggcuggccuucccugaauaccacuagcucuugcuugcccccuguauaccacuagcucuugcuugcccccuguauaccacuagcucuugcuugcccccuguauaccacuagcucuugcuugcccccugcauaccaguagcucuugcuugccuccugcacaccaguagcucuugcuugcccccugcauaccaguagcucuugcuugcccccugcauaccaguagcucuugcuugcccccugcauaccaguagcucuugcuugcccccugcacaccaguagcucuugcuugccuccgaaagcuuacuaaauaaacacaagcagcacgccacaggaaguacaagagaccucugagacaaggucucacucucaccaaguaggaagccagggagggacauuaacuaaaauaggcaacuagaguauuaguaucacacacaccuccuccuucccaaaguggcucugaggagcucuaggaggcaauaacaaccuaagaaugguuucugcucugugccugagcacucacacgcuauucacucaggaggcaggaauuacuguuguauucuucacuagcuaggacguggaggcccaugaaggucaaugaccugccccacucucucccucucucuccucuucucucucugcauauuuucucucccucccuuaacccgaccccuuccucauggcgacuucgcuggccuugguccuuggggccagugaacucacuugccugagaacagcuuccuaguaaaccugccuuuaauauaaucuuaaaaaagaaaagaaaaaacaaccugucccacacuucaguaaugggcugacucaggauuccagccaggucugucaccaaagcuuccuacagcugaggacugugacaggaaggaaaaaaaaugucucuagccacaacagucaggacggcaccuugggaaggccuguaucugggcucccagacccgacagccaccagcucagugaccacugaggacagcacagcauagggaacucacgguccacaccgguggaccuccucuaacucagccacacuccucauccucacaggagugucaccauggggaaagcaggccacuaaccacgcucuaccccagacaaugcugcugacggaauggaccugaagugcccuucugaugaucucucucgagguccaggcuagcugcaagcuuuggauggucuccccucaaccuccuaaggcuugugauguggauaugaaccaucauacacagcacaaaaagauuauguuauguccacacauacacaugaugaucugcacacugauuaucuguguuuuuuucugagacugucucuuaugauccaggcuggccucagacuugcuauaugaccaaggacggcacugaacucuuaauucuucugccuccggaggcuggaauuauaugugugugccaccgugccugacucuuaucuacauuuucacugcuacaaggucucuuaauagaaauugaagaaacuggacaggaggcaaugcgaccagagacuuugucagcacugcuucaaggagaggcaggccugacucucugggaccacugcuuccuucccuguuugagaaucucugagggaaugucuucagaggacagccucccucaccugugaaggcggacggucggaaugcagccaggcggggcagcagguuaaggauugucaucuggaucagcgaguucuugcugcuccugcacuucagcacccacuggcacaccugagagagcaaggacacaggguaggcggaggagagggacgugugggcuuggggaagaagggaggcccuuuugccuuuuaccugaucaaauuucucuuccaucaagucucugcaacagcggcuuuccaccagaguggacuuggcagggcugggggacgucccaaaucccaucaggccuugaggggagcuguaccccagcagucccaccaaggcguucggcugcuggggcugcacagccuggaaacuggugaagggcgugaugugccgaggcuuggucccgaagcccaugaggucuuugcaguacuugucaugcaccagcugcugcugggugaucuccuccaucucuucucucagacgcuacacacggcggaagcaagggacggaagaagcggucacuaagcugcugugaggcuucuacccugggcacagcgagcgugcagggcauccacccgcccacccugaggagcgacugccugacaguggaggggcccgucugcaucagaggaccagguccugcuccaguguaggcagaagaccccuuuauugagcaaggucaaaagguaaacaaaguccaccuuucuggaauaagaaagugaagcaggcugccugccuggagguccucccaccaaguguucagcagccaugcucaggaaggcugaacugcaaacugcugggaaggugacaguggcuuccugcuggccuccugcuaagaacauucuaauuucuuucccugaaguggaguagaaacucaggcaaaucauuuucucagaaugcuugccccaggguggcguggaacaaggugccugacagugcuggucucucugcugcugaagggacccacgggacucaucccccaguaguuuccagcacuucuuggcagauucuuucaucuuccaggaagguuccaaggaccaccucugaguccuccucucauaucugcugcaucugauauacugugaucucuugcaugagccccgcucucuguucugcuccgcucuucccggcuacucuagccucccuggcuacuccucacuucucaacuucagguucccaccucuuuccaucuacaccaggugggucaugcaugguucuugcccagucucaagacuugagauagcggcggcaaccccuacacucauuucucuuaaccagaucucuccccuucuagaacuacucaggaggccacucaggaggucacucaggagaucacucaggaggucacucaggugcccgagaagcaccuucaauuuaauacacucaaaaauacccuguucuccucacccugcuuccauaucucagcacaaagcaacuucggucucccaguuacaaaaccagauacacugacuuucuuccuuccaaucuaucccaaauccucaguccagagcccagccucuucuuacacaucagcgacuccauggagagccacaagaaugccugccaagauggcccguuccccucuuaaaccucucauuacucugcgucugcguguggugagaggacggcugugggagcugguucuccccauccaccacucagguugucagccuugaccacagucuucugaccugcucagugagccgugugguggcucugcaguucccucuuaaucaaucuguagcuucagcccuugacccucaauagucccuucucaccacagagccucacaucagucaaaagccacaccuaggggcucagucaguaaagugcugacugcacaggcaggaggaccuagcacagaugcccagcacccacggagcaagcuggguguggcuguguguggacguggucacaacaggggcuccagaucacaguggacagcuagucuggcugaacuguugagcucuagguucagugagaguccugagaguguaguaagucagggaacccagggcugaacuaccacacaacagauccucacagcaagucucacagauggaguuuuccuccagcauuuccugaaucccgucuccucaguaucuguguucacaacaucuaacugaagcaggccagacuauuccgggagccuccuguggcagccaccagaaugugaccucagcuacagaagccugacccaucaagaggcccuggugcugcucagagcuccaucaccaacccugugccauggccacaagggcugcucauagccaacaacagaaggugaggaugcuguagccugccugcuccugggugacacaagccugcucugauggccuauguuggcguaaaggaccucacaguggccucacauaagacaaagagacauccaaugcugcuucucuuuugugcauucaagccaguguggacucagcccuuccuguguucucucacagggugcaaauccuuccaccuuuaagcugacuaaacaacaccuaacucccugacuucauucccaccucuccacacacuuguucccacagccagaggugucagaaauccacaacccccaugauucccaugugcacaccacugacaucggugcugcaauuaaagaacugcugaccacagacagcaagcauguaacugggcucacgucucugacaccaucuccccuucucccuugcuuacacuauaccaaucucucccaccucaaagccucccccuagaguacagcucccagccaucuguaaggcagccucacucacauccugcggcucucucucagacggcaccacuguagggagagcagacccugaguguccacuuacccucccgggcccagacccacucacgaucuuccugccugcuucaugguuuucacaggacuuacacuaccugcaaugaucccaucuguggccuuccuugccugccgacagacaggcacaggaacccaggccccaacgcaggcccccgacacaggcacucaccucucccuccaugcugcugauacgaacuagcucguugaggaucagcaaggcuccguggauucgaucaucucgauucauacccuucucuuuggccagggucucaucaaaaccuuucucugcuucuucaaaugugugcuaaguauagagaaugccuucauuaccuaguguucaaaguagaaaacgcaggcuugccccucuacccagagguuugguggcacccagugccuguuggugccuugugccaacaucaauacugacucacaagugcuuuuguguaacuuggcuccaacgcuugcaacgugcucuugaggcaaaugccacuaucaccucuguuuugacggccacacaaaacccaaugaaauuaaguaacuugugcaauguuucacagcaagggaggccaggucucuuguucccauauuuaggacuccuucugugacauacauuuccuuggcagcagccaucagcacaggacucaggacacaacuagcccuaagucaguagcaauagcaaccagguuuacugagucagcaauccccagacuccugucuuuggacaacugcuggcugaugagaagguaaugauaaauaucagcucucacucggguuguguuugaaacaguguuucaucagguaguccagauugacucagcauucuuucauuuguuuguucguaugcuugauuacagaacuuaaucuugguuguaauauuuugaagugaugaugaugugggcacugcuagccaaaacugcaauuaucaaacauaauuugcuuuuguuuuagauacagggucucacuauguguacccagauggccuucaccucagagaccuaacugucugauucccaagugcugggauuaaauguaucagccacuacuuauggccaauuaucaaucuuuaaaagacaugguucaggggcugggcauguaguucaguuggcauguuuaccuaacacgcacaaagcucuggguucaagacccagcagggcauagaacuggacauggugguauguuccuauaaucucagcacuaaggagauagagacagaagaaucucaaauucaugauccugcccaaauucuuaucuucuugcuacagccucccaaaugcugggauuauaggggugucccaccauagucagaggccucuaauuauagucuaauugauacauuuuuauugauagagaugcauaaaauaauagugugacuaccacuacaucuguccuaagaaaacacaauauaguaacaacagaaucacagugagcaggagagagccgugccaagcucaaacagauguaaggccugcucuauggccagcugcagcucuccaggccaaagugcuucgcuaguggcugcguggacccaucucucacccgguaccacugaggcuucugcauuuccuuugguucccgcugcguggugagaaucagacaggcacgaagggccgcuacagcgccuucccggauggccugcuuggggucccacacagccacaaaaauguugucaaagaagggcugaacuugcuggaagaagaagguggggacacugauggccagcucacggagaacgaggaccugggagagaaggacaaacacaacucuuacuccuacaaggacuugcucucucgggacacaccccugucauccuugagcaucucccacaaggaaaagcgaagccuggccccaggagaggcgaaggaugaccgagcaagcaccccaggcucagugagcgccuguggacaagcacagaugcuggcgccuacgguguuguuguucaacaccgagacaacaggccgagaaccaugccugccauccaggacagucaauaaacaguuacuggaugaaaacaugauguucaauuuuguuacuacuuucguuuuagagaacgcuagugucuuuaguuaaggcagccacgcuacaaaguugugacugacaaagccaucagccaggguugaugcuugugcuugcuccuuccuugaaaccaagcugggaacgccgccauccugaggcaccccugcuugccuccaccucacagccuggaauccuuuucccaggacaagcugcggaagggagcaacacacacaacggggcuccucugcccccagcccuggcagggcucagucccugggaacucacagcggcaugucuccggcccucauuucggucagcacccagccacuccaaggcucgcuucacuucaaacuccacauauucagcagugaaaguguccccugccaucgccaggcggccaauggccuuggacgccauuuccaugacaacuggaucgcuugaggggaggagguuucgaagguaguuggcaaaucugccaauucugguggaauucccaccuuccacuccuaugaggcuggcuagaaaagaaagcaaagaugaccaugugggugguguguucuggaaugcauaugcugaacccugggagagaccuuacuccgcucucaguauauuucuauauggaagacagcaguuuuucauuugaaccagcaguuuggauuuuuguucuggaacuauguacguaaaucaaaaugaccucaucuuaacacaucuguguaucucauucuuaagacugagugacaauucacaguacuuguggccagcucuugggcaaauagcacgcauuucuacuuguguaucuaugagccccacugugccaaauccugcucuacuguggucagacccaccagggccaccuagggcagaagaaugaaaagcuggcuuuuagucucacccuuggcaaacuggccacagaagucaccaguucugagacucagcugucagugaguuuugcccgagucccaggacuuuugcuagaauuagcacucgucuaugugcagccugucuacgggugccuuaaaauucuuuuaaacuacagaugaaguagauaccacuacuccuuuagcaagugcagacagaguacagugagcaccaaguugaguuguccagugucccuaacaguuguugcuaccagaggcuguccuuaccgauggccaagaugccacccuuccucucauuggcaucugagcuggaaaccaguucaaaaaugugaugguucagcuggucauagaagcgaguagacuccuccugacucaucugcaaggaagaugugcacagaacagauuuguguauuugcaccacugguaaggcaguagcgagcuggcaacuugagauucagauggagagguggcaggcacaguucaaaccaaagacaaggcucaugcccauuuccacagcuuuaaagcgaagagcaacugaucacaugacuccuguuuauuuaacaacugcuuacugauucucuacgauagcagagaucagcuugucuuaaaaucgugauaauaccagugggacacaggugaguagguuagugucucugcccucaacuguggucuguuuggaaaguuugagacuaucagcucuucagagccaucccaaccacugucagagacagagaaccaaggggcuggugguaagaaaaaacaccauacaaaauaaacagcugacuugagaccauaaacacaagcgauauuacagaaaugugcaaucucugcaaaggaacccacacgcuucacagacaugaaaacuaguguccucucaaauacugagcuacaguggcaaucuaaaccaggggcggcacagcaggcacgguacccacaggccuggccccagagcgccagagaccaaccucucgaagcuccauggugacguagugcuggagcuccuuggcugcuuuggcccuggucuccucauuccggcucuucaguccacuggcgaacugcugcaggacgcucacguugcuagauguggcggcacuggcgguggccacggcaggacccgucccaagcaucuugcccugagguucuuuggggaagaacaucuuucaauauuguuacaggauauuugaaccuguuucuaguuaugguguagcucgacccucgguacacaccuuuaaucccucuggcucgaauacagacaugcccuuaguauacacguuuaacccuaaacaauaaagguuaaguuaguguguagaaggaagcacccauguuugaaagugaugucuaauugagaggcagauaaaguaacaaaucagacaaagauuugaaagaauaggauauggccaacucucaugagaagagaggggaaagggaagcuacuuuaaggagaguguacaggagggagacaguacagugaggggguacaguagaguucauggagacaguauagugagagggagaguagagcagcugagagggagaagaaggcaguuuuacugggaguuucacagagacagacugaagagaaaacaagcuagacacaggaaaagacagcaugagaaaaagaauaggagggaggcgaagauuagaaaagauugcuagaguuagucugaggccaggcagagcaauucaggggaggcugagaggaaccagacugaaucaaucagcugaggggugagcuucagccagaacagcugacuugagccagccaacuagagaucagaaagagcuagaaagggugaacuuauucggcagcaagucucaagaggcugaaaacauucuaggccuggacuauauuguauggaggguagaagcucccaggacuagaccuagguuagcagauggagguaguaagccucacagacaaucaauacaggugaauaaaaguuauuuucacacauuuuuuuuucaaauuaaaacauuuuaaacuuacauuuauuuauguacacacacacauacacacacauaccacagcauaugugaggugagaggacaacuugcaggaguugucucuuuauguggaucccagagauaaaacucaggcugucaacccuggcagcaagcaccuuugucuacuuagccauuuugcuggccccuuuaaaaaucuuuuucuuucauuuuuuucagccagucuucuauucauagcaugacccugaacucacgccacaguugacggccuggaaccaccaagcuaggagucgaagggugcugagauuccaagcugggcucugcaugcugcaagcauucuaccgagacggaacaccguccccagccccauccuucaauacucuauaaacucuguuaguaaauuccucuguggccuuccuaacacggauuuccacucauuuaugccaggcuugggacuccagagacuaccugggcuuaaauccugaggcaaagucaccuuccuuaagggggacacuuaagacuccucaauuuccauggcaccucaguagaagagccuaacucgugggauaaggugaggauuuacacauuuaaaaguguuucugggagugcaacacacagcucuucuucgcuuuuauaacuauuguagauguggucuaaagucaggaguagggcagaagagagagaacuaaaacuaagguuucuccuuuccucagacugucauuugcaggaguguauggagucuacagcagucuggcccaacagaaauauaauacaagucacgugagucauuuuauguuauuuuauuuuauuuaugcaugacuaucugaguguaugccacauaugugcagaagccugcaaaggucagaagaggacauuggagucccuggagcaggaguugcaggcaguugagaguggccugacaacugggguccacuggaugaacaacaagugcucuuaggugcugagauauugccagcccuccauguaauuuuaaaugaaacaggugaaacucacagggcguacucgauccaauaauucaaaaacucauuuugagaccgaguuuccaaaaucucgcauucaacuaucccgaucuggaucggucauaccucagcagcuacauguggcuacaggcuguuguauggauggcauagugcagcugugcaggguacuagcauggcuagcucgucucauccauggauucugaaccuggagagucuaccaaggauggacagaauauccuagggugugggugggagggaugccucagugggaaagggagcuugcugcuaaaucugaugacugaguucgaucucugggaccaacaagguaaaggagagaacuccuauaauuuguccugacaucaacgugcacaccacugcaugcacggcaccucccaccccccaucaauaaauagugcucuugucauuauuugcuacaugguagaguauaacaaccauucauaguguaugguacaguauaacaaccauucauaguguaugguacaguauaacaaccauucauaguguaugguacaguauaacaaccauucauaguguuugaagguaaaagcaagggaggugugauuuaaagcauacaaaagguuauauacaaguacugcaccauuucauaggacgaacaggcauucacuggguugggaaggcaguucuagaaacaaauacauacauacacacacacacaccauaggaaauagcaacacacucaaauggugagcucaacacuaucacucauuuuucaacuaugugauguuuguucccucaauaaguuuaccauccaggggaccccaauaaaguggccauuaaaaaggggcuagcccacuaugccauggcaguaacuaacauauacaccuauccugccagaguauacuaaaaaacaaaaacaauucccgaagcacucuggcuuugaaagaaucugugagacacagccuaacaugcacagaaccccuuguucaauccccaccaccucauaaccaaggcacgaugccacacaucuuuaagcccagcacugagggagaggcaagaaauucaaggucaugccgggguuagggauaaacacaaaacauaaggaguaaaauagucuugaaaggcuuucaaacgcuacacuacagggggaauaaaauacuauaaaaggaacugggccguuuuagagcggaagaaaccacuacugagcguguaagcacacgaggcagcgggaaggagaccgacuuggacuuucuauucucaucacgucaguaauuagacagucacuugaagguuuacccacaagccagcugccccaggcuggauucaaaguaacuauuugagucacaaaucccaaagguugugagaaugccuuaggggaauucgaguugaaagguugaaacgugaagggagggcgugacccugaggcugacccugcgugggcgcggaggucuggguuccuggcaggucuccauggugaaguguagggggcagaucccgaaacuggagcuccuggggacaggcuccaccgucaguaggugggucuggaguuccagguccugagcccgagaaggagaccuaaaugcuccacggaaggcccggagcagauccgccagccugcgggggucuccccgagggcgcggagcuggugcuggggcgcuguacgguucagacaggcggcuucccgggccucccccagcacggcccacacuggcugggagucuggccgucccgccagccgcaagcgcccgacuccaggccccagacucaccgcgcggcuucggccaccgccucagcugccgccgccggagccgguaccgccgcuucaggcccccagccucaacacccgccuu

SEQ ID NO: 12336 - RNA, 98217 nt, Mus musculus
cuccuuccgaaugggcaucaccguuuauugucgauuguguugggaacugaacagagcacaggcuguggagcagaggagaaaggaaaagaggaggaagucuguuucugaagaguucauuucuuuaaaacacuuuaugguuucaaauccuuucucaccccaaagggaacucaagaauucaaguauguugcguagggagcgguaauacagagagggcuucugcucgcgugcgccuaggugguguugucgggccauguaaacaagcagacagauuuccacauuucuugcacccuuuuuuuuuuuuguuuuuuuuguuuuuuguuucuuugcuuugguaaggucaaaccccaaaaggacacagcauauaaaagaaccccgggcugaggaacuuauccucagaggguaaccgcauaguuggaauugucacauaggauuaaaacaaaacaacaaaacaacaaaaaaccaaacacaccccucaccucccccgagccccacgagucacaggaguccugauccacuccagccagcugcugcugcaccugucccucaggaucuuaacugaggguugcuagaaggaccaggcucacaggguucucuucauuuuguuuauaauaaaaaaauuuaaaagggcuauuucaaaagaaaaaaaaacugaaauucaaauucugaaaauaucuugccuuuuuuauuaaucaugucaucuaacaccaauuaaaaaaacaaguaugugaauaugauauaaaaauacgaucccaagauuaacacuugucgcaggcacaaguuaucgcacagaauacauguuuggagggccgggaaaggagucugguucuguuucucuuuaaaaaacccacagcagugcaaguagggugagggaggggagauuguuuagcagcaaaauguccgaguucucuauucacaucgaaaaaacaaaacaaaacaaaacguaagcucaggggaagcugcccagacccacuugucacuaaacacuuccgcugccacagccccagguagcgacaggcgaagggugcgcuuuacuacacaagccaucguaaacucgucccucaagcuuugacuguugucacuuaaauauauguacaggaauccucuucucgucauccccucagaucuccacuguuuggucacacgggugggcucucaggaucuggccacaucugguuacaggcuggagcugcagccucgaggcagaugcugcugcggccuggcuggcuggcguggcggcuuccagcggaggagcgauggggccucaguggucacugcucuguuucucucucauccaggccugaaucugcuccuuuagcucuggcacugagggagaaagcacaggggaugaaugacccggaugacaggcucuuccacugcaguucuaucugcguggacacagaguccacggugcucacucccugugggcgcugaagacugcagaaggaacagccauggacagggaaacauuuacagccaaagugagcggagugcucuguggcuuuuggguacuuucuggauccaaugucccuuuuccuggugguggugcuggggacugagccugggaauguacacaguugggcaagggcucugugcaggcccagccaucuuuuccuuuuuguuugagacaguguuguaauuacacugucggaacuuacuugccaugaacaggcucuccccuucugcuucauccaccccgguagcugggacuacaggccucgcggcaccggccagcucucagucucccgcacggucuggcugcacucacuggccuccuaccuggcuccagcaugcucucagucagcaucuggcgguugaaggggucggugggggaguugagcagaugccgcaggaugauagaacgguccaugacggugccagagggcagucucacgggaucggucaucaggguguccaucagagggucuguggagacagagcagaacacacuaacccucaagaacaaaagcagaugguuccuaccagcgagacagucucagggagagcuguggagcgagcagccccucaagccccucaguaaaggaaggcagcaaaugaugaaggccuugcccugccuucugucacugcugcugggaggagaaaagagcaaagaggacagccaggcagcaggcccagggcagaacccuuugccuuagaauccagacuccuuccugauaguggcagagcugccuuuaaagucuuccuggguaccugaugaaaccgcacuggggauggucaauguaggacggacacugcugcuguccucagacacaccagcagagggugccagacuccauuuuggauguuugugagccaccaugugggugcugggaauugaacucaggacuuuuggaugagcagucagugcucuuaaccacugagccaucucuccagccucggauguucaacauuuuaaucuacaauauucacuacaauuuguacgcauaauuuucgacaaaucucaagaaucagcuauagcaucagacaaucaagaagcagagccagcggccacccuuguggugaucuagaugagaacgacucgccagaggcucaaauguuugaauucgugguccccaguuaacagaccaguuucaaaaggauuaggagguauggccuuguuggaauggcuguggucuugauggagauuugucacuggaaguggacucuaagguuuccacaccaagccuacuugcacucucuggcagcuugccucccugccugggucugcaugugagcucucagacccacaccugccugccugucgccauggcccugcuauccugaucgugcaugcacccucucaaacuguugccuugauuguggaauagcuucacaggaaugaaacagugaccaagaaagcacccuuaaugccacacacuccaaguuacacugcaugagcaugcggacuugccucugaacucguccggggcaucgcuguagucuauuucugcccgcgcauucuuugccacgauuuccuccacuuucucugcaagaaguuuaaacuucucuauugcgaugguggauuugauucccgccuuccgcaucuuugaaaugacuucuucaaacaguuccuugcuguaggaucgcugcacacaaggaaggucacguaagaugagaauacacuugagaagaaaacacaucagaaacggccaagugcagucugcgagauccuuggcuccuaaugacugugaccauacauucugcaucccaucuucuccuauacacuguaccgugggcaagggggcacuggauauaguuacagacaucugcacagagacagacucacgugugccaaggucaccuguggagaaagcuccaggacccagagaaaccggaaguuuuuaacuuuaggagcuagcaagcauuuguuauaaagaggagauugagguuauuuguuugugucagccacuguguccugggagcacaugacuaaauucugcuuuuuuacauaagggugagcacagaugcgaaccaagcauaggucacuggcccauuacuguccauacuuagaggggagcuuugcucuagucaccgcugguucccuaggcucacaugagugggcaugguggccgucacacguguacuccuuccuucccuccuagcgcaggcuacauggugaggccauacucaacagagcacaguaagccaaaucaccaggcaacagcugagcaucgucacucacugaaaccaacacuuccuaaugccacauuucccacagcacugaaccccuccuauaagcaggugacugacaucauuuguagaaaugcgaacaguggacaacacacccagacaaaccuagacacaaauucaggucccauuaccucccaguuauacagucuuuuuuaauuuucuuuuucuuuucuuccuuccuucuuuuuuuuuuuuaaagauuuauuuauugagccgggcgugguggcauacgccuuuaaucccagcacuccgggaggcagaggcaggcagauuucugaguucaaggccagccuggucuacaaagugaguuccaggacugcuagggcuauacagagaaacccugucucaaaaaaccaaaaaaaccaaccaacaaacaaaaaaaaccccaaagauuuauuuacuauguaaguacaccguagcuguuuucagacacaccagaagagggcaucagaucgcauuauggauggcugugagccaccauguugcugggguuugaacucaggaccuucagaaaagcagucagcgcucuuaccugcugagccaucucuccagcccccagucauguagucucauguaaaucccuaaccugcccaaacuagauuccucaggugugacguggucagcgacucagcucugagggaucuacuguguaacaaucacccacaccacaaaacacacagcacucgugcuucacagugcccacuugcugacuuaggccaagauacaaaggagaaugggucuccuggggcccagggacacaaccacagucucuaaucacaccagcaacaacagaacacaaaccaaaaccaucaaguaaaccaauguccaugaauuugcuuacgugaagacuccaccuuccaaugcugccguucccucuccggccugugagacugcacgugagauucagaggaggagcaggauggcagggucccccucugcuccccagugugagagcaaggggccagcgacagggccugcaggagcuucuguuucacugugaggccucugccgagucugcugcucaucuugugaccuugugagcaggaucuacacugacaccuacacagacucaucucuuuccagcagugggggaaacuccuuaauccaucugccuucuuuuuaaugagcgacaaucucaguauggagcccugguuggcuuggaacguuuuauguagaccaggcuggcacugaauucaaaagucugccugucccuuucccccgagcacugcauuuuaaagcuuccauuucuaaauaaccacacaggccugcuuccucugcauauccccgcuccacuccccuguccacgccuggaaccccagcacuggggaggcagccggccggcuacacagcgagacagugucccaaacaguaagaaacaacaagaagcaucgauacauuaauaauugugcgauaaaguuguaguugaaaagacaguguaugggcuggaaagauggcucagugguuaagagcacugacugcucuuccaaagguccugaguucaauucccggaaaccacaugguggcucacaaccauucauaacaagaucuggcacccucuucuggggugucugaagacagcuacaguauacuuacaaauaauaaauaaaucuuaaaaaaaaaaaaaaggcaguguaugaucaacacauaccugcgauucuagcacuugggaggcugacacuaaaggauccuggguucaaggcuagccugucucaaaaaaaaaaaaaaaaccaaaccaaaccaaacuaagaaaacaagaguauauauacaacucuuguguuuuaacauugcuccuuugaauuagcuauaggcagugaccuuuggagaguucugaggauggguaacauaugcugugcauacaaagauagugacaugggaagcaauauaccacacucugaacauuuagggagauggugagaauauggguacaggguuugacugccagucacacauucucccucuauaccauacuuucugagccuggacacgccacuaagcuccucugugcccuguguuccuuacuuuaaaacaaaggguuuaguagaagcugugccauagaauucaugcuuaucaaaugaguggucagagcgguauacaguaaacacgaagcauuacugugcugcagagcugcccagaugucaggcaugguagcacacaucaauguacucaagaggagaguuugagaucaggaguucaaaggcuagccuagucuacacgagacauuauggcaaaagaccugggaagaaagaugcucagagaccauggaggggaggaacccuuuccuuuuucucugcaaaagucuccggcuggacuaaggguugagccuagaacuuugcaaguucaggugcucuaccgcugaacuauacuccuagcucaauuuuguuuucauggauggucucaguuaaguccagguuagccuugaacuugugaccaaccuguuuccagcccccugaguauuugggauacaggcuugugccaccaggacagucaacaggauccccuucugugacaucacagagggaaggccuguacuggaggcugugguacaugagcugaccugacccccaaggcucuuggauaaaggagaggaggcaggcguuggcuugaaggccauguauucauggcagcugguaagcagggcgcuugggaagaccugcaauuuccugacacagcaaacagaguuuggaaacagaaucuguuugggggucugagggauuagggggccagcucugcucuauucucccaaggaagcaucaguucuucuccuggaccagcugugguccucgacuucauguucacugcauuaacaacuucugaaaacgagacuuuaaaauuccugcuuuaaccucuuuugagguguggaguacacacacacacacacacacacgcacaggguggagggggacgacaacacacacacgcacaaggucugcugugaaggugcagaccacagaugccaaccacacggcucagugccaggccuccugaugagaugggccuccucagugcucaccuggucaucggcgauggcuuuagcaaagcgagcacaguccaauuguaaauaaauaucugucaguugguccaacagcuucuuuggcucaaaaccauacuucucuggguuuucaacuuucaggucccggcacuuggguccgcagagcugcugcagguuaaaguucagcauggcugcuaaucggggaccaagcuccuaggaaaugaaggacaacaggacgguccaagcugcugcaaaguccaggcccagaagcuccuaccccagugggaaugggcugcucaaucugcaaagcaccccugaauugugcugagcugcagcacaaagcuagagaaagcauuggaaucaaacaucucccccgccauugaucugaaaaccccuauaauggaguggucugauugcauagagaugaacgcccacagaagucuucuggaaagagacacuuucucuuagagcaucacuccaaagucacugagaagcagggagaggacagaggcccucgcuguccugucacuguggcugggaagccucauguccacauuuccccauaaacuucucaaguccccaacagucaggcacguguuguucuaaucuacuuacugaagagagagaagacggugacauuugucaacggcguacgucuugccacugugaugaauuaaacugacagaauauuaaggacaaauagcccucaagagucggcaggccaacaguaccugcugcagcugggacaaacauggcuucugagcucagagacagcugcuguagaccagacauuaaauacugaccagcaaaaagauuccuuaacuaaugagguccucaugcagugacuggguucauacaaaaaaaucuccugagcuuccuguuguagaaaucaugguuuuagcccaguguuggaaagcugggggcugaaaaagugcuuaagcgagcaaggaaggagggcagaaaugcaggcgggcugaagagauggcuuggcuuuuaagaaaacgugcuucucuuccagaggacacacacuuugguucccagcaccaauaucagugcgcuccuaagaguaggcaaauccagcuccagggagucuaaagcucucuucugaccgccaaaggcgcuggcaagcacauagcauauaccgucccuaacacacccacacauaaaguuguauuugaauguggucacucuuuuggaaaacagucaggcuugucuauguccaggcuaucacaggagcacagcugagcaggugccugagacacaucuccaacaccuuuaaccggcugcucucucagccuugguaggagaugcuagcaaauccccuuuacacaucccuaagggagcaggaauguggaccacggugagcugcuucccgcucgcucgcaucugcugcuaugcugacaucugcuuaucaagaaacaggaaaagacccagaucucagucuguagacaggcccccgugugacaguggcccugcuggaggcaacacagugauuccugucacagagcagugaggaagcacagagaaggagaggaauacacaguaaagcugcacaugugcagacagcugcagauggaccucagcucccugcgcacugccaccccacagguaccucagcucuuuacugggguggggucuccauuacacugcccauucucaaccucggaacaggacugggccaggaguuucagccaucaggucacaguaagccucagucacaguucucaggagcccccagcucccucaauguugccucaaagcucuuuuauaagcagcaagcaucuuuuaccuauuacucuacuuaauguccuccaaaucauaauguguuaccuuauacuuuucugauauauaaacagguaauucaguaacaaugaaauugugucacaaauccugauccaaaugugcuguguaaucagaagagagcaaucuugaagugaacauuuuagaguauacguuaaggggcuucauuucagcccuguagaguaccaugugauguggaccaacugggaacaaaaucagaauucuauucacagccgggcgugguggugcgugccuuuaaucccagcacucgggaggcagaggcagguggauuucugaguuugaggucagccuggucuacagagugaguuccaggacagccaaggcuauacagagaaacccugucuugaaaaaccaaaggaagaaaaaaaagaauucuacucccugguugcuguagguaaaaugaacaugcgcugaguuauaaguucuguacccagacccuuaaagaucacacaagcaccccaguuucuacucacuggccucaggaacggcuucuggacuugcuuggugaggagauggaacauguccacgguuucaguugccagggcaagauaagaacgggaaacacgcucguccugagcaagcugagacugccgggccugcugcugauccugggaaacaucaaacaguugccaaagaaaucucaguaccagccggcuacucagaacacuuggccaagugugaaggaaaaacauggccggcuuacaguugcagagggugacaggccagugcacucugaaacagagguaauggccacaccagcacacugaccacacagcucaugcuugcuccuuccaggacggguccucugauggccuugacaccuuuggguuacacccagcuggcccaugcuaaacacaggcucuaccacuaaguuacacccaguccuggcccauggcugaccccucugagcaucaguguucgcaucgauaacaggcaggguuaguuccugggaggaugaauuagaccagucguccucaaccuucccagggcuguggcccucccuuuaauacagcuccucauguguggugccccaaccacgacauuacuuucauuguuauuucuuaacuguaauuuugcuacuguuaugcauguagguaugcaugucgaggccagagaaaauccuugggucuuguucuugggucccccgaccccaaacuuuuuuuuucucuuuuacaguuuuucucacccgccuggaaaaugucaaguagacaccgcuaacuggccagcaagccugaagggucucacugucaccacuaccucagcagugggauuacaacugggugccacccugccuggcuucagccccaccccccaggggaagggcaaacagcuggaauggcagcuacagcccagcaaguucccucugggcugcugcugcacuccgugccugguggagacucugcagugggcuggugagcugcccacuucuccugggcuaagaaugagccuauugagaggaagcugcaccaggaagggcccaggaacagccaggccucaauggccucagugugagucugaguaucccaucuuucccuugcagauauuaugcaggcuuggucugaggcaagacagauggacaggcugaaacuuuaacacaaccgauuaaacacaauuuucuauagacauuagugcucuggacaaaagacaucucaaaaauguaagaacaaccaacuguuugcuuacguucagagugugggcuaccuugaguuuaacuguguucacaacuucucucacuguacugucuaguuuugugucaacuugacacagcuggagcuaucacagagaaaggagcuucaguugaggaaaugucuccaugagauacaacuguggggcauuuucucaauuagugaucaagggggaaaggccccuugugggugggaccaucucugggcugguagucuugguucuauaagagagcaggcugagcaagccaggggaggcaagccaguaaagaacaucccucuauggccucugcaucggcuccugcuuccugaccugcuugaguuccaguccugacuuccuuggugauguacaacaguauggaaguguaagcugaauaaacccuuuccucccuaauugcuucuuggucugauguuugugcaggaauagaaacccugacuaagacacucacccuuacaguuaagcagugaaccucauaaagucacguuaaaauuacauuuacacaacaaaauucuuuuaggauaagaaauaagcaaaccaguccuugugcacgugugcacgcauguauauacauagaucuuauuuuucauguguaugaguguuuuguuuugccuacauguauguuaguaccaggugcaugccugguacccaaggaggccagagagggcugucagaucuccuggaauugggaugcagcugcugggaaacaaaccugaguccucucuccagcccuucauucauauauuuuauuucaauuuuaaauacuaaacuuuacuccuugcaaauuauagcacuguaauuuaagucacagaaaugcacacacagacacacacaugaaaucuccauuuugaaagcaucuaagauuaaaggcucacaacugaaaauagaaaaucaccuaagagagccccucucucaaaacgcuugggcuuaaacugaaggauguagauaaaguccuuuaucuuaaaaccuuacugacuuugcuuaaccugaaggauguagauaaaguccuuuaucuuaaaaccuuacuggcuuugcuucuggauagcuggucuugaauucuuccuucacagcagccaaggcucuggcuccccucccccagcacagguaucuuagugggaagacaacaccucagggugcuagaggcuaugcugagcuguaucuccgcacucuuauggaguccuuaggcaugggacugaagcacagcaauggcucagagagacucccaacucuguuggagacuuugcuuaauaaaguaucacaccccuugaauagacacacaaaaaggcugacaaggaauuggggagucaggucaagaaugauguuggggucagcaagccccagccagguuuucagucugggucaacagcacugugggaagaggggccgugaaugcaaagaggaagugggaaaggccagugggggaguagcuggaggggagagguugcuggagggggggaguagcuggaggggggauuagauggagggaguagacugaggggucaggggguugggagcuaagggcagaaaaguggacaugcccgcuaggauaccaagccuuugugugagaaggggcaucccuuggcuaugugcacuggugaggguggagacuacgaguaugcugcugcaacaaugaggguaaugcagaauggugacuuggaaggagaaggaagaggccacacacacucguccugaccuuccugccccauauccuaaguacugccauuccagggggacacgaccacauucuguuguaagguacuggggagugaacccagagcgccccaccacugaacuaaagcuucagcccauggagauaaaagacagucuagacaggggauggggcacagacuaaucacgggcaaccaggaaauggguagaaugaagcugccauugauuaaggucauugugacucagagaggagaccuaaaggacaagucaggacugaggcaauuagggcacagccaaagcaaagcaggccacacugcucaggccugcaggcaggagcgcucuaagcaggcagccauauuuugcagucuuuaaaauacagauauuuaaagcccuggaaaagaugagaucaccuggcagugacuucaagcagaggcaucagggaacgugcaggaguguuuggcugugugagcaggguuggggguggagggugaggaugaaggagauaggacagacugaaacacaggaagacacacauggcugguguuaaaugaacaacaguuucuuacagagauaugcuucagcauccuguuagugccccacagagaaauuacccaagggcaggggcggggcauacuuagaaguagaggacugagcucuggagcuaccauugcuuggaggcugggggauggaugaggaagugaaaggcagccaggaaccucagggucaagggucaaggaaaagcugucugugaauagaccuuagaggcaacuugugcuuaaaaaaaaaauccauuaagggaagaaucaauaguauuugucucaaguaaauguccugauggugacagagagaaugggcuucaggcccagagaucaacuccuaggagauuagcuggucuaaauaacacaggagggagaacaggugaggcaggggcaggagcagagguagaguuagguggggcugcauggggcacuggccauuucugaauaggagagaggucuaacauauuaaggaugguugaagauuuuuuagaaaugaacccaggguccaguuggagaaaacaggacccauuggaaaaccuccauuaucucaacagggaaggguuuggggccacggcuacagggagggccaggcguucauggacccccaugcagaaugcuauggaaggagcaggaugugacauucuuaucacagcugcaggaauaccugugaugagacccggccccacccccaaaccgagcuaugguccacacaccuuuaacuccagcaaucagaaggcagaggcaaguggagcucuuaauuccaggggaaccagugucacauaggggugagacucugccuuaagaaaaaguucccuuaaauguucaguguccuauagugaagauguuuuuaacucaacaacaggacuucaacacugccucacagugagugcagcaccaccccacuucccaccagggucuccccaugggggcaggacccuguggaaagcugcuuugauucugagcuaacccaagcccacgaugacauucccgggaguugucgggacgucccagguuaccaggaaccaucugaacggcuuccacugaguuaggagagggcagugcacugucacugguacagcaugcauuucucgcggaucuuggcaacuuuuucuaguaaaaaccaagaucaacaggagagaaaaagcuccacuaagguccuaggugaucgucagacaucugcagaggccuuucgagcaaacccaacuccugcccagcagacagaagccugagaguuauuuccuagcuaccacacaagucaaaaggcacaacauauacaacgaaacauuccucuaacaacccuuuaaaugaaaagacagagaaaguacccaugacacacugggaaaggcuucucauuucuucaacuuaagauauacuuuggugaugguuuuagaauccagagucucuccacaugauaaguuucuguucuacuccugaguuuuaccucaacccuaugaugugcgugugugugauguauacauacacacacacacacacacacacacacacacacacacacacaucugcauauauauauccguuuauauuuauauaaaugugagugggcaugagugaguuuaugugcacugugugugaaggagucccaugaguccagaaggcaucagaccaucagagcugauucacaggcagcugugagcugcgcgcuguuggugcugggaacugaagcugggucuucuggaagaacagugaagugcucucaaccgaugagacugguuuuggcaaugagaaucuggcuuugaggggacaccugauagccagucuuaguaaaguaaggaacauucuugcccgaaacucaagcagagagugaacuuuucuucccggggguuugggacaccacuggggacuauaagcaugcuauggaagcacucuaccacugagccacacccucugccccaagucuuuagauaaaaaccuuuaagaagcaucaucucuuccuaucucaaaccugaaaugcuacuuuacggacgccuaagguaggaaaggccccagcagaaagucagaccuaguguugcccgacccccccgccccccagagcccguacaggcgcagaggcgguucucacccgaggcagcuggucccacuguucuuuguucuucaucucuucuugcacuucauggauccgcuucagagacuccagacuuucguccaguaaaaaggucgugucauuuauuagcauauugauauaccgaacgaacugcuuuccagaacugaaagggcaacaagacaguguguggugaacaccuggcugggcacggagagagaauguaagccuccccagguaccaagacuccccgugacacugcaaauccugucgcagaugauauagcuggaguuuaaggacugccaauuaacucucuccuuagauuuuguuacucccuugguggugguuuugagaaaggucuuccuccuaccccaggcugauaucugaacuacucuccugccucaguaucacagcgcugggaugacagacaggcgccaccaagcucugccucacugcucuucccauucacugugacaagcucacucaaguggcagcuggaccagcacuguggggcugguaggagccagcggauacauaguccagaauucccugagcugacuuccuuggcaguuuaaacuuggcaacuauuuacauuguuacacugugaaaagcagcaaaugcugaaauucuuccugcuggagagguucacuguacagagcuguuguuucuacguagaggaaacccucuuccaggcuggaagagaaccagcaccaagagcacauuacaaaacacaagagauggaggcuacugaugaagcugucucucacacaacgaagauaccugaagaaaaacuaguccuauaauaucaauaaaggaagagaggaacucagguuauagacccaaagcgucaagucuaaggggagccugcugagagcuguaaugaaggcacuuacuggggaacugugaacuucugaaacugacagagacuuggcaaaaagagaaggcccaguguccucagcaggugcaccuagaaagcccaugcugggaggagaggggaacaugaacaugaacacaaggccucagacucaggaauuugggacaccagaacuuccauuuucaaaaagcaguguggacagaugcagcucacguugccggcaacaccgacuaguaacugaacacaggacagacagcuagacugaugaaagaucugguaugcaauggggcuaaacuuccuuugauggauaaagcaaggguucaauguucacacucaucuuucuuaaggacuugcaaauaauuuagaggaauggcuacugagcaggcuuacacaggcccugcaguuucaagcuuggcauauaagcgcagccaauaaauuaagaggccaccuuaacccaagugcuucgaaaccucggauguguucuuaauguuccugagucagauaacugcauuuaauaggauagaauucagaguaaacacaaaaaucacuccacauaaauauuuuuccagaacauucugccauguaagccacucccagugucaacaacgcuaaaguaagcagacaaucacguagguguccacgcugagcagugucuugugguuacuugagagaggcagagacagaaagcagccacagggagccgcugggcgggcuuucagcagccuccccucccaccugugcucugccugagagcaagcugugccaucaggccccaauacucacuugaacuccuccaugaaggugccauggugagcuauguuuugccaaaggcuuuuaaaaauagugcuaaugugauagcgaauugugaacuugucauagaacucgcugguggcuccaguaugcucgacaucuaaggaggaaagacaaagggacucagacacacauccugaccuuccagaugcaaugacauggcagugucucagugacagcggggacagugcuacccguaucucagugacagugaggcugggaagcgcuacccgugucucagacggaaggcacaggagaaagggaggauuccauuuucuuuuuaauuuuauuuauaauucauuuuuacacuccauagucuguuccccgccccuccccauccacccucugacugcuccgaauaucccacaccuccuccccaucccaccacgucuccauguagaugccaccacccuaucccaccugaccucuaaacucccaggggccuccagucucuugagaugcuucaucucugaaugaacacagacccggaacuccucuacuguguguguguugggggccucauaucagcugguguaucaugcugucuguuuggugguucaguguuugagagaucucagggguccagauuaaccaagacuguaguuauccagugcccaccaguaccccucuccccacauuucugcuuuauuugcuccuaaaugucccucaaaaucauauugcucagguuccaauucccaaguccuuaaagggaccugacucuugcuaaucucauaagccuuacccuguccuggaacauccauguagacuaggcugcccuugaucccccugacucagccugcugaccacugggacuaaagauaugugccaccacguccagcaugaacaaggcuuccugcugccaccuuccagguccaccucacugccuuuucugucacuccucagccgagaucaacugaugcagaugucugcauccaucccagagagcucugccuagaccacuuuuugugaaguagcccauuuucucugacagcuacuguccccaacucuuccacgucugccuccaugagggaucuugggguccucucauaguaggcccaacacaaacgcugcuaaguuagagguggagucugcccugccucugugcagccagccaguuaugaggaaggggccuggaaauaagucuuguagccauagccuucggagccucaggaauuccuaaggaauucuuccuuaaggaagacuguuaggacucauuuaaaacccucuuauuuugaagucuaauuuuauuuuugaaacaagauugugcauaaguaccuccuaugugccaugcccugagagaugcugguugcugcaguugaccuugggauauacaacucuaaguccuaucuugguggggugcugggcaggcccauggagacugugaaguuucagcagggugaaggccagaagagcagccaggcacacuugcuagaguccagcugcugagcaccugccacucacaggccuuaaccuuucgcaagcauccugaccuuucuaagcuccaguuuccucacuuagaaaauggacguauuuauaguacccaucuuuuccauggcuauucggaucaagugaccacaaguggcaacuauuauuaggaaaggugucaucuacccaugaccauggaagggcucaggccagaggccacugugcuccacgacagagagaaaggguggaugauauccacccacaugcuccucaggcacgccaguguguguguguucuuucuuucuccucucucucuccucccucucccucccucccucccucugucucucugaagcuacaguaacagguccagaccacuaaccgaauacuaacuagauucaacaaaaaucuauuuuuuaauauuaauauauaccuccuguggaauguggcuauuacuuggauuguucaguaaauuuuuggguuguuguuuuugacacagggucucacuaaguauuccugacuggccuccaaccugcaguguacacugcuccuguucugaauacacacaagguggcauuuguaccuaaauaugccgagcuuauccugaaacauggcuaggagaccaugaccuuuuuccccaaaaggugugccagugcacuggacuuucuccaaagaaagaauguuaucaaaauacucaagucagcaagugcuuacuucagacacaggagagucuaagggagggauguaacaaaguaacagugaccaaggggaaguaggcaggcagauucccagagccccuuacaaggugggagaguuggcugacccugaguccaaacaggcagugggaacacugggaauccucacacaggccaccccagucaacagcaacaggcuguauucuccgcagagcucagcaaggucuacuaaaugccagacacuugacuguauggccagaaaguaccagauucuauacaggaugagaaggcagggcagaucccaggaacuuccauuagccacuggaagccuuuguuagaggagagauuaacccgagaguucaaaagucaaauuuuguuaaacagucaaaauguggaauacagucugcccagacagcucauucuccauacccugucauuuccaaguguaacugagcacagcagacaguaccuagcaaauggcaggagcucagugaaugugauacgcugaugaaugugggaggacucccagagcaucccagaaugcucagcucacuggcucgggugaagcccaaccacuuucuuaaauuuuuuuuuuuuuuuuaauuuuaaaggcuuguuuguuuauuuauuugaguacacugucaucggacacaccaaaagagagcaucagaucccauuacaggugagccaccaugugguugcugggaauugaacucaggaccuuuggaagaacagucagugcucuuaaccguugagccaucucuccagccccgcccagucacuuucuguuguugccuuuuucuucuuuucagaagcuuaagguagccucaaacuugcuguggcagucaaggaugaccuagaaugcauauaucaaacucucuccuguuccaucucuuugaaaaggcagccacaggaugguguuauauaucagauacuguaaacucaacagcaaaugaaccagguuaacaacucagaugaaaacaucagcuuggacuaacaacaacgaacaguguaaaucaacggaaggccgcacacgcaguggccagugcgagcucucagaggccgggagagaaggcaugcgacagccugugcucugagcuggggcuaggaagugauuuacauaagcagauguuaaagccuugauggcaggauuauuuauuuaucuauuugugaaucuaggucacagauuuagauuuaaguucgcucugaaacaaccuugggucaaguacauuaccacauaccccagggccuacucugaaacccaccuguauagaacuucaugagggacggcaccagcaguuugguagagagaggaugguucucaaucaucucaaagaacuucugaguucucggcuggacagaaggguuggucaugaacaugaccuccaccagcuuggccacuagguaaggguuucggauguaguucugguugcacagcaucacaacgaggaacaugacaauguccugagugcagggcucauaaagcaccugaggagaguaucuguaaagaggagaaaacacauggugagucucggagagcucgcuaggccgggaaggagacaggguccagcagagggggguacugggguacauacacagcagagggggguacugggguacauacacagcagagaggggguacugggguacauacacagcagagggggguacugggguacauacacagcagagaggggguacugggguacauacacagcagagagggggguacugggguacauacacagcagaggggguacugggguacauacacagcagagggggguacugggguacacagcagaggggggguacuggaguacauacacagcagagggggguacuggaguacauacacagcagagggggauacuggggcacacagcagagggggaguacuggagugccucuacaugguucaacaaugugcacacuggagccacaaagauucaaagcaaaccugaguguuggcugcaauguguuuuagaaaguaagcaaaagccauaacugaaacuucacaaaaagaucuucacuguccaaaaguggggguuuuauuuauuuuaaaagacaggaucuuuuaaauagcuucaacuguccucaaauucacuauaugcuggcuuugaacguguuaucauuugccucuacuucccaaauacuuauauuaugggaaugcaugaccaugcccagcuucagaauggacaaccugaauuccaucucuaggacccaauuguuagcaggaccucuguagcauucaaggaccccaugcgcacacgaauaaauacauguaauuaaaauauuuuuagccaggcagugguggcacacaccuucaaucccacaacucaggagguagaggcaggugaaucucuggaguuugaggccagccugaucuacagagugacgaguuccaagacagccagagcuacacagagaaacccagucucaaauaucacccaaucuuuguaaaugagugcucucucuguauguuugccugcaugccagaagagggcaucagauccuaggauaugugguugugagccaccucgugauugcuggaauugaucuccaucucucuagccaccugccccaauuuaaaaaaaaaaaaaaaaaaaaaaaguucaaauuuuaagaaauuaaaauguaagccgggcgguaguggugcacgccuuuaaucccagcacuugggaggcagaggcagguggauuucugaguucgaggccagccuggucuacaaagugaguuccaggacagccagggcuguacagagaaacccugucucaaaaaaacaaaaacuaaccccuccacguuaccaccacugacugggccugcacagagagagcuugucuguccuuuugcugaucgagggagcggcucgauauguagaccaggcuagccuggaacucacaaugcuccugugugagcuuccaggugcugggcuuacaggugucagucaccaccaugcucggcugggggcagcuuuuaggacauaacacaaauuugcuuuguauaacuuuggauguuguuucuggucuauccugcuuuugcguuugaaaccagauuucacacacauucuucugccaaccaguucccauauaguuauggugaugagaaauuaccucucacaguuucaaaaugaaaagugaagggcuuugcuuugauuuuuguuuucaguaguacuggggauugaguccagggcccuuuaccugcugggcagcugaccugaggggucucccugagaggccagagaaggcucuagccccugaagugaggauuuuaggaaacaaaaauccaaacaaacugccuaucuccccccacguaccagacacgcagcuucuccaguuuuacaaauggagacaguuuugguucaaacacagcuguggguacuuuugguuuuggacauuuccuggggcauuucuccagagccuguucaauuaucaaacacugcucagguuucacagagaacuugccacugccucugucuuggagaucaaauuggaaucagcugcugcugaaggggguuucuuucucuaaguucugagcagcauucagguaaacagagucacacaaccuccgacugaagcgcagcuaugugaaccaugacacagcucagggcaccaggcacaguguauaagcagcagaacacgcagcucagggcaccaggcacaguguauaagcagcagaacacacagcucagggcaccaggcacaguguauaagcagaagaacacacagcucagggcaccaggcacaguguauaagcagaagaacacacagcucagggcaccaggcacaguguauaagcagcagaacacacagcucagggcaccaggcacaguguauaagcagaacaccacgcagcucagggcaccaggcacaguguauaagcagcagaacacacagcucagggcaccacgcacaauguauaagcagaagaagacacagcucagaggaccaggcacaguguauaagcagaagaacauacaguacgggaaguacuuacuguacaauaaaaaauaaaaauucagcaacaucuucgacauaaaacucaggcaaugcugcaaauaccuuggggacuucugaauucaaaggcaguguuacgcuguagaggagaaaaaccccacaauuuacaaaugcuaucauggaacacugauuaccugggguguuguacuuccaaaugccccauguggaaagagcagcccucacuguguaacacauguguaaaagugcacaggcaaacgacugacccgcagugugcagaaaggaugaggaaggccugggcguguuuuguaaguguuugccucaucuucuuuucuugccagacuuaaggaaguaguuaaaaugggaaagaaacccaaaggucgaauuuggucauuucaagcaacucauacuggguggauaaagccagcauauacuuuauauaagcuuuuccagucuuuuaggaacacaggccaaacuaaccaauaccugugaccuaggggguucacagaacguaagagaccugacuuaaacaacaacagugacugucgguguccucggcucuccgagacuuggugcucaggaggcucaggagccugucaccucuagcacuuugcuuccaauuuauaaacuuccuuuucuagccauccaauguuauagcaaaauuuuaaaacugacagccacuaaaaaacacauggggaaauauuaaucuagcuucauauguauuuaugcauaacuauaaaaauucucaagguuuaguuaugacucaagaacaauagcccgguagccaccgugaagacgaggcacggcaaagagcacacuuacucaggauaugcaggguccaggaugcgcagcaucagcugaaugagaaggccauaaaaauucaggcaucuucuuaggaagcucucgucaaguaagccagcgucagcacaggccuugcaccguaccaguuucuguggaagaggaugggccccggcccgaagauuaguccagugccauggccccugagcaugaguaggcagugaggggccaggagaugagaagucuagguucgguagcucugccuagccucgggacacuggugguugugucagggucuuucuguuuucagaauaaagacaacaggaagauaggccaugcaagccacugagcagagaggccaucagucagugcugaaggucagucacugacaucaucgcucaggaacuuggacaauuagugggaaaaagccagacaaguuguaucugaauuucagcaucaacaguucugugcuacucucaagcaaaauaucugucugcaacaucucagagggccgccugccagaggagacacacagagccacaucucagagggccuccugccagaggagaggcacagaggccacaucucagagggccgccugccagaggagaggcacagaggccacaucucagagggccaccugccagaggagacacacagagccacaucgugcaaguggauguugagcuucuuacagaccccuuagucacaacaauggaauauaagggaggcuacagaucugaaagaagagcuccggucauucugcauccugacguucggguaagacagggucucauucuguagcucaggguggccuuaaaaaccacagccacacucccuucuuggccuggguuaguguugggguuacagguaugagccacuacaccuagcuccauuuuauaucucaaaagcacucugcaguauuagcaaacaaaaacgugaaaauuucgcuugucauggaaaucagagagacacuuuucgcuauaaucccaguaaagagcccgugaacagcuaacacagcuuugccuucugaacacagcacagaagaugcacaugugugucucugcuuuuaccgcagggcuauucagguguagguucuaugggacagaucgucuucauuagacauagugauuaagagcacaggugacggggaucuuucuaccgccacagugcgcuguggcaacugccguggcagccuguaucuggaugcguguccugaacaugaguguggcagggauggaggggggagguuacacugcggucgagaacacuuacuaacgacucaaccggauauacacauguguguucucugcugagauuuaaauaaugagauacggaaauaugcaagguagcaacaaguccugugguaccuugagagaaaagaacaacaaagaaauaacagggacauacgagugcuugcucagggugcauacucuggcaaggggauugcuauuaagaagcugggccauaauuaugucaaucaacuguacaaaccuuaagcugaguuuuacagcgcuucagcauuucacggugucugguggccaguggggaaucuuuccacuggcuuucauuauuuuucaaaucuuccacgguucuaaaauuaacaaaacaaacaucuuaacaaucaaaugaaaugaaaaccaccuagguccaucucagacucucgaaccuaacugucucacagguaaguacuuugcauguuuguaugcauguauguuuguuuguuuguuuguuuggcaaggcagaguuucucuuuauagucauggccgucuugaaacucacuuuguagaccaggcuguccuugaacucaagagauccgccugccugucucccaagugccaguauuaauaucaagcgccaccagcgcccggacucacacuuagguaguuuaaaaacuaaagaauauaggccaggcauugaggugcaugacuccaauccaaacagguggaucucugguuuuuguuaaaguauauuauaauugucuauuuuuuuuauuaguuguuaaucccucaguguacuuaauuuauuaaaucuuauaaguauguauucauaagaagacacagugcaaauaauaagguuuuauagcauucaugguggcgcuugauauuaauacuggcacuugggagacggggcaggcggaucucugaguucaaggacagccuggucuacaaagugaguuucaagacggccaugacuauaaagagaaguggucucacacuucuguuuaacgcuauaauagaagccauagaagaauggggccggaaagauggcucagcuguuaggagcaccacucucuuggagaggaucaggguucccuucugagcacaaacauggcucacaagugucucuaacuccauuggccucuuuuggcuucuaaggguaccaagcacauggugcacaaauauacaugcaggcaaaacacuuguacacauaagcaaaauaaacaaaaacaaaccaacaacaacaacgaaacacucccaaaaccaacccaaaauccuggggcuggaaagcuggcucaaggguuaagaacacuguugcucuugcaaagcacuuuaguaaauuucccagcaccuauauggacacacauucaucuguaauuccaguucaaggccugaugucuccuugugaucuccaugggcacugcacacacauggugcauagacacacaugaaggaaaaccacaaaucuaacaaauugcuucgauaauuuauagucaauaaauaaacuaaauaaugaaaguauaaaaaggaauguacugugacaccaucauaugugaaaaccaaaccuuaaaacaaucugcagccgagcaugguggcgcacgccuuuaaucccagcacucgggaagcagaggcagguggauuucagaguucgaggccagccugguguacaaagugaguuccagaacagccagagcuauacggagaaacccugucucgaaaaaaccaaaaaaccaaaaccaaaccaaaacaaaaaacaaacaaagaaacaaaaacccaaucuacagaguugccaaacaguggcacaggccccugaugccagccagcacucaggaggcagaggcaggcagaucucugugaguucuaucuaggucagccuggucuacagaguuccaggauggccaaagcuacacaagagagcuggccugaaaacaaacaaaagaaucuauggaguccauguuggcauccaugaucugaggaauguauaguuagauauucaauaugacaguuuuucugacagucacccaagaccaaauggaagcggcucagaacagccuguccaucaggcgucugucuccaugugccgagaggguccuuuccucggggaaccugaccauccacagaugcuuggagcacaaacagcaauggugcuaaugauuccaugguugacaggugaggcuacaagccagacuuugggcuccucagacacaaacaacaggccaaaguccaauugcuuguuucucuugauuaucacaggaaaacagaguuugaaaaguccagagcaugccgggcgugguggcgcaugccuuuaaucccagcacucgggaggcagaggcaggaggaugucugaguucaaggccagcuuggucuacaaagugaguuccaggacagccaggauuacacagagaaacccugucuccaaaaaacaaacaaacaaacaaaaacaaaaaacaaaagaaaaagaaaguccagagcaagauggauauacuuaaaggcagauacucuucacagcgguuccugaucauucucacauuaguggaaacagacuuuagcaaccacacacagagaggagcaccaagggcucagagaucaaggccuggaucauugagucaccagaacacuggacaaaugagaggcaucgcaguaguagaggcagacagcacccuguaaugcacacagccuacucucagacauucugaccacaaccaacuccuugugccuguaggcagcaguaacagcaagccaggagagcgagcguggcacauaccuauugagcucgcggauggcucgaagucggcgaauguagcgacgacaacuaggcagaauagagaggugaugagcaugcagggugagaaagaaacauuccguagggaauuuuggcucagaaaauggaggcugaucaccaucuacaaagaaaagcaaacaaacaaacaaacaaacaugaauccuucagugaaaucaguuaugagccuagaauauuucugugugcauuugugugugugugucugucugucugucugucugugaggacaugguauguguauauggugugcauguguguguggacacagugugcaugcgugugcguguauuugugcagacauggcuuugcagacgugaggcuggagcuugugccuuuagauaccucacuuuugagacaggguauaucacugaggacagacaucaugagcucgaggcuagacuggggauaauacaaguucauccugucuccuuucccccaggguuggcgugacagaugcguacacccauaugcagcuuuuaugaggucugaggaagcugagcccaggaacucaugcucgccucacagugcuuuacagacccaguaagccaucuccccaggccaggccauuucauuuuguguuguuuugagacaggaucuucucuaugaaccucuggcuguccuggaacucagagagaucugccugccucugccucugccucugccucucagugcuggaauuaaagcauauacuacuaagcccagccuccaauaacauuuuuuuuaaauuacuaacuuaugcgauuuugcaagagaaauaaauuccucaugcuuuaguuaauguccuauaucgucuuaucugauuaaauguuggcauagaucaaucuuuuauaaugugucuuucugguauacucuauaaaaccgucuucauuuccccaagcugaacauguuacuucaaucugaaauaauuagggcauauuaauaaauuauggccauuuuccuacauguuuguguuuuugaucuucuaggaagaccuauuuacgaagccaucaauguugcaaguagaggcagaaaacuggaaucguggagaggguuccauuauacagugguuuuuaguuaggacauagcugggcucauaggguagaguucacacuucacacuuguguacaacugugguggucggagcgcuuuaucauuuuuuguguuagaacaaauaauuccaugagcgucuaugaaauacaccggagcugccacuacucauggcuauccugccgugcuaaagagcaucaggcuguuucuccugcaugacugcacccuuaaccagcugcacugcugcaagggcaaggucuugcugcuuaggagauaaggcaggagucuaagaacuugaagcuagccuaggcaacacagggaaggaguccucaacucauaagcuacuaagcccugggucacuucgccccgggccacugcugcucuaauaacuguccuccgugugccuccuucaccucugcaacuguauuacaauuccuauucaaguauugccgaauucuacucuaaagugaggaaauaaaucauuaaagggcaucuacuucuuucuuuucuuggucuuggaaggcagggucuugcuguguagcccacgcugaccuugaacucaugauucuuuucucucagucuccuaagugcuggggcuauccguaugcacuaagaaaggcugagcacuaaauaauuacuuuuuagaagguauacauuugaucauugcauuuccauuuucagguuaaguaggaauucauucuauuccacacauaagcaagauuauuguuaucacaccuuaaaauagucauaguuucaacugucaaaauguaacacaaaaucuauauaauauaaaguugcuguuauugggcuggagagauggcucagcaguuaagagcacuggcugcucuccuagagguccugaguucaacuccgagcacccacaugguggcucacaaccaucuguaaugggaucuucuggcacacaguuguacaugcagaucgcacacucauauaugugaaauaaaugaaucuuuuaaaaaguuacuguuauuauuucuuuuuuucacuuucacacccauguauucuacgaagcuguguugaguacuuccaggaugaauuuuuacucugcugauuuuaacuaugucucucucucucucucucucucagagcgacgaggaugagagggccaggcccacaucacucacagagcucugucagccgcucauucacauccuccaucguugcauuuauccgugucucaucauucgggagagugauccgacaucuuggguggaauauguaaguggggucaacuguuucuaacuugauuuuuguacuuagcugcugcaggacccaaaggagauucagcauaaacccgucuguagacaccaaccgaucaucugccugugacauaagacgugaagcaauugaaacaauuguuaggcacacauuuugcaaaucuaugaaagcacauucaaauguaaccaggcccuaaagccagugacaggacacguggcuaccacugucaaucagcuagcaggugccagcccagcaagguucuaccuauccaucaccacagacucacugaccucuguaauaacccacaguccauacacuauaacucacacuucagagaagagucaaugaaucggugucaguaaaacacagcaacuguagcuuccguuuccuuucuuauuucucaagagcaaugagcuguccuuagcccacaugacagcuuucccaucuuacacagugaguacagcccuggcugaaugacagagguucagggaucacgacacacucagaacgauucuaauggucuacauguaaaaggcucacaaauuaguggucacucuuaaacccacuuagcaaaugaagaaacugaggcacagagaaguaacuaucagauguggccaacuuaccgacuacauguggcaaaagccagcuguaaauguggcccaauguaaaacuauagacuuacacagaacaugauggauuuuugcacaugaccucuuugacuguguauucuuggcuguugaguuaugggugacacuaccaugugacaaugucaacagaugacauaccagaauacuaaugaguguccaaagacacugggauuuugcaauucuccauacuuuuauucuuuugcuuccaagaucuuacuaaaaacagucuacaguuuuaacuuucccacuguuaccaugcacacuagaguccucaagacuucuuggugcuucuucaggucugcuuccaaccccacaccuugucauuuuguggcugacacauguuuccuucuguggauucuacuagaguucucaucaguaaaauagacucaagagcauguuaccugcccaugucccccgagucaaaggaacugugugugccgggcuugcaauaaagcuggcucauuucuaaccuaacacacgaucaccaggagggcucuuuucucagccuuguaaggagccgcucuucaguugaagcuuuaauacgaggcuguucugcugccugaucaacagccaccccugugcugccguuccggcauuuuacaaguacgccugaauccuucacacuuccaucagcgacuacuacugccuggaugcugugcuugcauggccacccccugccugagaccucgggcugcacagaagcaggaugcuugcccgucuuguucuguacugccuucccaacccccagaacgcagccugggaggcgcaaagucacaucugcacuggagaaacagguuuaaugaguaacugaaagcacuuggggacuccuaccugcaucugggcuuucuucauguuggcauugacaagggccgccauguagcugagagccgcuucacgaguuucgccauuuaacaaaauacuauguagaaucuugaaaaguucuugcuaaauuauuuucaaaaugaaaaaacaauugauuucuuuuuuacuuuaaaaagagccucccacuccccaucucucuccuuguagggaacccaaguacagucaagaaaagagagagugugugugugugugugugugugagagagagaaagagagagagagagagagagagagagagagagagagagagagagagagagagaacgcacagcagcuugcaacaggaaggauguugagcagucaguguuaauaacccgccuuugccucuuagcucgcaugaccagcguggccucgauuagcaaggcacacggaagacauaguaaaagcuggagagagccuggccaccaggcgugccagcccccagcucaggucugcucugucccucuacaaagucugcuccuucagcauuucgcugcacuuuuucacaaagggaagaaccacuguuuaauuaacugggaaaucacguuuaaaagaaucauguuggacagccuaccuccuagagcacacauaaagcuuccuuacuugcguaugacguucccagagaaguggcauagcuacguuucagucacugggagacaccuugccgggcacaccugagguaacaggcuuguauuuuuuuuuuuuuuuugguuuuuugagacaggguuucucuguguagcccuggcuguccuggaacucacucuguagaccaggcuggucucgaacucagaaauccgccugccucugccucccaagugcugggauuaaaggcacgugccaccacauccggcaacaggcuuguaucuuaucucugcccacugacagcagcaacagcagcagcaacaagugcuaaaagcaucggguuagggucaacacagagcgcucuguuuguaagcugucugauuuguaugacacgaaugaccggcaagcacuggacaugugggacagacccuucuucccuagggaggcccucucuccucucaacaccuacccgucccagcuccagguaaugcuguagugacuggcugaccacgcguguguucuccaggguaauggcaggcccugagaaguauuucucaaccaccuuugccuggaagagaaggggacgcaggcaaucacaaagagcacagugggcacaggaaugagcugccuggcugcgcacugaguacuuacaucguccucugcgaagacugagaagcuaaagaaggccccuaaguaggagagucucugcagcucccgcccagaaccagggcuuaaggacuucggcaaccacagggguaaagaagcgaccuagacacaggacagagggcccagguaagcuucaaaggcagcugacacaggaggagcuuagagagcaacacucagagccacccagcacccggaaacagaaggacgagcaggucggguucccuguaauaguucugaccucagauagaggguacucuccaacuuccguauuuuauaagauauacguuuaaaauuuuaguuauucuuucacaauugugugcaugcaaguguguggucugauguauuccuauugcacuguccuauccugucacugucucccucccacuaagccccuccuucccucagguccccauacucucaugugcugucucuguagccugcugcagcugaguaaggacacugacaggagugugaguaggcaccugugacugcaacaaggucacacugcuauagcacuauuagagcagagggcacacugcugaggaugagucuccucaaaccaguaacucugccgcaggucagcaaccuauucugaugcuacucaaaggcuguucaaugucccacagcaccugcuccucuagaaaagccagcccucgucguagaauacacucuauaauagcagcggaacagaggguagccccgcccacauacaaaugucuuucaagagaagucuuuggcugauacuacuuuaaaacuggccuuugccgguugacagagaucaugugcagacucacccgguggacacuuaccaaauugcacauagggugugucuucccaaacuugguuucacagaguucacccagugccuagaaacaagaagggaaagaaucacugccaugucuucugucucacacugugccaugugugacagcaaggaacagcuuucauucccacugcaaaugcuuggcaaagcucucugugaggccaucagccuuaacaguguuccuacuuauagauagauagauagauagauagacagacagacagacagacagacagacaaacgauugauagauagacagacagaaagacagaugauagauagauagauagagcacaaugcccacacagcaggcgcucacaccucaaucacucgaucgcauacaaagcgcccugugguguccuggugaacagcuuuccaaacacgugcacuuagcuuuuaagacugaguuuucauuuuuaucaauucacaacacaagaucaacugcauaggcugugugugcuaaucccgggcagcaacacccagggcauucucgggaccccagacacuacguaccaaacacugaggcuuuggacgggcucacaggucagggauggagggaacugauuccaaguuuaaguucucauggcccacuguaggauaucacauuaauaccgcagggaaagccggaaacaaucucaacaccaaacaccaggcagcaaaccguccacaacuggggaaaaaaccugaggcuggcugccacacgucaucguugugauuuaucguugcugcuguuaucaucgugggauggggaguguuugcaucugugugaggugucggguguuugugcuugugcauguguguguuuccuucugaauaagacuuuguuauguugcccagguuggcccagaacucucaguucuccugccuuaaccucuuaaauacuggggcugacacaugcacaguagcaccagcacaagaaacaacacccuggaggucacagcauaggacauagcagagucugccaguugucaauccaacaacaacaguuguuucugugcuccaacaguccuccucucuuugcccuauugcccuccuccccucaugcccuccugaugcacccucguuacuguaccagcauaacagcaggccccaaguuaaaucccaccccccacccccacccccacaaaggaugacuguguuccaccaagggcauuuuguggauccugucauuacauuuuugucacugagucacuaagcuaaaccagaugaggagcacagcaguuccaaggcuguguugcagaacagcaagggugaucagcacugacuaaaaggcauccccgcugaggcagcagcagcagauuccacuuccugugcccagccauacaguuuauaacaaacagccccagaaacaugcucaaaguuuuuauuugucuacuuucuugauuuuuuuggagacagaaucucacuauguagcacagacuucucuggacuuucucacuaggaaguccuggaaugaucguccucccucagccucaacugcucaacuauagugcacccggcucaaagugagauuucaggcaggauguugugugcccaguauaaugucacacugugcugggaucaaagacacccugagcuccugauccuccugcucagacugugcagggaucaaggugaacccagacaccuggcuuuuguucuugccuuuguguaaauggacacucuguagcgcaggcuggccaacccaugaccuugacggcucagaucuccaaagcugcugaccgugaacuaccacacucgguucagcuucaccucauucccaacauuauuaugaacuucuccuuguuacugcuaugaaggucuuguuuuuccauuuguuuugagacaggguuucucuguguggcccucacuguccuuggaacuaguucuauagaccaggauggccuugauucagagauccgccagucucugccucccgguugcugggguuaaagguguguaccaccacugcccguuugucuugauuuucuaacaguagcccuucuguuaccuaugugaccaucugccacagauuaacugugaagauguuuugugaugaugcgacuuuuacccugaauuacgaauauccuaaggaaagagagcuugcuuuacaagcgccuaggguacccagggcacauccccaauauuaugagugauccacaaaauggaauuaaacgaaaagaguuaguaaaggaacaaacauagaguuucaauuucuuuauggccucauccuauacaaaguuguaccuguauguaagucauauagugagugaguuccaugguuuuauauuuuuucuauuauaauccuguaacaaaaauaccaaaagacauucaucucucaaaauuucaaagcagcaaaugucagacagaaaagaaccucucacuuguugcuguuugguaagguuuuuuguuuuguuuuccccagauggggccucucuauagagcucuggcuguucuggaacuauguagcccaugauggccucgaacucacagugaucaggugcacccgccucugccugccaagugaugggaugaaagucauggaccacgaugccucuuguauggacagcaguauuuuauaacaguugaguccucggugagaaucuggcuaaagacucuuauuauagucuaugguuguucugagcaccacggggcaccaggcacaucuacuuggaaacaaagaccacggaugagauguguggccucaauggcaggcaggcuacagacacaccgagauuuauguggguuuaguccuccugcuugccaggcaagcacuuuagcuacuaaaucaacuccuuaaccuguauuaacaggcuauuaaaauuuuaaaaaauuacucacuuagugugcgcuuauguguguaugugugugugugugugugugcaugugcacacgcacauguauagacaggcgcacacaugccaaagccccuaucuagaugucaaaguaaaacugcucagcaguugguuagugcccugcaccagguuuuggggcagaaucuccuuuuucuacuauugugcuuugcugcuccaagcuagcuagcccacaauuauccuguaccagccucuuaucuuacccuagcuauccugugacuacagauaguaggcagcacaccugucuuuuaauguugauuccgagaaagcaaacucaggucacaggguuguguggcaaguauuuuaaccugcuggaucaucucucuggcccagucgggcauggcaacacaaagcagucauccuagcauucgggauaaugaugcagguucaugaccacacggccagccugcacaacacaggaagauacuaaaaugaucuguuggggauuuuuuaaagauuuauuuuuauuugugugugccagguauaugccuccugagugcucggcagcaccugugaaggcagaagagggaaauccucuggagccggaguuccaggcuguccugcaaaccacacucgagccaugcggaagagcaucagacacuccugacugcuaagcugucuucccagccccaauccuauguugcgucuccauuuauuauuacuguguguguguguccggggaaagggggaguugaguauguaugugggaucucucucucaucuugacguggguuccaguugucaggccugaacagcaagcaucuaguaacucaagagcaagcuaucucaugaugcuugauguucaaaucccaaguauggcuugcuuguuguucuguaaaccagcaagaugccucugacagucauccuuugugcuggcuccccagaauagcaaggcacauucccacagugccucacucgcugcugucuaggacuggcaguggcggggcauggaaagcugccaauacacuaggguggcucaggacacagucacacaagugucuggccuauagcagggucucagguuuuacaucugaaggugagagugaucuacacuuguaaucucagcacucgagaggagggcgcagggccaugagcuaacgcagacaugagacugugucucaagaaaggaagaaaaaaaugaaaggaaaggaaaggaaaggaaaggaaagggaaaaagaaaaaaaagaaaaagaaagaaaaggaaaaacaagguuaaacacagaucugauaaaaaaaaaggaauaugcuuuuaccaugaggggauuauuuauauaucaauuaaaaaggaaagauugagcuuuuaccaugaggggguacuuaaaguagucgcuuuccaaggagcacucuuuggcagccagcgccaggccuuguaaaauggggauaaagaucuguaagaaagagaaccacaaacguuaggugugagaaagguuagcacgcaggcucugaagaugacuaccagucuguaguccacacacuugcacucuccccugccccaucccccccuccccccaagacacacugguuuuccccauccauaaaaacaacucuacaacucuuugguguggcugguccaccaggacaacuguccaagcagcaccagagcucagcugugcagggaaggacgagcguugagcacuagcagcacucuggcagggcccacggccuguagggcgcagacagggcggcugagagcguggggggaggguccugcugcacaccucagcacucccacuugcccugcccccacaguguugcugauuaacacacacccaugaucugcauggaaaucacacuaaguguuccacuuucuccucgaauccaccaacacuuaagaaauuguuucccucuguugcauucaacugagaacaaggagacagcugaugaauguucaaacugaaaauuuuauuuuuaguaagaaugucuugcuaacacagucaccugaccaggaaauugaaggguagucagacacacaaggcuggcacugauuuggugacaguggccaagcccugcugcucagcacagcucaccuucaaauuuaacagugccuucucacugagccacacaauuaggagugggcuagcaucuaagacuaacaccaucacgaggagaagguacacagcagccggcaacgugaaccacagcuguaaagggcgcguaguauaaaccuacuagaaaccuguaccaaucccucaggccacaaagcucaucccaucccagggaaguuucagcacaggagaaacgggauagaaagauagcgcacaccugcgcagagcacagccagguaucagaacagcgcuggaagagaucauucuggucucuguaacucaaguaaucaggguggaugguauuugugcuuucuuaagcaaucugaaaacacucaacacaggcaagagaugccagaaccgcaaucaagaaggcaaaacuucuacagucacacagauaaacgccauuaacuguccauccaaaaaauauuuaaaauuuacuuuuuuuaguagaguuauccuccuguguaaguaagaguuuaauugauaauaaacaggcaaaauaugaauaagcauaaauuguuaucaucaaggauucuauuuuuaaauuuuaaucuuacuguguucauauaauauguuguauaaguagguaugugugcauaugaaugugagaucagagggcaacuauuaggugucuucccuuucggguucaggaaccacacucaagccgucaggcuuacaaagcaagcauuucugccuagagacagcuugccugccuaggcaccauacuguuguugugaccugcauacuaaacguuacucuuuuauuuccaaguaagagccuccaggggagauagaagcuucaacgcuaaucuccagcccuuacauuaaguugcuauuuacuucuguuuguucauuuggaaacaucacucaaacauuagaggaaguagaaauuccagucaaggacuuagccaggucauaguugccgcaccuguuagguaaaaggcaggacguggucuggggucuccagucccuuuccuucgcauucucuccaaagaaaccucaaacacaggaagacaacagcacucacgccagccagccagcccgagagagcaccagcuuucugugacucagaggccuaucugugcuguuugcugccacugaguucaugccauguccuuuacaaagccaccuaaggucacuuuauuauggucucagcauaaguuuaucaauaaaauaagcacaaaaugucccuucagcuaauuuuugaccugauuuuaaaguuacucuggguucuucauugcuggcuuguacgaaaaaagaaaauccuucuaauuaagggucaccccccccccccaaaggcugccucucuuaacucuccagagacaaugacguuuucccacgcgaauuuccggauucgccuaaagaugagcagcucaggugcucccuuauuguuccuguguccacaagacaccaccaaagaccgaggucaccaacugcagaguagaaccgcuuuacagagaguuuuucuucuugaauccugaauuguucuuucuuccuuccuucucccccugaccccccuagccccccaaugagaugaagucuagccuggaacuuaaccguauaggccaggcugguuucaaacccauagagacuuacuugccucggacuggagagugcugggucaaaggccuggacugugcuuuuacaaacguaagaagccgacggucuuuaaaccaagaguuaugaguguacagacagaaagcaaggcgaaggcgugcugccagccgacaaugcccgcagugagaucuagggccuucuuauuuauuuccuuuuuagcacauguuaccuaugauggguuucaugacggccuuuuuguacacgcacauaaaagcacuuuuaucacccucaccccaucacaugccugcgucuccuucccacuccauucauucucuucuuccucuuaacuucaggccccggucgccucuuccuuccccucccuuccuuucccaccuuaccaguggcuuuaucacucaagaagguaucuaucuuuccagucugcagcccccacuaacuucauggagagguggggcuucaugagucucgccccuaccccaugccguggaguaucuaacagcagaggggcacuuagcuaaaagcuggagcauaccugcuugaacaccucuucauccuggugagugguccucaccagcucuugaaugaagccguacgggagguuccugcagagcauguacggcacgaggaaggauggcuguugcaaggaccugcagaugcaggaagagcaagggcugugaugggagcguguggaaugccauggccgcacaggccgcccgucgucacggaaacacaaaaccuaccaaacacugcuguacaaccauuacuuaggcaaagcaugaccuuccugacaauggugacaucuggccuuuuaaaggagacaucaguggaaacugcaaagacaacaagucuuucuaaaugaagcauuaggggcugggagguacgucacuuguuuagcguacggagagcccuaggccgggauccucagcaauggaagauaaauaauaaaugcauuaaaaaaaucaauuauggguccagagagacagcucagcagugagaauacuggcugagcuggcagaggaccuguuugauucccagcaccccugugguggcucacaacgguuuguaauuccagugccaggagaucucaacucauuuuucugaccucuaagagcacccacaagcacacacaaaggcucauaagugaaucuaauuuuguuaaauuaaaaauaaaaaauccucguuaugucucaucuacauugaagaaaaaaaauagccauaaucucuuucaaauuccuuuucuuuuuuucugugacuugguuuuguggagauuuuauuauuguuugguuugguuugguuugguaagguuccucaauuguuagcagcgacagcagugucacauuuaaucucagcgcucaggaaacagggguagaucucugaguuccaguccagccuggucuacauagccaggauagccagagcuacacagugaaaccuugucucaaaaaauaagcaaacaaacaaacaaaaaaaacaagguuuuucuggguagcccuggcuguccuggaacucccuggacuaggauggcuuugcauucagagaucuaccugccuguaccuuccaaaugcugagaguaaaggcaugugccaauucauccagcuuaguuaguuggauuuuaaagacaagguuuugcuacggagcccacgaaggucaaacuaguagucaaucccgcaucgaucuccccagugcugugagauuacagacaugugguacuauacggccuaauuuucuuccauuuugaaaagauuaaaaaccaugugguuauaguacaggcaauaaccaaaauuaaaaaaaagaaucccauuuuuuuccauuuuuccuuuagcuguuuuuacaugauagacaugaaauauagggcuggagaaaugugaugucagcaguuaagagcacugacggcucuuccaaaggcccuggguucaauucccagcagugacauggcagcaaucguugcuaacuccagcugcgggggguggggggauaaagugcccucuucuggccucuauggccaccaggcaugcauggaauacacaagaauacaagcagaaaaauacacauacucauaaauaaaauuuuguauugucuuauuuuuguuuuucaagacaggguuucuuuggguagcccuggauguccuggaacucgcuguauagaccaagcugaccuugaacucauagagucuaccugccucugccuccuaagugcuaggacuaaaggccuccaccccuggcauaaaugaaugaaugaaugaaugaaugaaugaaugaaauaugcaaucuuuuauuaaccuugagagcuauacaaaacuuucugaaaaagacaaauuauagcaaauuaucccaaauauuuucccuacaacuguacuuugguuuaucuuguuuuuaugagacagggucucaauaugaaacacaggcgggccugcaacuuccuauauaggccagacuggccuugugcugguguugcuccuccugccucugacuccugaaugcuaggacuauagauaaugucccuccucaccuggcccccacccccguuguucucuaguaccuaguaacaaucaauguggaagcacauggaaugucguuauuuugucaaaaacagacaaugaucccaagcacuagauauuaaauuaucgauauuuugccuuggcucuacauauuucaaaguauagagaacucuuaaaaaauaaauagggcuggugagauggcucaguggguaagagcacccgacagcucuuccgaagguccgaaguucaaaucccagcaaccacaugguggcucacaaccauccguaaugagaucugucucccucuucuggagugucugaagauagcuacaguguacuuauauauaauaaaaauaaauaaaucuuaaaauauauauacacacauauauauauaaaauaaauaaauaaauaaauaaauaaauaacuucuuuuuuuaaaauguuccguacuacuuagaaaaugaagaaaacauuuuauuuccaccguuucuacgaggaggaagugcaucuuuacuccuaaauaccucgcuauccuuagguggcuguauguuuaucgcauguuguuccugcauguauguauguuucuguacgacaccacauguguacaguguccaaagaggccagaagagggcaucagaucuacuggaauugggguuacagauacuacgccccaucauguggaugcugggaauugaacccaaguccuuggcaagagcagccagugcccuuaagucugagucaucucuccagcccgagcucugaggacugagagacagucacaauacaggacccagaguucucaccaugguauaaaacaacuggcggcugacaggcacugagcgcuggccuucccuacccacccagaagcacagcaaccgagugucguccgucauaccugggcugugugagggaaccuuguagcacuagugcggugugggagaugcacugcgagcggauguugcucagaagcuggcugacugcuggcuggcugcacaucugagaagagagacaacagucagcauaaagaaccaaaaaggcugggagcagaggcauggcuaugaaauggccugcuucucucacccugugcuccuaauggaccaaguaaggcaggugugcccacuguaccgagguuaaccagagaagacggcagagccacagggcacacccacuccauuuccuuuugggcggaguuauaacacacucugaggcagagucuuuuguacaguagcccagguggaucuccaucuagagcaauccuccugucccaggcucccgggaccacacccagcauuuguuugcuuuugcugagauuacgaacaacaguuucuuuuucuuuuuuuuaaaugugaucucuuuuaaaauuuuuaaagaauuauuucuuuuauguauaugaguauacuguagcugucuucggacacaccagaaaagggcauccgaucucauuacagaugguugugaggcaccaugugggugcugggaauugaacucgggaccucuggaagagcagugggugcucuuaaccgcugaucuaccucucuagcccccaaggacaucaguuucuaacgucagucugguaucagugagaugugaaugaggggauauggaaugagacagcggaaggugccggccgugguggugcacaccuccaucucagcuuccagaugcaaguggaucucuguguucaaggccacccagggcuacacagagagacgaugucucaaaaacagggcuggggcuacuuccuugucuuagcaugguccugcagcuuguacaacugcagcuucaccucugaggaguaucacucacucaugcggcuguggggacucacugggcaacugugaaaauccaagcucauggacuguaacaguugcugcaguccagggaacggaugcucuguaaugucggauguuuguaugguuaucucaggcaccuagcaguaugguuucaauagaaauaugccccuggaggacuucuuauguuauaggcuugguuucuagcugaugggcauuuuuugaggggugaaggggcaccagagcuguggcucuagcuucagcaaugcacugacugaugauacgguaggauuggcagguaaggccucaugaaaggaagcaggucaauuagaguguggcugagcagucuagcuagcucaucccaggacuuccucugcuuuccuuugcuccuuggucaccaugacaacagcaauuuagcuguaccacaccugucuacaaagaugcucaccauaucccagaaacaauggacucauuuggugauggauuuaaggaccugugagcguaauacaccuuucuugcuuugagcuuccuggacauucugugcuagcacuggaaaacugacacaaucagcaauuaucaggaccacggacaucaugggcagacagaggagaggacagacuccagagcccaggcgcgcccacucacagcggagcucuggcauaaggucuacaaggugcugugaguucuccaggacuagauuccguucucacagacaggcccuaagagcugcuccugcgcaggggucagcacaggcauaaauaagcuccgcaguaccuuuggugcuuuuuuuuccucuauuccaacucggucaaaacacucgaugagguaguucagcauguccgucucuuugcagguuucaauggugaaauggucacuguacgaaucccaguuacuugcuccaccagaggcucccaaacuuuggagaagagaaaacagauugacaaugcuuuccucuucaguaccacuccuagagcacagcuuucuagagcacagcuggccacuuugcagcagaaagccgguuagaagccugcacccacggugaagcacaauuuccccaugcagccacacugcagcucauugcugcuuugucugcgcccaggccaaccaaugaugucugggaaacacccuagccugucagggcgaccuggccuugcuggggaugcuaacuuacaaaucggaaggacuagaaacugcugcugagcguugagcaggcuggagucaccacagguucaugagccaaaacgaguggcaccacuugggcagacagugcuauagucucucacguuaggagagaugcuccaagugacuacuaggguaccacucucauccucaagaugucuacacagaccugaagagacuucacagcaucacaacaggccagagaaugccaaguuggaaggaaaaaugaauguguuugcuauugaauuuucagaaauuucagugaacaaggaaaagcaaaucagugaaaaccaaauaaacaaaaaucuugcacaaagaguaagcggacucagggcgugguaccagcuuagcuuguucccugcaacaagaacuuccacuacaccugcagggggcgcuguggagcccugcuacuacuauauaauauauauaauaacuauucccagacaaaggccaagcagcacaauggugagguccaaggauacuggacaaagaagcugagguuaaucuccaacaaaacggauguuccaguaccacacugauuuuuguguuuguacuuaacacaaaaaucacgaagagaugaagacaaaggaagaagcaggaaauucugaaauaaagggggaaaguuaggcaaaaauauccccuauggaagaugacagagaugggagacagcaggacuugacaucucuccuucaaccccacccagacaaagcacaggaacuaagagauccaauuaagaacugagagaacaacaauaggcuacacacucagucagagagacaagcguaacuacauuuggaaaaugugcgcuuaacuccccuuggcauuuggggaaacacauacagcagacgugagaauggaagugggguguggaggugacucagugcacaagaaaccaugcugcaaaaucaaggcugucccccagggacuaacaaacccgaauuacuguaaucuaacuccaguguguuaacauuuuuaaaaggaaagaaugaggcugaggggaagucuagggacggggcaggccuccgggcugcagagcaccuagccagaccuaggacaacagcagacgcgguggccuggagacgcugaagcagaguacguucauccucacagcggcaaggaguguucaggugugccuuacucacuaagccacacucuggaaggucccaacuggcuggacagcagaagcaggaacagugugaagcgcaggagacaggcacccaacaguggauucaaaccuaccacaagcgugcugauagagcaagcccugggaaguucacggggaaagccugccugacccacagcagccugaguuuuaccugggacucccugauuauguucacugcacaauccaaaggcuuugcuaauauagcccugcuccuauguguaauucagucauuguccuuguagcagcucucacauaagucagugaaaacauaacuuggugguuaaaaugaaaauuuuaaacuauuuccugauaagcacacauucaaacacuuucugaaguuuaaaaaaaaauuaaaaaguuaacauuugaugccaggagauccuugccagcugcacggagugugacauggcacccagaugagcacgugacuugugccugaggguaugaagcaccuguggcgugggcucaggcagcuguggcucgaguuacaaacagcucucagcaauacacuccacugaacaaccacgacacugcaaguguuccccuagaacgugaaguggcaggugaccggugcaccggcuuacaccugugaucucugcacucgggcagacgggcagaugccuaagaugaccaaguauguagaagucuauccauccucugcgagaccugaggaaauaucaaggaauuuucaaagcuaagagaugauucaugaaucagacagcaagcaauuagcggauuuacaucagaagggggauaaaggugagaugaaccuuuaacccaacacagacagagagagaaaauacuagcucuaucaguacucaaaguacccaaggaaaccaugaucccagucucaucaacgccaagucaacagucagaggucaaaaugacggcaaagauacucagcacagacucucagcacauuaaccucgucaggagcacagccgaggggacgucagcggcagugggauggucccgcugcucagcaggugaggaggcugaggaaggauaaccaccaguacugacgacacagcagguccccagccuccacacucaugauccuugcacagcucugacauccuaagauccuagaaacguuucauauuuaagucccaagaagggacagguuaaaaacuuacaccagcauuuucuaauaacgacaucagcagucugagucagucagcacugugaggugcuaaucagguaacuaccuccuagaacaggaguguaacagaauaucccaaacaaugaaaauauucucaaaaauaacacacaucucauguccaggcagaccaaauuacauuucaaauguaccaauaacaaucaccugcgucuuacaggauccuguguguuuccuucucuaaugggaauacucacauuuccauuuaccuggaguguucuuucuacuccagcgcacgcgugccuaugagugugcgugugagugugcgugcgugucugugugugcucaccacugaaugcuguacccucgggagcucacugaaugcacuggacauccuucugccugcguuuccucgccagcacucaaaccacacccaugugccacacugccgcaccaaguuuguucuaagcacaucuaugggacaaacccagguucccaggcgugcaccccgacucagccaucucucaagccucccauuuaccaagcucuuauguauagaccuugaaauucuguauuuucucaagcuaaggcccagaguuaaucaaguucacaccagccgauucacucuacaaaugugcacacgggaccacugugugcaccguucauaguccagggacucuacaaugaaugacacagaugaaggcugucagugaauaaaggcagagacuggguguggcgcagcacugggaaguugcacgaguaggcacgggacuguuucgucccuaggucgcuacagucagacguuagccccugaggagaugacacuggagcccaagccuugaggaaaguaaguggcaaacugcacagcucucugcaacaagagaggauaggaguccucagggcgguaagacaagauaagccuucccuuacagccuuauggacucuucccugagacaauucuuaccccccuaccccccucccccgcgcuguuuuaaaaaaaaauuacauuuauucauuuaauguguauuucugugugcacauuuguguacgagugugagagcauguguaugcaugugcaagcguaguaugugcucgcaacugcugagccacucccagccaccaagucuuuaguuuuaagucuagauucugcauaugagggagaaaguguuauuugucuuucugggccuggcuuacuuaauaaaaugaucuguagguauuaaaguccuuccacaacaugaacucugacgaccuucaaacaaggagugucuucaaggcugucagcauacaagcccuuuccugagaggcagcacuauuuuuccaaggugauuuauuucuuaccucugaaagacugcucugugggacugcuuuuuagcuuucuuucuuaacaugaucauucuauuauacagaaaaaugacucauuuuccugcaucccacgacuucacuuaaagugcuaguaaacuuugcagcuuucugguuggguuaacauagaucacagagauggagagaugguuaaagguauugguugcucucccagaagaccagguuugguucccagcacccacauggcugcucacaaccaucucuaacuccaguuccaaccuauucuggccuccaaaagcaccuacaugcuucuaagugcacacacacacacacccacacacacacacacacacagaggcacagacacaugaaauaauacaguuuuaaauagcuacagaaucaggcugaggaaacggcucagagauaaaguacaccagcugcucuuccagagaccuaaguucaauucccagcacugucguguuagcaacuauuaacaauugucuguaaaucuaguccccaaccagccaccaaugugauacagacacacaaacgcagacaagacaacccuacacauagaauaaauaaaagaaaucuuaacaaagaggaggaggaggagaaagcuauagaacgacaucuccuguacauagagauaaucugacuucagggaacgugguggccacgccuuuaaucccagcauugagcaggcagaggcagguggaucucugaguucaagaccagccuggucuacagaaggaguuccaggaaacccugucucaaaaaacaaaacaaaagaaaaucugacuucuuucuuauucacagccuguuuguuucucuguuacugcucugauugcucuggcuaacaaucccaauaccaagucacaggacauccucagcuacauaaauuuaucccacagauaaaucaaaacaugcucccacagacgucugcugugugcaauggagucacaugggauucuacaagcaggaaaaaagauuccacucaaaaagaaacaaguucuuuugcuaccucuugcuguccugaccuccauguauccucaaacucucgauuuguuuaguguuauauccugcaaccaucuucauacacuuuaucuggagucuacucguaaucuccaauagacaggccagauaucucauuucaguguagccaaagaagcuggagccaacugaugaaaauguaaccuuguaacugagccuaaaaacgcuggcccuucuguccaagaacagaagccacacaaagaaccugagcagcagagaugaaacucaaagaccacagccguccucccgcugcuccaguccaagucccaucacagagagcacacaggcgaugcuggacaagcaccgauccacagucacaccgcagccaguggauaagcacagagccuggagcucgggcacggcuggacacagggaaucuacaaagggacgugucaguaaaagcaggacgcgaucugcuaaagaacuaaccaaaacauuucgcccacagacagcucaaaccaaaccaaaugaagcauuuuaccacguauggaagccacuccuagggaugucugcugugugagcugucaucacacagacguuacaggcacaagacacacacaguggccuuugguaauaucugcuugggaaaagguaauaaaaaauucaaccuaauauaagcaucucucuuuuggggucaccucgcaucaacauucuucucucucuucaggagcugccaaaccuaaugacgcgcgcccagcuccugcugcagucucuacuucuagccuggaguuauuuguacugggcacaaacacaaacuggguggguccagagggaaauucaguugaagauguagaaacaaagggucauuaaauuugugugccccaaaucaucuagaaaugcaguuucuaacccaguuuucagagugggggagagcauugaguggccccagaaacaaaaggccacugcucaauugagacucaagagaugcucagggagacucaaggucauauguaaaaagagaaucccaguuacacuggacugcgugauguggaagaaauggccacacacccccaaaccacagugcuagucuucagcuccuacaaucuacacaagcauacucaggaacgcacuggcaaugagcaguggaggccccucaucuccuccuagcagggggcaggggagcuuaagacugaauggcaguucagcgcucucuccaggcacgugacagaugacgcagauaugcugaauuaccaguuuaacgaaucgucuaugugucacuucuucccaggguaagguccucucacuucagugcacacuugcuagucuuccucacuuaacacuacccugucuggacucaaagcagagagcucucagcagugcucacuaacguuagucccuaagcaccugaagcacaugcaggggcaagacuccauucugccgguaccuggacccaaacuggacauaagaaaaaucaucaucaccaccaccuucauccaacuccuccucaucuucuucuucaucaucaucacuacuguccccagaaaguucgaggaagaggaaggagaaagggcuguuggacauacuaccacaacaaaagcaaaaaaggucaucagggacagaggauagagggaacaggaggaagcugcugcugcaggcugucauuuaaaguaaaugucacacucggaagcuguacgcacugacaugcagaaacacaacguccugaguuacagaaacacccagggacauuugaaaaaggaggccaccagauuccugggcugcggcugcugcuuucugagagacuggaacuacaugcaaucagacgucaagacagaaacgcaggacucauagaaagagcagacaccggcccaguccaaaaaggcauccugugagccccauuucucaaaacacugaccagagucuccgaggacuagaucacagaagaagguggagugcuugguuuuugugugcagaugacaggaggaaugacaggggaggaagggcgucuucacuuccucguggacaaaaggcugccagaaucauggaggcaggcgcaugccuaccacagcuugcgagcgauacagguuaauaacccagcgacucccagaauucaacugaggucagugucacacagcaguucuuuccaaaccguguuaauuuccucucccugcacugcaaacacacacgcagcucuccugcaaauaaauaccuaggagagauccgcagggaggagggacgucugcuggcggcacugggcgaggcaggugggaaggcggggacccugcugcggggccucugucuggaggagcuggcagguacagcccggggacuacuugcgugggaagggaagccuggggagcuagccagaauggaggaucgugggguggggcaaggugaagacccccaagggugcgugacaguauagggccgauaccucggggaugagggcuggcuuccggcagcauuuccagaagcuguacuaugagggcugagggguggggaaggcacagccgccugcggggcuacaccaugggugcugagggacugggaaggcacagccaccugcggggcuacaccaugggugcugagggacugggaaggcacagccgccugcggggcuacaccaugggugcugagggacugggaaggcacagcugccugcggggcuacaccaugggugcugagggacugggaaggcacagccaccuguggggcuacaccaugggggcugagggacugggaaggcacagccgccugcggggcuacaccaugggggcugagggacugggaaggcacagccgccuguggggcuacaccaugggggcuaagggacugggaaggcauagccgccuguggggcugggugggaagguaaggcaaaggaugggcugagcgcuggcacaaaacuccauaaacuggcagagggggcggggcucguuucauagaggcugaguuaguugagagaccgagggaagggaaaaaaaaaucaaagaaaaacuugagauaacuaaaaugggugucaguuuuuaaaggauagcacauuuauacuacacacucuaggaauuuaaguagauaagcauuugaaaaaugaccagccucuauaaucacuacacucaugucggugaccccuuucaaagaguaccguagcacagacagccacgugugucuaaaauuuaaccaacaaccuaaccacagaaugcuaagaaauccaaccaaggaaugguaaagccacauccaauggccacauccccuucccccucucuccucccacaugucugagacacagaucagcccugugaacccgaacucaacagucacagcuguuuuccaccagugagacagcagagaaccacacugaccuagacaacgagcuggugcugaaggagcccauguugcagaacauggggcuuguuccugaacuggagccaguguucagcaugagauugcggucuggugaccgagcugccguggcgaugggcugggauguggcugucagacuggcaaauggauuuucaucucgugucugaguugacaucaucaguacuuccauuaaaaucuggccaaucagauccuuaaaaucagagaacacuguugggaaggcagagugaaaagcagguuauucauagguccucacuuauaccauccuaauaagccaaagagccaggccgauucugauucugugugcugggauccuggauuggauucucaagagugaaaggauuuuagcugaaacccaaaaaagcucuggugugguucccaguaauuuuuuuucuaaaaauuauuuuauauuuauuugcaucuguguguguaugugcacagugccaugcagaagaagacaacuuucaagagacccuuccauccacccacauggguucuuggggauggcacucaggccaacaggccgaggagccaucgaacuggcucagugcacaguccuguccgagucugggcacacacagucuacuguacagacugcuacaugagaggacacugagggaagcguaugcaugagcucucgggacggccuccaaucauuuucuauaaauauaaaacuaucccaaaauuaaaucuuauugaaaucaaguuagagugcagucagggagcuacuguugauaaauguuaacuguagaaggagccagucgcuaccagaucugcccuuacuacauacauacaccguaacacaugcagcugagcuaguguuucucagccagcacacacuuuacagaguccaaggcuccuaagggccucugaaaggcuccagacugagccacccucuggauucuaaagcagauucuacagucuagcuccuuucucauucuuugcagauccuaguugaucacuguugaucuauggacacauucuggauaucacugaaccaaagcccuguucuguggcaguuucaucugguuagauaauguguuagucaggguuccuguuccuacacaaacaucaugacaagaagcaaguuggggaggaaaggguuuauucagcuuacacuuccauacugcuguucaucaccaaggaagucaggacuggaacucaagcaggucaggaagcaggaacugaugcagaggccauggagggauguuacuuacuggcuugcuuccccuggcuugcucagcuugcuuucuuauagaacccaggacuaucagcccagggauggcaccacccacaaugggcugggcccucuccccacuugaucacuaauugagaaaaugccuuacagcuggcucucauggaggcauuuccucaagggaggcuucauucucugugacaacuccugcuugugucaaguugacacaaacugauguguacaaggcguuaugagaugugagauccuuagagcugacagccagaguauccaguggcaagucuuuaaaaccuaaggcugcucagcucuucacaacuacaaguacuaagaggcgaccccaucagaaaccgacccaccuuccaggaacacagaaauuucacucccucgcagaagacaggccaaguaaaagguaacaguaacccacgcuaacagcgacugcuuccgugaaaacccaucuuauacaaaacagggauauacacccaugagcagagagucacggcaacugcauuacaugccaguguaaaucaaagcacaaagccugcagcacacugacuggcccugcugcaagcaauuaaagccacagugcucaauaaagcugucuuacaaagcaugugauuauuuuaaguacaggucagcacagcugaccucuuaaaacagaacccuaggacaacaaaauauaaucauauucuaguuugcuaaguaauuugauaaaaagaucucacucgacugucuacaaaucgccugguaagcauucagauccuagaagaugaaugacaugcagaaagaagcucgcugcacuacagaugcaagcggguagcugagucuuggggcccacucagcacgcuucuacccuacaggagcugaugucuucucaaagagucuucuaccauaaaggaaaacuuccugccccagacagggaaaaccauucacuuauuuaguuuucuucuguaaaaucacacaucagggcuggagagauggcucagcaguuagaaaagcuugcugcucuuccacagaaccccaccucgguccucagcgcccacacugggugccucacagcccuguguaacuccaacuccagggagggaucuaacgcucucuucuagcuuccagagguaccugagcauagauauaugcaccauacacacagcacacacacauacauaaaaacaaauuuuaaaaaucacuuagcaauacucucagggaagaaagugaccacacagcuguguccccaccccguaacaggaacugcagucccacagcaagaggacagagacccucauggccugacaucccguauggaguugcucugacaaagagucccaccuucuuuuggguucuguuuaaacugcgcagagagagaagaaaggaagaugacaucucugucgcgguccuuccaggagacacggaagaucuuacagaccagcuguaaggcuugcucuucagacaccucaggaccugaagaaggcuccuaguggggaggaugugagaguuaaucuguaguagaagacaugcauuaagacauuuuguucugaucugauucauuuauuaacaaggauauuuuuaaaugcauaaaaccaucuagccaggcaggugacacagggaacgcaaggccagccuggucuacacaacccaagucucaagccaugcagaguuacauguaagauuuuguggacaggggaaguagcugcaaaaucagugucccaugaagcucauguccucauucauaaaaguuuggccagaaaagcagaggcgugagcgugcugccacccucgcuacuaacugugcugugcuauacggaacucucaagcgccagguucauguuguugguauauaaccauuuucucucaaggauauuuuacaaacguuaacaugucucacugauuacaugucaaauacauuaucacauaaaagaaacaugaagaacuccaugaauagagacaaccuggaggcuaagguccaacuucuguuuuguuuuuguuuuuugaacaggguuucucuguguaacccugacuguccuggaacucucucuguagaccacgcuggccuaaaacucagaaauccgccugccucugccucccaagugcugggauuaaaggcgugcgccacccaaacccaagccaccugagguuagggaacaaagcucaaaugaaaauaaacagaaaggccucccugaguuuuuacuugcugccacaaaauuaaguuuuacuuaugaaagcgcggacccagccagucauggcagccugucuuuaauacccacacacguugaacaggcacacacaucagggagcagccuggucuagauaggaaggaguuccgggcuacccaggaggauuucuaccucaaaaaaacccaacccaccugaccgaccucaaaaacaugcagccaagccaagcagaauggagggguuucacuguacaaaagggcccaguucugcugcugcugcugcugcugcugcugcugcugcugcugcuaagcagacuaaaguuggacugugggaucuucaguuccagcaccugaagcugacacggguggacugccaguuccaagccagcucagacugaggagugagaacuuuccggggcaaggcugagacuaagcauucuucaaaaggacaagccuagcuacagacagacagacagacagacgcucuggcuagggcaggcuagccaagcgagcacugagaaacggagcgcccuuugccaucacugaccuugucacucaggcuccguuuuucucuucggucguucucguccaccuccauauucucaauucccgaauccacauccaccugggacaugcuuuaaguacagaagacaaacaugucguucaucuuuucuaaaacucccagcaucaaggcucacuggucaggaaagcacaguaacacuggcucccccacccccuucuuccuguaagucuagcagcuccucccaaacuggcagcacauaagcguccuguucaucuuacgugcugcagucguuuuucccaagguaucauuuccuugggcucacuuucaaaaacgaagaaaucagcagaauggauuuucaggacaagcuauuuuuacacagugcagaacacaagugucuuuacagcacugacuguccggcacaugcauucagacgaccccccaugaugacacuugacgagaacacuauuccgccaugucucauuuuaaagaucugugggauuugcggcagucacuucuguccccagcagucaccuugucuccagcugacuugcuuuucuggcuugacauacaagucagaacgcacagcccuuacauuucugacucugguggcuuucggccuguagaguauguaaaguccuauacuuucauuagaucaagguugcuggcugcauugcuuaaucugucugcuuagucaccuucuuccucuccuugauguauuucuggccgaaagagacaugucugaaucccucuaggaugguuuuagguauggcaauuugcugccuagcgcucugucagccuucgcuuguaugauacgcugaugguagauuacuaaguguguacauauuuggaacagguauagcuacugauaaacucaacaucauccuagaauccuucuaaccacuggaauuggguuagaagagaauaguaguccgugggcucccuucacucaguucacucacucaucaauacuaugaaaccggaaguuucauaaacaacucaguugugaagugcaugcugcugagcggcagggugaaguccuguaacccugcuccacucugccaggugggaguccucccucugccugguugaucugcacgguacaugcuaucugcucauuggucauuugguagcuugguuaccaaacuacuugacuucaaguaucucuaacuuuacucaacaguggccccuaaguccaagaguggugacacugaggaagcacuaaggccuaacauaaggaaggagcuauuucugguacuacaugguagggcuccaggaugagacacuguuguuguuguuguuguuuucaauaauaaagaauuaggccaggcagugguggcgcacgccuuuaaucccagcacuugggaggcagaggcaggcagauuucugagcucgaggccagccuggucuacagagugaguucuaggacagucagggcuacacagagaaacccugucucaaaaaaaauaaaaacaaacaaacaaacaaacaaaaaagaaucuugaggguacuugcuguaaucauacccuuuauggcuucucuacuauggaccgcuguucagcaucucaacgcaaucggagguuuguggcuucugucagagcucacuacuguuccacacacuggcauuaucugccauuuauacagggagauuuauucagauguaucucguguucauuaugaggccauauauuuuuuuuuauucacucauaccuuacaucucauaaaagacauuuggaauuagagcucaaguccuauggaaagacagaacuuguaacugcugagccaccucucuagcucauaagaugcuuggcacuaacaaauauaaaaacaacguuucauuuagaacagaaacaccucaacuuaagaaugaaguuuguauuuaguuugauaggaaaauggcucucuggguuaccacuucagacagcuggcuagagacuagagaguggagacuucccuuccuauagacagggagcaccaaguuaccuuuucucacaggagacaccgucaauauccaugcucugggaacgggagagggacugagacugugucucaaggcuguuggaaggugagcugcugagagaacugacgccuucgcugcucuggcuccgaugggcaacuccuacacaggcaaggcaaaaagagagaaaggacaggugacacaaugcaagcccaagagugaaggcagagguuaacacaggugcccuuggaaagcuugaccgugaggauccugucagacaaaccaggacuguuacaaagaggucacgauuuaucacugugcaucaccuaaggucagcacucgagcugcacgugaugccugagaaaacucaccgccucuccuucagcagguccaacuggagccugaagccaggucuuugcuacuuuguggggcuuuccccccacccuuuaucucccugggguuucaccccaucacuagauaggagcgaaggggggggggagagagagagagagagagagagaaagggagaucccugaauccaauuuuuuuuguuuugucuaguaauaaaccgcacuaaaccucuuccccccacccccaaauaccaacccccaaagcuaccgcucaggagcccucacauuuauauaccccgucaaguucccagaauuccaaacaucauacaauuacagaaacuauccacagcuggcaaaaccaugccucugcuagagcacagggcaaaucauagucagcugcugcagacagccugaagcaauccauaccugagauucaaaugaaagcacacucuuuuauuucuguguuuuuuaaagaaaccacaaucccagaacuguuacuacagugcccaugaacaaauuagguuuugugacaguauagaaaguucuuguuuucuacgaugucaugaggguugguggcugaugucuuuacccauuacguuagcuauuucagcgacccaacaggacagaaaaacucuugaaauggacugaaaacgagauacacuaauggacugacagacaugaaaaacaaacaaacaaaacaacaacaacaacaaaccaacaacccaguaacagguguugauggcagaauccagaugguguggauguagguguuuguggacagucuuuccacuuugcuacaaaacugaacucagauaugcugagagacacagccuggcuucacugccccaucuaucuccuuguguacagaucaugguucuguugauggaauguguuugaaggaagaaaaagcugaccccaccauugucccuacagagcuuaugguggcaugaaaaccagcaucaggaggaggaacagauuauuucucagagagcuuugcucaaugccuuuaaaguuauguuuguuacagaacuuuaaaaaucaccuuagccaggugugaggcauaggcacccaggucucuaaguuugaggcuagccuggucuacgaagagaaauucuguuucaaaauaaauaaacaaccaaaaaaaaaaaucaaaggaugcaaaaagguugcuaggcaagcauuuacaguauuuauuuaucuuuguucauaaaaaggaaagugaacugagaugcuuaaaaauaaaugaauuaccacuaccugcugagauaacuaguaacugguaaauuuaaccguccuggcaucaugagaaagaaagccugccugucuccacacuaggauaucacaaaagcauacucacuccuccaccaucuucaaacucauaccaauuuguuaaaacuaguaaaggacucacaaaaggaaacugcaagcuagucacuauuccuaccaagacucaaaacagauagggcaucucacgccaucagaguucugaaauaagacuuaaaacucauucacucaagggcgagggagauggcucagugguuaaaagcacugacugcucuuccagauaguccugaguucaauucccagcaaccacaugguggcucacaaccaucuauaaugggaucugaugcccucuucuggucuauccaaagacagcgacaguguacccauauacauaaaauaaauccuuuaaaaaaaaaaaaagccaaaacaaaacaacucauucauucaagauauaaacaaaaaauaaguaaaaaauaaugcaggauuauuuuaucaaucacagaaaaggcuacuucauacugagacugauaacaaggaacuuaacuacauacuuuacuuuuuuuuuuaaccucaugggcugaguuguugucucuguugguaaacagaaagaccugaccccaugugaaagccaccuucaaugcuagccugggaaggcagaaggcagggagaugccuguggccagucuagcuaaaauggccagcucuaaguuaagcaagagacacugucucuaaaacaugagguggacagagacuuagaagacauuugguguucauucuggccuugacuguggugcccgcaugcacgcuaaacauaggaacuuuauuuaagacagagugcuuguacuaguuuuacgugucaacuugacacaagcuggaguuaucacagagaaggagccucccuugaggaggaaaugccuccaugagauucagcuguaaggcauuuuuucaacuaguggauggugccaucccugggcugguagucuuggauucuauaaaagagcaagcugagcaagccaggggaagcaagccaguaaguaacaucccuccauggccucugcaucagcuccugcuuccugaccugcuugaguucuauuccugacuuccuuuggugaugaacagcaguauggaaguguaagccgaauaaacccuuuccuccccaacuugcuucuuggucaugauguuuugugcagaaauacaaacccugacuaagacuauuuaauauacaauacauaccacagcagggaugaagugccggggcacacuguaagaaagacagcauuugaauccucuugguccugugcuucaaacaucuucacaucccaguucccccacagucacaugcgcccacugcuucccaucucuacacaucacaaugaucuaccugcuuuguaaaucuaccaagcucaguggccccuagcuuuacuuagacuguaaguuaucaagacaaaaacccaccaaaagcaacagcccauggcaucccucucuucugaaaccacuguuaucagucuuucccacuuccugcuggagaaaucacaguggaugaaguaagccucaaggauuaauguuuuguuccaucccccaucuuccuaaggcgagagauauuuaaaaaguuaaagccuuguuggguguggugaugcacgccuuuaauucuagggagguguaggcaggcagaucucuaauuuugaaaacagccuggucuacagagugagcucuaggacagccagcaaguuguacacugaaaagcccuaucacaaaaaucaaauuaaaaaaaaaguaauuuaggacuggagagauggcucagcgguuaagagcacugacugcucuuccagagguccugaguucaauucccagcaaccacaugguggcucauaaucaccuacaaugagaucuaguugcccucuucuggcauuuaggcauacacacaggcagaacacuguauacauaaugaaaugaaucucucucuuuuuuuaaagauuuauuauucauuuugugugaguacacuguugcucucuucagacacaccagaagaagguaucagaucccauuacagaugguugugaguccccaugugguuacugggaauugaacucaggaccucuggaagagcagacagugcucuuaacugcugaaccaucucuccggcccaugagaugaaucuuaaaaaauuaaaagaaaaaaagaaaaaaaauuagaaguaggggaggggcuggagagauggcucaguaguuaagagcucuuccagagguccagggaucaauucucagaagucacagggcagcucauaaccuucuucaacuccaguuccaggggauucaaugcccucuucuggccuccagagguaccagccaugugguacacagacauguaugcaaauaaaacacucauacacaauaaaauauuuuuauaaaugaaaauaggagaggugggcggaucauaaagaucucauccagucauccauucacucccgucuauagauaaaaaucaaaaucucugaagccauggaugguacugucugcuguaauccuagcacucaggaggcagaggcaagaguguugaguuugagacacuuagcaagacccuuaagaaucuaaaagaaaggaaggggcugagaggauggcucagaggcaagcacuuggugaguucaaacucccagugucuguacuuuaagaagaaagaguugggcaugaugcucaugcguguucucauggauggaaagacggacucucagacagguggacaucugcaagcuggcuucugcuccacaaauuucuaggucagugggaguacaucucaaaacaaaaaggaagaagguugcuaaggcaugacuucugaggcagcccucuuaccaccugacacauguaccacacacacacacacacaaacgcacagaggaaugcacacacugcauacacaacauggacacacaagugcacacacacaauacacacauucgagcucuaaugcacacacgaguacacacgcacauguauguacauacacacaaauucuaaauuuaugauguggcaucaggcaggcaacucuaugaaugcugugauuuguccuuuaaguuuagugucucuguuuaucugcucaguaaugggacuaagggagaagguucucuagccccucuaguucuguuaaaguuaaaacugucaucugguguucgugaacgugcauaucuguggacucaugcacgggugugugcacacauaaaggaaacacguuuuccaggaacuccucccguguucggcauugcuccucugcccucacagaauuuaccuuugaggcagguacagggacgacagcagugcugugcagagccggccucaggucaggcugggaaggcuuugagcagaggagauggcaggacaaugggaccacuggugcagacacaccaucacuaacaagacacugacaccugcuccaaauucacaaggggacgaauguggccuaggaacaaaugugcaagcaaaaaggaagguuccaaccaagagaaaccuucaggguguuuggggcucccuugcagcagcuccacagcagcuucugccugggucucugucucuagccaguaucugacuuugugauuucauuuucucagacagaccucacuacgaagccuacauuggccacaaacuuguggaaauccuccugccucugccucucaagcccugggcuuacaggcauaagacaguagugcccagcuguauguuucucuuugcuuauuuguuuuggcuguuucuauuucauuggauggagcccaaggucuccugaaugcuaacaagcucuuccacuaauugcaugcccagcugcaaagccaguuucuaaaccacacacaaaacuuucccucucccaagcccgugccaaguguaagaggaaaaaggacuuuaguauaagcaacugguaauagaacaaaagauuacaacucggccaaagucccugguaccauucuuaggcaaaggcagugugcugauaagagugcccuucccuuagcugaaguccccgaaaugcacaacuaacguguuaaagacuucauugaagacucaaaauuagaggacauggguuggacuuuccugcucuuucaucaaacaccaaggcuacuucugcacuaaaggccucugccucugccuuuccugcgcacagccuugcuugcccacaccauucuggacccugcugaccccaucuaucacugaggcucaugguugucgcuagagcagacgaauucccuccugcucucccugaguacuuuaucccaacacccaauaaacuguaagcacugagcuaagagcuggcaugguugaaauacacacuaaguggggcugcacgacuguucagcauuuagcaugucacugugacaaccuagagacauuagcagguucagggaagugagaguaacaccuguaaccaacagacagggaucaucccguuugccaagcaguaaugcugggguguuguuguuguuguuguuguuguuguuguuguuguuguuuuaagguagcuuuguggccuuuuagcucagcaauggaaaggcagaggcagguuauaugaauuugacgccaucccugucuacauagagcuucaggccauccagggagaacacacugagaaccugucuuuaaaaacaaaacaaaaacaugauagcugggcauauaugugucuguguauauguguguguguauguguguguuugugagagagagaguguguauguuuggggggugaggggaaucaagccaggguuugcaaaggcuaggcaagugcucuucacuuaacuacaucucuagcccaaggcagaguugaaaacacucaguccugaccuggccccugaggacugacacccacacaugugcacacagcagucagcugcagugagagcacagcaaaugcgcaccaccuuuuaagagaaggaaaagcaguguccgucacugucggucucccgugagaaacccaaauccacgagaggccacgaggccaugaggaacgauccuaccacauucacagcguaacaaaacccacuaacagucucgcaaguccacggccuugcugaaaggccagugcaaccucucugugaggacagcugccuagcaacccaggcaaccuugcaccaaggccuccccuguuacugaucuuuguggccagugauaauucaaaacaacuuacauaagcucccccccccccccuuuaccugggcagcugccuaccuuccugucuccacacaugaccgaccaugauccccuaaguacucaugugccuacacaaggcccgauccccugcaauacacaaguuccuauacucuggucauuuccaaaugaacucacuuccuuagaggucucucucuccacuguuagcuuuaaaggaggagcugagugaaagcguuaagcagcuucugggaaugguguaugaggugggacuuugaggaccauggugcugagggagaagugggacaucaugggcuccacagagguccacgggcaucagcuaugucucugugcccaucccaaguauuuuguccuuuuuuuuuaauuuuagaaggaaaugaaugguucagggaugauaaaacucucuucaggaggaacgacaaggcagacuugcugguuucagggggaggaguaaucuucaugaacuucaauuuguaguuugaaucuaacacuugugacaaaaaccauugcucuccucuguccagcaugagucucgggacaaggggauaaacugcaugucaaggagcugagacagcacagugguucucuccacuguuggguuuaggagaggggugaagagggugugugagggugacguuuuuucucuuuccaugggaguucccaggacugaacucaggucaucgggcauagagacaagcgcuuuuaucagcugagccaucuugccagccccauagcuuuuuuucuuuauuuuauacuuauuugagacaggguugcccuggaacucacuacacagaccugacuggccuugaauucacagagcuagccaccacugccuuccaagugcugguguuaaaggugugugccaucacacccagcaacucuucacuuuuaaaaugacaauugucauaauuucuugaaacaccuuuaaguuacacaagccugugcuguucuggucauuuucucuuuggggcucauucacuaguucaccccaucuuugagcuaaugccaggcauggcaggcacacgagugaacacaacaaacacuaacuccugagccagaccuagaguuuccacuccaucagggaaggcagacuaaacagggcacacaagcacucagguguacaaggaacacaaugcuggaaagagccaagaggcauggcacuuuguuauguaugcuagacaguggccaaagacagcuuuucugagaaagggaugcuaaaaauauuuuguuagccugguuuggguucuauuucuuccuuuuaaaaaucaucuucauaucuuuauuuauuuauggaugggggaagccuacuacaccuacgcaugcuccccccaccccauguguguaggggggcaggucaaggggcaccuuacagagguugcuucuuuccugccacucugggucaggggacuaaguuuaggucaucaggcuugccagugcgugucucugcuugcuaagccaucccaccgcccugaucuugcuuuucuaaggcaggguuuguuuggauuuuuuuuugggggggggggcucauacaccacagcaugucucugccuuccaaaugcuggcauuaaaggugugugccaucauauccggcaacucuucacuuucaaaaugacaauugucauaauuucuugaaacaccuuuaagcuacacaccacauagcccacagcaugucucugguggucagaggcucgugcuguggaaucaugucuuuccucccagucuuacgugaguucuagagugugacaucaucucuucacguuuguuuagcgagcccauuuacuugcuaagucaucucagcagcccccuaagcuugacguuaaagggcuggggaaaauggcucacuaagcacaguacuugccacacgugcaugagaacuugagcucagcucuccagcauccacacaaaagcuagguuagguuagcaaggcacagcuguaaccccagugcugcagagccagagccagagccagagccagagccagcaggaucucagguuaccguggccaggcgccuuagccaaaucagcaagcugggcucaagaaggcacugucucauaaaacacagcagagcacagucaaagggaauacuugacaccuauuucuggccuccacacacaggaauaggcauaugaacacacaucugcacacauaccuacacauggcguguaugugugggaacacacacauauuuauuuuuaagauuuuaagggugaaaugcugaugagaaagaaaguagacgucaaaugggucauaagauuaugagucuaaaguucaggaugcagaucugagcuggaaauguaaacuaaggaguuaucaaacuggaaaaaauacuaaagccaggacacuagaugaaaucaguaagagaauaaacauagagagucaagaguuuaaacacugaacgccggcaugcugcccuagagucacugaaaaggaacagggaggacgggaaccaggacaagacuguucuggaagcuaaacgguguuucagaggugagggggugaagccaccaagcgaggagacagagacucagagcagagguuccccucaagcuugcucagcucagcacagggugcagggcuaaagucagaggaggagggauuuaguccagaaggcuugccggggagagaggggugggggcugcaggggagaggggugggggcugcaggggagaggggugggggcugcaggagagagaggggugggggcugcaggggagaggggugggggcagcaggggagagggggugggagcagcaggggagagagggguggggacagcaggggaaaugggaagaaggggcuccuuuucacagucgccagcacuguacacacagugcacugcaaggucucagaaugguuaacaaggguucaccugagguagaaggaaaagggagcugugagaagugaggcuucgcuaggugagaggaagugcaggcacugacugaggccuaacaagaacugggcgugcacacaggagcccgacagaagcgaugacagaggcuguacagguucccuucugcaugugugucugcuccacacugagugugugcaugagagcgaggagaagcacacucggcagcagagaaggaaaguggacaggaaagccgugaagcugccuggguguacugggcucuuccugaguuugugaucaugggcuugagggagaucgacagaccacauggcugcgugagcuccccuccagccuggacgagggugggagacaagcggcaggcgggugaggaauggauggagcuagagcugugacacagccaguaagaaaaacagaugggaguggcgcugcccucaacauauuccagagcugaagggauggacgcccccgucauagcgaggaaacagcauagcagcgaccacauuucccaaggaaaggacaaacucacccuggaauccugaacgcuaacucuaugagaaaauugccacagcuacucaaaucacgccuuucauagcuguuguucccaccaaaugacgcuuuguucugaauuucuguuaucacuaacagaaugaugggucggcauuuauccacgcagagggaggccuguggagggcuaaugacuuaaagcaacagaugcuuuuagcugacaugagaaagagcaccuaguacuggaauccacagucauacaugauucuuauaugacauacauggcgcuccuagcuccuacuucauaauuuaacuguuacguaguaauuaugaaaugaccaugcuugauagaaaagucaugaaggaaaauauuuccggguacacaugugaauggacaucaucauuucuuaagaaagacaacccugaacaucaucuaugagcucauuuauuuaaaacaaacaaacaaacaaacccuuuuuaccaggguuaagcagcucucgaggagacagcuacaaacaccacacaggcagagcugauuccugcggugcgagggacugcacccagguccucacgcaugcuggugagugcucugccauccacaguacccuugauauccacucaauucuagaaacuuuugugccaauguagcacaaagacaagaaaccagggccuugccauucgaccauuacuucacucuuccauuuacagauuacuuuuugaucgugugugugugugugugugugugugugugugugugugugugugugugugucgcacgcauaugugcacuauacacucagaaggugguggugggucucuuccuuucauguucuugagacaggaccucccacugaacuagaacucaccuauuuguuagacuggcucgccaguguccuagaaugucccucccugugucuaccuccugagugucaggguuaccggcaugaccuccugaacccguaagucuuacgugcugugggaacuggggguccucacucccgugcaggaagcccuuugcccaccaugugcgcucccuaacccccagacagcauuaugggaaggcagagcagucuuuaggggagcccaugccuauagagagggagaauggggauuggagggagaagcaucagccaaauucacaaacucagcaggagcaacucagucuucgccagaccugagccuggcuggaagaggaacuggagcuggagaaggggaaggagauggguuugcagaagucuucacuagucacuaucaaaugaacagacagaagcaagacacaccgaccgcagugaccuucaggccacugauugcuuuaaucagugaggcaacaucgagaugcugagaccaaaguacagcuuccagguuggaggcugaggcucaccugcugcaccuaugggggagguagcuggggucauguuguggacauugagaccaagacucugggaggggccuggggcugaugcagcuauuggaggucccggaggguucucccucuggggagauguaagcgggguggucggcugggaggucuguccaccagcaagucgugccaggcgccuccgucgaaucuacagaagaggagagaaaggacauucugucacugacaguagaaacacaaccaccuguaagaacaaugacgucaguguacuaaaaccaucaaaaccaucuccaagcuuaggagccaaagacaccuaaaaagaaugugugcaggggcuggagagacggcucagcaguuaggagcacugacugcucuuccagagguccugaguucaauucccaucaaccacaugguggcucacaaccauauguaaagggauccgaugcccucuucuggugugucugaagacagcuacaguguacucauauaaaugaaauaaauuuaaaaagaauguguucagaaaaguaacaaggcaaagcaaauguuccaguugugugugugugugugugugugugugugugucagaggaaaaccucaaauuuaguccuuaccaucugccuaguuuaagcuagcucucuucuguuccccacugcauaggacaugcuagcugcccauccaugggggggggggguaucguuaggucucagcacccccaccucccuccccauaugucuagaaaugagcuuaagcaggagcacaggcugcaggacuucuggagguuagagaaaagcuagcauuccucaggaacuugugaaaggguuuucuauccccagaaagagucccuccucccagcuuaucagccuccucacaacccacgugauuugucugccccacacucaagcacuaucuugcugcucucuguacucuggcuaggcucucuugcuaucucccaacaccccucuccccaccccuacuccccugcuucccuaguguugcacacaaauagcaccagggcaacccacagcaccuuaggccugaccaaguccagucugcuuucucuucgcucugcucuggacucuuccagacgccccuggguacuuuccucuuuacucauaauaaaagccuccccuagcacagagaucaugucagcaguuucuuuacugcgcuccuccacaacaguuucuucucuuugccuuccaccccagcauaaaagcagugaagacaaggcacugcaccuggcucucuguggguucuggaccugaaaucugguccucacacuuagguagcuagggcuuuacuaagugagccauguccacagccccaaacugaugcucuuagaagcugcugccuuacucuugaaaccuauacagugaucggcucaccaagaugcucuauguuacacugcaaauuuccaauaugcucacuacccaacacacuaaaaccuguuuugguuauauaugugugugugugugugugugugugugugugugugguggcgagagcuaucuguucaagaaaggguuucucuguguagcauugucuguccuagaacuugcucuauagacaaggcuggccuugaacucaagacauccaccugucucugccuccagaguacugagauuaaaggugugugucaccaccgcaaaucaaaaccugguauuuuaacaaaauggcauuauguagucauuuuagauagguaagauuuagaggcuacauggcucaguaguuaaauguacuuuguucuuacagaagaccaaaguuugacuuccagcaaccauuucuaacuccaguuucagggaaucugaugcccucuucaagacucuguggcaaccaggcacacaugugguacacauacauauaugcaggcaggacaacucacacacauaaaauaaaaauaaaucuaaaaaaauuaaaagaaaagucuauuucacccaauaggagaaagaaacaaaagauacaccaagacacaaaguuuauguuuaggcugauuuuuuuuuuuuuuuuuuuuuuuuauuuauuauauguaaguacacuguagcugucuucagacacaccagaagagggcgucagaucucguuacggaugguugugagccaccaugugguugcugggauuugaacucuggaccuuuggaagagcagucgggugcucuuacccacugagccaucucaccagccccugauuuuuuuuuuuaaugugaucaaaaugaaaauauaaucggccauucucugaaugcuucaguuaccaaguaauuacaaauaaacauaggaugggucacagcagcauuuccuaugucacucauccucccucccucccucacacacacacaugcacgcaccaccacccugagguuauacauguauaccaagcacuagaugugaacaggcuucucagaaaugaggcagccccagacacacacacuccuccuaccaggaauaaguaggacaaagcuccagccccagcgauuccuaacaaggacagauuccaggaaaugcguguccuucucacacugugcaacaccugugcccuuuaccucucuuagaccaaggaaaugcccugaguccuugccccagagaggagaagcgucuccucccggccugugccucagacaugccaaccaaucgcuucaccugaaacaugucacacaggucacuaucucaaguuuacuuaagcacauuaaaucuuuugaagaagggauuaggagaagcuagggagauggcucaguugauaaaguucuugcucgaggaccggaauucagaucucccacaccugucucccccugcacagcugcaaacgugccacagccacgcaggcuuugucagggugcugggugucugaagucuggucccuaaacacuuacagcaagcauguuauccaccaagcaaucucccagucccgacuucuuuguugcuguguucuguuuuaauuucagcaauaagaccugagcauggggcgugccacacucuuagcaagcacucagcucucagguugacagcuccagcucaagguaugauuuucuuugaaaacuaagagauaaaaucugcaucaugaaauuuaagugugccaaguuuugauguacgacggagcuggggagcuggcucggcggcugggaaugcagccugugcuuagaugggacuugaauucgguucccugcaugcacgauggaugacucacaacugucugcaacuccaggcccaagggauucccccucaucggccuccucugacacugcacacuugccaaaagcacacaaacaaacacccauaauuaaaaauaaaaauaacucuuuaaaguuuccauuguaucuuauuauugugugcauauggguguugugcccacacgcuacauccaugcaccacauaacccacagagaguccuuagaggccagagagcgaucugcugagacuauagcuacagaucuucauguggaugcugggacugaacccagauccucuggaagagaucuacugaccuuaccacagagcuaucgcucuagccugaaauaaaaauaaauguucuuuuuaaaauuuuuaaugacauuacugaaaacacuuauauaaauacuaauaugaacagcccccauucucaaagauucccugauuuucuuuagugauuccugcauauucuaguuuucaaacacagauaucuucuuguauuuuugucacuuuugcaucuggcuuuacaccaccaguauuuucaguacuuaggacuacauuucuucagagcacacuaacacugcagcuuucugccauaucugcccacugcuuuguagccuuggcuguuggcacugcacugugcuugcuaaugacuccacuaaagggcugggcauacccaaaaucagggguuugguuuggcuuggugucugaagacagggucucacauaguccggcugaccacacacucauuaucuaacuaaggcuggucuugaacuucugauccuacugucuccacuucccaaguucugagaauaaaagcaugugugaccaugcgucaauaugcggcucaaaaaauaagacauuuuaaguugcugcggccagggggugaugauggagugcaccuuuaaucccagcacguaggaggcagagacagacagaucucugcugagucuugaggccagccugggcuacaguucguucuaggauagcuaggacuacacaaagaaacaaagagcccucacugcuccuggacacucauguaugggggauuauaaccagguauaauuccagcuccagggauccaacaaccucuucuguccucagaggacaucugcacagucccccuacaccccuaacacacacacacacacacacacacacacaaacacgcacagagagggagggagggagggagggagagggaggaaguagccagucccagcauuccaaguauuacuaaauuccuuuucuuuacucaaccuacuuuuuauggcugguuaucucaaguuaaaccuagguucuuuuuaaaagauuuccuuuuccauuugucacagaucaaaaauggaaaagcaugaaacagaaacagcuguggcaguuccauggccacggcugugccccgccccagacccuaaacaggagccacauucugcccgucucaggucacauuuuuagcugacacuacaacaggguuuccccuaauggcucuccugaugcuguaggucccacccccuccuccggauuuacccacacuagacucaaggcagggaaagccccagggcagggcagaucaaacugcuccucuuaguuuuagcucguugugggggucgggaggguccacaaaauacugcuuuaaauuuaauaaaauacagucugcaaaaauccuuauuuccaacuaaaauuuuacaaaguaaauaaauuccaacacacagacagacaucacucacaacuucuagucuuuaggauguucuccuaaagauagucuacacauuuuucagucacacgagaccucccagaucucagcaacaaccuaccccuguuccuacgaagaggaaggggaugggacagggacgacggacagaugguaaucuuucuacuuacaaugucacuucuggaggcucuuggugauccugacacaaaggaguaagugaauaauuaacugagguagcccucugcuucccaugggccagaugcagcucuauagcccauguguaagcucaguuaacaacccagggguccgcacacuccacuaccauuuuacaagugaggaaaccaccuccagugaagugacuugcucagcaacacagcucaggggacacagugcaggguuugaagcuggacugugacuucccacacaucaccugucuccacacaagacauuccuacggugacaagguggcacugccgcugacuaguuuaagaagucagcuuuguacagacugcuggugucggacacugccucaacccucugaucagcaacacugaacauacugaccucucuggugaggggugcacaguggagcacagaacauccacccgguguucuggcuacaauaggacaggagcauccuguccuaccacgaauuccuuguggcaugucgauaagugccuacugugugccacaaaguugaagaagauguuccacuugaguccuaauuccuacccucaaaguccucuaaauagaccaggaaaggaaaagcaaaggggcagucaggacacaaggucaggagggcaugggaugagggcagaggcaguaugggaagggagcacacggacgcgugccugugucacagccucacagggagaccagcccacggagagcucagcauccuguauccucaccaggaauaauacaaaaguagggugcgcuguguucacuuugaugucuucuuuuuuuuuccucucuaagauuuauauuuauuuuuugugggucugugugaaccuuucacaagcauguauauacaggugcccaugaagcagaccucgaggccagggguuacaggcagcugugaacccucuuauccgggacucuggaauagcagugacaccucuuacagacugagccgucucuccugccucacauccauggcuuuuaaaacuaaguguguuucuaugcuuuucaggguuuacaguagacuuguagaagcugaacuaaaaauccaguugcuacaagacaugcaccgauuuccucuguauccacacuacugcuagugcaaaucucauacuacaccucuaaaaccugcaaacacuugcugucacccuguuccaccccaccuucccuccaagaccaggugacagggcggagacauaacuaacuccaaacccuaccuaaccgggaagugaugcuuggaacugccugccacaggcugcgcacagcacauggggaagaggacuaaucccccucuucugacacgcuccuguccacauaacugcucugcagcccacccugcuccuucugguccugucucgcuuguuaaugagaccuucagcaccaccgcccaguccccacaucucuauggcgaccaaaccugcaaacaguucagcacaagccaagugugucuguguacacuaauuuauacgcuaagagaaaacgugaacacauuaguagcugaugauucaaagcaauuuauucaaccuuucuguaaauguaaaaaucgucagauuacaaagucgagagcuaagggcuggagagacgagacggcucgcugguuaagagcacuugcagaggaggcuggcucaguucccagcacacacaugguggcucacaaccaucucuaagucgaguuucagggaaccugaugcuacuucugauacugcagacaugcauacgguacacauacaagcauucuggcaaaucacucauauacauaaaauaaaaauaaauccgccaggcagugguggcacgugccuuuaaucccagcacuugggaggcagaggcagagguggauuucugaguuugaggccagccuggucuacaaagugaguuccaggaaagccagggcuacccagagaaacccugucucuaaaaaccaaaaccuaaaaauaaauaaguaaauaaaucucuuuuauuuuuaaguugagaacugaauuuagcagcaugcacuacaauaggagcaugagaguaagcucauggcuagcuuguacuacugacaccauguuucaaaaaaaaacagguagggggaaacugagcuugucuauacucuagccaagcucagcuguauacgagggacaugagcuaggacgucuggaagaaggcuggagugacauggaggugaggcaacgagagggcaagcaaggcugugacgaggcgauggaggagcuggggagcgugacucagccaucuuucuguuccuaguugcagaaggcaacuccugaauuccugaaauaaccuccaucuuuguuaagcucagcaagcugcacuguggcuuacaguggucugcuuauaaauacuuccacuccccaggaugcucaacaguguguggacagcagcaucuugcuuucuucacuucuggguuuucaggauucaagucucuuacacagugucuuagugucauguuuccgucacucccaggaacaacugugaagacccagcacgcugagcgccugagcugugcucacugcugacuggguuucuuuuucagagcagguagaaacccgcuggggugaggacagaggugcacugucagaggcagguggaucugcaggaacccacacugcuuccccgacaagcaagacacaagucagggcaggcaggcugagacacgcccacuagcaacaccacccugaugcccuggacuugcucaugaagguaaggagcaacugagauagacgaccauggcagucacugugaggacgagcacgaaggugggacaagacaccagacuggcauaaggacauggaagagagacggucaaguccaggcacauuuaauuagugcuacaaagaacuuggucaaaaaacaaaaaaacaaaaaccuuggucauucuuuggaauugaggcaugaagaaguaguggaaagcauagauuucaggccuggcuaucuacaugagauaaaauucuguaaagcaagaaugcaagagacuucaagagagcaaggcagccaggcaggagauauagcccugcagcaccagccccuugggaagcugagguagaauuguuggacucaaaagucucuggccaaccaaaacuaaauaaauaaauaaauaauaaaaggauacugagcauaggagacaaccuuuggcaucuauaggcuuccacacacacagagacagaugcacagacagguaaacagacugagacacacacacacacacacacacacacacacauacacacacacacacacacaagaauggaaggagcuagagguuaaacuaggaguaccugcaagaaacucauauaaacgggaggcaguggagccugcccguacuccuaucccuugggaggccgaggcaggagcauugcugaggucagccugagauacaguaagacuguauuaaaaacacuaaaugaagaauggagaagaaggggacaaggguagaggggcuccaggagcgcagcagcuaggcugacacacacguggcuguugcugacuguuucuaaguuuacagugaggccugggaauuuuaaaaagcaaaguagaaagaugggaaaauccugcacuuuucccagaagggagcauauuuaaaauugggacuaaagagggcaugacuucucaaaaaagaugaaagccauuaaaaggaagcaggugaagccgggugugguggcgcaugccuuaaaucccagcacuugggaggcagagucagguggauuucugaguucgaggccagccuggucuacagagugaguuccaggacagccaaggcuacacagagaaacccugucucgaaaaaacaaaaaacaaaaauaaauaaagaaacuuaaugcauaaaaaaccagaaccuacaaagaaaaaaaaaaaacaacguuuuuuuaaaggcagccaaguacuuuacccuggaacagugaagcugcugcucauacgcaggaacugccuggcuggaaggccuaguccagguucaaggguuauacacuuuuaacucauuugaggaacuuugcuuugggguuuguaaaaugacccaauggauaaagaacuuugcugagcaagcauaaacaccagaguucugaccccaaauccacguaagagcuguguggguguggucgcccacaaacccagcccccagaagacggagaugcagauccuagggcuagcuagguagcaagacaagguagugagcuaaguccagugagggcccugauaagcucaguagucaaagagggcacccuguuccccaaaagaugcaaagggcagggguuuuuccaaaauauucaucaacacuugauuuugggaaaggagcuagacacaccauggcauaauggucucaugcuuaccacaugaggcccaaagaucaggcucagauucugagacuugggggaagcuccuucaccacugacaaucccacagguucuagacacuucucagaaggcaccugagcuugcuguggcaguauacgcuguaaucagagcacucgggaggcugaggcaggaggaugcuaaguuccaggacagacugaccuagauaaugaggcccuguguugcacagauacacgaggaggaaacaaagaggggacgauguagagaaggaaggaaagaagggugaaggaagaaacacuuuaccacuccaucugaaaauacagcagaauccacaggcaggagugagcaaauaccauuccaucuccagucggccacaacaccagagcccuucuagcugggucuagccucaaccucggcuguacccacaccuaccuggguuccucucugagaccugaguuccugauacaggagaaguugacaaagagccacugaccucgcagguaagcaucagaacaggcugauauucugcuccaucugccagcuccucuuuacuaucugcacagcccaagcccuagcugacaggggcgugguccauucuuauucguccuacguccuugcaacccuaacaguaucucacccagagagcacuuaguaaacaguugcugaacaaaugaaggagucccugagaaagacaggugacaaguguuucccagagacacacaucacacacguaucaauauuuuucaacccagagcucucuccaucuuucugcacuuugaucucuuugaggcucagauacuacuuuccuuuagcuuggguucuguuaacauugugcgugcagcaaagcugcuguccugcgcaucaccucugugagcugacagagaaagcagaaggauccagagccucccuugggaagcauuguagggcuguaaggaggcuguuuuagcugcacugcauccugguuuguucguuugguugguuuggaguuuacuguuugguugauuuuuguuuucugacacaggaucucacuguauaucccugcuggccugaacugcuaaguagagcaggcagccuguuaaccuagagccugccugcccaccucugucucacuaaaauuaaagcuuaggccaccacccuuggcuccuuugggguuucugucuagugcugggguugagccuaggguguuacgcauucacaagagucuccacucaagcugcacccucagcuccuuucccuuugguuugcuuuuuuuuuuuuuuuuuuaagauuuauuuauuuauuauauguaaguacacuguagcugucuucagauacuccagaagagggaguuagaucucguuacggaugauugugagccaccaugugguugcugggauuugaacuccggaccuucggaagagcagucgggugcucuuacccacuaagcuaucucaccagcccugguuuguuuuuuugaaacaaggucucgcuguguagcccaggcuagccuugaacguucagugauccuucugccucaacuucaucaauaugggaauuacaagaagguaccacgguauucagcuuaaaaaaaugauucuuagccgggagugguggcacacgccuuaaaucccaguacucgggaggcagaggcagguggauuucugaguucgaggucagccuggucuacaaagugaguuccaggacagccagggcuauacagagaaacccugucuccaaaaaucaaaaaaaaaaaaaguagauucuuacagcuauaguuuugugucgacaccagaaagaucaggcuagacaagcacccugcaggugccacuugcaucuuugaucucacuuagagucgaugagccaaagccaagcagaagcugcuucuaacacugguccauaaaacagacucaguaagugacaagccccaggagaagggaccagcacucuaccgaagaagauggcuugccacacaagcauagggaccugagcuuggcuccacagcacccacauaaaaccugggcacauggcucgcaucugcaaugggggaggguggauaggcagauuccuagagcuugccagccagccaaucacgccaacugagcuccagguuuagugagaucuuauucaugaaaaugagaaagaugggcaacuggagaauacauuaguauucaguaauaacaguaaucuccccuggucuccaagaacacaaguucccacagguaagcaagcauguguauacauacacacacacacacacacacacacacacacaccauacauaugugcauaucuaaauauguauacaguuaacaguguguacuaacugguuuugugugucaacuugacacaagcuggaguuaucacaaagaguaagccucccucgaggaaaugccuccaugagauccagcuguaaggcauuuucucaauuagugaucauggggggggaggacuuauuauggguggugccaauccugggcugguaguccugaguucuacaggaaagcaggcugagcaagcgaguaagcagcauccuuccauggcuucugcaucagcuccugccuccaaguuccuaccccaugugaguuccuguccugacuuccuuugaugaugagcagcaauguggaaguguaagcugaauaaacccuuuccuccccaacuugcuucucggucauguuguuuugugcaggaauagaaacccugacuuagacacagaguuaguauuuaacugucucaccacaagaccaccauuguuucaauccaaguguacuuucccuggggugggagcacuaagacuggugcucagcaggaguggucacugacuuuaaucacgaaauaacaaaaacaaacaaguuucuuuuaggagagcuuauaugugguaaagaaaaauuauuucucuuuuaacagcuucauauuucucucaucucauucaaaaauuuuaauugauauuuuuuucuguguccauacugucucccaauauuaugaucagggaaacuguacuguucggucgcacagagcguuccagccaacgaugaggugggcguccaugaccgugacuccacccacuugagaggcagccugggcagaugggacaauaccuaaauaacaaaggcugguuuuuuucacuuucuaguaauuuuuaauuccaucccagaaauaauuuuccacauuaggccauccauaaauucaaauuuucucuguaaauguauuuugcuauuuuuuugaaaauuuaaaaucuguacauuauuuguagcuaaccuaaauaccugauggguuauuuugcuguuuuuaagucuauacauuauuuauagcuaacuuaguaccuuguuuacagauaaaaccucuauaagaauacuuggcagacugaggaaggaggaccccaaagucaaagaugucuugggcuuuauauuaaguuccugucuuaaaaaaacaaaaacuaacaacaacaugaacuaaccaguacccccagagcucccagggacuaaaccaccaaccaaagaguacagacgguaggacucauggcuccagcuacauaugcagcagaguauggccuagcccgucauuaaggggaggagaggcccuagguccugugaaggcucuaugccccaguaggggaugccagguucaggaagcgggaguggguggguuggugagcagggggagggguuaaggggaggggggauuucagaaggagaccaggaaagggauaacauuugaaauguaaauaaagaaaauaucuaguaaaaaaauacaaagaaaaaaaaacuaauacgguaagaaaaaaguguuuguuuauguauauacacacacagacauauggguuauaugaguauuuugccuaccuauguuuccugugcacuaccuaugugccugguucccucggaggccagaauagggagucaaauuccuugaaaacggaauugcagauugugagccaccauacggguucuaggaaucaaacccaaguuuucuggaagagcaguuagugcauuuaccgccaagguauguggccccuggauaaaacacacacacacacacacacacacacacacacacacacggguuuuuuuuuguuuuuuuuuuguuuuuuuuuuuuuuuugguuuuugguuuuuccauuugucaagacaggguuucucuguguggcucuggcuggccugaaauucugcucuauagaccaggcuggccuugaacucagagauccaccugcucugucuucugagugcugggauuaaagguguguacuaucacugcuaggcugaauuauauuuuuaaaaaacauuuuagguaaguuauggccuuauguaugauucauauuucuugaaaacaagacuuuauaccauaaauacaagauggaggaauggagacacagugcucuuucagaacaccaguguucaauucccaguacucacauggccggucacaaccaucuguaacuccaguuacagggaucugacacccucuucuggccaccaaaggcaccagguacacacacagugcacauauauacaugagggcaaaacauucauuuaaaauaaaugggcaaugguggcgcacgccuuuaauccuaguaccugggagucagaggcagguggaucucugaguucaugaccaaccuaaguccucacacaaagaaacccuguucaaacaacaaaacaaagaaaugauuuuuuaaagacaugaucaaaauagauacuguggaugauaaaacaccaaaguuuuauuaagacuggagaaauaagauguacaauccugggcuuaguguaagguauauccaaucuacuaacacaagauaaaaaacuagguuacaaagagacaacugucuuguucuguccauccaucuacucauaaaaacauuuaucaugggccauucugugcccagcccugugcuagaaagaggcuaacaaugagcaugagcugggagccuauguuccaguggagacacaucagugagcaggccagucaaggccacagaaccuggauuaaggacaggaaacaaauuuuuaaaaaagauuuauuuuauuuauaugaguacacuguagcuguuuccagacacaccagaagagggcaucagaucccuuuacagaugguugugagccaccaugugguugcugggaauugaacucaggaccucuggaagagcagugggugcucuuaaccacucagccaucucuccagccuagaaaaccaaauuuuaaugaaaugccuuuuccuucucucaaacccucccccucagcucaacugcugcugcugcugcuggaaugguacagugaggugggguuaccugagccucaugaucacaucuuaggagcuggagagauggcucagugguuaagaacacugacugggccgggcggugguggcacacaccuuuaaucccagcacucgggaggcagaagcagguggauuucugaguucgaggccagccuggucuacagagugaguuccaggacagccagagcuacacagagaaacccuguuucgaaaaaucaaaacaaaacaaaacaaaacaaagaacacugacugcucuuccagagguccugaguucaauucucagcaaccacaugguggcucacaaccaucuguaaugggaucugacgcccucuucuggugugucugaagacagcgacaguguacccauguaaauaagguaaauaaauaaaucuauuaaaaauauauacaaaaagcagcagugcaccguuuuguaaaaaaaaaaauaaauaaauaaauaaauaaauaaaauaaaaaaauaaaaaagccuuucagacccaggcaugaugguacacacuuuuagacugaggcaccuaccugaggccagucugggcucaaccuaagacaacccugccucaaaaaacaaaaccaaacacacaccaucucagaucaacaccucuaagcaauuucaaaagaaugaccaguuugccccaggaggacagagcugacacauuuuauccuccguggcccauucuguguacccaugccgcuccuguccccacccauucccaccauucccacugagaugaacugcuccacacauccacagcagcuccucacaucuacuuaccacacgagcucacugcuggaccaggacucccuuaucccugaucucaguaugagcaacccugacugagaaggcaugcaguaccuauuugcugaaauuaaauggauuaauaauaaucagauguccaccacguccauguuuaucaccagccuuauguuuguuguuguaacagccugccucgcuuuccccuuccaagagcugcaacuaggagcaugcaccacccaagcugacguuucuaaauucagacauguacuaugauggucuauauacugaguucugguucucguccaaacaaggcuacauaguaaaacacugucucagaaagcaagccaaugucacauugacuuccuaccucaaaggaaaggagagaaacaguaaacacugagucaaaccugcuggaaacaauaaagacauuggcccaguuuaaucuucuuuuuaauuuuaugugucuaaguguaucaggugcuuacagaggccagaagagggcauuagauccccugaaaugaaaugauacaggauuauaagccacuguguaguucuuagaaauuaaacccccauccucuggaaccagugcucuuaaccaaugagccgucuccccuuagccccauuuuaacuuuuuuaaaaaaagacaaaaguagugauuagaauagggaaaaauagcugggcgugguggcgcacaccuuuaaucccagcacucgggaggcaagggcagguggauuugaguucgaggccagccuggucuacagagugaauuccaggacagccagggcuauacagagaaacccugucucgaaaaacaaacaaacaaacaaaauaauaguaauaauaauagggaaaaauaaaauguaaaaaaaccuacccuccaaacccucaguuaaaccuauggcucccaucaauagccacaaguggcuuccuagcucccccacccauuuucuucugacuuaggccaacuuguccuauuaaggucguggaucacugcgcugccaaaucccaaaucccauagucaccucuacaucugucccucagcacuugcuauguagcucugacaaccugaguucaagccuacguaaaggugaaagaagagaauuacuccacggaugcugugcuguggcuccccaggcaugcauacuuaggcccaauacuuagggagggaguagagccaccugcaucccuagagcucacuggccaggcaaucuagccaaucagugagcuccagauucagagacacaucuuuaaaaaaacaugacuuacaaaggagacugagacacugaaccuugaccucuggccugcagaggcacuuacacaucuacacacaccuauaagaaacacacaggggcuggagagauggcucagugguuaagagcacugacugcucuuccagagguccugaguucaauucccagcaaccacaugguggcucacgaccaucuguaguagcaucugaugcccucuucuggggugucugaagacagcuacaguauacucauaauaaauaaauaagaaacaaagacacagauagcgcguacacacacaaaagccaaagcuaugcuucuaucuugcuuaggccauuauuauucuggacugucugcucuaucagcuaaucaccaccauaacuaccacacagaucuuggacccggaaguuauauguaugaccuugacuuggggucagcaugggcacagaugcagcagagcagaaagcaggugauccuuauuaagcuucaauaaacaucugguaagaauaaugacaccggggccuguaaggcggcugaacaggcagaaguacuugcucccaagcuuguucccuggcucccagaaagcagcgggaaagaaccauuucuagcaaguggucucugaccuccacaugcaugccaugccacgccauacaccguguccuguccaugucaccauaaaaaacagcugacacgccgacacagccuguaacuguagggcagcugcggggacgauucagaucuaauuauuuccuggcuucacgccacuguaaggaaguaguuccacgcaugaggccaaucagcauucaaguauaaaaggcacuaugaucugccuaaggaaugccugugcacagggcagguuuacucagaccagaaaaaacaaccucgucagcacucaagggauggacucuggagaaaacgccaucucaugaagaggaggugucugggccagcuucagacuuugcccaagaauagagacaguaacaagugugcuggauaguuucagccaucucagaggagaaccccaauucagaaaaugccuccauaaaacugggauggagggaagccuguacugucuugauugauugugauugaugggggagggaacaagccuuuguggggguccugaguucuauaaaaaagcaggcugagcaagccaggaagagcuagguuccugcacuguuugaguuccugcccugacuuccgucagagauaaagcauucccuggaaguguaaacugaaauaaacccacguugcuuuggucaugguauuucaucggaacaacugaaacccuaacuaggacaaccagggacaaggaggugccaccaaaguacccagaagcagggcugcugccugggauaucaggaaccacaccagggcagaaagcccgcacugguggcccuggcggguccagaaggaguuugccccaagggcuacagucuauccucuuucaaugggcgggcgucuuuauuuccaacacccuagcccucccacagcacacgaggggaagggcgggagggagagaacuggugccuucacccacguaaggguccuggacucuacaguuuccuuggguuuucuuccucagggcggugggguuucagaaggggcuaaccaggaaggucacugucuucucuuucucacaugaaaacuuuuggcugagcaggcaguugcccaaugacaacuguuucucagcauucccaacaaguggccaaggcucugcccagagagaggcaaccaaccaaagcuaugugcaacaucuaggcugugcgugacaaaguaugaccuccuucccucuccucucugacuaaaugcagacauacauugccaugagaugaagcuguauguugccacaccagccuuuugccuccuacccagacuuagaaucaacagccaucugaguccucuggcacccucaacucaaccccacagccauccugguucccaaaccacugacugacccaccuuccccaccaccaacccagcugcucccacgucaucucucccuggcacuucagcagugccuccuaaccuuucucuccgacuuccuccucauagaggagagaacugauucuuuaauaacauaaaucauuugugugcuagcuaguuuuugucaauuuaacacagcuuaggccaucugaaaagucucaauugaggggauuguccucaacagacuggcuugugguaauuucuguaaaaauuugccuugauugacuauugauggaggaggguucagcccaccgugagcagcugcauaccauaggcaggugguccugggcuauggaaggucagugagcaagccaguaacugcugcuccucuauggauuccacuccaguuccugaccugacuucucucagugguaaaaugugacgugagaguugucagaggaaauaaacccuuccuuuaccccaaguuacuuuuaucccaucaauaaaaacccugacgaagacacaauguaagccucauacuacauguaugagcacacaacuuuaaucccagcacugggaacgcucaaacagguggauuccugaauucaaggccagccugauguacauagcacauuccaggccagccauggucacauagugacaccugucucaaaaagaaaacaaaaauaaguauaagcugucucagguugccaguugcaccaaucagcaagagaaaagcaaacaaacaaacugcacauggaaccacagcaaagugcuuuaugauaggacagggacaaguagggcaaggugguuuaugccuaccacccaaggguuuaggggcugaggcacgaggcuugcccugggcucaaggccagggugggauacagugagagccccugaccuucaguugcagucuggggacugaggcaagcggaccucugugagaccaaggccaguggugagcuccaaacaagcucaauucuaaccauauguucaguugccaaguacagcacagcuucgagaaccagauuucugcccuugugaacucugcuaacaugcuuggcuguugccuuacaaugaaaaguugcugucaggacuccaaccgcagauacccacugcuauucccaucccucucuccauaaaaaagaacauuugcucauggagaggaggcaaagcacagcauguguguucccaaccugugugcaggugcauaccccgcuaugggggccagaagcccaccacugggauucacuucugcugccuuaguuuuugagacauggucucucccugaaccucauguuccuggacucagcugacuugcuggcuagcucucaagucugggggaaucucucgucucuacugcucagcucuaggaccaagcccugguaccacaccagcuuucucugcaggugcuggagacucugaacucccaugucguuaagucaccaccaugccugcgcggcaggcacuuuagccucugggccauuccuccaacccaaagcacaucuguuuuuuaaagguacuuaaaagggcaacuauacauaagagauugcucaaagggacaucaacggguuuaucagauuugcacaugggcaggaaacggccacgcacacaccaacgggucaacagcaauuacaccugccacaguaagaagcaucccaagcccaaauacugucauucggaaaggaugggaaggcagcccaaacugacagaggccuggggaacacaguaagacuccagcucucaccacugugucccucagacagcaagccccaagguggcugagucccuaggaacaaucugucccaaaacagcucccuauugucccuuaaauucuucucaaaacucugggcuggggagauggcucugugauuaaagagcuuacuauaaagguauaaggaccuaaauucagggccgggcgugguggcgcacaccuguaaucccagcacucgggaggcagagguaggcggauuucugaguuugaggacagccuggucuacaaagcaaguuccaggacagccaggguuauacagagaaacccugucucaaaaaaaacaaaaacaaaaaaaaacaaaaaaacaagggguaacacuauuugagaaggauuaagagguguggccuuguuggaggaaguguaucacuuggaguggacuuugagguuucaaaaaacccaccccaggcccagcaucuuaucuuucuccccucuugacuaagacaaaugagaaagccuaucucaagaacaaggauggcaagcaagcaaaaagcaccugacaucuaccuauggucuucauauaugcacacacaggcacacucucucucucacacacacacacacaugcauguguacacacacucacauacacacaugcaggcacacaccuuuaagacaccuucuucuaagucaaguguagugucucgugccuauagucucagcuacucaggagggugaggcaagacaauccucugagcucagggauuugaggccagccugcaguauguaacaaggccucacuggcuccccucaaaagugccagcugugauaacaagugacuugugucccagcacucagagggagaggcagguggaucucugugagucugaggccagucuaugguguacacaguaggcuugccagagcuacauauugagaccuuagcuaaaauaaaaaaaaauuggggguggagggggaccagagaugacucagugguuaagagcauuuacagcgcuuauguaagaccaggguucaguuccuaauaccuacaugauggcucacaaucaccuauuaauaucuacacaggcauacacguaaguagaaaaauaaaauaaaaagccaccccugaaacugaccccaguuuuucaauucuucaggcuauuuuauuuuccuuuauaggguauagcaucaaaaaaaacgccucaugugccugcauauuaucugcuuccuuugaggaaaaugacgcugccuggaagcagcucucagugguacuggaaugcagucagcaaacuaucagcccacagaguuaaaugccccaaggcagacaugucacuggcucacuacagaugccuuccugccuucaucaguauccagggcuaucugaggccuggacccuuggcuauaacaacuggaguauaaaagucugcuaguuucugcugccccucuucccuacucauuauggggguaaggguguuccuaauggugcuuuagcaaagggacugagaacuucacacuuaggcucuggauuggaauccagaucccacauuaaacuggcuuaugccuugcagcuggaauguaguucagcugguaaacuguuugccuguuuacaugccuuucggcaagcuuguuaauuucuauuaaccuggguuuuccuaucuguaaaauggagagaauaauagcaaaggugguaggggaguucagagcuuaaaacaaagaaguccuugagugucagcucacgucaccauuaucauugugucucgucuuuaagaggacacaaaaggaccgacaggauggcucagcgauuaaaagcaaacacuauucaugcaaagggccugaguuuggcucccagcacccuccgcagaggccucaggaccaucuguaacuccagguccagggaaaccugucucuugucucugaaggcaauugcacggacacccccgccccccccccacacacacacaguuaaaaaaauaaaauaaauaaauagaucuuuggugggaggagguagagaugaauuggaguacaaaggccaggugagaaucaccaagcaaauucauagugugucugucugucugucuuugacacaaguuucauugucugucugucugucugucugugauacaaguuucauguacucuggcugucuuugaacucuauguagcugaagauaacgucaagcuucuuagccuccacggucuaacuuccaaaccucagauacagaaaagcaucaccaucccugauuaaacagguccuggggauggaacccggggccucgugcaugcuagcuagguaagaacucuaccaacagagcuggaccaccagacuuacauuuucaguaucuugccuucucuaaaaucugcucauguccaaucccaaaaucagcccuguccuuaacuagacaccacggauuuaugucuccuccuucucuccugcgucacagcgauguuagaacuggauuaauuagucaagcauccaagcaugggacaugacagcacaacccuguggccccagcacuugggaaacagaagcaggagaaaucggcgaguuugaggccuacuugaacuacagaggucuagggcagccaaacagcuagggcuaccacagugagaucucacuucaaacaaaaaagagaaaagauaaggcaaaaagacagacagacagacagacagacagacagacagaaaagaaccagacuggcuuaaugccucggugcuuauucucagugugcccgcucacccccuucucacuguggaaggccucaauccacggaccucuguaacagcagcagccuccuacucugucccgcagugugcgccaccuuccucccaggccgcaggugcucacaccccugccagucaucuuaaguccuaagucucccugcaggguagagaucaaucucucucacgggcagaguagaaacgccuaaccuuucagacagcucuccaagaucugacaacagccagugccacaggcaaaccaucucccaugaccaagccccacggccugguacugagccccucaguccccguucccaggacccuuucagcgcagagccuuuuccugaagucuuaagaccucgccccaugaggcaucccuucuuaugcuucugaguggcucacauguaccuucacaauagcacuaggcacagcuucuacacuggacauuaagguaaucuuaugcuucacuguaugggagugagugcucugccuguagggguguaugugcacuacauaugugccuggugcccggagaagucagaagagggcacaggucccuagaacuggagacacagugagaaagcaaccuggguccucuacaagaguaagugcuucuaacugggaagcccucucuccagccccuauguuauacguuuuagauuccuaucuguaucacccaaccugacccccaaacuuauggaguaaaccaucugaggcugggguuggaaagaguuggugcagaaacaucauuacgcaugagucagucgguuccaagaacagaucacaucaugaaugaacucauacagaauaccacaucagagaggucaacauuagcagaauauucauguagaugcugugaucgauccauggacagcuguugaacagugagauguaauaaaggcagcuuuggaaucagggguccugagcuucuaaaccacgugacuucuaaaccuggucacuuuugccaagugucagccuaauguuuccucaccuauaaacuccacaaacagucuuacgucaucacauuguuucaccaaaugaggucgaccuuuuuuuuuuaaaaaaaccaccaugugguugcugggauuugaacucaggaccuucagaagagcagucggugcuuuuaaccacugagccaucucuccaguccuguuuuaccaaauaaaacaauggcugcaccacaccuggcaaagugcaggcuuuuaagacucaauaacuguuaaucuuuucccacuuacagaauacugcucaucuguaaucccagcacuugggaagcugaggcaggaggaucacaaaucuaaaaucuaccugguauauauagccacacccugucucaaaaaaaaaaaaaaaaaaaagaguggaagacacaguauuaaaaaucaauaaaaacccaaggucauauaugcugcauuugggaagaauacugaacacucuucuaaaacuuugagcacaccccaagucccagccagcgaccucacagaaguaggucauacaaauguagaagaaauagagaaaaggagccgggaaagguacaaaucaucucaaagcaaucuccucagcacugcugagcagcaguuuaaaccaccugcccuccuuacagcacugccuugguccacgagaacaacacacgaguagcuagguauagcacgaaugcaguguaaacaaugaugcugugggaugucacagcucuguuccggaaacucagcauaaagcacuacgugcaugacacagccaugcagauaaacaacccuuucaaauacacagaaagaaguaaaagaacucaaggugacccacgagagagggaccuggucugguuaaaccaguuuuuacucuucuagaugguauucacauauauuuucauuuuguuaaaguaugaaacucugauuuaauccaaguuccuaacuuacagugaggagaucacgucaguguguuuuguuuuuuuuuuuuuuuuaaauauuuauuuauuuauuauauguaaguacacuguagcugucuucagacacaccagaagagggcgucagaucucguuacagaugguugugagccaccaugugguugcugggauuugaacuccagaccuuuggaagagcagucgggugcucuuacccacugagccaucucaccagccccgucaguguguuuuaauucuaaaauguauccuuguaagacacauguguuuuauuuuuuuuuuuuuuuuuuuuuuuuuaauuuuucgagacaggguuucucuguccuggaacucacuuuguagaccaggcuggccuugaacucagaaauccaccugccucugcuuccugaaugcuggaauuaaaggcgugcgccaccacgcccggaguguuauauauuuuuuuaaccaaaucaacaucaccuacaacaucugucauauaaguuucuacuaccagaguaaccaaaaaugggcacaagcacuuuuggaaacaucucaguugagaaaugcacaccuaauucugaauuaagggaccuggauuaaagcugggcacacugguacacacucaggcagaggcagguaggggucugugagcuggaaccagccugggcuacagugagagucaaaaaagaaaaaaaaaaaaaagcuuuuaaagagauuuuuguucuggcuucuaaugagaauaaaaugaccaguaauuaauuguacugccacuguagucaagccaacuaauuuguugaaaauaccuuuauacuaauccugcuuuagugaauuuaauuuuucauauacauuuuaguguucuguugaccuugaaaaaaaauuucuuccauuucuuccacaaagguuauacguguuccuuuuauggucacuaagagaguuacaccaucucaagaacugagcaaaauaaagagauaccuuccagauuauacgguaucuuugaccagucuguauagucuggucaaaauuaagugguuugaaaaaaaaauuaacgaagaucaaaucuguaaaggucgcuaaaccaagaacuuuuacaaagcauaguacuuuuuagaaguaaagggcuacagaaaaacacagauuguguuucuuuagaaugaaaggaaaaugggaggaugcuuuuuuaaacuacauaaaaccaaguauuucuaaguugaucuccugauauuuccugaaacuacucagggcuuuucugauuuaagauuacacuccugcuguaguugaggaaaaccaaguuagcugacugaaaauuagcaauucugacuuaacaacugaaauaucacaagucacaagauugguuuuuuuuccccccuaccugacccuucacccacguacgcgcaugcuccaucccuggagaauuuuagugaguaaauaaacaugaggagaccauagccaaaaguggagcaccggccucuuccaaccgaccugaugacagaugacgacuacuuucauaauacugcaggggaagcuuacgggaagcaggggaagaaauuaagccagcugggaucucgaaaggaaugcuuucaauuuguaaaacgacaaggggaaaaaaaaaaucaacugaggcauagaaaucccuaguucccuaacugccucugcuuuccugaugaucccacacaguacaacccaaguuugagggggagggguccugacaaaaguaacauaauaccagaagucauuaggaaucuguuaaauuaguguaauuuaacuggaaucuuuuuaacuauuaaguauauacacuuuguuaauguuaaaucucaaggaaucuguaacuaccucucaaacacaaagguaccuuugauaauuuauuacaaugaaauggucacauguaucugggauuucaaauccuucccuuuaaaacugccauuaaacaucaugauuuuaugcaaaauuguucuuuaaaacccccgacgacgcagacacacacaauauaccacgaucuaaaucgcgccccucuuucucgaacacccuuuuaaaaagauugaacaccuucaagaugcuccucaccaccccacccccgucuucagacccuaaaagaaagaaaagcgaguggaguuccgaaugaagaaacgagagagaauaaaggagaauaaaacgagagacccucuugcauucucuaucucuggagaauuuuagugaucgaguaaacauacugagacgguagcccaaaguggagccaagggcuucuuacaauacagccaaccugaugaugaaugacuacuuccauuauauuucauuauucuugaaaaugccaucuccguugccuccccaaucccaagagcccgacaccaccagggcaaaaaucuguccccauccaaagcgccaaagaguugccaaguaauccuuucaaggugcccccccccacgccccagccuccucaccucgucagcgcucagcuccuccaucgcuuuccucuuaauggugaaaggcguuagagagauccuucaguucuugagaccagggcgggagcaaaggaagaguggaagguaucuaucgggcugucuggucccccaaugggggagguuucagaauugcauagucagagguuaaaaacuaagaacacgaggcacugaaucgccuuggcuucggccgcucgcaccgccgcagccuccuccagcagcaagcgcccagagcugccgccucuggccacggccaccgcuaugggguccucuccaggcgccacugacuccccucagcuucccagguuacccagggcgggcggcgcggucuccagcucggcucgugcccgcugcgcgccgugucuucguggcggugacgcggcagcugcguuuuuuucucccgcagacccugcuccgggucccaccccugggcccaggcgggaacagcuccacugcacacuggaugcccccgaggcgcggcgacccuacagcagcccaggcagagcccagcaccggaccgggaagccccuccccucuaaaagcaggccaggcucgccccgccuccacgcgagaaccccgguggggggcaggggagggacgggacuggcgaagcccucgcuggaagcguaaauccuccuaccccuccaacccuacucuuacccccucgccccaccaagaauuauucaucaaaacaacagggcggccaucuuugaaaggggucacgugacccuc

SEQ ID NO: 12337 - RNA, 98217 nt, Mus musculus
gagggucacgugaccccuuucaaagauggccgcccuguuguuuugaugaauaauucuugguggggcgaggggguaagaguaggguuggagggguaggaggauuuacgcuuccagcgagggcuucgccagucccgucccuccccugccccccaccgggguucucgcguggaggcggggcgagccuggccugcuuuuagaggggaggggcuucccgguccggugcugggcucugccugggcugcuguagggucgccgcgccucgggggcauccagugugcaguggagcuguucccgccugggcccaggggugggacccggagcagggucugcgggagaaaaaaacgcagcugccgcgucaccgccacgaagacacggcgcgcagcgggcacgagccgagcuggagaccgcgccgcccgcccuggguaaccugggaagcugaggggagucaguggcgccuggagaggaccccauagcgguggccguggccagaggcggcagcucugggcgcuugcugcuggaggaggcugcggcggugcgagcggccgaagccaaggcgauucagugccucguguucuuaguuuuuaaccucugacuaugcaauucugaaaccucccccauugggggaccagacagcccgauagauaccuuccacucuuccuuugcucccgcccuggucucaagaacugaaggaucucucuaacgccuuucaccauuaagaggaaagcgauggaggagcugagcgcugacgaggugaggaggcuggggcgugggggggggcaccuugaaaggauuacuuggcaacucuuuggcgcuuuggauggggacagauuuuugcccugguggugucgggcucuugggauuggggaggcaacggagauggcauuuucaagaauaaugaaauauaauggaaguagucauucaucaucagguuggcuguauuguaagaagcccuuggcuccacuuugggcuaccgucucaguauguuuacucgaucacuaaaauucuccagagauagagaaugcaagagggucucucguuuuauucuccuuuauucucucucguuucuucauucggaacuccacucgcuuuucuuucuuuuagggucugaagacgggggugggguggugaggagcaucuugaagguguucaaucuuuuuaaaaggguguucgagaaagaggggcgcgauuuagaucgugguauauugugugugucugcgucgucggggguuuuaaagaacaauuuugcauaaaaucaugauguuuaauggcaguuuuaaagggaaggauuugaaaucccagauacaugugaccauuucauuguaauaaauuaucaaagguaccuuuguguuugagagguaguuacagauuccuugagauuuaacauuaacaaaguguauauacuuaauaguuaaaaagauuccaguuaaauuacacuaauuuaacagauuccuaaugacuucugguauuauguuacuuuugucaggaccccucccccucaaacuuggguuguacugugugggaucaucaggaaagcagaggcaguuagggaacuagggauuucuaugccucaguugauuuuuuuuuuccccuugucguuuuacaaauugaaagcauuccuuucgagaucccagcuggcuuaauuucuuccccugcuucccguaagcuuccccugcaguauuaugaaaguagucgucaucugucaucaggucgguuggaagaggccggugcuccacuuuuggcuauggucuccucauguuuauuuacucacuaaaauucuccagggauggagcaugcgcguacgugggugaagggucagguaggggggaaaaaaaaccaaucuugugacuugugauauuucaguuguuaagucagaauugcuaauuuucagucagcuaacuugguuuuccucaacuacagcaggaguguaaucuuaaaucagaaaagcccugaguaguuucaggaaauaucaggagaucaacuuagaaauacuugguuuuauguaguuuaaaaaagcauccucccauuuuccuuucauucuaaagaaacacaaucuguguuuuucuguagcccuuuacuucuaaaaaguacuaugcuuuguaaaaguucuugguuuagcgaccuuuacagauuugaucuucguuaauuuuuuuuucaaaccacuuaauuuugaccagacuauacagacuggucaaagauaccguauaaucuggaagguaucucuuuauuuugcucaguucuugagaugguguaacucucuuagugaccauaaaaggaacacguauaaccuuuguggaagaaauggaagaaauuuuuuuucaaggucaacagaacacuaaaauguauaugaaaaauuaaauucacuaaagcaggauuaguauaaagguauuuucaacaaauuaguuggcuugacuacaguggcaguacaauuaauuacuggucauuuuauucucauuagaagccagaacaaaaaucucuuuaaaagcuuuuuuuuuuuuuucuuuuuugacucucacuguagcccaggcugguuccagcucacagaccccuaccugccucugccugaguguguaccagugugcccagcuuuaauccaggucccuuaauucagaauuaggugugcauuucucaacugagauguuuccaaaagugcuugugcccauuuuugguuacucugguaguagaaacuuauaugacagauguuguaggugauguugauuugguuaaaaaaauauauaacacuccgggcgugguggcgcacgccuuuaauuccagcauucaggaagcagaggcagguggauuucugaguucaaggccagccuggucuacaaagugaguuccaggacagagaaacccugucucgaaaaauuaaaaaaaaaaaaaaaaaaaaaaaaauaaaacacaugugucuuacaaggauacauuuuagaauuaaaacacacugacggggcuggugagauggcucaguggguaagagcacccgacugcucuuccaaaggucuggaguucaaaucccagcaaccacaugguggcucacaaccaucuguaacgagaucugacgcccucuucuggugugucugaagacagcuacaguguacuuacauauaauaaauaaauaaauauuuaaaaaaaaaaaaaaaacaaaacacacugacgugaucuccucacuguaaguuaggaacuuggauuaaaucagaguuucauacuuuaacaaaaugaaaauauaugugaauaccaucuagaagaguaaaaacugguuuaaccagaccaggucccucucucgugggucaccuugaguucuuuuacuucuuucuguguauuugaaaggguuguuuaucugcauggcugugucaugcacguagugcuuuaugcugaguuuccggaacagagcugugacaucccacagcaucauuguuuacacugcauucgugcuauaccuagcuacucguguguuguucucguggaccaaggcagugcuguaaggagggcaggugguuuaaacugcugcucagcagugcugaggagauugcuuugagaugauuuguaccuuucccggcuccuuuucucuauuucuucuacauuuguaugaccuacuucugugaggucgcuggcugggacuuggggugugcucaaaguuuuagaagaguguucaguauucuucccaaaugcagcauauaugaccuuggguuuuuauugauuuuuaauacugugucuuccacucuuuuuuuuuuuuuuuuuuuugagacaggguguggcuauauauaccagguagauuuuagauuugugauccuccugccucagcuucccaagugcugggauuacagaugagcaguauucuguaagugggaaaagauuaacaguuauugagucuuaaaagccugcacuuugccagguguggugcagccauuguuuuauuugguaaaacaggacuggagagauggcucagugguuaaaagcaccgacugcucuucugaagguccugaguucaaaucccagcaaccacauggugguuuuuuuaaaaaaaaaaggucgaccucauuuggugaaacaaugugaugacguaagacuguuuguggaguuuauaggugaggaaacauuaggcugacacuuggcaaaagugaccagguuuagaagucacgugguuuagaagcucaggaccccugauuccaaagcugccuuuauuacaucucacuguucaacagcuguccauggaucgaucacagcaucuacaugaauauucugcuaauguugaccucucugaugugguauucuguaugaguucauucaugaugugaucuguucuuggaaccgacugacucaugcguaaugauguuucugcaccaacucuuuccaaccccagccucagaugguuuacuccauaaguuugggggucagguugggugauacagauaggaaucuaaaacguauaacauaggggcuggagagagggcuucccaguuagaagcacuuacucuuguagaggacccagguugcuuucucacugugucuccaguucuagggaccugugcccucuucugacuucuccgggcaccaggcacauauguagugcacauacaccccuacaggcagagcacucacucccauacagugaagcauaagauuaccuuaauguccaguguagaagcugugccuagugcuauugugaagguacaugugagccacucagaagcauaagaagggaugccucauggggcgaggucuuaagacuucaggaaaaggcucugcgcugaaaggguccugggaacggggacugaggggcucaguaccaggccguggggcuuggucaugggagaugguuugccuguggcacuggcuguugucagaucuuggagagcugucugaaagguuaggcguuucuacucugcccgugagagagauugaucucuacccugcagggagacuuaggacuuaagaugacuggcaggggugugagcaccugcggccugggaggaagguggcgcacacugcgggacagaguaggaggcugcugcuguuacagagguccguggauugaggccuuccacagugagaagggggugagcgggcacacugagaauaagcaccgaggcauuaagccagucugguucuuuucugucugucugucugucugucugucugucugucuuuuugccuuaucuuuucucuuuuuuguuugaagugagaucucacugugguagcccuagcuguuuggcugcccuagaccucuguaguucaaguaggccucaaacucgccgauuucuccugcuucuguuucccaagugcuggggccacaggguugugcugucaugucccaugcuuggaugcuugacuaauuaauccaguucuaacaucgcugugacgcaggagagaaggaggagacauaaauccguggugucuaguuaaggacagggcugauuuugggauuggacaugagcagauuuuagagaaggcaagauacugaaaauguaagucuggugguccagcucuguugguagaguucuuaccuagcuagcaugcacgaggccccggguuccauccccaggaccuguuuaaucagggauggugaugcuuuucuguaucugagguuuggaaguuagaccguggaggcuaagaagcuugacguuaucuucagcuacauagaguucaaagacagccagaguacaugaaacuuguaucacagacagacagacagacagacaaugaaacuugugucaaagacagacagacagacacacuaugaauuugcuuggugauucucaccuggccuuuguacuccaauucaucucuaccuccucccaccaaagaucuauuuauuuauuuuauuuuuuuaacuguguguguguggggggggggcggggguguccgugcaauugccuucagagacaagagacagguuucccuggaccuggaguuacagaugguccugaggccucugcggagggugcugggagccaaacucaggcccuuugcaugaauaguguuugcuuuuaaucgcugagccauccugucgguccuuuuguguccucuuaaagacgagacacaaugauaauggugacgugagcugacacucaaggacuucuuuguuuuaagcucugaacuccccuaccaccuuugcuauuauucucuccauuuuacagauaggaaaacccagguuaauagaaauuaacaagcuugccgaaaggcauguaaacaggcaaacaguuuaccagcugaacuacauuccagcugcaaggcauaagccaguuuaaugugggaucuggauuccaauccagagccuaagugugaaguucucagucccuuugcuaaagcaccauuaggaacacccuuacccccauaaugaguagggaagaggggcagcagaaacuagcagacuuuuauacuccaguuguuauagccaaggguccaggccucagauagcccuggauacugaugaaggcaggaaggcaucuguagugagccagugacaugucugccuuggggcauuuaacucugugggcugauaguuugcugacugcauuccaguaccacugagagcugcuuccaggcagcgucauuuuccucaaaggaagcagauaauaugcaggcacaugaggcguuuuuuuugaugcuauacccuauaaaggaaaauaaaauagccugaagaauugaaaaacuggggucaguuucagggguggcuuuuuauuuuauuuuucuacuuacguguaugccuguguagauauuaauaggugauugugagccaucauguagguauuaggaacugaacccuggucuuacauaagcgcuguaaaugcucuuaaccacugagucaucucuggucccccuccacccccaauuuuuuuuuauuuuagcuaaggucucaauauguagcucuggcaagccuacuguguacaccauagacuggccucagacucacagagauccaccugccucucccucugagugcugggacacaagucacuuguuaucacagcuggcacuuuugaggggagccagugaggccuuguuacauacugcaggcuggccucaaaucccugagcucagaggauugucuugccucacccuccugaguagcugagacuauaggcacgagacacuacacuugacuuagaagaaggugucuuaaaggugugugccugcauguguguaugugaguguguguacacaugcaugugugugugugugugagagagagagugugccugugugugcauauaugaagaccauagguagaugucaggugcuuuuugcuugcuugccauccuuguucuugagauaggcuuucucauuugucuuagucaagaggggagaaagauaagaugcugggccugggguggguuuuuugaaaccucaaaguccacuccaagugauacacuuccuccaacaaggccacaccucuuaauccuucucaaauaguguuaccccuuguuuuuuuguuuuuuuuuguuuuuguuuuuuuugagacaggguuucucuguauaacccuggcuguccuggaacuugcuuuguagaccaggcuguccucaaacucagaaauccgccuaccucugccucccgagugcugggauuacaggugugcgccaccacgcccggcccugaauuuagguccuuauaccuuuauaguaagcucuuuaaucacagagccaucuccccagcccagaguuuugagaagaauuuaagggacaauagggagcuguuuugggacagauuguuccuagggacucagccaccuuggggcuugcugucugagggacacaguggugagagcuggagucuuacuguguuccccaggccucugucaguuugggcugccuucccauccuuuccgaaugacaguauuugggcuugggaugcuucuuacuguggcagguguaauugcuguugacccguuggugugugcguggccguuuccugcccaugugcaaaucugauaaacccguugaugucccuuugagcaaucucuuauguauaguugcccuuuuaaguaccuuuaaaaaacagaugugcuuuggguuggaggaauggcccagaggcuaaagugccugccgcgcaggcaugguggugacuuaacgacaugggaguucagagucuccagcaccugcagagaaagcuggugugguaccagggcuugguccuagagcugagcaguagagacgagagauucccccagacuugagagcuagccagcaagucagcugaguccaggaacaugagguucagggagagaccaugucucaaaaacuaaggcagcagaagugaaucccaguggugggcuucuggcccccauagcgggguaugcaccugcacacagguugggaacacacaugcugugcuuugccuccucuccaugagcaaauguucuuuuuuauggagagagggaugggaauagcaguggguaucugcgguuggaguccugacagcaacuuuucauuguaaggcaacagccaagcauguuagcagaguucacaagggcagaaaucugguucucgaagcugugcuguacuuggcaacugaacauaugguuagaauugagcuuguuuggagcucaccacuggccuuggucucacagagguccgcuugccucaguccccagacugcaacugaaggucaggggcucucacuguaucccacccuggccuugagcccagggcaagccucgugccucagccccuaaacccuugggugguaggcauaaaccaccuugcccuacuugucccuguccuaucauaaagcacuuugcugugguuccaugugcaguuuguuuguuugcuuuucucuugcugauuggugcaacuggcaaccugagacagcuuauacuuauuuuuguuuucuuuuugagacaggugucacuaugugaccauggcuggccuggaaugugcuauguacaucaggcuggccuugaauucaggaauccaccuguuugagcguucccagugcugggauuaaaguugugugcucauacauguaguaugaggcuuacauugugucuucgucaggguuuuuauugaugggauaaaaguaacuugggguaaaggaaggguuuauuuccucugacaacucucacgucacauuuuaccacugagagaagucaggucaggaacuggaguggaauccauagaggagcagcaguuacuggcuugcucacugaccuuccauagcccaggaccaccugccuaugguaugcagcugcucacggugggcugaacccuccuccaucaauagucaaucaaggcaaauuuuuacagaaauuaccacaagccagucuguugaggacaauccccucaauugagacuuuucagauggccuaagcuguguuaaauugacaaaaacuagcuagcacacaaaugauuuauguuauuaaagaaucaguucucuccucuaugaggaggaagucggagagaaagguuaggaggcacugcugaagugccagggagagaugacgugggagcagcuggguuggugguggggaaggugggucagucagugguuugggaaccaggauggcugugggguugaguugagggugccagaggacucagauggcuguugauucuaagucuggguaggaggcaaaaggcugguguggcaacauacagcuucaucucauggcaauguaugucugcauuuagucagagaggagagggaaggaggucauacuuugucacgcacagccuagauguugcacauagcuuugguugguugccucucucugggcagagccuuggccacuuguugggaaugcugagaaacaguugucauugggcaacugccugcucagccaaaaguuuucaugugagaaagagaagacagugaccuuccugguuagccccuucugaaaccccaccgcccugaggaagaaaacccaaggaaacuguagaguccaggacccuuacgugggugaaggcaccaguucucucccucccgcccuuccccucgugugcugugggagggcuaggguguuggaaauaaagacgcccgcccauugaaagaggauagacuguagcccuuggggcaaacuccuucuggacccgccagggccaccagugcgggcuuucugcccuggugugguuccugauaucccaggcagcagcccugcuucuggguacuuugguggcaccuccuugucccugguuguccuaguuaggguuucaguuguuccgaugaaauaccaugaccaaagcaacguggguuuauuucaguuuacacuuccagggaaugcuuuaucucugacggaagucagggcaggaacucaaacagugcaggaaccuagcucuuccuggcuugcucagccugcuuuuuuauagaacucaggacccccacaaaggcuuguucccucccccaucaaucacaaucaaucaagacaguacaggcuucccuccaucccaguuuuauggaggcauuuucugaauugggguucuccucugagauggcugaaacuauccagcacacuuguuacugucucuauucuugggcaaagucugaagcuggcccagacaccuccucuucaugagauggcguuuucuccagaguccaucccuugagugcugacgagguuguuuuuucuggucugaguaaaccugcccugugcacaggcauuccuuaggcagaucauagugccuuuuauacuugaaugcugauuggccucaugcguggaacuacuuccuuacaguggcgugaagccaggaaauaauuagaucugaaucguccccgcagcugcccuacaguuacaggcugugucggcgugucagcuguuuuuuauggugacauggacaggacacgguguauggcguggcauggcaugcauguggaggucagagaccacuugcuagaaaugguucuuucccgcugcuuucugggagccagggaacaagcuugggagcaaguacuucugccuguucagccgccuuacaggccccggugucauuauucuuaccagauguuuauugaagcuuaauaaggaucaccugcuuucugcucugcugcaucugugcccaugcugaccccaagucaaggucauacauauaacuuccggguccaagaucugugugguaguuaugguggugauuagcugauagagcagacaguccagaauaauaauggccuaagcaagauagaagcauagcuuuggcuuuuguguguguacgcgcuaucugugucuuuguuucuuauuuauuuauuaugaguauacuguagcugucuucagacaccccagaagagggcaucagaugcuacuacagauggucgugagccaccaugugguugcugggaauugaacucaggaccucuggaagagcagucagugcucuuaaccacugagccaucucuccagccccuguguguuucuuauagguguguguagauguguaagugccucugcaggccagaggucaagguucagugucucagucuccuuuguaagucauguuuuuuuaaagaugugucucugaaucuggagcucacugauuggcuagauugccuggccagugagcucuagggaugcagguggcucuacucccucccuaaguauugggccuaaguaugcaugccuggggagccacagcacagcauccguggaguaauucucuucuuucaccuuuacguaggcuugaacucagguugucagagcuacauagcaagugcugagggacagauguagaggugacuaugggauuugggauuuggcagcgcagugauccacgaccuuaauaggacaaguuggccuaagucagaagaaaaugggugggggagcuaggaagccacuuguggcuauugaugggagccauagguuuaacugaggguuuggaggguagguuuuuuuacauuuuauuuuucccuauuauuauuacuauuauuuuguuuguuuguuuguuuuucgagacaggguuucucuguauagcccuggcuguccuggaauucacucuguagaccaggcuggccucgaacucaaauccaccugcccuugccucccgagugcugggauuaaaggugugcgccaccacgcccagcuauuuuucccuauucuaaucacuacuuuugucuuuuuuuaaaaaaguuaaaauggggcuaaggggagacggcucauugguuaagagcacugguuccagaggauggggguuuaauuucuaagaacuacacaguggcuuauaauccuguaucauuucauuucaggggaucuaaugcccucuucuggccucuguaagcaccugauacacuuagacacauaaaauuaaaaagaagauuaaacugggccaaugucuuuauuguuuccagcagguuugacucaguguuuacuguuucucuccuuuccuuugagguaggaagucaaugugacauuggcuugcuuucugagacaguguuuuacuauguagccuuguuuggacgagaaccagaacucaguauauagaccaucauaguacaugucugaauuuagaaacgucagcuuggguggugcaugcuccuaguugcagcucuuggaaggggaaagcgaggcaggcuguuacaacaacaaacauaaggcuggugauaaacauggacgugguggacaucugauuauuauuaauccauuuaauuucagcaaauagguacugcaugccuucucagucaggguugcucauacugagaucagggauaagggaguccugguccagcagugagcucgugugguaaguagaugugaggagcugcuguggauguguggagcaguucaucucagugggaauggugggaauggguggggacaggagcggcauggguacacagaaugggccacggaggauaaaaugugucagcucuguccuccuggggcaaacuggucauucuuuugaaauugcuuagagguguugaucugagaugguguguguuugguuuuguuuuuugaggcaggguugucuuagguugagcccagacuggccucagguaggugccucagucuaaaaguguguaccaucaugccugggucugaaaggcuuuuuuauuuuuuuauuuuauuuauuuauuuauuuauuuauuuuuuuuuuuacaaaacggugcacugcugcuuuuuguauauauuuuuaauagauuuauuuauuuaccuuauuuacauggguacacugucgcugucuucagacacaccagaagagggcgucagaucccauuacagaugguugugagccaccaugugguugcugagaauugaacucaggaccucuggaagagcagucaguguucuuuguuuuguuuuguuuuguuuugauuuuucgaaacaggguuucucuguguagcucuggcuguccuggaacucacucuguagaccaggcuggccucgaacucagaaauccaccugcuucugccucccgagugcugggauuaaaggugugugccaccaccgcccggcccagucaguguucuuaaccacugagccaucucuccagcuccuaagaugugaucaugaggcucagguaaccccaccucacuguaccauuccagcagcagcagcagcaguugagcugagggggaggguuugagagaaggaaaaggcauuucauuaaaauuugguuuucuaggcuggagagauggcugagugguuaagagcacccacugcucuuccagagguccugaguucaauucccagcaaccacaugguggcucacaaccaucuguaaagggaucugaugcccucuucuggugugucuggaaacagcuacaguguacucauauaaauaaaauaaaucuuuuuuaaaaauuuguuuccuguccuuaauccagguucuguggccuugacuggccugcucacugaugugucuccacuggaacauaggcucccagcucaugcucauuguuagccucuuucuagcacagggcugggcacagaauggcccaugauaaauguuuuuaugaguagauggauggacagaacaagacaguugucucuuuguaaccuaguuuuuuaucuuguguuaguagauuggauauaccuuacacuaagcccaggauuguacaucuuauuucuccagucuuaauaaaacuuugguguuuuaucauccacaguaucuauuuugaucaugucuuuaaaaaaucauuucuuuguuuuguuguuugaacaggguuucuuugugugaggacuuagguuggucaugaacucagagauccaccugccucugacucccagguacuaggauuaaaggcgugcgccaccauugcccauuuauuuuaaaugaauguuuugcccucauguauauaugugcacuguguguguaccuggugccuuugguggccagaagagggugucagaucccuguaacuggaguuacagaugguugugaccggccaugugaguacugggaauugaacacugguguucugaaagagcacugugucuccauuccuccaucuuguauuuaugguauaaagucuuguuuucaagaaauaugaaucauacauaaggccauaacuuaccuaaaauguuuuuuaaaaauauaauucagccuagcagugauaguacacaccuuuaaucccagcacucagaagacagagcagguggaucucugaguucaaggccagccuggucuauagagcagaauuucaggccagccagagccacacagagaaacccugucuugacaaauggaaaaaccaaaaaccaaaaaaaaaaaaaaaacaaaaaaaaaacaaaaaaaaacccguguguguguguguguguguguguguguguguguguguuuuauccaggggccacauaccuuggcgguaaaugcacuaacugcucuuccagaaaacuuggguuugauuccuagaacccguaugguggcucacaaucugcaauuccguuuucaaggaauuugacucccuauucuggccuccgagggaaccaggcacauagguagugcacaggaaacauagguaggcaaaauacucauauaacccauaugucuguguguguauauacauaaacaaacacuuuuuucuuaccguauuaguuuuuuuuucuuuguauuuuuuuacuagauauuuucuuuauuuacauuucaaauguuaucccuuuccuggucuccuucugaaauccccccuccccuuaaccccucccccugcucaccaacccacccacucccgcuuccugaaccuggcauccccuacuggggcauagagccuucacaggaccuagggccucuccuccccuuaaugacgggcuaggccauacucugcugcauauguagcuggagccaugaguccuaccgucuguacucuuugguuggugguuuagucccugggagcucuggggguacugguuaguucauguuguuguuaguuuuuguuuuuuuaagacaggaacuuaauauaaagcccaagacaucuuugacuuugggguccuccuuccucagucugccaaguauucuuauagagguuuuaucuguaaacaagguacuaaguuagcuauaaauaauguauagacuuaaaaacagcaaaauaacccaucagguauuuagguuagcuacaaauaauguacagauuuuaaauuuucaaaaaaauagcaaaauacauuuacagagaaaauuugaauuuauggauggccuaauguggaaaauuauuucugggauggaauuaaaaauuacuagaaagugaaaaaaaccagccuuuguuauuuagguauugucccaucugcccaggcugccucucaaguggguggagucacggucauggacgcccaccucaucguuggcuggaacgcucugugcgaccgaacaguacaguuucccugaucauaauauugggagacaguauggacacagaaaaaaauaucaauuaaaauuuuugaaugagaugagagaaauaugaagcuguuaaaagagaaauaauuuuucuuuaccacauauaagcucuccuaaaagaaacuuguuuguuuuuguuauuucgugauuaaagucagugaccacuccugcugagcaccagucuuagugcucccaccccagggaaaguacacuuggauugaaacaaugguggucuuguggugagacaguuaaauacuaacucugugucuaagucaggguuucuauuccugcacaaaacaacaugaccgagaagcaaguuggggaggaaaggguuuauucagcuuacacuuccacauugcugcucaucaucaaaggaagucaggacaggaacucacaugggguaggaacuuggaggcaggagcugaugcagaagccauggaaggaugcugcuuacucgcuugcucagccugcuuuccuguagaacucaggacuaccagcccaggauuggcaccacccauaauaaguccuccccccccaugaucacuaauugagaaaaugccuuacagcuggaucucauggaggcauuuccucgagggaggcuuacucuuugugauaacuccagcuugugucaaguugacacacaaaaccaguuaguacacacuguuaacuguauacauauuuagauaugcacauauguaugguguguguguguguguguguguguguguguguauguauacacaugcuugcuuaccugugggaacuuguguucuuggagaccaggggagauuacuguuauuacugaauacuaauguauucuccaguugcccaucuuucucauuuucaugaauaagaucucacuaaaccuggagcucaguuggcgugauuggcuggcuggcaagcucuaggaaucugccuauccacccucccccauugcagaugcgagccaugugcccagguuuuaugugggugcuguggagccaagcucaggucccuaugcuuguguggcaagccaucuucuucgguagagugcuggucccuucuccuggggcuugucacuuacugagucuguuuuauggaccaguguuagaagcagcuucugcuuggcuuuggcucaucgacucuaagugagaucaaagaugcaaguggcaccugcagggugcuugucuagccugaucuuucuggugucgacacaaaacuauagcuguaagaaucuacuuuuuuuuuuuuugauuuuuggagacaggguuucucuguauagcccuggcuguccuggaacucacuuuguagaccaggcugaccucgaacucagaaauccaccugccucugccucccgaguacugggauuuaaggcgugugccaccacucccggcuaagaaucauuuuuuuaagcugaauaccgugguaccuucuuguaauucccauauugaugaaguugaggcagaaggaucacugaacguucaaggcuagccugggcuacacagcgagaccuuguuucaaaaaaacaaaccagggcuggugagauagcuuaguggguaagagcacccgacugcucuuccgaagguccggaguucaaaucccagcaaccacaugguggcucacaaucauccguaacgagaucuaacucccucuucuggaguaucugaagacagcuacaguguacuuacauauaauaaauaaauaaaucuuaaaaaaaaaaaaaaaaaagcaaaccaaagggaaaggagcugagggugcagcuugaguggagacucuugugaaugcguaacacccuaggcucaaccccagcacuagacagaaaccccaaaggagccaagggugguggccuaagcuuuaauuuuagugagacagaggugggcaggcaggcucuagguuaacaggcugccugcucuacuuagcaguucaggccagcagggauauacagugagauccugugucagaaaacaaaaaucaaccaaacaguaaacuccaaaccaaccaaacgaacaaaccaggaugcagugcagcuaaaacagccuccuuacagcccuacaaugcuucccaagggaggcucuggauccuucugcuuucucugucagcucacagaggugaugcgcaggacagcagcuuugcugcacgcacaauguuaacagaacccaagcuaaaggaaaguaguaucugagccucaaagagaucaaagugcagaaagauggagagagcucuggguugaaaaauauugauacgugugugaugugugucucugggaaacacuugucaccugucuuucucagggacuccuucauuuguucagcaacuguuuacuaagugcucucugggugagauacuguuaggguugcaaggacguaggacgaauaagaauggaccacgccccugucagcuagggcuugggcugugcagauaguaaagaggagcuggcagauggagcagaauaucagccuguucugaugcuuaccugcgaggucaguggcucuuugucaacuucuccuguaucaggaacucaggucucagagaggaacccagguagguguggguacagccgagguugaggcuagacccagcuagaagggcucugguguuguggccgacuggagauggaaugguauuugcucacuccugccuguggauucugcuguauuuucagauggagugguaaaguguuucuuccuucacccuucuuuccuuccuucucuacaucguccccucuuuguuuccuccucguguaucugugcaacacagggccucauuaucuaggucagucuguccuggaacuuagcauccuccugccucagccucccgagugcucugauuacagcguauacugccacagcaagcucaggugccuucugagaagugucuagaaccugugggauugucaguggugaaggagcuucccccaagucucagaaucugagccugaucuuugggccucaugugguaagcaugagaccauuaugccauggugugucuagcuccuuucccaaaaucaaguguugaugaauauuuuggaaaaaccccugcccuuugcaucuuuuggggaacagggugcccucuuugacuacugagcuuaucagggcccucacuggacuuagcucacuaccuugucuugcuaccuagcuagcccuaggaucugcaucuccgucuucugggggcuggguuugugggcgaccacacccacacagcucuuacguggauuuggggucagaacucugguguuuaugcuugcucagcaaaguucuuuauccauugggucauuuuacaaaccccaaagcaaaguuccucaaaugaguuaaaaguguauaacccuugaaccuggacuaggccuuccagccaggcaguuccugcguaugagcagcagcuucacuguuccaggguaaaguacuuggcugccuuuaaaaaaacguuguuuuuuuuuuuucuuuguagguucugguuuuuuaugcauuaaguuucuuuauuuauuuuuguuuuuuguuuuuucgagacaggguuucucuguguagccuuggcuguccuggaacucacucuguagaccaggcuggccucgaacucagaaauccaccugacucugccucccaagugcugggauuuaaggcaugcgccaccacacccggcuucaccugcuuccuuuuaauggcuuucaucuuuuuugagaagucaugcccucuuuagucccaauuuuaaauaugcucccuucugggaaaagugcaggauuuucccaucuuucuacuuugcuuuuuaaaauucccaggccucacuguaaacuuagaaacagucagcaacagccacgugugugucagccuagcugcugcgcuccuggagccccucuacccuuguccccuucuucuccauucuucauuuaguguuuuuaauacagucuuacuguaucucaggcugaccucagcaaugcuccugccucggccucccaagggauaggaguacgggcaggcuccacugccucccguuuauaugaguuucuugcagguacuccuaguuuaaccucuagcuccuuccauucuuguguguguguguguguguaugugugugugugugugugugugugugugugucucagucuguuuaccugucugugcaucugucucuguguguguggaagccuauagaugccaaagguugucuccuaugcucaguauccuuuuauuauuuauuuauuuauuuaguuuugguuggccagagacuuuugaguccaacaauucuaccucagcuucccaaggggcuggugcugcagggcuauaucuccugccuggcugccuugcucucuugaagucucuugcauucuugcuuuacagaauuuuaucucauguagauagccaggccugaaaucuaugcuuuccacuacuucuucaugccucaauuccaaagaaugaccaagguuuuuguuuuuuuguuuuuugaccaaguucuuuguagcacuaauuaaaugugccuggacuugaccgucucucuuccauguccuuaugccagucuggugucuugucccaccuucgugcucguccucacagugacugccauggucgucuaucucaguugcuccuuaccuucaugagcaaguccagggcaucagggugguguugcuagugggcgugucucagccugccugcccugacuugugucuugcuugucggggaagcaguguggguuccugcagauccaccugccucugacagugcaccucuguccucaccccagcggguuucuaccugcucugaaaaagaaacccagucagcagugagcacagcucaggcgcucagcgugcugggucuucacaguuguuccugggagugacggaaacaugacacuaagacacuguguaagagacuugaauccugaaaacccagaagugaagaaagcaagaugcugcuguccacacacuguugagcauccuggggaguggaaguauuuauaagcagaccacuguaagccacagugcagcuugcugagcuuaacaaagauggagguuauuucaggaauucaggaguugccuucugcaacuaggaacagaaagauggcugagucacgcuccccagcuccuccaucgccucgucacagccuugcuugcccucucguugccucaccuccaugucacuccagccuucuuccagacguccuagcucaugucccucguauacagcugagcuuggcuagaguauagacaagcucaguuucccccuaccuguuuuuuuuugaaacauggugucaguaguacaagcuagccaugagcuuacucucaugcuccuauuguagugcaugcugcuaaauucaguucucaacuuaaaaauaaaagagauuuauuuacuuauuuauuuuuagguuuugguuuuuagagacaggguuucucuggguagcccuggcuuuccuggaacucacuuuguagaccaggcuggccucaaacucagaaauccaccucugccucugccucccaagugcugggauuaaaggcacgugccaccacugccuggcggauuuauuuuuauuuuauguauaugagugauuugccagaaugcuuguauguguaccguaugcaugucugcaguaucagaaguagcaucagguucccugaaacucgacuuagagaugguugugagccaccaugugugugcugggaacugagccagccuccucugcaagugcucuuaaccagcgagccgucucgucucuccagcccuuagcucucgacuuuguaaucugacgauuuuuacauuuacagaaagguugaauaaauugcuuugaaucaucagcuacuaauguguucacguuuucucuuagcguauaaauuaguguacacagacacacuuggcuugugcugaacuguuugcagguuuggucgccauagagauguggggacugggcgguggugcugaaggucucauuaacaagcgagacaggaccagaaggagcagggugggcugcagagcaguuauguggacaggagcgugucagaagagggggauuaguccucuuccccaugugcugugcgcagccuguggcaggcaguuccaagcaucacuucccgguuagguaggguuuggaguuaguuaugucuccgcccugucaccuggucuuggagggaaggugggguggaacagggugacagcaaguguuugcagguuuuagagguguaguaugagauuugcacuagcaguaguguggauacagaggaaaucggugcaugucuuguagcaacuggauuuuuaguucagcuucuacaagucuacuguaaacccugaaaagcauagaaacacacuuaguuuuaaaagccauggaugugaggcaggagagacggcucagucuguaagaggugucacugcuauuccagagucccggauaagaggguucacagcugccuguaaccccuggccucgaggucugcuucaugggcaccuguauauacaugcuugugaaagguucacacagacccacaaaaaauaaauauaaaucuuagagaggaaaaaaaaagaagacaucaaagugaacacagcgcacccuacuuuuguauuauuccuggugaggauacaggaugcugagcucuccgugggcuggucucccugugaggcugugacacaggcacgcguccgugugcucccuucccauacugccucugcccucaucccaugcccuccugaccuuguguccugacugccccuuugcuuuuccuuuccuggucuauuuagaggacuuugaggguaggaauuaggacucaaguggaacaucuucuucaacuuuguggcacacaguaggcacuuaucgacaugccacaaggaauucgugguaggacaggaugcuccuguccuauuguagccagaacaccggguggauguucugugcuccacugugcaccccucaccagagaggucaguauguucaguguugcugaucagaggguugaggcaguguccgacaccagcagucuguacaaagcugacuucuuaaacuagucagcggcagugccaccuugucaccguaggaaugucuuguguggagacaggugaugugugggaagucacaguccagcuucaaacccugcacuguguccccugagcuguguugcugagcaagucacuucacuggaggugguuuccucacuuguaaaaugguaguggagugugcggaccccuggguuguuaacugagcuuacacaugggcuauagagcugcaucuggcccaugggaagcagagggcuaccucaguuaauuauucacuuacuccuuugugucaggaucaccaagagccuccagaagugacauuguaaguagaaagauuaccaucuguccgucgucccugucccauccccuuccucuucguaggaacagggguagguuguugcugagaucugggaggucucgugugacugaaaaauguguagacuaucuuuaggagaacauccuaaagacuagaaguugugagugaugucugucuguguguuggaauuuauuuacuuuguaaaauuuuaguuggaaauaaggauuuuugcagacuguauuuuauuaaauuuaaagcaguauuuuguggacccucccgacccccacaacgagcuaaaacuaagaggagcaguuugaucugcccugcccuggggcuuucccugccuugagucuaguguggguaaauccggaggagggggugggaccuacagcaucaggagagccauuaggggaaacccuguuguagugucagcuaaaaaugugaccugagacgggcagaauguggcuccuguuuagggucuggggcggggcacagccguggccauggaacugccacagcuguuucuguuucaugcuuuuccauuuuugaucugugacaaauggaaaaggaaaucuuuuaaaaagaaccuagguuuaacuugagauaaccagccauaaaaaguagguugaguaaagaaaaggaauuuaguaauacuuggaaugcugggacuggcuacuuccucccucucccucccucccucccucccucucugugcguguuuguguguguguguguguguguguguguguuagggguguagggggacugugcagauguccucugaggacagaagagguuguuggaucccuggagcuggaauuauaccugguuauaaucccccauacaugaguguccaggagcagugagggcucuuuguuucuuuguguaguccuagcuauccuagaacgaacuguagcccaggcuggccucaagacucagcagagaucugucugucucugccuccuacgugcugggauuaaaggugcacuccaucaucacccccuggccgcagcaacuuaaaaugucuuauuuuuugagccgcauauugacgcauggucacacaugcuuuuauucucagaacuugggaaguggagacaguaggaucagaaguucaagaccagccuuaguuagauaaugaguguguggucagccggacuaugugagacccugucuucagacaccaagccaaaccaaaccccugauuuuggguaugcccagcccuuuaguggagucauuagcaagcacagugcagugccaacagccaaggcuacaaagcagugggcagauauggcagaaagcugcaguguuagugugcucugaagaaauguaguccuaaguacugaaaauacuggugguguaaagccagaugcaaaagugacaaaaauacaagaagauaucuguguuugaaaacuagaauaugcaggaaucacuaaagaaaaucagggaaucuuugagaaugggggcuguucauauuaguauuuauauaaguguuuucaguaaugucauuaaaaauuuuaaaaagaacauuuauuuuuauuucaggcuagagcgauagcucugugguaaggucaguagaucucuuccagaggaucuggguucagucccagcauccacaugaagaucuguagcuauagucucagcagaucgcucucuggccucuaaggacucucuguggguuauguggugcauggauguagcgugugggcacaacacccauaugcacacaauaauaagauacaauggaaacuuuaaagaguuauuuuuauuuuuaauuauggguguuuguuugugugcuuuuggcaagugugcagugucagaggaggccgaugagggggaaucccuugggccuggaguugcagacaguugugagucauccaucgugcaugcagggaaccgaauucaagucccaucuaagcacaggcugcauucccagccgccgagccagcuccccagcuccgucguacaucaaaacuuggcacacuuaaauuucaugaugcagauuuuaucucuuaguuuucaaagaaaaucauaccuugagcuggagcugucaaccugagagcugagugcuugcuaagaguguggcacgccccaugcucaggucuuauugcugaaauuaaaacagaacacagcaacaaagaagucgggacugggagauugcuugguggauaacaugcuugcuguaaguguuuagggaccagacuucagacacccagcacccugacaaagccugcguggcuguggcacguuugcagcugugcagggggagacaggugugggagaucugaauuccgguccucgagcaagaacuuuaucaacugagccaucucccuagcuucuccuaaucccuucuucaaaagauuuaaugugcuuaaguaaacuugagauagugaccugugugacauguuucaggugaagcgauugguuggcaugucugaggcacaggccgggaggagacgcuucuccucucuggggcaaggacucagggcauuuccuuggucuaagagagguaaagggcacagguguugcacagugugagaaggacacgcauuuccuggaaucuguccuuguuaggaaucgcuggggcuggagcuuuguccuacuuauuccugguaggaggagugugugugucuggggcugccucauuucugagaagccuguucacaucuagugcuugguauacauguauaaccucagggugguggugcgugcaugugugugugugagggagggagggaggaugagugacauaggaaaugcugcugugacccauccuauguuuauuuguaauuacuugguaacugaagcauucagagaauggccgauuauauuuucauuuugaucacauuaaaaaaaaaaaucaggggcuggugagauggcucaguggguaagagcacccgacugcucuuccaaagguccagaguucaaaucccagcaaccacaugguggcucacaaccauccguaacgagaucugacgcccucuucuggugugucugaagacagcuacaguguacuuacauauaauaaauaaaaaaaaaaaaaaaaaaaaaaaaucagccuaaacauaaacuuugugucuugguguaucuuuuguuucuuucuccuauugggugaaauagacuuuucuuuuaauuuuuuuagauuuauuuuuauuuuaugugugugaguuguccugccugcauauauguauguguaccacaugugugccugguugccacagagucuugaagagggcaucagauucccugaaacuggaguuagaaaugguugcuggaagucaaacuuuggucuucuguaagaacaaaguacauuuaacuacugagccauguagccucuaaaucuuaccuaucuaaaaugacuacauaaugccauuuuguuaaaauaccagguuuugauuugcgguggugacacacaccuuuaaucucaguacucuggaggcagagacagguggaugucuugaguucaaggccagccuugucuauagagcaaguucuaggacagacaaugcuacacagagaaacccuuucuugaacagauagcucucgccaccacacacacacacacacacacacacacacacacauauauaaccaaaacagguuuuaguguguuggguagugagcauauuggaaauuugcaguguaacauagagcaucuuggugagccgaucacuguauagguuucaagaguaaggcagcagcuucuaagagcaucaguuuggggcuguggacauggcucacuuaguaaagcccuagcuaccuaagugugaggaccagauuucagguccagaacccacagagagccaggugcagugccuugucuucacugcuuuuaugcugggguggaaggcaaagagaagaaacuguuguggaggagcgcaguaaagaaacugcugacaugaucucugugcuaggggaggcuuuuauuaugaguaaagaggaaaguacccaggggcgucuggaagaguccagagcagagcgaagagaaagcagacuggacuuggucaggccuaaggugcuguggguugcccuggugcuauuugugugcaacacuagggaagcaggggaguagggguggggagagggguguugggagauagcaagagagccuagccagaguacagagagcagcaagauagugcuugaguguggggcagacaaaucacguggguugugaggaggcugauaagcugggaggagggacucuuucuggggauagaaaacccuuucacaaguuccugaggaaugcuagcuuuucucuaaccuccagaaguccugcagccugugcuccugcuuaagcucauuucuagacauauggggagggaggugggggugcugagaccuaacgauaccccccccccccauggaugggcagcuagcauguccuaugcaguggggaacagaagagagcuagcuuaaacuaggcagaugguaaggacuaaauuugagguuuuccucugacacacacacacacacacacacacacacacaacuggaacauuugcuuugccuuguuacuuuucugaacacauucuuuuuaaauuuauuucauuuauaugaguacacuguagcugucuucagacacaccagaagagggcaucggaucccuuuacauaugguugugagccaccaugugguugaugggaauugaacucaggaccucuggaagagcagucagugcuccuaacugcugagccgucucuccagccccugcacacauucuuuuuaggugucuuuggcuccuaagcuuggagaugguuuugaugguuuuaguacacugacgucauuguucuuacaggugguuguguuucuacugucagugacagaauguccuuucucuccucuucuguagauucgacggaggcgccuggcacgacuugcugguggacagaccucccagccgaccaccccgcuuacaucuccccagagggagaacccuccgggaccuccaauagcugcaucagccccaggccccucccagagucuuggucucaauguccacaacaugaccccagcuaccucccccauaggugcagcaggugagccucagccuccaaccuggaagcuguacuuuggucucagcaucucgauguugccucacugauuaaagcaaucaguggccugaaggucacugcggucggugugucuugcuucugucuguucauuugauagugacuagugaagacuucugcaaacccaucuccuuccccuucuccagcuccaguuccucuuccagccaggcucaggucuggcgaagacugaguugcuccugcugaguuugugaauuuggcugaugcuucucccuccaauccccauucucccucucuauaggcaugggcuccccuaaagacugcucugccuucccauaaugcugucuggggguuagggagcgcacauggugggcaaagggcuuccugcacgggagugaggacccccaguucccacagcacguaagacuuacggguucaggaggucaugccgguaacccugacacucaggagguagacacagggagggacauucuaggacacuggcgagccagucuaacaaauaggugaguucuaguucagugggagguccugucucaagaacaugaaaggaagagacccaccaccaccuucugaguguauagugcacauaugcgugcgacacacacacacacacacacacacacacacacacacacacacacacacacgaucaaaaaguaaucuguaaauggaagagugaaguaauggucgaauggcaaggcccugguuucuugucuuugugcuacauuggcacaaaaguuucuagaauugaguggauaucaaggguacuguggauggcagagcacucaccagcaugcgugaggaccugggugcagucccucgcaccgcaggaaucagcucugccugugugguguuuguagcugucuccucgagagcugcuuaacccugguaaaaaggguuuguuuguuuguuuguuuuaaauaaaugagcucauagaugauguucaggguugucuuucuuaagaaaugaugauguccauucacauguguacccggaaauauuuuccuucaugacuuuucuaucaagcauggucauuucauaauuacuacguaacaguuaaauuaugaaguaggagcuaggagcgccauguaugucauauaagaaucauguaugacuguggauuccaguacuaggugcucuuucucaugucagcuaaaagcaucuguugcuuuaagucauuagcccuccacaggccucccucugcguggauaaaugccgacccaucauucuguuagugauaacagaaauucagaacaaagcgucauuuggugggaacaacagcuaugaaaggcgugauuugaguagcuguggcaauuuucucauagaguuagcguucaggauuccagggugaguuuguccuuuccuugggaaauguggucgcugcuaugcuguuuccucgcuaugacgggggcguccaucccuucagcucuggaauauguugagggcagcgccacucccaucuguuuuucuuacuggcugugucacagcucuagcuccauccauuccucacccgccugccgcuugucucccacccucguccaggcuggaggggagcucacgcagccauguggucugucgaucucccucaagcccaugaucacaaacucaggaagagcccaguacacccaggcagcuucacggcuuuccuguccacuuuccuucucugcugccgagugugcuucuccucgcucucaugcacacacucaguguggagcagacacacaugcagaagggaaccuguacagccucugucaucgcuucugucgggcuccugugugcacgcccaguucuuguuaggccucagucagugccugcacuuccucucaccuagcgaagccucacuucucacagcucccuuuuccuucuaccucaggugaacccuuguuaaccauucugagaccuugcagugcacuguguguacagugcuggcgacugugaaaaggagccccuucuucccauuuccccugcuguccccaccccucucuccccugcugcucccacccccucuccccugcugcccccaccccucuccccugcagcccccaccccucucucuccugcagcccccaccccucuccccugcagcccccaccccucuccccugcagcccccaccccucucuccccggcaagccuucuggacuaaaucccuccuccucugacuuuagcccugcacccugugcugagcugagcaagcuugaggggaaccucugcucugagucucugucuccucgcuugguggcuucacccccucaccucugaaacaccguuuagcuuccagaacagucuuguccugguucccguccucccuguuccuuuucagugacucuagggcagcaugccggcguucaguguuuaaacucuugacucucuauguuuauucucuuacugauuucaucuaguguccuggcuuuaguauuuuuuccaguuugauaacuccuuaguuuacauuuccagcucagaucugcauccugaacuuuagacucauaaucuuaugacccauuugacgucuacuuucuuucucaucagcauuucacccuuaaaaucuuaaaaauaaauauguguguguucccacacauacacgccauguguagguaugugugcagauguguguucauaugccuauuccuguguguggaggccagaaauaggugucaaguauucccuuugacugugcucugcuguguuuuaugagacagugccuucuugagcccagcuugcugauuuggcuaaggcgccuggccacgguaaccugagauccugcuggcucuggcucuggcucuggcucuggcucugcagcacugggguuacagcugugccuugcuaaccuaaccuagcuuuuguguggaugcuggagagcugagcucaaguucucaugcacguguggcaaguacugugcuuagugagccauuuuccccagcccuuuaacgucaagcuuagggggcugcugagaugacuuagcaaguaaaugggcucgcuaaacaaacgugaagagaugaugucacacucuagaacucacguaagacugggaggaaagacaugauuccacagcacgagccucugaccaccagagacaugcugugggcuaugugguguguagcuuaaagguguuucaagaaauuaugacaauugucauuuugaaagugaagaguugccggauaugauggcacacaccuuuaaugccagcauuuggaaggcagagacaugcugugguguaugagcccccccccccaaaaaaaaauccaaacaaacccugccuuagaaaagcaagaucagggcggugggauggcuuagcaagcagagacacgcacuggcaagccugaugaccuaaacuuaguccccugacccagaguggcaggaaagaagcaaccucuguaaggugccccuugaccugccccccuacacacaugggguggggggagcaugcguagguguaguaggcuucccccauccauaaauaaauaaagauaugaagaugauuuuuaaaaggaagaaauagaacccaaaccaggcuaacaaaauauuuuuagcaucccuuucucagaaaagcugucuuuggccacugucuagcauacauaacaaagugccaugccucuuggcucuuuccagcauuguguuccuuguacaccugagugcuugugugcccuguuuagucugccuucccugauggaguggaaacucuaggucuggcucaggaguuaguguuuguuguguucacucgugugccugccaugccuggcauuagcucaaagauggggugaacuagugaaugagccccaaagagaaaaugaccagaacagcacaggcuuguguaacuuaaagguguuucaagaaauuaugacaauugucauuuuaaaagugaagaguugcugggugugauggcacacaccuuuaacaccagcacuuggaaggcagugguggcuagcucugugaauucaaggccagucaggucuguguagugaguuccagggcaacccugucucaaauaaguauaaaauaaagaaaaaaagcuauggggcuggcaagauggcucagcugauaaaagcgcuugucucuaugcccgaugaccugaguucaguccugggaacucccauggaaagagaaaaaacgucacccucacacacccucuucaccccucuccuaaacccaacaguggagagaaccacugugcugucucagcuccuugacaugcaguuuauccccuugucccgagacucaugcuggacagaggagagcaaugguuuuugucacaaguguuagauucaaacuacaaauugaaguucaugaagauuacuccucccccugaaaccagcaagucugccuugucguuccuccugaagagaguuuuaucaucccugaaccauucauuuccuucuaaaauuaaaaaaaaaggacaaaauacuugggaugggcacagagacauagcugaugcccguggaccucuguggagcccaugaugucccacuucucccucagcaccaugguccucaaagucccaccucauacaccauucccagaagcugcuuaacgcuuucacucagcuccuccuuuaaagcuaacaguggagagagagaccucuaaggaagugaguucauuuggaaaugaccagaguauaggaacuuguguauugcaggggaucgggccuuguguaggcacaugaguacuuaggggaucauggucggucauguguggagacaggaagguaggcagcugcccagguaaagggggggggggggagcuuauguaaguuguuuugaauuaucacuggccacaaagaucaguaacaggggaggccuuggugcaagguugccuggguugcuaggcagcuguccucacagagagguugcacuggccuuucagcaaggccguggacuugcgagacuguuaguggguuuuguuacgcugugaaugugguaggaucguuccucauggccucguggccucucguggauuuggguuucucacgggagaccgacagugacggacacugcuuuuccuucucuuaaaagguggugcgcauuugcugugcucucacugcagcugacugcugugugcacaugugugggugucaguccucaggggccaggucaggacugaguguuuucaacucugccuugggcuagagauguaguuaagugaagagcacuugccuagccuuugcaaacccuggcuugauuccccucaccccccaaacauacacacucucucucucacaaacacacacauacacacacacauauacacagacacauauaugcccagcuaucauguuuuuguuuuguuuuuaaagacagguucucaguguguucucccuggauggccugaagcucuauguagacagggauggcgucaaauucauauaaccugccucugccuuuccauugcugagcuaaaaggccacaaagcuaccuuaaaacaacaacaacaacaacaacaacaacaacaacaacaacaccccagcauuacugcuuggcaaacgggaugaucccugucuguugguuacagguguuacucucacuucccugaaccugcuaaugucucuagguugucacagugacaugcuaaaugcugaacagucgugcagccccacuuaguguguauuucaaccaugccagcucuuagcucagugcuuacaguuuauuggguguugggauaaaguacucagggagagcaggagggaauucgucugcucuagcgacaaccaugagccucagugauagauggggucagcaggguccagaauggugugggcaagcaaggcugugcgcaggaaaggcagaggcagaggccuuuagugcagaaguagccuugguguuugaugaaagagcaggaaaguccaacccauguccucuaauuuugagucuucaaugaagucuuuaacacguuaguugugcauuucggggacuucagcuaagggaagggcacucuuaucagcacacugccuuugccuaagaaugguaccagggacuuuggccgaguuguaaucuuuuguucuauuaccaguugcuuauacuaaaguccuuuuuccucuuacacuuggcacgggcuugggagagggaaaguuuugugugugguuuagaaacuggcuuugcagcugggcaugcaauuaguggaagagcuuguuagcauucaggagaccuugggcuccauccaaugaaauagaaacagccaaaacaaauaagcaaagagaaacauacagcugggcacuacugucuuaugccuguaagcccagggcuugagaggcagaggcaggaggauuuccacaaguuuguggccaauguaggcuucguagugaggucugucugagaaaaugaaaucacaaagucagauacuggcuagagacagagacccaggcagaagcugcuguggagcugcugcaagggagccccaaacacccugaagguuucucuugguuggaaccuuccuuuuugcuugcacauuuguuccuaggccacauucguccccuugugaauuuggagcaggugucagugucuuguuagugauggugugucugcaccaguggucccauuguccugccaucuccucugcucaaagccuucccagccugaccugaggccggcucugcacagcacugcugucgucccuguaccugccucaaagguaaauucugugagggcagaggagcaaugccgaacacgggaggaguuccuggaaaacguguuuccuuuaugugugcacacacccgugcaugaguccacagauaugcacguucacgaacaccagaugacaguuuuaacuuuaacagaacuagaggggcuagagaaccuucucccuuagucccauuacugagcagauaaacagagacacuaaacuuaaaggacaaaucacagcauucauagaguugccugccugaugccacaucauaaauuuagaauuuguguguauguacauacaugugcguguguacucgugugugcauuagagcucgaauguguguauugugugugugcacuuguguguccauguuguguaugcagugugugcauuccucugugcguuugugugugugugugugugguacaugugucaggugguaagagggcugccucagaagucaugccuuagcaaccuucuuccuuuuuguuuugagauguacucccacugaccuagaaauuuguggagcagaagccagcuugcagauguccaccugucugagaguccgucuuuccauccaugagaacacgcaugagcaucaugcccaacucuuucuucuuaaaguacagacacugggaguuugaacucaccaagugcuugccucugagccauccucucagccccuuccuuucuuuuagauucuuaagggucuugcuaagugucucaaacucaacacucuugccucugccuccugagugcuaggauuacagcagacaguaccauccauggcuucagagauuuugauuuuuaucuauagacgggagugaauggaugacuggaugagaucuuuaugauccgcccaccucuccuauuuucauuuauaaaaauauuuuauuguguaugaguguuuuauuugcauacaugucuguguaccacauggcugguaccucuggaggccagaagagggcauugaauccccuggaacuggaguugaagaagguuaugagcugcccugugacuucugagaauugaucccuggaccucuggaagagcucuuaacuacugagccaucucuccagccccuccccuacuucuaauuuuuuuucuuuuuuucuuuuaauuuuuuaagauucaucucaugggccggagagaugguucagcaguuaagagcacugucugcucuuccagagguccugaguucaauucccaguaaccacauggggacucacaaccaucuguaaugggaucugauaccuucuucuggugugucugaagagagcaacaguguacucacacaaaaugaauaauaaaucuuuaaaaaaagagagagauucauuucauuauguauacaguguucugccuguguguaugccuaaaugccagaagagggcaacuagaucucauuguaggugauuaugagccaccaugugguugcugggaauugaacucaggaccucuggaagagcagucagugcucuuaaccgcugagccaucucuccaguccuaaauuacuuuuuuuuuaauuugauuuuugugauagggcuuuucaguguacaacuugcuggcuguccuagagcucacucuguagaccaggcuguuuucaaaauuagagaucugccugccuacaccucccuagaauuaaaggcgugcaucaccacacccaacaaggcuuuaacuuuuuaaauaucucucgccuuaggaagaugggggauggaacaaaacauuaauccuugaggcuuacuucauccacugugauuucuccagcaggaagugggaaagacugauaacagugguuucagaagagagggaugccaugggcuguugcuuuugguggguuuuugucuugauaacuuacagucuaaguaaagcuaggggccacugagcuugguagauuuacaaagcagguagaucauugugauguguagagaugggaagcagugggcgcaugugacugugggggaacugggaugugaagauguuugaagcacaggaccaagaggauucaaaugcugucuuucuuacagugugccccggcacuucaucccugcugugguauguauuguauauuaaauagucuuagucaggguuuguauuucugcacaaaacaucaugaccaagaagcaaguuggggaggaaaggguuuauucggcuuacacuuccauacugcuguucaucaccaaaggaagucaggaauagaacucaagcaggucaggaagcaggagcugaugcagaggccauggagggauguuacuuacuggcuugcuuccccuggcuugcucagcuugcucuuuuauagaauccaagacuaccagcccagggauggcaccauccacuaguugaaaaaaugccuuacagcugaaucucauggaggcauuuccuccucaagggaggcuccuucucugugauaacuccagcuugugucaaguugacacguaaaacuaguacaagcacucugucuuaaauaaaguuccuauguuuagcgugcaugcgggcaccacagucaaggccagaaugaacaccaaaugucuucuaagucucuguccaccucauguuuuagagacagugucucuugcuuaacuuagagcuggccauuuuagcuagacuggccacaggcaucucccugccuucugccuucccaggcuagcauugaagguggcuuucacauggggucaggucuuucuguuuaccaacagagacaacaacucagcccaugagguuaaaaaaaaaaguaaaguauguaguuaaguuccuuguuaucagucucaguaugaaguagccuuuucugugauugauaaaauaauccugcauuauuuuuuacuuauuuuuuguuuauaucuugaaugaaugaguuguuuuguuuuggcuuuuuuuuuuuuuaaaggauuuauuuuauguauauggguacacugucgcugucuuuggauagaccagaagagggcaucagaucccauuauagaugguugugagccaccaugugguugcugggaauugaacucaggacuaucuggaagagcagucagugcuuuuaaccacugagccaucucccucgcccuugagugaaugaguuuuaagucuuauuucagaacucugauggcgugagaugcccuaucuguuuugagucuugguaggaauagugacuagcuugcaguuuccuuuugugaguccuuuacuaguuuuaacaaauugguaugaguuugaagaugguggaggagugaguaugcuuuugugauauccuaguguggagacaggcaggcuuucuuucucaugaugccaggacgguuaaauuuaccaguuacuaguuaucucagcagguagugguaauucauuuauuuuuaagcaucucaguucacuuuccuuuuuaugaacaaagauaaauaaauacuguaaaugcuugccuagcaaccuuuuugcauccuuugauuuuuuuuuuugguuguuuauuuauuuugaaacagaauuucucuucguagaccaggcuagccucaaacuuagagaccugggugccuaugccucacaccuggcuaaggugauuuuuaaaguucuguaacaaacauaacuuuaaaggcauugagcaaagcucucugagaaauaaucuguuccuccuccugaugcugguuuucaugccaccauaagcucuguagggacaaugguggggucagcuuuuucuuccuucaaacacauuccaucaacagaaccaugaucuguacacaaggagauagauggggcagugaagccaggcugugucucucagcauaucugaguucaguuuuguagcaaaguggaaagacuguccacaaacaccuacauccacaccaucuggauucugccaucaacaccuguuacuggguuguugguuuguuguuguuguuguuuuguuuguuuguuuuucaugucugucaguccauuaguguaucucguuuucaguccauuucaagaguuuuucuguccuguugggucgcugaaauagcuaacguaauggguaaagacaucagccaccaacccucaugacaucguagaaaacaagaacuuucuauacugucacaaaaccuaauuuguucaugggcacuguaguaacaguucugggauugugguuucuuuaaaaaacacagaaauaaaagagugugcuuucauuugaaucucagguauggauugcuucaggcugucugcagcagcugacuaugauuugcccugugcucuagcagaggcaugguuuugccagcuguggauaguuucuguaauuguaugauguuuggaauucugggaacuugacgggguauauaaaugugagggcuccugagcgguagcuuuggggguugguauuuggggguggggggaagagguuuagugcgguuuauuacuagacaaaacaaaaaaaauuggauucagggaucucccuuucucucucucucucucucucucuccccccccccuucgcuccuaucuagugauggggugaaaccccagggagauaaaggguggggggaaagccccacaaaguagcaaagaccuggcuucaggcuccaguuggaccugcugaaggagaggcggugaguuuucucaggcaucacgugcagcucgagugcugaccuuaggugaugcacagugauaaaucgugaccucuuuguaacaguccugguuugucugacaggauccucacggucaagcuuuccaagggcaccuguguuaaccucugccuucacucuugggcuugcauugugucaccuguccuuucucucuuuuugccuugccuguguaggaguugcccaucggagccagagcagcgaaggcgucaguucucucagcagcucaccuuccaacagccuugagacacagucucagucccucucccguucccagagcauggauauugacggugucuccugugagaaaagguaacuuggugcucccugucuauaggaagggaagucuccacucucuagucucuagccagcugucugaagugguaacccagagagccauuuuccuaucaaacuaaauacaaacuucauucuuaaguugagguguuucuguucuaaaugaaacguuguuuuuauauuuguuagugccaagcaucuuaugagcuagagagguggcucagcaguuacaaguucugucuuuccauaggacuugagcucuaauuccaaaugucuuuuaugagauguaagguaugagugaauaaaaaaaaauauauggccucauaaugaacacgagauacaucugaauaaaucucccuguauaaauggcagauaaugccaguguguggaacaguagugagcucugacagaagccacaaaccuccgauugcguugagaugcugaacagcgguccauaguagagaagccauaaaggguaugauuacagcaaguacccucaagauucuuuuuuguuuguuuguuuguuuguuuuuauuuuuuuugagacaggguuucucuguguagcccugacuguccuagaacucacucuguagaccaggcuggccucgagcucagaaaucugccugccucugccucccaagugcugggauuaaaggcgugcgccaccacugccuggccuaauucuuuauuauugaaaacaacaacaacaacaacagugucucauccuggagcccuaccauguaguaccagaaauagcuccuuccuuauguuaggccuuagugcuuccucagugucaccacucuuggacuuaggggccacuguugaguaaaguuagagauacuugaagucaaguaguuugguaaccaagcuaccaaaugaccaaugagcagauagcauguaccgugcagaucaaccaggcagagggaggacucccaccuggcagaguggagcaggguuacaggacuucacccugccgcucagcagcaugcacuucacaacugaguuguuuaugaaacuuccgguuucauaguauugaugagugagugaacugagugaagggagcccacggacuacuauucucuucuaacccaauuccagugguuagaaggauucuaggaugauguugaguuuaucaguagcuauaccuguuccaaauauguacacacuuaguaaucuaccaucagcguaucauacaagcgaaggcugacagagcgcuaggcagcaaauugccauaccuaaaaccauccuagagggauucagacaugucucuuucggccagaaauacaucaaggagaggaagaaggugacuaagcagacagauuaagcaaugcagccagcaaccuugaucuaaugaaaguauaggacuuuacauacucuacaggccgaaagccaccagagucagaaauguaagggcugugcguucugacuuguaugucaagccagaaaagcaagucagcuggagacaaggugacugcuggggacagaagugacugccgcaaaucccacagaucuuuaaaaugagacauggcggaauaguguucucgucaagugucaucauggggggucgucugaaugcaugugccggacagucagugcuguaaagacacuuguguucugcacuguguaaaaauagcuuguccugaaaauccauucugcugauuucuucguuuuugaaagugagcccaaggaaaugauaccuugggaaaaacgacugcagcacguaagaugaacaggacgcuuaugugcugccaguuugggaggagcugcuagacuuacaggaagaagggggugggggagccaguguuacugugcuuuccugaccagugagccuugaugcugggaguuuuagaaaagaugaacgacauguuugucuucuguacuuaaagcaugucccagguggauguggauucgggaauugagaauauggagguggacgagaacgaccgaagagaaaaacggagccugagugacaaggucagugauggcaaagggcgcuccguuucucagugcucgcuuggcuagccugcccuagccagagcgucugucugucugucugucuguagcuaggcuuguccuuuugaagaaugcuuagucucagccuugccccggaaaguucucacuccucagucugagcuggcuuggaacuggcaguccacccgugucagcuucaggugcuggaacugaagaucccacaguccaacuuuagucugcuuagcagcagcagcagcagcagcagcagcagcagcagcagcagaacugggcccuuuuguacagugaaaccccuccauucugcuuggcuuggcugcauguuuuugaggucggucagguggguuggguuuuuuugagguagaaauccuccuggguagcccggaacuccuuccuaucuagaccaggcugcucccugaugugugugccuguucaacguguguggguauuaaagacaggcugccaugacuggcuggguccgcgcuuucauaaguaaaacuuaauuuuguggcagcaaguaaaaacucagggaggccuuucuguuuauuuucauuugagcuuuguucccuaaccucagguggcuuggguuuggguggcgcacgccuuuaaucccagcacuugggaggcagaggcaggcggauuucugaguuuuaggccagcguggucuacagagagaguuccaggacagucaggguuacacagagaaacccuguucaaaaaacaaaaacaaaacagaaguuggaccuuagccuccagguugucucuauucauggaguucuucauguuucuuuuaugugauaauguauuugacauguaaucagugagacauguuaacguuuguaaaauauccuugagagaaaaugguuauauaccaacaacaugaaccuggcgcuugagaguuccguauagcacagcacaguuaguagcgaggguggcagcacgcucacgccucugcuuuucuggccaaacuuuuaugaaugaggacaugagcuucaugggacacugauuuugcagcuacuuccccuguccacaaaaucuuacauguaacucugcauggcuugagacuuggguuguguagaccaggcuggccuugcguucccugugucaccugccuggcuagaugguuuuaugcauuuaaaaauauccuuguuaauaaaugaaucagaucagaacaaaaugucuuaaugcaugucuucuacuacagauuaacucucacauccuccccacuaggagccuucuucagguccugaggugucugaagagcaagccuuacagcuggucuguaagaucuuccgugucuccuggaaggaccgcgacagagaugucaucuuccuuucuucucucucugcgcaguuuaaacagaacccaaaagaaggugggacucuuugucagagcaacuccauacgggaugucaggccaugagggucucuguccucuugcugugggacugcaguuccuguuacgggguggggacacagcuguguggucacuuucuucccugagaguauugcuaagugauuuuuaaaauuuguuuuuauguaugugugugugcuguguguauggugcauauaucuaugcucagguaccucuggaagcuagaagagagcguuagaucccucccuggaguuggaguuacacagggcugugaggcacccagugugggcgcugaggaccgaggugggguucuguggaagagcagcaagcuuuucuaacugcugagccaucucuccagcccugaugugugauuuuacagaagaaaacuaaauaagugaaugguuuucccugucuggggcaggaaguuuuccuuuaugguagaagacucuuugagaagacaucagcuccuguaggguagaagcgugcugagugggccccaagacucagcuacccgcuugcaucuguagugcagcgagcuucuuucugcaugucauucaucuucuaggaucugaaugcuuaccaggcgauuuguagacagucgagugagaucuuuuuaucaaauuacuuagcaaacuagaauaugauuauauuuuguuguccuaggguucuguuuuaagaggucagcugugcugaccuguacuuaaaauaaucacaugcuuuguaagacagcuuuauugagcacuguggcuuuaauugcuugcagcagggccagucagugugcugcaggcuuugugcuuugauuuacacuggcauguaaugcaguugccgugacucucugcucauggguguauaucccuguuuuguauaagauggguuuucacggaagcagucgcuguuagcguggguuacuguuaccuuuuacuuggccugucuucugcgagggagugaaauuucuguguuccuggaaggugggucgguuucugauggggucgccucuuaguacuuguaguugugaagagcugagcagccuuagguuuuaaagacuugccacuggauacucuggcugucagcucuaaggaucucacaucucauaacgccuuguacacaucaguuugugucaacuugacacaagcaggaguugucacagagaaugaagccucccuugaggaaaugccuccaugagagccagcuguaaggcauuuucucaauuagugaucaaguggggagagggcccagcccauuguggguggugccaucccugggcugauaguccuggguucuauaagaaagcaagcugagcaagccaggggaagcaagccaguaaguaacaucccuccauggccucugcaucaguuccugcuuccugaccugcuugaguuccaguccugacuuccuuggugaugaacagcaguauggaaguguaagcugaauaaacccuuuccuccccaacuugcuucuugucaugauguuuguguaggaacaggaacccugacuaacacauuaucuaaccagaugaaacugccacagaacagggcuuugguucagugauauccagaauguguccauagaucaacagugaucaacuaggaucugcaaagaaugagaaaggagcuagacuguagaaucugcuuuagaauccagaggguggcucagucuggagccuuucagaggcccuuaggagccuuggacucuguaaagugugugcuggcugagaaacacuagcucagcugcauguguuacgguguauguauguaguaagggcagaucugguagcgacuggcuccuucuacaguuaacauuuaucaacaguagcucccugacugcacucuaacuugauuucaauaagauuuaauuuugggauaguuuuauauuuauagaaaaugauuggaggccgucccgagagcucaugcauacgcuucccucaguguccucucauguagcagucuguacaguagacugugugugcccagacucggacaggacugugcacugagccaguucgauggcuccucggccuguuggccugagugccauccccaagaacccauguggguggauggaagggucucuugaaaguugucuucuucugcauggcacugugcacauacacacacagaugcaaauaaauauaaaauaauuuuuagaaaaaaaauuacugggaaccacaccagagcuuuuuuggguuucagcuaaaauccuuucacucuugagaauccaauccaggaucccagcacacagaaucagaaucggccuggcucuuuggcuuauuaggaugguauaagugaggaccuaugaauaaccugcuuuucacucugccuucccaacaguguucucugauuuuaaggaucugauuggccagauuuuaauggaaguacugaugaugucaacucagacacgagaugaaaauccauuugccagucugacagccacaucccagcccaucgccacggcagcucggucaccagaccgcaaucucaugcugaacacuggcuccaguucaggaacaagccccauguucugcaacaugggcuccuucagcaccagcucguugucuaggucagugugguucucugcugucucacugguggaaaacagcugugacuguugaguucggguucacagggcugaucugugucucagacaugugggaggagagagggggaaggggauguggccauuggauguggcuuuaccauuccuugguuggauuucuuagcauucugugguuagguuguugguuaaauuuuagacacacguggcugucugugcuacgguacucuuugaaaggggucaccgacaugaguguagugauuauagaggcuggucauuuuucaaaugcuuaucuacuuaaauuccuagaguguguaguauaaaugugcuauccuuuaaaaacugacacccauuuuaguuaucucaaguuuuucuuugauuuuuuuuucccuucccucggucucucaacuaacucagccucuaugaaacgagccccgcccccucugccaguuuauggaguuuugugccagcgcucagcccauccuuugccuuaccuucccacccagccccacaggcggcuaugccuucccagucccuuagcccccaugguguagccccacaggcggcugugccuucccagucccucagcccccaugguguagccccgcaggcggcugugccuucccagucccucagcccccaugguguagccccacagguggcugugccuucccagucccucagcacccaugguguagccccgcaggcagcugugccuucccagucccucagcacccaugguguagccccgcaggcggcugugccuucccagucccucagcacccaugguguagccccgcagguggcugugccuucccagucccucagcacccaugguguagccccgcaggcggcugugccuuccccaccccucagcccucauaguacagcuucuggaaaugcugccggaagccagcccucauccccgagguaucggcccuauacugucacgcacccuugggggucuucaccuugccccaccccacgauccuccauucuggcuagcuccccaggcuucccuucccacgcaaguaguccccgggcuguaccugccagcuccuccagacagaggccccgcagcaggguccccgccuucccaccugccucgcccagugccgccagcagacgucccuccucccugcggaucucuccuagguauuuauuugcaggagagcugcguguguguuugcagugcagggagaggaaauuaacacgguuuggaaagaacugcugugugacacugaccucaguugaauucugggagucgcuggguuauuaaccuguaucgcucgcaagcugugguaggcaugcgccugccuccaugauucuggcagccuuuuguccacgaggaagugaagacgcccuuccuccccugucauuccuccugucaucugcacacaaaaaccaagcacuccaccuucuucugugaucuaguccucggagacucuggucaguguuuugagaaauggggcucacaggaugccuuuuuggacugggccggugucugcucuuucuaugaguccugcguuucugucuugacgucugauugcauguaguuccagucucucagaaagcagcagccgcagcccaggaaucugguggccuccuuuuucaaaugucccuggguguuucuguaacucaggacguuguguuucugcaugucagugcguacagcuuccgagugugacauuuacuuuaaaugacagccugcagcagcagcuuccuccuguucccucuauccucugucccugaugaccuuuuuugcuuuuguugugguaguauguccaacagcccuuucuccuuccucuuccucgaacuuucuggggacaguagugaugaugaugaagaagaagaugaggaggaguuggaugaaggugguggugaugaugauuuuucuuauguccaguuuggguccagguaccggcagaauggagucuugccccugcaugugcuucaggugcuuagggacuaacguuagugagcacugcugagagcucucugcuuugaguccagacaggguaguguuaagugaggaagacuagcaagugugcacugaagugagaggaccuuacccugggaagaagugacacauagacgauucguuaaacugguaauucagcauaucugcgucaucugucacgugccuggagagagcgcugaacugccauucagucuuaagcuccccugcccccugcuaggaggagaugaggggccuccacugcucauugccagugcguuccugaguaugcuuguguagauuguaggagcugaagacuagcacugugguuuggggguguguggccauuucuuccacaucacgcaguccaguguaacugggauucucuuuuuacauaugaccuugagucucccugagcaucucuugagucucaauugagcaguggccuuuuguuucuggggccacucaaugcucucccccacucugaaaacuggguuagaaacugcauuucuagaugauuuggggcacacaaauuuaaugacccuuuguuucuacaucuucaacugaauuucccucuggacccacccaguuuguguuugugcccaguacaaauaacuccaggcuagaaguagagacugcagcaggagcugggcgcgcgucauuagguuuggcagcuccugaagagagagaagaauguugaugcgaggugaccccaaaagagagaugcuuauauuagguugaauuuuuuauuaccuuuucccaagcagauauuaccaaaggccacugugugugucuugugccuguaacgucugugugaugacagcucacacagcagacaucccuaggaguggcuuccauacgugguaaaaugcuucauuugguuugguuugagcugucugugggcgaaauguuuugguuaguucuuuagcagaucgcguccugcuuuuacugacacgucccuuuguagauucccuguguccagccgugcccgagcuccaggcucugugcuuauccacuggcugcggugugacuguggaucggugcuuguccagcaucgccugugugcucucugugaugggacuuggacuggagcagcgggaggacggcuguggucuuugaguuucaucucugcugcucagguucuuuguguggcuucuguucuuggacagaagggccagcguuuuuaggcucaguuacaagguuacauuuucaucaguuggcuccagcuucuuuggcuacacugaaaugagauaucuggccugucuauuggagauuacgaguagacuccagauaaaguguaugaagaugguugcaggauauaacacuaaacaaaucgagaguuugaggauacauggaggucaggacagcaagagguagcaaaagaacuuguuucuuuuugaguggaaucuuuuuuccugcuuguagaaucccaugugacuccauugcacacagcagacgucugugggagcauguuuugauuuaucugugggauaaauuuauguagcugaggauguccugugacuugguauugggauuguuagccagagcaaucagagcaguaacagagaaacaaacaggcugugaauaagaaagaagucagauuuucuuuuguuuuguuuuuugagacaggguuuccuggaacuccuucuguagaccaggcuggucuugaacucagagauccaccugccucugccugcucaaugcugggauuaaaggcguggccaccacguucccugaagucagauuaucucuauguacaggagaugucguucuauagcuuucuccuccuccuccucuuuguuaagauuucuuuuauuuauucuauguguaggguugucuugucugcguuugugugucuguaucacauugguggcugguuggggacuagauuuacagacaauuguuaauaguugcuaacacgacagugcugggaauugaacuuaggucucuggaagagcagcugguguacuuuaucucugagccguuuccucagccugauucuguagcuauuuaaaacuguauuauuucaugugucugugccucugugugugugugugugugugggugugugugugugugcacuuagaagcauguaggugcuuuuggaggccagaauagguuggaacuggaguuagagaugguugugagcagccaugugggugcugggaaccaaaccuggucuucugggagagcaaccaauaccuuuaaccaucucuccaucucugugaucuauguuaacccaaccagaaagcugcaaaguuuacuagcacuuuaagugaagucgugggaugcaggaaaaugagucauuuuucuguauaauagaaugaucauguuaagaaagaaagcuaaaaagcagucccacagagcagucuuucagagguaagaaauaaaucaccuuggaaaaauagugcugccucucaggaaagggcuuguaugcugacagccuugaagacacuccuuguuugaaggucgucagaguucauguuguggaaggacuuuaauaccuacagaucauuuuauuaaguaagccaggcccagaaagacaaauaacacuuucucccucauaugcagaaucuagacuuaaaacuaaagacuugguggcugggaguggcucagcaguugcgagcacauacuacgcuugcacaugcauacacaugcucucacacucguacacaaaugugcacacagaaauacacauuaaaugaauaaauguaauuuuuuuuuaaaacagcgcgggggagggggguagggggguaagaauugucucagggaagaguccauaaggcuguaagggaaggcuuaucuugucuuaccgcccugaggacuccuauccucucuuguugcagagagcugugcaguuugccacuuacuuuccucaaggcuugggcuccagugucaucuccucaggggcuaacgucugacuguagcgaccuagggacgaaacagucccgugccuacucgugcaacuucccagugcugcgccacacccagucucugccuuuauucacugacagccuucaucugugucauucauuguagagucccuggacuaugaacggugcacacaguggucccgugugcacauuuguagagugaaucggcuggugugaacuugauuaacucugggccuuagcuugagaaaauacagaauuucaaggucuauacauaagagcuugguaaaugggaggcuugagagauggcugagucggggugcacgccugggaaccuggguuugucccauagaugugcuuagaacaaacuuggugcggcaguguggcacaugggugugguuugagugcuggcgaggaaacgcaggcagaaggauguccagugcauucagugagcucccgaggguacagcauucaguggugagcacacacagacacgcacgcacacucacacgcacacucauaggcacgcgugcgcuggaguagaaagaacacuccagguaaauggaaaugugaguauucccauuagagaaggaaacacacaggauccuguaagacgcaggugauuguuauugguacauuugaaauguaauuuggucugccuggacaugagauguguguuauuuuugagaauauuuucauuguuugggauauucuguuacacuccuguucuaggagguaguuaccugauuagcaccucacagugcugacugacucagacugcugaugucguuauuagaaaaugcugguguaaguuuuuaaccugucccuucuugggacuuaaauaugaaacguuucuaggaucuuaggaugucagagcugugcaaggaucaugaguguggaggcuggggaccugcugugucgucaguacuggugguuauccuuccucagccuccucaccugcugagcagcgggaccaucccacugccgcugacguccccucggcugugcuccugacgagguuaaugugcugagagucugugcugaguaucuuugccgucauuuugaccucugacuguugacuuggcguugaugagacugggaucaugguuuccuuggguacuuugaguacugauagagcuaguauuuucucucucugucuguguuggguuaaagguucaucucaccuuuaucccccuucugauguaaauccgcuaauugcuugcugucugauucaugaaucaucucuuagcuuugaaaauuccuugauauuuccucaggucucgcagaggauggauagacuucuacauacuuggucaucuuaggcaucugcccgucugcccgagugcagagaucacagguguaagccggugcaccggucaccugccacuucacguucuaggggaacacuugcagugucgugguuguucaguggaguguauugcugagagcuguuuguaacucgagccacagcugccugagcccacgccacaggugcuucauacccucaggcacaagucacgugcucaucugggugccaugucacacuccgugcagcuggcaaggaucuccuggcaucaaauguuaacuuuuuaauuuuuuuuuaaacuucagaaaguguuugaaugugugcuuaucaggaaauaguuuaaaauuuucauuuuaaccaccaaguuauguuuucacugacuuaugugagagcugcuacaaggacaaugacugaauuacacauaggagcagggcuauauuagcaaagccuuuggauugugcagugaacauaaucagggagucccagguaaaacucaggcugcugugggucaggcaggcuuuccccgugaacuucccagggcuugcucuaucagcacgcuugugguagguuugaauccacuguugggugccugucuccugcgcuucacacuguuccugcuucugcuguccagccaguugggaccuuccagaguguggcuuagugaguaaggcacaccugaacacuccuugccgcugugaggaugaacguacucugcuucagcgucuccaggccaccgcgucugcuguuguccuaggucuggcuaggugcucugcagcccggaggccugccccgucccuagacuuccccucagccucauucuuuccuuuuaaaaauguuaacacacuggaguuagauuacaguaauucggguuuguuagucccugggggacagccuugauuuugcagcaugguuucuugugcacugagucaccuccacaccccacuuccauucucacgucugcuguauguguuuccccaaaugccaaggggaguuaagcgcacauuuuccaaauguaguuacgcuugucucucugacugaguguguagccuauuguuguucucucaguucuuaauuggaucucuuaguuccugugcuuugucugggugggguugaaggagagaugucaaguccugcugucucccaucucugucaucuuccauaggggauauuuuugccuaacuuucccccuuuauuucagaauuuccugcuucuuccuuugucuucaucucuucgugauuuuuguguuaaguacaaacacaaaaaucagugugguacuggaacauccguuuuguuggagauuaaccucagcuucuuuguccaguauccuuggaccucaccauugugcugcuuggccuuugucugggaauaguuauuauauauauuauauaguaguagcagggcuccacagcgcccccugcagguguaguggaaguucuuguugcagggaacaagcuaagcugguaccacgcccugaguccgcuuacucuuugugcaagauuuuuguuuauuugguuuucacugauuugcuuuuccuuguucacugaaauuucugaaaauucaauagcaaacacauucauuuuuccuuccaacuuggcauucucuggccuguugugaugcugugaagucucuucaggucuguguagacaucuugaggaugagagugguacccuaguagucacuuggagcaucucuccuaacgugagagacuauagcacugucugcccaaguggugccacucguuuuggcucaugaaccuguggugacuccagccugcucaacgcucagcagcaguuucuaguccuuccgauuuguaaguuagcauccccagcaaggccaggucgcccugacaggcuaggguguuucccagacaucauugguuggccugggcgcagacaaagcagcaaugagcugcaguguggcugcauggggaaauugugcuucaccgugggugcaggcuucuaaccggcuuucugcugcaaaguggccagcugugcucuagaaagcugugcucuaggagugguacugaagaggaaagcauugucaaucuguuuucucuucuccaaaguuugggagccucugguggagcaaguaacugggauucguacagugaccauuucaccauugaaaccugcaaagagacggacaugcugaacuaccucaucgaguguuuugaccgaguuggaauagaggaaaaaaaagcaccaaagguacugcggagcuuauuuaugccugugcugaccccugcgcaggagcagcucuuagggccugucugugagaacggaaucuaguccuggagaacucacagcaccuuguagaccuuaugccagagcuccgcugugagugggcgcgccugggcucuggagucuguccucuccucugucugcccaugauguccgugguccugauaauugcugauugugucaguuuuccagugcuagcacagaauguccaggaagcucaaagcaagaaagguguauuacgcucacagguccuuaaauccaucaccaaaugaguccauuguuucugggauauggugagcaucuuuguagacaggugugguacagcuaaauugcuguugucauggugaccaaggagcaaaggaaagcagaggaaguccugggaugagcuagcuagacugcucagccacacucuaauugaccugcuuccuuucaugaggccuuaccugccaauccuaccguaucaucagucagugcauugcugaagcuagagccacagcucuggugccccuucaccccucaaaaaaugcccaucagcuagaaaccaagccuauaacauaagaaguccuccaggggcauauuucuauugaaaccauacugcuaggugccugagauaaccauacaaacauccgacauuacagagcauccguucccuggacugcagcaacuguuacaguccaugagcuuggauuuucacaguugcccagugaguccccacagccgcaugagugagugauacuccucagaggugaagcugcaguuguacaagcugcaggaccaugcuaagacaaggaaguagccccagcccuguuuuugagacaucgucucucuguguagcccuggguggccuugaacacagagauccacuugcaucuggaagcugagauggaggugugcaccaccacggccggcaccuuccgcugucucauuccauauccccucauucacaucucacugauaccagacugacguuagaaacugauguccuugggggcuagagagguagaucagcgguuaagagcacccacugcucuuccagaggucccgaguucaauucccagcacccacauggugccucacaaccaucuguaaugagaucggaugcccuuuucugguguguccgaagacagcuacaguauacucauauacauaaaagaaauaauucuuuaaaaauuuuaaaagagaucacauuuaaaaaaaagaaaaagaaacuguuguucguaaucucagcaaaagcaaacaaaugcuggguguggucccgggagccugggacaggaggauugcucuagauggagauccaccugggcuacuguacaaaagacucugccucagaguguguuauaacuccgcccaaaaggaaauggagugggugugcccuguggcucugccgucuucucugguuaaccucgguacagugggcacaccugccuuacuugguccauuaggagcacagggugagagaagcaggccauuucauagccaugccucugcucccagccuuuuugguucuuuaugcugacuguugucucucuucucagaugugcagccagccagcagucagccagcuucugagcaacauccgcucgcagugcaucucccacaccgcacuagugcuacaagguucccucacacagcccagguaugacggacgacacucgguugcugugcuucuggguggguagggaaggccagcgcucagugccugucagccgccaguuguuuuauaccauggugagaacucuggguccuguauugugacugucucucaguccucagagcucgggcuggagagaugacucagacuuaagggcacuggcugcucuugccaaggacuuggguucaauucccagcauccacaugauggggcguaguaucuguaaccccaauuccaguagaucugaugcccucuucuggccucuuuggacacuguacacauguggugucguacagaaacauacauacaugcaggaacaacaugcgauaaacauacagccaccuaaggauagcgagguauuuaggaguaaagaugcacuuccuccucguagaaacgguggaaauaaaauguuuucuucauuuucuaaguaguacggaacauuuuaaaaaaagaaguuauuuauuuauuuauuuauuuauuuauuuuauauauauauguguguauauauauuuuaagauuuauuuauuuuuauuauauauaaguacacuguagcuaucuucagacacuccagaagagggagacagaucucauuacggaugguugugagccaccaugugguugcugggauuugaacuucggaccuucggaagagcugucgggugcucuuacccacugagccaucucaccagcccuauuuauuuuuuaagaguucucuauacuuugaaauauguagagccaaggcaaaauaucgauaauuuaauaucuagugcuugggaucauugucuguuuuugacaaaauaacgacauuccaugugcuuccacauugauuguuacuagguacuagagaacaacgggggugggggccaggugaggagggacauuaucuauaguccuagcauucaggagucagaggcaggaggagcaacaccagcacaaggccagucuggccuauauaggaaguugcaggcccgccuguguuucauauugagacccugucucauaaaaacaagauaaaccaaaguacaguuguagggaaaauauuugggauaauuugcuauaauuugucuuuuucagaaaguuuuguauagcucucaagguuaauaaaagauugcauauuucauucauucauucauucauucauucauucauuuaugccagggguggaggccuuuaguccuagcacuuaggaggcagaggcagguagacucuaugaguucaaggucagcuuggucuauacagcgaguuccaggacauccagggcuacccaaagaaacccugucuugaaaaacaaaaauaagacaauacaaaauuuuauuuaugaguauguguauuuuucugcuuguauucuuguguauuccaugcaugccugguggccauagaggccagaagagggcacuuuauccccccaccccccgcagcuggaguuagcaacgauugcugccaugucacugcugggaauugaacccagggccuuuggaagagccgucagugcucuuaacugcugacaucacauuucuccagcccuauauuucaugucuaucauguaaaaacagcuaaaggaaaaauggaaaaaaaugggauucuuuuuuuuaauuuugguuauugccuguacuauaaccacaugguuuuuaaucuuuucaaaauggaagaaaauuaggccguauaguaccacaugucuguaaucucacagcacuggggagaucgaugcgggauugacuacuaguuugaccuucgugggcuccguagcaaaaccuugucuuuaaaauccaacuaacuaagcuggaugaauuggcacaugccuuuacucucagcauuuggaagguacaggcagguagaucucugaaugcaaagccauccuaguccagggaguuccaggacagccagggcuacccagaaaaaccuuguuuuuuuuguuuguuuguuugcuuauuuuuugagacaagguuucacuguguagcucuggcuauccuggcuauguagaccaggcuggacuggaacucagagaucuaccccuguuuccugagcgcugagauuaaaugugacacugcugucgcugcuaacaauugaggaaccuuaccaaaccaaaccaaaccaaacaauaauaaaaucuccacaaaaccaagucacagaaaaaaagaaaaggaauuugaaagagauuauggcuauuuuuuuucuucaauguagaugagacauaacgaggauuuuuuauuuuuaauuuaacaaaauuagauucacuuaugagccuuugugugugcuugugggugcucuuagaggucagaaaaaugaguugagaucuccuggcacuggaauuacaaaccguugugagccaccacaggggugcugggaaucaaacagguccucugccagcucagccaguauucucacugcugagcugucucucuggacccauaauugauuuuuuuaaugcauuuauuauuuaucuuccauugcugaggaucccggccuagggcucuccguacgcuaaacaagugacguaccucccagccccuaaugcuucauuuagaaagacuuguugucuuugcaguuuccacugaugucuccuuuaaaaggccagaugucaccauugucaggaaggucaugcuuugccuaaguaaugguuguacagcaguguuugguagguuuuguguuuccgugacgacgggcggccugugcggccauggcauuccacacgcucccaucacagcccuugcucuuccugcaucugcagguccuugcaacagccauccuuccucgugccguacaugcucugcaggaaccucccguacggcuucauucaagagcuggugaggaccacucaccaggaugaagagguguucaagcagguaugcuccagcuuuuagcuaagugccccucugcuguuagauacuccacggcaugggguaggggcgagacucaugaagccccaccucuccaugaaguuagugggggcugcagacuggaaagauagauaccuucuugagugauaaagccacugguaaggugggaaaggaagggaggggaaggaagaggcgaccggggccugaaguuaagaggaagaagagaaugaauggagugggaaggagacgcaggcaugugauggggugagggugauaaaagugcuuuuaugugcguguacaaaaaggccgucaugaaacccaucauagguaacaugugcuaaaaaggaaauaaauaagaaggcccuagaucucacugcgggcauugucggcuggcagcacgccuucgccuugcuuucugucuguacacucauaacucuugguuuaaagaccgucggcuucuuacguuuguaaaagcacaguccaggccuuugacccagcacucuccaguccgaggcaaguaagucucuauggguuugaaaccagccuggccuauacgguuaaguuccaggcuagacuucaucucauuggggggcuaggggggucagggggagaaggaaggaagaaagaacaauucaggauucaagaagaaaaacucucuguaaagcgguucuacucugcaguuggugaccucggucuuugguggugucuuguggacacaggaacaauaagggagcaccugagcugcucaucuuuaggcgaauccggaaauucgcgugggaaaacgucauugucucuggagaguuaagagaggcagccuuuggggggggggggugacccuuaauuagaaggauuuucuuuuuucguacaagccagcaaugaagaacccagaguaacuuuaaaaucaggucaaaaauuagcugaagggacauuuugugcuuauuuuauugauaaacuuaugcugagaccauaauaaagugaccuuagguggcuuuguaaaggacauggcaugaacucaguggcagcaaacagcacagauaggccucugagucacagaaagcuggugcucucucgggcuggcuggcuggcgugagugcuguugucuuccuguguuugagguuucuuuggagagaaugcgaaggaaagggacuggagaccccagaccacguccugccuuuuaccuaacaggugcggcaacuaugaccuggcuaaguccuugacuggaauuucuacuuccucuaauguuugagugauguuuccaaaugaacaaacagaaguaaauagcaacuuaauguaagggcuggagauuagcguugaagcuucuaucuccccuggaggcucuuacuuggaaauaaaagaguaacguuuaguaugcaggucacaacaacaguauggugccuaggcaggcaagcugucucuaggcagaaaugcuugcuuuguaagccugacggcuugagugugguuccugaacccgaaagggaagacaccuaauaguugcccucugaucucacauucauaugcacacauaccuacuuauacaacauauuauaugaacacaguaagauuaaaauuuaaaaauagaauccuugaugauaacaauuuaugcuuauucauauuuugccuguuuauuaucaauuaaacucuuacuuacacaggaggauaacucuacuaaaaaaaguaaauuuuaaauauuuuuuggauggacaguuaauggcguuuaucugugugacuguagaaguuuugccuucuugauugcgguucuggcaucucuugccuguguugaguguuuucagauugcuuaagaaagcacaaauaccauccacccugauuacuugaguuacagagaccagaaugaucucuuccagcgcuguucugauaccuggcugugcucugcgcaggugugcgcuaucuuucuaucccguuucuccugugcugaaacuucccugggaugggaugagcuuuguggccugagggauugguacagguuucuaguagguuuauacuacgcgcccuuuacagcugugguucacguugccggcugcuguguaccuucuccucgugaugguguuagucuuagaugcuagcccacuccuaauuguguggcucagugagaaggcacuguuaaauuugaaggugagcugugcugagcagcagggcuuggccacugucaccaaaucagugccagccuugugugucugacuacccuucaauuuccuggucaggugacuguguuagcaagacauucuuacuaaaaauaaaauuuucaguuugaacauucaucagcugucuccuuguucucaguugaaugcaacagagggaaacaauuucuuaaguguugguggauucgaggagaaaguggaacacuuagugugauuuccaugcagaucauggguguguguuaaucagcaacacugugggggcagggcaagugggagugcugaggugugcagcaggacccuccccccacgcucucagccgcccugucugcgcccuacaggccgugggcccugccagagugcugcuagugcucaacgcucguccuucccugcacagcugagcucuggugcugcuuggacaguuguccugguggaccagccacaccaaagaguuguagaguuguuuuuauggauggggaaaaccagugugucuuggggggagggggggauggggcaggggagagugcaaguguguggacuacagacugguagucaucuucagagccugcgugcuaaccuuucucacaccuaacguuugugguucucuuucuuacagaucuuuauccccauuuuacaaggccuggcgcuggcugccaaagagugcuccuuggaaagcgacuacuuuaaguacccccucaugguaaaagcucaaucuuuccuuuuuaauugauauauaaauaauccccucaugguaaaagcauauuccuuuuuuuuuaucagaucuguguuuaaccuuguuuuuccuuuucuuucuuuuucuuuuuuuucuuuuucccuuuccuuuccuuuccuuuccuuuccuuucauuuuuuucuuccuuucuugagacacagucucaugucugcguuagcucauggcccugcgcccuccucucgagugcugagauuacaaguguagaucacucucaccuucagauguaaaaccugagacccugcuauaggccagacacuugugugacuguguccugagccacccuaguguauuggcagcuuuccaugccccgccacugccaguccuagacagcagcgagugaggcacugugggaaugugccuugcuauucuggggagccagcacaaaggaugacugucagaggcaucuugcugguuuacagaacaacaagcaagccauacuugggauuugaacaucaagcaucaugagauagcuugcucuugaguuacuagaugcuugcuguucaggccugacaacuggaacccacgucaagaugagagagagaucccacauacauacucaacucccccuuuccccggacacacacacacaguaauaauaaauggagacgcaacauaggauuggggcugggaagacagcuuagcagucaggagugucugaugcucuuccgcauggcucgagugugguuugcaggacagccuggaacuccggcuccagaggauuucccucuucugccuucacaggugcugccgagcacucaggaggcauauaccuggcacacacaaauaaaaauaaaucuuuaaaaaauccccaacagaucauuuuaguaucuuccuguguugugcaggcuggccguguggucaugaaccugcaucauuaucccgaaugcuaggaugacugcuuuguguugccaugcccgacugggccagagagaugauccagcagguuaaaauacuugccacacaacccugugaccugaguuugcuuucucggaaucaacauuaaaagacaggugugcugccuacuaucuguagucacaggauagcuaggguaagauaagaggcugguacaggauaauugugggcuagcuagcuuggagcagcaaagcacaauaguagaaaaaggagauucugccccaaaaccuggugcagggcacuaaccaacugcugagcaguuuuacuuugacaucuagauaggggcuuuggcaugugugcgccugucuauacaugugcgugugcacaugcacacacacacacacacacauacacacauaagcgcacacuaagugaguaauuuuuuaaaauuuuaauagccuguuaauacagguuaaggaguugauuuaguagcuaaagugcuugccuggcaagcaggaggacuaaacccacauaaaucucggugugucuguagccugccugccauugaggccacacaucucauccguggucuuuguuuccaaguagaugugccuggugccccguggugcucagaacaaccauagacuauaauaagagucuuuagccagauucucaccgaggacucaacuguuauaaaauacugcuguccauacaagaggcaucgugguccaugacuuucaucccaucacuuggcaggcagaggcgggugcaccugaucacugugaguucgaggccaucaugggcuacauaguuccagaacagccagagcucuauagagaggccccaucuggggaaaacaaaacaaaaaaccuuaccaaacagcaacaagugagagguucuuuucugucugacauuugcugcuuugaaauuuugagagaugaaugucuuuugguauuuuuguuacaggauuauaauagaaaaaauauaaaaccauggaacucacucacuauaugacuuacauacagguacaacuuuguauaggaugaggccauaaagaaauugaaacucuauguuuguuccuuuacuaacucuuuucguuuaauuccauuuuguggaucacucauaauauuggggaugugcccuggguacccuaggcgcuuguaaagcaagcucucuuuccuuaggauauucguaauucaggguaaaagucgcaucaucacaaaacaucuucacaguuaaucuguggcagauggucacauagguaacagaagggcuacuguuagaaaaucaagacaaacgggcaguggugguacacaccuuuaaccccagcaaccgggaggcagagacuggcggaucucugaaucaaggccauccuggucuauagaacuaguuccaaggacagugagggccacacagagaaacccugucucaaaacaaauggaaaaacaagaccuucauagcaguaacaaggagaaguucauaauaauguugggaaugaggugaagcugaaccgagugugguaguucacggucagcagcuuuggagaucugagccgucaaggucauggguuggccagccugcgcuacagaguguccauuuacacaaaggcaagaacaaaagccaggugucuggguucaccuugaucccugcacagucugagcaggaggaucaggagcucagggugucuuugaucccagcacagugugacauuauacugggcacacaacauccugccugaaaucucacuuugagccgggugcacuauaguugagcaguugaggcugagggaggacgaucauuccaggacuuccuagugagaaaguccagagaagucugugcuacauagugagauucugucuccaaaaaaaucaagaaaguagacaaauaaaaacuuugagcauguuucuggggcuguuuguuauaaacuguauggcugggcacaggaaguggaaucugcugcugcugccucagcggggaugccuuuuagucagugcugaucacccuugcuguucugcaacacagccuuggaacugcugugcuccucaucugguuuagcuuagugacucagugacaaaaauguaaugacaggauccacaaaaugcccuugguggaacacagucauccuuuguggggguggggguggggggugggauuuaacuuggggccugcuguuaugcugguacaguaacgagggugcaucaggagggcaugaggggaggagggcaauagggcaaagagaggaggacuguuggagcacagaaacaacuguuguuguuggauugacaacuggcagacucugcuauguccuaugcugugaccuccaggguguuguuucuugugcuggugcuacugugcaugugucagccccaguauuuaagagguuaaggcaggagaacugagaguucugggccaaccugggcaacauaacaaagucuuauucagaaggaaacacacacaugcacaagcacaaacacccgacaccucacacagaugcaaacacuccccaucccacgaugauaacagcagcaacgauaaaucacaacgaugacguguggcagccagccucagguuuuuuccccaguuguggacgguuugcugccugguguuugguguugagauuguuuccggcuuucccugcgguauuaaugugauauccuacagugggccaugagaacuuaaacuuggaaucaguucccuccaucccugaccugugagcccguccaaagccucaguguuugguacguagugucuggggucccgagaaugcccuggguguugcugcccgggauuagcacacacagccuaugcaguugaucuuguguugugaauugauaaaaaugaaaacucagucuuaaaagcuaagugcacguguuuggaaagcuguucaccaggacaccacagggcgcuuuguaugcgaucgagugauugaggugugagcgccugcugugugggcauugugcucuaucuaucuaucuaucaucugucuuucugucugucuaucuaucaaucguuugucugucugucugucugucugucugucuaucuaucuaucuaucuaucuauaaguaggaacacuguuaaggcugauggccucacagagagcuuugccaagcauuugcagugggaaugaaagcuguuccuugcugucacacauggcacagugugagacagaagacauggcagugauucuuucccuucuuguuucuaggcacugggugaacucugugaaaccaaguuugggaagacacacccuaugugcaauuugguaaguguccaccgggugagucugcacaugaucucugucaaccggcaaaggccaguuuuaaaguaguaucagccaaagacuucucuugaaagacauuuguaugugggcggggcuacccucuguuccgcugcuauuauagaguguauucuacgacgagggcuggcuuuucuagaggagcaggugcugugggacauugaacagccuuugaguagcaucagaauagguugcugaccugcggcagaguuacugguuugaggagacucauccucagcagugugcccucugcucuaauagugcuauagcagugugaccuuguugcagucacaggugccuacucacacuccugucaguguccuuacucagcugcagcaggcuacagagacagcacaugagaguauggggaccugagggaaggaggggcuuagugggagggagacagugacaggauaggacagugcaauaggaauacaucagaccacacacuugcaugcacacaauugugaaagaauaacuaaaauuuuaaacguauaucuuauaaaauacggaaguuggagaguacccucuaucugaggucagaacuauuacagggaacccgaccugcucguccuucuguuuccgggugcuggguggcucugaguguugcucucuaagcuccuccugugucagcugccuuugaagcuuaccugggcccucuguccugugucuaggucgcuucuuuaccccugugguugccgaaguccuuaagcccugguucugggcgggagcugcagagacucuccuacuuaggggccuucuuuagcuucucagucuucgcagaggacgauguaaguacucagugcgcagccaggcagcucauuccugugcccacugugcucuuugugauugccugcguccccuucucuuccaggcaaaggugguugagaaauacuucucagggccugccauuacccuggagaacacacgcguggucagccagucacuacagcauuaccuggagcugggacggguagguguugagaggagagagggccucccuagggaagaagggucugucccacauguccagugcuugccggucauucgugucauacaaaucagacagcuuacaaacagagcgcucuguguugacccuaacccgaugcuuuuagcacuuguugcugcugcuguugcugcugucagugggcagagauaagauacaagccuguugccggaugugguggcacgugccuuuaaucccagcacuugggaggcagaggcaggcggauuucugaguucgagaccagccuggucuacagagugaguuccaggacagccagggcuacacagagaaacccugucucaaaaaaccaaaaaaaaaaaaaaaauacaagccuguuaccucaggugugcccggcaaggugucucccagugacugaaacguagcuaugccacuucucugggaacgucauacgcaaguaaggaagcuuuaugugugcucuaggagguaggcuguccaacaugauucuuuuaaacgugauuucccaguuaauuaaacagugguucuucccuuugugaaaaagugcagcgaaaugcugaaggagcagacuuuguagagggacagagcagaccugagcugggggcuggcacgccugguggccaggcucucuccagcuuuuacuaugucuuccgugugccuugcuaaucgaggccacgcuggucaugcgagcuaagaggcaaaggcggguuauuaacacugacugcucaacauccuuccuguugcaagcugcugugcguucucucucucucucucucucucucucucucucucucucucucucucucucucuuucucucucucacacacacacacacacacacacucucucuuuucuugacuguacuuggguucccuacaaggagagagauggggagugggaggcucuuuuuaaaguaaaaaagaaaucaauuguuuuuucauuuugaaaauaauuuagcaagaacuuuucaagauucuacauaguauuuuguuaaauggcgaaacucgugaagcggcucucagcuacauggcggcccuugucaaugccaacaugaagaaagcccagaugcagguaggaguccccaagugcuuucaguuacucauuaaaccuguuucuccagugcagaugugacuuugcgccucccaggcugcguucuggggguugggaaggcaguacagaacaagacgggcaagcauccugcuucugugcagcccgaggucucaggcaggggguggccaugcaagcacagcauccaggcaguaguagucgcugauggaagugugaaggauucaggcguacuuguaaaaugccggaacggcagcacagggguggcuguugaucaggcagcagaacagccucguauuaaagcuucaacugaagagcggcuccuuacaaggcugagaaaagagcccuccuggugaucguguguuagguuagaaaugagccagcuuuauugcaagcccggcacacacaguuccuuugacucgggggacaugggcagguaacaugcucuugagucuauuuuacugaugagaacucuaguagaauccacagaaggaaacaugugucagccacaaaaugacaaggugugggguuggaagcagaccugaagaagcaccaagaagucuugaggacucuagugugcaugguaacagugggaaaguuaaaacuguagacuguuuuuaguaagaucuuggaagcaaaagaauaaaaguauggagaauugcaaaaucccagugucuuuggacacucauuaguauucugguaugucaucuguugacauugucacaugguagugucacccauaacucaacagccaagaauacacagucaaagaggucaugugcaaaaauccaucauguucuguguaagucuauaguuuuacauugggccacauuuacagcuggcuuuugccacauguagucgguaaguuggccacaucugauaguuacuucucugugccucaguuucuucauuugcuaaguggguuuaagagugaccacuaauuugugagccuuuuacauguagaccauuagaaucguucugagugugucgugaucccugaaccucugucauucagccagggcuguacucacuguguaagaugggaaagcugucaugugggcuaaggacagcucauugcucuugagaaauaagaaaggaaacggaagcuacaguugcuguguuuuacugacaccgauucauugacucuucucugaagugugaguuauaguguauggacuguggguuauuacagaggucagugagucuguggugauggauagguagaaccuugcugggcuggcaccugcuagcugauugacagugguagccacguguccugucacuggcuuuagggccugguuacauuugaaugugcuuucauagauuugcaaaaugugugccuaacaauuguuucaauugcuucacgucuuaugucacaggcagaugaucgguuggugucuacagacggguuuaugcugaaucuccuuuggguccugcagcagcuaaguacaaaaaucaaguuagaaacaguugaccccacuuacauauuccacccaagaugucggaucacucucccgaaugaugagacacggauaaaugcaacgauggaggaugugaaugagcggcugacagagcucugugagugaugugggccuggcccucucauccucgucgcucugagagagagagagagagagagacauaguuaaaaucagcagaguaaaaauucauccuggaaguacucaacacagcuucguagaauacaugggugugaaagugaaaaaaagaaauaauaacaguaacuuuuuaaaagauucauuuauuucacauauaugagugugcgaucugcauguacaacugugugccagaagaucccauuacagaugguugugagccaccaugugggugcucggaguugaacucaggaccucuaggagagcagccagugcucuuaacugcugagccaucucuccagcccaauaacagcaacuuuauauuauauagauuuuguguuacauuuugacaguugaaacuaugacuauuuuaaggugugauaacaauaaucuugcuuauguguggaauagaaugaauuccuacuuaaccugaaaauggaaaugcaaugaucaaauguauaccuucuaaaaaguaauuauuuagugcucagccuuucuuagugcauacggauagccccagcacuuaggagacugagagaaaagaaucaugaguucaaggucagcgugggcuacacagcaagacccugccuuccaagaccaagaaaagaaagaaguagaugcccuuuaaugauuuauuuccucacuuuagaguagaauucggcaauacuugaauaggaauuguaauacaguugcagaggugaaggaggcacacggaggacaguuauuagagcagcaguggcccggggcgaagugacccagggcuuaguagcuuaugaguugaggacuccuucccuguguugccuaggcuagcuucaaguucuuagacuccugccuuaucuccuaagcagcaagaccuugcccuugcagcagugcagcugguuaagggugcagucaugcaggagaaacagccugaugcucuuuagcacggcaggauagccaugaguaguggcagcuccgguguauuucauagacgcucauggaauuauuuguucuaacacaaaaaaugauaaagcgcuccgaccaccacaguuguacacaagugugaagugugaacucuacccuaugagcccagcuauguccuaacuaaaaaccacuguauaauggaacccucuccacgauuccaguuuucugccucuacuugcaacauugauggcuucguaaauaggucuuccuagaagaucaaaaacacaaacauguaggaaaauggccauaauuuauuaauaugcccuaauuauuucagauugaaguaacauguucagcuuggggaaaugaagacgguuuuauagaguauaccagaaagacacauuauaaaagauugaucuaugccaacauuuaaucagauaagacgauauaggacauuaacuaaagcaugaggaauuuauuucucuugcaaaaucgcauaaguuaguaauuuaaaaaaaauguuauuggaggcugggcuuaguaguauaugcuuuaauuccagcacugagaggcagaggcagaggcagaggcaggcagaucucucugaguuccaggacagccagagguucauagagaagauccugucucaaaacaacacaaaaugaaauggccuggccuggggagauggcuuacugggucuguaaagcacugugaggcgagcaugaguuccugggcucagcuuccucagaccucauaaaagcugcauauggguguacgcaucugucacgccaacccugggggaaaggagacaggaugaacuuguauuauccccagucuagccucgagcucaugaugucuguccucagugauauacccugucucaaaagugagguaucuaaaggcacaagcuccagccucacgucugcaaagccaugucugcacaaauacacgcacacgcaugcacacuguguccacacacacaugcacaccauauacacauaccauguccucacagacagacagacagacagacacacacacacaaaugcacacagaaauauucuaggcucauaacugauuucacugaaggauucauguuuguuuguuuguuuguuugcuuuucuuuguagauggugaucagccuccauuuucugagccaaaauucccuacggaauguuucuuucucacccugcaugcucaucaccucucuauucugccuaguugucgucgcuacauucgccgacuucgagccauccgcgagcucaauagguaugugccacgcucgcucuccuggcuugcuguuacugcugccuacaggcacaaggaguugguuguggucagaaugucugagaguaggcugugugcauuacagggugcugucugccucuacuacugcgaugccucucauuuguccaguguucuggugacucaaugauccaggccuugaucucugagcccuuggugcuccucucugugugugguugcuaaagucuguuuccacuaaugugagaaugaucaggaaccgcugugaagaguaucugccuuuaaguauauccaucuugcucuggacuuucuuuuucuuuuguuuuuuguuuuuguuuguuuguuuguuuuuuggagacaggguuucucuguguaauccuggcuguccuggaacucacuuuguagaccaagcuggccuugaacucagacauccuccugccucugccucccgagugcugggauuaaaggcaugcgccaccacgcccggcaugcucuggacuuuucaaacucuguuuuccugugauaaucaagagaaacaagcaauuggacuuuggccuguuguuugugucugaggagcccaaagucuggcuuguagccucaccugucaaccauggaaucauuagcaccauugcuguuugugcuccaagcaucuguggauggucagguuccccgaggaaaggacccucucggcacauggagacagacgccugauggacaggcuguucugagccgcuuccauuuggucuugggugacugucagaaaaacugucauauugaauaucuaacuauacauuccucagaucauggaugccaacauggacuccauagauucuuuuguuuguuuucaggccagcucucuuguguagcuuuggccauccuggaacucuguagaccaggcugaccuagauagaacucacagagaucugccugccucugccuccugagugcuggcuggcaucaggggccugugccacuguuuggcaacucuguagauuggguuuuuguuucuuuguuuguuuuuuguuuugguuugguuuugguuuuuugguuuuuucgagacaggguuucuccguauagcucuggcuguucuggaacucacuuuguacaccaggcuggccucgaacucugaaauccaccugccucugcuucccgagugcugggauuaaaggcgugcgccaccaugcucggcugcagauuguuuuaagguuugguuuucacauaugauggugucacaguacauuccuuuuuauacuuucauuauuuaguuuauuuauugacuauaaauuaucgaagcaauuuguuagauuugugguuuuccuucaugugugucuaugcaccaugugugugcagugcccauggagaucacaaggagacaucaggccuugaacuggaauuacagaugaauguguguccauauaggugcugggaaauuuacuaaagugcuuugcaagagcaacaguguucuuaacccuugagccagcuuuccagccccaggauuuuggguugguuuugggaguguuucguuguuguuguugguuuguuuuuguuuauuuugcuuauguguacaaguguuuugccugcauguauauuugugcaccaugugcuugguacccuuagaagccaaaagaggccaauggaguuagagacacuugugagccauguuugugcucagaagggaacccugauccucuccaagagaguggugcuccuaacagcugagccaucuuuccggccccauucuucuauggcuucuauuauagcguuaaacagaagugugagaccacuucucuuuauagucauggccgucuugaaacucacuuuguagaccaggcuguccuugaacucagagauccgccugccccgucucccaagugccaguauuaauaucaagcgccaccaugaaugcuauaaaaccuuauuauuugcacugugucuucuuaugaauacauacuuauaagauuuaauaaauuaaguacacugagggauuaacaacuaauaaaaaaaauagacaauuauaauauacuuuaacaaaaaccagagauccaccuguuuggauuggagucaugcaccucaaugccuggccuauauucuuuaguuuuuaaacuaccuaagugugaguccgggcgcugguggcgcuugauauuaauacuggcacuugggagacaggcaggcggaucucuugaguucaaggacagccuggucuacaaagugaguuucaagacggccaugacuauaaagagaaacucugccuugccaaacaaacaaacaaacaaacauacaugcauacaaacaugcaaaguacuuaccugugagacaguuagguucgagagucugagauggaccuaggugguuuucauuucauuugauuguuaagauguuuguuuuguuaauuuuagaaccguggaagauuugaaaaauaaugaaagccaguggaaagauuccccacuggccaccagacaccgugaaaugcugaagcgcuguaaaacucagcuuaagguuuguacaguugauugacauaauuauggcccagcuucuuaauagcaauccccuugccagaguaugcacccugagcaagcacucguaugucccuguuauuucuuuguuguucuuuucucucaagguaccacaggacuuguugcuaccuugcauauuuccguaucucauuauuuaaaucucagcagagaacacacauguguauauccgguugagucguuaguaaguguucucgaccgcaguguaaccuccccccuccaucccugccacacucauguucaggacacgcauccagauacaggcugccacggcaguugccacagcgcacuguggcgguagaaagauccccgucaccugugcucuuaaucacuaugucuaaugaagacgaucugucccauagaaccuacaccugaauagcccugcgguaaaagcagagacacacaugugcaucuucugugcuguguucagaaggcaaagcuguguuagcuguucacgggcucuuuacugggauuauagcgaaaagugucucucugauuuccaugacaagcgaaauuuucacguuuuuguuugcuaauacugcagagugcuuuugagauauaaaauggagcuagguguaguggcucauaccuguaaccccaacacuaacccaggccaagaagggaguguggcugugguuuuuaaggccacccugagcuacagaaugagacccugucuuacccgaacgucaggaugcagaaugaccggagcucuucuuucagaucuguagccucccuuauauuccauuguugugacuaaggggucuguaagaagcucaacauccacuugcacgauguggcucugugugucuccucuggcagguggcccucugagauguggccucugugccucuccucuggcaggcggcccucugagauguggccucugugccucuccucuggcaggaggcccucugagauguggcucugugugucuccucuggcaggcggcccucugagauguugcagacagauauuuugcuugagaguagcacagaacuguugaugcugaaauucagauacaacuugucuggcuuuuucccacuaauuguccaaguuccugagcgaugaugucagugacugaccuucagcacugacugauggccucucugcucaguggcuugcauggccuaucuuccuguugucuuuauucugaaaacagaaagacccugacacaaccaccagugucccgaggcuaggcagagcuaccgaaccuagacuucucaucuccuggccccucacugccuacucaugcucaggggccauggcacuggacuaaucuucgggccggggcccauccucuuccacagaaacugguacggugcaaggccugugcugacgcuggcuuacuugacgagagcuuccuaagaagaugccugaauuuuuauggccuucucauucagcugaugcugcgcauccuggacccugcauauccugaguaagugugcucuuugccgugccucgucuucacgguggcuaccgggcuauuguucuugagucauaacuaaaccuugagaauuuuuauaguuaugcauaaauacauaugaagcuagauuaauauuuccccauguguuuuuuaguggcugucaguuuuaaaauuuugcuauaacauuggauggcuagaaaaggaaguuuauaaauuggaagcaaagugcuagaggugacaggcuccugagccuccugagcaccaagucucggagagccgaggacaccgacagucacuguuguuguuuaagucaggucucuuacguucugugaacccccuaggucacagguauugguuaguuuggccuguguuccuaaaagacuggaaaagcuuauauaaaguauaugcuggcuuuauccacccaguaugaguugcuugaaaugaccaaauucgaccuuuggguuucuuucccauuuuaacuacuuccuuaagucuggcaagaaaagaagaugaggcaaacacuuacaaaacacgcccaggccuuccucauccuuucugcacacugcgggucagucguuugccugugcacuuuuacacauguguuacacagugagggcugcucuuuccacauggggcauuuggaaguacaacaccccagguaaucaguguuccaugauagcauuuguaaauugugggguuuuucuccucuacagcguaacacugccuuugaauucagaaguccccaagguauuugcagcauugccugaguuuuaugucgaagauguugcugaauuuuuauuuuuuauuguacaguaaguacuucccguacuguauguucuucugcuuauacacugugccugguccucugagcugugucuucuucugcuuauacauugugcguggugcccugagcuguguguucugcugcuuauacacugugccuggugcccugagcugcgugguguucugcuuauacacugugccuggugcccugagcuguguguucugcugcuuauacacugugccuggugcccugagcuguguguucuucugcuuauacacugugccuggugcccugagcuguguguucuucugcuuauacacugugccuggugcccugagcuguguguucugcugcuuauacacugugccuggugcccugagcugcguguucugcugcuuauacacugugccuggugcccugagcugugucaugguucacauagcugcgcuucagucggagguugugugacucuguuuaccugaaugcugcucagaacuuagagaaagaaacccccuucagcagcagcugauuccaauuugaucuccaagacagaggcaguggcaaguucucugugaaaccugagcaguguuugauaauugaacaggcucuggagaaaugccccaggaaauguccaaaaccaaaaguacccacagcuguguuugaaccaaaacugucuccauuuguaaaacuggagaagcugcgugucugguacguggggggagauaggcaguuuguuuggauuuuuguuuccuaaaauccucacuucaggggcuagagccuucucuggccucucagggagaccccucaggucagcugcccagcagguaaagggcccuggacucaauccccaguacuacugaaaacaaaaaucaaagcaaagcccuucacuuuucauuuugaaacugugagagguaauuucucaucaccauaacuauaugggaacugguuggcagaagaaugugugugaaaucugguuucaaacgcaaaagcaggauagaccagaaacaacauccaaaguuauacaaagcaaauuuguguuauguccuaaaagcugcccccagccgagcaugguggugacugacaccuguaagcccagcaccuggaagcucacacaggagcauugugaguuccaggcuagccuggucuacauaucgagccgcucccucgaucagcaaaaggacagacaagcucucucugugcaggcccagucaguggugguaacguggagggguuaguuuuuguuuuuuugagacaggguuucucuguacagcccuggcuguccuggaacucacuuuguagaccaggcuggccucgaacucagaaauccaccugccucugccucccaagugcugggauuaaaggcgugcaccacuaccgcccggcuuacauuuuaauuucuuaaaauuugaacuuuuuuuuuuuuuuuuuuuuuuuaaauuggggcagguggcuagagagauggagaucaauuccagcaaucacgagguggcucacaaccacauauccuaggaucugaugcccucuucuggcaugcaggcaaacauacagagagagcacucauuuacaaagauugggugauauuugagacuggguuucucuguguagcucuggcugucuuggaacucgucacucuguagaucaggcuggccucaaacuccagagauucaccugccucuaccuccugaguugugggauugaaggugugugccaccacugccuggcuaaaaauauuuuaauuacauguauuuauucgugugcgcaugggguccuugaaugcuacagagguccugcuaacaauuggguccuagagauggaauucagguuguccauucugaagcugggcauggucaugcauucccauaauauaaguauuugggaaguagaggcaaaugauaacacguucaaagccagcauauagugaauuugaggacaguugaagcuauuuaaaagauccugucuuuuaaaauaaauaaaacccccacuuuuggacagugaagaucuuuuugugaaguuucaguuauggcuuuugcuuacuuucuaaaacacauugcagccaacacucagguuugcuuugaaucuuuguggcuccagugugcacauuguugaaccauguagaggcacuccaguacucccccucugcugugugccccaguaucccccucugcuguguauguacuccaguaccccccucugcuguguauguacuccaguacccccccucugcuguguaccccaguaccccccucugcuguguauguaccccaguacccccucugcuguguauguaccccaguaccccccucucugcuguguauguaccccaguacccccucucugcuguguauguaccccaguaccccccucugcuguguauguaccccaguacccccucucugcuguguauguaccccaguaccccccucugcuguguauguaccccaguaccccccucugcuggacccugucuccuucccggccuagcgagcucuccgagacucaccauguguuuucuccucuuuacagauacucuccucaggugcuuuaugagcccugcacucaggacauugucauguuccucguugugaugcugugcaaccagaacuacauccgaaacccuuaccuaguggccaagcugguggaggucauguucaugaccaacccuucuguccagccgagaacucagaaguucuuugagaugauugagaaccauccucucucuaccaaacugcuggugccgucccucaugaaguucuauacagguggguuucagaguaggcccugggguaugugguaauguacuugacccaagguuguuucagagcgaacuuaaaucuaaaucugugaccuagauucacaaauagauaaauaaauaauccugccaucaaggcuuuaacaucugcuuauguaaaucacuuccuagccccagcucagagcacaggcugucgcaugccuucucucccggccucugagagcucgcacuggccacugcgugugcggccuuccguugauuuacacuguucguuguuguuaguccaagcugauguuuucaucugaguuguuaaccugguucauuugcuguugaguuuacaguaucugauauauaacaccauccuguggcugccuuuucaaagagauggaacaggagagaguuugauauaugcauucuaggucauccuugacugccacagcaaguuugaggcuaccuuaagcuucugaaaagaagaaaaaggcaacaacagaaagugacugggcggggcuggagagauggcucaacgguuaagagcacugacuguucuuccaaagguccugaguucaauucccagcaaccacaugguggcucaccuguaaugggaucugaugcucucuuuugguguguccgaugacaguguacucaaauaaauaaacaaacaagccuuuaaaauuaaaaaaaaaaaaaaaauuuaagaaagugguugggcuucacccgagccagugagcugagcauucugggaugcucugggaguccucccacauucaucagcguaucacauucacugagcuccugccauuugcuagguacugucugcugugcucaguuacacuuggaaaugacaggguauggagaaugagcugucugggcagacuguauuccacauuuugacuguuuaacaaaauuugacuuuugaacucucggguuaaucucuccucuaacaaaggcuuccaguggcuaauggaaguuccugggaucugcccugccuucucauccuguauagaaucugguacuuucuggccauacagucaagugucuggcauuuaguagaccuugcugagcucugcggagaauacagccuguugcuguugacugggguggccugugugaggauucccaguguucccacugccuguuuggacucagggucagccaacucucccaccuuguaaggggcucugggaaucugccugccuacuuccccuuggucacuguuacuuuguuacaucccucccuuagacucuccugugucugaaguaagcacuugcugacuugaguauuuugauaacauucuuucuuuggagaaaguccagugcacuggcacaccuuuuggggaaaaaggucauggucuccuagccauguuucaggauaagcucggcauauuuagguacaaaugccaccuuguguguauucagaacaggagcaguguacacugcagguuggaggccagucaggaauacuuagugagacccugugucaaaaacaacaacccaaaaauuuacugaacaauccaaguaauagccacauuccacaggagguauauauuaauauuaaaaaauagauuuuuguugaaucuaguuaguauucgguuaguggucuggaccuguuacuguagcuucagagagacagagggagggagggagggagagggaggagagagagaggagaaagaaagaacacacacacacuggcgugccugaggagcauguggguggauaucauccacccuuucucucugucguggagcacaguggccucuggccugagcccuuccauggucauggguagaugacaccuuuccuaauaauaguugccacuuguggucacuugauccgaauagccauggaaaagauggguacuauaaauacguccauuuucuaagugaggaaacuggagcuuagaaaggucaggaugcuugcgaaagguuaaggccugugaguggcaggugcucagcagcuggacucuagcaagugugccuggcugcucuucuggccuucacccugcugaaacuucacagucuccaugggccugcccagcaccccaccaagauaggacuuagaguuguauaucccaaggucaacugcagcaaccagcaucucucagggcauggcacauaggagguacuuaugcacaaucuuguuucaaaaauaaaauuagacuucaaaauaagaggguuuuaaaugaguccuaacagucuuccuuaaggaagaauuccuuaggaauuccugaggcuccgaaggcuauggcuacaagacuuauuuccaggccccuuccucauaacuggcuggcugcacagaggcagggcagacuccaccucuaacuuagcagcguuuguguugggccuacuaugagaggaccccaagaucccucauggaggcagacguggaagaguuggggacaguagcugucagagaaaaugggcuacuucacaaaaaguggucuaggcagagcucucugggauggaugcagacaucugcaucaguugaucucggcugaggagugacagaaaaggcagugagguggaccuggaagguggcagcaggaagccuuguucaugcuggacgugguggcacauaucuuuagucccaguggucagcaggcugagucagggggaucaagggcagccuagucuacauggauguuccaggacaggguaaggcuuaugagauuagcaagagucaggucccuuuaaggacuugggaauuggaaccugagcaauaugauuuugagggacauuuaggagcaaauaaagcagaaauguggggagagggguacuggugggcacuggauaacuacagucuugguuaaucuggaccccugagaucucucaaacacugaaccaccaaacagacagcaugauacaccagcugauaugaggcccccaacacacacacaguagaggaguuccgggucuguguucauucagagaugaagcaucucaagagacuggaggccccugggaguuuagaggucaggugggauagggugguggcaucuacauggagacguggugggauggggaggaggugugggauauucggagcagucagaggguggauggggaggggcggggaacagacuauggaguguaaaaaugaauuauaaauaaaauuaaaaagaaaauggaauccucccuuucuccugugccuuccgucugagacacggguagcgcuucccagccucacugucacugagauacggguagcacuguccccgcugucacugagacacugccaugucauugcaucuggaaggucaggaugugugucugagucccuuugucuuuccuccuuagaugucgagcauacuggagccaccagcgaguucuaugacaaguucacaauucgcuaucacauuagcacuauuuuuaaaagccuuuggcaaaacauagcucaccauggcaccuucauggaggaguucaagugaguauuggggccugauggcacagcuugcucucaggcagagcacaggugggaggggaggcugcugaaagcccgcccagcggcucccuguggcugcuuucugucucugccucucucaaguaaccacaagacacugcucagcguggacaccuacgugauugucugcuuacuuuagcguuguugacacugggaguggcuuacauggcagaauguucuggaaaaauauuuauguggagugauuuuuguguuuacucugaauucuauccuauuaaaugcaguuaucugacucaggaacauuaagaacacauccgagguuucgaagcacuuggguuaagguggccucuuaauuuauuggcugcgcuuauaugccaagcuugaaacugcagggccuguguaagccugcucaguagccauuccucuaaauuauuugcaaguccuuaagaaagaugagugugaacauugaacccuugcuuuauccaucaaaggaaguuuagccccauugcauaccagaucuuucaucagucuagcugucuguccuguguucaguuacuagucgguguugccggcaacgugagcugcaucuguccacacugcuuuuugaaaauggaaguucuggugucccaaauuccugagucugaggccuuguguucauguucauguuccccucuccucccagcaugggcuuucuaggugcaccugcugaggacacugggccuucucuuuuugccaagucucugucaguuucagaaguucacaguuccccaguaagugccuucauuacagcucucagcaggcuccccuuagacuugacgcuuugggucuauaaccugaguuccucucuuccuuuauugauauuauaggacuaguuuuucuucagguaucuucguugugugagagacagcuucaucaguagccuccaucucuuguguuuuguaaugugcucuuggugcugguucucuuccagccuggaagaggguuuccucuacguagaaacaacagcucuguacagugaaccucuccagcaggaagaauuucagcauuugcugcuuuucacaguguaacaauguaaauaguugccaaguuuaaacugccaaggaagucagcucagggaauucuggacuauguauccgcuggcuccuaccagccccacagugcugguccagcugccacuugagugagcuugucacagugaaugggaagagcagugaggcagagcuugguggcgccugucugucaucccagcgcugugauacugaggcaggagaguaguucagauaucagccugggguaggaggaagaccuuucucaaaaccaccaccaagggaguaacaaaaucuaaggagagaguuaauuggcaguccuuaaacuccagcuauaucaucugcgacaggauuugcagugucacggggagucuugguaccuggggaggcuuacauucucucuccgugcccagccagguguucaccacacacugucuuguugcccuuucaguucuggaaagcaguucguucgguauaucaauaugcuaauaaaugacacgaccuuuuuacuggacgaaagucuggagucucugaagcggauccaugaagugcaagaagagaugaagaacaaagaacagugggaccagcugccucgggugagaaccgccucugcgccuguacgggcucuggggggcgggggggucgggcaacacuaggucugacuuucugcuggggccuuuccuaccuuaggcguccguaaaguagcauuucagguuugagauaggaagagaugaugcuucuuaaagguuuuuaucuaaagacuuggggcagaggguguggcucagugguagagugcuuccauagcaugcuuauaguccccaguggugucccaaacccccgggaagaaaaguucacucucugcuugaguuucgggcaagaauguuccuuacuuuacuaagacuggcuaucagguguccccucaaagccagauucucauugccaaaaccagucucaucgguugagagcacuucacuguucuuccagaagacccagcuucaguucccagcaccaacagcgcgcagcucacagcugccugugaaucagcucugauggucugaugccuucuggacucaugggacuccuucacacacagugcacauaaacucacucaugcccacucacauuuauauaaauauaaacggauauauauaugcagauguguguguguguguguguguguguguguguguguguguguauguauacaucacacacacgcacaucauaggguugagguaaaacucaggaguagaacagaaacuuaucauguggagagacucuggauucuaaaaccaucaccaaaguauaucuuaaguugaagaaaugagaagccuuucccagugugucauggguacuuucucugucuuuucauuuaaaggguuguuagaggaauguuucguuguauauguugugccuuuugacuugugugguagcuaggaaauaacucucaggcuucugucugcugggcaggaguuggguuugcucgaaaggccucugcagaugucugacgaucaccuaggaccuuaguggagcuuuuucucuccuguugaucuugguuuuuacuagaaaaaguugccaagauccgcgagaaaugcaugcuguaccagugacagugcacugcccucuccuaacucaguggaagccguucagaugguuccugguaaccugggacgucccgacaacucccgggaaugucaucgugggcuuggguuagcucagaaucaaagcagcuuuccacaggguccugcccccauggggagacccuggugggaagugggguggugcugcacucacugugaggcaguguugaaguccuguuguugaguuaaaaacaucuucacuauaggacacugaacauuuaagggaacuuuuucuuaaggcagagucucaccccuaugugacacugguuccccuggaauuaagagcuccacuugccucugccuucugauugcuggaguuaaagguguguggaccauagcucgguuuggggguggggccgggucucaucacagguauuccugcagcugugauaagaaugucacauccugcuccuuccauagcauucugcauggggguccaugaacgccuggcccucccuguagccguggccccaaacccuucccuguugagauaauggagguuuuccaauggguccuguuuucuccaacuggacccuggguucauuucuaaaaaaucuucaaccauccuuaauauguuagaccucucuccuauucagaaauggccagugccccaugcagccccaccuaacucuaccucugcuccugccccugccucaccuguucucccuccuguguuauuuagaccagcuaaucuccuaggaguugaucucugggccugaagcccauucucucugucaccaucaggacauuuacuugagacaaauacuauugauucuucccuuaauggauuuuuuuuuuaagcacaaguugccucuaaggucuauucacagacagcuuuuccuugacccuugacccugagguuccuggcugccuuucacuuccucauccaucccccagccuccaagcaaugguagcuccagagcucaguccucuacuucuaaguaugccccgccccugcccuuggguaauuucucuguggggcacuaacaggaugcugaagcauaucucuguaagaaacuguuguucauuuaacaccagccaugugugucuuccuguguuucagucuguccuaucuccuucauccucacccuccacccccaacccugcucacacagccaaacacuccugcacguucccugaugccucugcuugaagucacugccaggugaucucaucuuuuccagggcuuuaaauaucuguauuuuaaagacugcaaaauauggcugccugcuuagagcgcuccugccugcaggccugagcaguguggccugcuuugcuuuggcugugcccuaauugccucaguccugacuuguccuuuaggucuccucucugagucacaaugaccuuaaucaauggcagcuucauucuacccauuuccugguugcccgugauuagucugugccccauccccugucuagacugucuuuuaucuccaugggcugaagcuuuaguucagugguggggcgcucuggguucacuccccaguaccuuacaacagaauguggucgugucccccuggaauggcaguacuuaggauauggggcaggaaggucaggacgaguguguguggccucuuccuucuccuuccaagucaccauucugcauuacccucauuguugcagcagcauacucguagucuccacccucaccagugcacauagccaagggaugccccuucucacacaaaggcuugguauccuagcgggcauguccacuuuucugcccuuagcucccaacccccugaccccucagucuacucccuccaucuaauccccccuccagcuacucccccccuccagcaaccucuccccuccagcuacucccccacuggccuuucccacuuccucuuugcauucacggccccucuucccacagugcuguugacccagacugaaaaccuggcuggggcuugcugaccccaacaucauucuugaccugacuccccaauuccuugucagccuuuuugugugucuauucaaggggugugauacuuuauuaagcaaagucuccaacagaguugggagucucucugagccauugcugugcuucagucccaugccuaaggacuccauaagagugcggagauacagcucagcauagccucuagcacccugagguguugucuucccacuaagauaccugugcugggggaggggagccagagccuuggcugcugugaaggaagaauucaagaccagcuauccagaagcaaagccaguaagguuuuaagauaaaggacuuuaucuacauccuucagguuaagcaaagucaguaagguuuuaagauaaaggacuuuaucuacauccuucaguuuaagcccaagcguuuugagagaggggcucucuuaggugauuuucuauuuucaguugugagccuuuaaucuuagaugcuuucaaaauggagauuucaugugugugucugugugugcauuucugugacuuaaauuacagugcuauaauuugcaaggaguaaaguuuaguauuuaaaauugaaauaaaauauaugaaugaagggcuggagagaggacucagguuuguuucccagcagcugcaucccaauuccaggagaucugacagcccucucuggccuccuuggguaccaggcaugcaccugguacuaacauacauguaggcaaaacaaaacacucauacacaugaaaaauaagaucuauguauauacaugcgugcacacgugcacaaggacugguuugcuuauuucuuauccuaaaagaauuuuguuguguaaauguaauuuuaacgugacuuuaugagguucacugcuuaacuguaagggugagugucuuagucaggguuucuauuccugcacaaacaucagaccaagaagcaauuagggaggaaaggguuuauucagcuuacacuuccauacuguuguacaucaccaaggaagucaggacuggaacucaagcaggucaggaagcaggagccgaugcagaggccauagagggauguucuuuacuggcuugccuccccuggcuugcucagccugcucucuuauagaaccaagacuaccagcccagagauggucccacccacaaggggccuuucccccuugaucacuaauugagaaaaugccccacaguuguaucucauggagacauuuccucaacugaagcuccuuucucugugauagcuccagcugugucaaguugacacaaaacuagacaguacagugagagaaguugugaacacaguuaaacucaagguagcccacacucugaacguaagcaaacaguugguuguucuuacauuuuugagaugucuuuuguccagagcacuaaugucuauagaaaauuguguuuaaucgguuguguuaaaguuucagccuguccaucugucuugccucagaccaagccugcauaauaucugcaagggaaagaugggauacucagacucacacugaggccauugaggccuggcuguuccugggcccuuccuggugcagcuuccucucaauaggcucauucuuagcccaggagaagugggcagcucaccagcccacugcagagucuccaccaggcacggagugcagcagcagcccagagggaacuugcugggcuguagcugccauuccagcuguuugcccuuccccugggggguggggcugaagccaggcaggguggcacccaguuguaaucccacugcugagguaguggugacagugagacccuucaggcuugcuggccaguuagcggugucuacuugacauuuuccaggcgggugagaaaaacuguaaaagagaaaaaaaaaguuuggggucgggggacccaagaacaagacccaaggauuuucucuggccucgacaugcauaccuacaugcauaacaguagcaaaauuacaguuaagaaauaacaaugaaaguaaugucgugguuggggcaccacacaugaggagcuguauuaaagggagggccacagcccugggaagguugaggacgacuggucuaauucauccucccaggaacuaacccugccuguuaucgaugcgaacacugaugcucagaggggucagccaugggccaggacuggguguaacuuagugguagagccuguguuuagcaugggccagcuggguguaacccaaaggugucaaggccaucagaggacccguccuggaaggagcaagcaugagcuguguggucagugugcugguguggccauuaccucuguuucagagugcacuggccugucacccucugcaacuguaagccggccauguuuuuccuucacacuuggccaaguguucugaguagccggcugguacugagauuucuuuggcaacuguuugauguuucccaggaucagcagcaggcccggcagucucagcuugcucaggacgagcguguuucccguucuuaucuugcccuggcaacugaaaccguggacauguuccaucuccucaccaagcaaguccagaagccguuccugaggccagugaguagaaacuggggugcuugugugaucuuuaagggucuggguacagaacuuauaacucagcgcauguucauuuuaccuacagcaaccagggaguagaauucuuuuuuuucuuccuuugguuuuucaagacaggguuucucuguauagccuuggcuguccuggaacucacucuguagaccaggcugaccucaaacucagaaauccaccugccucugccucccgagugcugggauuaaaggcacgcaccaccacgcccggcugugaauagaauucugauuuuguucccaguugguccacaucacaugguacucuacagggcugaaaugaagccccuuaacguauacucuaaaauguucacuucaagauugcucucuucugauuacacagcacauuuggaucaggauuugugacacaauuucauuguuacugaauuaccuguuuauauaucagaaaaguauaagguaacacauuaugauuuggaggacauuaaguagaguaauagguaaaagaugcuugcugcuuauaaaagagcuuugaggcaacauugagggagcugggggcuccugagaacugugacugaggcuuacugugaccugauggcugaaacuccuggcccaguccuguuccgagguugagaaugggcaguguaauggagaccccaccccaguaaagagcugagguaccugugggguggcagugcgcagggagcugagguccaucugcagcugucugcacaugugcagcuuuacuguguauuccucuccuucucugugcuuccucacugcucugugacaggaaucacuguguugccuccagcagggccacugucacacgggggccugucuacagacugagaucugggucuuuuccuguuucuugauaagcagaugucagcauagcagcagaugcgagcgagcgggaagcagcucaccgugguccacauuccugcucccuuagggauguguaaaggggauuugcuagcaucuccuaccaaggcugagagagcagccgguuaaagguguuggagaugugucucaggcaccugcucagcugugcuccugugauagccuggacauagacaagccugacuguuuuccaaaagagugaccacauucaaauacaacuuuauguguggguguguuagggacgguauaugcuaugugcuugccagcgccuuuggcggucagaagagagcuuuagacucccuggagcuggauuugccuacucuuaggagcgcacugauauuggugcugggaaccaaaguguguguccucuggaagagaagcacguuuucuuaaaagccaagccaucucuucagcccgccugcauuucugcccuccuuccuugcucgcuuaagcacuuuuucagcccccagcuuuccaacacugggcuaaaaccaugauuucuacaacaggaagcucaggagauuuuuuuguaugaacccagucacugcaugaggaccucauuaguuaaggaaucuuuuugcuggucaguauuuaaugucuggucuacagcagcugucucugagcucagaagccauguuugucccagcugcagcagguacuguuggccugccgacucuugagggcuauuuguccuuaauauucugucaguuuaauucaucacaguggcaagacguacgccguugacaaaugucaccgucuucucucucuucaguaaguagauuagaacaacacgugccugacuguuggggacuugagaaguuuauggggaaauguggacaugaggcuucccagccacagugacaggacagcgagggccucuguccucucccugcuucucagugacuuuggagugaugcucuaagagaaagugucucuuuccagaagacuucugugggcguucaucucuaugcaaucagaccacuccauuauagggguuuucagaucaauggcgggggagauguuugauuccaaugcuuucucuagcuuugugcugcagcucagcacaauucaggggugcuuugcagauugagcagcccauucccacugggguaggagcuucugggccuggacuuugcagcagcuuggaccguccuguuguccuucauuuccuaggagcuugguccccgauuagcagccaugcugaacuuuaaccugcagcagcucugcggacccaagugccgggaccugaaaguugaaaacccagagaaguaugguuuugagccaaagaagcuguuggaccaacugacagauauuuauuuacaauuggacugugcucgcuuugcuaaagccaucgccgaugaccaggugagcacugaggaggcccaucucaucaggaggccuggcacugagccgugugguuggcaucuguggucugcaccuucacagcagaccuugugcguguguguguugucgucccccuccacccugugcguguguguguguguguguguguacuccacaccucaaaagagguuaaagcaggaauuuuaaagucucguuuucagaaguuguuaaugcagugaacaugaagucgaggaccacagcugguccaggagaagaacugaugcuuccuugggagaauagagcagagcuggcccccuaaucccucagacccccaaacagauucuguuuccaaacucuguuugcugugucaggaaauugcaggucuucccaagcgcccugcuuaccagcugccaugaauacauggccuucaagccaacgccugccuccucuccuuuauccaagagccuugggggucaggucagcucauguaccacagccuccaguacaggccuucccucugugaugucacagaaggggauccuguugacuguccugguggcacaagccuguaucccaaauacucagggggcuggaaacagguuggucacaaguucaaggcuaaccuggacuuaacugagaccauccaugaaaacaaaauugagcuaggaguauaguucagcgguagagcaccugaacuugcaaaguucuaggcucaacccuuaguccagccggagacuuuugcagagaaaaaggaaaggguuccuccccuccauggucucugagcaucuuucuucccaggucuuuugccauaaugucucguguagacuaggcuagccuuugaacuccugaucucaaacucuccucuugaguacauugaugugugcuaccaugccugacaucugggcagcucugcagcacaguaaugcuucguguuuacuguauaccgcucugaccacucauuugauaagcaugaauucuauggcacagcuucuacuaaacccuuuguuuuaaaguaaggaacacagggcacagaggagcuuaguggcguguccaggcucagaaaguaugguauagagggagaaugugugacuggcagucaaacccuguacccauauucucaccaucucccuaaauguucagagugugguauauugcuucccaugucacuaucuuuguaugcacagcauauguuacccauccucagaacucuccaaaggucacugccuauagcuaauucaaaggagcaauguuaaaacacaagaguuguauauauacucuuguuuucuuaguuugguuugguuugguuuuuuuuuuuuuuuugagacaggcuagccuugaacccaggauccuuuagugucagccucccaagugcuagaaucgcagguauguguugaucauacacugccuuuuuuuuuuuuuuaagauuuauuuauuauuuguaaguauacuguagcugucuucagacaccccagaagagggugccagaucuuguuaugaaugguugugagccaccaugugguuuccgggaauugaacucaggaccuuuggaagagcagucagugcucuuaaccacugagccaucuuuccagcccauacacugucuuuucaacuacaacuuuaucgcacaauuauuaauguaucgaugcuucuuguuguuucuuacuguuugggacacugucucgcuguguagccggccggcugccuccccagugcugggguuccaggcguggacaggggaguggagcggggauaugcagaggaagcaggccugugugguuauuuagaaauggaagcuuuaaaaugcagugcucgggggaaagggacaggcagacuuuugaauucagugccagccuggucuacauaaaacguuccaagccaaccagggcuccauacugagauugucgcucauuaaaaagaaggcagauggauuaaggaguuucccccacugcuggaaagagaugagucuguguaggugucaguguagauccugcucacaaggucacaagaugagcagcagacucggcagaggccucacagugaaacagaagcuccugcaggcccugucgcuggccccuugcucucacacuggggagcagagggggacccugccauccugcuccuccucugaaucucacgugcagucucacaggccggagagggaacggcagcauuggaagguggagucuucacguaagcaaauucauggacauugguuuacuugaugguuuugguuuguguucuguuguugcuggugugauuagagacugugguugugucccugggccccaggagacccauucuccuuuguaucuuggccuaagucagcaagugggcacugugaagcacgagugcuguguguuuuguggugugggugauuguuacacaguagaucccucagagcugagucgcugaccacgucacaccugaggaaucuaguuugggcagguuagggauuuacaugagacuacaugacugggggcuggagagauggcucagcagguaagagcgcugacugcuuuucugaagguccugaguucaaaccccagcaacaugguggcucacagccauccauaaugcgaucugaugcccucuucuggugugucugaaaacagcuacgguguacuuacauaguaaauaaaucuuugggguuuuuuuuguuuguugguugguuuuuuugguuuuuugagacaggguuucucuguauagcccuagcaguccuggaacucacuuuguagaccaggcuggccuugaacucagaaaucugccugccucugccucccggagugcugggauuaaaggcguaugccaccacgcccggcucaauaaauaaaucuuuaaaaaaaaaaaagaaggaaggaagaaaagaaaaagaaaauuaaaaaagacuguauaacugggagguaaugggaccugaauuugugucuagguuugucuggguguguuguccacuguucgcauuucuacaaaugaugucagucaccugcuuauaggagggguucagugcugugggaaauguggcauuaggaaguguugguuucagugagugacgaugcucagcuguugccuggugauuuggcuuacugugcucuguugaguauggccucaccauguagccugcgcuaggagggaaggaaggaguacacgugugacggccaccaugcccacucaugugagccuagggaaccagcggugacuagagcaaagcuccccucuaaguauggacaguaaugggccagugaccuaugcuugguucgcaucugugcucacccuuauguaaaaaagcagaauuuagucaugugcucccaggacacaguggcugacacaaacaaauaaccucaaucuccucuuuauaacaaaugcuugcuagcuccuaaaguuaaaaacuuccgguuucucuggguccuggagcuuucuccacaggugaccuuggcacacgugagucugucucugugcagaugucuguaacuauauccagugcccccuugcccacgguacaguguauaggagaagaugggaugcagaauguauggucacagucauuaggagccaaggaucucgcagacugcacuuggccguuucugauguguuuucuucucaaguguauucucaucuuacgugaccuuccuugugugcagcgauccuacagcaaggaacuguuugaagaagucauuucaaagaugcggaaggcgggaaucaaauccaccaucgcaauagagaaguuuaaacuucuugcagagaaaguggaggaaaucguggcaaagaaugcgcgggcagaaauagacuacagcgaugccccggacgaguucagaggcaaguccgcaugcucaugcaguguaacuuggaguguguggcauuaagggugcuuucuuggucacuguuucauuccugugaagcuauuccacaaucaaggcaacaguuugagagggugcaugcacgaucaggauagcagggccauggcgacaggcaggcaggugugggucugagagcucacaugcagacccaggcagggaggcaagcugccagagagugcaaguaggcuugguguggaaaccuuagaguccacuuccagugacaaaucuccaucaagaccacagccauuccaacaaggccauaccuccuaauccuuuugaaacuggucuguuaacuggggaccacgaauucaaacauuugagccucuggcgagucguucucaucuagaucaccacaaggguggccgcuggcucugcuucuugauugucugaugcuauagcugauucuugagauuugucgaaaauuaugcguacaaauuguagugaauauuguagauuaaaauguugaacauccgaggcuggagagauggcucagugguuaagagcacugacugcucauccaaaaguccugaguucaauucccagcacccacaugguggcucacaaacauccaaaauggagucuggcacccucugcuggugugucugaggacagcagcaguguccguccuacauugaccauccccagugcgguuucaucagguacccaggaagacuuuaaaggcagcucugccacuaucaggaaggagucuggauucuaaggcaaaggguucugcccugggccugcugccuggcuguccucuuugcucuuuucuccucccagcagcagugacagaaggcagggcaaggccuucaucauuugcugccuuccuuuacugaggggcuugaggggcugcucgcuccacagcucucccugagacugucucgcugguaggaaccaucugcuuuuguucuugaggguuaguguguucugcucugucuccacagacccucugauggacacccugaugaccgaucccgugagacugcccucuggcaccgucauggaccguucuaucauccugcggcaucugcucaacucccccaccgaccccuucaaccgccagaugcugacugagagcaugcuggagccagguaggaggccagugagugcagccagaccgugcgggagacugagagcuggccggugccgcgaggccuguagucccagcuaccgggguggaugaagcagaaggggagagccuguucauggcaaguaaguuccgacaguguaauuacaacacugucucaaacaaaaaggaaaagauggcugggccugcacagagcccuugcccaacuguguacauucccaggcucaguccccagcaccaccaccaggaaaagggacauuggauccagaaaguacccaaaagccacagagcacuccgcucacuuuggcuguaaauguuucccuguccauggcuguuccuucugcagucuucagcgcccacagggagugagcaccguggacucuguguccacgcagauagaacugcaguggaagagccugucauccgggucauucauccccugugcuuucucccucagugccagagcuaaaggagcagauucaggccuggaugagagagaaacagagcagugaccacugaggccccaucgcuccuccgcuggaagccgccacgccagccagccaggccgcagcagcaucugccucgaggcugcagcuccagccuguaaccagauguggccagauccugagagcccacccgugugaccaaacaguggagaucugaggggaugacgagaagaggauuccuguacauauauuuaagugacaacagucaaagcuugagggacgaguuuacgauggcuuguguaguaaagcgcacccuucgccugucgcuaccuggggcuguggcagcggaaguguuuagugacaagugggucugggcagcuuccccugagcuuacguuuuguuuuguuuuguuuuuucgaugugaauagagaacucggacauuuugcugcuaaacaaucuccccucccucacccuacuugcacugcuguggguuuuuuaaagagaaacagaaccagacuccuuucccggcccuccaaacauguauucugugcgauaacuugugccugcgacaaguguuaaucuugggaucguauuuuuauaucauauucacauacuuguuuuuuuaauugguguuagaugacaugauuaauaaaaaaggcaagauauuuucagaauuugaauuucaguuuuuuuuucuuuugaaauagcccuuuuaaauuuuuuuauuauaaacaaaaugaagagaacccugugagccugguccuucuagcaacccucaguuaagauccugagggacaggugcagcagcagcuggcuggaguggaucaggacuccugugacucguggggcucgggggaggugagggguguguuugguuuuuuguuguuuuguuguuuuguuuuaauccuaugugacaauuccaacuaugcgguuacccucugaggauaaguuccucagcccgggguucuuuuauaugcuguguccuuuugggguuugaccuuaccaaagcaaagaaacaaaaaacaaaaaaaacaaaaaaaaaaaagggugcaagaaauguggaaaucugucugcuuguuuacauggcccgacaacaccaccuaggcgcacgcgagcagaagcccucucuguauuaccgcucccuacgcaacauacuugaauucuugaguucccuuuggggugagaaaggauuugaaaccauaaaguguuuuaaagaaaugaacucuucagaaacagacuuccuccucuuuuccuuucuccucugcuccacagccugugcucuguucaguucccaacacaaucgacaauaaacggugaugcccauucggaaggag

SEQ ID NO: 12338 - RNA, 802222 nt, Mus musculus
uggggaaauuuucuucauuuuuaauuuacagcagaaagaauauaaagcauucagaaaacauuuuccauauuuuuaagggcaauucaaaacauuuugcaugguuuccagcagcugaguucuucaacagauccauugacucaaugaugcuuuacaugcacaauuacaaaaauaaaacuuacaaaaaaggagacaucuagacuaguuuuacaugcaagucucagggaccccccguugggcgccaacuacuguguggaacugccauaagcgaccgugcagccagaaagggguucaucuuaaugucuuuauuucauucacacaguacagcugauuuugaauggguaacaaggauagcaauuaaaucuucaggagacagaauaagauuagcuauuaauuuuaucaugaaauccuacuccuggcacuugggaauucagauuauccaagaaagcugcgccuaucaccuuauauucaaaauuaagaguuacaaucaaaaaagguggucauaaaugcuuugugucaguggaaguaugcuucgaccucaccuagaauucacaguuguacugguagguuuugacccuacuucuaucuccuccauaagaacuuccuaauucuauguaagucuuuaucuuccagaguuuucuaacauauucagcuaauguggcaugugaaacacuaaaaaauaaaugugaggguugaagcaaauccacugaggucauugcucuggucaaaugauuggucaucugaaccauaagcaauggaguaaauguauccagauccaugauugagauaggauauucugaaaagagcuggcuuuacauucuauucccuguuaugaauacaauuguuuauguaaauuacucaguguccucagacaggucaaauuguguaaaauaauagguguggugggggcggggguaggggggucgaggauugcaacagcugcaacauaacccacacauguaaaaacaaaauugggucgggucagcuuacaaauguacagguggcuccuagcuguggggcugucgcuguuccaagcugaucacaagcagaaagacauguacuguacaguaauuugagguuggcagugaaaggaaguaauuaaaaaacaaguacaauuauagaaaaggcaccgagagcacugaccccaguuuuuauuauuauuauuauuuuuaaccacaauccuuuuguuucuaccuuccuucugaagacaccagcuuaaagcucauuugugaauauuuuuaggcuucacaacaagccucgaguuuuaacucacgguuggcagccagaaccauguugguuuguuuuuuguuuuuuguuuuuuaaaaaaagaaaaucucauaccaaccaauucucacacuuaaccugggaguuuuaaacuggcauuagcaaaugcaaaauugguucucucauaaguuagcuuugaaagcaucagauuucuuuggcuccucauuaccuggaaaguacuguaccguggcacccuuccgucaacaccaaucuccaccggguuucccuuuuauuuugucgagugagcaauuuuuauucgugguuuuuguuguuguuuguuuuuuaauuuccagcaggagauaugaaaaugugauauuuuucucauuuuguccuaauuuuuuuuccuaaacauugaucauccuaauguucuuuguuggugugaguggaugguguuaaggucucuaaggauucaucuuaugauuaucuauuuugcaaaaguaacuuaauuuuuuuaagcaauauuagcauucacauuacuuggcaccuuuggcaaaaaaauuuuuuuuaaauaaaauaaaauaaacuccugauagccaaaauuaaauguaaacauauccuuuuuuuuuuuuuuuuaaaguaaugcuacucugccucuuuuccuaagucuaaauacaguagcuccuuuuuauuuuuugcaggucaugcuuuagcaaaauguucuucuacagaacauuuaaaauaaaguacucuuauagugaaauaaaguuuuuuuuguuucauuuuacagaccauagccacuaaugcuuugcuuuuguucuuuuucuugaauucaugcacaucuuuguuuuaauauauacaauauauacaaacaauacauccacauuguucucgcucagacaaaacuauacaaauaauuucaucuugccauguuauugaccucugugaauaaaauauuuagcaauuaauauaaccccuuucaaauauuuucucgcuuuuuuucuccauuucuaccuuuuguauguacacagaaaccacucuguuuggaugagauagagccaaaacauggaauuuacuggccagaaugcagcaccacacuggucguuuagguggcaaauguccaggcaagguuuaugaucucuuggaauuacuaagguuuccaagguuacuaaaaaaggcuacaugcguuaccaagucuuaaguaauccucacugcaagauaguggggcagacaaacuaaagugcugaccaugagaagggacaggauggccacuauccuugcagauuccugggaggugggggggggggcaagaaaaugaauuuaaaucccguaagcuguuucucauuauuucccgugcauuacccguuuaccacacacccaccccucugcaaauuuucacaagacauuaaaaaccugcagauuuuaaaaguugcauuaagugugcuguagagauucaaacgaacggacggacaaaccgacagacagaaagaaagaaaaaaaaacgaaacagaaacucaaaagagaacagugaaggagaugaggacaggcggacucgcacaacucgggugaucuaagcccuccacugagaaccaaggauucagcuucuuggaagucaccgcaggugcaggcgcagcgcuccucguguggcugacgucgccccgccuguucuuaucuauauuuuugguauaaauauuuguacaguuccacacgauguuugaauacagcccuaaugacaaggaaagcggcuuccuccuaagaugaagcccuuccaguuccuccuggugucuuguuuuuccugugauccaacagaagauuugaguuccaagaugucuugcugaucaaauuaaaaguuguccaugagagugcaaauguaaugaccaaacauucucguuaaaauccugcagcugacuccccagaacugcagagggauuuuguguguguguguguauauauguguguguguguguguguguaugugugcacgagcguguguguuguuguugcaugucucugcuaaaaacagaaauggaaagagucugagaagcaaugucacauugcuaagggaugcugcuguaugucuucaaguuccuuggccuuuuucaauucuuucacucuggaagagaaacaaaacacaacaccaggugauaacuacagaguggaacugugaccagauaaaaggagaggggcuauggcccccgaaaugagaugcccagacaagccccuucugaagacugacacuugugaaauuguugggggaauauccaaagacgaagaugugacccuguguaaaaacauggaacguuucaccaggggugcuccaagaagaaagcaaagcuauuugcucuguuguucugacucaagggugguacguauagcuuggguacauuuaauuccuugaggaacuucuuccucugucugauggacugcuauaaaugccucacaaauccaugugauguaaacuggggaauuagcacacaauuuuccagcucugaguagacccagggacugaaucauuauuucacucauagacuccaggcugcuggcuaccuuacaccugacccuacaaccugcgcuaaguuccuucccuacucuacuauguuacugugucuuggauccucauaguucuugguucccucccauuucaaacuguaacuuugaaguucauguuccuucucagagcucccaaaugggcagcauuaggaucaauaccaaacagggccuuuguuuugcuuaucacauuguggcgagcuuuagaaauugcugcuccaauuucuauuuuuuaaauguaagacucugccuuaaaaaaaacaaaaacaaaaaaguggugccugaugaaaugaggugcaagggaaguauuguaggauaugagacuaucccucugcauggacgauggcaaguguauucauggcagaauagucaaaugcgucagccagucuccaaaugccgcagaguaacaucuucccagaagcuggcaugagaggaagguuuagccagacagaagcaggaguuucuuucacugccccagugacagaacaaggaaacauuugauagguagugggcuuauucggacaucagucaaauguggccucugucgaaggucucuccaaguguuuuaagauaugccaguccauuaaaaguuauucaagaugaaugucaguauuuucuaaauauagucaauaaaacucagucaaauaggaacauucggggaggcaugggggugggguggggggagaacccaacuauugguggaucacaguggugggcaaugaauguaaagaaacauauauucugagcaauuuaagaacuuuuagauuuacaaccuucaaacaaaaucauuucuuaggagugugaaagcugcugugaucucuucagagaaagaagauauauccuuugggagaaagccuucaucauuuauguuaaauugaugucguacaugaaaacaucaagcccagcuuagcacagcuuauuuacaaguggcaguguaucuccuaaacuaugcuuucuuaaagcuacauuuaauaugccuguuguuguugaugauguuguuuguuggaaauaggguuuuucuguauagcacuggcuguccuggaacuuacucuguagaccaggcuggccccaacucagagauccaccugaguguugagaucaaaacagugugcucuaccacugcccggcuuaauaugcacuuaauaauuaaggauaccauagugaauuagguccuaguguguggcaccauguuguaguauagaauaguauaggauuauaggccccuaauuuuggacaugcauacuugauaaaugguuucuuaaaaauugaaacaugcuauaggucucuguucaauuuuuaaacaugcagcaucuagacuaacaucccuuuuggcuggaacaaugcaaggcaugcauggaugccgaccucacuuccagacaugcagugucugagcucagacagacccaucugccagagaccugcaagagaugcaugcuaugucaaauaccauguuuuguuugugcauuagcacagaacucacucacagcaccgcugcugagaccucuagaguuucaagauuucugaacccagaaucugguggcaucaccacagagacagaccuucaucuuucuagaaccaucaaaaaugcuuuacacguauuaaguucaucacggaugugaaguaaaaaggagacuggaauguuuuaggcaacuucauaccaaagaaucuauaaccagcuggucaggauagguauaaguuaacgcuauacaucuagcuaaaccggucacgaggaugggcuuuugaagacaccaccccugccucuaccacuuacuucuuucagaaguuaaaaugucagcuaaguuuucacaaagguuuagguugccacauaacgaaugcugaauuaauuauaaauuaaugaugucaucgcagaccacuugguuaaagagagaggcauguccacacauacgcaagaagucuacacaggaaaagugaaaacaauccaauuuucaggcacauugauuucaucgcacuauacuggaauuaugcaugacaucggaggagcgaaaugccauaggacuuuucuuuaaauggaagucuguuaaaggaugaacuagagaaaaggguguugugugaaaaaagacuaaucaaacuccaguaucauuaaaggguacugagugccuguaacugaaacacagccucagucucuaaucuguaaauucagacuguaagauuccuaagaauuaagcgaccuuccuuagcuugugcagcugauaaauaucagagcagcaacuugaacuuaugucugucugacuucaaaaccauucugucccacuccacggccucuaacaguuuuguuuuuaaauuccuacuauauuguuuuguccaaaagacuuuaauaggaaaaaucaaucuggaccauaguuugaaugaaaguaaugauucuguuuucuccauucuaagauaccauuguaugugaagcacuauauugaauuuaauuacaauguuaagggggaaacacccucauacaaaagugcaccuggucuaaggcaauccuggaacccugaaacacacacaaagaaugugucuguuauccaagaagacagccugcaauguaaggcagacacacucugcugacaccaacccacagagacagcgggggaaacagaccugugcuaccgguccugcugaagucaccaaagggcuucacaguacuuaaagagaaaaugaggaugaaauaggugucuacauuucccuuuaaaucaagcaccaggcagauaaaaucaagcauucaaauuauauucugucucuaaguuucacagaaauucugucucuaaguugauuugagacaguaccagaaguacuagaauuuucaauaaauuccaagaaacaguuauuucaaaugaauauuccagagauuuuuuuaaaaacuaauuuugccuuaucacccauggacagaauaauuaaaaggcauauuuaaaaaaaugucuuuaucaaugagaaagcuauguaaguuuaauuaucaucucugugucuuccuccucgcucccguguucucuaugaaucacaguggauacauacuucuauauuaccuaccacaccugcuugccauccuuuuuuuuuuuuuuuaagauuuauuuauaagaguacacuguagcugucuucagacacaccagaagagggcgucagauuccauuacagauggcuguaagccaccaugugauugcugggaacugaacucaggaccucucauagaguaaucagcgcucuuaaccauugagccaagccaucucuccagcccgucugccauccuuuaagaugcuucuuuaaaguuauuuucgugugugguugugcgugaagcacuauauguacacaucaaggcuggagggcagcuuucagcaguccauuuucuuccucuaucauaaauuccgaggaucaaacuguuaaugcagccagcacuuacacccacagagccaucucucugucucuaaaaggguccuaagauauuguucuauguaucuguguuuacacgacagaaacuuaaguuagugggaaaaaaaauauuucuguuucacucaaacccaaaucaacugccuggacgacucugcuugguaucuccugugucacgcacguguucaguacaugagucugguacacacagaccucagguuuguaaauucgauuccuaucuggaaaugcagugccuguggcugcuaccgaugcaguuuagagccuaaguccucagccugccuugugaugucucacaguggcuaagcauugccaacgucugggguuucuugaacaacuacaaaggugaggcccacauaggacugagaaagaagugaacuuaaaugcccagguuaccuaccuacauuaaaaaucuaucaaucaacggauugcacuuguuucugaaucccauuacacggaauagacuugcaugacauaggauagacaaacacaagacagagcuuauaguuuuuauaugcaccagguauugcuuccucuaaggggagcuaugaggagcacauuucuuucuaauuuuaauuauguguaugugucuuucuggaggcacaugcacaagaguguaggugugcuuucucgagucggagcuacgugaggaugcugaggaccaaacuucaaucuucuguaagaacagcaagcguucuuaaccaccaagacaucccagcagcccgagaacuguauuucugacucucuugucaguaauuuggaagguacuugacuagguuggagguacaggaaucagggcagcaagccuuugaauugugaccauucaaaucagacgaucccaagauuuuucugagcauucaggcugcaaauaacucauacucugagauaccgaggcagucucaaccaaaaacaaagagaaagcugcaucaaauggacuggagugauguauaagcagcagcccugaaagccagcagaagcucacaggguugacuccaucagauguccaaugagaauacaugaauaaaugagaggccugcugcagagacucuagcgaacaauggcuucaugggaaaagcgucaggcaaagccgcuucauuacaucuacugggugacgcucagccagagagaugcuucaugagucaguggcuuuuagcaggcagagccucgcagugcuggccaucaaaaaaaaccacagggcagccugaugcuuucugguuaguuaccuguugcucucagggcugcaacagcuugugggaaauuuaggaaaagagagaucuugccauauuccagaaauuucauuuggauugcaaaauaaaaaagacagagaggcccaguaagaaugacagagagcauguugucugcaauuuaacacacaccacuguguuccaaaaauauucauuuccuaaaagaggcaagugagacacaauuacuuagagauucaugacccuccgugacauguuccacauucauuucuaacuucuugguaauacggggccaccugggaucuaaaccucaugcuacauuuaacugaagauguggcuaacacaucugcuagcccuugaugacggcucagcuuucugcaacacuacucuuuuggguggggucagaaaaugaucccuuggauaaaagugcacagcaaaaccaaugucaauuuguaacccccagaaccuggugacaaucuguuccaggcaguucacagggcuacucuggaaggcacagcugcuuggcugagguaaccacucaccaaaaugcuuggucacuucucacaaagugaaggauuggaaaacccaguucucaaacacccgugguuugaauguuugagauugaacgugcuaccucuucuuccucuaacaaagacucauuucggaagaagagccccacccaccuuuauuaaacaggagcaguaagucaguaauuuccaaaaauagguuauguaaauaccaaggauaacccuaaggacucugcugacuguuuucugaagccccccuuauuaccuuguacagaaaaaggagacaccugucuaggauauauggagaauggccucccucauuuaugaggggcacaaaaggacuguccuuaagacagaggacaaaaaccacuuuguaucugaaaagggacacagcuuugugucugcaugcauuuucagccaauuaugucuuaauacugaggccaaguuguugugugauuuagugacuugcuaguuccuuaacauguaucucagugguucugcugcagaacugggaaacaccacauggggcacacuagugguccacguggaaggcaguacuucccuuguacagcguugggaaauccucaaaccuucaaaauaauacaccaaucaugugcaugaaaguaaauaauaauucauuuaaauaaugcagaauaaacaaacauucuccccucaaaguaaaacugugucugggaaggaaggggggaaggagggagggaacgaacgaaccaaagcuucaaaccacacacuuaucagaaguugguaauuccacugucaguuauuggcuaaaucagcaguuaagccugggugaaaggcaggaaacaagugcgcugcacucuguauacaaaugagguguacugguccuuucccagccuuccaaagaggcugaaaugaaaagauacaguugguaauuuugggucacccugcagcugggauacucugcacccaggaugagcuauggaauccuaaaucugcugaugguggcgccuaccuuuguggagguccuucugcuguggaccugggaguuuggccaacagcauguuccacacugcaccacaaaauguaacuguacauauuuaauuacuuuucagcauauauaccucuaacugguuugcuguacuuuauaaauuaacaaaauaagcauguuauucucuuugacacaccaucucaggacuauacaccugagagacugcuuggcucccaaggagaaguucaacuugggggacuaucaauggggggugccacugcaaguccuugaggaagagagagggagaggagaucuuacuggcaacugcaccgagccacagacaagccauuccucaguaaggagcuggauaaauggucccgucccagaggaaccugaaacccucuugacuccucucucucaagcucccugcugacugcgugaggcaugagggaugguaugagauuccagcuucccaugcaugagugggagucuccagaguucauggcagaaugcagcaggcacuagagaaguuaaaguagggacucugguuugcacugaaauagccuuuagaaaaugagcucuugacaaugaucguuauugacauaccagaaacuaacaagcuucaaaagugcuuaagcaaccaucuccaaugucaguucccuucagcaggcucuacaaacugcauuuagcaugcaagauacuaccacugagguaaaccgaacgcuagggcaugcaccuguccucuggagggcucacuguuguuucuacugagagagguggagccuccucucacucuuuccccuauuucaagcagaugugucuaagaggcucucccauaggggccugacucucucaauggugaacaacugucuaacacuaagaagagugggaacugcuaacuugucagcaucgcuguguuucugguuuugguuccaaguuuucccuucagcaccuguucaugguuuguuuuauuccuguauuuaaagcagucacagcuguucuacacguaagucauuagucuggaaaaauuugcaaaaacucauugcuguaccaucacauuggcaaggcagcagccuguacagacugacgggcuauacugaauuaacuuccucucagaaagcuaacaaaguuaacccaaacucuagcccaguguugccgaguucuugcccucgcuuuugaagaguuuucugccacuuucuuucacugucacuucgaugugucucagcuacauucccacacguuccuguguguagugugcaccuacagacuggaauccuaugcucaaacaugggaacaccggcaguguccacugacuaccuagucacaaugucugccacauauaaaugcgacuucaacagcuacucccaaccguaacguggagucuccagcuaggcucaagguaccucgcacguuuuuuuaggaagaauuacaguugggcgcugcacaucuggcacaccuucugcuguguacucaauguccuaagcagguucugcagggcagcuuucuauccugacuucccucacaccacaagggaagagagcuuuagaaacugaugcucuggggcagggugacaggaaguaguaucuguaaauaaaugauuuucuuuccauccuagcacuuucuaaggagcuuuuuuagccuaaaaaauuuugaccaauuuugaggaaaucugacguggcgaaauacuguaguuacaaaaccacuugcugaauguuuuccuguaaggcugccucccgucagcaggaaggccuguguggagggcucuccgccuggcccgagcaugcuguugguggucucagaagguuccucccucacuuccucaugcaugugcacagcgacuaaguggcugcucuccuguugcauagacagcaggguuaguacucaggguuaguuuuuuauuuuaucuuauuuuucauucagaauggaugugaaacuuacuagcauaccuacgcugcagccccaugcaagcaagcaaaaagcaaaauauugaaaauggaagauaaggagaaacuggcuagcaggcagcuaaacucacccuuuuguacagccuaugguccaccagggggcuuuagacaguaaaacaacaccagagagcuauuagcaugugagggucacagcagaaaucuuaucaacagcuuuauuagcaugugaggggcacggcagaaaucuuaucaauagcuuuaugucacccaaagacacuagcaggugguuucucuugggaaggccaagaagggugguggcagggauugggacaaacaggaagaagacccgucaacuuuuaaaaaacuguugcgaucacaugacuuagaaauggguccugcugacuucucaggccacugucuaccuaccuuguugagagggugucaugaaguuuucuacuuaacacagauuguaaugcuucuaagagacaauaaacaugacaguuccacuuaugaaaguaaagcuaaguaaaccagaacgggauguacacaucugagggaacacacaaguuuaaaauaacccccaggagagcgagccaggacuccaucaggcucuuuagcgaaauguguuggagacgggaggugagcagcgagcacugcauccagcacacaaaggcucugcuguccacuugugugguuuuuaucauccgaaccaggaaagagcaauagucauuuuuuuugcugcaaauggugagcagaaagagccccaggcccgaugcucuccuucccaggagaccuugccagccuccccagggaugagcagcugguuaaaauaugaacuuagaacagcugagaucuucggccaauuccucaguuaaaguuaagugagggauuccuccguccagccuacuucagcaagcagucuuucaugcaauuauaugucaaguaucuuaaucuuugacucauccacuguaaacacagaacacacccucaaaagaacacacacggcagagucagugaaggacucggguagcucugcuuacccugcaucucuccuauacguuuggacucaaggaacaacaugaagugagcacagcacagcacagcacaguuuaacccauggaugguucugguuuauuugaaaagggccucaaaaagcaacauuagggucuagaccagaugaaccagucucaccaaguggaguggccgcucugcaccaugggagcuaagucuacuagucucugugcuggacaguguuuuggggacucucauucugcaggcaaaacaaagaggaugaggaacuggacuuaugaagagguaaggaaagugaccugggggaauccaagguauuuuaccaaccgaagaagcucggcuauucuaccaagucauaacugcuugauugccaacugaaagggauuggcuuaacaacagagacaggagacugaucgguuugaggggggacuugcagaaucacucucauuacgugagaucguacccuguaguuuacuauccguuuccugccaggacgucuucagucagcuuauucauacuuguauuucauaugcuagcucuuagggcaggagggccaggggaacguggugguggagguggaggaagaccuugauccaaggcauggaagagcagcgagggcauggaccucccaucuuggauuccaucuagagaacaccuaguacccuaacaagcucuuuaagguuuucuauuacuguugaugaaguggcuacuacgaauguuucuuucuauggucauacagaugagagucuguguuaaauaagaguaaguaagucucaaaggcaagguauuuugaaauauuagcaauguaaagagagagagagaaccugacgugaggucucugaggaaugaggggaugguuaaacaggagaaagagcggacagcacagagccagcucgcaacugcacagcuccugaugcucugggaacacacacucccccucugugcagcuccaacggccaccgcuauggacuccaggcuucaucuauagagaggaagcaagccucucccuccagccccagacaucuuaagucuucagcaagaaagcucacacuugaggagaugcuccucuagcgaggcuccaugaaaacauguuacauccuuggggaccaacaggcugucuuuuccucuguguucccugcccucccaccuuggaccaagccagacuggcucucagcgcuaaacugaguggaaaugcuauauucaauauauccagcagagggcacccgccgcuuaguggaaguuucacaugugagaaccuagaggucugucuuccuuaauuuucuguguggaugccuauuagcagauuaaggacauacugcgaagaccguaaggcaaacuggcguauacaugguagguuaaagagaaacuuggaccaaaagcuaguccgaguaaaucacauucaugcccaaaucaaaacagaaaagcacuggggggugggggggucuccauggucagacacgcacccucuugagucacugcugcccaaguggcagugccaagaugccaccauccuguuacaaccuggaaugcuugccccaugcuugcuagaggucaccagcguggcacagaaccagcaagugguuagaaagguuggggcuguucuauuauuccuuacgagcacgaugauagauaagggcuuguuguaccuguggcgacagcgacgcagaaaccucauuaucuuucgagcagcuugguccugcuuuuuggucagcaaacugcuccugaaaaagucagaacaugagcgucacaagaaaaggucccagaaagcuuacacugcagacccugaaccaaucugaucuacagcuggaggagacuuucgguuaaacggugucacaaauccaacugaaaagcugcccccacagugcagagaucagccuggggacucucccaagccuuugcuuugucuucuugaauuugagacggcagcgucuacugcaucucaggcuggcaucaaauccccaguacagcucagacuucugaacucgggaucuccugccuucacgucccagugcuggcacucgaggcaugagcugccuugaccacuucaugugauaagaggauacggagcccagggcuuuguacacgccaggcaguuacccuggcgacugaacuauggcucucucccgcguuuuaaaggagacaauaugaagacuaaaaaugagauggucccuccauaugcccuuacaacuuauucauucaucugggauuaaggcaagagguugcuuuguaggccagauuagccaaauaguacacacuugggauuacaaguguguaccacuauaaccagguuuuuuccuguuguuguuguuuguggaaacaggccuuauagugcuagccagacuucuucaggccaggaguuaauucugagcuugauacucucuuuggucuaguuucuguucuuaaucuuuagucuacuacguucuaagauggaaucacugagcccugagcccuauguacucuccugaaguaauuagggagucgaucaaaguucagaacacugcagaaugacuaaguacaaacucuggucccgacaaauucugaucuauauugaaguuggccaaugacauaaaaauaacaccauguggcagauaaaggaccuuuaagagaaacuaacaacuaauagguacuguuacacaaagucacacuggagaggaaggugcugccugccgugccucgggcccugcccagaggcaggucuagguacugugccaggcagagccucugccacacccugcaggcucuugacccaccugagcuucugcugcacgaugacagcgguccugcgggccggccgucuccggccacacuucuuguaacuccgguagaaguucuggaucagcacugcagcgcgccggcucugcuggaaccgcuucugcucauaguaacuucggaauuugcucuggauaaggauggccgccugggucaucuuuuuguaaagugcauacugugggggacacagaagggacaggacaguaaugacaagaguuggaaguccuccaagcuuaggcgguaagagccccuccuuccuuccuacccuaaucucugcugggagccaaccucaggaugccaacagcaagcuuccaguacuuuuccaaaaugcaaagaacuaccuucaggauggccugcgggcaacacuguaucuccauccucacacagcaagguguuauucuaccucucuucaagcuuuccaaaggcaauuaaaaggcaaaaacuuaaguuguguuuuaagaugagaauuuacuauccaauuaagaaacauuugaauucuuaagucugucucuugauuccacucagacagagcuacccagcagucagcaccucuuucuaacuaauuugcuccauggcacacauuucugauggaguuacaaggucccagauacaaggcuuaucacgaaaugcugacacuuuuaagccauuucacccuaccuaagaguaacaacacucgucagucccauacagugggccugggaaugcacccuggggggcuguuagaacucugggcuacuuaggagccaugucagaggaccccaaccaaccuacuccacagccacagaucuaaggaagggacagaagccaggccuggcuccuaaagcagucuugcagcccuaagaacacaaugcucgccaccaugccaugugggaguuucucacaagcgaagaagucacacgaagcucuuugcuuaaggcaacuuucuauuguuaagggaccacccacucagaacccuagccccaugccuaaccacauggcuggcugugccacaacccgaagaaaggaaauugacuucuuagaauguccaaaaagcaaaucugcacucccuugaccugcuguauauuccuuuccacccauccaaaaguccuuuaagguaagaacacugcagcuuacagagcuucuauggaccaugucacuguauccuaaacacagugcacauucuggucccuggggucacggugaaguccuucacagaaauuagguauuugcuuaauagucacuagguccaaagucaccggcuuucauggacugcccuggccaugaaaaguccaccuguuauuaacacccaaaccuccuccacuagaaaaaccacagguccccaaggacagaucuggugugucuggcuggcuuagcaaaggguguuuggugccucugccaucuuaaugagcccuccuuguggcuggugacgaguauggcauuggugacucuggugaaaugguuugugagaggacuugauggaucauuaccuucaaggcuauccaugucagcuugggggagaaacagaaaauacaaauuaauguuaguuuaccaaacagagggaacaaaccagacaaaaaucccaaaaccaguacaacucccaacccaaaccaaaagcaacaagaaggcagccuggcuguguuaacaucuuccaccguccaaaauaccguuccuacaguucucacuacuuccaaagacaaugccuuccaucuuccuagcagaagacaacauucacucagcagggaggaucuuuugcuuccucuucuucuucuuuuuuuuuuuuaaauaaauaacugcugucauuacagacuugaaaccucgauucuguguaugacauaauccagugcuaacaugaaaccugcucaccaaucacagagauaaagggaccacagugucagcguuuuacauaauaaaccuucagugucugggaucucggacucaacuggccagagcuggaacccuugccucccugcccuugaucgaguuuaaaggagaaguuuggaagacaaaacaaaacaaaauaaagugguaacacguguuagaaaccaagauccugggucaggagagcacaggaccucaaauuccuuuguaguuauuauacaaguagcacacaauacccuuuccguagcaguguaagggcuacucaggcaggguccuagaaaaucaauccaaggcuuccuaaaaccuucuccagaacagacagcgugagaguacacgccugcgcauguaaaaguggauccagguuggccuggaacuugccauccuucugucuuagucucugagugcugggacuagaggcuugugccgcuguucccaguaaaaagaucaagguuuaccauugagucuaaagucaauaaggaagcuucaguaucuuauaacuaccuugauaucuauaaacucuaacaucugcuuaauuuuccgagccuacuuucuuccucugugaauggcaacacaauugcuuggaguagcucugagacgacagcgcuccugaagacuggcauacacggcuccccagguagucuggcuaccccacaagcaggcagcaaggccuccaugagacaggccugccuguuauucuugccccuguuggcuaaagcucgaggcagggugcuguucucuuucccuaggguucucaauuauagcaauucaaguuagggcuuuguuaucagaagcuggagguggggcuuuuuagccaaaccgcagagcagcaucuuccuuugaggccagggcagcuuggacaggugcccuucccuucugggacacagagcuagguuuaccuguuuguacuuccuguaacagcgcuggaugacggcagcagccacuucuugcuguucccgcaggggucugcccugaaaggugaagcaagggagaucaguaaacugaccuaagacuugccaacauacaaacagcucaaaccuuuacucaugucauacaacuaacauaagaauugucaacauauggaggcugcagagauggcucagugguuaagagcacuggcugcucuuccagagaucccgaguucaauucccagcuaccugcaacucuaguuccaggaaucugacacccucaaauaauugucaucaaacgaauugccaucauacaaaaaacuuuacucaugucaugugccugcucaagaaauaaaacccagguuuacugaaccacaucaacaacaaucacuauaaauuaagaaaaauaaauuuuuagaauaaaucucuaucuuugcuuuuaaaagucaaaccauauuuggaugucaagaggacuaaaaauauguauuuaagaggcuuuuaacaaauuagguguugcacuacugaucuuucaggcuuucugcagucuucccuaaauaaucucacuacuguuucuaacaccuguggacagcuauaaaucccaauaggaauguguagaaaguaacacauucccaccccaauaaaagcaugugucuaaggugaugaccgaggucccagggcucagggaagcccacaguccucagguuuugauuuagccauacgccccuugggguggagaugucaguucaccaacaaugaguaagaugaugagagccaccccacugguuguauuugacuaaagcuccugaaaguuauuaugaugauaauacaacguaacauaacaucuuccaauagacauuugaucagaccacaaaccccaggggaaaggggccaggccgcuccuccuuuaccuuguacuuccggaaggcugucuggacaagccuggcagcuucauagaguucucucugcucguggucggacagugugagcugagcaagcucacucuccaccuucucacugguggacgcacucaggaauucugaccagucugccgcagagggaaggcuggguuucucgaaagccaccucacugacuggagagccugcgggacucaagcuggcauuagaagacggcgucaggggcucaguguacgcacuccuaagacaagaggagaaagagaagauguuagcgacuacugucaccauccauuaauuaauauuccaguaguuaauaagacaagacaggauccaccuggagcuaccugggccgguaagaugccuccacucugcgaguggcuauacacacuccacacuuugguugcaccuuggugaguuccuacugagcaccuauuaccagcuuagcacugugcuaaauacuaagcccacuaaguacacucacuauguugccucuaggaaacuuuagccaaagcaggcaucuccugagauagcauuuauuuuauguauauccugagacucauuuauguauaugaguguucuaucugcauguacacguacaugccaaaagaggacaucagcucccauuacagauggcuaugagccaccaugugggugcuugaacucagggccucugggagagcagucagugcucuuaaccgcugagccaucucuccagcaccaugacauggcaccuuauaaacacuggugugggagaaagcaacagauggaaagaagagagaaguggcauacuguccugugcucuccuugggaaagucucucuuugcccuuggccucccugccuccaguuaaauccaggccucuauccuggucagaggauccccaaccccaaauccucccaaccugaugugggcagcacugggcagacggucagcaucggcuagguaacuggccagccagcucaucguacugcuaaugguggcuggaucuguucuuuccaaggcugaggauuccaugggcacaaaguucuccugcuugauucggucugguguggccucgauaaugugcuccgccaaggucaucauguucaccugcaaccagaaggccacagagcacaugagcuuaggaaaaacaaaacaaaaaacaaaccuucagacucuaucaccugccccugaccucgcacaggacauggagggacacagaaguugggaagacaggugacauaugccuccauacuaugcauuuaaacagcauuuaacuuaggauacgauucacccugagaccugauuaucuccuaaccauagcuuggccucacacaucuuuuagagagcuuuugucuugggcccacugucuacuaucaacagcaugugucaguuauggaucucacaccuggugcagggaggcggggguuccagguaagacagcaucuuaaaaauauaaugacauuuauuucugugccugcacauguggagccagaggaccacgugcaggaacucauucucuccuccuaccugugguccaggagaccaagcuuaguuugaggaggcugaaggcaaacaccuguuaccugcugcauuauccuguugcccuaaauguuuauuuuuaauuaacugugugugugugcacaugugagaacagcugcucacagcccaaaagaggguguuggauccccuggaauuagaguugagagccaccuggcacggcacugagaaccaaacuaaggcucucugcaagaucaucaaccucucuuaccaucaaacgagacuugccagccccuaagauaucaucuucccucaccaauauccuuccccacucccccacuucuugucuggauacaacaaucugcugcaccucggcucagcuaugcccaucugcuucuggaucuccuacagucaggggaagguguauggcccaguucugggacguagugcugugcagccugcaaguaugagaacaugagccuaaccccagccgcacauaaaaaggcagaacacagcgucaugggccugcaaucucagcacaggagaggcagaagcaggacgauucugggaggcucacugagagacccugccuuccgacguuaguggggagcaaugggagaagaccuccaccucagcacguguuuaugcacacucucacacauggacacuuauaaaaauaaaauuuaagauuggaggugucuuuuuaaaauuccuugcacaccucuuaaaaaugguagucaaaaccacaggaguuuagguuuccaccagauccucuggcucagcggagagguguucugagaggacuccaaagagcgggaaaugcugcccuccuaccaugaagacagcucagaaaguuaccgugcuauagguucaagcuuugcacacugguucccuaguguguggagcugcugggggaggcuaugaaaccuucaguaaguaggaucucacugacaugaggagcaugucauguaaucaggaggaguuauccugauuacacacgguuaugaaggaagaccagacuuuccuguggguggacugcucccuggacugguauuccuccuggucuguguaccagcaagcaagcaagcaagcugagcacagagaagcagucacuggccugugucucuugccuuuggcuguauggugagcagcugcuccaagcugccuugaccucccagccacuacagacggugucuugaacuaugcucuaugugcuaaauagaccuuucucccucaggcugacuuugucagagugaucuaucacagcaucagaggaguguaagacacacacugguaggcaggggccuuugaaggcagagcuccaguucugguuccugagcacacucagugggcccugccaugcccuuccaaggccauaaacucuuuaacccguccuauaccagguauucuagucacuacaacacuuaacacauagaagacuacaucucaguuagaugaagcuuucagaaaggcaaaguucugggaauggaaucagaucuggguggauggugcgguggggacaccgagaguugaugcaggaagcagagcugaccuaagacuuuucugacagucggacaacuaucuauaguugacuaaaguagauuuuacaaucuaaaaaucugaccccacccaaaaaaaacccuccuauuuuaaaugucuaagauaaaauuuccucaaugaacaacuaucuaugacaguguuuccauaagguuuaacuaagaagagaagaucuacccugagcagacauugucaccccaagggcugggggcacgggcugaauaagcagaaagccaagagcaccagcaaccagcuccuugccgacugcuuggcacagagcaggcgccucacgcuccugcugcccugccucccccagcacaaugccagcguuguacccucaaacugaaccagaaauguccccugccccgcuuagcugguuucgucaugccaagcaggaaaguagccaccacuggugccagcaggaaugguccacaccgaggacuaggcagacuguagcaggccgagcagagccagcugccaguuugugugaugcgaguuuuaccacgucgcagcucugcucaucccuuuaacuuugucuacaguuccuuucgugcucuuaaggcagauccaaggcuauaacaguuucuguaugagccacaaagcuggagaauagucaccaccuggcucuuuacagaaaacaaaacaaaaaaaaccuuaccagccuuuugucuacaacauuauuggacuuaggcugggugugaugggacgcaucucuaacucuagcuacuugagaggcugaaguuggagguuugacaccagccagggaacuuaaugagaucacgucucuagauaaaauugaaaaggggcugaggauugugcccaguggagaguguuugcccaacacgugcaaagcccaaacaguaucauuugauuuaaccaggcaggcaucauccuggcuauaugguugaugguaaaucagugguggggucugcuguccaccaggagcagaggcuauacugcuaauacacacgcaggcuuuuuguuugucacagaaaaccaaagaguucccccagggugcaaugcucaagcaugacucagcagauacaccucuccaggaugagcuggcaggaguguggccuucccaccccagcaucacccuguuaggcgggugggaggugcucuauaucuuuccuuuuguuuugcgaugcuucaacaagaaccuggaaacagaggcugaggaguagagcauagaaaaccaugcugucugguugccccuucugacugcuucugcauaucugaguugauggauuuuugucuaguagccuggugcuuuguuuagucuaugacaacuuuagugcccucagaggacucugcuuccuacguucauuacaagggcagucaguuauuagcccuggagguauuucacuacaugccaugugagccucaagccacagaugcccuucacaauggcuagaugacggccgugcuagucaaagucacucagauaauccaaauccugucugcaggcuuccuugcuggcuauuuuuagggccuugacucuauuauaaccaguaccucaaagagcaaagcugccaucccggaugcgaggaagcagggcacuaauuauuagugucauaaguuuaguucucaagaggcugguacuggagggagggcuuuguuaagggccuguggucaggcccuacucacggugccuaauucacagaaggaaaaugugguuccaggaaagcagauaacuccacguccaccugagcaagaccagacugugacucuuccugggauggggacgggcaggugugugugugugggggggggggggguguaaagacuacacgacuuucagaacugagccgugauguucggggcugcuucugcaggcuuaccugagcagccuuaccugaauaucauccaugggcugggggcaauccucgugcucuguccuaucccgguaggcccccaucucuguauucaccaccucucuguuagccaacaucaggacgcucauugguucccucgggcgcaccugugaaggcgccgcguccuuuacuacacugguccccuucggauuuccagucaccuguacuguagacacaccaauguaaagaucuuuggcacuccacuuuacuacaggcugagaugcagacgcuugggaugcugcagucucuggagugggaggggcggcuucccggcuguacucccucacuccuucacuggggcugauugucucgggggaaggcugcuuagaccuagggcucugcuuccugauauuuggcugcuccagacucagugcagugcagagcagcuucuccugccuugccuggaaggacucgggguucaauuuaugcuuuuugggagccggauaaucuuuguggcccucagugcuguaguaauuagaggguucagaccgaggucuucucagcucugaaaaguacaguagaaaggacagucaggucaggugaugaaaguaggaaucccuaaagaauuaacacuuuaugccugggagauaaggagggcgaagcuggagcgcaaggcauguuccugagguauaaauacucccuagcagccuagacugcucagacaauccuccgccaaaaggauucguuuccuguacaaacagacuuuccauauugggaggagcacuacuuuuaaaggaaaaucagaagcaauaaguagcccccucccaccaaacccuuaaauguuuccuacagacucuucuaagggaagcugcagacagccaauggggagccggcaaguuccgagaugaaacccuugugaaucuguaccuggauuggugcucgcaaugacagugacuccuuuggguauuucuggagggcucauggccucccucugccacugggccauccagcugucugugguuggcucuucgcuuggggcacaguggauccgggaggccugucccaacugggccugcucaucucucugcagguguuccagacacucugcuaacuucacguggccccucgaccuggcaauucccaaaggcagccgucccagagagucggggauggagauggcccggcggucccacuuguagagcaccacagccgcuuccaagugccccagggcacaggcccacaucugaaagccaggcagacagauggaggaacuuaacaggagaccaaaaaaauggaugucucuuuugauguugcuagcagcagaaacacuagucuguugguguucuuuguggggccacuggauaaauagugccauuacagcuaucugauuccaacgagaaauaauggugugcaugucugucacucccccagagucuauaaauucauuuuccuacaucagauuagaauuuaucuuuguauuauauuuagaaagcguaucauuacagcccaggcuggccuugaacuguguagccaaggaugaccuugaacuugugaaccuccugauuccaucuccugaaagcuuacguuaggaguuugcaccaccaucacacucuguuuuuaguuucaucuuuuaagugacagucucagaucccauugggaucuagaguuccugugucaguuuagagagaugguuaggggacuaaacaagccaccucauccaucuauccauccauccauccauccauccauccuuccauccauuuauuuuaagauagaguuucuccauauaacccugucuguccuagaacucgcucuguagaccaggcugagccucgaacucaaaagauuugccugccucugccuccugaauucugggauuaaaggcgugcgccaucacugccaagcuaacaagccucuuccuuaccagaggaguacaggagaagugguccacauucaggggaucaaccuccaguuccaaaucaaugcugucugcaugcuuugugcuguuggagauagcacagagguuaccacacaguagcccacggcaaaaggaaacaccaggacaacacagaacccaugaaaaggaaaccaaacugggcaccaagccucccuggugugaagaaauaggauucuagauuccaagggcagauuggacuccauuugacaagagcccaaaggaagcagagcgccuagcaucucaugucucccucggcagucgagggcacaagaccacacaaaucuccagggacccguccugggaaaaagcccuggcucacgggccaugacacacacugagcgagcagauuccugggcaccagcggggaaagcccaggaaccggagagguggggacggcuggggccuuugcgccuggccuuaccgccauuugaugagggucuggaucaggguggcguagcccugggcagcagccagguguaagagggucaucccgcggaaggucuucgaauggaucagaugcuuggacuuggcccagcaggcccggcucaucaucuucucacacacgacaaccacacggcucucgaagcagcuccccagggucccagcgcccgaggcacacugcgucaugagaaaguacacgucacauccagggccccgggcccucuuccacacaagcgagacaaacgacaaucagcagucaguagaaaacauguuaaaggaccauuaagaacuggagacggggcuggcaagauggcuccaagcgggaaaggcuccggcugccaagcaagaggaccacggucugguccccuggaaccuacacgguaagcugcccucuggcuugcacacacaguuuuauuuuauuucuaauuacauauauauaaauuaugaaugugugcaugaguacaggugugugcccugaaagaugcacuguaaggguuacuuaucguaagggcgcacaggacccucagcgcuggccacacgccuuccuugcugggaacaagagagggauaaaaaucaaggcugcuacccagcaagcggaguccuggguagcaguccuuuguucaacacgcuuagccaaguggcacauguagccuaacccccaccucuguuguuacuauaaaagcccauuauuuucuggcaauaaauuccacauaauccaaauaggacagaaacaacacuggucuucaauguuauuuuuaaaucuaaaaaaaaaaaaaaaaauuccgaaaguuaaaaaggcagacgaccagucgaugcagggucaucuucaccagagcugucaaaacacuacaggaaagauagcugagccaucucaacaugcaacagacugaccuuggcccaggcagaaagccugcucuauauacaccaugcagacagguuuacagagacauggagaccaccagccagugacuaagcagggaaaguuuccaaugaaacacaaacggcccugucucugucgugaguaguagacaccgucguuuauuaucagaucacagagggccagcugccauauggcugagcucaaaagugugcuaaacuguucccuuuaugugauguucgugugugaaaaggguuucaggggaaccuaucauuuggcccucauaucaauauacagauuacuugcucuacacaacuuaguaucaggugaaaaaucaaagcuaucuugggcuggauauaguggcauauaggcuuuuaauaucaguauuugggagguagaggcauucuaggcuugucuuaacaguguggccuugaccaccaauuucugaagaugggaggcauaaaagaaagucugagauauuuuuaaugcuuugcuuucaucuguuauuaauauaaaaaauacuggugcuggagagauggcucagcaguuaagggcacuuguuacucuugcaagggucaauuccuagcacccauaugauugcacccaaacauguguaaguccagcuccacagaaaucugaugcccucugcuggucucuucaggcauugugugcacacacacacacacacacacucaggcaaaacacccaugugcauaaaauaaguaaauuaaaauauugcuaguguuucauauuuucaagauuuccaaacaaacaaaagaggaaauucugccaggcaugguggugauacacaacuugacccaagcccugaagaggcaaaggcggccaaucuccaaugaguucaaggccaccauggucuauauagugaguuccagcccagccagggcuauauggagaccuuaccucacaaacaaaaucaaaacaaaacagcaaacaaaacaaaacagaaagagggguguggaagagagaggaggaaagaaaaggcauccugcacaggaauccauccuucacagugaagaacaggaaggggguuuccuuguggcucucaggcaaggaaggacucgguagcugaugcaagaaacacuacugagucuuccaucuugggguguuuuaaaagaguuuauccucagacuuucucaaaacgaagcuccuaguugggauguccucagaagcuucaggaacaguagugugacagcaauacucggccaucucccuguguggccacuccacacagucuuugugcagucuaugaagaaaguacaaguggggcugguggacugauggcucaguggacagccgugcuugucacuaugccugacagccugcauccaaucccagaaccaaaguguuaguaaagaacugacuccccacagcugucccccuggagccccacgugccucauguacacaaacaaaaaugaagaaaauaaaauuuaaaaagaagaggaaagguguagcaagagaugaucgaccccaugcgguggcucacuggacaacaguccucaccauuuuuugaguucaucuucugggggcuguaaaaaggcauaaggacugcuagauugaauuaugcucuaauuucuccagacaggcaugagacacagaaucggaaggagagggacugguuuaauucggaguucugguagaugggcaucaacccuuggcugcuccuuccaacugccagggaacacagugagcucugagaccaagaggggcagcuggagacugggcuagucagucugcacccaggccucuuucacaccacacggacugagcaagggcacgaugaugcaggguccuugacgaugacaccaguagcagcaaggagggcacuggcaccaggugccucgugcacagaugaaacacagcaaacagaagcugccgccgauggacggcagggccuaccugggccuggcccccuccggcaccacucccgcugccgcucccgcugccgccuccgccgcucgccugcuugugcugcugggagccggucaucucggccauccuccuuuccaucugcuccagacgcuccaggauggacauccugaacugguuaucuagggcagagcaggaggcgugaggcugaguucuagaagaaagcauuugaccuguggccuaugccagcuugugagucugguguccaaaagacugucagcagcucugccaagugagggacuacggcaggcuggucuccccaguaaggcaggcaggcugucuccgcacaccagagcauaaugcuuacagaagcccacagugcacagaggaaggaccagaaaaaaaauucccuuugugucaaaacccucaauuuuggguuccugccucacuauuuguuuguggaauuccccacagaaacccugagggaaucagacaaaacacccacacacccccacagccacaccacuacaccaccaccacucagggaagacaccggaaguggcuaugauguaauauaaguuggggggggggggaagauucgagaaaggaggcaggaggguguaagcucccuuauagaguuuaacacucucagucagaggcagguccaugguucaguccuaccuaacaaaggcaacaagccaucgccacaggagcugggacuguaaauucagaaagcaugaaccuauaccaccaaguaaagaccagacagcacauccaugccccauccugcgugcaagcacacacgcaggaagaauccggacaugccacaggaguaagaggaccccaaaucauuaccaaagucaucggugccauguuaacgccacagguaaauaugguaccggggguucccgcggcacugaggagggcagaagagguauggugcugcuggagcccagucaagagugugcaaacgaggcagcgagugugugugaccagagugcgugggcacggagcugagauacgucaggaaaggugacccuuaagucuggcgggugugaagagaaaaaaacagauacacaagccagaaauaaagagccugaggcaagccgugaaaggaggaggaagggugggccggagaggagggagaggugggcuacucggaacacugcuauccugucggcuaacugcacagcaaggauaaagccacaguaccccuaacucccagcaauccagugggaaucccacugguucacacacggccaugcucagaauaugcuauguccuaaggaagcguucuucacaucaacuccucaaggugaacacggucgucaggaccuuguucaaggcagugagagcauguuucucccccaaacuucgaaaggcacagcuccauucagaacacccggccauccaagucacagagaagccuggaaaggggagaucggccgggguucccugcaacccucacgguaaccccagacugguaaguggggcagcucacgugcaaggcagagacaacacaccagggugguacccccuccaucccaagcucuucaaugcaggaggcaggcacagcugcuuuacaaacagcggcacacaaggauggcuccucucucuggccaaaugccccaggaaggaauuauuagagaaagauagggacaggcuugaaaugcccugaaaaaacguacuucuuccuuggaaacuuuaaauauuaacuuuccaucaaauucauuuuacuuaacuaaacuacacaauuuacuaaacuacacaauuauuuuacuaaaguacacaagagggagaccuuuucccagucuggcggucgccuccacaaauaucguuaacagaaacaagcgugcacacucaagugaaacgggagcccuccccccaucucugucuaacuugauucggccaucuuggaggauuucaucugaggauuaugcacgugaguaauuuggaaccaacacugucugggauggaggguagauggggaagagggccuucagcauuuggauaucaggaacccaaaugguacaggaaaacuuaucccucugucagaggucagcuaaagacagaacuccacccuugggucacagcucagcaggaagcagcaggccugggacacugcaaagguuccuccuucuuucccgcagugcggugguggcucaguuucaccuccauucaccucugggccugcaguaggcuaccucacugacacaauguagcugaauucuaagccuccucggccccagcuccuucuuaucccugcacuuuuccccaagcaccguggaccgagcagccaagaggagccgcuccucaggagacaaagucacagaggcucugaaagcccugagacccgguuacauccaccuggacacagccaccaguuuccuguggagcacacuggacuaugcugugcuaaggguguucaccugccugucccuccugccaggccuagauugaaaggacacagacucuccugacuugcaaaggcugaacacuacgcuggcuuuuaauccucagaaacaaggcugcccuguugcuaugcagugaguacuuauauaucgauaaacuaccccaagaagcacuucauaaagauacccagccucugacucaugagccaaauaaacaccuauucuuuauaaaucauccagucucuaacaacugucucuguauccauguccuggguauccaugggcuuauuugaaagauagaaaguaucucuaaaugaagguggaggagaugggaagaggcucaguccaugaagcacuugcccugcaagcaugggaacuugacauuuccagucaccaagaaggucagaguacauaugguaaccugucucgaggcccagcacuugggaggcagagauggcaucucuggggcaaagcagacuagcugaaucaguuaggcuccuagucugagugugagguaagaggaucaagaguucaaagccagacuggguaacuuaucaacacucuguuucaaaauuuaaaaagccugaugguucacaccuguaaucccagaacucaggaggcuaagucaggcagaucucugugaguuugaggcuagccuaagucuacauagcaaguucuuggccagccaggccuacacagugagauccugucaaagaaaaaacaaaacaucaaaauacuaagggcugucuuaucagugauucagagcuugaaucccaucaaaugagcacacugagcguguguggaugucuugucaucauucccgaacgauacggcauacugacugacacagcauuuaccuuauauuagauacagcaaacaacugugagacagugaaauccaagggaaggugcacacaggcucuaugcaaauauuuuguguaggagaccugaggauucuuggguccugguaucucugggauguccagaguccaaugcacccugguacugaggcggcacuuggcuucauuaucuccauaggaaauggacuaacaucggugacucccauuuucagagggcuuaagcgacuucugagcucuauuccuaagguuucugagcccacaggccugggcgaggcccagcgguuacauuucucacaaguucucaaggggaugccggggaugcuaguagggaccacauuucaaggagcauggcucaggcccuggcuugcuuccacugugaaagaacaucccuuuuccuccccgugcuuggcugcucugcaggugaucguccacuuuaggaccgucugguuagauagcauccgugggaucuuacgagaguagcagugggucggggaugguguauagacguugugacccuugaccaguuugguuugggcaggaucugcuggacuggcugguuaaguugggauuuuucucaugcagucuuugcaagcaagaaacuaaaacuccugucuguguucacagguaagaguacugaguucugugucacccagucuuagaagcaaugguccccagugagacguggaacccugcuccuuucacuggaggaugguguuuaggaaccaggacuugggugcuguguacacucccugaugcugggucacugcuucgaggcuccaucagugcacagagcuaguacacacuuguauguauacagacacaugcaaccacagcaauccaucugucguauguuaaaauaaacaugacuccguauuaacagcggaaaagaacuuuacaauguucauuugugaaaagaaacaagaguuuccuagacauggcacuggcaacaggagacacgcugcaaagacuacccagugauacgucagacugcaaaagaggagcuagaacccgguaggcacacaaaaggcugguacagucacaugccuggccauucucaccccagauccuaaauuuccaacaauauugaaaaauguaaguauaaaggaaaccacucauugucauggauaacuuggugguugcaaagaucagaaagaaaacaccacacaaccaaucacugcccaagaaucaagaacggcuuguugaagcugcgugugguagcaccaccuuugaacccagagcucagguggcagaggcagguagaucugaguucaaacccagccuggccuacguggugaguuccaggccagccagaucuacacaguaagacccacuuucagaaaaccauaaaacaacaaacaagaacagauaguuagggcuugacuuaucugauggcagccuuucccaucaugcaaagcaccacacagccaaucaggggacuucucugucucucugauaggaauucuuaacucucaaagggauucacuggaaauauucacugaaaauauuccuuuaucuuuaaaguuccuaagcuguaccaaaggcuuagagaaaaauuuucaagaagucagacauccacagacuguucuaaguuuagaaaacauggacucugcugcuggaaguggagacauccaggggccugagcaucugcuaucgaugagagggaggcuaugccaagagaccccgagccugcugcaccacugcuugcuccugguguuggacauccuauuuuaagcuuuagaacucaauuaauguucauaguucuacugaaugguuucugaccugagauccagagauuuaaaauaucagggccuggaccuggagagauggcucagcaguuacaagcacuggcugcucuuccagaggaccuggguuucaguucucagcacccacauggcagcucacaguuguccguacugcgagucucaggggacccaacccauucuucuggucucauuggggaucagauacaagcaauucauaaacauguaugcagacagaaccccagugcacauaaaaacuggcucagccacuaggaguacuuguugcucuuacacaggacucacguuuaguucccagcacccacacgauggcucagaaccaugaguaacuccaguuccagagcucuguggcagaugccaugcaggagagacuacagugggcgggugagcuuccuggagacaguacacuguuuugcacaguugcaauggagguagcuuggagaggcacagacccuguauaacaucuugcaguugcugugccuucucacaucuguccuugcuaucugccuccugaaucuggcaugguggaauugaguguggggagacccucacugcccauagucuggugugacugcuuccugggagaccgcccacucucuugggcaauuuccuguagaucaaaacgaagaugaacuuucucgauaugaugcuguuuagaugaauuccugguuucgucuuuuuggggaguuaggggagcugacagaaaguuuaagaagacgguuuagauuguucugacagaaagauauaguuauuagaaugaggagcagaacgugcccccucccuuguagaacagcgagggcugcagaaguuagagaaggcaugcagugagcuuccaugccuuacaagcuuguaacuguacuaggaagagaaaguaacaaguuaaugaucaaaggaaacacuuccuuccagauagggccugaguuccuggagcuugugaucuagggauguagucacugguuucagugugcgccaugaaaagauaggguuauggauaaagaauaaguauuucugaguaugagaauagagaacaggugauuagccaguuuagcuaaacaagacgccagaaacaagauguaagacagaugauuuguuucuugauaaauucaaacugucaucagcuaagcguagggaaaaacuugcuacuauagagugccucgcuuaaacuugguuaauaaauggcaaaaagaauuauugcuuugggguuacaaugaacccgugcagagaaaagacagacaggaaauguguaguuagguaugaguuucgaaagaagaacgcauccgccauaauccuguuguaauucuccuguguaauaauuuuaauguuuuugaagacuaugugauuuuguggugauuguuuuuagagaauauguaacauggcuaugaggcaauccuugucuaacauagagaauuuugucuuaggggcuaagggaaaaaacaaagugguuagaucuugcuuuauccacaaagugugugagugugugccagcuuuaguuuggucauugaccccacauccccucuccuuggauggcugaccaugcugucugagcuagugucaacagauauagcgcccucuucuggccaucacaaguauugcauucacaugacgcacuuauaugcaggcaaaauacucaaaauguaucuaaaaaaaauguuuaaguuaaaucauucucccagaaccuguacuguggaauuaaaccuuuugcuauacuguagcacacucugcaacaacuguuccagcucacuccucuguuuucuggugcuccccuccccccucaauucacuguccuccaaacauaggaauuuuccaugccucugggccuuagcuaaugucgcccuuuucccagucuaccugugaacuucugaugcucuguaagcucagcuagcacuuucaagauggggcaauaacagggcuggcugagcuaaguggaucaccuccagaagccagggacaccucccuucuaagucccauauacccaacaacugaaggguuccccucuucacuuagagaggagaaagccauggcuuacuuagccaagcucaggcuguuuaagaucaggacggagaucagaacacaggcuagaauccaaaguguuguucuuuccacugagcccaggugcccuucccggucuugcccucugucuuaagagaaaaaccucagccaacaguacacacuuacuuuccuauacgccaucccacuacuggcaagacuaugggcuuucgggacgcaggacucuggcaaaggcggagcgagagcucgguggaaggaguacucuuuucuaauuuaagcaccugggagccaaguuauugaugaggucauuuaccgacgggccaaggacucagcagauuucccugccacaguggaucuaugcaccaaccagcaguucuuacugcuuccuucagugggcggagagggauuggaugaaauggucaaaacgcagcggagcugacuuggaaggcagaugaaaaaaaaaaaaaacgcuguguuuuccuggcauccagccuucguuuuguuuuguuuuuuguuuuuuuuuuuucuuuuuucccagcucagguaaagagaugaugucacuacacagugcuggcccagaggccuggaagcaagacccuaccaugugacguccucacagacacaagcuggaauuuccuagcagagcaaugucacuuuucugcagccacuggugcugcacacuaaaaauaucacugaccccuaacugucaggugccccccuuugcacuugggaaaugggcucugcaaacgaccagcgcggagcucaccggcacccaagguagagccugugauaaguuaccgaaguguuaaacaaguccgucaggugaacuugcugugucaacacgaacuuuucaugaugugaaacaaaagaaauauuuuccuaggaccaccucagaugcaugcuugggcacggauagcugcagaugcgaggcccaggcagaaaggcgugucauacacgcugagccacuuagagucuuguugccagagugggagaaaguuugccuuggcagguaaaugaaugaaggggcaaccaucaaauaccaucugcuauuuuaaaacacgcuauuugugucucaagugcacaugugccuccuguugcuauuuggacgggggacgagaagccgucucucguuccauuuacagccuuuggcuucagcagcagcaagggcugaccaggcaggaggagguauggcugugacuauuucugugaagaacuguaauugcugcuuaggaaaccuccuaaauguuucaggaagcucggaaagauggggacaugaagucacuucauuccuucccagaauacacggggccaccggaguccauuaggcugcugcuccuugacaagccacguaagauguccaagugcggagggaaggggaggccggaccacgauaaggcacacacuguaccacuccgauuuuccaaagcaacugcuaaauuuagccuuaggaaaaagccugccacacuccacuuuugaaaagcccuccaacucuaccgaccagaacucuggaacuccuguccuagugaggguuucucccccacuugcuuccaucugcguggcuuuggcgcuccaguuucuccucugugucuuuguuccacacaacucugaccgagagucuuaggaaugcccaaagacucuuccgagaggcugccgaacaaagccaacuggcugguguggcagcaaagaggagcagugcuaacuuaaugauucucucccguucucucccaccugcagucguccaauaagagagccagaggcgcaagaggagcagcggcacgcuuauucuccagggauccuccccuccaagguuucauggggugcccacggagcucggcugucccugcagagcauuaaguaggaaagagccccaagguacugcaagaacugaccuugcugucaauaaaggacggauccaccugagagucaaggcagugaauuagaaccaaagagaauagggcuccggccaaggucagugcccacuucauucagugccccuuuaaguacaugaacuuuccaaaaggcagucaaauccauggguggccucaacgauuacaggucacugagaaaaugcaauacacaaugaagcccauaauuucagacaaugaguagaguauauguuaauaaaagaaauaugauaaacagaaaaggagacaucagacagacacagggggauuggauuaugccaaagcuggagguuuuucaaagccagagugcuagccugggaccuggagggcagacaggaagacaugagggugggaggaaagcuaacugauuuguacgaaggaaauucagagcaaaaccccuaauacuugaggacugagaagcaaagccggcaggacugucagaggcaugaacaggguacucaagugaagacagguuguaguuccacgguuaucgguguuagcgaaagccacuuaaaauccuuggggaagagucuggggaagagggacaggaagagacucacauuguaccugaacuagggcuauagagcuguaauaaccaagacagcucaagcuuuguuaaccaaaaagggucuaaaacaugcgaacucagccucuggcugaagagaauauagucugaugcacaaaacauaggccaccagguuauaucccccacagcccaacacagcuucucaacauacagagacacgcugagccgggcauggugggugcacaccuuuagucucagugcuggggaggcagaagcagguggaccccugggagguuaaggccagccugguuuacccaguaagugccagggcuauguaaagucccugaguuaaaaaagaaaaaaaaaaaaaagggagggagggaaauacacacugagaaauaucuggcacauaagugauuucccccaucugaaagguaagaugugacagcaguaacaagcuacugccguuucuaugguggcuuguuuuuucuaaccaaguuauuaaaaccaauuucuugcuuuuguuuuauuuguuugauccuggcugucauguaccucaaacucacuauuuagccaagauggaccaucaaccuccuuauucuucuaccuccaccuccagaugcagggguuacaggcacacgugccacacaugccccucccacuucccguucuucaucuggcacagaugucuuuuaucuaucucacugaagagauauuaaagacccggcuucugaaacacacaagacaacuugccaagacuauguuauauaaucuuuaguguuuccccuuagaaaccgugccuugcaagguuaggaaggaggcugcaggaggcagagauggaaacuuaguaacaaaagaaaggcuguuuugcagggcaccugggaaaaggagucagagaacccuggcuacuuccaguuaggacuucuacucacagauacuuagucccucguuccuggugguuuucagcaucugagaaaccaugcaugccacacacugauuggaagaauuccccagcagguuccagacucaaucucuaugcacucucccgggccugcauucggcaaaccuuggcucucagagauggcuguagggugccaccugcacagucgcacucugaugacuugcuagcuugugagaauguugaaguucaagguaauucaaaagcgaguaucuuuauuuauuuuaggacagggucuuacuguguagugguggcuagucggucugacauugaacucacagagacuccccucaucucugccucacaagugcugagauuaaagacacgugccagcugagccuuuuauuuuuuacagcagaguucuaugauggcauacuucuaucccgcaacuuggacaucuaauaaccguacuuuuuuuuuuuuuuuugcaaugguauaaacucugggguaaauauaagcaaaguaccuuuagauaacucaauuaaaauaauuuagaaauaaacagccauaaucccuaaaaugguggccagaucacauguaagucucaacaagauaaaagacgcaaagacaguauuuuauaauccaucacagcacaggucuuucugauaaagggauacacauuuuguuaaauucugcgagguucuugagagauuuugugaagaacaaauaguuuuaggaagugcgugguccucagcaucuuuccaagaugguuguuuuguccugggcuccaucugcugcacgggaacaaggaaaaauccacgucugcacacuacucacuccauguggagacugugguacuuagcacucacacccuaggccaggucugaacccuacuccaucgggguggggccuggccuucugggugaggcagaagagccaaagcagccaguguccacuacagugcugcaaagcuugacuccaagcacguguggggcagcccuagccugcuaccgccguacaagcgcccagagcggacuuccuaaaccacuccauucagaguacaguucuaaaggugugcggaacaguucaacaaugaaccaaggggauggcucagagguuaagagcacugacuauucuuucagagguccugaguucaauucccagcaaccacaugguggcucacaaccaucuggaaugggauccaauguucuuucugguguguacgcaaauaaauaaauaaauaaaucuuuaaaaaaaaaaaaaagaacagaagguuaaugaugaacucaggcagccauggagaccagcguggaaagccucuacugccagcccuuacuccacagucccuuucucccuccuuccccucucugucccagucuauuccuccgaguucauuuaguccccuccuugcccuugcuuagcggguggcaauccuagaagcuacaucuguuugaggcggugggugggaaugcacacaagugacacauuagaugagggaaaucaagacucaagaaaggaaacugcucagcucaagcacgcacacagagaacggcacccggugcuccaaggguagaagggaguccuuggcuucacucagcagaccaggugaagcagaggccgcugguuucgggaucgcgaccugucaggugccuacaggcguggccaucccuuguaucaagaucugaagagggacuggagggauggcucaccggcugagagcuacugcucuuucagaagauacaguuugguucccaggaccccacugggcggcucacaagcucacuccacugggugcuuguggccucuguaggcaaugcacucgcuggcacaacuuauacauauacacacacaauacacagaaauccacaggcacaguguucacgcgcacacacgcacucugaaagaaaugucuuccauagguacuaauaagaaccuuuaugguggcucauaaccaccuguaaugagaucugaugccgucuucuggugugucggaacacagugagaguguacucacauacauaaaauaaaucuuuuuuaaaaaguggggggaguacgagguuuuuccuauuuuagagcaucauuuugaguucuguacaagaauccucacccaaaacuguucccauuucuaaacuguaaauguuuggcccaagcaucgcuguuuugugaugugagguucacucucucccuggcuugggaacacacugucaguguagguaacaugcugcuguaagcuguaagcuacacagugcagugcuugaucauauacagugccuggccgggcuguguuucuguugcuuguuuccccugcaaauguaaaauaauaaacuacuuauugcaggcuuaaaggguuuugcugucagguuagcccaggggccuaccacugugaaguauuacugauaggucuguaagcuuuaaaaaaaaaaaugucucacguagucauagauuuuaaacacuugauucccuguuggcgacccuuuggggacucuagaugguacagccuuguugcaggaagugcaguaacuggggguagguuuugaaauuaaaaaccagucccgcucuucagaucggucucucugcaccaugcuugcaccaggaggcaugagagugcacacgagcacacaugcacacacaggcacaugcacacgcacacgcgcgcgcgcgcacacacacacacacacacacacacacgcugcugcuccugcugcucgcugccccacuucucucuggauugccuugaggauggggcuuuaucacagcuugcucucccugguuuuuuaaaguaggaaccaaaacaccuuucgcacauucaagagccaagggcauugauucuggccagcguacaaucaaugguuucuuucacgagaaaggacggcaagauacuuaaauacaaucuuuguuggggaguccaaaccacaagcgugugauguuaugaagccaaauuguauuuucuggaaacaguccucagaaccauuggucagcaaccacugaggagucgauaaacggcaaugagcucuggugucuccucuuuuaaaaugggacaggagcgagaacacagaacggggcuuuacugcugaguuucugugguuucugagugacaguuugguguaaggaucgcaagugucaguucccacgcgguaugcccaccugaccucccuuccucugacaacaucucugggggcacacaguguuucugagccuucuucaaagccacacauccaaauucuguaaccugaggagacagggucucugguggguagucaggucaugguggcauacuuaugaacaggacaacugcccuuuuaagggaccccagggaaccauccuguucuuuuguaacacaaggacaugguuggcuggcaacagcacccuggagaacaaccacgugcguggacaccuugaccugggccuucccgcuuccagaacuuuggcaaccacuacguucauaaacugccugccgaggguaugacgucccagcagcccagacuaaaaacuacucuugcccuguacuuaaggggguacuggcacaugacuccagggguuaguggacaaagacuggacgcuugauuccagcugggccagaauccagaaaguggcucaucugugcuaauaagggacauuucgggaaaugcaaaggucagucugucuuuccagacaaguuugcuaaacuggugggguguaaaaccggcgcucugagcagcaggcugcuucagggauaccugccugagacuaaagaagaagacagauuccuuauggguacccagaaccagcgucccugaagaaaaugcccaaccugcucucacuaugacucagggacuuccuuucuacagaaucugguucaagggagagaauuuugucauuugcagcuaaaagaaagaugcgugguggggcuggugggauggcucugugaggaaagguguuuucccugccaccccggagaugccagcuccaugccuagaaaccacauaaagauuggucaagaaaacugacuucauaauguucuacaccugugucacaacaggcagggacgcucgcccauauacaacagcagacucuccuuuaagguuccuucuuuuaauucuaaaaggaaggguugaagugauggcuaaucaguuacgagcccuggcugcucuuccagaggacccagguuagauucccaguuacagggcagcucaugacuggcuggaaccccaauccuauggaccugaugccuuuuagcgucuacugggcacugggccuacauauacaucaugcacacaggcaaaacauuuauacacauaaaguaaaguuuaauuuuuuuaaaaaaagguaugagaagacuguaaaaugauggucuuuuugcuaaauaucagggaaguucuauuuuucacuuauaaguaaaaauauucccuauuacuaaccauauuuuaguacuacccuuacguugcuauaauuuucucuagaaaaccggauaaaugcuggcagaaacaagcugccgugcuuaugcagagcacaacuugaugcucauuauccacagaaaucaaaaagauggcaaaggcagacugugcucuggccuagcugcagaccaucugucaucgaauuuauaucucgaagaaucuuaacucuucaagccucgaguuacagccgaaugcuguggcacaaagacacaccccacagagcagaaucacaacauaccacuagaucugaaaagguggccuaggaacuaccuucugacucauaccguggccgacagcaacagaagccacgaggcagacaggccgacaggcaagcagacagacucacagauaccugaagcaaaggcacuucccaugugcaccgugcuuugauuuuaaucauugguggugcugacccaccaaacggacuuccugaacccuuacagcuucgggagcuagcuagguaagggauggagacgcagggguguaaggcagucccuacuaguucaguuaguggcaaagugaagauacaaccgcaguacccaucuuacuguaugauaugacacgagacagcugucgccuauacacauuccuggacagcaagcucccccgccaacccuaagaaaccugggaagaugauccacaugucugaccuaagccacucuccauggguacaguguccagguuuuuagggccuccucgagaccacuuaagaaggauucacauccaguggagaccuugaaccgaccucagugggagaucaugugacgucugugucuagacugccaagagacaagaacagaccuaauguauaaauaggaucauguugguuucaagcuuaaagaauauuuucacgucaagaucccggcacuguuugcugagaagcguaaggcugaaagauaucuuucuuggugggcaucaagcuuuaccaccuagacccuaucauggcagggagggaaagggaagggagcgguagccaccccucgcacagucaccagccacuucucuaauccagaugcuggaaaaggucagguuagugaggagggggcugagccaagcucggagaauauguggacagaauuuaacauggagaguugacguauggaagcuucccgaguggcugcaauacuagaucccuauucaacagcaagucauagaccuggaugguggugguaacgggguugggauaaaacggacagaggacacggcuguuaacaaagauguuaacaagucuuaguuuaaaauaauggaacacccuauauauuuacacuugcuucccacaauacaaaaaauguuaagccuaucagcaguuuaauuacuauaaacaucugcucucccuguauuuacuuucuacaacuuaguucuccucuguuacaaguugcuuggaacccuguauacaguagaugcuucagaacagguggguccaucucuccacaugcuuugucuacuaugcuugccuuagacaacaaugcaaaauuaaacaaagaaaagauaccauacugccaaaauuuugguuaauucauaagaaggauuuuucuaaaaaugaagcauuaagaaagaucaaagaacgaaccccuuccacgccugcauuuuuuuuuuuuuuuuuuuuugugaaggccacuguuuauaagcuaucuugucaguuuuaaagagugacuuuccagaccgcaaaagcauccugucugccuacuguguggucgcucaaauguaagagcagagaugcgagaugccuacugugugguaacccaaguguaagagcagagaugccuacugugugguaacccaaguguaagagcagagaugccuacugugugguaacccaaguguaagagcaguggggaacagcaagaagucaucuggcuucugggcuuucgggugcuuugcugaaggugagccuguucauacagaucucugcagaucugagcaccaagacccccuccaucacacaaggugacaacacccaucugugucacguaguaagcuaauaagcacuuccuaaauguggcugauuuaacacgugaccaucaauguaacuuaauacauaucaucuagauuucucccacuuuuauuuaaaauuacuugauggcugucugaccuuaugugaaauacauaucuuaaaagaguaagaaagauaaaauuacccacagguugauuuagucuacaauuguuagacagccuuaaguagaguuuauggucaaccccuaggaagugcguaagauuuuauagcguuguuuacucauuucaauaguuuccccagugcucucucuugagccuucaauuuccugucuaauccucuuuuauuucaucuauuuuuaucuggauucauguguaaucuauaucuccguagccuuccuuaagucccucccucucccccucgauggaaggugagccacacacacauaaaccacauuacacauggcugccagaagcuuuuuggcaaagaacuacauaacugaaaucagcucccaaauauuaggcuugggcaccgggacggggugcucugcuaauguuuaauaaugaagcccuggcaccagacugagacucccucucuugaaaauaucaaggggacacaaacaugaaaucacuuuaaacuggagaaagcaacgccuuuuaaauaggaaaagacacaagagugcacagugaucagugaggagccgaggaagacagguacaucugccugggaaaagaugaaggcuuccaaaacacccugcggggcugugccaagccuaacaaaauggucuccccugauuuuuacugggaagcauggaaaguuguguuuugcaugaacguacucaauuuucuuuaaacauucuuuuuuaaaaagggggggggcaggcuauacacaguacuguaacuuccaaauucgugagaaagaguggcacccccgaaguuauuaugacagauuuccaaaggaaacucuagaucccccaauuuacaugucccacaacugccaggggccagccgcucccgagcugagccuggaauccuagcugucaguaagagcuucacgccuucuugguuggauacuuccacuggcaacugauuggucugcuugauuugcucgugggaaacaaagaauucucaguuccaccuguuauccacgaauucugaagcagcccaacccuaucacacugcagcagugugggcuauucuaggaaggaggacccagcucaguccugaauacugggcugagagaagucugaaccggcaugccugagauuuaaaagccuuaaugcgacccgguuaauucuuuccuuaaaugaucuauguccacuuggguuguccagaguggaauuaaccaagaccccacugagguuccuaagcaauucacaacuucaaugcuuuuuguuuuucacuacuaaccaaacgcuguuuucuaaaacauuaaagauuaucauucccuaaaugcaauacaaagaaaaagaccgacaagcuaaucugcuaacucugguuuucaaauaaaaaaugauuuaccuauaagcacauaccaggaaaagcgcuaugagcugcuucguguuuuucuuuaccggauuucauaguaauaguuucuguguacaaagacgggagggaaacucuauccagcuacuguuuauccauuuuaccacaaaacuggcugggauaacaguuauaacgugaguuugcuucccugagaagcccgguuaaccaagucgagguaagaggcacucuggagaugggagagcccucuugguuguuuacugggucugcuauccucacugcuaccucagguuugguggaucaaguaggauggggagacaaugcacaagacucagaaguggguccagcuguuccacaguagccuaugguuuuugacaaugguaagugcuacuuuuaacaccaugcaaaccacggagaaucaaagagcaaggcgacccacccugggcaucuaaacggguggccauaaauaaaaaggugcccccucgcccuugcuucugagcugcagguaagccaagcucucagcaaguucugccacaccuugcccucaacuuuccccgccggccuugggcgcaaggaaaacaaagcggccuucgcugcccucucugcgugcaccgcgggcggggauccaggcaaggggcgcgagcccgcggacagagggggagcucagcgcagcaacagagccggagcgcgccccccgcccgcgcgcccccgccgcgucgcacauaaacacgcgcgcuccagaaacgcgcgccaacgcccggccccgcgcgcucccuggcgcacguaaacacacuccgucucccacgagcccgcgugucucacaccugcucugcgcacgcucacccaaacacacgcccuccuguaaacacgggccucgcaccagcgauugcuccagaaacacagcucggcuccccacgcucacccgaccacccacacgcucuucccacucgcuuccaaagcacgcgcgucucacacgcaguacucaaaccuacuugcagcugcgaucucacccccccaaucgccccaaaacacgccccccacaacaccagguccccgcgcacacuccaggguucacucgcgccauaaacacgcgcgcacucaccgccgcgccuguaaagacaacccgaauggccucgcuuccuacgcgcuccagaaucacgcgugccugcaccuagcuccucugacgcucuccuucuucacucucgcucgcacccucgcgagcacgcguguuguccccacgcccccgcccgcgcgccagccuccgcccucgccucuucgccaggcgcacacucacuaggacgugggagcacagucacccucgguccguccggcguccagacgcccgugccccgcucuccgccccgcccggccccgcccgagucgcuccacuccacaagccgccgcuggaacgcagcgcuggucuccggguaccgcggucuccccgccacagcccgagugcgcccgcaccaccaauggaggggcgcggcggugagcucaccgcacccggcuccgccuccaacaccgcgagggccaaucgaagugagcuacgucacccggagccgggcagaagcagguguggggcgcggagcggcucggcgcgcggacugcgccggaacugcgcccagcuuggcggcgucgcgcuggacggcgucgggccgggccuggagggcgucucgcgcgaguggggucgcguggggcccgagccgccgcccugcccucgcggccgcucccucggccuccagccuagaugcacuccggaggcagggcgucucccagcccgacgggcagccgcggucucagauucccugcaacuccuagcugcgcagcgccgucgguggggggggggggggggggggcgggagcccacucucaggggcucugagguccaaacgucugcaaugcagcgagcugguggagggggcagugcgcuguccgagguggggcucgaggaccaaggggcugugacagugacugcacccccuagaaguucaaggcucuuuccauuucuaugaucagagcccaacuccuuagcuggagucauggggccuccgccuacucaguucuggccucgcucuccccaacucacagcgcuguaaucacucacuuggauacuuugccaaaauauucucucgccuccugcuauaaagcuaaacacaacgcuaaaggcuccuugucuccacacagccuucucagacgucccaaaggaaugccaccgacccuuauuuuucucagacauauauauccuaucauuauucguuuaaccacucacccaccaagaccuuguucauagaaaguaugacccacgcacgcuucugaagggccaucuuuuguuugcauuuuuuauauugucuauugacuuuaaaaaugacguuaugucuuuccugccaucugagcuacaaaucuccacacauaaaagccuuuugauccuacccaauuagauuauaaaaaugccacacuuucgcacagcccuuaaguucgaacaaccaacagggacuccgugguuagaauccaagugaaggacacacaguguuuaugcuuccgaagcagaaaaagcaagucggaggcugcgucuggccacagacugaauuugagcacauccucuucucuucccaagcuugugggagcaucaucaggacuccacagcaucuuuacguccccucuagguccuucagaguccacaagccucuacccuggucccacacuggagccccacggcuucccaccucuccaugugcuaggguaacuucugucgauaucuagggcguggcuuaaagcucaccacccuuggcgcuuuuuccugccacuguggauagagccaugcugacagcaccgccaguucuggagcugcagcacagaguggguacagcacugucaauucuggagcugcagcacacaguggguggguucugccucugucuaagagacacggugcaugagcaguagucaaggaaacuucaacuuuggacacaaauugcccaaauucagagucagaugcugacacuugcuaccuauguggucgguuggucuguuucuuuguaucuauggggccauagauacuaaggcccaucuaaacacuuuguggcauuaucuaguguuacuuucuuaacuaaauauggguauaccuugagcuucuaagcagugacuaaaaguuauggagccacagguuccgaauuucaaauaauguucuaugguuggccugagcagcuuuaguuuuguacccaugaucuguguauuauuccauauguauacuguauauucaucaagauuucaaagguuagcgggucagcucuaagaucucucugaacagugcagcugagcuuguguccauagcugauuguuggauugcccuuggucaagugugaacaacacccaaacuguguacauaagaggagcaugaggagccacacccaccccaugcuccaacaugccagggaaugcaccaagaucgggcuaagaaauaggggauccccaggaucuugugugaggaagcucuuuuucucauucuuuuuuuuaaagaagggaugaaggugagcccuggguaucccugcugucugggugcagaccccagaagccaggaaauaucggacugacccuuccuuuucuuuccagccaccccaugucuauauaguaugagaagaaaguggagucuguggcugcugcaugccguacaggaggcauggcugagcccuccuguccagucuggagcuggaacuuuccuucuaggcagccucugcagcaggacuuccucuuacugcuccucugaugggcaguuuccuagaaggcacguccugucacccugagucccuacuguaccauggaaacagucauucucuuuggccagugcacagagagcugggcagagcuggggugagcuggaugggucugcagcuaacucagagcgugcucaggguguguuacagccaaaugcccacaggugguggauugcuccuuguggguaucuguguccuuuagacaaugaaaggguggggcacacccguaacucaagcaaaguaccacacugggguuuuaugagacuuugauuggaccuggguccuuuucuggcauggagaaaaagaaagcuuucaugaguuaguuaugaguccaguugguggaagccagaucaagggcaguuuuugucccuuaggcaaauacagucugcuguaaucuuagcccaaccugugcucacuggggauccugagugccgacagggaagaagggaagugcagugggcugggcggguguuaucugcucccaucaugcugggcacuccuauccauuaccgcucauucuucugcaaguaggacagaguaggagacaaaagcuccaagaggcagauaacuugcuccaggcuccgcagcuggcaagcagcagaccugaagcugcaccccauuucauccuguuccaggcacuuaaagaaggugcaguccggaaguuacucuaaaagaacugaguuuccuuacaaugguuaaaguuucaggugcacaacagagaggccaaaucagccgcuuccauucagugcccuguagggagagaagggagcguucauguuuccagccgccauccucagggagguguugugcucucuggacuccucugacguuugaugugaccaugugauuuucuugggccaggaaaggugggaugauuugugucauuacagauggaaauaugaagagccagggaugugcccaccacagucauuuccccagcccugacacuugugaaagcuuguuuacaucaagugguggcuucucucugccuagaccccuggaggugcaucacaggcagagucccccccccccaaacaguacuugaaguauggcugaccaaccauggacaucaaacauuggacuguuggauaccgaggcacagucuaacuucuccuguauguuaacaaacaaguaugcuucuagauaguucagcuuccaguaagugaaaagacaguaacaaaaugaauauuuuagcauaacuaggaggcacgagaguuggcucagcaguaagagcacuugaugcucuuuuagaagacccagguucgauucccaucacccacaugguggccacaaugguaauucaguuccaggagauccacuggcaucuccugucccucucagcauccagacaugcacauggugcacacacaugcaagcaggcacuuguauauacacauaaaauaaaaucuuuuaaagaaaaucuaaacuaaacauaaguaaguguaauaugcauguuuauguuuuuaaaaaacaaugacaggaaagauaaggugauauaauggauaaaagaaguguuuccaacaagugugcuggaaaacuggaucccccaggcuggagagauggcucagugguuaagaauacugacugcucuuccagagguccugaguucaauucccagcaaccacaugguggcucauaaccaucuguaauaggauccaaugcccucuucuggugugucugaagacagcaacaguguacuccuauacauauaauaaagaauuuuuuuuaaaacaccggauaccugcacucaaaaaaaccaaaaagggacauuuccuuaucucacaugggauauaaaaacaaacucacaguccaacaaaaaucugcaagaauccaaacuauagaacuccuucaagcgucuuaucggcagauuguuaugacauggacuuuguugguggccacuuuaaauaugaucucaaagauacaagccaucaaagggacaauaaauaaccugaacuugagcaaaaugaaacacaguugugcuuccaagaauagcacuaaggagcagaaagacaccaaaaaggaggaaacauauaaauggcauauuuaauaagggucuugcaucuaaaaucaggaauucuuacagcuuaaauuuaaaggaagcaacuuauuuuuuaaaauccaaguaagggaucaaaugaggguuuuguuuuguuuugucuuguuuuuuuguuuuuuuuuuaaagaagauaaacaaaagaccaguaaaaacaugagaagauguuuggcaucugaugaaaucugugucacugagaaaugcaaauaaaaacagcuguggaccagacaugguggcccacaccuuuaaucccagcacucuacuugagaggcagaggcugguggccagccagacccacaaaguaaguuccaggccagccaaagcuggcuuuugagacuuugucucaaaaaccaaaaccaacaacaucaucaacaucaacaagacagucaugaagcaacaacaauaacaacaacaagaagagccuucaaggaaagagcagaacucuuuaguacugcugguggggauguaggauggugagauugcauuggggagugcacuggcaguuucuccggguggaccuucagcuaugacauggaccagcaauucuucuccuagcuauggacccgagagaaauggaaacagauguucgacauguggacaucugucuggcaauaaacagacagauacacacaguacacgaugaacccaaaaggcagcauacuagguuaaaaaaaagaaaacccagcuguauggccacacacugccugauuccuucuacaggcaacaccaagaacaggcagguuuauagagacagagaagauuacuaguuguuuaggguagggcucagagcacggugguuucuuuuggggugggggcugggggggugagaaugaucuagaauuaaguuucugguaacuguauaacccugaggacuagagacuucugaauccuguacuuuaacaaagugugagacuggaaagcuggcucagggguuaagagcacugguugcucuuccagagaaucggcauucaauucccagcacccacaugggagcucagaaccaucuccaguucaaguuccagaggauccaaugccuucuucucgucucugggggagcaugacacccauauaguacacaggcauacacgaaggccaaacacuuauauauaaaaauacguaaguugugaaauauaaacauguaugcacacacacacacacauagacacacacacauagacacacacacacacacacaaagacacacacaaacacauacauauugguaguaacaagccuaagucucagaaagaaggcuggaccuuaggagaagggcucaggucauggaggggaggaagacucuagacagggcucugcuucaggacuuuaggguuucuuggugaaggcuccaaugucucaugaugcugacuuccaagaccacaggccggaagguggccauuucuaacaguccacuggaggaugggggaaagcaaggucaaaucuaccaaauccauuaauacuguaauggccccuuugaucuuggaaaaacacguccugaacugaggucucucucaacaccccauucgguggcugacuuguggauaccacagcaagcuuuauagacucccacugcccugccagggccuuggccagggccuuuggaauguucaguaggaggcucgggacaguagccugaauuuuggguccagcugcaacacuaaguccuugggugguggguuucugcuuccuuugcuuugagccccuuucugccuauguaaaaugaggucgggcuggaucucaauggaauuuguaaagcaaccugagcugagagcaaggccuccgagcuucccugcaaggaaccuggaugccacgugaugugacgugaccaguccuacgagggcagcugcacaagugagcccaaccaacccacggugcccagaaaauaaaugcacuuggguuauuuugagccccucagcuguggguggcuuguucgcagcaauaccuacaacuagcacagugguagacagugaggaagagaggcacuuacuacuuggauggccaucagacugggaagguuguuggcuuuguucaggcuguaagaggaggggcccuuuccauaagucugacaacaugcagauuucucuucauggacaaaaugcagaaaagaaaacaaaucaccuuuaacuuguucuccuuauugcuucugcagacucauccauacccaacacucccaaaugucgguacuacagcgaaugauaaaguccaccgcuauuguccauguuaaaguggggggaagugcagagacaucucucuccagggcagugggcguagaaucagaagucugggugaauagggauggaugccccaggguugccauccccagccuguauuacaggauaacuuacuagacccuugugagauaugggcucuguguuagaauaaagauggagaccgcuccugguaaucaauuaucaaugauuaucaaacccagaggccaggugggugcucagcaaggcucguggaucagggaugacucugaggcaacauacccuuucccacuuucuauguauuaaaauaaaugugucuucugugaagcugugggagggagguggcagaugccauggccaugguagauaaucccauacagauggacagucacccucacugaguccuacucuggggccuuccaggaaaaguuggggagagagguuccaggcccagacucuuuagcauaccccagguuagcucaaaagccucacccagcaggcacuguaucagcuaagacaagcucagcccaaacccacaguuuuaugcauuucuuugucuggcacagcucacaggccuccucuguggagagcauagaagccucccuaacccucccucauggcuccuuguucgaccagagcauaccucacucagucuuuauggagguagggcuugaggguugagagcacccgaggcugaaguuggccuuuguacaaggcagagcgcuccccuaagaagacuggggguaccuacaaccaugcagacaccacuucuccauaagaaaggcacacucauaaauacacagauuagucagccaggugcaguggugugccuuuagucacaguguugaagaggcagagagaggcugauugcuacaaauucagggcuagccuggucuauauagugaguucuagcacagccagggauacacaguaagacccuccuguuucaaaaaauaaaacgugcaagcaugcacacacgcaggcaagcaagcacacaugugcgcgcacacacacaagagaaaugcauggacuaaagcugccaucaucagauaccucuguaaaaagugggggucugaccaagacaaguaggcaaugacagagucaaaagacuagccacuuagaaugacagccaccuuggaaucacccucagaguggccaugagacaucuauggaaguaacagcuaggugagcacuccaggacggggcagagggacagauuuaucucagggacucugcaggcacucuaggugauaaacucgauugucagaaagggcaagaguguggccaggggaaacguggcugggucacuccugcuggccuuucucugacacuaugaucaugucuccuccacaguggcuccucuccauguagccacaucccccuggugccagcuccaggcucugggacuuuguuugauucugcugaccacuuuuccuagguccguucgcaucuagcggccgacacugugaucagggauucccccagccaaagaugaagaccagauaacccuggauugcuccaccugccacaagaacaagaaacaccccacccaccuguccucugugguuuaauuccuguucaggugacucaaaauaacuaccugugucuugcucacuuucuuauugggaacaaaaccauauagagaugaacacacacacacacacacacacacacacacgagggucagggcuuagucccggacagcagcaacaauaaaacaaaaaaaugggggccaaggggaagugaggggaagaaaagagauucaaaaaguguagaaagaauggggagggaugggaggggagaugagacagguagccccuggugcagggggaugucuuggaguuccagaccuuuuugcuucuccacucagcuugcucuugccugauauuuuuuuggggggggggggagggggagguagaaguuuucucaaaaugcaccaggcuggacaagcacaguagcauauaagccugcagucccagugcucuggaggaugaggcagggucauuguagcaaauucaaggccagccugggcuacagaaugagacuagcucaaaacaaaggaguaagagauccuuggggacuuccaaauuccagggcacugguggcuucauuuacaucaagcccagccuucugaaauccugcucauggcucuggcauggcacuggcuccggagccccccauacaggccguuugcagucuucuauccugauucucuggcuuuggcuguugcgggauagcccagacccagccuuccggugguauaaucaacaccaccacacgccuuaagcauuauaucuugaacggucuccacaguauaauaguaauaauaaucagauggcugauuauuucaccuaucagcuggccaccguucgcaaagccagguccgucccccagugaugggggaagucacagagacacugugugaggucagucacacaggagagguuaauaguucuaguuuuccccauguucaugggccccagcucagggagagggaguuggugggcagggggagaagcuguucguaagugucccgcagugaaggacccuuugggagaacauuuaccaaaacagagaacguugcuccagguuggggugcugucuguagaauggaagugagacucggggucuuuucaguugugacuaaagugauauauuaggguaauagccaugacuaccaaggcaccugcauuuucucacuuaaucucacaucgaagcccagggaaaacuaagcuguccuguccgugauauccuccauaaaagacgaaauauauauucacucgcguuauguuucuggauaaaaugaaugagcugcacaaccgugcuuuaaaaauaagugaccacacagggaucuucaucauuccuuccucccgccacgaagauagaagaauguaauccaccgggguguguguuugggggggggaggacacacagggagcaccacuuuaagaggagaugacauguggccuuuauccucaccugggagguggucucuaagcccucuuggaucacaggauaguuagcaacaccaugugaagagguugugguuuggugucacacacacaggaccagcugaccugagcuugcaugacagagccacagacugugaaggcuaagguucugaugagcauaccuucucucugacugauauacaucaaugcuaggagagcaagaugcuaggagaugcaucaaugcuaggagagcaagauggcucaugacagcaugcucagaagaaaaugggagcucuguauuugguaacccccuaggcuuaugcaugguggcuguuucugaccauaucuguguccuucuguggugagacuaacaaccuucacugucuuuuucguaauuuaucaggggcucuucgggaucuuugaaaacguaguuggugucauagaaggucaaugaagcccccccccuggagggcaggauaccaggcagugacuucccugggaacuuuccugccucucugauggucagaggaugaguaggucugaaggcaaaaauugcucuucuguuacuuucccaccuacagggagccgaagggagaacucuccaucccuccaggugaucucuuaaguggaccaucaagcuucuacaugcuugucuugggucacuugccugaagcuugcccagugagacaaagagcagaaaagguuaaggauggacgccugccccagcuuggcucugacauccuaaagccagcacaagccauggggauggagggcacaaagacagcacugggcuacuccagugacucauguguccauucaucuguccauccaugaguccauccacucaucuaccccaccaccuauccacccacccacccacccauccaucugucuauucaucaauccauccaucuacccacccaccuacccauccaacugucuauccauaaaauccguucaucuauccacucacccacccauccaucugucuauucaucaauccauccaucuacccacucaucucccuccucauccaucaugaucacccgcuugcccauccaucugucuauucaucugcucauccaucccuugaagaaccaauuauuaaggauugcuacaucccuacgucucuuacagugcuaauuaagauaaaaaucccuugggacucagcuauuuucuuguccuugucaaucucacccauauucacugccuccuucuauccaggaccaccuccucgcagacacccaucuccugcucgucagcuuucuuggauuuugaaguguauggucacuuaccaaugacuuuuuucacaaaaguuccaaagggcccucaaucaagcuccaucaaacucaggacaaguccuccaaggugaaugguguggagcccauaggcaauccuuccacagacuguacuaaugucaccucccuucuuguuucuuaacucugugccuucuccucugagcugccaucuuuuaucagaacagcuaacuggucuaccuuguguacuucaggacuucuuuaaucggagugcuguggucagugccagcuagacccacaccaccucucucccaucucauggccuucaccaaaaccucucucccaucacagagcuccuguggaugucaccuuggccuggaaucuucuugucuucuguuuucauggagucaacauuugcucuuccuacugaucucuucaaaggucauuucuucaacaaaucccuccuagaccucacugaggaguccugccucaucagaagcaucccgaguuuaagcuuggcaaguacaaggaccucaucaacccagcugcaccugcucugauucccagcacugggacagcaccuggcagcuagagggaacacgcucuacuccaguaaugaguucaggggaaacugcuaaugaaggaauuuacaaagcauuaugggaaagcaggauaugcaggcuuucuucaaggggcagugagagggagcuugcuucaagcucggggacaacacucaggcagcaccacagggacuggggagagagugagaggucagaugccaauggcauggagguaaagggagggucacuguguccucugcucccuguaccaccugcucacucuggugucucaguucuucccugugcacaaggaccugaaagguugcuggaaagucagaguaaggggcaccacgugaauguggauauggccuggggcacgaugaucuuugaaagcugcuguuagcccuagcugggcagugugucuccagaccagucagugcagccuggugucagcgaauugacucaagggugacucuccaaggcgggaauggaauccuccacucacacccccacacaucucaugucgcaguaggagaaaaguccccuagaagccaccacuggggauuguccccaucugcuggcacguggcaucucaggccuagagugggagucagguuccaccucucuuguugguguaagcguuagcaaagagcaucggcuuguucagccaggucaccucucaugacccuugaccccgggaaagaagcuauaaccuaugucgcuagcuuccagccagcuucuuuuucaucugccuuccugucucccagggcugagggaugcuuggcuguggggaagggaaagcugguggaagggaggacauugugcagagggaacuauuuggagacuuccauuuuggucagccgugguuugguuuggggccgcuggccuucugggggcucaggcuuccugcuagugagcccuagauuuguuuuucauauacgcuuuucacucugugcugauucuaacaaaaaaacccucccccucccccuuuuuuuuaacuucucaugucauuaguuuacaguaggccaugacuacagcguagggagcuggucugcaguccaucaaagauuguggaaugcccuggugucauggaggugagagauaaggucacugaaccacacagacagaaccagauauguguauguuuuuuagaaacuuggagaaggagaggccuuagccuuggcuccuguuagaggcugaaggcugaccccucggccccaccuggagcugcacgaccuggguagugucuucuucugaagucuccagaggucccaaccugcauccugcucuuugcuuccuugcuguugaugcucuccaggcuccuggucucaggaccauuccucucugcugcuggaucuacagaccagccucuucaugcuuucucagacggauggaugauuggagcuuggcuuaggaaagcccauggaagccagucggauggccacauggcagacuugaaggacagucuuccuaccaauaggaucccugaguuauggcagcauccaguggccaggagacuagagcugccuccucucaucugacaucaguauacuauuuggguggggacgaucaucauuuguuccugauuagaguucaaccccugauuggaagagugaaggggggguuucucuuggacucugggcagaugcagggcuuagaggcuaccuuccucuugcccauggaccuagcaaacagauaaggcaggagaaggagaaauuagauucccugcuccagcugugcaguagaaggagcaaacagugggaggcacagggccuccccaccaggucagccugaaugaggcucaugcccucuguuacccugcuccagguugugacucugagcugagacaggcuuggcaguauggugucugaaaucuaggcaaaagucuugaguucucuaagcuuggucuuccccuaacucuucuagacucuuccaacaacacaugggucccccuggcugggauguucuuucucuucuucacuuagcacuggucaugaugaccaaggccuucuugaaaugcuuucuucucucagccuccuugggaucccacccuccaugucuuccaccuuccaccuugcuggccacacagucucuuugccgucuccucuucugcuuauggguaagugcuaggccagccugugguccuuuuuccguuuguuuguuuguuuguuuguuuguuuuaaauaggguuucugugaaaucugguuuuccugaaucuugcccuauagacccaggcuggccucgaacucagaaaucugccugccucugccucccaagugcuagguuuaaaggguucaccaccacuuccaggucuagccuguguuuaccacagcuucucuuucuauacuguuucauggagcaauuacacacagccacccacacacucaugaucccccaaucucuguucuguuccuuauucuccaucaucuccagaccuucaaagccaacuguggcauugguguccccaccuaaccacaccaaaaccaagcuucucauugccaguggcucccacaggggcuucuucaaaugucuccaucgaugaauauaaguugcugucccucuagcuauuaaaagcccaaaucuggacaucaacccaccuaguucccuuccucauuagacauucaaaccccagcaggacaccuguuguuuacauccaaaugucucucaaauccggugucucugcagacugucauaagcucugucagagucacuccuagcaccuguugccuaaggggaugcucuggccucugggaagggggccugcagauggagacacagugcagucuccaaacagcagcugggguggacuggcaaacacaccugaaugugucuuguaaccuaccuaaacauacaccugggugcaccccuucacccguuuagcgcacacgccugaguacacagguuccuccuccauggcgucuuccuacugaccuuaggaugaaguguuagcucccuacacuggaugacagagcuccuguggacugcagugucuggagucuagcugauucucccugcaacaucaucuuccuuucuucuuccucggauguacuagaauacccaguucauucccacccuccuggaaaccguguucuugagaaucuuucugccuagcauguucuuccugugaguugaauucuauccuuccccugcccccuccacaccucaccuucacaggugucucuuuuccuccccaaccccaaauaccugccuggaaccucuccuggaucagauugcucaagguuucugcuuagcaaucacugccagcugguguuucuaccugcaacuugucguuugucuuucuccccacuggaagauaacccccugggagaguuaagacuccccagggccuagaccagugccuggcacccggcagaggcuuagcacauauuuaugggaugauggaagaaugagugccgggguuggggaaggaggccaggagacaggcuaggacgugcacaacuauuuugagcugcaugacagugguguuggggauggggagaaguagaaagcaugaaagaaaugaaggagagaaaaguaccaggcuggaggcaacauagaggggagaagggaggaagcagggaguccacucuuuuccugugguucaucgaaaaggccaggaagaagugugggauguggguagccacgugacaggucuagaucugggaagacauacugaggaguggucaccauguccugugcucuuguauuugaaugcugaguguccagccagcggugcuguuuguagagguuacaaaacuuuugagauauaacuggcuagaggaaggcugcuaggucuuguaugcuauagcugccucugguccuggccucagcacuuugacuccugacuggacaucauguuaaggucucacuccuaugcaugccuuucccacaaugaugggaugaaauccuuccuuggucauagcaauaagaagaagccacgaaaaaccaaaaaaaaaaaaaaaaaaaaaaagaaaaaagaaaagaagaagaagaagaagaagaagaagaagaagaagaagaagaagaagaagaagaagaagaagaagaagaagcagccacuaacacacugguagaugacagaguggguuagacccaggcuugaguccucagggaaagugggcaaagaaagaaagaggccagcuacauaggcacuuauagaaccuuccagaaggaggagcuggugacaggcagaagaguugaaaggagcuggaggagagugugaagguccagagaguggggcaaaggggcuucaaaagaggcaggaucaaucagcagggguccuagggcuuaagggucauguggacaauagggaccuacuaugaucuuggcaagggauaugcuugucuacacguccaugguacauggaugugggggaaucaaaaacuggaugucaaugucuuuucuguccugucucccagaaccagcagagcaucauuguugagcaguagauugcuuucuucguggauauuccagaauccacgagauaaaugcucacuguuguguggaguacacucccuuuacagacugcuccuaagcgugggucugcaccgugggucugcacccugcugccgaccucaccacaucuggucagagucccacagagaucaaaccccgguggggcgucuguguucucugcaucucagcucgcuuucagcaaggcuaaagacggccaggaccacacuggguaucugucuugguuacuuguuuguugcugugauaaaauuccaugaccaaggccacuuagggaaggguuuauuugggcuuauggcccagagggaugagucuagcaccaucacguguggcaacaggcaggcacaguagcacaacagcugagagcucacaucucaaccacaagggaacagacacacugggaagacacugggaauggcaaaggcuuugaaaccucaagcuccacccccuaguaccauacuuccucccaacaaggcuuccuuguugccuccuaaaccugucaaacagcacugccaacugaagaccaaguaaucaaaugacaggaacuagggaggauacuucacucaaaccgccgcaguauucuggaugccccuggacacgaguccucaagggcugucgugcuggguugccuacuggaaccucagcgugugaucugaugcagaaguagggccacauuccagagacggcuagcuagugaggucacaguggacuagguggcuccuuacauagaaacagagacacagagaagagagaugaccacgugccaguggaggagggacugggguuauacugcuacaucguauuaggugacaaagaauguuaauagcuaucugccauugggugagaugauagggaacucuucuuacauccucugaggggagucuggcccugcugcccuguaccucgggcuucuauuucugccauccaugguaacuacacagcagccauaggagaauacaguagucaaaggggcgucgcugaugguguccaucagagcgucucucccauaggcuugggacacagucaacucagccccccaguggcugggagccagguccacaauacagccuauaccuaccagguccuugggcuuccuccaugacacauuucucugcuuucuacccaagcagcuggguugaaguggcaaugguuauuucuuuggccucuguaggggcuguccucucuccuaaaugacccuuuuuggcaggguguuauuugucacuacugcaagaaggugcagugaggcagcugcagggacacuuguucuuagccacagagaggaguucuguacaaagucacuuaggguggcuccagauguaaacagcaggaaguuacuuucccuuggucccaagagaugggcugacuaggaaccucgggagccaagacacuugccacagcuggaugcagacacgaaucucaugcaacagagcacaggacccaagcagcugaaccuacccuuguuagcuuuaacugccaacuugauacaccuagagucccuauaaaaggaugaccagauuaaaggacugccugugcuaugucuauaaggaauugucuugguugaaaguugaggugggaacgcccaccccucuguaggcaacuucaucucuugggcagguggucugggcuguaaagaaagcuaaccaggcuaagcuagcaaaaagccucccaugguuucugcuuccagguccugcuugaguuccugauuuaaccacccaagaugacggaugaugaugugaauguauaagccacauaaguucuucucuccccuaaguugccuucgaucagaguauuuuaccacaguaacagaaaggaaaacuacccacacccucaacuugugauguggacccuacaaaggacaggagcaacugacaagauggagaagacacuggccacacccagaggggacacuccuccuccugacccauccccugccacucagcuccaagacccuccuccuaccacucagccccaagacccuccccaagacccuccuucugucacucagccccaagacccuccuccugccacucagcccuaagauucuuguccugucacucagccccaagacccuccuccugucacucagccccaagacccuccucaugccacucagcuccaagacccuagugugagacuggcucaaaucaacccugcugcaaccugugucccccagguugcuguuguacacggaagcagccagaaacccauguacuaacaaguauuuguuugcccaaagcucacuccagguagaccgggaaagcuccaggugggguccuuauucccucucuagucuuugcuuacuuacuggccagcucuggugacaguaagucuacagucucccuagaggcaggacagagugaucuugugcuucuaggccuuaacuaugcuaggauucaaagcuguuaucuaagguaagacaguuaaccauugucuuuucuuaaaaaaaaaaaagaaaaaucuguggacugugugcagcagcccaugcuuuuaauccuagcacugaaaggcagagguaggugggucucugugaguuucaggccaaccaaggacacauagugagacccuucuugugaauauuguauucugugcuauaaaauauacaaaauuaacuuuuuuucucuuccuucauuauguggggaaggacaucuuuggauugcucuagguuacuguuuaccuacauguacuaucuuccgucacccagcaggcucuaugaguaugauguccagauggacuggacaguggggaccacggacugggcuauaagggcgugggcccacucaucggaaggcccuggaauaccacugggugaagaagcaccucagaggccucucgggagcaacuggcacagcuagacuucguguagggccucuagcucccgagguuucuauagucucaggauuauauucaauguaucuaugccugggugagccccuagcccuggcagacacuggcuggggucagaagcccacuaggaggggaccacaugccagggcuagaccugcucacagcaacaguacagcguagaggcagcugcaucucucccauuuguuugcacagagggcaggucagaccagacuaaacuagaaagccagaccuuaccuuuucuuuuaggccaaagccagggugcuggggccgggguguguauauaugugugucagggaauaaucucuguccuaugaguugaaggagaccucuggccugguugaggccagcuugggaggcaggcaccuggaucuggaacuugagcuccgggccccagcucccuccuugccugagaugacaaggucccucccucccuagggugaagucagcaggccuguccaggugaccagcccaggagagcugcuuccaucucuuauucaaguucucucagcuguuggaggagcagagcaacaauuuaagcagcuuacagagguucaagaagacaggaaggcugagagugggggcagggaacccaugaaucuccuuagcccaccuucucuagaaucagaugguuacaaagaaacaaggacaagacacacacacagguuccacuccagggacagaggucaccugguaccccacugccuguggccuaaugagcaucugccuagcacgcccucaggaccagggcuguuguggcaaguagccuggccuuauucucuuuauggacaccagcacagaucugagcauggcccuggcugugaguauccacuggacccaaggcagacaggggagacacuucccagaagccauaccagacagucuccugggaaacaaaccucguggcuugccuacuuccagucuggagcaguguccccuugcaagcccuauugcugaccauccugggauccuaugcaaaugaccugggacauuuguucuggaucuagacauuggggagaaauguggcaguacucagagccuggacaaagauggaggcuuuucucccuucuguccucucuucccugacacuccuuccuuccaucccucuuagccuggccgauaacuggccuucaaguggccuccccccgccccccccccuccgugcaaucaugacucaaccacgcauugcugcauacuaaagcaggcugccuguacuauggggucucagcagacgugguccuuuguccccagcgcccaguuaaggaaagcgcuauggagaaacucccuaggucuugagaagguguggugguucagaaggcugugugcaucugcgcuucccccuucugcaagcccauucucugcuuugcccuagcggagguuuggggacguuaaauccugagccacaggaccccaccuugagaaaaaaaaaucguuuugugcuggguggggcugcacacacaaaaucugcguagcagacaaaacugagcauuagggacaacgacugcagcggggacaaagacgguggcgaggacaaaggcggagccgcagcugcugcgugcacgcgccuagugcgcgcuaaagcucuauguuucgggaccaggcgcccccaccuggcccugaauccgguaaacaaguccauuguucuaaagcagcaaaggcugaaauucuugucccccaaacagucccgggcuuugaggcaggggaaggacaaauagcgcucuccagagucggaggagggcgacgccgggaaggacugaaaagcuaccagcccucaaucacagugcuuuugcgcuuucccugccaggaacggcugcgcgcucuuccuaugaacacccgccguucugcggcagccagcgugcacugaaaccccacgggacccgcgucaccagcuacugcgugaaaagaccccgcauugcggcggugcgcgcgcgcgugguggggagagcguaugugugcaucgcgugcgcgcuucccgcccgcguugccccagaucuccgggugcugcagucuccucacccccacccccgccuuugcacacacgucccugcaguuuggugagcugugauggagagaaggugcccaguggccguggcucggcagagaauggugacgcgagggagugaaagggagaugcuuacccgccuggccgcuguagcuucugccuccacacaaagcucgcugccaagccaaccgguuggcaggaggccgggagacccccgcccuccugcuagcugucucagcugucuccugcgcuggggcagauuaugccccuggcgugucucggcgcugcuccccucccccacggcccaucagacgagugaaauggugggcaagcugggcacguucauuuagagaucuagaagcgcccggaagcucccagauucucagucaggugggaucucaguccugcugaccccaccucuuaucuccucccauuacuugaaagaacugcugaccaagagcaggggaaagagaaugccacaggggguaacgugggggguagucugguuccucaagagugguucccauacccauguagcuaguguucuaaccggauccugccugggugguaacgcaaagccaacguugcucagaugcccaggucuuaaugccaucucuccuguuuugugccaagcagcuggagguauuucaguuugaaggcccauagaagagagaacucgaucuuggagcaggaggcugcugggaagcaggccuacgacccacccgggaguguguuuguuaugaggucugagugggcaggcuacucuccucucagcauccuccccugccuuccauuagucauaagcaccauuagcuagcuauacccggcuuucugggcuuccaaggacccgcagguauuuugaguguuugaaggcaccguuuagccugagacucugcuuugaagacagacccuacacuggucccagcauccuggguucuacccuagggaggcugauggggucacucugggaaagccagggcucugccgaguguccuacuccauuccucauuuuguucugcaaaacugaaaccggauuuccugaacaggagccccuggucacccugcccuucuccguuacacacugugggucaucagcucaugcuggcuccagccucagccagggaugcugccaagaccagcacggagcuccucggcagcccugccagggugcagaugccugcugaccccaaaccaccucugggaguaacuccggaggguucaugggccaaggcagcugccaggcacccuguggguguggggacaggggcagggauaggguugggcugaacauacugagaaguucuagaaagccccgcagggucugaaccaucagccaacaggagaaggaagguuggaguuagacgguuacugugggugagugguacuuagcccuucaacauucagggauugcugugacuuccaacaaagguacccuguagacuguccacuuuacagacuguccugguacuuaggcuaggucuuauauuuguucccucugcaaaacccuacccaggacugcccagcugcagggcaucuuguaucaugccuaaguagggaaagaaggcagcuucuaacccuggcaccccucagccggacuuucccauuguuuuuuucugcagagauucuuuuguuucccgggugaaagaaaucuacccaucaacucaaggccaaggccagcaacucuggaagccucugccacuccuugacuagcaagccccgcccuccuuugcaguauaauuucagccacgguuaugagccugggcuugucuuaggaguuguaccaggcagagacuuaacaccagccaagaagcugagauggcaggagugccgagcuucccggaggaggccuggcuacuuagcucagguucacagccuggccacccaagccugacaucugaacaaaggccugcugcagcacccacacuguuagccuuuccuggaggugcagggcugggccaugccuccaggaccaccccccucuuccuguaggaaauacaggggcagcaccagaggggcuucacugcuggaguuagcugcugggcucccccagcucuggggggagcuuguucagccacucagacaccuuggcaggagugacagccgcaagccagccucacaugcuucaucuguugccaagagaggaugaguuaagauagggcucacaaguagccagacacagacugaacgguaguguguacucucaaucaaugggaggacucugcagguccucccuuggcagaccccaacaccggucccagccccucucugcuagcuccuucuuuuuuuccaaaucuauacuuccuuccccucuguguccaagaaggugaccagagcgccauucuuaccguccagugacagccagucgugcugggaggaagggagugugggcagcgcccgagccuuguacucaaacaccaccgaauuagagaugaucugauuguugaaggcaacuugcagggucacaagacccgugucgugggcugaaaggcagaaagagagaggucagggugagggcuagccuuccaacuaccgcuccugcaguugauaaccagcuaguaacccagccucugcccgccuaucccagagggcccaaguguggcacuucugaaaaaauucuuggcuccagauucaccaggugucuggaauccccagaggguuguuuauuguuuguuuguuuauuuguuuguuuugagacaaguucuacuauagagcccuaguuggccuagaacuaacuauauaguuagcaggucccaaaacucucagagaucugcuugucucaacuccugagugccgggauuaaugguaugugccaccguauuugacaagccucuaagacauagcugucuguuccugggaugccaggaaugggcagggaccugagcucagcacacaugacuagucccaggguuagguacaucugacaauuuguguuucuuuggccccuuccugccccguguccugacucacuccauguaagauccucaauguuuuaggaacuuggcuuccugcugacagcaagaguuucaucuguggcucucacuguggccugguuauccggagaugcugugggcaggguagcuacugagccgcugcagugugcuguagcacacuguuacuuccaaggacuaugggaaagcuugagcuuguauucugacgcaaauucagggcucaacaacaaaugaaccauuaaauggauguaauguucucuuuaacaggagagaagucuggaggcagagaccuaaaucugcuuggguggaggccacaccaacaagauauuaccacggauuucuugggggcugcacugugguccccaaagauguccuguagguuauaguggcuaugcuggugcucaauccccuaauaggggucagguuauguuuucuggaaccugcuuuucugaagcugggacaccaauacucagggccucccccagcaggagcaggcugacuuccagggaggacgcacgcacggggaucguauuacuguuuaggcucuuggcuuucagaagccuacggucaugaggaagccauccaagucagcugcuccugaggacagggugaagcucuggcuucccucaaaggacaucugcagaucccacuuccgaugggaaacccgacucauuggccauggccuuucuccaaccgagguguauauagaaagcaggacuuggagacaucaccgcccagguguccaggacacaaucuugaaaggauggguucccuggggaucaugaggaaccucccaugguucuucucuggauagggaucccaaugauguuuggagucuucugccaucccacaucccugggcaacacuccaagauuguggucucuguucucucuuagagaugugccugguuuaccaacagggaggaaggacucugagaacuuuccuugugaucucagggcgcucuguucuccaggugggggaagccauaucuuguggccaguguccccauggaggacccucuguuacugcuacuaugucacuguccuggcuucuacacaacuggcagcacagcugacacucgggcacccccagcauccccagagaugcaguacaagggggaccugccaauucaaggugucaggcccaggacccacagacuuccuugacuuccucucugagucuccucugcgucugcuucugcucuuauugaugaccaugccuugccucugccgacacaauggccucuugcugaaggcaacaaagccaacagucucaggucuguuccugcugcaggaggccuggggagggggcugccuugagcaccccuagaggagguuaccaggagaaucuucuuccuuaaaggucacgccuagcccaguugcccuggcuuuccuauuuagguuacugcuccuccuaacccauucucucagaauaaucuucuuaugagggagagggggagacagggucucacuauccaaccuuaggcagccuagaacucacuguguagcccagacuagccuuaaacauagagagccaccugcuucugaauccucccccccaagugcugggauuaaaggugugaacuaacacaucaacucagaaucaucuuuuaaagacauaauuuagaucaaaccacucugcugucuaaagccauuggcuucccaugaaaguacaauauaaucagauucccauuggccaaccucuuccugccucagggccucugcgcucuccuuaucuucugccuguugugacaucuaccacccuucccaagauuggcucugugccacccuucuucugccagccuccuggggaugcacauccucaugucugagaagggaccucugcugggcacgcccucuccacugugcugggcacacccccucugcugggcacacccucuccacucccccuugcugaaucuuuucguuccuucauuccuuccugucuuccuguagcagaguagcucccgacagaguagcucccaacagcuaagaccuugucaguucagcucugcaugcucaaugccagucacugucaagaucccgucuggccguccguaacuccuuuaagugagcugcuuuaacacauguacugcucgcucugcguuucgucuuuugcuuucugacgacuuccuaggagaccaaguggggccuucgagcccgcagacuucuuggcagacuccuccaccuucugcuucuagucugugguguugcccuuucucugugaucugacuugacugccuccuugggcucagggcagacccagaccaugugucuacuguugccaaugauggugugaacuuggaagaauucuguucucugucagguuuggguuugcccaggcaucugccccaggcucacaggcaguggacauuggguucucugugcuuccuuuuucccuucccuucccuucccuucccuucccuucccuucccuucccuucccuucccuucccuucccuucccuucccuucccuaucucagccucuaggguggcuuggcuuguguuuaccagccucugagccccuuuguguuggcaaggccaguuugguucuggugucugguguuuauccuucaggacuggccucaguuuccugcagaagaccccaugaugacauccccagaagcugccaccaccucccaaggaagcgguuggcugaccugacccagccucuuuggauuagaagcuuuugggucagguguuccucugggcugggacuucaucucagucauagucuaggaaccuacucaauccauggcaagugggagacucuuacaaaugauuuggaaaugaugaaguaaugaacaaaugaaccaaccgaucaauacacccggcaggaccuccuuccguugggauguuaaaacgauguauucucauggggcaugcuuugugaggcuggcugccaacagaaggugcccagcagccaggccauggcacacagccccuaguucuguggucucugguuggagaaaggauauuuuagaagugaccagugacccuucuaaaguuccccagggaccaggagaaacaguggccuggaugagcucugcauauuagcacuggugacccagaagugcauggacagcagacgaauuaccugagaagaccagaacggcccugguucuccuuccuucuccccacucucccucuagaaaagcuuuugcgagaugagccccagaggcaagcgcuucaugacccaugaucacuuuauguucuuggcuaugugggaagaaggucucugaagauuaagguucaggagcaccauucuccaaaguauagucacacagaugguacuugauugacaggacaaaccuggguaggacugacucuagcucccagaauccucuggguccugacccggcauaccauucagaggucauacaaagcucaguccuuugucacgaacccgaggcaagguauuuagcccagguacaggaagauguggcaucuauuuauagaccaggcaagucccuucccacagcaggugcagaguggaaagcuuaauaguaugcugccauuccuccugggcugccuuggcccagggcggccaucuggauggcugcuguccaaucuuagcaggguucugggaggaccuggggcuggguaccucuggagcuagccuuugagcuggugagagcugggucagcagcaaagugugugugugugugugugugcgugugugugcgcgcuauagacaccaggcaugacauccuggagcaugcuagacugagcugaacagucgaugccaaccccacagagcagagcauucugaucugguggacugcaaaggaaggugaagagagaggagggagagggaaggugaggaggggagaggaagaagugggagggagaugagagagaggucggggaagaagaaugguuggcuuguaaacuccagacuuuugcaauaggggggacagggucagcgagacaggcaggcacuggggagagaccacacuguguagagaggaacccuguuggcccgcacaguccugguuagccugcuucugucugggaguuccuucuuuccuuccccauucugacucuuccagaagugcccuccuuucugccggaaguauccuccuuucugccggaaguacccucuuuucugucggaaauaccuuccuuucugucggaaguauccuccuuucugccggaaguacccucuuuucugccggaaguauccuccuuucugccggaaguacccucuuuucugccggaagugcccuccuuucugucggaagugcccuuuuucaccgucucugguuucagacaacauagauauaucccaucuuccuuguuuugccucucugucccuugcccaggcuagguggacgagcuguccauagagccgaugaugugggagguuaaugagauaaagguuucccaguuccagccaagagaacagaaaggucauguuuuccaaacugcuuucagacuccaggaguccaagucucuucuuuacagaucuccagcaccccaggcaccuugcuagccuuggggauacaacagccuccaagaaagacacagucucgugccuucaugggguuuacaggcuaaccgggaaguagucauaguuagaggucaaggauuaguuagccagaccgagauaccaaucuaaggaggucagagcucccuaaaccgggggucacaugaucccauaagacacugccaaauggaacaccaggguugacaccaaguuuggcaacagugaaagguuucuaaauauucaacaaccaaaacuuugacauaaaugcguagugacucggaggccauccgggcugugcuugcccauguuggcuucugagacuacugaacauguaacgugugugcuuugcucugcguggcuguccuggcacaagccuccagcaaacccugccugaaguaccucgucucugaucugggacuugucugucaugaacugcgguguuuuuguagcucacaccaaguucucugcucaauuccugaaaacagagaccagauaguucuguccccaucacuccucagugcauagauaucauacgaguccauuuggauuguauuguauucgaauguuugcuuuuaaagauugauuuuugaguugcagauuugaguuucauuuaaaaaaaaaaaucacggcacgaauuuuggcuuacaguuaggacagagcuuccgacaaucucuaaaguggcccaaagucaaacuuuuaccacuuuauacuucauauuuauguaaacuggcauauucucaguauuaugauuauaaaauccagauaucaguuaaccgaaaaauauugaagauguucuaugcccuuugguaucaaauagccaaaauuuaauauuugguggaaagauaaacaaacucuccauuuuguuaauaugcaaauuugaucuuaucuucgauagacgauaaauuauaugaauaccaaauaaaugucuuaaaaucaauuuuuauaauugucuuuaaaucaauuccucugugguuuguuacaagucagugucugacuuaucggccaguuauacaugccuggacacuugaagaaucacaggcuaaaaagccuaaggccgcaugaauuagaugacagauacugaagcccaggacgagggagggagaagacagagccacagggcacagagcuucuggcuggcuucgaugggugugugcuuaccccucaaaggagccugugcuccucauucuaaguuuggcccacacaccccaguuccccacagucccuccacauggaaggcuucccugacuuccuuucaccugcuccgugccccaaugagccaauauugugagcacagggcccugaguuuucugagccucaggguggccugggccagggcaggagugaggucagcucugcuguaggagaguauuucacuuuggccgggccccauccggaccccaccugggauaugccacuugacuaauuggcucuuuaaauaguccuuuugcuuuguuuucuucacaacccccccccccccccccaucgugcacgccuaccauucccggcugauccaggauccaugagccccaacugaagauguuauauuagacugugugagugagcacacaucuucacggcugaggaaggcggaguaaaggcgugacuuccucaaggucaccccaaggcugacucagagucuguucuccuuccuccccaacccccgcuggcacagccuccucaccugggcaguagcaacgcaacaccccaggcugaaucagggaugcaggcacggagaucuggucaaacaggcaacuguaauuauugcuggcuucuugccaugggccugugaugagaaccuucacuccucccugcagaggagagagaugagauagaacaguucccccggggaaugcagcacacaggacgccccugcagcugcaggcuuagacgggaagggcugagggcugcuggcuacacaugcagauucccaggcccuaugacaccauuccaaaaagcccugacuucugagaugccccucuagaagacaggucugcagcugcucugaccccccccccccgccagaggccauccuuuuuugacccuccccuaggcaucuugacccugaaaguucagggugauacuagagggaggcaggacuucccaugccacauagcccauggugcaccugagaaccagccagcagggucccuaggaaggaagcagaggggacaagggggacucugagucaugcauuugggaagagguggagggaacucagauuuggaaacugucaccccaagggacagauguucuuguaggaaacugaagggaaauggagggcccccaggguguggcaggaggugguaagggggggaggcccagguaguggauggggagagagaaaaucgaagugaagcauucagaauuggaggggcucagguagagcucuuggaacugagcuggggcuugggauggacugacccuccaguucucuaccugccugcugugucauucaggguaucucgagcuaagcagacacaagaguggccccucauuggcacuucugcaccacacaugcaggcaccagccuggcagccuggccuacagagucuaagcagaccuuucucugcuccaguggagggaaaacugucuucacagacccaaggggacaagcgccagaaagcauuagaaacgcugggcucucucuaaccuacucuggccagcaggaauaccccagaacaaagagccccauguggcugcucccaggaaaucccuuucagggacuuuguucccguuagugauuaaugucucucucugucucucugugucucugucucucuccugauccccagguggagaaguccccuacuuacggcuuagccaagaagagaggcuggucacucgggguggagggaggcucugccccgggauguagaggcaggggcgcuggccucuggcucuccuggcuaaccuuggauagacccaccccagaggcucauccaccccacccccaaacaaguaaacaccuuucccugcaggggggcggagagcugugcucgauagggaggagagcgccaccuggcgcccuggcuagagaaggccgagaggcgcuccaggagcugaaccgaggccggguuaggagcugcggcaaugaguccugacuucccccacugcuucaggccagggccacagcucuccgcugcugccccaggcaagccugccagacucugucgccuauucagucccagauucuugauucucguuugcuauucuuaacccuugcuuguuccugcccuagaggaagcuccaacuucauacccauucuuugcucucaagauucccacuccccuacaauguugccuggaacccagacuuagccuggggcuaaccuuggccauaagagguagcaguuuguuuacugugaugauguccugagacuaucugugacccacagccguagacuggcccuugaagggaagguaccccccugugcuggcaaguacauuuuccucugggugugacguuuagcuuaggucaugguuuuguggugccaccgagguuugccgagaguggagagagcucaagacagaguuccaaaaucauagcgugccccaccccuguuccguuuauuuauuguguauauuuuugccugcauguaugugugugugugucuggugcucucagaggucaggagguggcacuggauccccuggaacuggaguuacagauggccuugagccaccaugugggugcugagaagcaagcccagccccugcaagaggagcagguacucuuaacugcaagagcugcugagccuugcccccagcccccagcaucugcucuuguccuugguaucugugugacuucaggaaguagcccagucccacugguagcugugauuucagaagccuuuccgccgccagcgguuccauaaaguagauucagggcucugacaaagugaugguguaggggguuggaagugauugccugagugaggcguccugcucugagcaagguccucccauggaggauguggaagaacacuggcuucaaaaggccacggacaguuaccaugugagaagaggggacaugaaaacugcaacccacagcuguuaguucaacgauggguugcugcgcgggguggugguggggacaaauugcugcggagaccgggaacaucaagaccuucuccauggcaacugccgcaggacgccucagaauccaucauuuccacggacgguucccauggcaaccacuccgccccggcuguccugaauuguuugugaugugugcaugcccgacaguucuaauugccgcuucuucugccuggugcagccagagccaauggggaggggcgggagcggggggugggugggugggggugggggagaugaugcaggggagagguggggagaggcaggggugccaucugaggucuauguccuguaaguccugagaugaagggucuugaauucaugcaccuugggcaaaugcugaggcacagagagcguugcucucucucucucucucucucucucucucucucucucucucucucucucuguguguguguguguguuggggaccagcugagagaucaccaaguggguagguguggaggagacaugggagcaaaggaagaagggaagcauacucagagaggagccagcaggccaaaccgggcacagcaugccugggaaccauugcaguuuaaagcuggugggagugguguacccguguccacacagccugacucagagcaagaucccagcugcacagcucccuccuaagcuugccagagcccacuucaaaccagacuccuggugacgucagcucacacaugcacccuuaucagcuggcagggacagaaggcaagauacccggcaaucaugccagcaagggguuugugaggggacacaagugccagcuuggugaccgacccuauuguccuggguaggagagccuggcaaggaggaacgccaccuuggaggcuuuaccacgaggucccgcuggacaccaaaauggcuuuuccccucuaaacauauugacuaugcuuugcuuccaugucagggugccgggaacuaucaggguuucuggaaaaccuggguuggacaagccugauugcuauugcauaugucauccugggcugcccucugguggacagaugcugaacugccggucuccgggaucuagucgaaggcugcauaggcuggugaagaacagaggaagucaggcuugcugaagacuuccuuucagcagggucuagagagcuggccugggcacaugcucgcaggccaggaaacaagccgaucccaccucuuagguguucuaaaacaugacugcagccggccuguaggcagcuuuugugaggggggcaaccccaaaguucuaaggcacagaggucuuaaauccaccccucucuugugugucuugauaagggaauggaggcccagagucucagaucugaguuaggucacaaggcugauaugaccuucccagaaugcaugguggucucaucuuccuucuuuccugcucuaucggguuuucuaagccuccugggaaggcuacccagugggucucuggugagcagagacaaugauguuugcuugggagagcugggcgacagcugagccauaccaagagaaagcccacuggguuccuucuggguuccuaccaaggaguuggagugugccggaguugaggcagacagggcuggcucugccuggguacuuaacgcagagacuccaggauccccuugcugcuuucacuuuuaaaaguuaauuuaacauuguguguguguguguggguggguggguguuuagcuugcaugguguuugugugugccuggugcugaaaggggccagaggaggguguucagaucuccugggacuagaguuacagucgucagcuuucgugugggugcugggaauugaacccgggcccucuggaagagcagcuagugcucuuaauugcugagccauuucucagguaacuccacgggugcuauuuuagagacagggaagauggcaauguguccaaggucacuggcgucuaaggguagagccaggaugcauaccagcccauccaguuccgguuccagcgccacgcuccuggccguucaccuaccgcaauggucucacggcuuccaucagugucccguggacacucacaagaccacacggacaacagccgcucugccuauacaguugccaggcugcuggugcagggcuacugggcugcggccugugcuacucugauucuuuucugaccugugccauuuguggacagaucgucucagguuggcuuucccagagggcggaaguaguaugagccuauucccugccuggugccuagaugacauggccaggggaccaagaguuaugggcaagccaccucccaggggagagugucugauuugggaccaagaggaugcacuggugaagccggggagaguucaagcucggccacaugcaagcaaggcacucaggggaucugcaacugcacuguccccuucccaggacguucuauuuuauugcacacacacacccccaccccaccaggcaagaccugggucguccuaugaucccguuggagcgguagucuuuaaggugacagcccauggugacaggagcacaggcuagauccugggucacaugccaugcuucuguuucuguagauggcugaguguuccaaaguugcacccucccuuucacuguggaugggagcgcugcccggcugcccguuagcguaagugaggccaagcuugagcuacgggggacccaaugaccccgugugacucugguguugauuucugggugcuuuaaaagcagcaccaagacaccccuccauccccaaaagaagggaggugagaggagcaggggaaaggaagagagaaagaaaaggaagaaugcacacuguucugaugggugccgggaagggcagcuugccuccagggauagcccugacugcacagcucccugcuagagugaagucugagagccaccacgggaggggacagcuuuguguuuccggucagagcuccauccaaagaauggccacaugcaaacaagcuuuccagguugcauaauggcccaggugaggggggugguggggcgguggcaugugguggcaucugcagcuuaccucuggguaagaccacucuggggaauagucagucaccaugaacacccguccgcucugcugcagcaugcccagggcgcccugggccgaggcggccgagaccaccucugcaacaugcauguaggccauggugcugggcccgcccucagcgcugcucagcugcaggcugcccuguugggggcugcagcagggaauacacaucuccgccugggugaagggugcccgcgccccaucuuccgacugugagagugcagcgcugucccccgacaccagcuggugcccguagaucguaccacugccccccuccacagagaugaagucauugaucaggucugagaacugauugcugaaggaaaugucaaagugguccaggcugagcuccauguuagagcuguugcccaggcugggcugggccaccggguagagucccugcaccacauugcucgggagaagggggacgccaccugcgcugcggaucaccccauuggucucuggcugcagguagugcucagagccacaggccugcagcuccccagacuugaggaggaccucauucccuucagcugccugugaggucuccaugguaaccuccccuucugccgccauggcuuggaaguuggccuggaacugcaugaggugcaaggaggaaguagacucuauccggguuuccacguggccgcugcaagagcugguuugggacgaggccuccguuuucaccgugggcaucacaaaggcggccccugacucgcuuaggcugcuguggguauucugcucaagggggaggggcuugcuggcauccugcaggaagaagcugggggaggggguuugguggauaugggggcuguggcccgucuggcugaagcuggacgcguaguccuuguuagagucuauggcacugaaguccaucugcucgaggguggugcugggacucaggccaccgcccgacggcaggaggcuagaucccgccgcggucagugugagggagcuggacgcggcagcugccgccgaggaggaguaggccgccucuuuggccaucugcugcucaaaggaggugucuucggucuugaucuccuuggugaggacgcuggugaagccaaagcuccucucugcaggcggcgagugccggauauuggugcuaaccaucucagcuuucaggcccccacccccguaugucuggcccugcuuuggauuauugaggaaacagucggggucgaaguucauggcggucucuggaaucuuccggccaccgucgagggugguggagaggaccagcucuucggacacauuggcgggcagcauggacaggcugucugagcugcccgugguggggaaggcaaacuuguggccgucagaacuuacagccaguacaaggcccugagaggcaucgggcgagaggagguggugguugggaccagcggugggggacaugguguacacggccucguuagugaccucggacauaaacacuguggcacuuugggacaguccccccaucacagaggccacugccaugcuggacacaccugugacaaccgggcugucuaccaugucugggucacuguugagcccgcugcugauggacacgggggagcucuggguagugucggggaccuccaccugguugguggaggaaaccuccgugcuguucuggugcagcagugccggcuuggccaccuugccauuccucuucucccggcucgugcuccugccguggcuggguucaugcuugcccucugacacgucguuguguuguacuuccgaguggcccccauagcccccggcccgcggcuccaccuuuggugagaugaugcgguguuuggcacuauuacacuuaugaugcacgcugcugcccgcuccuguggagaugggaacacagcacacacaugcgcgcacacacacacacacacacacacacacacacacacgcaaggucagagcugggacuuuggcuaauucuucucgcaagcaguuagaacgcauccaguuacaaagcccccauccaggcuaggcaggacaaagagcgaagucccuguacugcugugaucugcucccaggcccgaggcucugccaugcccuaugugaccaucuuaaaauguuuuaaucuugcuguuguuguguuguuuuuuucaaaaucagcaagauguggcaugugggaaacccuagcacauguguguuguguguuguguguguguggugugaguguauaugugugugauguguguacauguguguaguguaaguaugucuguguuguguguaugugugugauguguguauauguguauucauguguauaguguguguauuuguguauaaguguauguuguguguauguguauguauauguguaugcauguguauauuguguguguuguguguguguauguguaugcauuguauaguauauguguguguguguggugugaauauauugugucugugguguaaguguguguauauguguaagguauguguauguguguguguuuguggugugguaugugugugguauauaugugugugguguguaugugguguguaauugcaugcguguacgugugguguguguguaugauguguaugagugugguguguauguguuugugugugguguguaugugugguguaaguguguaugugugugguauguaaucauguguguguaugugugugugugugugugguauguguguggaauguaaucaugugagugugugugugagugcguguggcuuuucaagaaaguucucuucaccaucaaaagcagacugugcucaucuggaaggacucuuuuggacccagaacagucauccccgccauugcagcugugacuccaucccuaacccagcuucucacaccugauucuggcuguguaaugccucaagaaaccuaugaccuccaggagccuugugcuggggacaagaaggcagaggcuggcccagggagguggagagugaacccucuccaggucagcucucagacccuagggucaaagagcauucuagacucugcccuagggguguggaaguauuuauuucuauuccacuauuugugugugugugugaggagagggacgugugugccaugguacuggaagucagaggacaagauacaggaguuggguccuuucauguaaauuacaaacucggcuuaucuggcuugauugcaagcucuuucaccuacugagccaucuugcugucccaauaaggagauuucugagaugacccucuccaccauucaguuaggccagggucuguccguaacucuuuggcccuucaugucuuugaggauccauuccauuccaucagaucagggucauccuguucuugauaacuaguuaugaaggaagggggaggggacccgauucccgccgaauaaucucugguccaguagaaaggugcacggguguggcuccgcagguuccagcagugggcauggcagaacgaaugagcaggaagcuccaccccgagcaagcagguuucaggcugggggaggggagacuacaucuccucccuuuuauuaacaaaauuuaaaaaaagaaaaagcuggccugaggggggaaaaauuaucuacgcucaauaguucugccuggaaucuagggcuaaagaaaaaacuugcuucacugggauucuuuaacuuuucuuaugguaaacuguaucuggcuuaagacuguccuuucuuaucuuagugaacaacuaacugaaaagccuggagcuguaggcucugacuuuauaaugcuaauuaguacuugguagguaacuuucuaguugaauuuuaaguagggcguuggaacucuggcuaaguuugacugaacgaugugaaaauaacacuaaguugauacuccuccgcauuuuuggaagauaggugggaaacagggagaaggcguucgaccggcucuuuuauuugggugggaggcagugaagggcuugcccuuucaauaguacgucucuaauggugaauucuuccacagaacacugacucagcugauugauggaagcaucuaaugaaggcaggcaggggaguggagagccguaucucacaaaucaaaugccacggucagaaaggcagaggcgguaccguggagugagagauaccgucccuccuuggaacagaacggcuaaaggcagguauagcuugaauggucccacugucucaggacagaugcugagaagccuccugcugaggcgucccaagaacacacuccccacaggcaccuacaguaaaguguguggaggccccgaaccccaaacaucuguaccuuucuagugcaucugugagcugcuccuguaaccucagccucacuggagacggccccucucuuauccaaagcugauucugggggcaggaucagggcgaagggccuacugggugccucucucaguugcuguuauauaaacugguuccuugucccuucccuuucuggauaggaugggagggugcccuguacccuaccugcucuuuaggauccucaacucaggccucuucauucaugugacaggauagauaacucaguuucaucuguccccagagccuccacucaauccuucccucccuggguugaauagcagcgccucgcccuccccuaaugccuaguaccaccuggccucugaagaucucaccccuucccucacuggacaggacaucagagccugccacccagugcccagugcugcaugccccucggggccccagcucacccaggcugccggugcagaggcaguuguggguccggggcuggggcuuggucugguggcugucgaggaucuguugcaccagcugcuccacggagaagccugagcugcuguuuccauugcugcagguccauuugauaccauggacugcagggagagagagagagagagagagagagagagagagagagagagagagagagaagucaggggcugcuagugaugggucuguccuggcagggagugcuaucaggcccuuugaaagcucagcccccuggaaggcugguucuaagauugauuugggaggcccagcgagccaccagagucugcuccauuaggagcucugagaucuugggcuuuccuccuuuucugaacuggggaauaguucgccuacagcaguggcucucaaccuuccuaaggcugccacccuuucauacaguuucucagguuguggugaccccuaaccauaaaauuauuuuuauugcuacuucauaacugucauucguaauauaugaaucugauuugcaggauaucugauacucgacccuugugaaagguuguuugaccccccccccccaccucaaaagggauugcgaccuacagguugagauccgcuagccuagagucucacuuuuguuuuuccaaagucaaagucacugagauagcucuuuaggggguucccgagaggaagaagaaagcaaggauggugaggaagccaggguuaggggugcugucaugugccuguagacuguaaggcuuugcggccucacaggaugaagugggagcauucagcaaacaggaccacuccaggagcaucuguggagggggcucuguccaaagggagacuucagcuuccuacucuccccacauuucucuacuccgaagggaauuguaagagaagcuggacggggaacaagaaugauaggccccuagcccagaguguagaugacuccaauccgguucuaaucaguagucuuuacagcugcccggggguuugacagccccuggcugucugcagucccuggaguugggauaaaaagcccagaacgagagagaaggagagauuuccacuugccuaccaggacaggcgggggggaaaagguagguagguggguaucaagcacagagauaccugcaggggcuccaggaugcagccauggggacacaucuaaucugcaaggcuggaagaagcugggcuagccucacaccuggcuuugaggccaagguggaaucugagguggccgugacaggagcaaagguccacguugggaaggaagcucaguccuccaaacccgguacagaccccaccucaagcggcauuuuguugucacuauggugggguuucagggggaaagagcggggucuguggcuggcaaugucucuccaggcugguuuccuuuuggacuucucuuacccaccggccaggugauugcucaacuuccuugcccucuagcccucggagggucuucagggauuugccucuguuagcuucugaugugccuagugaguuccagcuucugguugguggcgucugcugcuggucugccaaucuguguagcuuuggagguguuccugcucauacugagccuuaugggguggaccugugcagcgagaugauggugccugugguccauucuucugcaggggaaagggggcucuguucuugggcucccucuguuguguguguguuccagugggaaugggaauccccacagauccgggaggccuugcuaauuaaaccaauuuagguuuauucucucugaacgucgugucuccaggauacuuguaagagcuggaaagccuggccugggcgaaggguugcugugcaucaccacagccguggaaucuucuccucaaauuaugcucugucuccagucccagcgaacagaguggacagcagcgggggccaggccacuuaccucuccagauucauucauuucacggaugagaagacaggcucagcgaggggagaugauguaucauaugcaggagagggagaguaccauggagacgcgcccuucugcuccccaaaucugcaacagcagaucccagcuguguguuuccuccacugcaccaagaguuugacauuguggggcugaaguguuucaagguauguuuuaaagcucccacaguguguguguguguguguguguguguguguguccacguguguuuuuuaaugccaccaagauggagcacauacauagcucugacuugacccuaauccagcaaggaauucaaguccuagaaugagggccuuguguuguuagaacauccaguauggaaaccuuaagcagacaccaguuggggagucccccgcucacgugaauuugauuuucuagagggauaaguguucucagggcaaccccaacgcuggcugcuacccgugucagugucaguccuagauggggcuuuggguugggugggccggcgccaucuucccgaguuucugaccauuccccaccaucccguuucuucuccagcccuggcugccacagaccccauucacucucugccucuugccuucuuguguaugucguggaaguacaaaacgaaacccggcgaagggugacagauugcaagcagagaauuucuggacgcuuaaugcaaauuaccuagugucuugguacauccaauauguagaucaucucccuccuccaucuggggaaggggggggagccuccuccuucaggguggggagcuguuaguacugaauaucaaauacuaucaagacggcuuuuaacaugucaugcuuggcuucccgacacguaaugaaucagcgggaaaggagauuucuacaggggaagaaaaaaaugugcuuugaaaagaagguuuauaaaugcacaggguaccugccacucgccaucccugccugggccacgcccuccuuaugagagcagaaaagaggucucaggaagagcccuugaucaaaugcaaggccacaaugggucacagagacaaaaaaggaauagacaggaaaauaacggguccccuccuggucauuuuuuucccccggaacaauuugccuccgggcacagagggacaaaucucaggcaguggcaccccagaggcaccacuucuucaggcccccauacauggagccuaggugguaguuucuggacugguuaaggggaggaagggagccuguguccccaggaaggcagggacagggaaugucccagagagggagugaagcagggguggaguuggcacauugcccuccuaccagccuuuccacaauaggagcagcagggaagaccacagagacaccaggaagcagaugcugggcucuuaaagaacuccaucuugguccuuccugcugagcccucccgagauccugggcugccugcugcgaggcagagccacaacuggggacaacugucagagaaaccaaucaccuuacacuagugcugaucugacugaugaagguguccucaccggaaccgugacaaggcagcuucuaccgcugugacuagcugaagccagggccagcacauggcugugcucagagauggagaccaccuuccugagagacagccggcugccaugaggagacugauuaagacagcgaggagggggcugggugaagguggaaggcuugaacuugacaugggcaacugccagcuaagggcauccugguuauggcaagcagcccugucccugggucuccagaggaagaggagagcaugggccuaagccccuccccuccccucaugaugguagucccucaaagcuacacaugccacacccccaacaagucucuaaggaagucauuaaugguugcaguaggcagacauagcggaagugcuucagagagaagccacaugagguuagagcucugcacagagagacugcacaaggcagaaaccaaccucaaagucgcccuggccucgucauuccagucuccagaacuggaaaccaccacuguccacggugcacacaccccagccagcggugcuucaccgcaguggugccuguggucuucuuucugcugcaaucccugaacaccacgggccagggcagggguuaugacgggcacaguucuggaggguggaaggccaaguucaggugcaggaguguggggguagcuggggcagcauggaggagcugggggagcagggagcgggaggaacuguggaguaaggggaguagugaggagguagaggaggagggggaggagggggaggagggaagagguuggggaggagggaggagcugggagaggagggggaugagggggaaguggaggaauugagaugacaaggaggauaccuggcagguagguacucuuggaaccccuccuguccagccccagaaagcagagggaggggagagaagguucacauuagggcugcaggaggccuaagggcucagauccugcccuagcccagauacuaggagguguagccuggccucugucucagcaggccagagccagcauaggaaaguguguggaggagaucuguauacaggaugggcuugcagacuggcuuuaccggggauuuggagguggagcuaagaccucuguggcccaggugagacccucgucuggcacuccugccucugaggugagcuaauggcguauacaugucagcagauguucauucugaccucauggccgcacguguugaaggcugagaggacuggaagcccgaagcaggcgggugacuuucagccaccauggccucugcagcggccucaggguggcugcagcuccucgcuuguguuuccuggaaguuuuuccgccucaguucccucaucuauaacaaagcugucaccaugcuuccucuggcuccacgccaucucccaggaacuuuaaggacacagugguaagggggacucaaguguggugguggagggacacagugacuucacaccaggagaacagacccugggaagaaacaggauaaagggaaggaagcaggggccaucagcccuggugucuccucugauuucagaaagaugacaagugugucagagcuuuaacugccacagcaacggcacaggugcaccagugagaaaccacacugacccuuccccaaagaagagaugcuuggcgcuguggcaacuaagagacaagugugaguaucugugugucagugucugugugacacugucugugugucagugucugugugucaguguuucugugacagugucucucuguggcagugucucugacagugucucugugguagucucucucugugucagugucucugacagugucucugugguagucucucucuguggcagugucucugacagugucucugugguagucucucucuguggcagugucuguguggcagugucucugucucagcgucucucagugucugugucucucagugucugugugucaaugucugugugucagugucucugucacagugucucucuguggcagugucugucucugugucagugucucugugucagugucucugugguagucucucucuguggcagugucuguguggcacugucucuguguggcacugucucugugucagugucucugugguagucucucucuguguuagugccugucuguuagugucugugugucagugucucuaucucagugucucuguggcacugucucuguguggcagugucucugugucagugucucugugguagucucucucugugucagugucucugacagugucucugugguagucucucucuguguuagugucugugugucagugucucuaucucagugucucugugucagugucucugugguagucucucucuguguuagugucugugugacagugucucucucucagugucucuguggcacagugucucugucccaggguuugcuggaucacccuuucccuucguccucauugcacauccacccagaaucugccacacaagagugacccacgcaaggauggccauuuguuuaacuuguccaaaccagguuacccuugacccagagacacucccuggccagcuuggucauuggggucacccuacuugugagccaugugacauagucagcuggagagagagcccauuucugugccuagcugccagugaaugagagcccuuuuggaauucuucggaauuguuguugcucaaaggcugucaccauagcaacaaggucaauaggaaauggcagccgugaguagguuucauccucacuguauccuuguugacaggaauaaaggcccugcuucugauuucuugguucaacuagaugaaguuuucauuagauuuaacuucucauauccagacacccacaugcuagucagcuccccaucuccgcucucauuuggaggcgcaccaucggggcugaggguuaggcguggcgugcauacuggcugugugcaaggauccucugcgugcagcaucuccaaggagccugguugcuguguugggacucagcaugcuagaagccccuuucuacugggagaccuagacuucaugcucagucacacccaccucuggagaaagccagaagcugagguuuggugucagcuguggaguggggaacucacccuggccauauuguuucagaggagagggacacuggaugugaggggccgggaugccuaaaucagggaaucuagaccacauggugauaguguagccuuggcuuggaaaaaccguaaagguggacggacaugcuagaaacuguccuuggcugagagcuuagccucuucucccugggauggugacucuucacaaugguagugaaugugccagaaacccugacuugcuggcaaugcuggaagaucaguguggcagcgagaggaguugcuucuggugucgguuucaaaccuggagucccuaguccuucccgcuacuugagggaagagccagucaacggggaaacauguagucguaaauaguuggguacccaguccuacagggccacuugaaauuagggacauuucauauggcuggcuucccuuaggggaaacucccuucuaacucuccacuaugugguccagagaucuugauucuuacagagacauaaaaccuagggagauggagugccacacuucacuagagcgucuccucuuuagcgagcugaucucugaguuagaaucagacccuugacucucaggcuuagggcaggucugagaauaagccacaaagguugguugggcuggugaauggggaggagaaagccaaaggagacuucuggaacagccuacggguacaagugcccaaggagccucaaagaacaagcagcgagggacaggcaggaaaucagaagcauguucuuucugggggacacauccgcucaauagaaucuagccugaaggaaaaaaaagaacauuugcaaaacaaaccaaggucccacgggcaggggugggaggugucugccaaaggcacccaccucugugccaggcuggaagauggccaaggugcagcaggaugaggucugcagccaggaguguggcagagcagagcagggcucagccaaucugaggcuccaggacaguagcuccuuucccagggacagcagagggcacagggaauccucugcaggccuuugggggucuaucuuuguuuucccagacucucagguccugcagugacugcaggacacaagacuucucucccuaaggacagagcugcuauucuuggccccagggacaaagguauagguaugguccauacucaggacuuuucuugaguuacagucaacaaguguucagcaaggacaccccccccccccccccccgugucagccaggccuugguggcacaggccugaaauccaagcaacccagaaggcugagaugggaggagcauaaguucaaauccaguccgggaaacuuagcaagauccuaucucaaaauggaaaauagaaaaagggcuuagcacuguggcuuagugguagcacuugcccagcaugcgugaggcucuggguuugaaccccagccucauggcuuccaagagaucacacugugugcuggcaccaagacucaaacuacaaauccagaaaauauuaaggguuguaguucuuaauuaggagccuagggagacaucucaguucuggaacacccagaaacuaggucucccaucuccgggacauuucccucuggaaguucccugauaaaucuccgaccgugccucccugccaucccaagaaguccaagggugagggugcuagcucagcuuuccaagcaagagcccuggguuugccucuuucuggugucugccucaggcuagaguuucuaggaaauacaagccuggagagucuagcaugagaacgguuuguaaaacacccagaguccccuggcuggcuuccacccuagacaucagaacaaaguuggacagggcccccaaagccugcuuuuccuagaccugcccagguacuucagaaaugaaaugguuccugccgcuggcugcucugugcucggggcucaccugcgcugcagugauccgaaaaagaaggugcucugaaccccagacaccaaggugugagccugggcgccaaagcucacaccugacuuagagucugucacuccuaccccagagcucuuccuccacugcagggacacuggaugaagccucccuagcagcagucaacccaaggcuggucucugacacucugcuccucucauggccacaucugcaguccgugggcaguugcuuugucacucugaggccagccaccccacuccacaggcugugcucagauaauucccgcaggagugcuaggcacauccuggaagcgugcuacuaugacuggccaccagguggcgcuaaaugaccaggaacuggucuagaaggcgcagggaaggcgcacccuuguugauuuuaugucuugauacuccauaaucaccaggauuacaaucuaagcaaaaaagcaagacaaauaaacaccugccccaugaagaguuugucuucguuugaaaaaaaucacgagaaaacaugauacuuugaacguacccccuaaggcucaggugagcaccagugagccucuugggacagaugggaaguugcuguggggacuggguggggaguucccaggaaaggcaggugcuaucacguacugcccugucucuucuuugccucugaagcuucaguuucacacuguggggucccugucugcagucucccuagccuaugcuggcugcccugggacuggaaaagacccuugcugagugugcggagaggggccaagacauggcuucuaaaaccauuuccaguaaagacagaagagucaaggcaucugaggacugcuaggaucuagaagagcacccuuagccucucgcucaccacggccaccaccccgugcuuacagcggccuuuacccuacagccaacauggcucuaucccacaugcacuaugaccuucagcccacacucaccagggccucuccuaugauuucccuuccccauacucaacauggcuucaaucucuucauucucacauggucuccagcucugaccccuacucaacaagguuuccacacugacgccuaccauggccucuacccagcauucaacacaauaucucuucccucaaguucaacauggccuccaccccggacucaacacagaugacucccgcuucccaugcucaacauggcuucuucucuucucucacacuaacauucagcccacucuccauccccaccgucaccugggccucuaaccccaaacucagcaugguccccaucgcuucagaguccugaaggccugcagcccugcaggccacaguccugacacugacacaccauuucuacucacaucgccucugcuuccuucucuauguuccgcacacugccugggaugcccuguagccuuccgccacaccauccuccgggcugguggccuggggccccuacagcauggcuauccuugagacagcccugugaugccuucucagcaggcccccuuugauuggguuccccgagggauggccugggcuuccuccugucuggcaucuucccaaagcacagagcucaguggucccacucuggcuggaggaagacaggagauguccagguagcccuugggugcccuugcugggcacacagggguugugagauaagggcuuggccuccagagggcgcuguucuggccuuugggcagguuuuuccuccuaacuacagccacuacaugggucauuugacaucuaugaugucauuucagggccacacagacaacauugucacccguuccaggaaagaggacauggccacucagaaagcucagguguacuggccaagucugggagagggggugcuaccuucacacaucucagagaugccaaguuuacauccagccucugaccucugcuggaaauccuuuuacacagcauccccuugcuggcacugucacccaaaucauggagccauggagccauggagccacggagccacuucucauguguacguccuagucuggcagguuaccaacaugcccuuggccuugacucgucauagacaaggggucuggguugcuuuggagaaaguuucagaagucauagggucaggaaaccaaaccuuccccauucugagcucuuguguguguccuggucuauggguguccaagauggcgagggugcugugugcauguggguauuuauaugugcaagugugcaugacauugugggacaaugcaggagcagugggggaaugagguggcugcugucccaggcccaggaucucuuuccaggcaacuuuccgacuuggcccucauuuuguagcugaagacaccugccauaggcaucuauggaccuagagugacauggugggguucccagaagacaguugggcugagcuggcugaaggcuggagccuucugagggugguggaggccugcugaaacucaggucuugcuuguucuucagggccaucuggccauccagggugcuccaaauaaagcccuaagguggggacagcugggcaggauugugcucagggaagggcuaggaacagcuuaaaagccuugaugcaucagucuggcugcuagcugggaagaggcugggguacucuuuccuaaugggcagccaggaaaugggauaaggcagaaagccaugggugcccuaugggaaccaguuuuaucuagcucuccguugggucacagaagcugagagugcccgauuugggccaugguggugguggcuuugagccacugaacaaauuucccagcaagcuagaaggaccaagagccagagccuugcuugccgaccagccguccacucgaaagcaucccucugcagcuggccugggaggagaaacuuugcucuuauuagugaagcuugcugggagcuaagcugagucucggggacagcuguaggagagcagguuccaggacuuccaggaugugacaggcuguaugcaaaugaaguccaucucucccaccccagacagaacuccaggcagucaugcccagacauuggccugagaggagcaguuggccauacuguaagccagcaaagacgaagcucacaggguccucgugcacacugcaccgggggagaaagucauuucucaaaacgugccuagcaaaacgcuguagugccucagaguccuccccaagugggggugagccugggacaacauguugcucagcggcacaugaguagaaaugauguguuauuuuguggcucugcccuuaaagggaagaggcuugcucuccaguuuucuccuuucauuggccagcauacaguugugaugggcaagggcuggaguggccaucuuuaaccuguagaaagugaacagcauccugaaaauggcagagcaccggcagggaggagccugaggggcuggcuucagauacaggggacgggcaucucaauucuggacuuuggaaagacguaaagguggaagccaaauguauuucuuuuuugacuuaagccacuguuauuuggccaggagggguuacaaaagucagggaggcucuugggaaaccuguugggaauccagucagacaucuuaauuuucccucuguguuugcucuuuccaggagugcuccugagacuacgggugaagggaaggcccuuuuguccaaagaaucagggagccccucuccugcuucgagacaggugagacagagacugaguguggacagaggccugauaccgaucagugucauguuccgauuaagccacugacaacucugaugggcagagagaucgggaaacaucagggcaucaaacagggaagccuuugaaggagugugauuuaugaagcuaaugcgcuuggcuccagccuucauacuaugcuggauucuggaacccgucugauggcuucuuggcucucagcaaacagugcuuuccccgaauacugcuggcuggcaccugugugcuauggaagcccaaccagcagcuaggcacuuagaggggcuguguuuccaagugcugguccccaggcagggcugccugcacagcagaggccagggcaggcauacaccaaccgucgagugauccaaccacuugaucuccuuguaguuuuuaugucaacuuccuugaugcacagcaggcucugaacaagcauucauuccuccccgucccccaguuaaaccucagaagccaaacuaagucuuuguccccggaguuugggagccugagacucuugccuagccuggagguggcacccuugugcaagggucaggagacaggacacugauggcuuuggguagaaacugucugugugcauuuaacgaggaagccauaggcagggcauagggguuggcuuggcagacauggcuuucccuguagcaugucccugguguccuucuggcacagacagucucuggcacuugugucaggacccagucaucugcuccugguggccuggguagagccuuucaucugcaaacaggcucuaauuugccaauggcaggcagcaggaugaauuccuugccgugacccagaagacaaauaugaccguuccagaggggggaagcuaaugugcucccuucuaccuggagauggguuuuggagccaaacaauaccuagacagaauacugaggguguggaccaggggcagaagcccuuggacucuucccacuuuuccaaguaaagaguccucccuacggccuuuaauuuggaagugguaacuaaguaccagcaagaaggcaggggacacagacaucacaggugucaggggcgugacugaccaccugaccagagggcugaggcugagcccaaggaucagugucugccucugucuccgaccuuauauaaccugcuggcuggcgaugagacagaagacagaguuucuggaugcuaaugcacugccuucucagauugcuagauuucuggagagagcgagauguuaaucccagccucugcucauuggcuucugugagugacaaguagcaagaacugaauuccaguuucacgguggccauaaaaccagcacaacgguuaguguccugagccugagcucuggcucuguuuacucuuaaaccagguggcauuagaguguguucuggguagagucccugcugaggcuaaucagaggcauaagaaaggacaaaugggccccggggggugggggggaggcccaugagaggaugaguaggaccccugucugugcuugggggcaucucuugaggucaccuggguccugaauuagaagcagaaaaccuaagaacuaggaccugggaugggaaggcacaucuggacaucuuuaugucccagagccuggaugcuggaggcugugauccgcuguccaggguccugcagacacugcacaaaagccagcgcagucacuuugugcucacaccccauaccacuccaagcaguaacugcaugucagggcuucccgugucuccuugcucuguggaguuaggcgaaggcugugagguuccugugcaugaugcugaugggcuuguuuaugucuggcggucccuggaguagagcuuugaggcgacuagggggcuuuggagccuaugagcuaagccaaggggagggguuguguauagacugaguccaggcaccaaagugaggagaaagaaaugaagagaggagaggccagaucgaggaacccaaggcaugauggccacaaagccucaggaugggugcagagguggaggcauugccugccacuggcagaaaggggcguugcaccagaggcuucaggccaguacagacacaguugggguuucagucgaggaugaauccugaacgccgaaggccccugggccaccugcagcaccagagacagcaccugcagcucgggaggacaacccaggagaugcucuguccugaggccgagccccagggcggaucuuuugggucuucauccaauacauguugucccuaguaacccccucuagaguuuaugcugaugacauacuaggaucugggcauguagugaccuucagaagaagugggucauggcagcucccccuagcuucagcuuguaucccauaggcaaggauacuguagcuucccucuggccagcucagaaugguccugcuccugagcgaccuacggguccgcucuacuagguccugauggugucugagaagacaaccagcaugcucaugugcuguggggcucuggcaagcacugggaagccucgugguuuucucagucugggugagccagccuagcugguaggggcaggaaggauggugguaccugcagcaacaaggguccuuggcucccuggagccuuggccaucugucuuggugacucgcaccugacagaugcugcagaaagcuccacuuugccgaugaaauggacucaacucaauuacggaaagcccuuugucacccaggcugagcacuguggcagcccagggccagcagcccgcugccgugucugggguuagcacaggcagucauucuuccuguuccuugccuggucccaucuccucagucuuucagccugcuccuacauguggggucacaugccugaugaguucuuucucuaccccacuuaugcugucugcaugucugagccucaccuccuccaucugucguacgagucugaggaaugcaggucggugguggguaugugugaguggaggucauaggauaacuugggauggcagaccucagaaauuuccccgccuuuguguuugagguagggucucucauuggccuggagcuacaucaagggggcuaggcuagcuguuuggagagcuuucuggggcccuugacuccaccuugaaucucaccaccuccacuguguccggcugguuacauaaauccccagggauucaaguucagguccugaugaguuuggguccucacaaagcuguacucuaccgaccuaccucacccugggucuggggaguuugugccuugguuacgguuuagaagcuuaagugaccacaggcaucggaggggaugucauuaaggcuaaauucacagugucaccgugccugagagaaauggggauccgugcggaguccccaaggcgcaccugggcggugcuggcugagggcacagggagguacucacacaugggcuucagcugcccgaugaguuccuccuucguccacuuagcccacuccuucuugucgguguugauggagcagaggaugggcccacagggcuugccgcaguccucaauggccggcacauucagguagugcaccaggacgaugucgggguucuguggggagagcagagacuggcaacaugaggucacagcagguggacaucauccccacacugccucaguggcccuagcucuaugcuggauccaggugauagcauuugagaccaugcuaggcacuguaggaugccagcgccuuccugggccuguagccaccaugggccguuaggcuccugccuucacugggacaaugacaaugggaaaggcuucuggcuuuauccagggcccucagaggcaaaucccccgaugcaaaccacagauauacauacacaguggcugacaagcuugaagucaaggaccuuaauugcaaaauggaacuuuguguccugugagcuuaagaccucucauuucucaccccugcugcuuaaggaacauauccuggucacagucacugaagucacugauaugggcucucaagagaaaaguagcuaccaggguuucccacccacuucuccaguaccagccucugcuugcagccuggcaccuucccuggcauaaacagccacagcacaugucacagugccucacccagcagacagcugucaccaggaaccucagacagcuucuuccagucugcuuuagagcuuaagaaugggaaggcuguuagcccaaaggcaucaaggacauuuguuuccagaugaaauggcuagccuuuccuccuccagauucaauccaggugcacagccaccacauucugccaccaguagcucugauggcgacacccuagggcuucugacaguuuuguugcaaugauuccccaagccuuuggguggucuccccaauucuugaaguuuacucagucacaccaugcccgacaaagaacaacaaccacggcgaccgcgagucaggcauggguuugcauaucuaugucgguacugggaggugaagggcaggagcaaguucaaggucauauauacagccgucuauauagcaaguucaaggccagccugggcuauauaaaaccaugucacaagcaagcaaacaagcaaacaaaccaacaguagccaucugaccaucacacaucacacaucuucacgaauguucccgggaaaacuugcuuagcccucuguccugaccagaaaguauuuccuaagucacucucuuucagcuuucuaaggaauuaucaaaacacugaagaaaacuccggaaaggccacaugguagguaggcccucacuguauuugcucugcuggcuagcauccccaguuugccccaaacuugagcccugggaguggacaagcuccccggcagagggagguugaaucugagguugcuguuuugguuacagucagggccagaguaauaaaugaaaauaugaaucaaucugcccauuaauaaauaaagacucaagacuauaccaugaccagaguaagaaagcaaacuggcauaauuuaaaaagauuuccaauaaggguugaaaugugggcuuuuuuuuuuuccucuugccaacgcucaguuaaccaggaaauuaaaucaacaugaacaggaggcuucucguuaauggcagcuuuucuggauuguggaaaugaugcuccuuaauaauaagauaaucccugccacugugggccgaccuggucuuuuuugaguauuuucacacuauuauuucauuugguguccacgagagccagggaggcaggcaggccagggcagggcucccucccucuggagagggagacucugugaguugcuugcccagagcucuguuccuggcgagagacccgccugggcuggaugccagggcucugacuucagauucacguccugccaagacagcugguggccgcuuuccgcucugcccgacugcuucccuacucuucauuucccuuuauucuugcaauaugcccgacaggugggugggcuguguggaucugccacgcccaccaaauggaagggauguagaugacugacucucagacucguagcccugaguucugcucucccugaagccaggauuugacugaagguucuugcuggguccugggccuggucuggcagcuggaccugcugcugagcaugaagagaaaagauaagagccuggaucaaaaggcagcagggaccagcaggccaccuggggcuuccucugaucccaucccuggagggagcguggcccugcaggagggagcuggaaugcccaaugccugggagaugaaaagcuguggcuucccuccguccccacagccucaccgagccgaggcagccugugcaggacccacgggagauacaggcuugugaaaccuguggacccaaaccugcagcuugacgcuccugcaugguacuggaugguuucucgagauucgccugcuauccucuguacagccagcguccaccuguugucacucacgacauguaugggagacccucuuucucaagaaggacuuuccugguuucucaacucuguuuuccaaggcauggugauuugauggacugauaacugaucaaucgauuggauggcuucaugucugaauguggaucucuucaggacaaggcccugggauauuauaaugcccuagcaauaaugcagucacuuuaaguuuguaggaaugaaaacaggucaaauuaugacucugacucuuccccuugaaguuugaggucugcugacaucaggguccacaaggggcagggaggguuuuugaauguggacacugacaaguaaagcuaauuuucuaucuuucuaucuaucuaucuaucuaucuaucuaucuaucuaucuaucuaucuaucugucaucuaucaauuuaucugucaucuaucaauuuaucugucaucuaucaguauaucuauuaucuaucauucuauuaucuaucuaucuaucuaucuaucuaucuaucuaucuaucuaccaucccucuaucuugcaucucacacuauagcccagguuggcucacuauauagacuguauuggccccagagucacagcauccuuuuugccucaaccuccuaagggcugaaucacaggcaggagucacuguauccaccaccaggucuggcuuucccuucugagcuguauccacacucuacuucauaaggucccagaaccaggagcggcuggacucucaucauuuaccaccgacuugaggguucuagaucagcucccugacaggagcacaugccugccacaggggcuugucagccugccuuucugcacugcuuugaugaaguaacaggaagcccagccccugcuguccaaggagucuggcuuggguuuggaagagggagaggcaggcaaggcucggucccagacuccacccaugggagccaguacuggggauccuuaggacagugucauauuccuacuucccagcucgggucaacuuaaagcccagaauauuugcaguguuuuuaaaaugugggcgcacacaucucuuccuggcaacaucgugguuuugcucauuagccauaggcuuuauggggugcucuuggcagaacaauguauuggguuugguguuccaacacaucgauuucauggacugcucaccucaauaucacagcaacccacugcucuccccaguggugauguggcuggggcugagggacaguucugggauuuauuucugugaagccagaggcuguucuuugaaguggacaugacuuugaagcugagccccaaaugugcuagcguucuggugggggcuuuaaaugucagcaugggagggucccugcgggcuggcuuggaacgaugguggcaaggccaaggucgaggcagcgugagggguucccuagucuucuggaaggagccacaggcuggagcuuccuuucucgccucuugguacucauggcaucucaacuacaacuggaagcaggacucaucucucacccuagagcauccuggugggaaccuugccaggucucuggaagauaccaagcacuguauggauggcccaaagcccuggguauucucaguggccaccaaaacccaaacaagcccacacaaagccugaaguccuuccugagaaaaugagcagugucacaguuuagcauacaggucgccuguggggacaucccugauuccacuggcagcccacaccugcccccauuuucacaggucacagacucuuugcgguggguggggguacagcacugugucuuuagcucucucuucccucccuauugaccuuauuuugccaccaacuugaagcucccaagugucccuaggccccucuccagccugacgcugcucacugcagcccauuugccuguuaagccugcaagccggcccucuuaugcacagccucggagauacuccuggcucuguguugugcggccaagcacagcugccacaccuggcucugcccaggcuacacucaaugaaggacagcgccgcucugcccuccccucaucugaaagagcagcuacccuugccucaguacucccacugcauaacugucaacucugccagcuuuccuuaaagccagccggacccuuccucucagcccaagugccuggaguccaaaccuccuaauggugcggguguuggagggaagcccuucucuugggucuccucucuuccucucuuccucguuccucaaaccauucuucucacccgagcaggugugauccaauaacaucaugauggcucucugggccugaggauggacgauguacauacucuuccggugcugcggcaagcauauuucucuccagcgaccucuugucucacacuccccaaaacgcugcucauccccccauucgccuauguaccccguaccucaacaaagcccuaaucuucagagcacucggcccuagauaggaugucuuuguccagccccuccccucgaggcucagggauuacauggaagagaaggcgggaggaucgaaagaguuggagguagagggugaccaugagacaacuucauccagaagcugggaugguacacuuaugaacccacaaguucaaaccagacaaaaucuuagcaugaagaagugggagugggugcagggccucaccccuaccuaagcaagaaguuaugugcaauugacaaauaccaggaaaggcaaaagcuaaagcaagcaggucccggaggaggaggcccgacacccacucccagagcugcugccucccuccgcugccugacuccccgagccccuugucacguaugccugauuccccagauggagcccacccagcagaugcugucugccuucuggauugguugaucuccaugacccccucuuccgcaggccucucauggcccuugcuguggccagagcugccccuccucuuauuuagaaagcugacagacgggggcugugugggcuaaggggggggggaucggagaaaauggaaauaaaacugcuuugaacaaagaaguguccacagauccacccucuuggaacuguguggugcccacggccaaugccaacagugcaaggggguggcaggugcucaccggcaacucuugugacucguguuaacaugaagaagcugugccaauaccucuagcuauguaugcccugucaugacugcagcuggcuaggggcaucuguccagggagcuggaagggacuggccgacuuguuucuuucuuuguuagauccucgacagguugggaaaugccagacgcccuugcaaaggccuagcaagggaggucuagacucagucagcucauagcaaaaccuuggccuggagagauggaccucaggccaggcuuguggaaaggugucacagagugaaagagcaaaggagaggagaggggcacucaagcugggggacagccauggguugagcagauacuugaaggggcgccaaacuucuuagcccuuugagggcccucaguuacccaugaagugaguaccuacaaccagccuucucuguuucugagagaggaagggcagaguucagaggcugccacgucacugaucuccccagagaucagaacagggagaccaggucaacagccuucaccacaccaggaaggagagaaacggucuccucgcugccaccggcucucacaccgaaggccugggccacagcuuaucagaagugugcagugcucagucacagguaaccauggagcuaagaaggaguugcgauuuguguggagccuccacgcugggcucacccagggugucugacagguccugugucaauuaugggugugggagugagcuaguccucagagaccaagagacucaaguugccaagagcaagaggcaugggucccccauuuggccacuuccauuaugaacugggugccuuguaggaucucacucccugugcacaucucuccugccucugugggaaaggagagucagagccagcacccuuuguguagagcaagagagacagcgguauuauaagaagcgguuaaaaaugcaaaacgcgguugguuuugauaaagaaaaaugcagcugcaacaucuguuugacucuuguuugcagcuucaucaacgcuaaguggucaauaaaucagaguggcguggcgcuccgcuccuucugaggcucggucauuaaucucaugccaguucucaugaaaaaugaaggagagaggguugcgugguagugaaaauguauacauuacccagaaagucauaauagcauguaauagugcaauguauacauuacccagaaggucauaauagccugugauagagccgcacaccuccaaagucauaacagccugggauagcgcugcacaccucccugcuugcaguggggggcuggaggggagaacccgagaggcagaggcugcggggaggggauggagcgaguaaaucagcaucguuugugccaagagccuguucugcgaucacaucugucauauuagcgccauuuaugcagagcuagacgaccccgugcgcccgaucugaagaggcgcagcuuucuggaccugugugcuuaauaaacaaccaggacgggagcccguaaaacgagaguguggaguuggcagaaggaaggacaagauuuacuagggaauggauaagugacugcggcaggcggcucggggcuggggugucacccggauguaugguagacggaagcucuugcuguagcugcuccuggcagccggcuggcuguccucccugcuuggaguaauggaauggaggagggaggggcugauggauaccaacaaaaagcaagcugucucucagagcaaccagcagggugcuccagcccccaugucccccacagaggccugcucacuucaggacagauuucagcagaccacagggacagaagaaacuccuagaacuccauccacauucugaggagggccagggacauagcacuuguugcuuagguucccccagggucugccaguugcuggaagacacaggcuucccugucgcagaccagaagggauccucuuaugcuguaguacauauaauuggcacauucuauggcccucucuggguagcugcuggguauaggacuauccugugggcuccccccauagauagagaagccucuguuuucagagacggcuucugaagacagcucugugccagccuuaucuucaagccucagggugccugguuuuuagucccucuaagcaccaaagugcugagugacugcuaucccacgcacagggcagagagugugucugaggauggagauucccagcccgccccagauaaaugcuccauuuccucuccuucacucugcuagggcuccuggagacucaacggauggugagugaggaggcugugcuccaagucccgugcccaggacuguacagcccuguuacagucauaggucaagagcaaaaucagauucaggaggcccagcuggguccugggcuccaggggcuggauuuagaguucagggcagggcaaggccucagacaugccugcaucuacgccaagugccuucagaggucagaaugggaucugugucaggcagggucauaggucagaaugcagucugugucaggcggggucauaggucagaaugugcucugugucaggcagggucauaggucagaaugugcucugugucaggcggggucauaggucagaaugugcucugugucaggcggggucauaggucagaaugcagucugugucaggcggggucauaggucagaaugugcucugugucaggcggggucauaggucagaaugugcucugugucaggcggggucauaggucagaaugugcucugugucaggcggggucauaggucacaaugugcucugugucagacggggucauaggucacaaugugcucugugucaggcggggucauaggucagaaugugcucugugucaggcggggucauaggucagaaugugcucugugucaggcggggucauaggucagaaugugcucugugucagguggggucauaggucacaaugugcucugugucaggcagcuacaagggaacaugaauagguuugagugccugugacuuagcaguguguguguguguguguguguguguguguugugugcauagauugaaaaggagggagagagaaggaccugaaggagcaggucuagugcacuugggaacagcagggcucagugaucaacucuccuuccugggaaucaggucucaucauauacugagcccaggacuaucauuguaaccugaggaacaggcuuccuguacagcccaacaggguuaggggagcuuggugggugaccaguaagagguugggaggugcuucuuggggcagaagccagcugcccagggagugccaacccugucucagggcugacaucauuacaugaacgcaugcauuggcaggagcugagccggcaguccuuccugcuuucgagggaggccgggagacuuaauuaguuaauguggguaaaguggccugaagaugaaaacccuggguaauugcugagcgcuguugcuguuguuauuacacaauuaccagaauuuuccagucacgggaaucuuguuaaacaauucccaccuggugugggguuccgggauccacuccggcugaggggcuggcugacucugacucccugguuggaagguaauggaggagaggcacagaaauguggggcaccgggucuguguagguccuguuacacccugggcaccccaagggcacuuugucucuguuccagaacagacaaacuguacgggcauaaagaagugcuggaagguucugccuucguggauuucccccagaaaguucuagaaacuuuuaccaaacccccaggaggccaaaauauuccaaaaguaugcugcugggagaacuuccugugacacagcuagcccuggcugucuagaguccagauggacagaugagagcuugaucaggcuacggcuuguuuaaaaucucuggugaucuggggaagagcuguccaaucauaucucuguguuacaaugauacugaacuauuucauuuacugaagcagugugugguuaguuuugcugggcagaauagugacagauagguaaggugagugaaggcagugucugggagagugggcugacuugcccauggaaggccagaggaccucagggguucacacuggccaaagguugcugaccagcaggggcacaggcaggagagaugagauggugccaagucucagacagaaacacugaagggcgccaaggugaguggauuccccugcagaggugagcgcagaccccagaaaacagagcuaagacuuccccuauucagacacaaagagagaagugauucucacuuucuuuuugugggaucaaaaggagaugagauaugauguguugcccccacgaucccggugcuaagauuaaaggugucccuguaccucggaguuauagcccaaacaggcaaagaaggggcacaggacucacuguaguaagggaacugugggccauaaauaucauuaguccccuaagaaguguugggagagcaggaucucugggcuuucuuccucuggagcccaacccaaggaggcaccaugaugcucuguguuaccaguggggaggaauguaggcuggaagcaccagccaguguucagugucugcucauucauguuucccuugccaggugccugccagggacacagguggugcgugccccaugauugguggagucuggcuuugaucgaauugcugguuugucuccuauuugccucccauucucaccuggaaccaagcuucgauuuauuggagaucacugugagaauaccuccggcaaguucagggauaagaauucucagccuucugaaguccuacaggguaucuuucucaggguauggcaugcugaccaagcagagucugagggcaaggcagucggguaggcaggucucugaaacccaugggucacaugaccucacugaccucaaagaagccccauuugcuauugcacuugcccuuaacuucccuuaacuucccacaucuccaucucucccuucugggaucagaaccauggccaagugguggugucacgaucaucaggucccugucauacccauggaagaaaccacugucucacggcacugaguguuaucaguugaaccauucaggaacacagggcucaugggaagcagagggggaccugacuggggcacgucguguccuguguguagcaguauaaagguuuucucuagggaaaccaccuccugucccucacauaauccaggguguuauaugugccucaacuggucagguugagccugccaugaguccacugaaacugguuuaggaccaggacuuuaaagcccaccgguagccaccagguccuuggacuuuggcuggggccaccgagaugauuuuucuagcuggauuuaauuugggagaugggucccuguggcaaggcaagaauggcuggggaggagugaacgaauuacccucagaggugaggccggagcuggagaaccccagugacucgcauucccuggccucagguggcugcuggaacuggugugggucuaggcaggaggggugggaugacuggucaucugggaaggaaaugaugaaggcugaguucuggaaccaucuuaccagcacguggaaucuaagaagcucucugacacagccuccgugccauugauggagucucuggauccagacauacccgaggcuaauacaccuuaagauuguucagaaauuugagcccguauacacuccuucacacgagucagaucaggugagcccucuauugcagcuguggagcucucucucuguaccacucugccuguguggagggugggcaacugucuccaccaucaccgggacuauucugaaguauggguuaucuggaccagagagcucccggggcagggugguaagcacgucacaggaauuggcucuguuacaucucgcaacacucccaggaggccugacuauggacuagagucucuggacacucagggaccccaaagagcaaaucaccauugaucuuuccugagccccacccucuaaguccagaucugcaggaagcuaaagauguaugucccagaugguggaguugguuugaauguggguuccaagaccugguagcuauggucagucaugucccagcaccuugguauucuuaccuauauaagggagagaugagucagucagcuaagcgauugccauugaagcuuaaggacuugaguucaagccccaaagcccauguuuuugcaaaaagccauggggcuggagagauggcucagcgguaaagauuguuggcugcucuugaggaagacauaggcucaguucuuagcacccacaugguggcuugugaccacuuguaauuccaguuccagagguucgaugccaucuccugacuuucacaggcaccggucaugcaccuggcacacaaacaugccugugggcaaaaugcucucacauaaaauaaaauagacugaugcuuaaaaagccaggugcgguguugccaggguaacaggaaacaguauuggaacaagcccuagccuuucaaacuggggcuugggauagcccaggccucgcucucaaaacagugucaaugucucaaaauaucgcuacaaagucuccuaccuucuuauagaaccacuaguuggaauaacaaacugauuccgacucuaccuacuugggaguuaaugugugaagacagaugcucacaugagccacuuuauacguuuuuuuuuuuuuuuucccccaaacacugaggaggaggcauggucaucucaagguaugagauaaccacaaggaauugcagggcuuucaaaguaguaacugggaaccauuccuuaccaauugcaaacacaaucucagggaagauucuuggcuagcucccaagacaaagggacauuuucucaggaacgaguucaucagccucugugaacucgggcguccuuccugggccucaccugccacacaccaccugacugugugggauucucuggggccacaagguucaugucucaccuggauggugagggagccccggucuuucaagcgcuucucuggugauugcuggucaccgcuuugccugggugcucugugcaguuuaacgggugcauggaagauggcagggaccuuggcaagcacauggcucuugcuucucccccuguaaacaggcugaugaagcggaagcagggaucaugcaggccgacuuauccuccacuucagcuagcaaaacccaaccaggagaggguguggggggguccacguugccccgugacauccaaugcaggucuggcucccugggcagugucugcuuuuuauggucuugaucuuccuaacaagucucugggugggagcuccuucugggcuggaaaggagaccuggauuuaguuagucagagucccugccuucugugcagagucuccaguuggcagaaaaggaggggaagggguuuuaagcaggggauuccaugaggcuggggcuugggucaccucccccugcucugggaggaugccucuguaagguccuguuaaagacacuaaccccaauucuccccuggcugacaagcaggcagguugcccagaccaggagaaguuauaggauuuuuaugcuccagcaaccauaauagugagaucccagcagugguuuuagaggggcuuauggggaaauuggguuguuuuuuauuuuauuuuauuuuuuuauuuaaaaugugaaggugaaguaucaucauggaaguuauuguggcccuuaacaguucauguccugaaagugugacuggaguuaacaaagccacuacagggcaggguucagauuagaaaacaugguucuucuuuuuguuauuucccuuuuuaagccccucauucucuucauccuuucucccguggcuucuguagcucacugauaacccauaagccuccucggguaaucacagcugcaaaacuaaugacacaggcaaagcgggagccacgcccucugccgggaugcugcaugggcaccccugcuucagagcccccgcagggagugccagcuuguuccuccucuucccucacccaugggguuucauguggugaauaccagcaaggaucaagacacggggaggggacggggcaugccuguaauccuggaucaagacacgggggaaugguggggcaggccuguaaucccagcugccaagguggcagcaggaggauugaaaguucaaggccgaggaagaugcugucagaaaauaaaaauauaagcgguuugggauguaguucaauugcggaaugcuugccugguguacaggaggccuuggguucaaucuaugguucugagguaagaggcggagaagaaggagagggaggggccaucugucuucacugcugucuccuaaagguaguggcuggugccaacacuucaggcagcaacaaggugaguucccaagucccagcacugcuucaaaaugucauuucuccuaugggcucugaggacaaagauggggagguguguguagccugcuaggagcuccuccauuccaaagaacuggcugccuccaguuugcuccaagcaucucuuggacauugcucugaaagacugagagggggcggcacagagucucaaagcuacuagguagcucugguucuagaugcuguugccccuaauauuggcaaaguugccugaggaacaauaauggagaaggaaugguaucccuguuacuguggccauuuacgcagccugggcucccugccuugucucugcguccuggccccaccugacugcgagccaccuucucagucucaguucuggugcugauaucccuguaaccccuuguuuccuaugaacacaacccuacuucuggcaccaaaugucuccaugguucacagaucacgcaguuaccagacacauucuguacagcccucagccugcuugucagcugcccuucccacucugccucagugucuagaauuucaccgcaucccaccuacucaugaaauaucagcuccaccauccuugcaguuuuccuucucuuccaaccaaagagaauguuguucuccuaagaccucacacgcaaagucuaggguaguccagacucaucucccucaucugugggcuggagcccacauaccucccucuaaaccaaggcuucccaagaucaggaucuaagccagaggaaaacuucacccaacuguaggcaaugagcaguugaaugacuggcuggugaaacacacuggcccuugaggcuggugaauggaugucuugucuguuuagcaugaacccaugacugggaggcucugugcugguguugggcauugcuuuugcagugagugacccacagugucccaguguccgagugacccacagugucccagugacccagugacccagugaauggcuuagauacuggacacccacugaucacucucuuucucucucuggaaacuucuccagcaggguccucuagaauugcuuucccugugggagcacagcaagacgcuuugcucuggucucucauacacugucucuguucucuucuuuauaagaaaccguggcuugugguacucuuuccaggguccuaggaaucucuucacagaguucuguuguccauuucuaaguggacacaaacacacacacagacauacauucauacaugcaugcauguacacacacaugcauguacacaagugcacaugcacacacacaugcacauacacacaugcacauucacauacccaugcauacacucacacaugcacacacauguacacauacaugcacauaugcacacacacacacacgcacacacaugagugcucagccuccuugguuagagaaccacagcucucgcauacuguuuguuuucaagucucaccacggcugccuggaagcugagagaacacgcugggcugagggccuuggcacucgcccaggguaacugggacacccauguuugcaaagaaagcauuugugaagugugaagaaauccugaacagugccguucagauacuguguuuaaauuucacucagaagguucuauuuuguguagggguagagucccuuuggcaaaaacacuggcuggcauucuugaagcaugguugccauggagccguuaagagacacuagauacugagggguggcaaugaaucgugugguuggagggacacugagcuggcagcuccuugggggagcuucugggaaagggaacccuaagagccaaaguugaaagagggugcuuuuagucuaauucugucacauggcaaaagagagagagagagagagagagagagagagagaaagagauaugcuuauaugcacuucccugcugucuaaaauugaggauguagcuccugaagauuuccaucucuggcuuuccugucagugaacuugcaaggucagaggggguucuagaggcugcccugggauaccaggccaccuagggacucuccuccucugcuuaccucagaggccagucacucacucuccaacagaugugucgggguuggccuagguuuggaaucuacucuggacaagacauagcuucugcugccagagacaaacuauaaauauuuaaugaagaaggugauuguagagucucugugaggcucuagaagcaagcacaagaugacggguuaacaggguggagggugacagggcacagcucuuccagggcucucagagggggcugugaggagaggaacugaugcugccugugcaaugacagagaagccaccugcggggagacacacccaagaggaagggaaggguuucaggaccagggaucagggauggagacaguaaggcagacacaggugccuggugagcaugcagcgauacagccaggaaaagaaagaacacgggcuaagaaacaacgcucccaaccccccaaaaugaagucuccaaauuauauuaaaauucccacaugugguauaugcuugcaaugcauuugaaaggcucaaacaggggggcugcugugaguuucaggucagguuaagcuaccauguaagacuuuauuucaauaaaccaaaaaaggaggaggaggaggagaaauagggggagaaggagggggaggaagagggggagaaggaggagggaaaggaggagggagaggaggaggagggggaggaggagggggagaaagaagaggaggaaggagaggaggagggagaggaggagggaauggaggagggagaggaggaggucaccuggaggucuguuccuguggcccaaaagggacugauaaaagccaguucccaucacuguggucuuacgacugacuuucuuguuccccgcaucuggcuuggcauagggcccagagucaggcugaguaaauauuugcugaguaaguaaacuggcccaggaacacuuuaauguugaaugaggcucucuauugaaguagagauucaaucucucuucagaaggcaaacuucugcacguagagaucagaucaccagaaagggcugcuucucaaagcgagggagccacacaagaugaacccaguucacccugcaggaagucaccaagcucccauuguuuaaggcuugcucugcaagaauaaucuaucugucagugggcuguagaauggaggaaagauggcuggguuccaaguagucagucgcuucccguaacgaugcuaauucuggaauccaaagcugguaagggagcagggcucugucauuguccagcuugcugcugcaugauggaagggccagguguggagcugaccuuggcacaugucucccuugagccacucuaaacguugcgacuuugggaaaguugcuuaaugucucuugcuccucccacccccgccaccucauccccccagcagggcgaucaccgugucuccucggagcuccauggugagaguuauggugggugucaacuuuccuguuuuuuuuuuuuuuauaacuucauaacuccuuauuggacagcaguuuuuagaaagccaaaagcugggugcaauuacagugucaccugaggucacccagagaagaugugucacccugucuuuagaggcaacuaaagggaagcuaugauauggaagagcucagcuagugcccacuguucuucagucaaccuugaccagauuaaaucaaaucgucuucucaaagcacggguacuggggcuggucucugcugggcauccuugcucuaccaaagggugcacaggccuuuccaacccucaucuaguaagcuuuccagaugguugcccauccucucucauuguaauguaggcuggugaugaaggguguuggcuggcguugccaggcggaggcaccggggaggaaauuaaauguuuaguuucuuauuaacucugcaguuaauuaacuuugcaggacaguguuuaccagggcucccacuaauuccaguguugguggugcacagggagggaugcgggaugcucugucucucucacucccuucucaggcugguaccuaacuuagcaaauacucagaagccaauagugaauccuuggcaccccagacugcagucccucagugaauuucuuuggcgcuuaugggaucaaaacaagauaaaaauccugcugucaucugucuggagguucuugaguuuucuggcaucugcuggggacauguccaagagccauuggcuucucaagagcugguagccucuuguucuugggucauccuuaggagaggcuccauggcuugcucagcgcccuuuaucccugcugugugccaggccuugucaguacucgguugccuccugugaacuuugccucucuucagcauccauucccucuuguccugucucccaggaugccccugacaucucuucccaccugcucuugacagggcagacuuuggcucggccucgacugucaaguuuaauuucucaaacaaaggcuuugacuucuacuugacuaacuccagaacagugagugugcuucagcuaagaaccggaagaucucagcuucagcugaaggcugcauggagggcccugcuccaaucaugccuguaccaugccccuucccuccaguccucugcuuccucauuccaucuaguccugugggauacccagucaugaugguugggauagacacguuggcugagcauggcccugccuucuaaugguggcaguuuccuugaagugaccuuuuuuucucuauaugccuguguauauuuguaggaggucaaaugaagccauuugagagaaaaggacagacaaagguagauuuguguuuucuaguuucuagccacauccagcugacaaaccaucuuacuuuuguaucuuccccauggagcaaagcacuaugggaguagccugcaugugugccuuaggucugguuacugagcaaagaguaggguuaggacucccagacaccucucuugugacacagacauguguaacaggaaccuggguccuugggaacacuaccaagcccucuauccacugaccuuccugcagacagcuccccaggggguuuguaccaccgaaccuguggaaggugugguuucucugcauaaggguggguggcucucacagugggccaaggcagcaacaguugucaaugggaggagggaggaggccaucagccuuccucccuccuccuuagcaccuaccucacauugccugucuguacucuugucugccucacacugagagaacccaaagacuugccaugggauaagugcccuagucuuugcugcccccuggccuggccuccccaaaaucucucguuaggauacaagcuucaccaucagcuuugaacaaaucccuuguuucccugcccuauaucaaacccaggaucagguggaaauaauguuaauguuuuuuuccuggaaaaaauagauagcucuaaauuaauacucaaugauacugagagcuuuuaaacuggcaugcacaauuggguggagccuaaccuaauucaauaauauuaaagaaacagggaaguauuuuaauuauaucauucucauaaugggagaggaagcuggguacauaggagguaaacaccucaagccacagaguucucguguaaauugggcugacaaagggggggggcauuucuuccugucuggugauauuuccagauguauggccccccucucugucucuuucugucuuugucucucuaucucugccuuucucugucucucugugugucuuucuauuucugucucugucucucucucuuccaccacagccaugacaauccagugaauuagaaagcauaguaaaauaucaucagacuuggcugggaccaauugcaaggagccagucuuguggccugggccuuaagacggagagagacagaaacaaacuacagcucaucuuugggguccaaggccucuggcugggagaaaaaaaaauggcuucccagagguucagguugccaccgugucugauaaaaggaggcccagaggcaaggcucccuccuuguaugaugguccuggcugcuggggagucuccggcccuugugaagcuggaaucuucucuggcuuggaggcaaggggcugaagugcucuuuccacccagcacauaacuagcucuuccaucuucccuuauuccuuucuucugucccuuucuuccuuugccccuucucuccucuuccuuccuuagagugcacauaugugcacacacagcacacucuugugugucugcuguguacacgugucugugugugcaggcauccaugcauguaccuaugugugugacuguggagacccagggagaggaugacaugggucuugcuguauauucuuugcccuauuccuuggaccuggagauagcaucaucaaacuucagauauucuucuggcucagcacccccauaggugugcauggcuaaaucuggcaucguuuuuuagggcaaguacuugagacucaaacucaaguccucauucuugcacagaaagcacucuuauccacugaaucgccucuucaguccacaacuaacacuuucuugagaggcucugugcagggcucuggcgguguaccaauagaaaaacagagucuuguccucgggguuuagagggagaagacgggugauagaguaaccacgcagguucucugagaugacccugcgggaugcugcugcugcugcugcugcaucagagcugccgcaggaagaccacaucuugaaaaccgacucaaaucuccauaacaaccuaccaugcucgugaagcaggggugaaauuuuccuuggaucaaugcucagaagagccaguguccaucugugcuaggcccugggcugcaggcuucaagugucucccuguacuggguuauccagagaaccuugcuaugcuuagcaucacuuaggggcagagaaaacagguucagagcagcaaaggaacugcuucugugacugcuucacauccuggcugagagcacuugauccaaaggucauguucucucaucugacuaaccuggcccugaugcuggauggaugggugcgugagguucccgauucugcaguugcuggacugguuuagaaucaggaagguuuagggacuggggagaaggcucaaugggcuaagaugcuugccaucgacccuaaugaccugaguuugauccucaggacccacaggguagaaggagaaggcugacuccuacaagcagccuuugauuaugugugugcugugcuguguacacaguccucccucccccagcgaauaaacacacacacacacacacacacacacacacacacacacacacacacacacaauuugggacaugagaguaaacuucuaagaacauagauccaagauuuuauuugugaccaaaguucacagggugaacuugccacugagauacacaucaucucucuguccguacgucagguuagcagggaaagacgcugccacauggucugggcaccuugcaugugccugaucugaagcagccuuguauuaucugcaguuaguaccugggaugguggcuagcccucuggguucuuuauauauacugcaucuccugugugccccacggcauugucacauagcaccaaaguuacucuguccuucgaaguuuuguguuccaaugcuuucucggcaacaacaaauuucugcacgcuagagcuguugcugagacaaauaagccuggucugaauguaagcacugugaucccaggacagcugaucugauacacaagaccguuaacugagugacugacgggcacgacucauagacguguggaugggauacagggagagaggaaucaugugcugggugggaugccgugaacuuucaucaugauauucaggacagugugcaacuuagaauguaugcgcuuccuguuucuggaggcuccuacuuaaugcuuuuugagucacaguuggacaugguugucugaaagcagacacuggaacuguggucaaggguuagcuacagaacuggaauaagaagcagaggguagaggacucuuuuggguacucaucauagcucuuaauggugucccaucauuccacagggcacagaaaggaugccugagaccaauucaggcagagcuauguaggcacucagucuacaugggaacaggucaauaggcuccuggagcuuuccguauguauugccugauucuuugcugacacacccuucccccuuggccugcuagaugcccaccuacaccagcucacacauccauacacauccaucuuagagacugucaccucccuccuucaacauucuagggagcaagagacuuuagccccaggagaaagcccugugcaacccuccugcacucacucccuugcguggguacugcacuuucagcacucuggacagagcacaggacagccauccagucuugcccaguuggcauuggaggggaacugguagaagaggcuauuggguaugaaggacuacagaaagacuuuuggcuguaacuaugugaauaucaguugcuuugaugccaggaaaacagauccucagcagccuuggagaucaaggucaaaguugccaaaacagcccagggugagaaucuuggcucccagcagcucccacaggaagggcuaucacagaacgaucagugcauaucacaucuaguccccagagcucaacccuccacauuuggggagugucacuccaggugacaucugcauaguggcaagacuuauuccaaagacagauuuauaauaaacagccucauuuuauagagccccaaauauuugcacaaaaaugagcccuguguauaacuugcuccauuuaucuuucugcugucacugaguguaucuuuauuuuauuacuguauccuccagucccuccagcuuccaaguguaccucucauuuccaaagucacugucauucaggcagucuugucuucagcuuccuucaccucucuccuucugucugcuagggcccuacccacacccgcucauccagcagccucucgggguaccccuccuuccccaucaagagcaucccuccuccagucacucauucccuggggcaacgccuucuuuucagcacucuggacagagcucccggaggcugcguuuugacagacuuuagccuugcaggcccaggcugcccugugcagagcaauuugagaugcugcucccuccuuccuccacucuuagcauuaccagcguuaugaaguaaaccccaagugguuucuaaccuccacggcuacccaagacacaggcucaguaauagagcgagcaguguauggaaaaaggagcgauuuuaauuucaaaguucugcugacauucaucgaguacucucaagguuuauauaaacagaacgccccgcuugaaauaucacuuugaauucugucggugccaucacgccucuaauaggcugcuguuuugguuccucucagcaaugugagccuuuguguuuuaauauucagaggcacaaggaagcaagaaaauuauagcugggaagcccaggcuugguucuucaucauccaaguuaaauuuggcugaauggagggaaaauauccuuuuaaaagggauggugaaugggaauaauaaucucuuacauuuacaaaacacuacacauuuucaaagcccucucacguucauuaucuuguuagauuucccuagcaaucugguacagagcaccccacagauaguauagggggugccagauaugguggcaggucuuggaagacgacagugaagaaagaaacugaggcugggcugucagugacuggcuggucagucuguggugucaaaaaugguccggguuggccaaggccaggacuugacaacaucaacauaucucuuggcaugcaaccuccucugaaccucccccacaucugcaaagugacuuuuccccucuccuccugucagacagacauucuccaaaccaagcagcguugaggaugucucgccagggucucuucuuuuuuuaggagaccuaauguucacagcauaaaggagagacugacuacuaaugggcaguaauuuuuuucuuuuucuuuuucuuuuuuagugagcacuguuuguccuagaagugccugucccuugaucugcauugguucaggugaccuuugcaacucugggaugugggcagccccuguugugguuaggcugcugcauguugcaguauggucaaggagccagcuguuugucauccugagaugugcuuccuauuugucuccaacaacaaugcccaacuucacugagagggaggauuuggguggggacggagcuugcaucucuaagggccaaauucuuggucuccugucuucugauccuggcuuggggaccagaacucugugaaucuaacuaacauccugggucccaagacuuccucuuugcuuccauuaucugugggaugaaaucucugccucaauguauucugucaguggcccaggcauucacacaacagugccacuacucaagcaagugggcugugguaaggauagguggcagaugagugaauaaaugaacagugagugaauuaggggagaauuuaacucuucauuucaguguguguguucgcauugugcauguauguaugcaugugugaacauccaugcauguguguguauguaugugcguguauguauguauguguguaugugugugcaugcaugcauguguguauguaugaauguguauguguguaugugugugcaugcauugcacauauguaugcacaugugugucucugugugcaugugugugcauaugugccuguguguaugcauguguguaugugugcauguguaugugugugcgugcaaguguguguauaugugugugcaugugugcauacaugugcgcguacauguauguaugcaugugugugugcauguguguguaugcaugcauguguguguguguguauguguaggucagaggaaaacauugcagaguugcucuugccuuccaucuucuugugagauccaggaaaucaaacuuaaguugucagguuuguacagcaaggaccuuaacccauugagcuacuucacuggaugaggacuuaacccuucaaagagguguagggugagcagcagaaagaccucagccaucaagaguagagcuccugcccugccuugaagcccugaugggucuucagugaaagugucccuguggcauccccagcaucucccaccucuucucagcagcacuggcaacucccgacaagcuggcaaagggaaugcaucugaggccggagcuuuggagggucaaggugagagaggaagacaggagauccagcgcuagggcacaccagggacucauuagauaagacuguucugauguucauggcugagcuggacugggcagguugaugguggauuguugcaggcucugucucugggggcggugucauuuauagguucuugaaauuuguugcuguugauaacagugacaagcuauaagcaucccacgugaggaauguuaauaacgcaggaggcauuuuuuaagugguggcuuuggggagccuucagcauguuagugccaaugggcuggcuguuggcgcugucauauaucugggaaguuauucugggaaggucgcgcggugacuccauugucauuauguacaaaauauuucaauuuuccagaauagacuugguuguggcaccaaugaaucuucaucucuucuccuuuuaugucccugcuugucucuggagucugguuuuguguaagcagaagauagacaaacaguaggugguucuggcaggagugggauucugcacagcagggcuguggugaggggggugggugggugagagaccagaugggucucugaggaccucuggggacgggucauagcugugguccagaucuuaaggcuccuccucacacagccgacccccagcucaccuguuccagccaaacuguuucccagacacagcuggaaccuuuagccugggucuuucuucuguuuauuuuuuuuaaagauuuauuuauuauuauaucuaaguacacuguagcugucuucagacacaccagaagagggcaucagaucucauuacagaugguugugagccaccaugugguugcugggauuugaacucaggaccuucagcagagcagucagugaucuuaaucgcugagagccaucucucuguccagcaucucucagagccagcccucccucaaggccauugcucucugacugggagccugagaaguggaacaucugguguucaucagagcuucuuggugccccagcuuccauuuccuauggggcagugggcuuaaauccuguucuauuuaacuucucuucaaucugacaucacugugggcaagcaccaugccacaucgacucccauagguccuaaagcagcuggcugccuccaugcuuccugucuccuguccuucagaauugaccccccaguaccucucuagaccuccagucugacuuccugcaugugaggaccaccaggggcaucagccugggcugaucaccucacgagccuagaccugcugcucucgccucaauucacuuucuuucuuucuuucuuucuuucuuucuuucuuucuuucuuucuuucuuucuuucuuucuuucuuucuuucuuucuuucuuccuuccuuccuuccuuccuuccuuccuucuuucuuucuuucuuucuuucuuucuuucuuucuuucuuucuuucuuuuguuuuuguuuuuuucgagacaggguuucucuguguagcccuggaacucacuuuguagaccaggcuggccucgaacucagaaaucugccugccucugccucccaagugcugggauuaaaggcaugggccaccaccgcccgguuccucaauacuuucuagugagccggacaugugucacacuuugcaugacugaggagacaggaagacagugacucagcuuaaacucggaggguaacuacugauggacaggaugccagagcuggaguuagacauuccugcccagggccucccugcuggucucugcuggacccuuuaaucaaugccuuguuccucuaagcugaccccucccuuggccucaaacucuuuaguauacaccuucagcaaaggauucagcccccagauguguagcagcgacaaaugagauacuugccugagacaccaaaagucagggagggcacugugaugauuaaucuauauccggaaucaauugaaccccaaucauugggcaugacugugagggauuuucuugauuggaucaucugacagggaggacccgcccucaaucugggccacaccuucuaguggcaugucaaucaaaggacagggccgaaggaagcuuuugcuuuuggccugccugcccucagucucacaggcaaguuugucuaucuucuugcugagucuucccuuugcugguguuagaaucuacuucuucaggauuccaauauagacggaagaccaucaguucuccaggauuccccugugacgacuccagccccgcauugaaacuacucagacauccaggcaaacggacuauauaacucccagacccuccuuggcaugucggcugggagacauccauuguuugaguacucaguccauggcccgucagcucuucuaauaaauucucuauuuauaucuacauaaaaaaugaauguauauucauucuauccauucuguuccuuuagagaauacaaauacagaucguaguaccagaauguuggccacauaguucugguuuuagagucaugaagaauaugucaauaaagggacuguggaaucuuucuugacaguuaaggagagccgcucacaccagcggaugagugccagggcagucccugcguggagguucugagaaugcaggaagcccugagaggccauugcaugaagcugcgagggugaagccggagccauguuggagacccugagguguuaagagaugcuggagccaugggcuaucugccgaggaaagcugaaacaggguagaaccaaccaagagagagagaaaccucccaggcagcaaagcuggagggguggagccaucugagccagugguucucaaccuucguaacgcuguaacucuuucauaggguucuucaugcuuccguaacucccaacuguaaaauuacuuuguuguuacauuguaacuguaauuucguuacuguugugaauugugauguaaaucucugaugugauauaaguaucugauaugcgacccccaaaguggucaugacacacaagauagggcgacacugauccuaaacucugacaucugacauggaaucaggagauuuuggguuuucccuucucggcuuggcucuugcuuugguccaggacugccucacuauauagccauuccuccccuuuggaacaguaauguagacuccgugccaucauuguauguuggaaguaucucaccugccuuuugacuuuacagggguuccagcuaagagacugccucacaucucagaagaggcuuggacuuuggacuuucaaacaguguugcgagacugaauguaauuuguaucgugauauggccaggagacucuaggggugcagggaguggacuguggugggucgaaggagaaugacuaccacaaggcucaggcuuugaacacuuggacuaugggggugaugauugcaagguguggcuuugcugaaggaagucacugggggugggauuuacgguuucaaaagacuccaacaauuuugagucagcccucucugcuuccuguuuguggauuggauccaagcucucagcugcuacagguggugguaaugaauuucuauucuuccugaauuguaagccccaaauauacccuuccucccgugaguuucucuggucagggugucucaguacagcaauaggcaaguaaccaaugcauacacgaaacccuuagcgaugaagaugauaguuaacgcaguguucccaaccaccggaccuacuguggaaagcacauguuacaaaugaagcuguuuuaaacagacaggaucaauaaccuaccuucuucccacugucacaccugacccucuuggagaccuggcucugagcuaguagccucucccuuuucuagacgcucaggaagugaggugauuugcucaguauagccugggugauaaagggcagagcugggagcccucccagggaauggauuguugccacugagccucaccguggcauguuggcuggugucugugcccagugauugucaguccugauagguaccugccuccccucaccuggguuccucccaggguucuuuguccucaaggugcuauuugucccccucuuguaugcugauagugugucuacccacguaggcaggacaauacccuguccuugcuguagugaguuugaagagcauuuaggaagggaaggaaaagcugccgcccuucucaucuggggcagguuccugcuucuaggagucacuggguuguggcucugaugguucccacgugcccucucaaccacuguguagccucggggacgucuccaccucugcuacacucuaaugucagaaucgggcuagaaagacucugggggcggaugcuacagagucaugugguuaacucaguugguugcugcucuccggaggaaacaccgaaaccagacagaaggccacguggucaggagcacagaccugguaccuuaguuucuaucuauccugaccccugggguaaacuauccugacuggaagcaacuuaggggagaaagggcuaauaacagcucagaguuaucaucugucauggcacagggugggguggagcaaggaggagacacagugccacgagcaggaagaggaagccaggccuaugcccccugaaucagaagcagaguggggaacgcaugaucguccugguuucguucaguucugaggcagcacagaaaggggugcugcugcauucagugugggccuucacagcucagcugucacccuaguuaaggaaaucccucccaggcaccaccacaggucacucagacaaggacccccaugagacucccuucucaggugauccgggaccugccaagcugaugauugaaaauuacccucaccccuggcuuugucccagccucugcucagcacacuccauacacuauuguccuugggcuguuguggaggucuguucugcggccacaccauggcacgcucaccgagagcuuagaacaccugucaucacucccaggagacccucacagccuugcggucucuggcucacaagucuuccccuaggauguagaaaugguugugcaacugugugcaaucuccccauuuuccuguaaguaaccccaauuaagccuguugguucaccaagcuagacagagauggucuguuguuggugucaucucuggggugaacagauguuuguucaucuucccccccccccaaaucagcaacagaguaauguuuaccagugggcgcccaauguugugagugcacccaacacacccucccagaagcuggucaacagggcaggagaggacugcucucagaugcucagccuuucccacgagagccugcccauaggucacuguacugaacugugugugagaauagggguuggggagugugguuaaggaauguucuggaguuugccagcagguggugguggcuagccccuguggcaaucaguuugguugcaagccaccuaaguacaugcuugucaccacuuggugccuuuggugaggacccaucuccuugagccuuauauauagaacagggaggcucccaagagcauggugacccguucaaggucauuuccccuguugguguugggguguguguguguguguggcucaggguuucagcucugacauccuccacaaggucacuguuguggcagcuggaacucuucugucuuguucugcuugcagucugugcugaggcuugguugagaucagcucacucagcaggacugggccuggguccccagggagggcuccagggcucccauguguccccagugggcagggacgcugccauagcuugccuuuccucagcucgcccuucagaggggcuuugauucgcuguuaaccuagcagagccucaugaaucauucaugaagaugcuccgaacgagaucauuauuuugagugucgagugucaggaaaacagcgucugacgggcaaacaugaugucugaugacagaacagccgauggggugacccggcagcugggcaccugccaugcugcagagaauuuuuaaacauuuaaaaaaaaaaaaaaaaagaaacccacucuggcuuaaagaagagcagagccuccucacagaccccaggcaggcagacacaggugugugugagaugcagggaggggaggcuguccugagaguccagucuguucucugggaagugacucaguguagcccagccugucaggggcccagcugcucuaugagccaacccacagccuggcucaguagaacggacacugccuucccuugugacuuuccagggaaggucauucuaaaaaugaccggguagggcucaugcugaggcccagccuguucccugagaccuccuaguccagcagcgauaggcuggaccuguggcuggucgagcccuugggacccuggggggggggggguuucuggccgugucgaagccacuuuccagcagaugacagguugucaauaagcucacuaccugcauuauuuaagcagaacaaggugagcuugccugcgcccuugagcucagaucaaauugaugggcagcacaggagcuacaggcaauaagauuguuccaaagagaaagaaagucagaggggacggacggacggguguggggccugcagcggggcggggcucugguccucuucucuguggguagaggccuugagcucuggcuucucucuuggccucucauuagcgccaccaagccuuggaucucuguagcggaauugggugucagauuuauauguuuguuuuaagagguaagauauccccuaaccaccacccgccccccagaagcucugcccuguucuaugaccugaucccucggggacauucaaaggaugucuucuugcgccccgugcccucccuuccagucccucaccucuaaccggcaggugauugacugucacgugccuucuguucucuuacagucuggcuccugagaguuuaaucaaaggcaaggcaggggaguguguccacuccaucaggcagcaacagcgaaagcagagcguggggccccugcggcucgggcagaccuaggaagcgcugguucacagacucuaaguacggggcuuaaagggaagguugucacauguuuccccuaccaguucaaggacauguccuaaaggcacaggcucuuucugaacacucccuggguggagggcuugcugccucucgaccccucuaccauccaaggccaauggggcugcuacaaaguucuuucuucaggaggacgcugccuuucaaagauuagacgagggguucaguuacuuguucauuugcacacccgucuacgcguauguccauccauuuaucccucuguccauucaccuacucaggccuucauucucccacccaucucucuacccaggcacccauccacaacucacuuauuggccucacaaaccuguccaucaacauauccucccacccacuuaacuuucuaccccuccauccaucaacucauugacccaccagggucucugcagccgcuacuuacuaauccuaucugucagccugucccccugcucauccacccaccuguccacacaccuguccuuccagccauacccauacuugcccacuaguccucccuuucuucuggcuguccucugcccguucauucacggguccacucaccuagccuuccaguuacccacacacccauccuauguguagacagccgugaaaacuguugagucugcucugguuauaaaagauggcgggacgucccaaucccacggccugcuaaugcucccagagaagaacacaguguauccagggaaaaugcaaucuccuccccagucauuccccaaaccacaauccccgagaguuggcccuggccauacuauguagccaggguguucuucagccccgaggaagcuggugggacccugugucuuagggucugaagagcuuuuccccuacaucuccagggaacagggaaugucuaugccugaaauucaaaauguacucccaagcucuuuugcagauuacuguuuuuuuuuuccaguauaugaaaaagcagcucagacaagucccuggugggcucaguugggaaguuuuuuuggacacuuaaaaucucagccugcaaacgccaggcaugcuggagguaauuguucaugaaaaucaaagggaagccaauacagcagguuucugguauuuuaucagccacagacacagguuaguucucaucacccugagccucaagaaagauaaaacuggagcauugaucugagccucucccaugagggucccgugcuggcaaaccaguaccaucucagagcagacguucccuggcuugaaacagccacgugugggguggcagcugcuggccucaaacacuccucuagagaggcugugguggucaagaacaccugaaaccucuucuguuacucccugcgggugcccagccugccagggcugggaggucuguccaggaccucccgugucuauggcaaccgaugcaucccauucccaaggcagggaccaaggcccuugcuuaaguuacuuuguauggugguaaccaggcuugugugggagagcugcccuuuggugaaggcuuucccuagagauaggaaaugaggggugggagaugacaaaccaggcagggcaggcccuagagcccacagugucuucggagggcagaggacaccuguugcugaucuuacaagucaauugacagaauucauccuuggaaggaauucuuugaggagaguagcauuuagaccaguggauuguggguaagcagguggaccuccuccuugugaacaggccuccaaccaucaacagaaggucuuaagacacaaaugccaaggucucgaaggaaacaggaaucccagcugcaggcagccuuccagcccucccuggaacaccagcucuguccuagguccccaaagguuggccuggccuggagaaugcaggguuuuaggcuccacagucaaaggagccaauuccuuauacacuuccugucucuguccuccuaucuccaucucagucucccucccaccgacucuucccuggccagcccagagucaagcucccuaucucugaagaucuccgagccagucaacaaccaaccaagcagccacugcuaauuguugagugccugucuugugcagaucacggagcuaacggcacaugccuccucucacaaguccucagggaagugaauggaagcucucgaugucaagcagccugcucaaggucaaguguaagaagacuagacucuaggucuaacugagguccccuccuggagcugggcucuuguccugguauuuauugggaggccaaggaugagaaggccaguggcgccaggaaggagauguuggggcaacaaagagggaacaauuacuguuauagaacaccaugaccaaaagcaaucuggggggggggggagagggagggcuuacuuuaucucauacuuccaagaaacaguuccucacguaaggcaggaccccagaggcaggaacugaggcagaggcgggggaagaaugcuccuuaucaguuuguuccuccugguuugcuuagccugucuucuuauagcacccgguaagaccagccuaagggaugguacugcccacagugggcuggguccucccauauuacucaagaaagugcaccacaggcaaaucugauggcggcccaucucagaugagaaucucuuuucccacaugacucuacuuuguauuaaguuuguauacaaaguuaaccaaacaaaacaacuuagucagcacaguugccagccaaggccaaaugcugauaccugagaccaggccaggccuucuacguccucagguucaccagguuccugggguaccacagccugcucuggagacaccggcucugccucuguugggagcuuuuguguccuaagcuugucaccuugucaguccccucccauagacagaagcauggaggagagcggggaggaaaugaaaucuaaaaagccaugucaguuugagugauucuccagcagcuggcugccccucauugcuccaaggaaggcaauaaagccagggagccaauaacagcaaacggcaugaggcuugacagauauggcuguccccagcaggugauggccaauucaaccagggcgagaaauggaaguuggggcaaacugguccaugaaaugagugacccugugaaaccucucccccugacuaguccaucugagcagugaguaccaguccgccccaugggagcaggcuggguugcucaaguggagggggcccauggcacagaucgcagaguagcugugggagguguuguagggcccccauggguggggaggugggcaugugcuauuaguaucugauguuuggguggauaucaagcacaggggugaggggccaaugagugugaggggcucuucguauuaguuuucguguaaacucagggccugguuacacgcuuggcuggagcuaagcugggcuuuccauacuugggcugagggcaaggcacucacauugcugugauuggacaggcauggguugugcgagccccucaguuucucugcaagcuggcucaccugacccuaugcucugcccugccugcccacucucaaggcagguaucugguucuuaccaacuuccugaugacaugguagcagcacaggcugagcucagcucaaugcuuguugcuggggcuuggugccuaagauggggcaggcaccugaugccgguucccuagugcauaucaagacaguuggccagguuucuggggaugugacuuuggccuugucucuaauccucgucuccuuggggagaagggaggcagggaaggauugucuguacggagaagaccccggcugaggucagucuucagagagcauguucucucugugucuguguagggcagcugcucaggucugccugacauugacaucuuuugacucugaaucaacaaccauaacaagagucaggggagauggcuugguugguaaagugcuugccaugaaauccccagccaccaucuacuaagccaaaugugugcucuugugaucccagcccugggagaucucugaccagacagcccaacccaacaagugagccccaggucccagcaugagacucuguuucaaagagucaaggggaugcuucguuaggaaugacacccgaguugaccucugaccuccauacacaugugcacaugugcacacacacagaaaaccaugggcgagccagggugguagggagccucagauuugcaccaugggagcacugacacccuucugagcuccaguugccugggaacuucccacagaacaggcgcucucaggggcugagguaggcuagaguucauggccccuacggagaaucugugucuaggucucuacacugggucaaagccccagacuuacuuaggauccugggaggcuaugugcucccagagacacugagaugucuuccaggcugagaggugagguugugacaagccaccaggacaucucaauauggggguauggggggcaagacacccugcaggagaugcugaaagcuugcaagagagugacucagauccaucuggcacugccauugggcaugcuuucuuuuggcucucugucucugagaugaggcuagcccuucuuagcuucuuucuuuuacaacucuggguuucccuaugcagccccaggcuagccucaaacucauggugauccuccugcuucagcuuccucaguagcaggacuacaagaaugaaccaccaugccugaucucucuucuuagcaucuuacugcucacucgagaccucagugucuccaugugcuaagugugaggaguccagcacuuacuagcuucaugccaaaugucuggacuggcgccagcccgcacagagcaucccuagaaacauccagacuucuaagcaccagcugacaacgugccuccgcagucggcggagccacgagaggaaacagcuucccaccuccuuggauccaagaagaaccaaauuaaggugcuaaguuuauacauuaauuuuuuuuuuuuuuuuuugccgcagacaggaauggaaauagcuuucuaaaagguauuuuuaaaaacugcuuuuuggugcuccauuaaaaggcucuuccgccuugccuuggagucucugcaucugccaaaaauacuaugaaaauugcuaaaacacagugucuguuggcucuagcagguuugccagccagcuccaaauaaucuaaaaccugaucucacauucgauccgagauggaaggcacacagcucacucuaacggugauccaaaagccugggagaaaggccucucugggguugagagguguccuuaucuccugggugguggccacaauggcuuugccuguaucuuccuacuucccuucccagguccugauuuguccagccaacuccaaguccacaccauccacuugcagugucuacccagaugaccaacaugugucuugcucccaacacggcucagaggacccaugauuucucuaguccacgcccugcuuacaucucuccgguguacacagccuugccagccccuaguuauccaaguccaaggccaccacuggucaggcuggaucccucucuuucuaaaacgagccugccugccccuaagcaagucugguaaaccuuaccacuuagcccucagcccccuuuuccucugcuccugcuauguccuccugcugagucgcuguaggaccuacuagcugccaccuugucccuuacagcaagagagaacuuuaaaagcacauuuaucagaucacaucacugcugugcuuagaguauccaaauaagacugaggcauucugcccuuccuuggggugggagcucccucaggcuucccuucgagugcuuuccugugcuugccuggcucaucggcuccaguccccuguuugcuugcuuucuccugcuuuacagccucaggagcuuggaacuggcugcucccucuggaacauucuucccaagguucauaccggugguuuccaugugacucggucacaguccagaugacaccccuuuggagagcacagaccucaaagcugguggccuuucuugucuauguguacaccagcauccuucccacuagauggccugcccugagggcugggaucucaggacaggauuucagcggucuggagcugcguccuguguacgcucugguauguaggccucugugauugaaugagcgaggaccugucccacaucacccaccuccacgcacgugugcaccaggagcucgugaccccucgcuuguuucauucugacaguggcuagggcucuugcugagccaccucucauuguacucagacccugguuagaagucaccagcccagugugggguagcaggaagguaccuccgaaggccugcugggugguacgggcguaaaggguuucagaugaaaggcagagcaauuccgacucugcuacuuauacucugcguggcuuagacacaccauuuauauuccagguguccauuguccuuccacacagaccacacccuugucaagagcuaaugaauucuagguuuccuggguuacagcaccugaucuuguucagguucugagguucuuacacugccauggaugaaagagacaagcuuuugggggaagaauuauagcaagucuucaauuccaaugaaaagggccuaagagauccuagugguccucaggaguacaccauggacccuacauuaacaacacagagaagucagcauccaguuugauaaaauaaaauaaaauaaaauaaaauaaaauaaaauaaaauaaaaaaaaacuaccuagacacagaacaucuaauccuauacaagaaagauacacaaaugaggccuggcccaucccacaggaugcuggccaugccuugugccuggaguggcaucuauucuuucccuuaguggcucuaugccacauuuugguuaugaugcagugauguccccagcccagggaccugacacaaggguggcacacggcuauagagauaugauaagauuaaaaacaaguaccaguggccauccugugagccaggauaaagaggaauccaggaacaaacuuaaggaguggauuccaaggcagggcugcugagcugagaccuaaauccugcgguagacacagcugugguagaucaggaggacuucguaggcagaggagcggucagggcgagaagugugggcucuacuuguucuucagaagagaguagagagaguggggucuuccuguggcuauagaaugaccugcgguagcgggaagccagaggaggccggacccauugagcccugagacauggguggacaugcaggucuuccacccaucagcagaaccuuggcuugagaucugauuuguucaaaccaugaagagcugauuauaaguuuuaauugucucuggaaacuuugaggccuuggagccgagugaaaagacuccuuacaugguucacaauaacggucuguuaacacauuccagacccaauuuauccaagaacuuguuaaaauucccucugugcagccagcaaaggaaugugauuuugaagucguuuacuuaccaauaaauuacaaugcucugggaucauuagcagcaaaguaaauuguuuuaauugaucugaacuucguuacgacccagggacuccgcuccugugcaaaugcacuuucuaagggucuaaaauaacaaaugaaucucucuugaauccugucaucuuuagaucuguucuuucccccagagaccaggaaaggggagagaaucaaugguggcaguagauauugcugcauggcccagggaccgcacaaaacacugcauagauauugcugcauggcccagggaccgcacaaaacacuacauagauauuaccaccuggcccagaggccgcacagaacacugcauacagaaacacugcauagauagauauugccacauggcacaggggcugcacagagacacuguuccgggagcugggucucugugcagcuagucuuugcaauggugggauggugggggaagugugaacuugagagcuguccugugcugauaucccucuguccccuuguguugucgcaggcucuguaauuguucacccacagguuuccugcagauucugcaggugcuguuugcauggcaauacaaacacaagcuaauuuacaagugaacagacugguguguagccuaacaauggggacauuuuaaaaaaugugugucaggugaccuaagaacuauuuauuuguuuauguguguuguuuuuuuucuuuuuggaggggucauguguguuacauucaugucacgguaugaauguggaggucaaaggauaauuugcaguagucucuccuucuaccauguaggucucagaguuugaacucagucaucuuggcaguaagugccuuuacuuucugagccauuuggcagucuuuaucagguguacuuaacacacacuaagcuggcugugaccuagcaaugucaaccuauguguguccccauugggccuaaaaccacacguguguucaugaagaggauuucacuuuuauuuguguacgcuuguaugucucugugugaaugcccguggaggucagucaaggguguuggaucccucagagcugggaaccaaacucugguccucuucaagagcagccagugcucuuaacugcugagccaucuccccagccauaucuggauaugcuuuagagucagguguugugugaugauguugaauuaugagcuguuccuagggaaggcccugugugcugagcggggagccccgugagagucacccuccucuuuccccuuaauacugcugugagccugacuuucuguguccaguggcucugaguguguaccaaggcauuagucaccgaaacaggaccuuaaagggacuggaucugcgucaugguuccucggauccauuuggaauuagcacuggccaguugauguuucccaucaacaucaucagggugggacauuacuguagcugaugauagcuaguggacuaauagauuacaccauggguaaaggacaccuccagcugcucugccagucacaggcagcaaggcuagauaucucauauuauggucugugugugcagauaucagcccagggaauggcuugcaggguggugggguucucuugaccuucauucuccaggguuagcaaugaggucacauagaggcugcaggagcagagaugucccacaucagucuaaaccaucccaauguguguucaagccccugcuggcucuccacaguucaugguguucugugugcccggaacuuccuuccucugacugcuucuacacagggcugggguuauauggagaagaagcuaggcccuggauauagagcuaggcauaaaugcugguauuuucaaguugcuuguauuuucauggaagcaacacugacuuaugcucaaugaaugaagcauucuuaacuggagacggugagcuagugacccuuggcacagaugcauagggucaaguagagacucagcucuuggcccucaaguucuuguuuuuagagcauuuucuaugguccuaucaagcuggggaauaugaaggacacgcugaccucuucugcaugcagcccugccuggcacagcuaguaggcgugggagagaucaaauacacuugccaggacaggaccuacauagccaggagagcaguggagguugaacaaugucacaauaguuuaucuuguuggcacugauggagaggccucaggagauaccuguccaguuuaccagggguggagcgauuuacaucucaaccaauccuuccuauuaugcccagaagaacgggaaauuugaggcaaggucuuugggggcccaacaugaggcauuguucagccuuccaauggccaaucccaccagaacagagaaccucauagcuagaaaauagaaccugcaggugcagagcagaguggaagggaacuauggacacagagcuacgggacacaccgcugaccaugcucucaccaagggucccaagucuucaaguucccagacgucccagagccaacgucugcuucuuaugaugugagugacagaagaauguuccaggacaguaagccugaggacucugcccaggcucaggacagggagacguccagccuaagugggugcugggugccugugcugcagcaauaaaguacuuggacaaaaagcaaguuuaaaaggaaggggaagaggguucaugcuggcacaugguuugagggcacaggucacgguggcagagcuuagagucacauugguagcaacaggaggccacagucaggaagugagggcuuggguggggggccguguuuucaucugguuuguccuuuucuugcaguccuggacccagcuccugcauccaggauaggucuuccucccuccauuggccuacuguagagcaucccucaagggcauccagagugaccugucuccuaggugaugcuagaccccaucaaucugaugauuaaccuccacaguguagaaccucuaggaagucacaccuccuuugggcacccugucccuguuagcuccaaggagccccagcccuuucacaggugcuagcucggcccagcacuucaggaugagcugccuguccccuccaugaaggggaggacuccccccgcacccccagccaagcccuaaucuuccaaggaggcagaaucaaauguuaaugggaaacacuuaacaugggaagggagucuauuucuccuuaacugucucuggcugcacaggaucccagggaguuauugaagguaaauugcuugguuuucaauuuuaagcuguacuuaucugagcucgaucagucuucccugaucgcggcagaaaauaauaagugcccgguacgggguugcccuggugcucaauaacauggcgauuguauccccauuucauuauggaagacagagagugcugggugcaaguuuauugauaugauaaaugguuccucauauccuuaucugugaaacuccugccugaagacugugggcaggggcugguaccuacuggaagagccauguuauuggcaucugucugggcguaccugcuagggauaaacuugggauuacccugcuaaugagggcacugcagggcgucagcguggccagggcauacucagucuccugaccuggauuuaggggcagguaugcugcaugaggcuugagagcccaaggucugggaucuacuggauucaaacuguaugugcccaccuuucaaugccuuucugaaauaaggagacaguaccggaagugguuaggcagagccaacugguguccuguggucauguuagccucugggcuacugggggcaacucccaucagacagcaagggaagagacugaugguugcucuggguucccagaugaacuguacuggccacagaugcccgaggacacugaggccugccugggcugggugcuugcccugugccauucugugagaucugagccccagaggccagggcagaguugauagucacucgcaggcugccuaguccuacucugcagcauagaaguugccacaaagauuugagcgacuggaugaacaccagaagcagaucuuagcaaggcauccgggaucuguugcccaggguagaagcuaccacgugcaggcuuaggaggaggcuggggcagaaccauuauauucccuuccugaacaaccauugcuaguuuuggaggcaaggacuuuucuguuuccagagaugccuucccuuggggcgaugugcaccagccacugucaucuggaauccucacacaguggaccccagacauggcagcugccaaacaugacucaggucuuucagaaccgaagugcacagggucccugaggccucaccccaucccgaguacucaucuuuaaacccuaauucaaaaauaaaugggcaggaaaggcucuccguccucaaccacguaaacacagaacagcaacgcgucggcggcacucggucugacacgggagccgugaggcauugcucacccagauaaguuuaaugcauaauuuagaaacaucaucaaaaugggaagaaagagaagagggcccuaaaugacucagaaagagcuccugugcugagcuccugaggagagagcagaggggaggcugugggcucaccguggacgcacaccccgcgcuugccguaauuggauugagacggaucccugagcacagugccuaggcaggacagaugcaccccuucugggagugggaagcagagcccugcagaagccagcauccaggcaugacagaugacacacucaacccuggcgggccccaaauucucugcaguaaaugugggauaugccaucuagauucccugguguccuucagccacccuuggcuggaggcugcuuccuugaccuagguagauguggggccuggugucuggaugagcagagugguggggaagggggacacacuuaggcauuuguguccccuuucuccuguagugcuggagguggaugcaggugacccuugccaggaaacgauugacaauuucugagcugggggcuuuucugcucuuugugaugcuugucugggggugggggacaucucagggacagggacaucacagacucagccugauauaucaaagacacuuuuggucaacaagcuccccaggguacucuaauuuccccuucauuaaagggguguagcauucccaggacagacagccaagauggcuuggaaaaaacuuggucccaugagccagagacccagcacagcacggagcucuuggaguccuguugucuuucugacauuucuuugagacucugaugucccugccuacaucagacacuuggagggugguggggucuccucuaucaagcuggcccggccuauugggacaaaucauuuguuaggcaguucuucuuugucaauaugccaagcucaguaaggugggagggaggcuguggcacacagaagagauggagugucacaugguuaugaccccucggucacugggggaaguuccugucaggcagcagagcggagacuucugguugcagaguccucuggauuuccaaagacugugcuagccauggguacugggagggcgaugggcccaggaugucugcugucaggccacaggggagauccaacccacccacugccaaucugcugguccuucaaauggucaguuggccauggcaaaggcgguguguguguguguguguguguguguguguguguggugauguugguugguggcgaugauagcuggugagguuugaaagcucccaaacuauagacuaugcccaugguugagacuggacccuguaggauacagccgguucuuguggagucuaaacaagacuccuucccaaaaggaacaagucucaggcaggugagccaggcacagucccuaauuucuugggauuauugacaaugcaagccaugcgugugccugcuuuaauguagcugcagacauccuuggcuucucccaagaugucucuguggcagggugguguccacacucaggaucccuggcuacgagagaagcuucccuccucguaacaucaaacucuugacccccauuucagcuucuuuacaccgggcccaccuaucuuugaaaucuugcuugccugggaacugcccccucugaccugucuuccaacccuucaagguuuaugugucugggguguugcggggcaugggugcuggccgaaggcucagccucaugcugaaccagacaagggugaaauggacaagguccuggggccaggggucuugggauaaugagaggugacugacaggcaguaccucccaguuuccaaggaugaacuacauucucuagccuuuauucuauaugaccuggccacccuggggcacgauuccuccuccuucaaggcugucugcuuuuggucugcgcagcucauugagcaccuguaucucucuugccuacacauucgcauccaaguccuguagccccuuagcucaggucuguucucauccgaucccuuugagcaucuccugcagaugugcugcccuccuggaucuuucccagcugccccagggccuuugcacggucauugucuguccagauccacagucccuagauaaugucacgucacucaggcaucugccuggauguccccucagcacagagaguccccuauguggccacucugccugagcccccguuacuccuuccuugccucugcuuuguuauugccacagcauuuaucacgaucugaaauuauauuacaggcucacaacccaauuccaaaauccauaaagcucugaaaaaccaaaagcuuguucauaacucauuugauggcgaaaacgugaccugaacggaugcaaggcuauuuauagcucggguucaucccucuucgugugaauauucauacauuuugcuguagaaauauuaaugcguuugauuacgggguacuguuccacaccccgcuggggacauuacauaauauauggucugcgaacuguauuaagucucugaguguucccgcuggguuuccaguccucagcaucccuggucucaugggccagacggcucugcugugggggugguucacaccuuagcagacccucuggccuccagccuaagaugcuugccagcaacauccucuccuuagguugacacaggaugucugaagacaucaacaggcucucaguuaagguccccucgcuugagccuaucuggcuuaaggguuuucaaaagagggaccuggccacuucugguuugguucccuucccuggcacauggcugcccugagucugguugugcugcgcccugcuguguccccaggacuuggugacauucaucaugguuuccuuauuugguuggaucaaggucucacuccuugcaccaagacacgagacccccuucuucaagucccccacaggcuguaucccuagagccuccccucucugcuccuuuugugagaauccugcuacccuugguggcugaccucucucuggcucuugucacccagugaccuguuuccugcccugacucauuuuccaccagcucuaaccauuguucccucuggucagugguggaaaauuccacauguccuugugggaaucaagaguggaaacccagccuuccucccccccccccccgacccccccccagcucuuccaucagccucugacuguggcucccgugucugccaucucucucccucccucccucaucuuuagcaguuucuucuuagcugcacaccacugaugccuaaagaaaccaaggauuucaugcugagggcggugucccucaugcugagggcuuaucaggauguccucagaguccccucccagcagagcauccugaaccauccuggauggaucaccuuucugggauuauucacacccccgggggcaauccagucccaacauccugccucugaucucauaacggcagggcugaccucagagagugaagcuuuagaguggggacacuggcccguguccuccucucgggaggugcuucuuuauaaauagcuaggugcuuauccauuggcuagaggcauguuaucccugaaccaucuggugaacucacccaccuugggagcaaacccaggaauucagagggcagacacacgcaggggaagcaggggacaggaggccaggagcugggggaguugauaagauuuuauccuguuuacgccaggaagaucaguuucugcccacugacauuucagccuguguuugcauacguucguucguucgguaggggagaguguagugguuugaaugucuacauaggcucgcauaccugaacaauggguccccguuugugggcgcuguuuggaaagcuauggaaacuuugaaggggaagccucuccucccuuccaguuucucagcuuccaccaugcuuauugccauaccuucuuugccauauggccuuaccauccagaacuagaagccaagacacgcccuuuuucauaugaggcuuuuugguccugguuucaucacagcaacggaaguguggcugacacugugagauuaacuugucucgggaagccuaguaucacagaggacggugggucugaaagacacuccuuucuuaucccuccccaacgacuccagccggguaucuggagcucagaguaccaagccuguuccacuccacaccccacggugcuuccugcccaggccccuugcugccacacccacagguucccacauauuuccacucuuccccgggugaacuaucaugucaaagggggacugccgaagucaugcugggccgcuuucuccaccaagggagagcugagugguucuugauggucuccuguccuucacagucaguuuccauggucaaggucaccaaggggugugcuccaggacaaggcuacccuugggaucuggggaucuauuacacccaacuucuuggaggagacagacaaaugacccugaacauaaagaggguacagcccccagaaaauucuggaagauaguuguaguguccacagcagaggugcccauuuccuuacugcuccuggaagcacggucacccugauggcugugugacaguucccagcuuucuuugcaucagguauggcugcgugcccgaacaccggucaacaggguaugacagugauguaccaaaguucucagggccauuuuaaaaagggagggcugugccgcucuuuccuggcagcugggaugucucuaugacagcuggcaauggggcagacauauuggaccacaagcagcugaagcagaugguuagaagaagacccagggagccuggcucccuuagacauuguuggagacacccagcaagccccucccuggccagcucuguugcagcgagagaaauagaccuuuaaccuuggaacuuuuauuuguguuaaaauuaguauauacauauuuuuuuaauugauaagugauuccagcucacgagaaucuagagcucaggcagaucuugccaggaauaauuccggaaaguucuuuuacggcugcacugcagugugcugagagugacugaagguggcgcagcaacguccugggagcgggggcagagagcaggaagaaauuaggcagguagaaggcugcucuuccugagagacagaugggucgcuuagguccacaguucucaaccuuccuaaugcugggaccuuucagacgguuccucauugcuacuucauaacuguaauuuuguaauguaaauaucugauaauguuggaugucugacauguggccccugugaaagggucacuugacccccaaagggauugcgaccuacaggccuggggucauuggcgugaugaugguccuuucugcccucugagggcagcugcuuugugcccucaucggugauaacuacagauuccuaccacaggagggcccuauuccccuggaggcugacucuuggggcagacacuggcuguugggagacagagccagcaucaucaaagugacagaaacaacuuucaggagguccucuaggaacaaguccuuccagaaaguaaccacucggcugggucgaggaggaagcagagagacgucugcugguacuagguacuaaacuugucaugcccucuacugaggcuuuauuuaacucucuaaucacucugugagaaacaggaagggcuccuagucuucugugacagccugggaaacugaggcacgacucccagcagggcccuuggagagaagcuaaaacugaaccaugucaaccaggaggugguagaauccaggaccacagcgggaggauggugcuggcuucugcugcuggauuccuggcagcagcggccagggcugacgagucagagaucuagaaccccuauggccccugucuaacuggaggcuugucucuacagucccaagggucacucacaacugguacauuuugcagggcucacccauaacuggcagagcccagugggcugccaugccugcaguucucugaugucugccuuggccgggcuuuccucgggauuucuggugcccaggcuggcuauuguuucuguauuuucuccaaauuaaaaacccaucgcugccccuuccuagguaaaaagaguuacuuuucgauuugaaugugugggagagcauccccagggaacagaguaaugaagccgcuagugcuccuugcaaaacaaauagauagaucaauguuucaauuuucuccacgugggcaaaggaacggccaccguugcuuagcaaucggaagaacaugacugcccgccccucugaggugguaguaaaugcacagaaguugcuaggguccugagccacgccagagcaaccaccacgugagcacccuaaaugagcacccucugggaugugugggagcccaggaaggaggcuggagacaaccccagaaacuggccuuuuagcuucccagugcccacggaggcccugggcaccugagagccccaagggugucagcagugaggcuuuccaggcagaugaugucauucggacacuaugggcugcuggguaugauggggguggggggcggagaacugggaccuacugugcgggacgcugcuucugccggcagacuugcaugcagcucagcuaggaacggccgagcagggccucugcuuuucugcuuuuggauucuccagggcucuccagcaccuuugccucuuggagcucaugguuaucauguguggaugagguagaggacacaugucucccacauacuggggaggccuucuuggaugaggcugugguaggcacaggguuggcaaagguagcuaggaaagagauucccccucccucaaaagagcuaccccaaggucacccugagcuagcagucugacccagagacuguggugccugggaccgggcaguucuucaggcugagggguccagaguccucgagccuggagguuuagguggccucaugauggcugacugggauugccagacacccggggagcagucaccggaaguuguuauaagccgcuucaggacccaccucuuuuccuacccagagcaggcuggccccagacucagggaguuugccugauucugcauccccugcacugggaucagagacagugccaccaugccuggccuggucauuggauuucugcccauguuccccugucacccuagggucuucugaguuccucaggagccuuguuugacuagaucgacucauguggggaaccugccacuuguuacuggguaaucugucagcuaccuggcccauggggaaggaccaugaaugcuaauguccugugacgucugauggugugcccugccggaaagcaccaaguuucccuaccagccucuuagcuuacuucucauccuuucccggcccacuaugcccgagaccccacccuauuucucuaucuuuccagugcuuuuucuggaagguuccuucuuccucucuacgaccccucccccagcaacucccaaagccagcccagauguucaaccaaaggccccuggccuguccggagggaggccucuacuccuugugggcuggacagacagacuuggcuagaagacauccccagcucccucaguuucuacccagugccccucucuggugugcucacaaggccuaguauaccccugcucccugcccaugccucgcucagagcagggaguagaggugggcugugagcuggcugaauggggcuagcaagcccaaggcagaugaaggccccuuuucacaguagagacuaccauucaucccugaaacauugcccagugacaaagaagacccaaacuuacaaguccuuggagacuuccacucugccugucucugugccuugagggagcauccugcccugagcagagcugugucucugcaggagagacuguaccuaagaccaugcucauguccugucuugucacagcugaccaggagggggcgccauggucugugucaccagaagcagggauggauggcaagacugguuggggaggcccaagaagcucucuggggcaaaucuagcagcagcugcauuugugccagguagcugguccuguuggucucagcucugggccccugauuggguccucugagaucacagugugaugucucccuucuguuaagguacugaguacauuuccagggaucucuccugguugcuguagcauacccagggcaggcuagggacgucugccacaccaaugaauuguccaaaggcuccagccaccuucccugucccuagcuaaagagcacaagaauucauaggcaguucaggugucauggaacauaucaggcacccccuuggcacagugucuccuaauuccugccucagccauguucucuaaccuuuucuacaguacuggaguauguagcugacuucugaugccgacgaugacagaccauaggacaaggggagucuuucugacauaggccacagugagagucugggguuggaugacagccaaggggcucuguuccugaaacucaaguuccugagaccggcagcccaggaugcucuuugugaccugggcauugccauggagaagcugcacacggcucaggaccgggccaggccuugcuuguccuguggccacaaagcuacaggacacauggugggaacacauggaacccuucuguaagcugcaaggaugaugccaacagcuguguguuggggggagcaagagaagaaggaagaagaagaggggaagggagggagaaaggagggagggagaagggagggagaagggagggagggaaauaagaagggggaggaagaagaaggaauggaggaaguaaugaaggacggaagcaggggaggaaggaagggaggaggggaagggaggagagagagaaggggaggggagaagagcagagggggaggggaggagagcagagggggaggggaggagagcagaggaggaggggaaagaagggcggagaggaaacaggaaagggaagaagccaccuccagguccccguaggaacaggacuccuacugucagggucaaauguguuugggaaacgugugucagcuugcuuucugucaagugucaguauuauggggacagugggaggugcaugggaacccaucaggcugucucucccuggauaucacccucacaugauucagaauacugcuuuuguggaacagcaaaaacuagugacucgaaacagcuuuggauacaacuugcuagaacgcaggcuggcgaacaaucacccaagcugaugcucauuugcuuuauaaacaaggcuuuacuggcacagagccagcccgucuacccagccacugugucucagagcuuuccagccacagcggcagaauuggguguugugacaaaggccgcaaggcagaaaguacucucugugucuuuaaggaugacacggcaacacuuggcuuuagacccaggcuuggaagagcgcguugaagaaauggagugugggaauggaaagucagccugacuauaccauagaaguguuggaaugaggaagguagcuuggugaagagccgcucaguucaugucuacaguggacacaaguucucccgggcuugagccuugagggagcauccuucccugagcagagcugugucucugcaggagagacuguaccuaagaccaugcucaaacccugccuugccacagcuggccaggagggggcgccauggucugucucugucaccagaagcagagaugggguggcaagacuggcuggggaggcccgagacgcucucuggggcaaauguagcaaagaauccucaaauaaacacagcagggacacuuagagcuccacacacgguguaucuauggauagccucugggcugugguccuggaugggcagaggggagagggcugugaggacgcccucugcaggccucucaugucacaguauuguccuagggccacugugucccgguccccucccuuccagcacuggcaggugaugacccccccccccauccccacucugguggauccugcacacuggagccaaucuguguccugacuaucagggcacacagagcuaugccacuauucaaggaccugcucuggcuauccagcacugcuccucugucccauaauggcaucuucuggcuuccuccaggaggguaugcugagugccuuguaaaccacagacguuuauauucuauggcucuuguuuugggaaguugaagcgcuggcccauuuggugagagcucgcuuccugguucaacagugccucauggaugguaugaggacucucucagaccucucaaaaauggaauaaauaucaacaugagcccuucaaccuccuaaagacccccaucguguuggagaguuaggaucucaacauauggguuugggggaggggauacaaacacuuaaucuacaccaacaaggcaauuaauauugcccugucuuccaaggcuagccucucuguagcgagggcuucccacuccccaccccccaucaccuagucuuuugcuaaaugaaguauccagagaggcaagaacugaaaaaaaaucacgggguaugauuaugagaauugagucauuaaaaaugccucucccacaacuccugauaccuauaccagugacaggcauuaccaauugaucucagauuuccucuuugagccagaacuuagauuuccccuucauugaugcuauaaaagagaugagauuauaugccauggguugucugggauggaaacagaggacuugagaggucaggugacuggccuuaagucaugaagugauuuaaggcagagcaggccuaggucuucucucuccuuuccucuggcccgggguuuuacaauagguauaugcaugaacucuguauucauauucuagaaauuaguuucugcaucaagcucuuguggggaauggagaucuguuaggaaccuauacauccaggauaaggucaggucuaucgacccagcuguccucuuggugcuuguaauuuagauacauggaaagugggagauaucuguccagagagcagagaugggccaggguagacuagaggaacaaaggguacggcagagccuaggcuucuguuucuggccaucacgggcuucacuuccccucgcagggucaggagacuuaagaaagaaucgcccagaggaugccaggcaagcacucggaauuggcuauagccaggguauagugcuuaacaugagcaaccccugggcuccuugcuguuuccccaggcagcaggauggccuauuacagggagagaacaagggcagaggggagcaagacccugcuggggaugagucaggagacaugcgcaaagcagggguccagagcuaggcauggcugccauuggggcauggcugugguugggcucuauaccauuauugaaccccacuuuuguuguccugggggcccuagggaaggcuggggugagguucagagaagccgagccugaagggucugggguuuguaagagaaaaugauccaauggucggaugagagcugcaagccuguaacucuuccccugucuuagccaucugaccccuggccucgcuccaucuaagcuccggaagcccaggcuccuuuuccagaggcagagaggucugaggcuggucaagaggcuuagagaaggacagagccgaggagcagaauaaacagcccuucuucuccggaaaaugacccugcugaucccggaguuaaaaauaguggcguauugaucgugggcugugccuagccagcaccaguuaucugagccucacuggcagaaggaccugucugacucagccacucagguaauuuauuuuuuccauucaguagccaggaaguguccccugcacauccugggaugagccacgacacccccuaaccucagaguucaucauuccuauguuggggugcuuaacccuagggagagggagaaggucacauuucucuauuuguuccucaaagacacugcagggucuuugugggaugacgugucugcucagagucuuguuuuguggguuuauaggacaaccuaccgcucacggaccacagguccaagcguagcgcacgguucaggccuccacaccugguugucccuguugcuguccaucagagggcacugcagggcaccuggaccuuccagcuuccuggugaugaccagaccaagcuacuucucugagugguggcuuguguuuucaaugugaguccacgguggguaggaggauguggagagggauggggacagggugccagguguuuucccaagaaagacacugaacccaugugauuucccauggguuauccuguuuacucaggcauucuccucagcccuuuccauuacagggguacagggguugccucugaguaaaauccgguuccccaaaaauguaugucuacacggaacaccagaaugugacagugucugggucucuagccuaggaaugacaaaacccagcaagagucacagguacuagauucaggccuagguaggcuuuccucucagagcccagggaaggcccugacccacuugcaccuccauuuuggaugcauggccugagagcugugagguagcaaggauuugucgucucaggcuacccgcccuguggucaugugguagggcagccagggaucaaggcuuccuuuguagaaauggcuuaagggcuguaucaggauggcaaagaaguagccgugaucccugaagccagcagcaccccgggcuuggaguuagaacaucagagcuccgcaucaccuucugaggccuuggcuuugucacccuacagugggcacggucauccaaacucacaggaagagcgccaaaagccauugcaggcccaccugcuagggcaguggcuguggaguggaggguguggucccgagggcuaagggcacggcuuuugcuuccacugcugcccaccgugcccacccagaucuggaagacgcuagguagaagaaucuggggccggguacaggcagaacugaaaacguggcuuuagaugaagccauugcuuccgaggagaacuugaacuaugaaagccgacggacggucuagggccagcaccuggcucucugugccgcuguggccagcagacgaaagggcacaccaaggagggagaggcuugcaggcggcuugagcacagccuggcuuucaucaugcagggcccucagccaacccgagcuuucuaguuugcucuucuuugcccuucaguccuuagcagcccucaguccugcuauggccuggaugcuccugcccuuuccaacauugaagcugacauucuagacucagagguaacacauuaggugggggccucaguggggugaucaagccauggaccagagacgaccugagugggaucagugcccuuucaaaugaggucugagaaaccccucaccuuaucacaggaaacagggcaucugugaacaggcuagcccucacuauacauggacugacuggugcuagcaugguggugaggauggagaugaugaugauaguggugaugacgaugaugaugguggugaagaugguggugauguuggugauggugauaaucauuuauugauuacuuuuuuaccugccagguaauauucuauaagcuucccaugcauuaaccuacagcacaagguugucacauuugcugauguggaaacaggcacggagaaguuuggagcuguacccgagagcauagagaggcuauugacagagccuggcaguaaagccagagaguucagaauccucucugcccaccuuccauggggugggcaugagcccaggagagaguacuugucagagacuugaggggucaccgacugcuugcucaucagaagcaccugaaauauauacagaugcaaaauagggaaaggugguaagaggaaaaaaggggggaggggagaaaaugaagaaggaacaaacaaaggaagccuccagagggaggggaccgagggccagagggaccagugccugcuguguggcggguucuggcccaccuagccagagucugcagugcuugcagccugaagcgucucggaaggugccaccgccaccaccugcuugcucugcuuggcaucagucuugagguagggaggagagaccagggcuggaagcaaguuuggcagagccgggcuggggucucuuugguauucuuugcaggacuuggaacucagugggugcuuaauaaauguuuauuauggguaauaaaaucaaccuuguuuacaccaggacugucuccaaagaccacuuuccauacuuaaaaauaaccuuaaucuccucucgccacauccuccacagauggggucgacucuacaguaugccuggcgagggacgagaaggccuacagaccacacacaucccagcuuagcucuccccaggcccccaccucugaucucuggagaacccgggacacagguugaccccuagaucuuccucaugggacuuggagguaugguggacucaacuguaucccuuaccuuaauccaaaauuuggaaccugaaccuuacagugcaaccagaaaagauggccucccccaagugcccagcuccuuccucagaggcuccgugcacagcaguguccuggauguucccucucacaaauacacuggagcaggacaugacucuucagugggcuaaaacuaucucagagaggugccagucucacuagccagcccuaccaagcaaagaugcccgugcccacagaguaggcccuucuggggaaggccugccuccuguguggagugugcucagcucucugcucccaaccucacauucucuagcagguggucugagacacaggcuagcccacugugucuagagagugggucugcgggccuggguagaccuguccccagccugagcccaugcccaggaccacaggcccugugaacccucgccuguucuuuuugauggauacuuccccucccuccaucccucucucccuccauuccuccuccuucccucccugugucccucucugcuucucucucucccugucugccuucucuauccucacagaugcucacccccccccccauuucugugguuccuaucacccauucuccaaacccucuuuccauaugagguggugaggacuggacuucuuggaccauggcuaugacuacaggucacacaugacaaauauagaggucacacaugacagauauagaggucacacaugacacauccaugugcuuccccuugugcacacaaugcacacagcacacaaagacagccauuacuagaacuugcugcaccucgcucuugcugcacagggcccggaauggugauggagccagcagggagcugauuuuguuuucuggugcuggguauggaaccugggggcugugcccaugcuaagcacaugcuccaccgcuaagcugugccccaagcuguggcagcagggggcuuagagagcuccuaagaacucgcuggguaaagacgaggcccucucuaauuaauuuucagggcucgcugcaaacugcagcgcacucaaucccaaggcagccgcguccugcagccgcuuacaaaucacagcugcagcuguaacccuucuggcugccaccuaccucgaggaaggagaggaagccuuggaggcuggccuggcugagggagaggcaaggcagacagagagagucuagcagccagcuuccuuauuccugcagaaaccucaggaggaccugggagauggugggggaaggggaaugcccaggaagcgugagacgaggcugucccaaggauagccuccaccaugguccacuggacagaaugagacuuuugccuucugcuuggcucuaaagcccagaagugaaggucucggcucagagagcaguguaaccuggcccuaguccucacacugagcccugaagacuaagugucaacuccauauaacagucccuguguuugccuuguccuuuugaggcacggcaugggaugggcaggaggcgcugguuuccuucuuuucuggugcggugacugaagucaggugcuugcuaggugaguguuguuaccacugaguuuaaugcuuaagccaguagaccuuagccaggccccaaggggagcccaggcacagggagacacccgccagcccugccagucuaucaggccugcugagccuugcugauugccugcacuuuaguccucgaggguggcaggcacugggagccagugcuacccaggcuccucuguggaguggggagccaaguugcaggcaugcuuauucucagcagcucugugcaggagcuccugacaaacccaggagagugcucaugccgggauacaguggcucacaaccaacaugugaguagaagaaucccugacacacagaaauagggcacugggcuggguggaccaaauuugauguguagauaugagugacaaucagcaggucuguguacacuuaugcucggguggcacugagguguggccggggucaggggcaggaggaacacugcggaaugucaagggcgaggcaggaagcagcuuccagaaaaauguuccugucaguaccuaacagccccagacaacucgggguugcaggugcugcuacagggagggucucaggaggugaggagcuggggaagcagaggguccccucacucggagacuggaggaugcgggaaccacagacaggcuaaggauuuacaacagcugcggaaacaccagacccuucucugcgggcgcuugucuaugccagccagaggagcgagauaagccaucugagaacauuguacgacaacucaggugguuucagauggcuacgggugacaucuccaaacgagagauaacgugucagggacacgugggcagugcugcauugucccagcagccuguugaggagacucaggcagaaguauuggcuuccgugggaagugaaauuucaacuacccaccuccuggauggugccacagugggaggcaaacugagucauccccagccacggcgagaaagugcuaagauucuuacauagugcucuuacauauuccaaccaagcaaguaccccaaacuguccccugaaagugacuuuacgagguucagcugauugauagaguagcagauuuuagagguucccaaagcucugggcaugcugaaccccaugcccugggcagccacagccugcuuaccucuguaaggcuggcuggaacaggugcucccaggcaaggccaccucuggugugcaacuaugcuuggcaccgcuaaucuaucaccuaggccaugaccuucaagugggacaaguucuaaaggaaagaauucucaggacucucucuggaggcuuagcaguauuucugugaacuagggcaugagaugggggcaagcuggcuguagugcagcuaggaaagcagccaucaccuuacaggcaggggguagugaauuucucuccguguaugagccauuccggccucugggaaguagggugaggagccaucccaucacugucuuggcucaggaagagggaaucccugauaggaacuagucccuugggacccuucuugccuaggucaccccauaaggaccauacgcuggcugugacugaguuggccuggugcccgcgucccuucugggggaucuagcugauuguuuacugggccaaaguacagucaggccagggacucacugucucuguuugagauuauuucagaagguuugguggugccccacucagcaggagcugggagcccugucuccuacaggaagguaucugaaugccucaucuugccugcugcuggucugcucaugaagaaaagguuucugcaacaagggaggagccauguccagagucacaccaggagugaggagggccuguuuccagugccugcagccgcucuuaaagucugaaccacgugucacggagucuccaguucucuugggugauggucuuagaaggcuugggcuacaguaaggaugcuauccaucucccucugguggccagccuucucucagccuuuuuccauccucugccucauugagcugcccaccccagguaccacuugcuauggcuuuauucacucauaggaaugcccuuaggucauuuucuuaucgggcagauggggucccaagcuugcugacaaugcaucuucaaguagaugauguacuucaacccagagaucucgaagcacaaacccucacaacucaccccugaugaccuguguccgguccagcggacuucaugucauagcugguuugggggcgugggucauauccguggcccaguugccugugcaucguguggccuaaaaggagcacagauggucucuucucaccuagaggggacaaggacaucuugcccaugucacuucagguccgcugcaggccauucuuauauucagcucaguccccagcccugagcucagcgggugagcauggaccaaugucuuaggggacuucagagaaccagggacaguggggccugcagaaaauaggcagagccaccucagggccucuaagaaguugggugggacuagggccuucuguuucacuuguccuuagagacacagccagaaucccuuuaacccgcaguagggaugaccaggagagaggagucgccauauugaagguggauauccaucccauuuaggucagccuccugccucaggcucccugaggcacacauguuucugaaggaaguaaacauuuccuuggcaaagaauucucaagaacgcggaacgaguuucucauuuaaaaaaugcagagguguucuggaaacugacuugggaucucuuuuggaauucuccuccaggaggggaaccugagcacugcccuucaucuccccagugcuggauugaggaggaaacacucauagaauguagguguagccacagaguugccucauugaaggcacgaugaucuuaggggcaggcucugggccccucccucccaaggcugugaguguucaccugucauggagggccuuggucaauggaaucaccuugcucagugccugcguccuccucccccccccccaaaauaaacugaucugcggccugaacagguccacugagcuccaaacuuugcccccugugaaaaucugaagcaugcagcugggcuggcugcccccuccgcucccugauccuuuaaucugagacuauuaaaacuucauuccacuucuauugguaaaccauccaucacucucaccaagcagcgcagggcugugggagcccagcgggagggcggcaggcagagggagggguaggcaggcagacugcccccagcugccugcccugccaguccuggccagaauggggcggggaggccgcuguccuugaagaggacaaggcucgugagugaagggacaugacaaagugaugucagggugggggacauggcagaggcuugccauggccgcaggagggcugacuggggcccgcccucaauguguggaggcagaaccacaaugaagcagacauuaccauuggugccagcugacacucccugacccuggcacgguggucuuagaucucccuagguggcugcuugcuuccuauucuuugacaccaggcccuacuuuacccuggccuuugacaacagggaugaagcaggggcccaggccuuuaaggucucccacagaaaagcaacagcucggugcuugcaggauuacagcucuuuuucuuaauuaaaaaagauccaauuaaauuaagauaucagaacugaagaacgguugagucauuagugcgacuuucaucuuaauggcugcagcugcccaaauccuucgauuuuguagccuccugucaugguggauggacggacucuuguggauagaagucuggccugacuaacccaggccaggcagggucaggugaaucacccugccuccccuaccccaggccacacagaggggaaagcuccauauuauauguuaugucuuggggacaggauguggccaaguguccuuucuccgcacuugaugcccaucggcccugguggcugccacuacagggccucucuggaagcuaagcgcaucuuuacuguguuugaaggcuucccugaggaaggaagcugcuccgcuaucccgcccugaagccaggaaagccacuguacgagcugcugagaccugugcucuggacaagugggaggggccugcuaugcuaggcuggggcccaggguucuucauucccauauucugagucccagaacucaguggagagcagagaggggagagggagcagaggggagaacagagaggguaggggggagaacagagguggggagaggggagagggaggagaggggagaacagagaggguaggggggagaacagagaggggagaacagagagagaaaaugggagaacagagagaggagaggggagaacagagaggagggggagggagagggagagggagggagggagaaggggaggggggagggagaggggucaagcucauucgccugucucuguccuuugcggaacccucauugggucuccuggacuccauuucuuucuuuucagauccagauucagacagaagaggcgcuugcuggcagcccagacacucaaauaucccccggugagcccuuccuaccagauugcacagacuccauggcugcagcucccagggcaggguuccaucucaguauccuaugucuaaguuggaaucaaucagaaacauagcaaacucaaagauacuauguagccauucaagcccugggcagagccuugggagcagaaaccauguucccacugaauuccaccauaugucuacaaagugcuucgcuucugcaagaaaaaauuaaaaugaugaaaaacaaaaacaaaacaaaaccaaaaccaaaacccaaaaccacaugcuacaugugcuuuucuagaaaauacggagccaucaagaggguggcuggggacacucaugucccgggcugucccagcugggugagagcuggcaggcaugcaguucugucagugacugaggcugugggagagagauggagcuggccgggauccagacucccagguuggaucuuauaugccccuugauggcccuauauaugugacauggcagaaucuggcugggccuaagcgaaggccaguuggaaccucaggucccagagaacguugagccccaaguagcuaugggaguggaggacauaggaugaccaggguguggcaagaagguugccagcucaaggcacagggcaggggaaagaguaaaucucucuaguucauguuggucggagccuccggaugcaaccucgcuuggaaauggugccuuugcagaucuguuuacuucgguuaagaugcagucaggaccgacgaggguagacccccagauccgaacacuagugucuucaugaggccgggggauuagaacacaggcagacacgcagggagaugccaccuuacaacagggcagacauugcccagaggcaggugaauuugaggccagccuggucuacagagugaguucuaggauacccaaggcuacacagagacacccugucucagaaaaacaaagcuaaauauauaaauaaauauuugagacuuauguugugugggcauuuugccuccaugaaggucuguuccccacgcaugugcccaaugccugcagagucagaggaggaucucagggccccuggaacuggagucauagaaggcugugggcugcuguguggguggagucauagacagcugugggcugcugcuguguggguggagucauagacggcugugggcugcuguguggguggagucauagacggcugugggcugcuguguggguggagucauagacagcugugggcugcuguguggguggagucauagacggcugugggcugcugugugggccuuaggaaucaaaccaggauccucuggaagagcagggagugcucuucacugcugagucaucucuccagccucgagguuuaacuuuuauuacuuuuuaauuauguguacgugagugccugagucugggcgugugcacauggggauagaugucugcagaggccagaggcaucaggucccccagucucucacacuagggcugccugcccugaucuccacaggaccagguacagacaaccagcgaccaauccuguuuguaccagagccacuugaugccagcccucccuccuggaccaccccuuccucuguaaaugucugccuccaccucuccucgcccucuccgcccugacugaccuggaugucucuucaaaggacaaggcccacuucucugcgugggcucugugggacgacacacuggcuucucugagauaucgucucuuagaugguagcuaacacaaugacaguggacacacgugagaacccagcagcaugagagucgggcuggcugcugggaagggcccuggacuugggaugcuuaagagacaagauggacagaucugguggggaguuggugauuggauaguaugugagguuggggguggggugggcuugccacccaagggagcuggggcuucugaggggaauuagguucauagagggcaaguuucugaccuuuaccagaaacuucgugggaaccgggcccuuucugccacuguugcgagcaggaaccccagauucuaggcucuugauucagagucugaaacguguagucuucuccuucccuggacccccuuuuccccucccucccucccucccuuccuuccuccuucccucccucuuuccucccuucccuccucccccuuuucucugaaucgugaccccauauaacuggcuggccuuuaacuggcuguguagcugacaauaacccugaacuucugaucugccugcuuccaucccccaagcgccgggauuacaggccugcaccgccucauaugguuuauauaaggcugggaaucgaacccagggauucacgcaugcuagacaagugcuucaccagcuggguuaacaucccuagcccccaagcuuauaguccuggaggcgcccagaccugagcucgguccucaguaggagauagagaacaguuccaugauacagcccaggucucagaaagaaagaaaaggaagacaggaucuaggagugggggucacacaggugucagaggggcuccauugguugaggaauagaaguucagugucaccugguuugguuauaggaaguuaugaagcuaucugcccuccugggucuuucccucgugcacacaagaugaacaucaccaugcugaaaguggaggaauagagacugccacuuucccagguuccaaagaauggagggcucugugauuccaucaguagguccucaaguugccagucugccugcuccagagaggaccacccuccacugccucagggggcugcugaugcccuuccuacuuucuggaagacccuggagcugcauggaaugggaaugucuggaaguucucggguuaugggaggugucagccuucgcgcaucauuacccagggccggcagaggcagcugugaacucugcaaacccucuucucaccuccauuagcagauugcuuugggggcggggaacccaaccagaaauauucagcacacagccuugggcuccugccaucaggccugggcugccagcuguguuuccucugaagagaucuggcacccacuauuuuggggugaagcaaaccaaaccaaaggguuccaguaacugaggcaaccccaaagggucauaagagcaugugggcuugggacaacuguggacaaaggggcauaagacauagcccaugagaagugcaugugugguauuuugugaugcuggaaauggaagguagucaggcuggagauggcgauaugaggaagccaguugauuccagcuuauucaucagcuucuacugacagguggcagcugggggccaagcugacgacucugaagugcagguucaguauaacauauacugcaaucuauuaguaaugucuguccugggcauaggaauggaaaguggaggcaacugggagauuugcuguccucaaguuucagacugguuuagaaguaagaugggaagacaagcaucaccuuccagaacauuccuuuggaaguguccugaagaagcuguccugugcuucuucagcacucucucuuaucucaaguaacuucuagaauaggagaaaccaggaugcuggugugaacucuauauagcaaccaggacagacuucccucaagaucugugagauaauuggcucugagaggaaagcaaaguagagggagagggguauucugggaaugguguggggugggauggaaggagaggauggagugaacuuggaagguggggaagggcuuccagcaaggacuucacacuguacuuggcuucagcucuccucuaggccaccuucagugucuugccuucucuuccucccauucaggcugcacuggaugcucgagcagagcccaucccuugugucccaagagacauucccucccaggucuggggcccgguguggaccuggcaucuuagcagggcgcccagcaucugcgucucagucugugugggcugucugcgguugcccagguuggggcucccagccccauucuccacagugugugacucuuacccaccagagcucuggcagcccgaccccagcuccugaggccaugccccaguguuuggguagcugccuucccuuuucuggaggugaaugcagggcagggagcagcuucccucaucuccuuuagccccacauuaggggggugucagcacagucagcaaucagccaggccccaugcagauggggcacagcagaaucagccugaggguggcagcuuuucuuucuguuucucaucuuccuguuggguuccaugaaggcaaggccagagugggcugcugugaggggguguuguugguuauucuuuuuaagaguucauuacuuucccuuuuguguauugagcauuuugccugcagcuagguauggccaccacacgagugcauugccugcagaggccagaagagggcgccagacacccggagcuggaguuaacagauggugugauccaccauguucuaagugcucuuacccacagaaccaucucuccagauguccuguucuguguuucuucaguacuaucucuuaucucuaguaacuucuagaacaggagaagccaggaugcuggugugaacucuauauagcaaccaggacaaucuuccuucaagaucugugaaauaauuggcucugagaaaagcuaaguguuuuuuccccccuuugagagagggucuuacuaugcaacccugguuggcgugaaacuugcugcauagaccaggauagccucagauucacagagacuguuggccccugucuuccaagugcaugagccaccaugaucggccuucuuuaucuuuuucaaagggcugaccucucuuugucacuuccagcaugcccuccucacaucccucuguccuuccuucccuccauuauagacucgcccacacacccacucacucacccacuuauccacccacccaggcacucacccacucaugcacucagggggcugacuggacagaugguccacacuguagauagagucuuugaugcucaggcuuacagauggcuuaaugccaaaaggagcagaguuugggaaguagauggagggucccuccaugugcccuucauaauccugccagagacaccaugacacauauguuugugcgagcacauacacagauacacacacaugcauacacauauuugcaugugcacacaugcaugcacacaugggcaugcacauagacccacaugugcaugcgcacgcgcgcgcgcacacacacacacacacacacacacacacacacacaccauuuccugguagcuggaugugggacagccaggccuccacuuacuuccugucacaggaccugucuccugggcccgugugggcgaugacguaguaaaugaagcucagaguggcugucaguuuauggauccuauggauccucucccugauuucuccgaggguucuuggggguuccuggggugggaccccaaaguguucuacugcacuuuacagaggcugcugcagaccuagggggcucgugauggcucagaaagaagacuguaugaaguacacaauguauuuccacacucgggaagcugagacaggaggauugcuaugaguuugaggucagucuggcuaaagcgagacugucucgaaagaaagaaagaaagaaagaaagaaagaaagaaagaaagaaagaaagaaaaagaaagaaagaaagaaaaaaccaaaagugcacggcccaauaccaaugggaacaagucuauacaggagcccacugcucugacacucucccuuccuggcauagcucugggcauggcucugggcugggauccuuaggcuaugaugaagccuaagacaagggcucucccugcaaaggacuaagcagcugggaagggcagagagcuaagcagaacaggaaucagaugccaaagacaagguauggggagaccaaugaggucaagccccuagccaagccaucggggggggggggguggcgcugagccguucccaugauccaaugggaguugggaagcuucuggagucagaaucucuuuucuacuccaucuagacacuuuccuaccucagaccuccagggagcuccaucuucucccauggguauugugguccuuuacaugggagucaaguggguggcagaugccugcgcccagguucucaguaugugucugucuuacucagagcuucaccccugcaccagacauugcuuccuggcacucaggguagcuugguuuagauuuuguuucccuuccccuuccuucccuucacucaugaaccccaaaggucacuccagaacccuguccagcugagucgcugaggcagacaccuauaggauaaauagguuccggguaaggcugagaaaguccauagcuacacgcuacucagagcaugcuuucuacaguagaccuuucuagaagcccuggcagacaggcauggagcugaguuaucacgcuccugaugguauuuauugagccgucugugaucucuugguucuguggauaacagucuuaggaacagggcugcagaagguugcaguaggccuuccacucagaggcaccccggaaggggguagaaggagucauaacaucuucccauggucaucuucuuaacaagcucuauaugggacuccccggguacaggaaggaacagaaccagggaagcggcugagggagcuauucaaagcuauggaugcagaacuguagagcagacccaaaacuguuucccagaacccaauaaaagggacaacuacgugacccaguugacaaccuauauauuuuggauuaguuauaauuguuguuauagaucucucaaaaacuacacugcaaccugacagcugaaugcacauggucuucccaggccgggguaaguguucuauacucccuacuugccuguccuuuacagacauuacuaguagauaacagcacucuuuccccuggaaauagccuggagauagcuucagaaucuuuccuaugauugauuguuuucuugacggauaaggggaaauugcucacaguauggcccucucaagggcugucagagcccaggcagagauaugagauaagugguuuguagggagcuuggucacauguguaaacauauuucaggauucuaggagacagcuuauuaagaugguaaauauggucauaaguaugggauaaacuuacagacacugaguguauuuucuugcucuauccacuuacaaggcucggaucaacaauaucaagauaaccaugugcacacagaggagcccacaucuucacuuuuaaauaucacuuuccucucaaaguaaccagggccuuugaagaaaugguggauucuagggaaguagagauaugcuuggaauucuguguucagaacgugggggaaacgcccacagaguuuuggcucauuucacauggugcagaagcucaccagccauccaggucugagucaaccccggcaucacaacagaccaucuggcaauccauagaacaaaagaggagacuauuagucuauaauagugugaaaauaaacaaaguaacugaagguuugaggagggaugguacaaaguacccacucccagaauacuuacuaacuaaagagggggagaggcuaacuggcauagggacagaccaugucaucuuagucagugugaccccuaggccaucuggcacuuggggccccuuggugcagucggauaugaagccacaaagccagaaucuccucaggaggagacgcugacauccucccaaaugaugggcacucucugaaacaaugaauccgugacucucaaagauggcagagacacagaagccaaggacagagugaagaacaaacacugcagaucgaagcggaugccaagggcauugggauggcuggugggacacacuggaaggcuggggacaccagggaagugugcugcaggauccugaucugggagcucugagaaggcuauguaggggaacgcuaagguguccaggggccaaggaggcuggcaacuugcaaaugauccacagugucuucuaauuuucagcaaauuugugaccacuuuaaaauuuuaaaaaaugugaaaaauagugaucagaaaucaagaaaagccaaaauaauggugaaacaacuccuaguuugaaucauuaggaaugggacacagaugacacaguaaacuacaacaaauucacccuagaauguguguuagauucuacguggaggugacucccagcuggcccugauuucugguuuucauggggaugaauggaaccuggcucaggucccugagucauugugcugaacccacucaggcagagaagcacccaccaggaccacugcaggacuucuggggccaggugcaaaaccaugugacccaccccuuaaucgagauuuaccaagaauuucaagaaugaacuggcccaaguuguagacucgggaucugguccuuucccuaacacuuggcaaaugcuguuguccuucugagaacaugucaauuuggaauacucacagguaggacuggagacucauauaccacagauaacucuuccauaggcuuaacacuggcaggaucauaaacaucccacagaagggaaugauaaauugcggucuauucauaaaguggaauaucauguuauauaagguuagaugaacagaauagcuuggggacaaaacacaaacuuauauaugcaccaugucacagccacaaggacuggcaggagauuugcugaagcagaagcaaggcuccucucugggugacuuuuacuauuuuuuuuuucauauuuuccuauagcucguaagcgugcuacugugaguguaucuaauuuuuuuaauuagaauaauauuuuuaagugguuaagaauaaugcauucauuuguuacaacgagcuccguugccucuguaauuaaauauuuuuaauaaagaaaaagucgaagaagaaaaaaggcuaucgguggaaccaauauuuaugcaccuccucccguguaucacgugaugggggcugugggcggcgggggaugcagaggaaccuguaaggagcgaggacgcugcucccuugcucaucuuuuccugagaucugcugagagccagaguccaccggagcuggugaugguccccagcuccugccagccaagccuggaguuuuuggucacgugaccacggaccacacaacuugcuggggugaugggugauuugccuguguaaugucuguguguuucaucggggcacgccucggaagguauuuguuaaacauauuacccuuuaauaaucuauaacuuaaaaggcaacggcagguugaaaguaaucaauaccacauuguaauaauuucaagcaaacagagauuuauauuccaugcacccuggacagcaauuacuuaacucuucuaauagacuugcggacgaggcuuuauuuucccuuaaaccaauuugcuuuauugaccagaucaagucuuguggccauaauaccaacccuucucccaucguccagcucagcaaauccagugcccaucaauaauuaugacaaggcggcgauuguucccucuuuagagcugagcuauuguugaugagcccuaucuagaguugucauuuucugagucucccucuucuggauggggaagagagaagaaggcccuacucaugcuacaaggccauggucagagaacaagucuaaacauggagaggcagauaagagagaggaugcaaacggacaaacaagagagccaggagccaagcguggagugugggccacagcagcuggagcagcacagaaaguugcuuugcucagcacagcucugaguucucuuguggcaagagucaguuuccuagggacccugugccccucaguuccucaggucgauguacccagggcaggcugggagcaacucacuggagcaugccguuagccagacaucagugacccacucccucccuccucaugguggagaggcagcuucauguaacuaaccagauaauucauucaacuucagagagguaggucaaggcccaccaugacugggucaauuaaucacagcugagaguugcacuuggcguugggcucucagcaauaguuuucuugaccuuuugaaaacuguauaacuauauaaguaucccucaggagucuuuaacuugaugcacuuuuucauccucaacuggccuguggcucccgcuuguaaucugggaaggguuagcaccagacccaugcaucuagguugccuccuugggaggccgaggcaagagagggggcugauccacaagucugugaggcauaagccaugcaguccuuucugcaucguggacaugugcuccuggaagucagggcaucacugaacucucggccuagggugggaaggggucugacccauaccugggacguaggacuguugaaacucuccucagcuggggccacuguucugggcaggcugguuuguucagugguuucaugacaagagugucagcuaguccugauccucuggugaaaccugguuccaagacugagcucacuuugucuaagcccagacacucuucaguucugaugcuaggccccaaucuggccucucagagagcaacuucuauaucauuuguccguccacccauccauccauccauccauccauccacccauccacccacccauccauccauccaucauccauucuuccauccaugcacccacccacacaugucugcauccauccauccauccauccauccauucauccauccacccacccaucuauccauccaccuauccauccuuccauccaugcacccacccacccacccacacaugucuccauccauacauccacccacccacccacccacccgcccacccacccaugcaugucugcauucaucuauccagcuaccccuccaucuauccccucaacugaccauucauucaccacccauccauguaauuaucuauccacccauccaucucuuuguccauccauucaucuccuuauugaaccuccucauucacauaccagcauagucucaggcagugggcccaccuccaugaaccagacauggcccuugcagugaggcuggaucaugucaacagaaucguaacacggagaaugaugcuguacagggcagguacaggguuuagagggaacucggaggaaggugugaugaccuuucaggaagguaaggccuccuggaggaaguggcuuccuagccagguucguagggggaacagaggcuuggccuaaaaccccugcagcgggaagggugaacccagcagaggccaaugcuucauucucuucgcagcaucuuagcuccgaggcucuucugacacauguccugauuuguccaucgggagcuucaguccacaagggggccucccaucccugggccuugaugucacacgugugcucucauuccauuuugcacacgacacacagauugggcugcgcacugugcugcacacggcccuaggaggcgcuguuuccacaagcugguaugauagguccucuggaaugauccagugcauuggccggagagggauauucuucucucccacaaagaaauaugccgagugcuuccccucugaaugcauggaccgcucgccccauccuucacuggccacuucuguaaaaacaaccugagcagcugugaguauuucuuuaagaaaaaaagccacagcucuggcggugugagaaauggcggccuggcuguuggcuggccugaguacugggcagagagagagagagcgugggguguggcugguggccagaugcuugccagccuguuaucuggggcagcugcucacaccagcuccucccuguuguagccacaggggggcguuuagacucacuaggcugaggcuuccggucuucaagaagagccacguaaucugcaggcuugugugagauugaaagguuuuuagguagagucaaugguuucuuuuaaaaauuuuaaauugcauguguguguguguguguguggcacgcaugcacaugcaugaucaugggcacaugugccacaucaugcauguggauggucagaagaaagcuuguaggaguugguucucccuggggaaucaggcuuagguugucaggcuaggcaucagguggccuuacccacggagcccucucacuagcuugcacaaaguuuucuaaaacagugcacaggguaaguaugugagagguccgguggaggagucuacccuggcagccuucacccugggggccgcaggcuuuguggaucuggggacugccacccacaggaagagucuuagaugaugggagggcagcugguaggagacaggguuuaggccccuguagcugguagaacugagagcuuaaaugaauuuuccagaccuuucaaagccuggaugccaaggacuccuggacgccaucuccuggccucuauagacagugcagucacgugugcagacacuuacgcaaccaaacauccagacaaaaacaaauaauacauaaaucuuuuuaaaaaagguuucaggguucggagcaguuuggauuggggaugcacacugugugagcccuggacccuuccaggguugaaugaagaagaugggggucacuuguguccccagcuuuaugcuaccugguuuaagcucaggcucccaugggucugaacagucagugccauguggccuuuccagaaacgucugagucguaagcaaagacagacuugggugguuagagcuggggcuuacauaacuguuacacauuguagacagugauagacaccaauccacuaacauguauuuuucucucagcuuugugccccaaggacaucguguugacaaaggcugaguaucccccauccaaacugcucuaaacccugagccuuuuaaaaaccauuucuguauuauuuugugucugggugguuuaacuggcguguauguuucugcacaugugagugcagugccuacagaggccagaagguggcgacagauuccccuggaacuggaguuacagguagugagcguccauguggaugcagggaacugaacuugagaccuccacaagagcagccacugcucuuaaccacugaacuguugcuccauucccuagccuugagacauuccugagugccaaagagacagaggaaaagucugugacaaacgcuaaaagccagguguggugacuguaucucauuacacauauguacaaacucuaaaacccaaaaaccucaggcuacgcgauguucuugagggaugccagucuguaguuugaaaucagccaugauggaaauuggcaaacacuacaaaucaggcuccuuauucccaccgccaugcccauucccaccaggaugcugguccuuaagcaucugugggcgcaccauucacaccuaacugaggguccugaggccucugcuuuauuacuuccagguaaauugaugugugaugugcacacauuuauucacaucuaucaaaugaugaaacaggaaacaaacugguccaggggugaugccaaaggagggugcauggugugugguuugugugugugugugugggggucuguuuuaugaaagagaagaguggggaaggcccuucugagaggaggagguccacccuugucagucacagcugugagugaaaacuccagaaacggccuuucuucuacccuccaaggucugccuggacauggagugucccucugaaaaguguucgcccaauaaagccacccgcaauuagcaucuccugucuuccaaggagcucaggagugcuucuauuugucuggggcuaaaggguuuggauuggucuccagggaagugauugauuaacaaggacagacugagcuguuuccagggaacagguugcuccauuucucguucugggggcccuucaagggcaagaggcucccucugaggagaugggacccagcauaucacagauauguuucccagaccuggcuccugaaauacagccuuuggccucagcccuucacccacugacccugagucugguggaggccagacgccugcagagcuggggugcugggcucgcugcagagcuggggugcugggcucgcugcagcuggggcugugcugcuugcuguucuggacgaggcucucuggccuguggagcugaggggcugaaggugauggcugucagucucugggcagaguguauacuggcggcugggguuauucgaacugagcggggaggggagaaaccucaccaacuguuuggguugggugcucuaacagcagagggucagagacaaaguguccuccacaaagauauccccaaguccuguccacuuaaucaugcuuugucccauaaacuguggggggaugcaugccuucugguugggccauaugccuccugcucaggagagcuacaucugucaacuguggggaagaggcccugcgggcagaugcucagggccacccucugacauuaagcaacuguuaccuggcuggaccagagccucugcuuaagccuggaacccacaggaaggauagucaaggugugugugggggugucagccuaccacacccaguuugugugaccagcuccuuagaggaggugacgucagagaacagaggagcaaggaagaugagcgagcagugugugugugugugugugugugugugugugcgcgcacgcgcgcgcgcgcgcaugugugcaaucauuagaccugaggccugggguggaagcacucagccaggggacucagggagggcagcucaggugcccucuugaguguuaccacauccggccucagagccagggcggggucgagggcugggaguagagggaaggcuucagugggcccacaacuagaaaguuucacaucuuauucccagguucacacagaugugggcgccugccacucagagauaaaacuccugcugggcaggguacccagagauagcccacacguccuccccagagcagagcaggcaaggaagaucagagggccuuguccagcccuugccaguuucuuuccagagcaaggacacugaacuagcguggccuagcgccgccaaaaucuugucuguuucagaaccauggaagaacucuggcaggaagugaagaagagaacagggaaacuggaacccagagcaaaggccgggagccugcacagggccaggagugagcgaccucagauacugugucuuccuccuccuuugauuuuuuuuuucuuuuuugcggaggcaggguggggcucucuacucaccccaaagcgcugagucaggccuggcugguuuaaugagaauacucggagaucuauuuugcauaagauucucaacuggcugcccccugggagcccgccuccaccggggaggaagcugcuggguuuuaugaggcccguuucuugauuucuccgacucuggagggggcgccgcuagggaaccucugcccaccccugccuuacucagcauuuaccuuaauaccaggcagagguuguuagaacccgagucuauaaauaaaggauuugcaauuaaggcuauuaguuagcaucagguggaaccuuaacgcuggagccucgaaucucaugcacauaaauaggucuguacaguaagcaucucauucugguuaaaaagaaaccagccggaguuccuugcaagaagcccucucuaacaugcgucccaaagaguuccugcccagcugggcucucauggguguggguggaucuagugcuggggacauaggagaaagggcacccagaagccuccuuguccaaacccuguuuccacugcagcaauuaugccucacaggggcgcuguccuggccuugcaccugagagagggcagggcagacguugcuucugucuucagcaggaggcugguuagcucugagcccauagucucaauacacaauaaugcuguggaaugggcucccagccaccacucuccaaugucagacucugccucuucuccuaaggacccagcccucuuagaaaaacacuuaaaagccagugggaggaggggccauucccaagaggcaccuugcuagaggggggcgggguagcccugauccuuuagagcacacucgauggcuaguuaccacugucaacuugacuucauuuagaaucuaucaaggaaacacggcagugcgcguaaggguguuugcgcaaaaguuuaaccgaggaagaaagacuaacccucaaugugggcagcaccacccacgggcuggaguccucccaguccuuauuuaaaggagaaagcuugcugagagcucuagcauucaucucucucugcauccugagugcagaugcgacaugaccccugccccuagauccuguggcccugccuuccugccuccauggacuguacucuccaacuguaagccaaagucaaaccucccaucauucuagaaugggucucagucaaucagagucuuucaucaacaggcauccccgcuggggcucacucuccccucuacagaccugucucaaugacgggugggguagcagguccucuaggaggcagagaguguggccuccacacgccagccccuucacacaacacaaaaccacaacaucuuuuucucggaugaaacuccuccccuucuccugcccuucccucuucuccacucuugccacucaaauuucugaaugucuuccaaaauggagagccauucauaaccagcagaaguccaguuuauaugucccugagacagcuucaaggacaagccaugaauauggccacugggcugucucuaaagccaccugugggcucuaggagggagaagaaggagccccacgccgggcauaacucuuuucugcugugacggcuacaacacuguccugggcaguggaaacacgcagccugcgcuucuccgcccacugcaaaggacucugcuggacaggaccggacacagugaggagagagcucacugugcagugccacuaucuaccagggucacccuggguuccucggcugcuuaccaggguggugacugugaccagcuacaggggaagugaauccugggugaaacgugagacaaacucauguggguaauuuguacuccaucucaggcagccuuuuccagaucucuccccagacaccccuccccaaaagcucggcugacgugucagagaaggcaccagggcauugggaagauuuacuccuugcucucucugaugaaggcuuggagcucagugcuguugauacaaacuaaaaauagccggcggcccccagcuucagccuccagccagucuccgcaagauuaggauggcucucacguaagggaagacuaauggauuucuuccucaaggcaauuaaaaagugauuugucacaccccaagauguauggcuuuguauuggcagaccagaggcugcauggggcggugggugaugguggcacugagggguucccuggggcucuuugaaaggagcagagcagaacacggugggcaguggguaaaguaugugcaguguagacacagccagggcaagcuuggcaaaggggccucuagaaaagcccuucacgcugaagaaagaugcuguccgaacauuuucugaugucuauuuagcuggagaaguuuauaaacucaggcuugguagcuuccuguggcuccuucagcacccuggagagaggaauugggacuccugcacuuguggcaggccauggaagguccugucuggaggccuccucuauagucacaugugugggcaggcccucauagcuuccccgcacaugauauacccucauaacggcugugaccuggguaggccagcacagccuccucacaccagggcagaccccaccuguuaaccccaaucugggcagacccaucuccaguuguauuucugggcauguccccacagucuuuccauuccuuggcagguccccuguuuagucacacguguaggcaggaucucaagcuuuuccccacauucugaacacaacagcccugcucagaauaaagcucagagcccaucucugccuugcucucagcucucaagcccucugcaaagauugguagcuguaacuuguaaccggaagcugaaacacacuugcugucugaguguuuuuuuccuguggcugugacaaaaugcuccaagaggcaacaguacucaagagguaggagguucuuugagcuucaggccagucugagucuacccuagagagugaguuccaggacagccagggauauauggugagacccuguccccaaaacaaaagcaaaaagcaacuuaaggaaggguuuauuuuuagcucuuaauuccaggucaucugucaugaccugggagucccaggggaaggggcuuagagcaacagguuguuugcaaucagaauaguaaagauuuaugugcgcacaauggcccucagcuugccugcuccacucagcccagcucuuguccacaauuaagaugggucaucccacaucaauuaauguaaucaagggugucccccaaaggcagagcauggaugagucuaugucuuaucaaguugacaacugagaguaaccaacucacuaacuaggcaccaacuuaaaggaagcuucuaggcuggugguacucaaccuccuuaaugcugcaacccuggaaugaugugagccuugcugugguaugacagcagaacagcaugggcacacacugaacgcucauugacacccccacccccagaguccacagagugggugcuauggugcauauccuacagauagauacaggauggaaagcagggacugcugaagggagugggcuuuaggcuguggaagacgcacaguaguguugagcaagagaaucagcucucacauugcucuacucuuagcuuccucauugcuucuccuucucuuucuuuauccuuucugcucucuccucucuuuugcucuccuuucuuccauucauccaucuaucauccauuaauccuccauucauccaucuauacaucuauccauccuucauccauccauccaucauccaucuauccacccauccaucuaccuaucuaauuauccauccaucuauccaucuaucaucgguccaucugcuauccauccaucucucuauccauccauccauccacccaucucaucuauccacucaugcaucucuacccaucuuuccuucauccacccaucccauccaucuauccauccacccguucaucuauccauccacccaacuaucuuauaccauugauccauuuaucuuccacccacccaccugucuguccauccgucuuaauaccuauugaucauguuaagaguuacucugugacagggauacuuuaguaauuuggaaagcccacauucucuuuuuauaguugcaacgcucuguugggaagauauacuaguggacauguaacugcacacuggcacauagcauaaggcagaggaagccuuacucagacacaguacccgaguggguacuguguuugcccuucugcuguguggccaugggaagccuccuuaacgucucugacccucaggucucauuuauacaacauacucggggagcagucaggagaucuguguugcacuggaugguaacauguaugaggcuugguuuccauaaaucauggaaauaaaugcacaguucccugcuccccgggaccgaucagugcacugcucagcaucaaaucaauaggcuuaauauuuaauaauaauccacugaaaggcacuuuggucacucaacgcaucagugccacacuaauaacaaauuacuuccuaaauuguuagccucggucccuuucaugaaccacugauuauguuugugacagcgagggggaagagcugaggcaggcugcagccccagccaagacggcugggcaaucuggaaccuucuguagguggcgccacaggcuggcacacaacuggcagaacugcccagcugcaggagagggguguggcaacggagacaggguaagcugcugaacuacugagcacagccagcaacucgagaccaccuccugggauugggagagccccaaucuagcccaccgugggcaugaguugagugcacacagccagcagaggccccucuagggaccaugggacaugaaguuugaugauguauggguggggcaggaagguccuuucuuuccuucuguccugccuaucugucucuuucaauguauaucaaagguaucccguugccacaaaaccugccuggaaccuuccuagcuuuguuuaaaaugcugauuuuuuuuuuucugagcauuuugacuaaaaagcuccauugaaauauuaucugacuuaucuacugguucucauggguccaccuuaaauucugcagccagguccugccccuuuacuagacccuaguuaugggcaaggcugggugagguaccagcaucuccaaguccuugguguugggggcagaggacuggccaaauguucugcucuguccuacuugccucucucucagacugugaguagccccuggguccugccugccuaucugguccugggcagcagccugcauauggucaguggguggucuguagaugcuaaggagggaagacucaagccagagcuguccugccuuggccauggcuugagauagugugcucaaugcagggagcaggggaagguggauggguggacuguagccccccuggugucacuuucccuucuggcuggaguuguucaggaaagugagugcuccuuucuacuggagccugaggaugcucagagcccuggugcagaaaaccaucagcuuggcuucucuccaauccagcgggacucucucugccugaggccacugaugauaacaauaauaauauugcuauuauuaaagagauuugcauaggcagaaauuguuucccugauuaagaacaacaacaaccaccaagggcaccggcaguaggucauccugcagcuguggcaagacaggaagccgugccugcagaagguuccagagcuggggcuaggcugggacaaggcggcauguccucugcccgcugccgaagcugggagacggaugggcucuggggaugaugcucggugugggaaaauaaucuggagucggcagcagcuccugaggcaaugcuagccugggccagucccccgaggacagagggauguagucacgugugguauggcaggauaaaaugaggggcacuccgagggaauguguuagaugggcuuucuguaggaagagugacaccccucaugcuguuguuaugggauggauggccuaaggcucaggcuugcugagugacucgugaggggggcaaacuccugguucccaaaguuucaugagugagagugucucucagagaguuagggggagggggagggggaggggucaucucuauuugauugucaaaaagcauccacaaaaucccuaguagggacagccgaauguggggaugucugucgcacucucagcccgcacaguagagggagcccaaggcacagacaaaaaguacaagacacauaggucggucuggcagaaauacaaccagcucucuagaugccauggaguucccagccuccugcagaaaauuaacccagacaggcaaggaggcucgguaaggugaugagagacaggauggacacggggaaucgacucauuuccguauucaaaggacaaacucgagagauggagugaaacucacaguugcgcucacaagagugccaaagagaacgaaauucugcagccgaucuguguacaggaguggugugcuaaaguggccacacuggugucauccgagacggggccuaagaugugaagcaucugcuguucauggacggaggccgcagcacagcgaggaugcuaauccuuucuaaaucuaucaaugggcugaaaccuaugagaugguguguauacuugucuguauguguucggauguacacgcauacaugagugugugugcgugaaugugcaugugcgugcaugcuuguauaugugugugcgucugcauguguuuguguguguagcugcgguugacauugagcguuauccucagucauucuccaucucguuugaacccagaccuugcugauucagcucguuuaguuggccagcuugcucuggggaccccugccucagcaugcaccaggauuacauuuacaaaguacagaggaccugggcuccagccuucacucuugagugccaaaugcuuuuccugugagccucaucccucuagcucccaaagcaacauuuucugacagguauauauuuucuaucauguguguggaaagacgcaggccucggagagcuaagauacccacagagguacacaaagggggcccagccuguacauugaggcugaccacagagugacaacaauguagccagugggguaccaagaagggacagacacacagaccagugggauagggcacggaacgcagaguuugucaggcaugaacaaguuuagcuuuuugauaaaggcacacagcaguuaaauggaaggagaguaauguuuucaacagacauugcuguggcaaugagacaucugcagacacaccucaaaaaccuccucccccaaaccaaaaccuagaaaaaauaaaaauaucacaaucccccugcagcacgaacuccaacuuguugcucugaccacccacauaacuaaauaccaaccacggacugagcuauagaaaugcuaaaacuguuaguaaaaauagaagauauuugguaccuagcaauaccacacuuacgggucuauaaagaaaauguuaguaagcuguauuuuaucaaaauuaaacuuaaaaagccucccacacuucucaacagacugacaagaacgucacucugugugguucggggccgaagacaaucauucgagagccguuaacaucuggcauaggcgucuuaagcaaugggaaggugguggugagggcggugaugauggugaugguggugauaauggugaaggugaugguggugguggugaugguaacagcugugaugguagugguguguaguggucacaauguauagugguguguuugggauucuucagugucucagggaaggccggucugggcacagacugugacauucuggaaggaaucaugaagugaauguugggacaggugccaggccuuucuaagggcuggauggacuuauccugaccacugcugucugcgugugguuccuuucuccucaagucuucccauuauagauccaugucucucaaccacacuuuuguugauggcucagggaagugggaccccaccucccugaagagcaguuuccacucagcauuucugcaggaggccccacccugugcagagucgcuaaucaaaucacucccauggcaugcauuccuuguggccaagaacuaggcuuugcugagccagccccaugcaucaccguggcaggcuguuagagaagaggggccuggaugccagagcccagggacagauuguaucuguucaugggguuggacagaccuuggcuccgcacacugggccagucacccuugggauccagagugugacucugaugacagaacuuucauugugugcacuguggaauggacaaggaacaaggcauucucaggcggagugauagaaaagcagaacacaggccauggggaccgagguguccccuccagcauauggccugccuccucguucccagagagugacaacacugugucuuuggagaugugacucacagccccagacccugggcaaugcuuuaaauauagaugugugugguaucaucugagcaaguggcuuuuaaguguaucuacccaucuguccauccauccauccguccguccguccguccguccguccauccauccauccauccauccguccguccacccauccaucuguccaucuaucuguccauccaucuguccauccauccauccauccauccauccauccauccauccauccauccguccguccguccauccaucuguccaucuaucuguccauccaucuguccauccauccauccauccauccauccauccauccauccauccauccgucuguccguccauccaucuguccaucuaucuguccauccauccauccguccaucuguccauccaucuguccaucuaucuguccauccaucuguccauccauccguccguccguccguccauccauccauccauccuuccacucaucugugacaucuaagguacugagaaggacucucaaagcagucacaacucaaauucuggaacuagaccacuugaguucaagccacagaugucccccacugaccuuuucacgcaggcuaggcaggcacuuaaccucucucgugccucaguuucuuucucucuaagauaaaggucacgacagcgaagaccaggagaggagguguugaugucuucgcgacugagauugacacagaguacagaaggagucaaccuucgaaacagucauacaagcacauuagccuaggagggaaagaggagcauugcccccaagaaagucuacuaaugacucugcccccaacuccgugcagcacagagugcggguccuggggcagugugagcagaugcuuuuuuaaaacuuggcucugcagcucugcggcagaggcuugacgucauagggccaugauggggcccaagacuuggcauuuucagcaaaauuucccagugcuucugauuuugugacccaugggcuggaaccuggggggggggguucuggagcuucucgcaguggggugucucuguucugaggcacguuuaggaggaaaggaagaagggaggaaggcacacuggauggccucuugcugggcccccacagguagguucugugcacacaaagcccuggcgcuggccagugaagggguguccaccaagugugggugauuauugcuuccccacccccaggaugaggggaucuuugaagacuuggggaguggagugucgugaaauaacauguuuuagaaagaccucugagaaucaauccugagacucagaaccauagcagggcagcuguuguccccaagaugagcaaagagacaacugugaaaagcgagcgagggauccgacugugcagacagagaggagaggcaccagccuggguguggcggcaugcaccucucccaccgucagggagguagagacagguggaacccaggggcuugcuggccaggcgucuaaccaacucagugagccccagacucagagagaaucccuacuaaaaccuaagaugaagaacugaggaagaacggacaggcugugagcugauguuugagagagagccucagaagagacgcagggaccugcagaacaggccacaaaugagccuagcauugacggccccugaaggagaaggaugcucugucaggcaggcagcuggaugggcagccuacagcccagacgagaggcucaaaacuggagaggaauuagagaguuauuguccaaacaaugggcguggcugagguggcucggggaagagauaacuugggaccaucaguuccacggagauucacaaagccaguuaaagccccauguccagcucuaggacacugaugcauggaaggggcuucccauugucucgccaugccagcguugcaaguguucagaguuccugugaaaaguguugcugugggcagagggcccuaaaggaaaaccaccuccugaggugucacaaacaauagcugcccucagugaggucugugcgaagcuuccagcccccucuuccagcccuaccuaccugcccagugccccagagagacagaucuggccaccuuaagcuccugcuuaucagggaaggguaggagggguggguuccacaucagcaccuggacaccuugggugucucaccuugcaaacgagcuuuugaugauuccagaagccuuuaauuagagcaagcgguuaggaucucgagauuaauagccacuaauaucaggugcuccuuuccuuucuuuaugugaagcagguggucuguccuaauggcugauguggcggggagguuggccaggagguuuucuuggggauugauaccucucccaggguccucugcuccugacacaggacugguccccuuccuaggcaccuauacuagccuauggcaucaugguucacagucuguagccuucgcaggacauuuuuuuucuggggcaugguuagguuuagauaugaguuauccuucccagaagcucauauguuaaaaccugugugugugugugugugugugcgugcaugugcuuauauguguggaucuguguaugugacuuuaugugugcauguauguacgugugugugugcauguacuuguguguauaugcauguauccgugucucuguguuugugcaugugcuugcauguauaugugugucugugugcaugcaugugcuugcauguguggaucuguguaugugucccuguaugugcauguacuuguguguguguaucugugacugucuguguguacaugugcuugcaugcaugugugugugucuguauucgugcaugugaaggccagaagucaauguugggugccuuuuccaauugcucuccagcuuauuauuuuguagacaggaucucuugcugaaccuggagcuugcccaggugaccugauugccuggcagugagaccuucuguguguccuccuguaccucccuccccauagcuguacgucaccaugcccgacauuuguugugggcgcuggggcuucacacucagguccuuaugccugugcagugagcccuuuaccaacggagccaucccccagucccuggugguucuguuggaaggcgaguggaucuagaaggacauuaccucucccacacauuccccuauggcugaucucacagcuggguggacacagcaggaggugggagcuccccagagaaaguggucgcugggacaggugugucuuugaccgaaaguggcuaaacaagugcccagcagaggagggguuuucccaggguggcuuuagaaggugaucaguguuggccagguucccucugcccauugaugggaggcucuauagauuuguuaugacauuugccuuugaagagauggaggcagaaagggccaagaaaaauugaugaacuguguccauguccuccuugggaugcagggccuucugcugcagccagcucugaaugggcacagggccugagggccugcucccaagggcagggagaacacacugccacccuggggggagcuccagggcucuccgauugcuuugacugaguguaucucuuuguccucauuuccucagacaaacucaucagugcucugagaugccaagauaccacugaggccuucacuggggcucccagugaugagcccagacccauaauggagggaguccauggaaagcagagggaaggaggaggcagaagagcaaggauaggagauccacuaagaaacaggucacgaugggugggggcucagccuccaagaggcucagcuaugcuucugacagcuuuuauuuuaccaguuuuuuuguuguguaucguuuugauuuuuuguuuguuguuuguuuguuuuuccaaauugcaaagaaggucaaacuggcccuagcuuauugucccagcuccuacauggucuucauacaucugucucuggucacauccaugacauauaggcuucacagcugccacaggucuauccagauguccucucagucucuggugggagaagagucucugagcccuuggccucuguuuuuaggcuagagagccuagagucucuaauggcucagcggcugcccaaacuuaguaauccagaggaccuaccccagucacaggcucagagcuagguauaagagggaucuuucaggccacccuaggggaacuuccucccacacugagacuugccauaauauguugauucaaacuaucuuuggaccugcuuccucuguuuuggacugguuuucauucccagaacagaauggauacuacauucccucugacgugacaagccaagauauccaagcggugucuagaagccuguguggguuucucuagacgccugugaccuuuaaauuuugaagauaaauuccagagaacaucguucuuccugacaccaccccuucagcaauccacccugggcucuucuucagcccaagcccccucuaguucuucuuuccuaugagaugaaaagaugacaaggaacauuaugcacggauguccuuucugcgcugagucagcacauggcaguacugaacgggagcccaaguuccacuguaucuaugacgugcugggcuuggcgccugggccugcagucauuacccccauccccuaagcagggagcacggcuucagggggauuaaaacguugacuauggccacaaaucaagcagacuuccucuccaacaaagaaaguccccugucuccuugcagagcagugucuuggaguuuaucacaaagaauucagcugaccagcauagaaaagauaccaggggguuuggaguguucauuaagaacaauuaagaaucaucaaaaguccgaccaucagaggacgauuaggcguuuguggaauaggauaugacggugucgcuaaagaagcgucccaagaucugaaaccccauagccuauaaugaugcaccugagaugccacucugugacaggagauuauuaggacugcuguguccaacgggagcacguuugcccaagcccacagucacgugccugagaguggcuuggaagcucacacacugaaguuugaaaaugauuuccaaguggugggaugucaugugauuuuuuuuuuucuagaaccccuuuccuuuuaugacugguucgauuuccaaaacugggcacggcugcuuuccuaaguagauaacaauggacuaugcagguuacaaagagaagacggucagaggcucacgcaucucacccuuccccgccgacauggcugccuuccaucugucugaacacagacucugucucuuuccucugcacauucgguauggggauccguuuugugacccuugagguguggcaccuguguucacuaucuuuuuuuaucugggguuuucaggauggccucugccuuuccuaucuauugucuugaggaaagagaugaaguauguggaacccugaaagggacaagcaggaacgaucccuuugcucuacccacuacugcaguaucucagcaucugcauccaggguacccagcauccagagcaucugcauucaggacaccugaccuauagcauuggaaagauccaauuuagaggggcuauuauacauggcuagaggaagucccucccauccaagggagagauacacgugcucuggaucugggccagcgcucugccuguccaccaccugcuguccccauggcuccugcuucuuccuggcuccccccaguccacagcaagccuccacagggaggcuuugggacagcagaacgauuuaauuccuauuacaguauaaaaauuaauaacauuaaaaugucaugaucaucccacacuaauuaagcaucuaaugaauaauuagcuguggacacaucugacauuuuuggucauuaauuugagcaaguguuuuaaguuccaaacaaaaccccucugugguggagccugugacuuuguguuaagaggcagagccuuacaaaguuagccugcucagacccugccuaugggaggcaggaggggcgguagguucccccucccugcaagaacaaguucguuguacacaaaggggucucaucuuucuucugaggauacaucuccccuguccuucaaaggacagcccuccccaaggccacacucuggccccuaauguuuuccugaaugcauuucuaaguuugcacacagugcuguggcacacaguaggugcuuggugaagcaacagaucccuucauccauucguggacuccuccaccggagugucugaccucaacagugguuuagugagugacuggggcuggggucaaggcaggacgggaggccuaaggaagaucugagccuuuuccuuugcuuagggagcugggagagguuucuagaaggggagacccccucucugccugcugggggugcacccccuguaauguuacaugcuguuuuguauccuuagcucuaucauguugugaagucccaaggguuuuaauguuaccuggugugggcucacugcugagggcauuagucgagaugagaucacagugaaguggagggcccugaucuacuggcuguugucuguauaagaaggcgauucggcuucagaggucaugacagugagagaguggccaauaugccuuuaaauucuaaacaguguacagucauuuucccucuuccuuauaaugcacaacugugcaugguaaccccacaauacaggugaggaaugagugugcaaugccacaggacuaaauuguuucucuagcccuugaguguguguguguguacauguacauguauguaugcgugagugugaguuuggugugugugcaugcacgugcauguaugugagagugcacacacaugagugugagaauguguaugugguguguaugaaugugcucacaugugcauucauuugcaugugugaguguguguaugugugugcacaugcccauguggguaugugggaguaugaguuuguugugugagugugugcaggcaugugcauguacugugugcacaugugucugugugcacgcaugugugaguguauguguguuuggguacacaugccacagcacacgugugaaggucaggggacaaucuggggcaguuaguucucuccucccaccacauggaagucccagggauugaauucaagucaucaggcuugggagcgagcaccuucaucugccugagucaucuucgcggccaaaacuuuaggacuugcaaaguuggaguuuuacgcaacgcuuugcuuaauuucccaguuuugacuugaaagggaagggagauggcggcaugcuguuagggcauggucuccaccuuugaagaacaucagcugacauguggaauuaaugaucacucgcaagcacgugaccuccagcagucuaucaaggaccaugggaagacuaaauaggucagcagaggagaugcugaaggagaaucgcauggagggauuaaggagggcagaagugaagcucccaggagccuuuccagggagacagccuuguguggguaagggaggguaugaaggguuuggucagggaucgagggugauguuaauguugcaaaggcacagugacccccgaaacacagcacccucaaaccagagcagggguaaugguccuucuuaugaaccagggugcucaggaggauccugaaacggggguccccgugagggggagcaucaggggacuguggaucuuagggaaugcgagaggaaaaccauuuugcauaaauagcacauuucugucccaggaacugcaagauaucuaguagagauccucaacucaguucugacacccccauaaaggccaagcccucaguguugacccccucccacagcugcuggcaacagggccaccacugucccggagguucugacauagggagagaggccccccuccccacccaccuucugccucucccucuacugcaggagcagccaaaaccaggcaucagagguggacccacuccaaucuguuuugacaccagaagccaucccgggcuucaucccagacccacuggaccagaggucccuggagggugcucaggcauugagcuccuuuguguuugaugggagacacuguccugggagcuugaucuuggcuuuuacuuucaaugaaaaugguagggcugaccuuaugcucuuuuauuuaucaaauguggaaucuuuuucuggugugaaaaucagucuggaaucugaggaacaugucucuaaucuugacacuauaagcuggagagcuuuaagccagccugggcuacacagcaagacucucaucuccccucccucucuccuucccucccccccgcuggccacagagggucuggaaugcuccuggucugaugucugguuagugacuuuuucaggcucucaauggucucagagggaggcuacuguuauaaauuauuguuguuccugggaugaccuugggacgacagucaguacacauggccuagaggcugccugagaggaagaggaucaucucaccuuuggucacccaacugucaggcgacaccugauucccucggcucauuugaucauuuacagauggcuucaggguccaugcaacucucucgucuggcgggaaugaugcuccaugcucacgaccuucacuccaggucacagaguuuugggaccuggccucuuacuccguggcaggucugcugaugucccuaccuggagccuggacccagcagcuauauaaggucugguccaagccucuggccuugguguguuuuuauggccuaguuauaaaccucugagaaauggggcuuauaauggaaacucugacaccaccuaaaauaugaccacauacugggugcucccagaacacagcccuaauuuauaaaccacucagggauccugggccauuuugaaacucauggacugcaauccagaaauggaguggacccagagagggaaaaauggcccacggccccuaggacuauaaagugccacggccgacaguccagaaaucaagccagugucacaauguuuggucucuguccugaauccuggucccccuccucucuggcaaguguccccagccuaguggaggccuguaguaguccucagccuguugcugggcagugcuuugggugugcaccaccuggugcuagugggguugcucgcuagcgagagggggcagaguggggaggagucucucuguugcuccuagggaugucguuaggaguggagaagaaaauaauugaaccgucugcucuccagacaucccaggucacugcuaaaugauggugggauugcccaucccccguuguauccagaucucugcccagccagaucagggacagccuccuucacagggccgggauccugccugggagggcacccaggcaagucgugcacaccuucagccuccccgcccaacucccgcacccgcccagccacagaaaccaggauggaaagaaaagccagagggaagcaaggcgguacuaacucaggcaguggcagaaggugucagagccuacgcccucaggaggugggcuggacccuguuccugcugcucagccccugacucugcccaccccaucccccacuucccucauuaguucuaacccacaagcaccugaacauauuccuaguuugaggcuuuguccuggggacacagaagcugcgaaggggacuugcaggacaaggugccccacuugugagagcucagagguccuaacgugggucuuccacggcugaccucuguucccuucucagaccacuguggagccuuacguaggguaacugucaccaccaacuucacauucaucacagaacuuuugagggucuuuucggccccgccucagugucuagaaguuuuccagauagauaccucuucugauggggugagagcagccauccuucccauguauugccagagaucuacagaggguuguguagagacaaccccaccuugcuucgagcacagcucagagacagagagccccagcugaaggcugucagugccuccucuuggcugcacccaucaaguaucucauuucccugucccuaaugcagcagccagaacaacccugccucguaaggucuccaaauggacuuaaugagcuaacaaacaccgugcacagcccugucggagacacagccaagaguucugcagaccuugcuugcacugugguuuguggaaagagaagugggcuuuagaggaaucagcaugagcaaaggcccuggggcacaaacuagcacugcaucaacaaagugauuuguagacuccuccccaggguggagccugcagggaggauuccucaggagacgggugcuucugcuagggaggcaggcucugcucuuguccccuuguaguuuguuucgggaggccuaaggggauggggcucugacucucaggcugguggcuccucagaguggggcuggcagcuucccucugcccaugcuucuucccgcacuccugucuucugagcuccuuggggaaaaugcaauuugagucaagccacuuucaauuauggaugcaguugugcugagcccaggagguaauaaagggcccgcucuccuucugggaaugcuugggguucuccgggauccagaggagagaagaggaaacagggcuaagugcugcucuaaggagcaaauggcuccacaguccccagagcugggagugugccuacacaccccgggcugccaggccccucggcagaggugcagucccagggaagggacaaggagaaaagggcuuggugaggcuggguguguucugugagccugugugugagcaugugugacugugaguccguuagucaucaugaguccuguguguguguguguguguguaguguguguguguuguguggggaggcccaaacuucaaaccacacaucuggagucuccuuggcucuucugggcccaagugaccuggagcuugcugccuuacgcugggaugcaggcaauguuaggugugaagggagcccccagauggcagugcuggacaauggccggugugacaggcaguguaggcucagcucaggcuggacucucacaggguagacagaaggauugcuaccugaacucugcauuccccagagaccuugugaagcaggcuucugucugucaggaaaagccuuauuucucucacccaccccucaaaaccaacuaacucugacaagggugggcauacaguuucugauuaacucaaguaagccugaacccuaagacauaucaaaguucccuuacugugcuggccaauaugccagcuuccccuacuuuuaacacaggccccuuccugcuccccuuaaaaccggcaaggcagucagcucuccccaugcccagggccuggcugcugcuauucuaucuacuugcccuggacagggcucccucucuauccaggcuaucuaggaggugagcagagaguguggacacagcuuauuugcccgggagccccugcugauccacggugcucaguguucccaggcaggggccgagaagcaggggacacuuggcucauuuuugucuccaaagagucacuccuuccaugagcagggcaaagagaagugacaccggaaagucacucuacuugccgcucuccacagcacauugacaucuaguccuuacugacucugugucccagaagccaccuguucccuggcagguucagcaacccucaucaugccagaaagacccccgugucucccaagcccugaggccuagcuccuuugcagguucaaggccaggagccuccauaccugggcuuacagggggcuugugaacuucuuaggaagcaggggcuaaaggugacuuccuggucgggggcagugauucccuccaggugcccucccuaaagcugacuggagcugaacucuguccaagcaagggaccgaacaggcacuuggaauucgcaaggagacucugccgagcugccggagcccaucaaauuuuuauuggacgcauuuccucuggagaacuugucuacuaaauccugccugggccguauuagagaaauaaaaauuccacacacagacucgacugccaauguuucugcccagagagaggacauacuuccucaaaagccagugugcagaggcuggccuuugaggcuguccuugaccagggauuggaggcuagcuggcagcucaggcuccagacggucaaguggcaugaagccaugcugggacuccuaaccaguccccguaaagcucccgugggccuuggccuaguccuggccaccugcaguuuccucguuccuguccaguccugaguagaaaaccaccagccucccuacugcuccuucccugaggccagggaccaccacaacuagagcaugggagcucuuggcuugugccucacuccuuccucuguagaccccggugcagaucucacugcaaacaccagaggcgcagcuguucucugcuggaggucuaggggcuuuaaaaaagucuucaccucacacaggcaacccacuggguuccagcaggugucugugcaucccagaacccccuccccccaagcuguagucacugaugggguggggaagggaggcagaaagaucuacaaagaagggacuccguggcagacgccagucaggucuacaagcauauccauagacucguacuuaaaauaauuauaagagagcuccuuguucaucugcaauucaaaugcacggagcaucugcuauuuuggcuugcagacuuuugcaagcaugaagaucaaccucuggggucuagugcacguugaguuuccaggcuuggucugcucugcuccaccccacaggugcaaagcucggcagagauguuuucugugagcugcuugccccacgggcucuggaagacagaaaucugaacugacagcacacagaggcuggcagccgggagggcacaucugguugggagauucugggaacaaacuguugucaccagccccacucccuugugggcacagccccagcccacacuucugcacuuuucucuccgggauuuucuuguugcuuuuuucuucuacuuuguugcugccgaccaagggcagagagccaggcugcucgguaaggaaauccccccagaaggguuucuagggaaggcuccagaaucugcugacucagcuucccccauuggcuacugagcuuggcuccccugcaguggcccauaaacacgcuggcaucaagacaaaugacacaugucacugguggguaauaacuggcuuccucaagccccgcuugcuucuccgcagggccaagugacgcuuccacggucacaggcuaguucucccgggaagcucuuaggccucucugccugcgacuccuuugcccaguugggucuggccaguugagugugaagccaggauacuucucagagccgacaagggcacagccucgacacugggcuguuuggcaucaccuaggcccagacuugcagcuuggcaaaggaaauggguaucugccucaguuucucugaagcuaagcauagaucuggaaggaugagaaccaucuccucuccccaccccaccccgccccgcccccccaccaucuuggauggggcugcucguaccugccacucagagcugugguauuugaagcuggugagcagaagugugaagcagucugaguaagagaacauccuggagaggcugcugugccuggcgugccaggcagggacacagagaggugcccuugaaggucuguguuuguggaugggggucaggagagacucugcuugcuagagcgacauaaaagcugggcaguaacuaacugcccuucuuaaacuccgauaaacaugugcugaguucucacacacaguagugugcacaugaauacauacugaacacaguuauguauucauaaacacacagcucacauauacacacgcauuuacauacacacuaauacaugacacaacacucauauauacaugaaugugcauauccuauucauauauaugugcacacuaauuuaguccaugaauaacacucgugugaacauguaugcaaaacucaaacaucccacaauacucauucaaucaaauccaacaacacaacacucauguauacaugugcauaucccauggauaacacucauauguaugcacucacauguauagaccaugcaaaauuauaucacaacauucauaugcagucagcccugcacauguacauacagaagaaaaacauacauguacaacaaccuuauauacuuacauguauaauaggcaugcacacacauuacauacucacauguacauaguuacuugccugccuuaacucauacgcacacugcacacauacaugcauucacauccaccacaauacuuaaauagaagauguacauacuuucucauauaugcacuacacacaugugcauauguacauguguauccaugaacacauacucacaugcauugcaacacuccugugcacauguacaucuuuacauguauacacacucauaacacaggcacacacacauguacauagcacacauccacaauuaacacaacacugaaacauauguacauacucucacauagccacuaugcauaucaaaauacauauguacacauguguaugugaacacgugcucaaaugcauuguaccacccaugugcacuguguaucuuuacauguacacauacuuauaacucuguacguacacacacacacacacacacacacacacacacacacacacacacacacacaccaugucuuguugagccucccaagccaugaggagacuugugucccccaaucuauccugcaguggugccccaggaagggcugggcucacucuagcacaugagacuuccucaggcagcacugagggucucuuuggcacccagcagacaagggcagucuuccaagggcccagucagucaccuucuccuguacuggcugguuuuguguaucaacuugacacaagcuggaguuaucacaaaggagccucccuggaggaaaugccuccaugagauccagcuguaaggcauuuucucaauuagugaucaugggggugggggagggcccauuguggguggugccaucccugggcugguaguccuggguucuauaagaaagcaagcugagcaagccaguggaagcaagccaguaaguaacaucccuccauggccucugcaucagcuccugcuuccugcccugugugaguuccuguccugacuuccuuuagugaugaacagcaaugugaauguauaagcugaauaaaucauuuccuccccaacuugcuucuuggucaugauguuugugcaggaauagaaacccugacuaagacaccuccugucuacacaguagaguggggcugcuuguauugaccucuauauguuggcauagaauauugagagggauuuucuggaaugcaagccaccuuccccauccccagcguguucacugaggagggugugcccugccugucucaucuccacucucauuggucaccucugcugucauucuuucugggcucugacuguuguugucccuuccagugggugaguucuuaagagacucacgggggaacugaaaaucauaugcucacgagguuuugagagguccacagagaagaacucugugaugugacucucagucuagaagcacaccaggagcaagaugaacggggccacaagaguucucuagggugacagcucaggugccaacacugauggccgagaggcagggccagggccaucaccacccagggcucauccuuucuccugcccagacagugcaugguucagaagauggaaggggacaggcuggguguggcuuucuagguaaauuguugacaggaggaagcugcuacuuacuagcuucagacuuuuuaagggacaggacagucuaugugacggucaucauggcugaagggcugaaaauggagccuuuuguggcaccagcuucuguagagacaccaccagcucucccagccucagaggaaccauacagcuaugaccuuguuggaagcuguagcuugcuucucucugcugguccugggugaucagccugacauucagagaaauagggcaggggagccuaggguccagagcuaugcccuugggaccagcaugcacagggcucaagguaauuuaguagcuuuuguuacuuguccuggccuuuagucuuugggggccuagcuuggcaucugugucucugucccuggccuguaccaucucuucacagccaagaaaaaaaauguguuccuucgagugcucaugacagaggcucucaggaugaaccugugcagcaguuagcaucuggaagguaucgaugaagccggcaggccuccauccuggguccugcggaagagugaacagcaggcuuaugugaaucaggggcggguagugucauggcucaaaagagggcagcagggcaggguagaaauucugucucuuacacugucuucauuuucagaagaaccugcucaugauggacaccagacaagcaagagcugacuuagacaucugcaguuccuucuugggaggugcuacuguggcguggcaguguggugcaaucaccaauguuuaaagagacacacagccaauguacaggccgggacaaguucacggccacaugcagaccaugagaccugcccccuaccucagccuccuucucgaguucuuaagcucauucuuucacacucagccacagaacuuuuccuaaggaguccuucaucccagagagucacagcucaugguccuacacagccuggucuacagaaaucccagccuggcucacaccuccuucugcugggucuucagcaugagagcugguuuucaaguacaaagacaucccagagccuguuccuguguggggacaaccucaggccgacaccccaggaagaggauaaccacuuugcucugacugucccuuaguguguagguggccaagucuucugggagcccuaccagggcucugggaacacucagaaagcucuuccuggaccagaaaaggugguuugcaugucugaggcggugaaaggggcuuucauccacccgagauggaauuacggccaacaggucugagaacaagacagaaauagaugagugcagcacagccucucuauaaauuccuggaaucugcaaucuguccaggacuggcuuccuaugccugagagcccugagacagauucugcuuaaacaagaucuagggcccuccaggugaaagggcacaggcuuccucauaaccaaauccaggcaagcagggacaucucagacaggcagauccuggauagugacaucauccugcaucuaccugugcugauggggacuccagaggaggccaucugcagucaacuccuggcuuucaccucucucucucucucucucucucucucucucucucucucucucucucucucugucugucucucugucugucucccagggggaugcaggaugucugcaguggggccgacuucauugcuaaguuuuuuuucaauuguuuaugaguuugagccucucacucuccucaagcagucacuagacaaccacgaaguuugagagaugguuugggcaaggugggaccaguucuucagcauggaacuggcucgaggaggccaggacccuucucccuugucugucagcaggauuaggguuggcaugagucaucccucuaugaggacaugacaggaugauccccaaucacaaagcacauaagguaggguaggcauagccccugcuucagggugaguccacuuacugggcaagcugaccacccaccucccuacugaucacugguuuucuuuaaaccuguuagccaucacaccccauaggccuagaaacaaggugguacaucccaacauggcuucuccucagggacucccugagccucgaauugcccagccugccaguuuagcugcagcuccagggccuacagccucuccuguguccagguucacuacauucaggggagcugccuuggaucuccugcccagaaaaggauaaauauuucugaucuauagcaaacguguuuccuuuagcuaacauccuggcaggcaagcacgcuaaucucucaggaaaaccuagggcccgaacagcaagccgagcgcccccccccacccccaccccugccuugagcaaacagaaauucugaguugcuuuuuaaacgcugccuuuucuuuucuuuuguuaaaaaaagaagaagaagaagaagaagaagagaaagaucugggggagagucaugguccauuaagucugcauuucuugaaaggaaaacccaccucuccgaucaaaggcaaaaugaaccaggugugcaugaguguuuagacuguaucaggggugcagugggccuccgcaagccccugcucagccugcagagaccagacugggagcacuuccugggaugugaccaguaagguuagccugggaggacagaagggacugaauucauugaccccacaucuggguaaaaggcauagucacagagauccccaaucucccguguguccccauauuauagucucuccauuuuccuucuguagcuucaacuaggaagaagcucaggggauauacagccagggcaucaucagauggaaccccaaagagaggauccuagaucuucagagaagccaaaagcucccuaaaggaugaguacccccgcuuccucaugaguuucuggaggaagggaagcucugcucucaagugcugggagcucagaacugcauggucuaaaugcauguguauaugguugaacuccgggaccuguggucugcaccugcguggugcauguaccugugugugcaugugugugcaugcacguaugggugaguguauguucugacucaggaggagauauuguacccccuguuacugccaggggaaguccuaccccugucccucccacggugcuuuuucuccagcugcugugaagaggaggaggaggcaggaggauggauguggcucguggcucauuggguacaucugaacaucugagcagggcauucugggagugcguaaggcugaggucaguuccucucccucuuuauccacacuacccccaaaagccuuggacagacacaaccaagaaguggggggggggggaagagaaagaaaccuuuaagagacccuaaagaguguguggucccuucuuccugccagagaagucuugggcccaugagggaggguuggggcugcuucaggucacucaccggacagguccaugguuccugccuugucugaggcaaggauaagauuagucagaagggauacuccugccuuggaggacuugccugguaccaccccaaugauagcauccccaucaccuucuccaugggaacuggaagucucuccuauccuagauggcuccccccacuucucaacccuggaaauggauauugccugaguggcccuuucagaccauguggggugaaauccugaccgucauggugugaccacugaggcuuuagcugaggcugaacacaguuuggccccagcacucugugcagagggagcacggacggcucacuagaggggcccguuaggucugcauuucccaucauggaucaaguaaacaaaccagaagaggagguacccaucacagccuggcuucccgacaggaaacuguaugagugacuucguuuuuaaacauuauuauccucuugaaagcaaaagauaaaggaugccuuggagcagccaaauugcucuggcucaaaaaucauuuuaaauaccauuuccuuuaacaagccuacugccugggcaguggaucaacacuauucauuuuaaccuuagucaguaggaaaaaaaaauucugcagacgggcuuguaauuauuuagcacucucccucucugacccccacccagauacauuaacuaauggccucaacagcgcauaauggguucucuucaacacaaaugaacacugggugguauacacagaacauucuggaaccauuuucccucucuuuccagugugaacccaagcugggggcugaaggcucuuuucugccuuuuccagggacggugaggaccagaguucuucccccuacuguaucuguuuguggacauuauccggccagugugagagcuugccuucgagugagcaaguucggccuggauggugauugaaggcaggaaggcagcagggaaaagagggauauccagggaugcccugcaugccacgaugccaggaccgagcuggagagccacagauguguagguggaacucaggcuaagaucuccuauuauuuuggaaauaaacugaaaguaauuuccauucugucauuugcaagcaaaaauacccuacacagaagcaaagaggaagcucugcagaaaugauucccacaggaaggagcgaguuugcaaagcagaacugggucaagggguucucucacagccagaagaugcaggcacagagggggaucacuggcuaccugauccugauguuuuaagccauuuugggguucuguccacaucacccuggggaauaauauccauuaggcauggggguagaacucuuugucaccucagcuaccgaugccaugucugaagacuggucaucaagguuagcagaaguggacacagccuuccacucagaucggaagaccauauggggugguuccuucaagcccagagccugacagggagcagguugcuccucaaugacccagauacuccugcugcuccucagugacccagauacuccugaucccucacacggaggagugggauuccacaucauuccuggcaauugcaguuuggcuugcacugagagcuaagagccuuguuccugggcagaucugcagaaagccauggguacagcaaaagacacucagcaucugggugacacagggacagucugauucuggguuugggaagaagagcuauuuauuccgacagcauucagagacauuagccaggucacccaggucucuuguaggucgugagcagaguggugcuaaggaacggcuuuguuugcagggugugugcagaguccgggugggggaacugauauccaagcaugugccauuucuagugggacccgugugcccuccuggaguugcugaaggucacugucugcugagcagcagaggcuggcugcugacucucucagccagucauuccuucugcuuaggggcccaggcauggggauauagaggacaugucauaccaacuccuuagucacaagaugccccagggguccaucccugccuggaucuaggcccacagagauuuuccuuaucuucugggccucaagagggacacugcuucaacaagucgggucacaugaaaaucuacaugaaauggagaaauucagggcaauucugacuucccaaaggauuagccaucagguccccaagugagucucucugaaucuuugcccacaggacugguuuguccauguccccuaaaccuggcauguugcccaacucuuacauugauguccaaagagcaaauuucucuagacucccaaaccuggcauuauguucucugggaaccgguuuguacauucucgaugcacgagaguugucaaaguaauuccagacccuggcagccuuuucccuccccacacagugaugcccugaaagauaucuuggauguggauauauauggaucccucuggaaaguacuauacaguucacucucugcauucuggaauuagaagaaguucggccucuggaaauggggcacagagacaagaggauagaccaccccaaacuuguccuauuuccucugugcacgggagccauagagucuggcaacuaccguggggagaguccccaaggccugggaagccuuggguggcaguaggaggcacuggcugugucagggcugagcauggguggccaccgaggaggaaggaaaggagaacauguagguuccaagauccauuguuugaaugaaaucaaggaaacugaggcccagaggucacauagggagccaaggugacauguguguguaccuuuuacacggguggcuucauacaaguuuuaaaaacagacccucugcaagacaagacuugcaagacccgcucacagguagaguagcuaaggguccccuacucaacauguccaaggucaaggacugggcaacagaggagcaacgagggacaucaucgggacaaucaccaguguucaguuccacagggcagcauccuaccagauugccaugccccccgaggaugguauugcucaggcucaggagccauagcacacguucagauuccuguaagguuucugugggagagggccugcagggggcuguucagggcagcaggagacuguugcggaaggacaaauccagaggacaggggccaugccuggcagggagucuugggccagacagcucuucccuugucacuguccucugccagagagaaggcucuccaggaucuucugggauccaaaaggaagaaugccacccauagaagauauuuuuggccagguugaccauagcccauggagacagagaguggaacuggcccuguucauaacagggaagugggggucgcuuugggacaagcauuuuccuuaccauggcuccccaaacccacuccugccuugucuucuccaaaucucuagcccaucugucugaucugggcucugccugaugcccuuccugugucagcgagaaggcccugucccaugguccuuuggagaacuggcugacugacuucugauucagaguacuuaagcagcacggagggccccucgcucacuuggaggcuugcuugcauugacaucugucuuccucggagaagcaggcaggacacugucaacuugcaggaaaagccagagaagggaggauguguacuccgcagagggccugaguggggaguccgucuacaccaggguggagggaggcucagggaagagcuccaagccuucugugcucacacaccuuuccagcagauuuccaagaaagauggauugugaguggcacucaagagcacccagaauuccccagagaugacaagaggucuagaccagucuugaagagaugacuguucuggacuccuaucccugcuuagcagagaggcgcccacauggccacgacucugcaagguguguccuucuggagucaaaguucacauggugcugggaguacagggagugugauuguauguauauaccauguguguacaugcacacuuaugcauacacauauauguugugcaugcaugcguacacacaugugcuuguguguauaugugauaaguauacacauguaauaauuuacuauauauguacaauguaugcaugcaugucagguauguuguauauauacauguuuauacuguguauguguauauauauauuauauguauguacacauguccauauuauaauacauguaucauguuguguaugugcaugcacacacaacauugcuguccaaagcaucuaguuuacuagcacugcgcuaugucauggccaugcuaagugcucuguguguuaaggccucuccucuaacaauaacuaacuuuguaucuccacugaccacaccaagaaacuaggguacuuuuucaaaguuaagcuacuuuuccaaagaaauaaggguagaguuggguuucucgucugugcuugggcacgcugggaaggccagcaggaagcccuuccuccugcuccugucucugggagcucucccaagggcaucccgggagguugggcuuggccacagcuccuucccugcaggagcuggagggguaaagagggaaugggaccaaccaaagggggggaagaccuggcucagugagggaaacccccacaguggcauugccacgaccccugcuaaaggucaacuguagucauccaaggcauagcgaggaggagacugaaggcuggagcugacgggcgggggccuggcaucacccuggcauuguaagccaaggccuuaggucuagggaugacacugaaccucagaucuccacccccagaucccugcguggugcugggcugccauucccauggagauucaagacagauucugccuuucaucuaccaagguacaagugucacuagucacaaccagauguggagaggcucaaacaagccuucagacaccagacauaaccuccagucugggccgacacuguggugugcuauugccagccugccauggcaccccuggcuuucaggagcugccugcuaggguccacugggagcucccagucagcagcauggaaacugggaacccccagaccaggcauccguuuucacuuucuucuagaggucugcuagcuggcuacuugccagcaccacccugcugggcaggacaaaaucuggccaucuuuccauauaccuccccagcagaagggcaggcgccuagcucccaaaaagagccuucaucccaaacagcagcugaacucgagcauccuuucuggagccggggaagcuccguguguugcuggcagcggauccuuuaucugauuaagcccgacucgggcuaauguugugagguuguauucucugaucagacaccagcggcuggcagcugagccgcaugcuggggcguccugggaagcuagcccagaauguuagaaauucugugacucacacacagucuguguggagaggggcaguccagaaagacgccuggcuuagcguugcggaugcagggcuucagcccagcucuucugccaagucaugggcauucccagauaaguggggaccucucugggugaucgcuuuccucuguaaaacgaggcucugggcagcugguuucuacccccuaccccgguacugccaauggugcugaaaucuucccagauaaaaaggggccaccugcauggccugagguguguuuguguaguguggacugaaggacgugacucggcguggccacuccacgugagguccagagccucagaggaucccagcaguggucaguccuguaaaaggccauaucugcccaaggggacuggacucucucucucugcugcagccuugacccuaggcuguugcaugacuucauuuucagggugauggcuuugguggaaggggugccugcuuggaacccacucccacauuaagauagcugcuucuaggaagcaggccaugguagggugucacagagccagaguaguggcagcacaugggacuccugucuugucaggaggcuuggguauggguaucuccuuauccuccuggaccaguggcaguggcugcuaugacaugucugagaggcagcugccaugaggaugcugugacaagauaugcugacguuaucagguuuagugugagauaccaagacacaggaagggcaaggccaggugagugggcaagaaagguaagugggcaggccagguggggcaggccaguugguugucaugccagguggguggacaggccaggugggugggcaggucagaugaaugggcaggccaggugggugggcaggucagguagguggggaagccaggugagugggcaggucaggugagugggcaggccagguggguggacaggucagaugagugggcaggccagguggguggggaggucagguggguggggaagccagaugagugggcaggucaggugagugggcaggccagguggguggacaggucagaugagugggcaggccaggugggugggcaggccggguggggcagaccaguugguugucaugccaggugggugggcaggccaggugggugggcaggucagguggguggguaagccaggugagugggcaggucaggugagugggcaggccaggugggugggcaggucagaugagugggcaggccaggugggugggcagaccagguggguggccaggccacauggaugguagcugaacaaugauggccgauuuucacaaacuugguuucuuagaaggugcuagauaggggccugaccugcuccuaggcuagcugggcagcucugaggacacuccuacaguuaucuggaaggacacauggagaaaaggaacccuagccugguaagggcaucagcugugaaugugggaaacaaucugguaggagcagaaugagaacuguuggagaccaucacagaggaaaggauuugggaugcaggcucccuggggccaagcugagggugauggcccagagcucucaagaugacagcaacuaagguuaccaccugcagcuugccugugucucagcugcgcugucucuuugaacccuucugacugaaaugcaccauccuauagagaaacagagcccaggucuggaguuaaucagccugaagugacacagccuugugugcuuucagaaguaggaucagggucuaucucagaguggcagcuuccugucuuugagaggagccagagaucucagcuccuagggugcauucugguuacccguuuucccugaacccuuuuaaggaguugcucauguucccauaaaacucugggagcuguggggcuuggggacccuaucgaccuuguaccaucaccugggugagcugguaccagcucggagcacaaucugcagucuguaggcagcuguucuaucuccuuuguuugccuaggagugaaugcuggggucugaagcuugucagcucagcacuugggugcaauuacuaccuacccgggcggggcagaguuagcuuuuaguggagcaagauaggauucuuucuggccuguauacccaagggucagggauggagugacagcuagguccucugcucccauugcgguagggucaggugauauuuugagugugcaggacagggugaagcccauuccagggguugcuucuagguggugcugcugucuucaggccuugucuuuugucucuuguacagcugagaugcccuaaacuugccaggagaccaauaaggacauauggucuuugucuucuagcccuaugccacauauagcaagaugcaggcucucaccaaccuucagggaauuggggcugaacacuauuagcagcugauguagggacaguucccagagcuaaacugaagucucucccagccuccuacccuuuagccaggcugcuguauccauggggacuucauuggguuggcucagucuccugacuuggaauucugaagcccucuggagcuauugaaggugcccucccugauggccagccugggaucagaguuugggauagaggacaugcucaauuuauagucacauagggcacagaacauugugcucccagaaccauuaaucuuagcacucagaucgggggguggggugggggggacagaucacaguugagccccagagccacaccccagcaguaagaggcucagucaaagcuuauuucuuugcaaaugaccauguaagaacucaguuucuaaaccaggcaaucugcuugcaauucaugaucagcaaauaugucuuacccuggauuuccucucaagcuuccaagcuaaccucauagagauuucugucucccaaggguaagacuucagggcacccuagagacuuccagagaccuuagcuucacuccaaagccacuucaaacuauaccucagaauuguaaaccugcuucucaggagggggaaggacuguaggagagggagggggggucacagugcacaacucccuuauuagguugucuguccugaccccagggucuugcaaauccagcuuugagagugaacugggaagagcuccagggaacagcaggagacugcuagcccccuccagccuuccuucuauuaugggccuuccccucuaggguagguaaugucauaaggaugguaaugucauggcaagugacagaagccuagcacaggaguauacaggauuuugggacaguagauagagucaggauugaaagauuaagauaugacagggaccaguuugcagagagacuagaaguccuuccucacuuaggcuucuucuaaugaccagagcauacucaggaaaccauggcagcucccugcauucucagacccggacuaaaacacacggcucucuuuccccuuugcccccaucuuucucuccuuggcagucgccaagauuuacagccuguccagaugaguuuauuuccaacucgaguaaaaugguccuugggcuuccuucugaguccauuuuaaaauuauuuuauuaacaagacuaaaaaagacccuaugaaagggaagcccaaguuaccgaguaacaauucuaccuguuuuaaagugccagaacccuugugggcaaugccaggcaggugcugaccucggaccuaggaugaaacaccaggcuuucugggcagaggcuguuucuguccuugauggccaugggcuaugacaaccuauacacuugguaaguuacacucaguuggcucacagaggaaacugacuucagacacaaagaaccaggcagaccuugagguuugguugagggcgugccugcagaugccuauuguguagaugcccucucugcuugcgacuucugacgugcacgaaaaggauucacugugcuacugcacagaugugacacggcgaccaaggcagacagcccauggugauggggucuagauacuugugaaaucuccucagcuuuuccgagcaucagaaagugcugggggaagggaacagagugauuugcccguacugacugagggucaagaaaacuauggcgaucacucaaugacuucgcuaagaccugcauuuuaaccagccagguaaggcuugggauaucucccaggcagcuagaggauuacaugcaaaggccccggggcaccuaggagcuagguuuuacucaagaacaaaauaaaccaucaaagaagagccucuaggucagcggcuccccaaccuguggguugugaccccuuuggggccacaugacccuuccacaggggucacauaccagauauccuguauaucagauguuucauuaugacucauaacaguagcaaaauuacaguuacaaaguagcagugaaaaaacggugguucaugguuggggaucaccaggaccugagaaacuguguuaaagggucacagcauugggaaggucaggagccaccacucuaggugaagaaagaugaaagcacaugacacgggccaucaugaggucauggcaagggcguggcaguuuuaaguacagagauuuagggagcugauuggugugugagagaaaaagagaagccaauuucugucuuaagaggccaugcgagugugcugugggggacaggccauuugcaaaagacagcaccuggccugaccaugcagagagccagagcuggucucagggcagcagaagaggucauggugggagggucuggguugaagacacauuucugagcagggagagaggaaagacagaagugaauggcuagagcccugaggguuggggauucucuuuggaaccagagucuugcuggguccugugguaacacagcucuaggaagacugguggauauauuauuuccuucuuggucaagcgugcaggucugaacucaggcgucauuagccuaugacuggcccaugaagacgugggacugcugagccuaggaggcaaugcagaggagaggccaaggagaccggagagauuccaauaccaaggggucaaaggacaguuuguacagagugguuagugagaccagagagacagggagcaguagagaguacuccagaaggaacuggccaaccuuagggagugcugcagggacaugggcaggugaggauggcaagguagcuuuggacugaaccaagcaaaugcucaugggaaaucagaaggcacagucagggcagagugaagggcagggcagggcagagaccgcuuccggugaacccugagcugggugagcugcucgccugcauuggggcaucacacaggaucauccugacuaucuucacccugugacacccugugccaauguacccaucagcaugucugggaaaaagaccauauaggcuauuccuugggagguccuacccacaauccacugcuuugcaacaugggagauagagaguguuauuucagauccugcaggaucugggucuaggaggagggcagaauucagaguggggggggguggaugguguacuggcugguuuugugugucaacuugacacaagcuggagcuaucacaaagaaaggaaccccucuugaggaaaugccuccaugagauccagcuguaaggcauuuucucaauuagugaucaagugggggggggcauuguggguggugccauucccugaguugguagucucagguucuauaagaaaguaaacugagugagccagaagaagcaagcaaguaagcagcccuccuccauggccucuguaucagcuccugcuuccugcccugugugagauccaguccugacuuccucugaugaugaacagcaauguggaaguguaagcugaauaaacccuugccuccccaacuugcuuguggucaugauguuugugcaagaauagaaacccugacuaagacaggugggaaucagggaugcuauauaaaaccaugcauaccuguguacacguguauaugauaaugauaucccuguguccaugaucacaaauguauacauaugcauauauuuuguauacucugcacaucuaugaauauaugugcauaccuaugcccaucugugaucauauguauguaaaguggauagccaugcagaaugucuauauagucaugcacacccacaaacaucuauggcuaucugugcauaccuaugaacauauaugugcacaccugugauuguauauacuuaugaguauauguguauacucaugcacaccuaugcauaucuaugaacaccugugaucauaugugcacacauguucaugccuguguaugccuaugaacaccugcuuauacauguguauacuuaugauuuguguacauaugcacaccuaugcauuuaugcauacuuguguguguguguguguaccugugcaccccugcagacaucuaucuagcuaaaaccaccuaucaagucugcagcaugucucaucccuacauguggacaucuaagcaauggugcagaucacgggaacuccuuauuuaugcuggaucuagaacauuccuacaaaaccuggcaucacccacuagggcacacuauagcuaagugcgcugcugacagucacaggcaggcggagcacgugacagaugucucagauucuaucacaucugaguuuccuucucggcccuuugaguuucuucagaggcgacgccguaagaauuccucgaggccaacuuuugucuggcgcuuugagaagcauagccacacaguucccccuuugcucaaaagaagauuaggauauuacggacaggaugucagcucaagauuacacaagcaggauaauuagacaaaagccugcauuauaagccaucuagccgggaaauuaagccgcuuuggcuuucuccucgccuuugaaggguauucuguaagggagguggggcgugaguuguugggugugauagauaaagauaguaaccaaaccguagaacccauuguucugccuuuacaugaaagacaauugcuuagccaagcugacagcacacaccguggagccacaaacuccucuucagacccucggauuaagagacugacacguuguggauaauaagacuaauuaauaauucccaucuccaagggaccgcagcccuggcagcuucauucugucucugccuuccagcucgccugggcagcccaguccuugcugaaggacagaggagagcaagcacgccaggauaagggacacggagcaaaggaggcucagggaugugaggggacaggagaccaguugauggauagaaggauguagaggcuccagcucacgugacaaugggagaaauccuugcccaaggcugugggacaagcuugacucugggccuaugauggaacagugacaucuaaaagacuuuacauuuugcuuguggagagacagucucuuaggggcugccucugacacuuacccaccgaaucuacugggguaaaagcccuggcaguggucaacggucagccuaccaagcaggacaccaggaucuuugcaggucugacgucuauccucagaaugagaauaaaugucuguacacacacacacagacacacacacacacagacacacacacacauucacacacacacacacucacacacagacacacagauguacacgcgcgcgcacacacacacacacacacacacacacacacacacacacacacacacacacacacacacuccacacuuagaacaccuagucagaaucccaagcuagcaagaguaguagugaagcugugauuccaggauuuucuauccgcaguacacguccuguccacuaggugguagcagagugucccguggcuucagagagcuccggccucgccagcaaccuugguauacagaaaucuccaaggugagguugaagcuggccacucccaccggagaccacccaugaaaaggacauuccccaucgcuccugucuccugaggaagggaucuggaugagggaaacugaaaacugcccggucacacuccucagaggagaauaggcuuugggagccugccauauuuucuggaggcauuggguggguacagcuagggccuuggcaucguaaaucgcaaucaagaaaagacaucuaaggaggaaauacuacccgcuccgcugcgcagccuuggccaggguccugaaaucuuaauggaauugagcaauuuuuuuuuuuuuuuuuuuuuuuugcauagcaccguaaauuccuggugucuaccuaaucuccugaucacguuauucaagagacauuaaauggagaaaggaaaagcugcucguuagaauagagccaggauaagacgacaucucgggaauggucucugccagcacccuuguuccugccccuuccccuuugacauguacaacccgucuagucugguuucccaggucagagccaccuagaggguuucuccacuuggcuucgguuugagucaguuaccccuggacuggaaucuuccagacugaaugggaccuagcucccuuuggcaacagucccuccugcuguggcuucuuccuggaguucacgguccucacucccugccccucucccacccguugugacaccagugccagccuucuccugcagugcacccgcugacccauggacuccuguccuuccuguggucuuccucccuaggcagggauaucuuaucuggaggcaccuuggaguggguugaugucugguuugggauuagaaugccuccagcccaccaaguggggaccagcugauggccagucuaagucugugcuggaaucaaucccaaacucccuucuacacaguggucauagugauguagcagcuucaugaggacaacaaagugcucagaagcacaagggcugagaugaaugaaguuauuagcacagaugaugauggugauggugaugaucauggugguggugauggugauggugaugauggugauggugaugauggugguggcuacugcuaacaguggagaaacugucacgaaguaucauuguuucuguuuguggagaugggauauagcugcugcccaggcuagccucagacacuuccugcuccucaucacccaaucucuaucagccuccagacugcuggggcuacaggccccagugccuuugcucugauacccugccuaggcccccucuuccccgcugugcugggaagcagagauagugaacuccagaccucucuccucuauucccucuucccagaugggcccuggaccagguauguguaucugggaacuuugagcagccaugguacccccugcuugacuccuacagaaaacauucauuaaccccacugggcgcgugcccucaccugccucacaucaaaagggcaucgaggccacucuucccacccugcuuccuccaucuuucaacucuagacucaucuccucuuccaggaaaccuucucagaucaccugguccauugcuaugguacaccagaaugcauugcauggacuagccucuaugaccagaaucugcgaugcccccagagcccacauccuaaaguuaugguccccagucuguggcacuaugauaagguggcagaaacuuauggcaaagaaggcccaugaaggucacugaagcacacacacagagauuacacacacacacacacacacacacacacacacacacacacgguaaauauaugguauauauauauauauuuguaguguauauaugguauauauaguauauauacuauauagagaguauaugugguauauaaguauauaugguauauauagugucugcauauauauaugauauauauagguguauauguguguauauauaguauauaguauauauaguaauauauaaguauauauacaguauauacagcauauauaguauauacacaauauauacacuauaguauauacaguguguauguguauauguguauauauauguauauguguauguguauauauacauauauguguguguguguguaugguauauaccaugauaucaugugcacacaugacacacucaaagggaaaaggaccuagagacuagggacaggaaaccucugaaaccaugagcugaaguaaacauuucuuccuuacaagauggcuacccuggacauuuugucagaauaauaccccaucacuccucggaacucaccauuucuaggguuagcagagccuagugggugggaaggaagguggagaggcugacccuaggagaccuugacaucuugcuucauucugcccccuggugccugagugauugaaucgccaaucccuagugacaaggagcacuuggugaagguugacugccuggccaggaagccauggccuccuuagguuagaccacguaguacuggaauccagcucugugaacucaggauacagugcucuuccaaaguccagguccuagaccuuggauuugaaaugccaggucuuuagugaacugggagccccacacccugugccauguccuucccggugccccagcaucuaucuucccacaggucuuuguguauuacagggcugugcugagccaggaaggauucccacggccucugccccacggcuggaaugagcagucaagcugccauguggaggcacacccccugccuugugugcagaaaacauucauuaagcauuuuagagaacaaugguaaagagaaaaacacucauuagaagcagaaacgguuugcaaagaagccagcagacugcugggagucacggccagcgauggagcuuauucucagagagagcugcacucagagggaugcaucacggaggccugaggcccggggccccagacggggagacacuuucuguuugacucugcuucaucccuuggcacugucgcuggcccuggggagcucagcccuggaagcuacagccaagcuacgucaggcggugaagcaggggcuggaagaucacugcugugccccauuccuggcucaugugugacucuagaccuggcccuguucucuguggaccucacugggcacugaagccgagggaccugauagcugugacacagagggugacggugugagcaaaggcagcguguauggaaccugcagagguggccuucuccacagggucuggccagcuggagaaggagauggagaaauacagucgacucaggguccauaggggcuugcagcuggggauacugucuugggcacaaguggccccacccuuaugcaccucugagaugcccagcguuuugagcagcacaggauccuccagucaugguaacagccuuacaggccugugagcuagcuaggcuucaguguccuagauuguaggcuugcucaguuguguccuggauucagcuacaguagaaacuucacuagcagugacuggggggagggguuaugacacacacacaaaccgacagaaagaagcagcuaccaccugacucccucagugccaagcacaaagccuugaccacagcuggacccccuccccgaagaaagccagguggcucaaacacuucuaacucuguaugacucaguuucaucuucugggucuugacguugacccauguuccuagccacuggccuuugggcuugcucugcacugcucuuugaggacauuuguuuguuaaacugugaccuuuaggacauguuggcucuugcccugccuuggucaaggcuccgugcuugguucugagggagacagaggcaguagguuucucuguugggggaucuaccacuguggguaauaagaccccaguggauuucuuugucccuacuguggucccauagaggucccugcugugcuaaauggcucugaaguggcccccacuggaagaugccagaggauggaaucgagccacaguuugugggcaagagcuggcuacugagcugagacgguggcagccagagguggggguaucccuugaggaaguuccuuuauccagcuguacucuccccugacugcacccauccuguaagucccacccucucuagaagguugucuuguuccagcuacuuugcucagcagauggugggcuguaugcuccuggccaacccuggucucuuccucagcaccuccucagggccuaaacaccacccuguucagcaacuuccuuucucaccucccauggggcccagcccugauacccuccuccccaccaaggcuuuucugugguccuugguguuugaggacccagagaugagcgauggggaugacaauccugcccggcgugagauggcaaaugaagaugcaccagagcagccaaguuaguucugccacacuggccuuuggugggaggaggggaguccagcuuccugucagccggaucgugacaagcgagacucaagcacaccaaucaccccaggcaugucuucagcagccagaggccaggaugcagagacagggagggagaguggagagugugcggaggagagggcuuucccucuugcuuuaggcgcaucuggaaggcaccggaaugcagcuguggagaagagagcucagcccucacgcugcccaaagguuucugcuuccggcagaggaaguuuaauggaguuaaaaagccacaagagcgugaugggcugagggcaggcguggaggaggaggaggccacccuugaggagggguguucgcacccccagcaggaagcuggcaaguggggagcuaaucuguuaggagucccagucugguguggcacagagggcaugacagagaugcauucuaacaagggacauagacaccaaaaggaaaagagccacagccagggacaggaagcuggaauaaaucaagucccugugaccuagcauccaagccagggaaccagggucauguuuguagccagcccagagcacuguccucagagccgagaccucacugaccugcuccuuagugucuucaggacaaugccuaggaacaaaagcaguucuccaccaccaugcagaacaccccuggaugcaggaaacuggacacuccugcaucugccucccaaggacacggagaugggacaacugacaguggagccuggugugagggaagugucagcuuugccgaugagcaauagucugacuggucgcuuucuaaggaaugugcugagccacaggcaacuaacuacuuuugggaacugaaggagaauggaaggacugacugguggcuacagcugggagaccagggugguagggcccugccaaggcugagccguggccucccuaugcagacagccucaagcccugugauacuucccagaccauccucccuggaagcaguggucucucuguaccuggugcucuuuucuguuaauuuauucccaaccuugccccucagguccccaagacaacaacccucaugcacuugucaguuugaacagaauugagugcacacaguggggccacaguaacgaggcccccaggcagcaguuccuggccagagguaguaggacaaaguuauguguaaggguaauggggacaggcccauugggcuggguucuacauagagaauuuguauagcagauagcuuggaaagagauccagguccagucccaucggauaaacccucagcccuuccucccucgcagugacauccuauccugaguggcuucuagauagccucugcuuagacccaaugggccagcaccauggacagaggcagucuggauacaccacagauacagcuguuuguccauaaccauagacuauagguguuuguccauaaucacaaacaggggcugucuguccagcaccacgcacagaggcugccugaccagcaccacagaggcugccuggccagaaccauggacagaggcugccugguugcaccacagacauagcuuuuuuuguuguuguuuuuguuuuuguuuuuguuuuuguuuuuguuguuuauaaccacggacagaggcugucuugccagcaccacgauagaggcugccuggccaggaggcugccuagucacacaacagacaaagcuguucauaaccacagacagaggcugccuggccagcaccacggacagaggcugccuggacaaaaucauggacagaggcuuccuggcuacaccacaacauaacaauuuguccauaaccacagacagaggcugccuagccagcaccauggacauagaccccuuccacaagcauggcagaugcucccacaccacagucuuuaaggcaggcaucacauaucaaucacaagaccuacuccucuccagugggcaacccugacaaucccacaguaccaaaaccagccaugaaagccuauuucccacauguaccuucugacuaaccaagacagcaaaugaauauauggauuguagccaacagggauuuuauagugagggacgugacacccagccuucuuaaaccucacuaaaaggaaacugggaaccuuggcaccuugaagcucuuuauccucaugaaugagcaagguguacccuggccaccaguucucacuuuccuuucuggaacuucacucacaacuagaccugucaccaaaccagccuuggcaaauaccgcugaaaacuaggagaucgcaccaggacucucagcccaaacuugcugucacgcacaggagccccacgcccccucaacgcccuccacagacccuucccaagcaccagagagcgacgcaugagaaauccaaccucagccaccuaccugaaggagccaguagcaccuccgguggaaaguagguaugauggaggaauggacauagcagccguacaagcacuagggagagagaggaaaaacgagaguucaguuggaaagagggaagggagggaggaagacagugggugcaacaaagaggagcaagagggaccaugccacugcuggcaggccuggggagacugaggcacaggguggacuccagggauagggucuaagauagauuguagggcaugccagugugugugggggggugggguggggugcaggcaucuggcacuguacccuguggaggacuaaaggcaccggagaacucagaacugccaggcagcacuaaggggcugaaguuaccgugcucaucgacacagccugggcaaauccuuggguguauugggaggacugaggguuaccuuguggaauaaaacaacacacacacccacaugcacgcacacgcgagcgcacacacacacacacucaaacacacacaugcacacacacacagagacacaugcaugcacacagauauauacacacaugcacacaacacacacagagauaugcgcgcacauaacacagagacauaugcgcacaugcacacauacagacauguguucacauguacacacacacacacacacacacacacacacacacacacacaccauacugccccaggauagccauccuuguugaaauaaguccagugcuaaugggaacaaggcuaggcaacaguggaauaugucuacagagguggggguuaccaccuucuacguaucccacuuuugcuuuugaguaaggguugguugguuuguucccauguuuguuugcuugcuuuuuguauuuacugcagauaaaugguuggacaauggggggugggggcgcucagguuuggggcugauccgggaggaaggucaguccucgggggccuaucacuugguggaguugaccggugggugggcugcacugcagccucuguuucugggugggggggggcagcugaucuauauucagagcuugguucucaaggggugagccuguuggugagaugagaagagaccaaaggugaccugccaguuaggguccuccagaaaucugcaugggagagaaaggcauccggccacagcgcacugauucggcaagggcugucucggugugccuggugaugggauccacccccgagucugcgccaaagacuuugcuuugggcuuccgauuccaaguccgacaaucccccuuuccaugcucagcguucccuuggcuugucaagguccagcccagaaacaguggaguggacagagaaggaugaguugguagagcugcccaggacaccgagggacugcucccaccucccccauagcagagaggaauggcagggagccucuccuuggcacuucugucagauguuuuuaugccccccagaaagaccaagugcaauuuggcuugacucagaguccaucugagccuugccugucugauuagcgggguuggaagagaaaucauuuuggacucugggauucaggcugcaagaaaaucagauuuccaauauguuagaacuuuuacagaucgcugucagcugggauuuaagcccuguacaaaccaaacaaacaaagcggaaauuaauuuaaacgauucccuugcaguucuugcccacgaaauguauuuauuauuaagaaggcaauauucuucccugacuucucugguuugcaagaugcuguguuuugguuuugugauugggauuuuuuuccuuucauuucuugccagguugacucuuguuuggacauucccccccccccuugguuugguuugcaacagaacaaacagccaccugugacuuucugugcccuccuuccuuucauggcaaccuuguuucucaugggcaguuucuuugccuuacuuugugagucaagaggagagagacacugaugguugagagaaauguccccaucccuuagaaauaaaaggcucucgucugugucuucucacuguuuacuccccuccagacuugagaugaacaaguccagcuucuggcaucauauccccuugcugugcccccuacucauagaucuuagccucuggaaucccacgguuaggcugcaaauuugccaaacaccugaucuacccagugugugaauguggaaagggagugaacaggggugcccucucuacacaugccagccaaaaacccaucuacccagaagugcccagaaucgcugcauaagcaaaaugaaguucaaaugaaaaauggacgugugccuaucagggcuugugcauuuaaacuagaggaaucuccaggcuucacucagagccauaagcccaucuguagaugugccucugccaugaucacacaucucucgucucaucagcagagaggugugaaguuaggaaccugugagaggaagcaaagccaaggcuacacucugacaaugcgggcauuguguaggagaagccaggagccccagagcaugggcuucgccgucccauguuuaccuccauggcucucuuacugucucugggucaaguugaguaagcccuuuccuauccaugacuuaaagcuccuuaaccugguaugcucaaugguggggagaguagauaucucguuuucauuucugguacucaguaagacgaggacuucagcacacgcaggaugagacucuggagguggugguguguuagugcuccaaggguucauucagcucugguuucaagagagccacacuuguguugcaugaugcacgccuguccucacaugggaacaugugcauagucccgcgcuccuagcaucagaggcacucaggaggggccggcagcaucauggaugcuggguggggcaggagacccgacuuggcuauccuaccacucacuggcucagacgcugcuaucauuccaggcugcaaaaugauuaccaucagaguggucgugaggaaagagagcuaauguaacaacaggaggcuugugucagucucugagucuagcaucugugcaaacaugugacaggcucucaccagaggggggucgagaagccagaagaaugaguuggccuagcugaggcaagagauggguaagacagcauuagcagcuggagagcccaggguugagggugaggugggacagugcuugaggaaccaggaagacagauggacggaugauguacagagugcgcugagcuggcuacucuggucagauuccccacuggugauggcaagcagggcuguggcuccucaucuaggaacagugggaaguuaaggagaguagcagucacaucuguaucucagaugcuugcuuugggacggcagccccugggugaucaucgccuggacgguugacucuagcuuucuccuugucaaugcagaggagcccauaggaaccccacaagggaggcguaugggaugcagaggugugugaccagugugguugaaagugcuucggaugggagguaggccaaacacucaggauccuugaugggaggacacaguaggcaugcacugugugcuccuuccucgccaugaccacacaaucccgggcugccugcuccccuucggcaccucugcucccuugcuugcugugaccugaacccaucuggcuuucccagucuuuuuguggaucuccaguuugagugacgcugucaucgccaagcugauuggggauuaacugugcaacauuucacaaggcaguauaucagaccauuccuuuaccugcucaccuaaaagcaaucaacuuugccuguagugauuugugcuguacaaacucucggccugaucugaccaggcugcggguguccccagccuucccagguggaacuuuccaauaaggggcugggaugugguuagaaggagcucuaucuccaugucuacucucaugugugugugauuguauaugugcauauguaugagcgaguaugugagcaugugugugugacugaguaugaauaugugauuguaugugugcaaguguguacgaauguguguaugagugugugugugggaguauguaaacauauauguguguaugacugggugugaauguguuauuauauguaugcaaguguguauaugugugaguuugugugugagacuguauaugucucuguguguacauguguguguaggggguguacauauguaugcaugugggaguguauaugugaauggguguguaaaugugugugugagaggcugagugugaguugugauuguauuuguguguauauguaugaguacguaaacauguauguuuguaugacugggcaugaguaugugauguaaguauguauaugugugagugugugugugagaagacuguguaugucuguguguguacaugugugaguauguguguauguauguguguguacaugugugaauguguauagguguaugugugugugugugacuguguaugugagagcauguaugugaauagguguaaguguguguguguacacuccugugguugugugagagugugugcuguggccucccuguauacuucuguguaauaaacccagauucagaaagacaaauacagcgauucucucucauauuaggcucccauuguuggauuuuuguauguguguauauaauauauauacagauauaaaugugcaaagccaggaaacuggaaaggggcccaagagaggaggauaaugaggcuuuaagaaagcaggcugugucacaggaacacgugauacagaaaggaaaggggaagucugggcagaaggguaaaauagggacaggggcuggagacggagaggagaagacagggguagggauaaaucaaggguaaguguguaugagaauaccccaaggggacucguugcuugguaugauaauuacaaaacaaauguggguggguggagagacagagagacugagagacaaauggagagagagacagagagagagagagagagacagcuagacaccuucaggaaugccacccuucggcagaaguggcccucagaagagccacauuggggguuaagguacagcagccuccaucuaacacacccagguuuccuuguaaaccacacaauguuuuuuaucuuuuaauaaaaggaaagguggagcaacagaggaaccaacaacaaagaccagcugucuucaaaguaaaagcgucaccuagagcaacaggugcgcuggccaugcgggcucugccagggcuccccauugcuucccugugccaaaggcagagcucaauuuauuggcuaggagggcaagacacuguggggagcccuccuccaacuuucucucugccuuuccaccuguuguuucuguucucucucuuucucaugucucacugcuucuauucaucucuuagacacaugcacgcacacacacauacacauacacacacacacacagguggggggaaagacagacagagagagagagagagagacagagagagagagagagagagagagagagagagaggagagcucuuuccuuuggcuuccaguuucaaucacacauggcccagguuuccaucucggggaaguccuagagguacagagagcuaaagaagagcaggcaggaccuagauacuucugcuggcccaaacuaagcuccacuaaggccucuguucuuucuuccugagauagcacuggcucacagugcccagcuggccuugggcaucccuggugcaggccucugcucucaccaggggguggcucuggggccagcugccuucucuucaccugucacaucucagcagcugcaggaacccgcaggaacccgcaggaaccugcaggaucccuuucuguccguuacguagcagaguuccuggacagaggaguccaugcugucuguagggacagcaagaagcauggagauuuucccagagagaaucgcgcaccuucauuauugcggauccacauucuacccuucugcuccucacaggggccgggaaacauucuguucggggauaggucuagauggcaagcauuuuuagcuauuuuuagcuuggugagucagaccacuaaguauuucugcucaguucuucccuguggggccaaagcagccuugggggacaggucuguggauggauauggcuuguccuagugagacacagaaaagcgaguguuaugugauuuucacacgucauaagcguuacuguuucuuucaguuuuagaaaacuguugaugacauguaaaacacacaguugacucuuaggccgagccagaacuugccaagccccaacccuucagaaauggaaacaugaacauuauaugguccuucaagaaaaaguccccuacauacaacacacucucugucaucccucaguucucauaccacgacugacuaggagggggcuaccacagcgcaagcacacagaagcaacaggaugaauaguuagcaaacagauaugaggggcuggacauggguuugaguugcaagugguuuguucuuuugcugacccugagucugagcccauguggcuccucucccuuggauaaguacagcgucccuggaugcucggccucccuagaagaaacacccccucacuguuuucugagaucuaccucucaagaggaggcaguagacagggagccccacacccucaaaaaaccaguuugccauugacuuuucuuucaaggaaaauguagccgcauggaagacuagccacaugcuauauucuaugguucgguacccagagaacucuagcuagucagggcaucagcagcaaggggccugaggaaccauuugaagaccagagucuguuuuugcuaggcuggcaggccucaaccagcaaggguuccuggagacuccuguaucagcgccaguagaaccugucuacacccugaagcauccaugccuccacagagagacauuauucaacauggcagccucuagccccgugcggcugugcaaauccuuuacaugaguuaaaaugaaugguucagagcuucagucacaauacacuauacgauguuagccuugaaugugaagguggggcuuagauucacccuggaaaacaaccucuggccauaucuguaagggaguuccuagauuggauuaauucagguggaaagaccaaaaccuugaauugugggcagcaccauccuacaggcugagaucaaagaaugaauaaagaggagccagccagcugaucaccagcauccagugucugcauccugcggaugcagaacacagccucaucaguugcuccgugauccccuccugguaaaacgcaccuccuggaacugcagaacaacccuuccucaaguggcuuuguuggauauuuugucacagcaauaggaaaugucaccaauaggccaagacccuuagagcagaauuccaagaaccaggaugcuuggauauggagauaggacgauauggagaauugggggcuuucagaguggggacuugggacacuggaaugucuaaaggcccgaguccaucauucuuccagaacuagcaggacucaaucaucgaagguuuccagaaccuucugaaccugcccccagaaaagcucaccccuugaagcuggcucuaaagcagggauacuaccugcuguguccucagaccagggcaugugccagcaaaucucaucuguaauccucucacaggggaaggggaguuuccucuguggacaucccugcugaggucacagcagacaggcugccugccagggucugagaucuggcuguggcugcugcaguaaccuccacauuccucaggggcacagaugggagcucuucuuggcuccccucuucccugagguggggcuggggacagguaaccgucuccauaaaggcacacagagugaacagauucuuggugugcuuaguuuaauucucucgcuuguaucugauguauacaugaccaagacaaauggauuuagaaugagccucuguguagagguagugauggagaagagaccagaggagggaauagagaaucccucuggaagauaccagcuuaauccuguugaaguaaguuggggaggugagcuuccaggugagacucagcuauaccuuggcaggagggcacccugggcaagcagaccugggcucagauguacaaggaaagcaaagaugauaccugggagguuuuacugcuaucuucuccaggaccauauccgcucauugccucgguuccugagugaaccccaauaaaugguaaagaauaaacaagaggcccaaggccaagugccaagaccucagagugggugagaugugcuccuuccggauugaaggucagcaaagccaccugagaggaagggacauuuguguugagauaaggagagugaagaggaggugacccgagaggugacaggcagaagacaccaggcugaguacacagcagugaccuccuguacagacucuggacaggcagggaugccagguccuuccugcguuucuuaucugaauccuauguuugggagcuugugggcagagucuguguuucaaacugucccauggaaggccccauuaagacccaggaccaguguguugacagauaacuucaugugugaagcaaacaccccuggcuucuaugguucucucccucuccacuagucaggccucucaguugacugugggcagcucugagggcugaagcuccaaauguaggucuccccugcgucugugucuuaccuccuccucuguuuuuucucuccugcugcuucuggacagccuuuacguggcagagggugagaucuuccugauucuagcugugacccaagaggcauuugagucuauugcuucuagauuugggaugacagcaccaaagagggacuugaccuuucuggguagugagccuaauucuagggaugccaggaggccagaguagccugugggguucucccaaggcuguaggcauggcuaguugcagacaggcugaggaaugagcuaaaugcugaugucuaccaaguacagcaguacagaggcucaggguggggucaagguggucuuuuccugcugaauauuugacauauuaggggacagguaccccccaaagagcaguuuucccccaguaccucucagaucccccuaaccauagcaaauguauacuaaggcccagaaggaaggaagcaguuacccugaacgcugagacugauccuuggugucuuggguagagccugugugggacacguggaggcugacacaauggccaucuaacggcacagaggcaucauugagggggcccaaugccuagacaggcucaaugacuuguucaaggucaccuagcaucuuagggaccugauggagccuuggcugacuccugaagcucucgugucuucucccgcagcaggccaccucugguugcuucucacuagugccauggccaagaagucagcgcuuccacgggaccugccucuguugagugcaaaagugauaaagucccugggggugggggugggggguccuagaacuguccucgcugaaggauuugguuuguaucaauuuaagauuggaccaaauaauuuaauucaaaugcugcuugcacgagugcuggagcccgggacucauuaaauaguggauugcuucaaaaugagucugaggcaaacggaucgcaugcaggcugacucggccuccagguuggagugguggcagagauggggaauauuagaucaucacuggccagggcucccauccugcuccacuccgaagaccucccccccacacacacacauggccuguuccccaccauacuggacaaugaccagugagcaaaagccauugaauccuuagugaucuuccccaguagccaaaggggauggcaggcugcccagcaagcucagggucucuccccugcauacuguacuuucuuugaggccuuaggagggauguuguugagcugggguggaaaucugcuaaaagauuaucuucucagauggccauucuccaaagagugccuccucccucacguggcuucuccucaucuggcaucaggugguccugccuuuucaugauguuaaucuggucuugaagccauuuaauugaacauggcuguaccgggugcuauagagaacccagaaggacccagaagggugccacaauagggaacuuucugaaaucuuugaaagaaggcgggugagaaugucccuccacagagguggcuguugaggucuuccuuggauaaggugucauagcugaauucugggcucuccucagaucugcacagcuugugggagcucagagacagaucugacccacaccgcagagggauccuggggaucagguggcucagcuuggcugugaaacaggucugccaagguagcgccaacugagggaagagagaagguggggcagaggcaggacacgucucaaagcuccccacccccacaggaagcacgcgaaggaaaaggaaaagauagggagccuugucucuuccugggacacaccacucuggaaaaaggccuguuggccccagaacacacaaacagcagacaccccagaccccuaaaugggcugguucucagggcaggagaaggccgaggaaaacaucagcgguggggucacuauggacgccagggcucugcguggcaccccacuagucucuagacaagaggguaccugccgucucccaccccuugccuccgaagcgaagcucccuuguggucucagcaaggcauagagagauggcccugugcagugcaccaggagaacggggacaggguucucaaacuagaggguugccuggcaucuccacagaauguucuagagcacuucuccagcaggggaaguuuuugcggagugggaacucaaggagaaccgaagaucagcgagggaagcccaagaagcagcaggcacugggguaggagccagcgcagggauugggggcaggggagugggaggguggagacugcaugagguuaggagcaggcacugggggcggggccagcgcggugcgggguguagguggggcagacugcacagucucaggaugacagcacgggcauagcaguccugacucuggcaccagccccagcagcacccaccuccuucaccugagcucccaacccgugggagacacugugcuugugagagaaaccgccccgguaaagccccgucagccuaaggaucgcaugagugaggagugcgauaaagauuaaaugaaguuuuagauaagaaggcauaaaaaucauguucaaagacauaaauaaaauucccagagcucugacuuuauugugcuggggguugguggugguuuccaagauuaauaaauuaaugggcauaaaauagaguaauggcuaaaaacggauaauaagguaaauuuggaugugcagugggcauuguuuccagcugugaagcucuggucagggaugaccaggccacagugggcgugcacaucugucccgagaucaucuuggcccuacaaucugcugcuuccauucugccuccuucuggggugaaguccggguacuuagccacccucgcccaaauguucucccacccuccggggauccaugggcgagcacaugguuccugucacucucagcccuggcccguuuguuugcucugcagagccagauggaugcuggaggugucauuuucucagccuuagcagccuguccuggcacaugggccuuuggccccacgugggaggaacacggucuuugcucuuccccuuguggaugcaucaggcugccuggcccugcuuguccuguggucagcaggagcuaccccguguguguguguguguguguguguguguguguguguguguguguggucucacccagccaucagggguuuguaucuccaaccaauuucaauauagccuugccauuucuauuacaaauacuugcaaagcuacaagacauaaauaauaaauaaauaaaguaaaauguccuuuuucucaucaaagugcauugcucagacucauuucuuguagacuugucaaguggugggaacugaucuugaucgugccagugguuuguauuggugacagcuagacaucuccccucuguuccucuccucccucucuggauaugaagcaagcuuucugcucuuuauucccccauccugucuguguuagguguccagaguuucucacacagacaauggauuuccacaggcucuucuuggucuaccaccccuguggacagcaucccauguggguuuuacgcauuuagacaaagaaugaccagagagauggagaacugcuguccaagaugcggcucucugugcucucuggggcugggggcucucuccauuuccagggagccagcccucuuugucccacuccuccaugccuagccucuagagggcagcagagauggguaacagaaucccacacuccaggcccucaguggccauucuaagugaggaguggggagcacaagguaguggcugggauuggcucccucuccaggugggccucagaacugcaucugcuaaacaccugugacacugucuggguaccaaggcggaccuuugccacccagcugcacccaggcaggagucugggaaggaauucuuacuuaaaaccggucaugaggcuuuguuugugaagaaggugggggaaaugccaggccagacuguggcuauguuaaugcgaggcugggcucccugccaagacauuaagcggggagucgaauuccucaaaccagcuuuaaucagcagauuuuuaagguuagaauuacucucuccucucaaggcuugccaagguuaauucuggccugagcaugcagaauuaaugggcuggacagagggaaucgaccuuuucccgauuuuuuucuuaaguucacaaaaacaucucuacaagaggagaagguggcagggcugggcccccaugggaaagaaauaccuggcacuaagcaacccaucugggagcccaggucagaaacacacacagucagacucacgccaagucaggcgugaacacaugggccaggacaggcauccauucucacccugggagaguggagaguagaguucccagcagcuccagccccguccccuuaaacagcugugggccuccuacccuaccuagccucugccugauggggcuacccaagccugugugucucaguguggauggggucuagcuggccaagugaaggacagaggcuucuccugguccagcacagaucuacagaggaagguaguccugugagcgcccacagcaggagcagggucuggguucgaaacuccccuacacaccccaggauaaugacugugggucagggcuguguucuaccuggaucugccaguggaaacaggagggacauaagccccgauauggcaggucugcucggugaagcagcgauguauuuucagugacugacacccacauggcaguagcaaacacaggcuuccuuaguuuccacaggucaccuacagauggucucccuccucuguaguacucaugguguccccucugguggucccuacagaucccugccugggccgcacugggagagccuuccuuugccugaggccagggcuauuaaaaaccaguggggcugcccagagcugcuggaccuggccacguugcuggaugguuugcuccuuccccuccaguuggucccgcuucagccuggguuugaaacucaggucauccucgugaccuuggcugggcucaccacucuccacagcaaggaaguaugaaagccagacugucuauccacuguguaaccugcauggcuaccgguggccucagcaaaagugagucacucuuggccugacuuccauaucuucccucacucugcccuaccccuucuugcccuggaauggagaaggucuuaguccaggccacucccuucccccuuucucuuccucccucucuuccccuuucccucucccuguccucuccucuucauagucggagcuguuccuaggaucugguaggcauggaaggucucuuacuguaguguccagauacccgcugcaaugccuagaaauacugaaucuguaggacaaagcugucaagccuggugcuuugauaaaugcacacacaggagccuaaccuuucuagcugguagacugcagcuuuguggaccagaagcacugagaucuaggccacugucagggucaccccgguugugaggauggagagggaagugcagagacaggaagaucugccucccuccuggucaugugugacucagccuagccaucuucuguaugucucauugagcugggaugcugauguccacgugcuggaagaccgggcugccuaaagccucucccagcaucugccugacuuggcaguuuugacucuuccaucccccauuccugcccccugggcucaggccaagaucugaguuccuagugggagggaaugggguccuacucuugugcuuccauggaacccaucagugcuggucaauaggacagcucuuuggaugucucuuuugagcuuuacacagaaacuguggaccauuccucaaaaaaguaaccacagcauuacuguaugaccagccacugagugccuaaguagacguuccaaaagacugcacgagguucacgucacucagauccacacuggaacucuucacacaagacucaggcagcccacaaguccacccauagauggaauggugaaugagauacaauagaaccacacagcggaauauuacucgccuguguaaaggaauaaaggguacaucgugggcaauuacaaccgcuagacuagcugacagucgccagaaaccaaagggaucuauugaauuauuuuaguuacugcuuaguuguugcuaugacaaagugccugacaaaaacauccaaggagcauggggcaugggauuuaauauuuuacacacacacacacacacacacacacacacacacacacacuguuguuguuuucugagacagggugucgggcugaauucaaacacaauacauagcuaaggauggacuugaacuccugacccuccugcucucaccucccaagugcugggauuacaggcuguguguaccacuauacccugcuaggaaggauuuauuuggagucacaguuuggcaguauuacagauggggagggagggcagcuggucacaucacaucuguagucaagaaccagaguggacaggaagccaugcuuggcuuggagaccuuggagccugccucuguggcucauuucuuacagugaagcuccaccucccauuuccacaaccuugcaaaacagcaccacuccugggacccacuguccaaacacaccagccugugaggggcauuucaaugcagguaaauccuggagucagaacucagacugguggcagcgagagggagagaguggcgaggggcugguuggagguuccuuuuugggggggggguggaaauguuugaaacuaaacagcaguguuuauaugacgaucccaaaccuacuaaaugucaccgauuguuuacuugaaaaagcuugagucuuguuaacgugaacuuuaaacccaauggaacaaaaggagcgagcccacagccuauacagguguugcagcucagugaccuccccacccaccccaugagggcaucggggagccuggaacgaugugcagaggucacagagugcacgggcacacccaagucccuuguccuuuugcaugccugugauguggcacuuacuaaggguauugagggucauugggucuuggucagcaagaugauugcugcccuuccuugcuugacguagccuuguaaacucagggucuaguugucuccccuggcucuuuuauacaugcuuugccauggauucaucuggcaggccuguggguugguccucagguaaugucaccaccauacuucuaugugacguuucuuccuuguacuugcugagcacucacacacucacacguggcuuccuguaugaaugcguguugaccacaggcuccuguguccacaugccagcaccgaggaguauggggauaaaggccuaguguugggaccuagcuaagaacacuggagaaaccgagggcagggagccuagagccucguugggucagcuggcagcugccauccucuaaagcuugugggccugggcauugccuaugcccaaucuagcucagucugccaggucucaugccgaguuugcuacagacaagauggcagggaggggucuuccccuuuccccuuugcaaggcuccuuaaggagguuugcucuucugcucucuuucaucuccccaaccuggcacaaacauggaauucuuugggaaagucccuaagcugagaaucaaaucuggggagaaugaggggggcucuugagaacagggagagcagagcuaauggucucucuggccucagggcagagccaagaccuuccucagggguggugaagucucccacccgcccggguaggaaggagguccauuugcuggcacaguucagcggguaucuaggcugccacagccccacagcuccacucugugaucggagcccuccaagucugcucgccaagucccuccugcagcucugagcagggccucggugagagguguaaucugcagauggcaacaggaagcaaauggcucuccacuggagccuggggcagggagagccgagggcuggcuggguacuuuaaugauacaaggcagggggcuuggucuccugggaccugggaccuguaaaaagugggagugaagcucaguaucucagcuggugugcgcuaccgucuaccugcagaucccacauccauuaaagcagcagccugcuccggucugugcaauuacaccugcaucucugucacgagcaucauccuugcuggccucccuuggcgaaauaacagauuguccugcagccuccaggaagaugagccucccggggcgggagcagugggcuugcuuccuaaugaugggaugcagguaucucacaucuacuugccuucucuggacucccacccuuggcccugcuuuuuaucugccuuguaauggguuugcaggcucuggcaagagagaaugcaauauuuuuaaaauguauaaugucacgcgggcugcaugcggucccaauuuucugguugcauaagacgggagagaaacgggcuucuuguugccuguaaccauuggguggugcuaaauucugacucacuggaauccugauauguugcuaaccugggugggguagcaucaaaucucauaagcaagauggugaagugguggggcucccggcccgggucucacuuguuucagaccugcucuggucuguuuaugagucacgggcugcacgagccauagccugcccuucccccacaccagcggugagucaggcuacaagaaaccugccuccucucucucugaagcuuaagcggugcucugggcauaaaggaugacauuauacauggugaccacauguccagguuccugaaaaauuaaagaacauauuuauucauaugugaguauguguguguguguauguauguauguacaaauucauguggguacacauggaggccagaagagggugucgggucccccaggguucgauuuacaggcaguuguaagccaccuaauaugggugcugggaguggaacuuggguucucuauaagagcaaccuguguucuuagccucagagucaugucuccagcaccugagaggucuaacaaaauccauuuagagccucauuggauguguuacgucucugagccaccaucuccuaacaaaguaucaguguguacugacccaauacccuugcuggcccuugguccucacaucaacccuuccuuccgggagagaacuggcaccucggucucuggguggagccacuguacugugaagaggcucgggaugugggauguguuuacaucagaaggaauucugaccgagccacuguaccauguaccgugaagaggcucuggauguguuuacaucagaaggaauucugaccuggcuaacugggcggcauccuacaagcuaccccagcagugagugcgggaggacuccccuuagccccacuuccgggaugguggggucagaagcugaaccugcccugcccaccuccuauccucucaaacgugcagccuccuuccaccacggcacagccugcaucgagguuugguucugaagcccucucuucccucucucuggggaacgagcauuuccucauuccuaacucgaagucaagaaaucagucccuaagaggcugaggacucucccggucccaccuccuggcacgauugcccaccccaggaagagucugucugccucaucccucaagagucagggaccucaucucacaccagacaaacuucacuuggcuccaggcauacuugucaggggcaagcuuaguuaaaaagugggcgccccacccaugggaguccaggauggggccugggccuguaccucuugaauccugcuugccuggaaauggaggugcagcccccacaccagugucugucucagacucuaugcuuccuucucggaguggcuccuagaagcugccugcacuccugggcaucuuuuugaccuuacccauggugccccgucaggccacaguggcaucaguacuggugacagguggcuguuuaaggggggaaccuuuguuucugugcucugagccauuugauaucugugugugcaaaauggcccuuagcugucacagagcaagcagugcccagagcguagccucuacgaagggcucaggggaccccauauucacgucaguguugcugggacauugugguucuggugggagaggacuugggggaaaaguuagagcucuguaacaagaccugcacccugcucacaagaggccugagaccugcacccugcucacagaggccugagaccugcacccugcucacagaggccugagaccugcacccugcucacagaggccugagagagaccugcacccugcucacagaggccugagagagacuugcacccugcucacagaggccugagaccugcacccggcucacagaggccugagagagaccugcacccugcucacagaggccugagagagaccugcacccugcucacagaggccugagagagaccugcacccugcucacagaggccugagagagaccugcacccugcucacagaggccugagagagaccugcacccugcucacagaggccugagagagaccugcacccugcucacagaggccugagaccugcacccugcucacagaggccugagagagaccugcacccugcucacagaggccugagagagaccugcacccugcucacagaggccugagagagaccugcacccugcucacagaggccugagagagaccugcacccugcucacagaggccugagaccugcacccugcucacagaggccugagaccugcacccugcucacagaggccugggagagaccugcacccugcucacagaggccugagagagaccugcacccugcucacagaggccugagagagaccugcacccugcucacagaggccugagagagacuugcacccugcucacagaggccugagagagaccugcacccuguucacagaggccugagagagaccugcacccugcucacagaggccugagagagaccugcacccugcucacagagaccugagaccugcacccugcucacagaggcuuggacccuuugugacuugagggugcagagagcaacuucgagaaccagagaacucagcagacauugaaucugucagagccuuggacuuggccuuccagccucaagaaaagcaagaaaaccauacauucugugugugugugugcgcgugcauguauguguacauguguguaugugugugaguguuuaugccuguguguaugugugaguguguguguaugggugugugaguguguguauguguguaucugugugaguguuuguaucugugugugaguauauguguguguaaauguguguauauguguauauauguguguguauguaugaauguacaaguguguauguaugaauguacaaguguguacauguguauguguguaugaguguguauauaugugugugucugugugaguguguguauguguuuguguauguguguauaugugugugugugugucuguguguguguauguauguauguguguguaucugugucugugugaagucagugauuuggcaguguuucgcuacagcagcaugcuggucugagaaaggcucuguccuggauucucaggaggacggccggcucucacccgcucccaccucugcuaucaugcuugggcgucuagcagagcucacugucaggaucucccugcgcaccugccuggagaccagguucucucuggcagaugguccuuccuccaggacacaggcucaagugaauuccagacccauugaagcgugggauuucaugccuuccugucagccugggagcccaagagguggucccugcagcaggugucauuuaucagggcugugcagagagagaaccccaugccugugccugcugccugugagggaaaccaucaaucuucguggccuccuccucaccccagaauuugcucagggaaggagaggaggaaagugaggaggccgggcuugugcaccuaggucuccgcucugcucugcaaacacagagggugguguaaggggagggagaaggcagccauagaggagccugcuuuucugccaggaggccucaugagcacgggcugaguguuugcaggcgcuaggguuagaccuucuugggugugaccuugguuuuacaccagcaugugaccuuggacaaacagcagagacuuuuuguacccaagcaugggcacggugggaagcagagaauagcuuuugccuccuguagugcugaacaucugucugaugugcaucuggaaaugccucaagcccagcccaggggugccccaggggagcaauagcucccucacugcugucuccaagggaacaggggauggugguuaccuugcuacccacagggggcacugaaaaggagaaacugccuagaccaaugaaaacaaacaggaggagagacacagggcugacaagaccacaggaaagcgagaacugacccuugguguccauugaaagacuaaggucuuggaagggaugccgcgugguagaugucguguuccagugacgcccuggcauuccucccaguacccaaggcuggcauaggcauuggaugggacugagagggugcgugcagagagguugcuggggagaucuagaagccugaguggaagaacagacucagcccgagcccuggagggggcggcuucaugcugguguguagaagaggcccugaggugguuugguuggguucggggagggcaaagcaucguauaacuggaaagauggcagagaccagcaucccaaggcuuguagguuguaagguguacuagcaaccagcauggcgcuaccucagaugcccacuggcacucacucccacccacccacccaaagcccuucagucgaaggcuauuccaugcauguuuccgggugcauaucuauguuccugcagagacacacccucagaagagcacuucuguucuccacaggugcuggcagugccuggcuuacuaugggugggcguggaaggagggacauacgauguugcuaucucacagggugaggagggguaguccauagagagcgaucggguccuacaacaccauuaguggcuugggagucaucuguggaugccagcacuguuccugggagggagaaaaaucucaggcucugcuuacaggaugcucugagcagugugcuguggucuucgccagguguccauacaaggaacagcagggcuuugagcagagucccacacagcccuggaggagugacccauucacauucauggcccgagggaagggaugucagggcuuaaucagcucaguaacuucugauggauggucccuucaggugacauaagcuggagcacagccuccugagggaggcguucucuacacggcccaaagacuggcucagcgccuggcaggacuaguaaaugcagugugaccaccacgugccauccacuucucuguggcccauucacccuaaggccagcuuuguggucauguaggcccucgccacaaccaguaacagugcucucucuggccuuccuucccaagugggacuccccauacccaugggaucugagccccagacagccucuuacccccgagccucugccaggccaagcagcuuuugugaucaaauauuguuauauuuaccuaaggaucuguuaggaagcaauuuuugagaugaugaauauuuaaugaaaaauuuaaauauuuaauaggaacucuuccaaaccugacuuaauaaucugugucacggggcgagagaggcagggucguggcuugcaacuuccucuaguacucuugguguuugcuagguuuucuggguuucuuuuuuuuuuuuucuguucacaguuuuaauuauacucaauauuccagagagaaucucuuuucucauuaaaacuuaacucuugcugacagcaaggugaguggguggguaacggagaugguugggacugccuacaccaaccaccugacuccauccugguccacaugaggacagaaugaucccagacauccacagacgcaucuaagucacuucugauacccgaguuuaugcccagaugggacccaggccuuuggugacucugggaacggcuuucuagacagcaucuagaugccuaagcauuugugccaauucaggcugauccaagugacauccccaggccucugucccuaaccgaggccaacgggagcugcaguagauggaaaauuccaucccacaguaggucaaugcagaccaccuugaaagacuuaaucauucuaacguucuuccaacacaggagggcggggccggaagccaagcguggccuaaucuugacaagauccccaucuucucucuguaagggagucugguucacucgccuggagcuagcuagguucuucuaccuggacccagguucacagggaaguuugcccagcuggguguuuaggcacugguaucucagcacccauggacucaagggauauccauccuuagcagacugauguucagaccccacuccaacccaauuccaagccuuuccuuguccccucgaaguguaagcacacccgugcugggugccugucuagauucucacucauagcagcugcuuagcucaccugcaggcccuguagacucucuugcccucugcccaagccacaccccuauggggagucuuuucagagccugauaagggcacuggagccaagcucccugucacuggcgucaggagggucucuguucugcugagggcaaagugggagcgugcaucuugaaacacacacucagccccaugggcgcuuucaugucuagcuccaugccaugagcaaguuggaacuugcuacacacauuuccauauugucagagccucgccuagcuuuuaaacccuaucuaaccguaaacgaacacuaaccuaaugcuaacuuaacccugacuuuacccuaacuuuacccuaaucuaaucuaaccuuaagcuaacccuaccuaacacagaccaacauuaacauaacucuaauuuaaccuaagccuaaccaaaucguaaucuaacuucacccuaacacuauguaaacuuaaccacaaacaaacauuaaccuaacucuacccuaaccuuauuuaaccuuaacccaaccuaaccaaacuuuaaccuaacccuaacccgauuuuacccuaaccauaucugaccuuaaccuaaccuaccuuacccuaaccuuaaccuaauucuccucuuaucuuaucuaaccuuaaccuaucguaacuuuaacuauagccuaaacuaaccuaaccuaaccuaaccuaaccuaaccuagcucaaccaaacucugacucagccugagcccugucuccucuaaccuucucuaauucucucagacuaacauggauacacauuaguccaugcuccuuccugccaccagccccagcuucucccguaucccuguaggcacaggaccuugccuaugugcaggauccauguuccugucucugcccugggcuggaggcuucugggacacaggacuuuguugcuuauugccuucuugggcuggcccagcaccagagaggcaggaaguagcaacuagaacucuggcuccagaccauauccucaccugccucauggauucuguagaccucccaggcugcagccgagccugcuggagcugcuaagacacaggcugaguuaccagaagccuguauacuccagcaugcugggcacagaguagguccucagaauggcuuaugaucuuggguuccaggcagagaucauuuuggcuggggagaccacacuccagagaaaggacaagcuggcggacaggcugacauuucaaaaugguaacucuuuuaauaaagagauuuuaaauauuuaguaaacccaugcaagaggccaauucaggcaggaaugauaguuuuaaucuuacaggagcuccagaggauucccucuaagagagcucccgccccagcccagccugagcccacacacacuggugguuucuuugggaggccugaagagggugggcucacugggcuccugacugaucaccaaguccuagccuggcuuuuccuggucuguguauaggcagagguguguaggaggagacuugaccaacuuaugggaacuugugugggagccacauuagggcugccagcaacuguuaggaggucaagaugacugagcgggggaugcagagaccugagggaccacucuagaaacccuacuguucuuuccuccugacuuccacauccacacaacccauccaagaaggcucugcccuccacccuaggucuauccuaggucaauguaagcuucucuuggcucaucugggucuucccauuucaugcuaaaugcaaacuugguacccaguguccuaaugggcccugaugccauccaggagcuccacagaugccacugugcugagaugguucagguaccaucuccagaaguugcugaugauggggcugcucagucuugggggaucuuggccccucccauccucuuuccaucagauccagucaccuuggcacaauauacacuaacucauaaguacuugcugagguuuccgugugcuaggugcuacacugagacggaugccgggagaggcagccucacagacugguggguccugugcgugccugggcgaggauccagaggccucugcggucauucugcagggucucggagggguugggaagcagggcaucaagccaggagugacaccuauaagcaccuauaagacucagacaucaggccaagugucccagagggggacacagugggaaagaguuuguggacagcagugacagaagagcaaguccagaagcucaguagagaauucggcccuugggaagccuggggugaugacaccuccauauugccuuuuauaaucaguaccuguccuccccaucagcccuacuggggagggcacuacauuuauccuuuauaaauccauaaauaccagcucaauaccauuauauaccagagcucaauaaauacuaguagucuggauaaaaugugcucccccacccugaaggggcaucccuaacacccccaucucacuagaaugcccugagcugugguuagccaguuagcagauuaguggguuagcagguuagcagguuagaguuagguuagguugggacugagaaucuuggcaggucacauugaauggucagugaggucaggauucgaaccagggcucaccugaccacaaaaccccuguccucaaacagauuaagaccuuugggaacacauuucuuuggugucuaucuccagguagacccacccacagcaccugccaggcugucccugugugcccacagccaggacauugguaugcaaccuguacucuccuggcacaggcugcuccuucauuuugcauaguuccuuauuaaagcaggauacuuuaaucuucaucuaauuuugucuuuagggaagcucuggccccaggcugccuacugcuaaagcccucaggaagcaggcgccuacuugcgauucacgccacgacguccaucugccaacacgcccgucuucugugcuugccaucucuuauuuauaaucccgcucagauuaaugaaugacgguaguucucaucacaggaaauuugauuaaucaauuuaagugcuuaaucaccacagccucguugagagcugagcacaaggggucucacuuugauguagaugaaauuucagaaagagggaggaaagaauuaaaguagucagcauaucuccauggcaauacaggggauaagggcaucccugggaagucccaaggguucccagaagaucaaggugggggcuccuuggaaagaacugacagaugacucaggcaaggcaccagaguuaaccuacccugggcccuagcuacucauuuaguuugcccugaaguugagccaggcaugucccaggaccccaggacagcuguaagugugguccagcauaaauuuguaaaguuacuuaaaacaugauauuguuugcauuuaaaaaaaaaaaccaaaaccuggauuguaugauucucgaacuucagagaagacaauguuaccccucaauuucggaaggccguucuugcuuagcucagaauggguagguagcacgggcagagcccaccccggugggagagcuucgggaaguggcauggcugagccggcacagaauccaagcaggcugagauccacgguucaucaucaacagcuaaugagcuggacccauggagcgcagggcugcucucauccagaugccccucuggcaguacgugcuuccccuccuucuggccuuggcucagggcaccauccccaccugccugccaccucuuccuuuuagccaguguaagguuugcagcguuagaagcuuagcuuagcuggguacccucucccagaaaaguacccccaccccauccuccagucucugcuagcucaagcuauagccuauuccgcaucacuggguaccauaacgcagcucucuggaugggcucacuucucucaacucuuuuggggacaaauacaaagaaagaccccugggggcuugcugucccaaaguccagcugaaucugugagcuccagcuucagacaguuagcagagaagcaacagagaaagacacccaacagccucuagccuccacaugcaugugcacacagacauaugcaugcacacaugcacacacacacaaagacacacguggguuaagucaggguugaaggccugcgccagcagaugcuacacaccucagacugacgcagcuuugcacaccagccaggagggccaaagccccagucaccaaacauucacugaauaccuacuguguguaagcuguaguuuaauugcaauuagcugcauaucaugacgaauaaccauagguacuuuacaguugagagagugggaguggagaagggccguucuugguucucaagcugugcugagacaggacaagaggggaacaggcuggcucaguucacuacucugcccccacuccauuuccugaagccugcaagaacauggaaguauauuucaguucccaggguucugggacccaggggccacaccugccgcacuugcgaaggcaaacacuagcuaccucugacagguaaaaaaagagagugcaucucacgcuguuugugacagcugcuguacagagagaggcuaauuuuggaaacagauuauuaaaacauauaucugcucugaagggcgcgaucaaucaaaagcuggaggggcaggcucacccugugcucuaggucucccuggcagcagacagcuucucccagcuacagaagagucugccaggccuaguccccguugccacacugguccauuccugcuucaggcgagauggagaggaagcuggggcccugcuugcauuuuggaggcugcuggugggcucuaggcugugaacuaaacaucucuccuuugccauuccugguauggccuugacaugaggguccugaggccgacugucaccugugcaauggcagccauguguggugccugcccugggguggggguuagugcguggacagguguggaagccuagcacagguguguaccccaggccaccgacuucccuggagguacuuccucccucucagauguguugggcuaucaaggaggguuuggggaauucuagagaugauuccgugaaagucccucagagcuugcucuuccuaugaaaaaggaaaccagaacauaggagaagccccacccucugacaagugugcugugcugugcugugcugugcugugcugugcugugcugugcugugugugcugugcugugcugugcugugcugugugugcuguggugugcuguggugugcugugcugugcugugcugugcugugcugugcugugcugugcugugcuguguaagagccuuggaaacccaguccuggcccucaggagcccaggcccucucuccccucacuucacccaccucagaaucaagguccuggcacucuggagauaaaaagcaguccugaaucuaggacaagggacccgugcugucauacauagaguagugagucucaguccuccuaaugccgccacuuuuuaauacaguuaguuccucaugcuguuaugacccccagcuauaaaacuaucucccuguuucuucauaacuguaauuuuguuaugguuaugaaccauaauguaaauaucugauaugccggauaucugauaugcaacccugugaaaauguuguucgacucccaagaggggcuggacccacagguugagaaccauugguguagcgcgcucucuacuggguuucugccuacaucacgucuccuggaaacugcaggaccugccuguuucaaaagccuguuuguucucugcccaccugagcaagccugcuacugugcuuuauggcugagaugcuggagaaagagaucugccucuagcgcaggugugcccugucucuuuccugcuagcaacaggcuuggcacacaggucagaauccacccacugcugugccugguucugguggcuccacuuguauuuauagccucuaucacuccccccacccaccucuagauggcagaacccucaguccccuaccacacugagagcccuaccuuccucccagacaugucugacagaagcccagucacuugagcuaucccagcauguaauuugaagagggauguguguguguguguguguguguguguguguguguguguguguguguuuaauaagaaacaacagccaccuggaugcuguaaggccugcaagauaccgaggaccugguuggaacuugagucccaggaacauguuccauguaccuuagagccagggggcugggaagaaagcuccaaacccuagcaugguggaaccccucuaugaucauccacuucucuaagaaucuuggggguucugcaucugccaucugccaucugucaccugcaagcagagauaagcccuagaggcucuccugauucaguugccccauucugggagucugggagagucugggaacauuuccaggugggccuugggcuggaggaucuaaacagcuaugaaaaagcugggacuucuagggucuugaagaaagagacuguagugucagacuaauacacugaagguagugucccagccuucaguguccccuugcccugaugccacacuaggcaggaagguaccuggaagcuaaggggcauuucugcaaccaacaguucugccacagggugaccagagcugagccuaauggaucagcaagaggcuuccuccccugugggcagcuugguuacugcugggcugaaggcuuggugggcaugugcaaugaaugccccauuccuagcuccuauccucagauguguccugaaugaccagaggaggaacaagggagacucucgcagcuuucugcugccagccaugagcucggcaacagucaagcugaugaguuuguaccccuccagaacuuaggagcucccaagagacauagaaaaugucccccccccccauaaaugagauggaggauuuugucaaugagauuucauccagccgaagcuagccuggucuucugcuuugggccauacccuucgcagccagaaaacauugacgagagcauugaucauggacuuucuagccuuacaaaacccaugucuguccuucauccauagccacgucugaagaauuccaugccagccacacaaacagcuggagacacacauucacucagauucagguuagaguacccagugcuuagcaagauccuagacacggagggagguccggggcuccuggagaaguuaaugaauggauagauuaaucaaugacagagcuguccuauugugagaaugauacaguaucugucccuggccaagaggcgcaugaagaugucucuccucgccugugaccuccaccuaccuccugcaguccuuugaaugggaacaaaaggucuggccauugcugugugcugauaccuagggaaauagccugguuggauagacacagaauauauccuauccaaccucaggauaagggggagggaggggcuugguuccuaaagggaggcccaggggaaucuuggguuacaguaauaggagauguagcccugcugacagacuuggccuuugugguggcuuggauguguguccccguagucaggaacauuuugggggcugggucuccaguugguggcacugcuugggagauuuaggagguguggccuaguuggaggaggugugugccuggacgugggcuuugaauguugaaagacucagucguugcuuugguucaagaugugggcccgaggcuucuguucccagaauccaguuccuguagccugaugccccucuguggcauccauggauucuaacucuagaacaguaagcccaaauaaacucguuccucugugaguugccuuggucacaguguuuuuuaucacagcaauagaagaguaacagagauggaauugcuucuucuguggugacacgggaugaucccgugacccugacuuuggguugagaucagggcugauagcugucaaugggucagcgggccucauuccucuacauaucucaaugcugggccccuucagaacauuuccaccacaaggacccuuccugucaagucccacccaccucccucuuucucaacgcccugugcucaccaaucuguuuuccacauccauaaugcuaucauuucagcgauagcaucuaaauggaaucccacaguauacagccuuuggcacugacuggcuuucuccgcucagugaauccagcccggcagugguauguguuuauuguuuauuguguccuugaguuaccacuggcuccucugugucacuggcuuugccaggccuggagccuucccuaggaguaggaaccugcagggucucuacaucaggaaaccacugggcacgucaggggugaagggugcaggugcaugugacagggcagggguggacauuuguucuaagggcaaauggcucccggaggccucaucugaagaguccacauucaacacuaaggaacagagagaagagagguauagugcucaggugggaggugggcaacccuuccuuccugaccucuugcagccuauuaggguagccaugugccucauacuggcccauucuguccgaggauucccaggggaaguacacagauacccaaggucuaugggaucuguauugagagcuuagugcaccuuggcagugagacccuugaucaucucgucuccaguggucagagggggcuacguucuuccuuuuaaggagcugaucucugcagggcugagggcccacggggccgggagacccucuggggcuggcuuggaaugaagccccaacccaggugcagagccuuuacucaaagagaugcagacugcagaugcucgcccucgcugcugcuaccugucucacuagugggagcucaaccugggcauuuccuacagagagggaaauaaacaaggcuguaaauaauccuuucccugugaggcugaaagacagaagggcccuggauagagauagcggaagaugcaagggccacaagggggccagcaaauuuuguuccacucaguggaacagagacagcugagaggcggauaccagacaggaaagagcagcugaaucuccagggccucacucugcgggggaucccaaaccggccucccccugggcaggcaagaauggggguggaucacugccauggccccucccgugccuugcccuacugugggccaugccagaggccuccaauucucacagcaugcacugccuccccaucaguccuccucaguauggagagugguuucugccgauucucuggaacacuauggacacacccacaaaccgggcuccuugaggaugcugaccugaguacagacuccgacuccgugcauucuggcugugugaccucagggaagucauaugcccucuuuggaccaggcuuuuguuuguagaguagagaugccccccaucagcucagaaagcagagacaaaaagagcagccacucuuggcacgaaucauccacacagcgcacaguaguucccauccuguggccgccagggugccugcuucaggguggccuuggccuugggaagucauaugccucucaugucugggucuuguucuccagauaugaaggcagcuuacugaaugccaggcuugcuguugcgugguucaaagcgcuucuugcccugaugccaucauuagcacacuuucuaagcauccaguugcauugggcacugucauucaucccaugaugaaaggaggguggguggccacagccacgaccuucaagggucucagagucuaauggcagcauuagcaccauaacuacuauauaccuuugugugugugugugugugugugugugugugugugugugugugugugugcauauaguacagggaucuuggagcagggcaauggguagccagggugucccuagcuaggcuuacagaaucaggucucaaagcucuaagggagcagaauauucuaaaagcagggcauguggguaugccauucaggacagagggggucccagcaagagcuugggaguaggaaucuaaggaacacauagcugcauauagaguaggguuuaccugaggaggcagaggguaccugccacugaauggccugugcaaaguguccaucuacucaaagagaaccaucuggaacaucuuccaucucucaagggggaaugucaaagugagcugcuugcuuucaugguggcccucaaauaagccagggauuugggcccacuauggguucagggccagaggcucagugggagcuguucucuagugguacacuguauauggguccucugggguagggugaccugugauagucaccuggacaagggcucuccauucuauccuucaggaccaagccuccuguucaggcuccuuggguacuccggugcuaaugggauccaaagacaacaccucagagugcucagaaauggcccuggagagagaggcucugggaugcuggagugguucacucucaccaggcugggaaggcaccucugagucugcagaaagcugcucuccccaaguucccauaaaguguccugcgucuccacuaacucauugauccacauguuuucccaggccugaagauuucuuaacugucaucacaagguuagaagaauuguggguuaggaaacuaugcagcguauuaaagucaggcugaaauauugccacaauacagagaaauauuuuauauuuauucucuuuuagaaauuguuauaaagggaauauaaugagaauguugcaaacgagcagaauauuuucuucuaaccugacaauaaaaauaugucaacugcacgcaugaaggccuaauagggagaagcccauagcucuagaggcacggggaguuagagaagauuucacuugguaucucagacagcucaaagagcggaaaugguggugucuaaggcaggauuucuuagggaagaauccacagaggagggaggugaggggcaauggguagccucugagccuaaagaaacccuggaacuggucagagaucagagaggcuagcagauacacccauauuaucgucaucgucguugucccaugauuccucucguccuccaucauaaccauuauccaugauucccaaucuaucacucagcucucuuacucccaauaucauuuccaacucacaccacuauccaucaucaucauuaucaacaucccugucaccaucaccaccaucuguaucaucucuacucucaccgccauccaggaucaucccaccaccauaauagcuaccaucuguaucaugaccgcuacuaccaccccaugaucgugaccaucagucaccaccaucuucauccuccccacugccaccauucccaucaccagcacacugacacuaccauuaucagauucucaccaucagcaccauuuuuaccgucauucaguccagcaucauuauuaucaccauagcagcuaucaugcaucaccaccaauagcacacugccaugaccaccacaacagucaccaucuuugucccucuaucacuauuaucuacacugugcauaucauaccuccagcaugaccauuaccuaauuauuaucacugucauuuccaucgcuguuuuaugguuagcaucacuuucacuauaguuaucuacaggggaaucucaguuauagaauugccaccacuucgacugucauuucgucaccaggaucaccguuguuguuauuccauuauccccaacaucaacaucccaacaccaccaccaugacccugugacuacucuccuguguauccaguaugguaaccagacagcuuacacaagcacacacgugucugagggauggaccucgucugggaugccagauuacucugucagcucagaggccgagacacaacuugaaagcaccuguuaagucucagaacggugacgagcuuucuccuuagacagcguuaugugcguuacaugccauauguugucacugauugcagaccgugaggaauuccacucacuuaguacuggauagacucaacaauuuguacaggcccaggggcuagccgaggaaucuaacacaggaagacaaucuugcuucaagacaagaugcaagucaccuggugcuaaacacgggacgagaugccaugaaaucucuuggguuuggcaugaggugagaauggggggcuuuagggaaaaggagauguacucccauggaggaaagggcagggaggcugaggagggcuaagaguugggggugacuucagacuagggcuuccaggaaguaagacuugucuguggagagccuggcuucugaccuguaugaggaggugcuuggaucugacuaugugucuuguggcucccaaagucacaagaaccauaugguuuacgauuugguggccagucugccaaaguccagaaggcaacaucccacaccucuuucugagcccacacucaaagguucuauuaguagaaaaucuaacaauuacucauagagaacuucuaccaaguugcucugcggugagguggaauggcaugggagccccaacugcuauuaggaccccaccuuucaaagcaugugagcuggcgugcccagaaaggcugcccagauaaccugaccugacccuugcuggggacugugcuucccaaaacuaugugacaaacagcuccucaaagccuacugggagccaauggcucucuggugcuacauuuccucuauguaugguacacuugcuaggaccacaccugcugggaccacaccugcugggacuacaccugcugggaccacacaugccaggaccacaccugcuaggaccacaccugcuaggaccacaccugcagggaccacaccugcugggacuacaccuguugggaccacacaugcugggaccacaccugcuaggaccacaccugcagagaccacaccugcugggacuacaccugcugggaccacacaugcugggaccacaccugcugggaccacaccuucugggaccacaccugcagggaucacaccugcugggaccacaccugcugggaccacaccuacuaggaucacaccugcugggaccacaccuacaggcacagugcuuuccacagaagugagucacaucaccucuguccaucaguguuggaucucucccuaaucccaagcacgggugaucucaaaaggaaagaaagaacagcaggaggauuagagaaaccucuggaagacagagcucacugugcuuccauguccacagccaaugcucaucucucucucccaggggaucagcugggauuaugcugugcucuggacucagcaauguguacagagggcaggggugcuccuggggaaaaguguccucaaguugacauucaacuucccaucgcuaaaaauacuucugaagccaagccacucaggauuauaaagagaccagagauugagaauucaacacaaauccacccagugcuggggaaaccugaccuucaaaacuuccugucaacaauuuuugaaacagaauacuauuuauacagcuuaaaacaaaucauuguguagcccuaugcgaaaucuucauguuccaauuuagacucuguaguccuucccagagcuuggcuguguuggcaagaaucgccaucagagaguguuugaaaaacacuguauugcuguagaaauuccaaguuuggguuacgcacaaucaacuuauaaauauuacauucauguuccccggacccgaacagcugagcauuaaucucucaagauuaguagcuaagugugcaggaauccaccacgcacaaauaagaaacccacuucccugacacgugugggccacuuagaaagcagccaaaaagguccugcaucaucuuagcauuaauuuuuuaucagagcagcccaagcucauguucagacuuauaacaaacagcucuucccggcucacaggcauccugucucccacccgacagcgcucucacuuguccuugaggaugggaaacagccucuuccgaucugcacguugcugcugcugcugcugcugcugguuggauucuagaagauuccauccaggcuuaaacgggaaugacaccucaggauguugaguguggaaaacaugaugcuaaguguccccgcugagcaagaaaggccuuacuggugcccugauaaauuacuaaaacacgagccagauuuaaggaccaaauucaaucuugcccugccucccaagaggccagcgcuucugucuuuuguacuuggguuucacaauucuacaaaacucccuauuuauaagccauacccaagcugauaugcucaaacugagcacaaagcccaucccauucugggcuuccacucagaucucaggguuccccuccccagauggagguucuucugccucuuugcuggguugcuaccagccuucccuuccaaaagccaugagccagacugauuaauuauggauucuccaaaccuccaagcauucacuaaaguuaaucuuuuaaaugaucuucauguaaaucaggcccuguucagccccauccagggccccucugccuuaucuaacaaauaguaucaaucgaaucgaugcaguuauuuagcggguaaugggcuccgagcuggaaaccccaggucggcaguuuuggguggugaucacucuuguucaucuuaugucugcagcugggacaggagccaaugcuguccccagcccaccuggcugugcuggccuuggaccagccgggaagggcaugcacagagccuccaaggggagaagguaugcuaucuuucccagcucaccccaagcucuugaggccccuuucucagucccuggcaccgugcuuggugcacugugucuacagacauggcaaugaaugacagcauagaauggccauuuuguuuggcucugugacuauuccagauugggcagguaagauggaaccugaaguccaacagugucaucucuucugagagagugaggccugagucugaagaacacggcagaccucuugcccuuauuuaggaagugggagggcugaugggauguuugcugcaugaaggggacagcccccccaccccccgucacacaugggacauaagggguggauguggccuuacugugcccucugccucucugguucucuggcaacaagaguuuuaucaaacauggucucauguaacccaggccagcccccaacuaacuagguagccaaguacaaccuugcauuucugaucuucuugacuccacuguaaguguugggguuacagacauauacaacaacaaugccuggccuaugaccugcuggagaucaagccugggcuuuaaucuaggcuaagcaaacauuccaacaacugagcucuggucccaagaaccuggcucuuuagucaucuggucuaccuucccccaacagccuccuucaugccagucccucauuaccaccaugcugucaccaagugcugcugcggacccugcuucugccaggauucacagagggagacagaccaaggccagaaggcuugucagugcccgugccgaccccuagcagcugagccacgccucuggguuggaagccuguagcuuuugcuuuccugcuagaauuucuuccccagccacuuccccuggcucaggcagacucauauguggugaagccagccccugguuaaacccugggcgggguccacggaccccugagaucccccaggcaugaaugcaauuguguuuuuuuuuuuuuuucccaccgaguccacaagcagcacuguaaacugcagggcacagaucccauugccugagccauucuggagacuggucucuaacucuccaugucaauaccgccccuucuccuuguccccgcuccccagugggaagucuguucugagaggacauuucugcagggcucagaucuucacgcuguugugugcauauuccagagaagagcuggugccggcugaggacaguuuucuucuaagugaguacugcacuuggccaccgacccaucucacaucaucaaacugcaaugugauacuuuuaugggccuugcuucucaggcuucugaaaucggcuccuaccuuucaggagccagugccauaacuauuuagcugucuggaccucaguguaaggaagaggacaauuuaacccaugagagaguggcaccaaagccaggccugcucuccccuccuauaggcuuuaaaaagugagucuuaauguagcccaggcuagccuccaacucccuauguagccuaaauguauccauaggggcggaggguugagucauugaggagauucccacaccacgaggcucuaccugccccccucugcuccuccccaccacgugucaggaagagaaagugcugagggcuaaaggaagacccuucaugcugugcaaaacgauguuugcaagaacuggcagagaccaaggaagaucaaagccuuucaauuugcagugcagugaugaggcggaggcagaggcuuuuaauucaguuucucuuuuaaaaaagcaucuaugaauguuuacaugauaaaugccucuaaaaugcuucuuguugauacaagagagaagagauacuggugugcagaugccugugucugagaagcagucucccaggggagacaaaaagguaucaguagauggugauuauagcccagagcccauggaccacacugcugaaagaaaauggaaauauaugccuaucagguuuccuucuaccaagagcucacugcacacccccugagcaugcaggacccuauuacacaccccugaguguacaagacacuauuguacacucccuuagcaugcaagagucugccucaccuacucugagcaugcaagacccuaaugcacacccccugagcaugcaagauccugcuucauccaccaugagcaugcaagaaucugcugcaauacccugagcgugaaagacccuaccuuauauccuuugaacauacaagacccuacugcauagccccugaaauacaugagccuacugcauagccucugagcauacaagacucuacugcauacccgcugaacacacaagacccuacugcauacccccugaacacacaagacccuacugcauaccccugaacaugcaagauccugcuucacccaucuuaagcaugcaagacccuacuguacaacucauaaacauucaagacccuacuuuacacucccugagcaugcaaaacuguccuguacaccccugagcaugcagagaaauccucuguugaaaguugucaccugguacuguacuguuaagcaguccaugacccuccugcagccuuaaggaggaggugccauugggcaauucuugaaggauggauaguucacuugacuaauagagacccuaagagcccucucaaaguguuugccugucuauccuugugccuacucuaccuuuagaucaugugaugguuuguauuugcucugcuuagggaguggcacuauuagaagguguggucuuguuggaguaggcguggcacuguggaugugggcuuauccuagcugccuggaagucaguauucugcuagcagucuucagaugaagauguugaacucucagcuacuccugcaccaugucugccuggaugcugccauguuccugacgugaugaauaugggcugaaccucugaaccuauaagccagccccaauuaaauguuguccuuauaagaauugccuuggucauggugucucuucacagcaguaaaacccuaacugagacaguacucuaccuuaagaucacuuuccucuaugacacauaccaaugaacgaaugaaugacgaaugaaugaacgaaugaauguagaacacauauagaaucucagaagcaccagacagcugguucuaugacguuuuucaaguuaacucacaguuaacucaccuugccccuaggagauggacaagagauguaguagcccauuuugcugauaaagaaacugaggcagaguaaguauuuuggugacuggaagauuuauauucauugacaaaagcuacuguggcuaaaaaugcccagguguucccaucucacugaaaggaaaaggcggcggggguggaguggggguggggggggaggggaccugaggcagacuuccagaugauugucaacagaacgugcccaucuggguguaugcaagcaggcgugcccacaccacucaggcugcuguagcuggggcugagagcagccuugcccuggcucucucuccagaccccacgcgagucccuuucucaagauccugauuuguaguuaucaucccugagguggucaaccccugaaaaacacacuuccucaaauccggguuccgaggaguauacugugggcucagacaugaauauauccaaagucuacacagggcccugcacgggcacggguccucccuucugaccauuucacagcgacuaguccucacaguggccaacagggggcgcugaagauacaacugaacuaguuuuaguuuccagauggggaaacugaggacauuggcauauccugccaaugucgggaagcucggagccuauagggagaccaugcucuagagaguaggaaccuggaguuagacaggcagagcauuaaagccuaccaaccacacauauuuuauuucuaugaucucuguguguauguacgugugugcucaugcccaugugcgugugugcuacagggccuugugauuucuagguuuugauggcaaagcagggaaggggcugggaagguccacagggguccuaggaucucagacucguuuuccuugggucacauccaaaagcugucuggauucuaucguaaucgcucaucccuucacccuucagacauauuuacacagucugacaacagaccacgaaucucuucgaacuggccccuccuuaugaaguucacacggcuggcugcuguuaaggguggcuucgguccucuccaucagcacggaagagagaaguguucccuuccagugggcauuguguuugucauuuaauuaauuaaacuuaauucuaguucuuuuuuuuuuuuaagauuuauuuauugguuauauguaaguacacuguagcugucuucagacacuccagaagagggagucagaucucguuacggaugguugugagccaccaugugguugcugggauuugaacuccggaccuucggaagagcagucaggugcucuuacccacugagccaucucaccagcccaaacagacauuuuccuauagucagaggacugcuuccguggauggaagaugguagccauucacaguggugguguauccuagacaggcagagggcuccagugggccuccugaacaauggcauugggugucaggcugggucacacccaggcacuguguucaaggagugucugagcccuuacgcuagugcacagagccuggggaagcuuugaaaugucuaaaaaaaccuaccccaggcacugcccugcccccugccaaaugcagcugggugauuuugccagugaaggaggugggggucuauucugagucagcugcugucucguuaucccaaggaacagagcagacagcugccugggauccaggccgacugugaugagaguauugugcaccacggaaucuacgcggcucugcaaagagauacucaaaggcgugcacauacucgugagcacacacaccugcuaugcacacuagagacucacgagucuuccagggaucuugggaaaauguccuucacguguaguaugcgacaccaccggcagagcaugucagguucccacggccuggggucucagugguacuugcauuuugaugucgugaggggcuugcagccuccugggcuaugugcacagcagccauguuugauacagacacgucacugugugguccgugcucaaggacucuccagucaggagaucuacaccgcgagcugugauggacaugcucugcaguccauaguugcuggccaugaauauucaucagggucuuccugaagguguugcugaaucagggauugugagccagaaagcuuacccacaaugccaugcagcaggcucugagcccugugaagacuccugaccacugucgggguucugaccaucuaagugcuuaggccaccuugcugaagcagccuugacacugcucagccacggggaguucacucgccacagguuuucucagggucacuuucccuggcuguggcucucccucuucccacagguuuucuauuuucugacaggcugccuuggagcaagcgacucccaacuuuccacucccaguucugucuuaugguggcucccaguguaaccgugcaucuagggcgcacaccuuuaggcacguguuuaaggaugcuuccagagagauuuaacugaggagggagggcccacucugaauguggggggcagcaccccagagacugggaccccagaaggauuaagaagggggcugggcacagcacuccucuccugucuuccaaugggugugaccagcugccuagcuccuggcacccugccuucccugcacaauggaugcuacuuucugaaacugugagcugaauaaccccucugucccuaaaccacuuuugccagguauuuuguuagggccuagcucaacuuuaaaccaacugccauuugaccugaaugcuuuucugcaaggaggagagacuaugaggucaagauccccuguucuuugaaccaccaagcuuccagucaccaucccuuaaaagcucauugccucaaggcaguggcugaccaccaauagaccuggcacacuggguucaucaugcuccauggcuuacguggccugugccccucaaacagguccaggccuuggcucucaggccaacagagaaggcccauaagcucuaaacgcauuugacaauuuaucugagaggagaagaacuuggaaccccagguggggaguuugcucuuuccccuuagagauuuuuuuucauaaacgcuaaguaggugcuggugggauggcuuguggauaauggugcuugccaucaagacugacaaccugaguuugaucccuggaacccacaugguagaaagaaagagccaauccuucugaguugucaucugaacuccacaugaacuucauggcaugcacgcauacauucuuacauacauacauacauacauacauacauacauacauacauacuacuuugaaagacaaaaagcauuagguaucaaaacuccuauaccuuggacaaaaugcuuagccucuguaagaacuugcuuguggcaugugauauaugugugugucaugcacaugauauauauguguaugugugaugucugugcaugcaugcuguauguauguguauaguaugugugguauauguguguguaguaucuaugugugcacaguaugaagauguauaguaugugguauggguucuuuguguguguuuguguuaucuguaugugcauuauguaucuguauuaugguaugugcaugugauauguauguauguauaugguauuugugcaugugugugacauguuugugugugaaugguguguauguguaguauuugugugugacauauauguguguuuauguguauaguauaguguauauacaugugcaugguguguaugucuauaguauguguaugugugccaguggaugguguguauauguauuguacuugugugugaugugugcuguauauauguguauagugugugauguauauaugguauguacauguauagcaugugcacguguuucaugugugugugguguauaugugcacaguguguucacauaugugguauguauguauauagugcagagaagucagccuccagcauacauguguggugugucugcaguauguauguguauagcauacauauguguguaugugcaagcgugugcauuccucuguguguguguguuggccaugagcacuuuaccacgacagagacaaaacaaaggcuauugugagggcauuucccaggagcacacuaaaagagucuuguccgcauccuggcugcaccucugggcuggacacucgaccuccaugguagcuucuguucuccacuccccuccccacccccaaucucagaacagcacuuugaguucccuaaaguggaaacuaugcccuaacacaacccccuucccugccguugucuggacuuggugcuccuguuaggggugcuggagccauggucaccagacuuccacaugccuuuccuugccgcugccugaggacuugaugggguccuucccaucccccauccuccagcaaccuagagacuuacgauuucucccaaagucucuugggagagcaggcauugagccuacacggcugcgaaaccccagcguugcccguagugggugcccguguuccuauagucuaaccucuuccugugcucuaccagccucucuggaaccugagcugaaguucaaagggcacaacucacuacucaccgucagcagcaaaagcuuccaaggucccucucgucccaccacgcagcucuguacagaacaguagcccugccuggcccucaacugcugggacggugcugccccagccagcagcauuccucccucaaccgagccaggcuggcgcugccucaagggcgcugagcuagccucgagugcguucacagaaaccuaccacucacccacaagggucgcuuggugccacccucauuuacagguuagcacacgaaggaagcucgggcagaaaaaacugacauccaaggccaauggacugucacccaaacgggauauccugcugcagcagaaaaggggaucucagaugcagucuauggaggcaguaccucccagugaccugcagggggcagggcagaggcgccagcagggaggcaagccuucagcccagacucaccccgcacaaacacaaggaccugagguauacugcucaacgccacugccacucacuuuccugauauuuuuuauuccagcucaacuguaaaaguaauggauaaucuacuguuacacuaaaaagaccuuuauuuuacgcuggucauuaacuggaggcuucccggugcagauugguucuauuagagacuugaaauugcuuauaucaauuuccuuguucggcaaagacuuucuuaaaguguguuauaaguaguuuucccauugccccaaaggaaagggcucagcugggcuucuugcaggggacccucagccagacucuagaaauagcauugaauacugaagacaguccccaagaagcuggcagcugagaggucccugccuaauggacaacagcaagaauacaaccuucugucuccagcucuguguugauggaggcagaaagacugcauuccagagauguauacagauagagaaguuugugcuguggacgcugucuuucuggggauaccagagggucagcacagcaaaggaacaccaaaagccagugucuaaguacauguucuguaagaaggguaugggggugagcucucagagauagcaaaaaggaccagaucugcacaggaaagggagggcaaagggcauuucagggguggggugaagaguggacaguguggauaccacauugagacuggugacucaccauucaaacaugaggaccugaguucaaauccccaauauccacaugacauaagugccuguaaucccaucaucccuagagguggacacaggagacuuccuggaaauuugagagucagcuacccggauguacaacagcagcaaaugacaaaagagagacuugucucugaagguagaaagcaaggacugacucccaggguuguccucugacccacaaauccacacuguggcaugugcacacuugcacacaugaacacacaaaagguuaaaacaauauugcauucgaagcaugguccaacaaccacgcauuagugaugagagacuaagagccaaggucaccguggcagaccgcuaaacaaugguuacguaaggacgagggagagugacaggugaacuguaccaaacuagaaacggcaagcacauuugcccucugccucagcgaucccauuucuggaaugcgucccgcgucuguacuugugcaagcagcaagugauguaugcacgggcgcacuccacauauaguauuucucauagaaaaaaaccaacagcagugaguuauggcgcugugaguuuggaaaaaguaaaaucagaggagguagcaaaaaaguucccugcaacaguggcagacacucucuggaguagcucauuaaauccaaaaaauaugacacagcucugagcaaacggaugggacgugugcagaggcgccagugcacugccaugugcaucaguacagagaaacaccggccgcggcaagaaagccggugcaagcgagcgagcgcucaguggacaccucuuucauuuuaguaccucuuugauuuugagccacaugagcacauuaacauaggcaggaggauggccguucagaaauguccgugcguaccucucuggaacacacaacucaaugucauucguggcagaagggacugugcagcuggguugggauuggggcccugagccagaagguuacucagaugggacacugcagaggcuggcaguucuagaagcggagccccuucucuggcuguggucagagggggcgugcagcugagaugagaggaaggucagagaaaggcagaguuguggcuuugaauacaggugguugugugccaagagaugccccaaagccagagacuggagggaaauagggucucucccgaagccuccuguaggagccugcaggaugaacugugauugucaggagacaaagcccugggcaugucuauguaggggguugggguuggggugggacugggacuggguuugacuucagauguucagaacuguaagaugcuaggaucaguguuacuguuagccacuaaauuaucgcuacacaagucacaaauagcaaguauguucuuuuuguuguuguuuuaagaaaaagaaaagccaggaaagcacgcguggaacacguuugcuucucucucacaugugacugggucacggcaagaagcccagcggggggcguggcuguuugcaucugcuuuccaaacacuacagggggcggggcagcccagagucaggggccugacgcccuccuaggagcuuccccuuauggggaagguccuuuagagcaguccauccuggaacugcucugauugccuucggagcauuggacaaggugcuuguuccuccuccuucagaaggcgguagcugaagcaguguccuugcuggaggccagcuugcuccccuuugcuaaccugggugccuggccaagugauucacagagaagagccagaguaugaggucaagccccaccugugcgacuuuggggggggcaccaagcacacagaggucguauuugugaaauucagagacuccccaccuguguguuuagggagggagcacuuagggcuuucaggguccccucggaagccagagucgagggacaccuccagugacacuguuggccauuauguaauaagccagcauccgcguggcccuguggcaagggggaguuacugaacagcagaggggccgguacggcuggcaggaggcaacuccaaccucuccccccccacagaggaucagcccaggcuaucaucucaggcugagcuggaccauggucauguccuugucuucagacagccaccaugggcagaacuuguaagguucuguuggcaggacccccauuacauucccaaauccuccugucccuaggacucccucacauccccugaccaguucaugugcuuccuugaaagcccagagucaccuccucugggaagcccucccugguuuucuugucuucacuacauacuuugggagccaucucuccuucuccaccaaguguuacuguuauuucugugucuucuucccucacugagcugugagcuucuuauuuuccccaaauuccuagcagagucccuggcauauaacacucacucauucauucauucauucauucauucauucauucguucguucguucauucacccauucauuuacccacucauucauuuauucauccauauguucauuuauucauucacucauuugcucguucauucauucauucacucaucagauacucuaagcaccuuuugugccggggccuuuuuaaguguaagaauaaaacauagagauugucgguucuagaaaaugcuuggagacauuuccuaccaguggagucuggcaggaacucugagggcagaccacucuaagguuucugugauguguuuugcccuuugauucuuuucuaguuuugaauuaaugcuuguguccccgacucuccaucagcguuugaucaccccucuucauacuauagcccacuggccuggcccgauuugugcuugcugcagaccugacuaacugcagaccugaggccaggagggggagggagagcgagagaccuggagggagcuacugugugacuuggcucuguccccacaaaggcaucugaugggucccgugucugccacagaguaaaucagaguuccuuguucucucuaguuuagaauaugggacaaccaaccaacccccauaaggacaggguggcaauggccugagagaccgacagguucccuguggcagcugugugcgcacacagacaaagcucaggcugguuccaguggguagaagagaaaguugggguuggaggaaggaaacaagccaagccugggucugaggagacacuguguauauguguguguguguguguguguguggcggggggcagcccgcuggguuaaugccuccugacucaucuucugcccacuccccugcaucuacuucucccacgagcagaucauaacagcgccuggauuggacagcggugccucuucaagcuucagcuauuccagcaggagcucgaggccugugcagcccuugucaccagcuccaguguuccuagacugagaagagagcaggugacucaguucucauuucagggagaggaaaacuacagagcuagugacucacuccuucaaggugacucagagucugucugggacuguagcccagugaccuaguucccagaacgcacucuggagaccaaggacauaguuccagggugagcagggagggagcaggcagcaggaauggggcacccuaaucucagaacucagguccuuguacaagagcaagaagcaauugccuucugaggagcauccaugcgccgcugggggggugggguggggguugugacagcaucacagccugaaaagaauguucagauguaaucuaacaagaugcgggcaggauccguguucuggaaacugugaagggcugaugaaagagaucagagaccaggaaggagagccaggcaccgggcugacuuaugggagccuggguagccacgagcugucagcacccgugagcaucccccagaucagacagucuauagacacaaugcaguucugaucagaaucccagcaggacaugcuuucuguaggaauuaacaaaugaauuuuuaaauuuacccagaaaggcaaaggagggagacuugccaaaacaauuaggacaaagaaugaagcugcgagacacacccuaccugguuuuucggaaucaagcuacaguaaucaagacaaugugcaccuggcaaagagacagauaccaauaaaggaggccugaaauagaaccucacccauacagucaaucgauuuucaaugcgagugcagaggcaacucuguggacagaagacggucacuucaguucauacugcuugagaaauuggauauccacauuaaggagagagagaaaaaaaauccucaauugauacucacaccauaagcaaauacaaucguuaggcaagucacagauagacuuaaaacuguacacuagcaaaaaaccacauagaacuuuuguguucuggcugaagcaacccuuguuuugauauuggccagucacaaacaaaaacagaaaagccccaaccaccaccacccaccacuaccaccacuaccccaccaccaccaaagcauugagaaacuugaccuuauugaauuaaggucaccuguccuaugagacacauugcagaugagugugaaggugaggugacaagcuagggaccuuucuuaccaauguucuucuuccaaggagggccuccuugcgagccacauauagaacaaagggcuugugucugcucggagaagaacgcuggcaagaaaggugccaggcagauagcucagugagugaaccucucgcugucuaagugugagggcgugacgucagauccccgacacucauuaaaaacaucucuguguaacgucggcuguauggcaaguagaaccacgucagccgacaaggaacugguaagguuaagcagauucaaaaaccccugguaaaucucauaacugagaacgguaggcauuagaaucaacuccagaccagguuccuguccuggagaaugugacuacgacacgccucaaagaggacuaugacaaccggucauguauugcaaacaccuagaguucuccaugcuaaugagaugccuagacaggcuccaauguuuagccaaugagcugccuguucugggcauuccuuucugcaaaagguauuuaaucccuggcucacccugaguaagauguacgcaaccucacccaacacaaauaaaacaguuuggacaagcaaggacagucuccuucaucaaggacugcugcggggaugggggguggggguggggaggucuuugacauaaagagccaugccuaaucucccauagaaggccugucuuccagcccuucuguacuucugacacuuacuuggaaacaaauuggaucccacccagccuugggcucauugugggucuucggaccccuguucccaacuccuugugguccccagugguguacacaggaguuugagaaccacaacaccugccccaguccuugguguuuucacauggagaaacacggacugagaccccuacuucagacugcacuucgccuucucugagcagcgugccagcauucuggcaucccagcggcagggcggaaacacagagaguuuggccaucugaaaucccagugcgggggaggcagacagguggauccuagagcccacuggucaguuagcccucucagccccuggugggcuccagauucacugagaaauccugucucaaaaaaaguagguugagagaaccugggauauagcuuagugguugaaguacuuucgaucaagugugaagaccagaguucauacucccaugacccauguaaaaaccagguaggcauuguggccugcuuguaauuacagcacucagaagacauggagggggugggguguggagcaaacugaugucuauaaagccacaugggcaagcucuggguccaggugggaccuugcaucaauaaagaagauaaagagcaaucaaggaaggcgucugauguuaaguucaggccuuuguacacauaugcacaugcaucuguacacaguugucucucucucucucucucucucucucucucucucucucucucucucucacacacacacacacacacacacacacacuguacauguggaaagcaaaaauauaaggugaagauuuauugagaaggacaccugaaugucaaccuuuggucuccauauucacacauauacacaugcacaaacccacacaaacacauacauacaucacagcacacacaugcacacacacauacauacaucacacacacacacacacacacacacacacacacacacacacacuuuauaaaguugauaagaaaaacaaagaaaaaaauggccauaacauuucaaaugucauuccuuggguagguaugcagacgccugcaaucaggcgccugaaacacauuacuugucauuagaaaaacacaaauuaaagucucaauggccugaacuugcuagcuucggagacacuauuauuugcuggccaggaggggguuaacuagaauucgaacguugcugguaggcaucaacaagacaagacggucuuuguggaauacaaucuaucagauuuuuauaaaguucaauguguuuaccaggcagccuagcaauuucacgccuagagauuuacccaagacauaaaagcaacugagcagacacaacuugugugcauguuggagcuuggcaugaguuucugagcugauggaaaggcacuauccuuuauggugccgauguguacacaucucugcacagggguuuaaagcucuagaauuggugagaguuugauggaaugugagaccaagcccauccuagccacgugaaugggccacaugaccggucucucugaguagcaaugcccuaauauauaagaggagguugaauauaaaacucacugucuuugggacaucaggugaugccauccuagcgggauuggacacagucuagaaucaucugagagaggaauuuccuagaccagacugcccugugggcaugucuguaggggguugucuugauuguuaauugauacaggaaguccagggccacuguggguggcaccauuccuuagacugauuguccuaaacuguaugagaaagcuaguucaguguaaaccagucugugagccagcuagucaacggcauccucuaugguuuggcuguguggaacagcaagcaggcuugccuuccaguaccugccuugaguucccucaauaaugaagucuaaaccucaaauaaacucuuuccucccugaguugcuuuugaucagaguguuuuaucauagcaagagaugagacaaaaacaaaugcuguaaagggcucaguggacaucagcagacccagacauuaaaaugugccaaccccacggagacgacaggauacaccauucgaccuuccgacccacccaguuaugcuggcucucugcccuguauaacaggacagggacauuugcaaacaccauuaaugggacacacagcccggaugcaagaggcuuccagugcuugcugagauggagccuugguaguaagccccagggagaagagggugagccaaaaagagauggaagaaagggugaagagaggagaggagaagguuaucuucagcacugggagucuuccccagcagagacagggcugcuccaucuacucucgauggggcaaugagaucuggaguuaggcagccauucacugccaacugcccuucccuuacagagcucugaagcagggcuguaaggccagggaauggcucuaaguggcgauaggacaucaacaaugauaagucagucuuggcccuauaggacucaggcaagaagaggagggugggcagguauaacagcaagggccacuguggcccuggguggaggcugagugccuuccagucucagacacagccccacaccaacagucaagggacagccccccacuccccaacucccauaggaaauuagaacuggcaauacaucgaggugaacuggcugcugccuccuuguugaaauggccuuuccagagaugaacuuuuccucagagcuggcucucucugacuguugggcaggcugcuaaccacagcucuguaggacucugcacgcccacccugaaguaccuucugcuuguccuggucaccuccucuccugacagcaguucuccuacaccuccaggaagggaggacaauuaaccacuuucccucugacacagagauauccaaauugagccagaaucccauuucuacccacacgggccaagcaccccaaaggcuauggggaugaaccaagacaguccuuuagucugccuuacagaaacagagguacucuuggcccuugagcuuacaggacaacaucugcucuaagaauuccuucccuggggagacguuaagaagggcuccaucuccccauaaagccccggugacaaaccaacgugagauuccaccaaaguccgcgcaggaaauugaugaguuuauuggcuuccuuauagaguguaggugaggggucccuaacaggaacacacacagguggccccaaaucagccacacuggaaagucugcacccaggagggugacggguugccuaugguuguauaacaaaacccgugugagucuuccccuagccuggauacuucagcaccuccugaaacccuccccucacaaggccaugcacaacuagggggaaacugcacacaaauggucaagaggaguggcugauccaagagcccuuccacgccuuccuuccaugagagaccacacauaguccccaggcucugcggcaaucgacucccgcaagcaagaaaggaugcacugagaaagauggcagcucuuuuuucccagaggaccucacucugcagcagcacccuagagcaggacacugagcaccagugacagcuucccgcugggccucaccgugacugugacgacaggaggcagcugugucuacuucaacuugauucuuacgggucauuucuuucaauucucacaaagaccccacacagagggacaacugccccacuuuuccagaugaagaagcaauugauucucagagcggcagucugcccacggccagagcagggauuugaacccaagacccuccaagaucagcaaguuauagacagaaaugcccaucuccugaccuggcugcaggagggaggccaagugggaaagaaaacggauauagauucuaaauccuuccuuaggaacugacugacccugacaaccagaaaggcuuucagagcauugucuguaggagaaaaaaaaaaaagccuugucaggaagcaagaaggaaaggcacaagaguggagaucaauugugucacagacaauauagcaggacgacugaccgcacgagagauucccucugacuggguucugccagccucgugggauuuuucaucccaagauuaaucgaaauucuaucccgccgcagccuccucccgcucccgucuccuaauaucauuuuuuuuuuuuuuacaccacgcagcacaaucuuuuuugagacaaggacucauguaacgcaggcuggucuugaacuuccgaaguuacugaggguggucuugaacaccugaucuuccugucucuaccuccccacuggugggacuccaggcaggcaccaucaggccugguuuaccuggugcugggaaugaaaccauggcucugugugugcuuguuaagaacacuaccaagugcauuaccucuccacccccaacacugugcacauuucaaaaucauugggccagugcgaucaucaggccugcugauccgacugauccccggggcacgagugguggaaggagagaacuggcucccaccggcgcuucucugaccucuacacaggcgcuguggcaugugugcccaucccuacaaaugacuaaguggaacuggaaaaccuacccuguagcccucugcacgucucagugggaguaagccccuuggacguuucaggaagagaagcaguugaggcucggccuguggagugaacaagacccaggcugggccuaggagcgacuuuucauauccaaacuccacagugcaucauagccuuucucgugacagguuaucuuccaguggaccacagccccucucuggaccacaugucuggcuucacagcucggugucugcuugaccuuggccccuugauggagaucuaugccuuugccuugaaggaaugaaggucacagacgccagaggaggugauaggcagggguggccagggcuagacuccagagccacugccccauagucuaguccacagccuugggagugugcgguagccuuggaggcccuucccagagcugucugucccuccuauuccaagcacuggccugugagccgaaaauuuaaauguccaaauaucccuucagagauguuauucaaacagcgaggccgagauaaacauauucaaguugagcuguaaaacgccuaaggcaaaugucugcacagcuuuauuuguucuggaaauauugcuugcugcuauccaacaaaaacuuguuaauagcaaacagaaaggagacaggggacuccucccgcugaagccggguggucugaagcccaagggcggcuugccggcaucucucccguggggaucucucaccugggaggccacaacuggaagaagagggucucgucuccgcucaggcccagcagacucaugucagagacacagcgcuaacugguaaggaaggcaguagcccuuuugagucuaaggcucgucccuuuaccaacccaguguucccccacgccccccccgacucugggccccaaaggccuaccccucaugauuaacagccaggcugcacacuggucacacccuggagugagucacaggauuuuaugguccgugauucagcacaccuacccuucucucuucauuuugauuaaauuagcaauaaugaagccugacaaaggagcggagauuugcugauuuaucgaauguguguccuugcugcuuaaaugcgcgcacgcucagaacuuuaagugggaaaagggggaaaacuggcgugugaucgacuuauuagcagccagugagcaguggguugggaaggcucgaggaggugcugagcaggguguggggccuuugggacuggcaugcugaugcacaggagacccccacacacaccuggagaugcagggugggcaccaggugaggcccacagcccugggaggccugggcagcaggauucagaauggauaacaagccacugggcccuggugagcagcaggcccuuguugcucucugaaggaggaggcugggugaagauggaggggccaaccuucccaggcaggggugcugggguggggggagcugcgauuugcccagcucucuucuccugucccagagccaccuggcaacagcccaggcucacucugucugucccucucugcuguucuguccucuguguggcacugauaagguccaucgcuuacuauaucagaagaaugaaggcagauuaugcauuccauaaucuucuauggccauucucauccucaccaucuuccuccacaacaucaccaugaccaucaaugucagaaaauaaccuccucaucaucaacagcaccaucaccaccaucaucaucaccaccaucacuccuucacaggccgacucugucauguacacuaccuuacuuuagucagugcugugagucagacauccuauucucacuuuccacguaagucaaaugagucaaggggaaaauaaacacuggggauccaagugccugcaggaugggauugcgucacccucaaucuaguaaguacaugaaaaacuuggagcgacgaguacacuugaagcuucugaaguucuauguagcuauagauagaagcugaugagauacagccgggaugugguauguugguuacauccacagucacuguaguaaauggcccagagcaaugaaaagaaugguuaauuuuggcucagguuacagcaaaucaugaugggaaaguugcaguggccagagauugagagaucuggucauacgagacccacaguaaagagcaggaggagaacaaauggaugcuuagcuuugaagucccagaugcccugucuagggaaugaugcugcccacaguggacagguauuuuuuuuaucucaauuaacauaaucaagauaaucccuuuuaagaaggcccagagguccaucuccaaagugauuuugauaccacuaagcagacuauuaagauuaaucaucacauguggucucccacuucuuguuagggugcagcuguagcucuaugcauagcauccaucucauaccauuagguagaagucucguguggcagucaguaguccugaauugugggugggcaggauaacgacaguucaccagucaccacucuggcuccgagucacugaucaggcuuucaagguggagaauucaaccugccaacuuacauuucuuaagugauugcuggcgaaccucacuucuggacucuuaaguacauuuuccuaacacuuucuuuagaaaguagcuuauuucugagauccuuccaagguacaagaacauuaggcuaaagcacuugucacggugucugguuuaucucggagugaauguucgggauaaaccaacuggccacagcucagcuguucuguggggcaguggcugcugcucuaugcgggcauauggcagaucagcgagguagucugggcgaauggcuuucacagagcccaaauuccauaccucugccuggcacccagacaugcuucaaacuggugugccaacccucagcugggcacagaagacucagugagagggauggaauugcauucuacugggaaggacugcuucaguuuagagcaccggggagguguggucaaguguaacacagcccuuauccacugagaaacccugcuaagaaugccugagaggggagguaccaggcgaaaggacagccacuuccuagauccauaggaaaaggaaccgaacucucagggggggggggggaauccuccucaaagagccagauuuucauauaaauaauagacaugucgaggcauaggaugucucguaggacaucuagauuuguuauucaucgccaggguugagaauguuccauuuguaauaauuuccucacauucuauagaugcuccugcagccucugucuucagcacugacgaugggcaauuaauuaaauugccauuguacuuccugaaauggugggugcugauuaaggacagccuuuccacacugcucgcucucugcucuggguucugcccggccauaguguugucgggaguugcuuugugugugauuguguacgugugcacaugugugugugugugugugugcuguauguguguauacauacaugugugugugcugcauguguguauacauacaugugugugcugcauguaugugcacacgugugugugugcuguguguguguauacauacaugugugugcugcauguaugugcacacgugugugugugugcuguguguguguauacauacaugugugcugcauguaugugcacacaugugugugugcuguguguguguauacauacaugugugcugcaugugugugcacauguguguaugugcacauguguguguguguguguguguguacguguacguguguguacaaguggaauccagaguagauuucaggcggcuucuucgaauguucuccaccuuauucgaucauguucacaucuauuuauuuugugugugugggguggaggguuaugaauauuccauggcucacaugugaaagucagacgacaguuuacgagcaaucaguucucucccgacguuugaguucuggggaucaaacucaggucacaggcuugguggcaagcacccugacuaacugagucaucucacuaagacacuuuauauuuugagacaggaaccccuacugacugucaggcugauuaggcuaggcuggucagccaagaggggcuccagggcuuauccugucuauacaaccacagcacugggguuccaugcacugagcaccugacacccccauaaguucauuugacacuuugcucuucccaugccuugccucauuuggaucacaugguaaccagugaggcagguguucuuucaaucacuaaugccucacaucuaaccaccuuaucaucguauguaucuauguaugcaugcauguaucuauguaugugugcauguauguacauauguaugcaugcauguauguaucuauuaucauuuaucucuauuuuaccuauguauguauguauuaucuaugcaugcauauaucuauccaucuaucaucuauccacccauccauccaucuaucuaucuaucuaucuaucuaucuaucuaucuaucuaucuauucacccaucuauucacccagacuaaucaaucacagaaacaaauaggcauauauuaaucucucaugugaacuaaugaagaaaugaaugagcucuggaucccagauaacaaggccagaggucagaaacuacaccaaaugucccaaagcugcuuuuuguccauccugccugugguuuaguggccaccaccucaacuuauccuucucuuccagagacuucugaucaagggagacuucaagaggcccuacacucaggacguggggucacagccacagaaagacaaugugcucuguggcacuguuccaggauuugaaacuguagccuuuucugccaguggcuugaaauaaccucccauguucuuuccccauuccccaaauuuaaauuucaucaccaaagaagcuuccaggaaaugaaucuccacguauaauguuuccucacuguggaucucaaauuguaauaaauguacaacuugaauccuaaaggugaauuucaaugaaggacuugggcauuuauuuugcucuagaccacaauuuuaaaaagaaaaacaaaaagccuucagugccacuagcaacaguucuccugugauaucucuuugaaaaccaacuauuuuugaaagccaacuuagaaaaacacaugugcuccgggguaucaggcaaguggcaccguguauaaaauguaacagggagagcaggaucugaguauauugacauuauaaaaaccggggaguggugggaaauaauauuuuuacaaaggugccaaagaaaaccgccaagccugcagauagguuuauagacugcugucacacgcggugguauuuuaucuuggggugcccaugaaagcaaggugaagagggccugucgggugugugugugugugacugaggauuguuggcugucagcugcccuggaagucagaaaugcagaggguucaggcaccucccgacuagggaagcaggaaaaugaguucccucccucacaaaucccacaguccuucccacauucccaaguuugguguugacccuggcucugacuuuuccauguuugaacugagaugauauucaccuagcaucaaauauaccauuuuuaaguguccaauucaggguggggugaaguuuauauucugagcugcacugcacugccacuaucugguuccaaaauauuuucauuacccuggaaggaaacuccuugaagccugguagucccauggccccuaacccacccauagcucccuccugucuucugcacugcgguuuuaucugcuauggacgcuucccagcuaggggagacugugguggcuuagugacaagugacccccauagucucaggaacuugaacccacuuggugaugcugcuucggaaggggagguuuggguggguaaaccuauccuuugcagauuguucucucugcuuccugcuugugacucaagacgugagcucucagccccuagcuacugccacgagcccucuggaaccuuaagcccaagcaaaccauuucuccgagccgccuuggucaccgcgcuuucccauagcaacgggagaguaaacaguacagaacugcgcaugcuuggcuuuugcagacuggccuuggcuuagcugagcagaauauaucuggcucugccccgccagagugggcuucagcacucugcccaacucgcuccagagaagaacugucuugucuucagcugagaggcgagugcucugcaucaaccuuucagucacucugaggguucuuucucugacaucaggggucccuggcacagcgauggcguccgguuacgugggagguggcuaagcuucgauguaugaauagacagacagcaaguguugcugcaguggaaaugccaccggugcuugguguuuacucugcaucuucccuuucccauuguuuauccucacaaagucuggagacuucccccagcaccgucucccaggauagacccacagguggcaaacuucccacaagaggcuugucuguacauguuuuuggcauuccaggcaauacagucuccgucacaccucaguucuguuuugcaaaagcaguuauacucaacauugacaaaugggcacgguugugugccaauaaaacuuuauuuauaaaaacgaaagacagauggcagguuggacuugggccacaggcuguggauugucaaacaguagucucagcucagugguuggcucagagcagucagggauggcuggugagccacagggauggagaggagggcaugguccuuggugguugggaagacauagguucuuucuucauggggaggguagguagugucacugggaagucugaaaugccugcagccacuuuguaccccaaggaagccagccuugggcugaggagagauuacaccaaguggcaccaccugaaccagacaccagacguugccucuucucugaccuucccaacacagguacuuggauucucaguaucaugaggcagguguugcugacagcugccuuguauucuugaaguccucagccaauguuugcugcaugaaugaaugaaugaauugaucuccugcagacuggggaggugaguggacaucaugcuccuugggaacacagccaggcugugacuggggugggagcuugagagacagcuguaccuuggcagagccacuccagaaagggcagggaugggcccccaccucugaugccaucugcaagcuuauaucccuuagaccugggguucucaagcugugggaugagaccccuuuugggggucgaaggaccucugaacaggggucacaugucagacaugcugcauaucaucuauuugcauuaugauucauaacagcagaacauuaucauuaugaaguagcaacaaaauacauuuaugguugggagucaccacaauaugagggacucuauuaaaggguggcagcguuacauuaggaagguugaggaccacugccucaaagcuuucaaauguggccaaggagguagcaggugacagagcccugcucaugugcacaaggcacaagggcaagcaauaacugguuuagggucggcagaccacugguucuaucugcagggcaaagaauacacuagucaccuauagcaacacagauuuggggugaugcuggacacacgccagaugaugaacuguuuuucucuccuggcuccuaguguuauaugggcauggaugccccacccgcuccggggaguguuguccucaaagaggaagugaggguacagcccccaugagcuugcucuaacagagcaaccaagccucugggcuagcugcuggacuuuaaauuagguacugccuaugaaccagcuuuguagaagcuccaaggugccaggugaauauccucaggacagcccagacaggucacagguaagcaauggcuuacgaacuccugucuagcuuuccuggaagucgaggguggagacaguguagguagucugcuuuauaugccucacauaggcaggcagauaccaauguuaaccaggucuacaugacuaccagggcagagccacugccuguccauuuacacccaugcccaucugcuugguggaggaagcagagaugaauaaacccacaaucaaauaaauuaauaagagugccauucuuguucuccguuuguguaugacuagaagcauuucugcagugagacgacggcauagauaaacaaggcccaagggaacccuuugcuggugaccuugggguauuuauccagucucuccacuagcacucuaaagucuggggacucagugcucauuucuaguccagacagguggagcaagcagguggagacccuaccuggugcugugcccccuucaccaaggaagaucucacacaggccuggagccacagcucugccugcaauccucuaaauccugccccuccaacccuaccacauccuccacccccaccauguuuguugucagagagcaccuggcuuagggagcaggcuccagaggcuuuuagaggucguucaaaggccaggaugauuggaaaagucagaucuugaaggucacagacccacuccagacuuacaucucuugccuggaauucaggccucagaaucuauggcuguccucuagccugggugacauggggucguguauccuuuaaucaaaggaagcagaccaacaagaugggaugaggccaaaccuccagcugcucagggcaggaacucagauuaacaccccagcaagcuugccuaucucugccaggugggggucccuuggcauuguaauugccuagaccaauguccuuacgugugucuaccucagauccacaauggcaaccaggaagugcaugaggcugguuaccauggaaaccauuucucuuugaagugggacuuugcuuuuguauggugaggugauccauggggccccauagucacugaauguggccaguggugggauggaggggcuugugguagaugagagaagguuuucuucuaguuagggaacugagaggagugcguuuuaucuucuccuagaggugguucaaugacccccuuuucacaggucaccaaaacucaaucccccuacccccaagaagugggucagguuccaaccuguguccucugacuacagaaccuucuagaagcagauggcucuaccgaggggucaucuagcuuugacuacacaggagcacagacagaggaccuggggaucugucuucagguccagcucagguccguggcuaggcuggugucugucugcuggucugacaguaacucuaaaguuaauaagaagcccaaagggcuucugagcaccccacccccagcaucugggagcccagacccacuguucagccucccuauucccuucccugauaacgacaccuucugaagguaacacagcagccauuucuacagcuggagggacucucuggagccaggacuccauuccuaggcaucugacauucccaccccaucuucccuucugcucaggaagucuguaacgcagcaaauugcuucugugcuugggggaaagcagcucuucagaccuucuccauccuuguccaccgcacccuccccucugcuccuguucccucugcugagccuguuccaccuaagacugcaacaaucccccuuuuguguuccauaagaacuuucugcauuuccaaucggaaccauuacuccuauuuccccucucagcagucggugaauucucagauacggagcaaacaaggcuccagaguaugcacacgggcacaggcuuugcccagcccucaacuggaagcugaauaaggcucuguuagaauguugucugcagaggaaagaggcuuggagcaagcauuugcuugcugucugugcugagaugggcuguuuuccaucggggauccagccguuuccugggcaauuuaucaaugacaugugcuaauucugggcucgcaccggaggcugcgguuugccaguggggcuggaggcagcuuugagaggcuucucccuucgaggggccaucggucagaaccccucuugcucuuauggacuuugccaagcucagagcagccagucggccccgcucagcccauccgugggagcauucuuuauuacccaaggaaauugaggaugcccaguggugagggaggaauaaaucauuguucccagcuaaauggaguggugcagaucuucugagcacgccgccuuuuaucaacagugcaaauaacgaagauuccaugcgccgagaacaaugaaaugagccaccgcacuauugaugggguauuuguacaacucugugaguuauguuuccaaaccaggcucuauuaaagaugcagaaccccuuucagaagcacaaagacuaauaacgcccuccaaauaauuuauacauuccccacaaggcaagaaaagaaaaguugucuggagaccagagaucgcuguuuggcauuucccagcuccugugcccucuaggucucuggucagcuuuaggaguggcaucuccagagggccaauuccccagcuccucugauccccaguucccccagaucuucagguagaggggacaggagcagguagagguagagaaugaaccauuccuccugccuacguucagagucugugccuacucuguaccucauucagucucagcaguucgguauucugggaaccaggacagcuaaaacccaccaagaguaagacccuuuaaugguuaaaccuuagcacugcuccccacccaggcuucagcugcgcuucucaaccccagcaaacgacauccccccgucccccagucuccuccugcuaccacauacacaggggauuuuuuggcaaaggauuaaagacaagacuagaggcuaaaggcuagaggggacugggauaaguggggacauccugaacagcacaagacagucccuccaagaaagacccuccuugucccauaaguauugacaaugccaaagcaagaagcccugggcauaggaguggccauucuauaggcucugagaguccugcugguucuguguggauagaaggagauagcucagcuugugaggccuccaccugugacacccaaggcaggacacaagccccaccaagcuaacccaggauagauucaacaggggguggcuccugauaugccuggugcagcuccuagagacuccuuugggguucagucuuggguuccacggcuauaagucucaucccucugggcccccugccuaugcaguagaaguaauaagaacccacugacaacacaggcugcuguggguauugaaucaggucuuaugugcaaagcaggcacaaaggcagcagcuugugugaaaggccaagaagcagaggcuguuaggaucaucagcacuggugaggagcagggacuguguguagggcucaguaagagauggagguucuggaaugucugccugucagccauccccgugcugcggagaaaagccugcgauaaacccucuguugcacgguagauucagguaugaaccucuggauauuguauuugucuuuagggagaaaaucgaaugcuaguuuaacacaacuugacagcacacacacacacacacacacuccaauacagucauccucacugggaccgugugccuccuaagggacagccacagggccucauuggugcugaugagaacaauugcuccugaagaauugguagcaaggauggguccugguggugguuaaagaggaagacauguuggaaggggcuuuggccaaccuuguagacccaccccacacagacuccagcccuccuugauccuggaggaccaaacaugacagccaacagcaagcacuucaggguuagaggggacuaacagagacaggugcauggucuacccagaccuugacuagcuuggauuccagaggguccugccccaucuuaaccacuggcggugacacaacacuucccccucagauggccccaugaaagaggugccaccuccuuaguuauaagaaccaaaauguucccagggugggagacaaaaaucaacucugguagggaaccguggaagcugguaacaucugaaccccuucgugcccuuccauguggguaucacagaacagagcuacauuucaagucagugugggagguggaagcagggucgcacagguaagugcauuacugcugacaggaaccagccugauauggggauuucugaaguacuuugguccagagaaacaauuggguagauuugggaaagaugguaguugaaacacagcgcugggcuggguuuacuuuguuuguuuguuuucucuaauuauuuuucuuauucacuuuacaucccgauuacagcccuccuuccuccucuccuuccagucccaccuuccccaucauucccucaccuucuccuuagagagggggagucccuuuuggguaccacccuacccugggacaucuagccccagcaggacuaggcacauucucucccacugagacccaagcaggcaguccagguauggggaaggggacccaauggcagggaacagagagugagacagccccagcuccacuuauuagggguuacacaugaagaccaagcugcacauuugccccuggaugcuuccugguugaugacccagucacugugagccccccaugggcccagguugguugacuuuggaggucuucuugugggaccaugguuugauggguaaagauggaucuggaggcaugaggaccgaaguuuggaaauccagaauccaugugaaggcuaagaaugguagcaccugccuggaaucucagaaccggagaggaggaagcaggagguucacugucuaacugucguagccagcuggcgagcuccaggcucagugagagacaucagcuccaaaguaaggugguuugugugugguagaagacucauggcacagaccucuggcuuacacacacacacacacacacacacacacacacacacacgcacauuccaauauaacccccccacacacauacaacagaacuacacacacauauauagaaacacacaaagagacacacacacauauacagaaauacacaacacauacccagaaacacacugaaaugcacacacacacacacacacacacacacacaaaucccaauauaaacccuacacacacauauauagaaacacacaaagagacacacacacauauacagaaauacacaacacauacccagaaauacacugaaaugcacacacacacacacacacacacacacaaaucccaauauaaacccuacacacacauauauauagaaacacacaaagagacacacacacauauacagaaauacacaacacauacccagaaacacacugaaaugcacacacgcacacacacacacacacacacacacacacacgcacgcacacaaaucccaauauaaacccccauacacauacaacagaacuacacacacauauauagaaacacaaagagacacacacacauauacagaaauacacaacacauacccagaaacacacugaaaugcacacacacacacacacacacacacacacgcacacacacacacacacacgcacgcacacacacacacacacucaaaggacccaggaucuggacccaaaauaaagaauccugaaaaaugacagaggggggaggaggacagcaccaucuacaagacauacacggaaaucugcaugcauuuuuaaugaaauguaggaaugggaaaucuguaucauuccucaguugcuauauuaauucgugugccaugugcuuuaaauauauaugaguaaacucaguaauaaauagcaaaaaaacaaaacaaaacauaacaaaaaucccaacaaccccgaggauaaaaaccucuucagauacacguucccucucacuuagcaauauauuaauccuugaacaaucacacgugccaauaaauaacagccuguggaacgccaaguguuaagaguggucccgguaauguguguuuucccgcaaauccgaccugggucauaauggauuaguuuacuccauuucgggacgcucgcguuucuuacguauauuuuaaaacccuuggguucgaacguaccuuauuacauuuuaaagucuuuggauuguagcagaaaaauguucugcacuauaaaacauagagcauaguugagguuugauggguuugcuucuauuuucuaccccacaaaacgcuuucuaaaugccauuaaaauuuagcauacaccauaacagccaggcugcauuuuguuccccgcuuaagucaauugacuucugaguuuuauuucuucauauacaucaagccaaauaaagucauugcugcagugggaggugagggacauugaugccagaguggcgugagcagcccugaugccccauaggaaggaggguguugguggaagacacagucagggacaguaacuguugaugucugaggaagagaagggccgggcugcagggcugcagggcugcagggcugcagggcugcagggcugcagggcugcagggcugcagggcugcagggcugcagggcugcagggcugcaggacugguucucugcggcaggugucaaagugccaugaagcaggagagaugagacucacagggaauauguagcaucaaaccuauccuuaguggaucagaagauagaggucagccaugcaaggccacuuggcccagaguccuuaugaccccguccagggaagaccuuggguggcgaggcaaagcuaguucccuuaguucguaggauugcacaaugaugaagccguucugcccaugacuccacacagagaccaccucccccagaagccuggugucucuuuuccucgauuauucauauacuuaucugugugcagauguggaggucagaaacaacauucagggguugguccucuccuucuaccauguauauucuggggccaaacucaggcugucaggcuugguggcaaguaccuuuacaagcugagccauuucacaggcccccucugcuuuugccaaucuuuguccuaucacuacggcagcuuagaacuaggagcuuaacaguucagcggcuucugaguccucucugagguuguuccgcaccccccaccccacccacccggaacuugcagcuagugucagaagugaaggcugucuuuguauaggacacucaaccccuagcucuuacacuagcaagcucugaguuuagagcucaacuccaggcagccccaggccagccagaucaucauuucuaccccuuggaccuucagaaaacucugggaaguggguaagcuguggcugacccuugcccaggaggagggcacguggcuagggaauucauaccaucugugaacagccauuugggccauggagaggcagacgcagaagcccggggguguaagcgccuggcucuaccugcugagccgccucguggaaggagugugcagccucccuaaugcguuguggcaggaaggaaguacagauaaacauaauaaaucugguagaauggccauucugauguagagucugaaccagcacggagaauggggggcagccaguguccuuugugucacgggagcucauagccggcucuuuccuuuuaccuggggcucuguucuuuacagcaaauuggaccuuucgcuccgaaagaaauaauuacucuccgaggagaagagagcuggccaugaaugcugauaugacacacaaugucaccuugccagucagaggaggcuccagcgccucggcuuggggcccguccaacucccagucuuuuccucauaauggaggucaccucucuauagaauuuguugaugaucuccaaaaugacaaguuagaaagcuccugucagcaggauauuuuuuuuuuccaagagggaaggacggcaucgaugaaggcggcagaagccacggaguggggaaaggaccaggggcccagggaugaggcuaagggcagguuuugcauaaccacugugaagucccauccaaaauuaacuucuagagccagugacacagacacaugucacaucagaaacuggugcucucucuccccuugaccauccacagugugugugugugugggggggggcacagaguccacggggggggggcccacagaguccaccaggagccagguuggcaggaagcugcagucucgggcucccacuggugcaugguacagcauucccgcccccugcaggggcuuccccacagucuccugcagcuacauucugauuugccuggggaaggaggaauauccccagccacaccaccauggaagacacugggggggggguuugggggaaggugggaagacugaaugucaucauuagcgcugcaaaaagagcauccacuucaccugccagccuugcucaggggagcaggggaagagaggcgccagggguuguaaauaauuccaucugccgagccuagaaagggauuugagccacgugcacaccccaccagugucucugugggagccauggagauauucugagcuuucuccaagcauugcaagggccuugaaggagugggcccaggagagagggcaccuccucucuaaagucccucugcccaaggacaguagcucccuccuccaucugugacuacccaccaggaccugguuaugcccacgcaguggggguaggggagauucagggggcucugcccaggguggaaucccaaggcuuugcaucaacauagacacagcuucaggcaagugagugaggggagacaggcauagcaggacugaucucacuguguacgcccgugugagggacagugacaccgucucugccacccaagaaccucacagccacuccuuaagucacucugcuuucugaugcugguguaaauucaaccgugcaaggacuuuuuaguaucacaggguauguacguacauuccagggccacagaggacaugcagucuugggccuagaccucugguggcuuugcggaaggccacagacuggcgaguucugggcagcaacuuccuaccuaccuccugguugagggacaagacaccuccccugggcccucuucaucagcaaacccuggguccuauaccagcuuucccagacugccuugcugauaaacaaacccagggaugacucgcuaaaucgguuccaaaacgggagaggcaaaagggcaggacagggugauccuugccaagauggcagauacagaaaaccuggugcuggacccuagcagggcugcuauccugacccugcccccaacaagucucuuugccacccuggggcacugggaaagaaagcucuuggcuagguguccauaccuucagaaaaaaauaaaagccagauccguuggaaauuauuuuuuaaaauaggaacaggagguuuuaaucaaagaggagagaggaauuccuuuugggugauggcccacugguagcacuuccuaaaguaaugagguuuuaguguccaacaauaaaacgugaucuauucagaacuaaggaaauaaaacuccagagauaauuuuuggaugauuuucagaugccugagagguguuucagguuugguccauuaagcugacccacagagguggcugucaagggccugcuggggaugcucagggaggggcuggaaagacagcauccaaaugagagacuccaaggacuauggaccagucuucauagagccucagccccaccaaaggacuccacaaccaacuccagcauaucgugcuuuccuuccucagcaucagccacauguagccuggagcucgccacaccaggaaacccaccaccaccacgcccaacucgaccaaguagagauaucagcguauugaggaguucagucacuaauucacaaacccuguaguggacaacugcuuuauaccauagauucuggugguuuccagaauaucaugcacaccacugggcugcugcaaggagcacagaagaaucccgucuuggugagcccacauccagugacacacuaagauggcugcucccagugcaucaagaacauucuaccccucuuguuuucauaccuuccuccacccuuucucgagcagccucuucucuccugaccccauccacagaccgcaaagccuccagcaugcugucccuacagcaaguacagacacugcuuuuaccugcaugcacaagucugagaggcagaugaucccuggagaagugggaucccaugugucuuagucaggguuucuauuccugcacaggcaucaugaccaagaaacaaguuggggaggaaaagguuuauucagcuuccacauugcuguucaucaccaaaggaagucaggacuggaacucaagcaggucagaaagcaggagcugaugcagaggccauggagggauguuucuuacugccuugcuuccccugacuugcucauuuugcuuucuuauagaacccaggacuaccagccuagggaauggcaccacccacaaugggcccuccuacccuugaucacuaauugagaaacugccuuacagcuggaucucauggaggcauuuccucaagggaggcuccuuucucugugauaacgccagcugugucaaguugacacagaaccagccaguacaccaugcccuucucccuguggcaccccuguugcuguguagcccugugacagucagcucucuguggaugccugcuuaugaaugaucugauggauccagacuuguucugauggugagcacuggccauggagaccagguucaagauccaaguggacaguuacgccuagcuauggggacacgccuggcucuucuggaucauuuuuccuccggaagcugccagguacugggcuacacauccauucuggacuuugugauggguaucuucugguccuggguguggcuaauucccugagacucuccagcuugccgugauucugaaacaccccucgucugucugguggccauggcucugccacagucuaugcuuggauagagccgcggguccauuauacaccggaggagguguguguacccacaccaggcccaaaacagaccugccaaucucagagcucagguccuuccgaggguucuugaggcaaccacaugcuccgugguuccaaugucacccacccugugacacaucacucugcaccagcagccaaacaccuacuuuaaaaccugccaugauccaaagccggagacagccuaaagggaaggauuaagugaaguucggcugauggaugauaguccacaaaaggucacccccagaucaucaccccauuuauuauuuauuaacaaccucggagacgugugugucacagcagcuguccaggaauggggaaaugauaaagucauauuuuauagcuagaggccucuuaaagguguuuaacaaagagcuuaccaagugauuucaauggguuacaaaauaauuuauuaagaagucaccguagccaaacauuaaaaaagguauuaaucaccaagagagauggaugcaagaaaaacagcccaggacauguccugggugauacagaguaaguacaacacccugcugauguagcacuuggaugggacaagggcggcauccacaucccacaggcccuggaccugcuagcacuucggcacgggacaauuucucccuaacccuccucucugaagagcuugcuugacugagcagguaagcaaaagcagucguaacuuuccaguaaccaccuugucuacccacgugagcccccgacguuacccaggaccaggaacucucaccacaccaaccuaugccacccaaguccugaagcacugucauagaccauuaacuacccacacccaccucuccuucccaauguuauccaugacucugcucaugccaccuacuguauaucuaucacagcugccaacucaacucuccucagguuuuaagagaagcgcucacacuugcaagauaggauucacgccagccaccauaguguguggcugugauguaaagcagguagcugaccccuguguggcucccaggaggacacugggcauuuguggcuuuggguagcugcuugcaagaggcaagcauugagaacagucucaggcuggcuuccuagaacacagauuauggcuugcauguuugaggaauauuaaaugccuagagggcagauaucagaaauucuuccucaaagagcagccaagacugagagcagccccagggcuuggggaaucaugagagacacagucaguguggaaagggaacaaaagaucaaagaugauuaauauacauggacccagcuugaaggcaaccuggugcaacuaaccaggcaggagaagaugguccccaccaggggcgucacugcuccaaauuucuuaacuagcagcaaugccucucuugcauaagaaauugauugucacacauaaaaguuuaauguacccccagccuuucagguuaauauuuauugcaugggaugagauucacuuugacuuuuuaaaaagucaagcuguagaaaagucaccagguggcuagauccacagacccaaguccucguuucucccccacaggcagucacagaaggccuugaaggaaaaggacaugccucccgagugaucuggguuucucgggucucaccucuugacugggccagcucugucaagugucuucuacaaggcuacaucaccaccaccaccaccacccgaagaagcuuugccuagcuauaucccuuccccaaagaacuuucuagaugugguagcuggggaccaaaucuguccuauuugaaccuccagcccaccagacccaaguuaaaaguugagcggccucaccaaaugaaugaaugcauacggucuaagaugagugugaaagcucucgaugaggagggaacuccaaauugcaaacauacugugucucugcgauggcuaauacugucaccucacuggaucuagagucacagaagagacaagccucugggagugcugugagggcuuagucuugauuagucuacguggaaugggaagacccauucacucuaagugacaguugugccuucccugcuguuccacaggcugagguccugggugcacagaaagguaaaagcaagcugaaccccacuauccguuccucugcuuccuguucccguugccacgccuucccaccauaauggauccugucucuugaaccagagaacucaaauaaccuccuccuuccucgggcugccacugccagguguuccgagacaguaacggagacacgcuccuuucuguccgcagacucaacucgcuggcuggaucggcagguggagagccaaacuuggcuuccaugaugaaagcugcccugagucggaagaaaauuccagaaccucaccccucacaccucgccuaucuuccagaggcaaaucccauuagcacuggcugagcacaggcugauuuaugugcugcggaaaacgaccccauuaagcuuggcaguaaagucccuucagccacggcgcacugcacccugccugccaaguggcugcagacaggggcgggggaggaaaagaccucucucucaucucgcuucuucacguguagagauuccucaaucucuggucagccaaacacuguccgccgccuggcuaggcccagggaauguguggcagacggggcaggaugcaaagggacucacacaaaagccaugagcaugcacuguguucccagcacaggguaguaacccaggcuggcugucaucuugcuaggucccagaucagcccucuggguggggauguuuucccaguuugcaagcaggaaauggagccugggagaacacaggccaccugacccagguccugggggcugggagugggggaaugguggacugagauaccuugcuucacaccaacgcacaggccauccucucagcucaucugacacagugaccuggggaacauaucuguggaggaaauggccuccaggccugccugagguggaaaccccggugacacauggacagagcuugucugcaauguuugccucucccaagauucccaugcugaaaccuugagccccucagucucagacugugaccuuuggagauggggucuuauagagguuaucaaguuaaaaugagguaucaagguggacccagguccaauauagcgccuagccugugucuacacacacacacacacacacacacacacauaugcgugugcuagcccuggccugugucuaauguggucacaaguuuuuauuuccugccggucaugcuuccacccugcccucuugccucuuagggcuuuugucuaagaauacaagcaagagccugggcaaggaugcugaagaaacugucccacaugggcccagaccgcucucccuuggagaucaacuaccacaccucuaacauaguggugcacaaacgugucaugucacggcuaaagauaaguugcaaacagagaguagaagacacggauuauuucuaaggaaagacuuggggaagagaugugauguggcuggaaacugaagaaucuugggauuucugggaguuaggagggguggagggagacugucuaugucaguggugauggugggaagcccagcagagggacccaagcagaagcugggccugccagacaccuauaucuggcacaagaaagaggacaagauggcuucccauuggcccuggugucgucagcaucucaaugaaaaggcuucaagggguaccacaagcaugcagccugggaagagcaaacaaguccagagaggacaccucugaaagcaggucccacccgauguccuuuauacagccguuguggucagacaagucuccacacauuuucuggaugcgagcuuccuguuccucuguuugccucacaggcugcuaaaaggugagaguuuaauagccaaugccaucagaccacagggcccuugugucgacagcccguccucggccuaugucccaguuguuaauguuagucacacauaaagggguuggggauacaaagccagagucacuuguccuuucaauaaauacugugugucacuguaagaaggucccaucaaucagacuccaaagucucauuuggucuggauaaagccacugccuaaccacgugcucaucaggucaugugaucgcggaagaaaaaaacccgcagguuuggcuagcucccggaggggcggugaaaaagcggagccugguaucccaguggcccuggaaggaggggacggaaacccugcccgcucuaaacgugggccaccuaaguaugaggacaucaguaaaaaacacaaacacuguaaaaugccaccaagcagccgagaaguuuauuucucaucaugagaaacaggacacacucggacuccuccugaaauaaugaaguccauuuuuaacgucugcuuccgugacuuccagauaauaggcgaauuuaccccgaggccacagccuguuaucaaggcaaggcauuuagcuacagauucagaaaagcaacccaagggucccauguccccaacacggugaaugaaaaugaggacuuggguuaucuccccugucugcuagucauagccuguuaaaggaccccgccccuuuuuccuauagcauaucccugagccaggccucccaggcugguuaucggacuucuuauccaacagcaaucaguggcacacacaagucacaggcgccagaaccccugagcaccaccuggaagccaggccauguaaagaauacuucccaucuaucucacaggugccacccccuaucaugcccccugggacuucuuccuccaaacacagauuggcuuuuaaaggcacacauuguugaugacaccugcaugguuuaaagaaauuuuuaaaaaauguauucauaugguugugugugugugcgugcgugcgugccugaagaguguauagagccuucagagcuggaguuacaggguaaugugagcugcuccauguggcugcugggaaccaacauuggguuccauggaagagcagcaaucgcucguaauggcucagccaucucuccagcccccaccugccuguuuaaaaauaaaagcaaaugagcagacaaacuggaaucauuuucccagacuuccuggacccuuugauaaguagcuuuauucuuuaagauguuuauuuauauguauucauacuugcaaguguguuagugggugggugccuguggaggccagaagagggcaucugauuuuacaaaaccauauuuguaggcaauagcaaaccucccagugcuagcccagcaagugcucuuaaccuucacguuaucccucaaguccaagaaaaagguuuuuugggggggcaagcagucuaguuuagaguacuguucacccauucccuccuccucaucucuaccucccucacaccuauggaggggaggggcuguucccugagaccucccucacaccagcuguguuuauaaacgaggaaaugggguuucagagagguccagucacuacuugagagggcagcaucgggacuuaagaccugagcagccuggcagccccuguucuucaucaggagcucuagauggccccucauggucccccacaggacagaccugggaagggaagcuugguccugcuucccuggcaacugccacuuccuaugggggggggggaggucagagaaggggagagaauagcugagcauguucucuccuucuuggcgaggagagaccucuccagaaauuuccugaggcaagaaagguaccgcagcacccacagacucuuguaacuauggccuucagcccgacccaggacaccagcaugaaggggauuccugagaaccagggcuucaaauaugcacuucuggaaaagucaugggaagaggggaacagaaggggcucacaguuggguacuguguggauggccauaguucagacacccaucaaaucuuuacugacauugugaggcagagaauguaccuaccuaaaccuagagaaggaaacagaagcccacagaagugagguguccuuggucacagucagggauugaaggagucagggucuguaucuguaucuaaggacuccaaagucccuggguguguuuuaguccuucauuuuaaauuuuuacuugcuuuauuuugugacaggaucucauguagcccaggcuagccucaaacuucuccucucacuccucccccuccaguuuauguguuguuggcaacugagcgagcuuucgcaugcuacgcaaucacucuaccaacagaguuacagcccagcccuaaagucuccauacuugaccaguguccuaccuccauuaacagcaauggccuggaauaaaguaccucuggacccuacagagcugagcuccaacauguuagaagggaucuguggccaaguggaccuggccuugccaaacuggagcaggaguguugggcagagugggaagcauagaguauggcuagagacagcaagccugaauacucaacaggaguccuggcuggcuagagccaaggggaugggagggaaugagaugcaggcuugcuuggguagagaggaaucugcuugcaggaguuuaaaugggauuucuagcuagaggaggagccacggggggugcuuuaaggaggguguacuuaugacacugugaguggagaauggguggagacucggcaaugguggacgcagacaagcuuggguguauuugggguuagggauguuggggcuggcugagccagcaaaugaagaaggcagggaagaaagauccaggugucccugacauccuugacagacggacaguggguauggaagaugguaugguugguggagguuuagauggaguuugcauuugccucuuuuaggucugggauaucucgcaggcauccagguggagagucccagaaagggucagagaccuggggcugagauauaaauggggacuguagacagagauucgacaugaguugccauuuccuuacaguggggacaagcugauuccaaccucgucuacaggcaauugauugcacaaucaugaucucugucaccagugacuggguaggccagaagucuggcugugcauguagccaaauucacuccugacuuaugcagacuggugaggccccugcuauuuucugccucugugcauccacccuuguucugggauggugaugcuaaugucccauaucgagccuggaaccuacagacacucaagaguacuugugauuauuuggcaagacugccaacccuggcugaacagagucucucuggacccuccucucuguuccuggugagguaggcucacuguaagccacgagaucuuucugugucaggcuucucaccccagauggggccuugccaagaguccugggcccagccaggaagaaaguaggacuaacuaccagaugagaaacuaggaaguccucagcucugagcuagacccagccucagcucaaucugagccccacauuacuccccagcacccaaaggaacuuccaugggccagaguugcugggcugaaacccgaggccuagcagguaugugaccuacuguaauuuaccuuaaaaugucuuucuugggagagcaucuccgggcgggugguaaaggauauuucccuagacaggaagccagugaggacaucauucaaacaccuacauauaccccugagcucagacgaucacaaaguuggacacugugucucugucaguaacaaggcuggagaaucugggaccugggugacaucaugaccaagagucuuuggugggcacaggccacaggggcuucucaacuuuucuuuuuuggggaacacacagcacacgugugaccagaucuccuagauaacucagcaguggcuugaaaggaccuagugucaggauggacagcccucacugggcacagagcacagcuuccauaugacacaggaccccuucccuucuuccugcaccucugcucucccaguuuacccccaucuccuucccacccuuagucacagugacuuccaucauggcugcagcaagcuggcacuuuccugauguuucagauuccucccuuucuauuuccuggauuauagugguggcacugaaaacagggacaugccacuuugcucuuuguuuauauaaaaacucaugcacgcugcucuuagugcggcuguccucacagucaggugaaguuuauuauuugguaauaauaaugcccuguuuauauuuuccauaaaugucaggcccgaauaacaggcugcaaucuaucccacaacguugggauuuaugaacagcuccaaaugcagaggcaaaggcuccaugugaccacugcccucugaaagccccugaugggucccaccccugugagacagggaggcaagggguugaaacucugaacaggaacuggagaguacuuccuaugucaggucaggucaggucaggucaggucaggucaggucaggucaggucagggcagggcagggcagggcagggcagguucuggguccguccgugugcauugcucuuacucagccguccuccacugaggcugggcucagucccacucaggcugaagauaucacaugcuguccuugaccugcagaagacucuguguguguguguguguguguguguguguguguguguguguguguguguguuuguguaggggacucggcuccuuugcuguuuggcucaggaggcucugcuaucaugccaugugcugcuccucuuuguuuuggggccuugcguagcacucagacuacaaagugacccugucuguccucaguccccagggaaaguaaucauugcucagccgcaggacccauguuugcaaaagcgagcagccacugacacucaucuccuccagaggcaacauaaacuuugaugugcggcccagucucugucaaguucuaggcgccacacgugacccugucugcaguaugucaaagauucucaaaacacugaggugugccgcggaaaaacaugacuaggggaccacaguguggccagaaggagggagcuccacucuugggguccuggagguccccacuaacagcugcuggaguagagcaguggccuauuggggacccugccagccugagcugacauggguuuagguaaagcagauuugugucuggaugcaggagaaacuccucauuaccugaggaaguuuuuuaaaaaaggcauauguguguguggcuggagaacccuggagaauagagacauaucugagacacuccauaggcugagcccacaugugcaugcaugugcgcuuauguacaugcacaugugugugcaugugugugcacauacgugugugugugugugugugugugugugugugcacgugcaugugugauaagauguuggcagccagaccacuccuagcagggagcuccccuccuagaguuugggccagagccucacccuaaaucauggacccaucauggugcucaaacuuguguaagggccccuucuauccucagcucugcccaaauuagacccaaacugcaacucuaccaacagcagucacccagucgcuucucucaguuaaaccugaggagaagugauggcuuccugaccugucuuuagaugcucaguagacauggcuccuugggccaccuugaacagaaggcucagauaugccugccuucacuacuguuacaaggugaccugugaccuacacacacacacacacacacacacacacguuguccgaguucaagcuucagugucuguggaaaucugguguuugcagaugaucaaacuguaacgaggucauuagcgucggcuccaauucaauauggccaccccucauuagaaucgcaaaugcagauacagaacaagcacccccugggggaggauucugagaggacauggggaggacacugacacccuugugccucagaaacuccaggaaccagaggccgggagagcucugaaauugguccuuucuccuaaaaagcacaaggcacccacccugcggacaccauggcauacgacauccagacucagagacuuccgagagaaugcauuucuguccugggacggcccauccauagucuucaguacagccaccccagaagggcaaaacaagugucuugauuuacccuccaauccucgccugacauugucaucuuugucuugugucccuaaagggaaagugagggacagcuuuggcuuugugaugcccugucccugauacucauaacacuuggcacaaucauaguauagaaauaaaugacguggguucagauccgauccuacuacuuaacuugcugugugaccuugcauaaguuacuagguccccuaagcucagcucugcacauuggaaaagaguaucaauaacaugucuuugaagggccccucuguggcuugcugagaacauguauguaaacaugggaccaugccugguacaggauacuugaagguauaaagaauccagucggcaggcaaugguggugcacgccuuuaauccuagcacucaggaggcagaggcaggcagauuucugaguucaaagccagccuggucuacagagugaguuucagaacagcuagggcuacacagagaaaccgugucucaggggaaacaaacaaacuaacuaaaaaaccaaaccaaaccaaacuaaaaaaaaaaaaaagaagaagaaaaaaaagaaagaaagaaagaauccagccagugccugacacagcaggcacuugacaucuacccagcccucaggaaacugguccuuuuuuugcuucugagagucaggagggcuuagggucccuccuguucucucuccaagaagaaaugugacccacuccaucuaaaaggggcgugguguggcaugcugucuaaaguacacugccucugagauaaugccacuuacacgggccuccauggagagugagaacacagagaugugcaugcucagccaaggcugcaaugcuuucaggggcuugauggucugaguuguguaccccaaacucaucuguggaagaccuagcucccagaguaggcuguuuuaaccacaggugagacaggcacucucccucucucccucccucccucccucccucccucccucccucccucccucccucucucccuuccuuuauuuauccuuuuuccuguuuuacaaaccuuauggauuuaguuaacugauuuauauguggauguacauguauguggauguacauguauguggaaaugcaugugugugugaacaugugcagacuagaagauaccuugagugcucuuuguuggugguaguugcuauacacauuuuuaaaaagucuuuucuuauuuuuaagagacaggacuucucacuggcuuggaacucacuaagcagaccaggcuggcuggccagugagccccuuaugaugcugggguuacauguguaugccgccuugccccugacccccuuucaacauggguucugagaauugaauucugguccucacacuuauaaggcaaacacuuuacccacugagccaucuccccagcccuggacacagggcaggaaugguaagaauuaaucccuuguggccauacccaggcugauggaaucugccucagcagguagugugguaugggccaccgaugucugagcagaggguaccuccaaacaucagcugguccaggauaggggcacagggaggcagagagagaccccagaaggagaccaggguuaaugacugggcuccaugccugugaggcaguaauuaacagucgagggcuggucccuuccuugaaugcuuugggaugucgucuccauuuugcugacuuuggagaaaaggacggugauaaauaaacgugaagcacgcgggcgguggugcgaaaugaugcuucgucuaauuaucgccauuccgaggcgucguuaacacgcgagcgagcgcggagaaugauaacgacuucugugguucgucgaggcucggauuugccaucuuaagccccuagcccagggacgcggaauucccugggacagacucucucacagacaaaugauggcauugaguagaagguaaagagaaaaagagucacuguggccgaauugaaaagggcaugaugaugcucccuggcuuccgggacugccuggagagggcucagaaagucagcgaaugagagagugacuuugaggggcacccgagagggcugcugggaaauuuuuccuccauggcagcucccucuuaugccuaccaaggucauggugcagggaacgcaccagcuccaucuuucuuuggggcuuagacgacaggggagucccuggauccugccguucagaaggccgaggcuguuuuagucucuagguuccuauugucccucuguugucucagccuggaaucucacagagcacaacauuucuguccauucacaaggugacugccucauucaguugggucuguuuccgccucucccugcaggucacccugggcuucggggggcaccacagccucuaucauguugcgggcauguuuuugccccuucuugggcucucugcucaguaccacagcuccaucauacuguuuggacuaggaggguacacacauggugccugaccagucagcagaacacuggacugauguaagaagaaaggguggccugugagaugucuuacccaaggggguugguacauugcugagacugagaccagagaguggagaugagaccaccacaccuuagacuuggaaggaagauguaggugcugaaagauaggaaacacgugugccagagagcaaggaggggugacuggggcuaagaagccacagcagaagcaccaagagguagcaauguacuugaacuagcugggcagagaaacccuacacuguagcugcuccugucuuuuagucuugcuaugaaggcuggcccagccccaugcugguuuggcauggcaagguacgcuccuaccaaggugaacuugccccugaguuacuacacccacauccuagccucugagacuacagaugggacuuauuugaaaacagggucucuacaggcuuaauuaaggaucucaggcaggacuugggugguacuuaaccuaaauggcuuagauaggacggaaaaggacgcacacagacagccugcagugugauguggccgggauucccacgugacucagcagccagcuggagaugauggggaagcugagggcacaggcagcugcuggaugcagggauagguguggaugggcccuacccccagaguccugggguaaggacuugugcagacacuguguuugggacuccuggccuuugcugcugggagagaauaucuguuucuuuacacaauccaguuccugguuauuaugggagcaagguggggccucauacaaccgaacaaugcacuucuaacacacaggagcagggguugccauccagggagccagugucacagcaggagucuggcagggcuuuagaucugccucuuccucaaccugccugugaucuccagcccagacagagccucucucuggagcauggcuccuccugggagagugggggcugggcccagaaguucuaccccacagcagccagagcccacuacuguccuuccuauugcugugaucaaacaaacaaacaaacaaauaaaaccaaugccccgagcaaaagcagccaggcgggaaggguuuauuuagcuuauaugucccaguccuaguccaccauugagggaagucaggacagggacagaagcaagaacuugaagcagaaacucugaaggaaugucgcuuugcuggcuuucucacaggcccacguuuagauaguuuucuuauacagcccaggauggccugccuagggaaugaugccacccacaauggacugagcucuccuacaccagucaguuaccagucaagacaaucucccacagacgugcccagaggucaaccugauuugggaaucccucccaugugauuccuuucucugacaacucuaggcugugucaagcugacaguugaaucuaaugaaggccaugcgucugcauaaacuguaaaaagaagauaggccaacagaacagggaucgcaugcuaaaccagcucccuuuuucuuuugagacagaaucccacacaucucagacuggcauugagcucaccaugucacagaggacgacccccaucuuuggcuccuccugccucuaccuccaaacugcugagaucccagaugcauagggccacacccaguuucauucagcgaugaagaccaaacucagggcuuuguaccugcuaagcaagcccuccgcccaaugagcugcaccgcuucagccacuucuuuaacuugcuugccacuccaccaaagggacgucucugggaugcagcaugggggugaggugguauagcaucucuucacuaccuauucaucucaaagaagacuuuuggagacuuuggggacuuuuuggagacccacaaacagccaagcuguaaggacaggcagcccuguggucagaggaaggaugcauggcugugucuaugugugugccauaugcuuccaucuauaaaggcaggauguauggcugggacacucagcccugagcugcaaagcugucucauggaacaccaagaaaacaucaggugaggagccugggcucuggagaugaucagacauggguaccaccugcuuuuacacacaugaggcaccaaaccccaagagcucccuaggauauaggcaaccugauggugcuugaacuuucaagagggaggccuucuggaaaguuccacuuccauuucagaggucggcacuuaacuuaccacuccuucccuuaugagucuaacuuaaaaauacuucuggaggcauggugacucaugcuggugaucguaggaaaccacuuggaaacugaggcaggaggauggagaauuuuagaauagcuugagcuuuguaguguguuucaaugugaauaacugaaugaguacuaaaaacacuugagcuuuucagaaucaaugaguucucuugguaucugcaggcaucaugccacucauggucugggaaauucauuaaaggccuugaccaaaaaaauaaaaauaaaaauaaagaccuuggccagguccuuccuggaacccuauacuggagccuuggaguaugcuugcacacucugccguggcuucgagcuggugaccacuuugaaaaccacuaagacuccucugauaaggacaaaugcccaugugacucacaggguccuaugaagacagcuuuggagagguccugaccaguucccaugccccagaaccacggcuggcacugccaggcucaccaacaguguggcaggcacaucaaagacuuauggcuggcuguaagaagccuguggcguccaccaagcuuccugggguacccacuauggaacacaagugaaggauggaggacaacuugagggagucaguucucuccuuccaccacaaggacccugagacuugaacauggguugacagguuuagcagcacgcaucuuuaccuucugagccauaucacuagcccccuccuuuauuaaaaaaaaaucauacaagggacagaugauccuggcucaaguccuacccagccacaggaggguggucaagacaacacaguuaaggcccucuagccuuggugacaaaacacagugcugccaccuugaugucccuugcaucccauaaucuccaggagccucacccauaaaaagcagccccucccacauccccaauccacucagagccgcugagccuugcguccaauuucacagccgugugccuaccacuuaacgugggaagauguuacuuauaaaagaugauucugaaaggaaaguuugggggguuuauuauaccucugggcuagauugggcgaucuuggaagaaauaagguuguacccuuuucauuuccuauccacaggacaauauuuuagcaguacguggggucagggagaagaagccaggggccggcgcuauaugaugcacggccguagaaucggggcccgcugagcauggagggcagcugucuccaccuuaauaggagcaaggagauugugucugauugaugaggagugagaaaugucucucaaaggacaugcugggguugcagaaaacagccugcccaccagcugcccagagcugugugugcccaggcaugcucugguuuuuuuuuuucaauagccugcugggcaugugggaaagucuccccucuuuccagcauuaggguucaguggucugccuacugacacgccuucagcacaugaucaaggacccugugcuguuggaugcuaggacaagaggaccggauugcuuacuuugggaaugccacggccaaaagcaccccggggaaggaagagucuauucggcuccuggugagggagggaugggagcccgucaugguguggaggcaugcacggaggcaagagcggggaaacccagggcucacgucucuaaccacccacggaaagcagagggucugaaugggauaggauuauaaacucucaagggccaagccuggugauguacuuccuccagcaaggcucugcucuuccaaguucacagcucucucuaacagugccaucaagugcuugaguacaugagccuacuagggacauuucucaguccaaccaccacaggggccauucuuccagggcuguuccaggcccugcccugauugagggccaggagauucauuccuuugcaccuccaggcucagaguucuccagggucaccacuuccccagguccuauccuagcagguguguccaacuuccugacaauuucaugacgcugucacuuaccaagcccacacuuaagaacugcaucauuaaucacacacacacaaauaccaugauacuuuacauaaguguaugauucuguguugggugguuguccuaacuuuacuuuugcugcuauaguaacauauccugaucggaagugaccaugagaggggaaggucucuuagucagaguuuguaucccugcacaaaacaucaugaccaagaagcaaguugaggaguugcuuacacuucagcuuacacuuccacaaugcuguucaucaccaaaggaagucaggacagaaacucauacaaggcaugaacuuggaggccggagcugaugcagaggccauggagggauguuauuacuggcuugcuuccccuggcuugcucaaguuucugacuuauagagcccaggacuaccagcccagggaugguaccacccacaauuccacccccccccaaugaucauuaauugagaaaaugccuuacagcugggucucauggaggcauuuccuuaagggaggcuccuuucucugugauaaugccaguuugugucaaguugacacacaaaaccaguacagaagggauuuauuuggcuuccaguucugguuuauagaccaucauugagaggaagucacagcaggaacgacagacagacagucacacccccaucaagaacagagcgagaacaggcacacuccuguuuguuucacucuuauacaguucaaggcaugguccaggaaacagugaggucuccagugcgcuccuacagcacuuaacaaucagacaaucucucagagacauguccagcccauaggcaaucccucaguugagacucucuucuguggugagucuaugucaugucaagcugacaguuaaagccacagcacucugaggcagcagacuguagccuggacguuccugcaggacccauuggagcaggugacaaguaggucaccauggaggucacagcucaguggggaagguacaggagccacgcaucccugcccaacguuagggcaaucccagaagcgccagcagagucggcucucaagagggaguagacgaccugcccgggaccucagagagcccagagaaagcccagggucugccaacugcaaugccucuggcaagcaugcaaccuggacucuucuggagucacccuuuccucuaguuaucggacacucugaguggcuccuggagauggcccucaagcaaacuugaaggauaucacauuuaauuuguuuccccaguaaggacgucacuguguaccucaguucccucauugguaacagaguuccgugaguguggguaugaggacucgaugagaugcuguguagagauggcuugcccggcagaguuagcucacagucagggguaauggaugcugaagucuguguaccaguaggaucgacauggacgccauaggaacaagugccccugaucauaucugucccuguaaaccuccaugaaaucaucccugggcccuauucuuccaaccucaccaguggcuccauuacaccagcuguccaggaagaaccucuauucguagccaauccuaggcccuguaccucuucccuguaagaggccaacccuggccccucuguaucucuacucaggcucaauacccugucccuccaacuucccaggaggccagcccugggacccuguccuuuuagcuucccaggaagccagccuugggucccugucccucucaccucccuggaacucauaccuggacccuucugaaacuuaauucuugcuuuauccucuaagaacagagaacauaaucucgagaucucuggguuuuccagcuccaugugcugaugagcuaagaauccaugcugguaguauuuaccaugggauaugauggggacucaaggcuggccugguugucacugcuucacgcaggaccacagcugcuugagcuguucuguucuugcuugcaagagagucaugcaaggcaggagcagucguuugaguugagaagccagugcucuggugggaacuuauuucucauucaaauggccuccacacauuucagcugugccggaauacuagagaauggaaauauuuucacgucuccagacacagugauggcugguccugccuucugggguauguaccauucuguacaaggcuugugauuuggaacagagacugaacccugcuuuguuuuccugucccucaguagccugauaccccaacagggucccuucauauccaggagauagcucucuuucuuauuacaaacccuagagcuggcacaucucggggcucgcacaucugggggcuugcacagcuaggagcuggcacagcuggagggcagcucuguggccaaucacaaucgagagccuggagucaguugcccacagccuacagggaauuucuaccuuagagacucuuguggacugagagcugguguccagagcuagagggauuuuugucaagggucagucuucuugguuuggauuaaagaggaagccugaccuuccagaaugcuuucuaucauguguuuaacauggugcucauuccaguggcuuauggguuggguguggguuuguccauggcaagaucccuuggaugguaaggacuacgugugcccuccucugaguccuugaggcccaagucauuguuugaugaagagaugaaggguugguauuaagguucuugccaaugagacagggcauggacagauggauggauggacagauggaugcauauaagcaggagguggggugggguagagagaggagaggaagaaacaaaggaagaggggaagagagggagggaagucuucuagguggauuaggacuuagcagcugccaaggaaagcaaccaugcuccaggagagggcuaagucuuggggcuccuuuacucuagagacacagaugucugauuuguccuguggagcuguuccccugggaaccugacuagagggacaacccgccuucuuuuuccuugaugcacagacuagggaggcaacgugcgucaagguccgucccuuuggucuaacccucacuagaaagucuugcuaagugucagacuggagccggggcuuguagccaugggccaaauccaguggccgucugaauuuguacauaaaauugcauaggaacgcagcccauguguuuccuccuugucucuggcugccuuaggacuaagguugguccuaagagguuaguccagcuacaaaggucugauggcucaaaacagcugacuuacugacuggcccugugcaggcaagggcugcugauuccugggacagagccuuguuagaugcccauggcagguucuggggucuggggauagcccccaacagaaacuguuguuugccauauaccuucugaggaagagaaaauugggggaucugguggaagucggggcuguggggaauggcaugguggaaugcuuuucagggugaccggaaaggcuucugaguacacaggauugcucuucacucaggaucucuugccugagcagcuaccuucucagggagggacuccagccugcuguguacgcagugguccaccucaccugccuguguuuuaucuuucugaaacaggcacagugugauauaaucacccacacaucacucccccaccccagaauggacaacuugcuggguuuuaagacacucaagaguugcacgauccacguuagaauucagaacguaaacuuuaguuuagaauucaaauacaaaauuuaaauuaaaucaaguguagaauuuaaaaccgacuucagaguauuuaagaguuauuuuucaauuguucuuuacauuaaagucauuuuuuuagaaucuauauaaaacugaccaccauuuuagucacuuugagguaugaggucugcuuucacuagauaugguuauaguuccacuuuaccaucacuaucaugguagcgcauuuuuaaccccuuugcuaccucaggucuacuugacacagugccagccccuguguuucacuuccagcugaaaggucaccuaucuccagggacuugcccuacugaguagagugcccuccacaugguggguguaaaugaaaugauuggcaagaccauggacugaguccaucucuguggguauuggcuuuacuggagccaaguccuaugccugguacacaucugcucugcgugugguucacaacagacagugccgagcccgccucugugagcagaagauccuggacuguggggacuccuccucuacuguguccauaagugccagcaccaucagcccaugguugugucuguaggagaagcaccauggugcuucccugaggguggcuacggugccaaggacaaacccuccaaaauccaggagagggagcagagauuugaugcccauauuagagcucuucauggaaaacagccaauaagagauaucuauaugccugucuauugaccgagcaaucuauugaucgagccuuacauacauauucggaugauggaaagacauuuaucuugaguacuuggcucagcuauggggccugggaagccccauacuccgagggcagaagagcagccugcaaauguggccaggcauuggugguguccucuuggguaugaauucaagcauggcaggcugggagcauaggcagggcuucuaggauacagacgggagccaaaucccuucagggacucggcucucaaagccuuagucuaauuggaagaggcccacccuugcugcaagaggcguuugcuuuacucagagaguacuauagcaucccagcaccagcaccggcaucggcaucagcaucacuguccacccccagaccaggaagaaaaggcaggcuguaggaauggccgcucccaaggaccaaucuggucuuuuauugcuuugcauacuugugagagaaaaaaaaaauaaauucgcagguguucagcaaagggcugcuccgugggcaggagagccccagguuggagugcggauccguggcugcguuuuaauuagcuccauaaauaauuaugccucagagacaccagcucugccuuccaggcucucccccacaccaauagauccaucuuauuuaacacauuuuacugauuaaacaaaccugugcucuguacuuuaaaugccaggguuaugcuggccucauuuucagaguuaucuauaaacacaucugccaccacugaacggcaaaaccccuugucacaagucagccuggcagguggguuccucccaccaugacgcaucaccagcuccgugugcccagccucagcgccugcauucuguccucacucggcuucuguucagagagccuggccuugguuuucuccccagagccaggugugugagacucucaggggguggggauaggggugggggugugugugugggggggagaucuuucauccagagccacaggaagccaagggcuucaaggaggcuggggacaugcagagcugagauggcucagcuguucugaaggcugucaccgggagucuguugacaucccaaauccugacagguggcugcuggguaaacuguugauugacccacuuguuuacuuuaauaaaggcaccauuaaaaaaaggcagugcugugugucaacgucagucucuggacaaagaaggaaucuuuuugcacggaggaugcggaaggcugagcacuauauuccaucccugagcuuugcgggaagcaccggaaguuccacuugcuuagaacuuaauggagacucgcacaagaaaaccguaaagaguccccaggagggaucucugagggagauccaguuuuccuggcucugguggcugugggcauggguggucuuucucuugcaugguauaugaauccguucggauucggcaggugcuucucagagccggaagucaguuuaaauaaagggucaguucuaaaguuugcaggcggagcuucagccaaggggcucgcggcuuuaauuugucugcgggcgcaaagccugccucucccaccccacgcugcggcaggcaggcaugcucuaguuagaaacugagcgcuccccugccagaugccaggugagaggguuacugagcguggcuuucagaacaguggguuuuauggcuggcucugaggaaccgcucagccucauuugcaucccaauggcagucuaggaaaaggcacugggcgccggaagcagccuccuccagcuccacugccagucacgggucacuuuaaguuaacaucuggugaggguauuuuuaaaucacaucuguagcuuuaauuggggcucaccugggggugccaggggaggcuugagaggagcauugcugaaaguuauguguggccugggcccagaagcugccuggcuccaguuuugugaugccgcguguugggcugcgauggauaggggaaggcagaaauccccuuucuaccccugcauuuugaaaagugccuucugccccagcauccaagaaggguuuccccuuaagcagcacagaaacccacaccguucucagaugucaagcgaggucaccuuaugcucucuugccaaggaacaucaaggauuucuucucuguuugcuaggcaggucucucucuucucucucuuuucuguggugauaacuggaugguacuucauuauccaaaagaguuuuauuuuucacaugaccaacgagaacacacacacacacacuucucugagaucucugcucuuccuuaaguauguucaagacguacagaacuauucaaaaauucugucaacucaaagaaacaaauauuaaaaauucaaauuuaaauggugaccucuuugggcuggccuagcuaaacauuauguuuucgucuacaaagacacaagggaacccuguuucccaaagacaggccgccaugccaucuggcuguugugccgccccgccuccuuucuugauaaauaccaguaauaauaggaacgaaaucccugcauuucacuggaacgaccauuaaaauguaaacgcagagaggggauuuugagugggccacaaaaaugcuuuauuccgaagacugcaugaggcgaggaaaaucuacaguugagucuugaaccuauuccauaguauguaaauaugccagcuucuguuucugaacacucuguguugauuggaagaucugcaacauggugcagaguaggucaggauccugggaaaaggcaggcuuggucaaguugcucauuuuggcucaaauaauaaggguucugaugcugcagaggcccaggauguuucucaauaacaaagcagggucccccucagggaggcccagagcaggaagaggagcaugugcagucugugccuacccacgggggcuuuuuccagguuugacuuugugugaagggacaccucugcgggacaccucugcgggacaccucugcgguuguccucaucagaguggggucugggguugggucagacgcacacucaggccuuugucuauucguagaaaugguaaggagaccagaucugugccaagcccagggcucagugggaaugacugugggucaucagaggagcuggccaguggucacuagaguguccucugacacaucugcucucccuguucccaaaccucagagcagggcauccugaaugccugguggaucuccacaacggcagagggaauccugucacucacgcacaucugugugucacuugcaaugaguucagugugaugccguggagagccucagggaagaaggacgcagaaaucuucacauuugacuugcuggugaugucccuccauuucacuauggucuuaaaggaguggcuaggggccugagugucaacaacaaugacacauaucaucugccuucuguucauaacugggagggauaaguucaugauccaugaaaccaaaaggggguuaugagcacacuaguaugacauuugugugcacaugcuggggugggggguuaggagccuacuggcagggaauacaguauaugugcgugugugcauguguguggagggcgggagcuuaagaacaugcuagcauggaauguaauuauguauacacguguauaugcaugugaaguggaggggguuacagaccuacuaauaggcauauuuaggugugugcaugaguaugugugugugccgcauagaugaugaggccacuaacagggagugugugugcacaucugugcauaugugugucuccaggggccuguguauauucaugucaccuagaaggauucuuuauuuuuacugccugcuuugcucaggcugcagacggcauaagaucagcagcagccucuaaauuauagaucggcucaccgaguucuccaugucacucauuagccacgucaccccgaggcucugcgcaaccguaaauuaaggaacacaauggcugcagggaaauuaggugaauaauuuucucauuaaacuaaaaacuuggggacgcuuccgguuacuuccaggcuguuccugagacaauacagagccaugaacagacaacaggcaggccccuggaugccaaggguaccauucuucagagcgaguuaggugugguuuacauuaaaaauagaacaggcuccugcaaacagacuuguauuuauauggaaugcugcgacaacugucauuucacauuacucagagaaaucccacgggucccuuguaaguauuaaauguggcaauuuuuuuuguuuaccgacaaaacauaauaaaaagaacacaggcucccgggugacauucagggggauuuccccccucguuccccgaaguuauucauaaaauaaacauguguuuccuguccccgcugcccugcguuuugaggguucccugacaggggaccaaguccgacaggcaaggcagcacccuguucccgggacccccaauccacagcuccuauccacaccuuuccugcugugucuccauguguccaaagagccgcuuccaaccucauccuggaguccauugugaccagugugacaagcagagagguacagagacuugggaaggggaacacaugugcaugcaugugugcaugccuguguguaugugugugguauauacauguuuguaugugcacacauguuuguguguguauaugaaugugguguauacauguuuguguguguaugguauauacauguucauguguguguauauaugugugcauacacaugugguguacauauguucgugggugugcaugagcaugugcaugcccacauguauguagagacuaaugucaggagucuucuucaauugcucuccacauuauuuuuugacacaaucuuucacugaaccugggacucaccaguucagcugggcuggccggcuagugaacuccagggccccuccugccucugccccucugccccucugccccucugccccucugccccucugccccucugccgcugccacaguuauaggcauuucccaaugaguccauugaauuuuguggguccucauguuuacuaagccuaguccuauuuucuagguuccaggagggacagacuuaacuauuauuuauuuauuuauuuauuuauuuauucauuuauuguggugggaaagagagaaguggucuaaauuacucaucucaagcucaggaucuguuuuguuuguuuguuugguugguugguuguuuuuuuuguuuuuuuuuuuuuuuuguuuuuuguuuuuuguuuuucaagacaggguuucucuguauagcccuggcuguccuggaacucacucuauagaucaggcuguccucugccucccaaaugcugggaucaaaggcaugcgccaccacugcccgguaggauuuguucuugauguagaaacacugaguguuccagggaaggccaugaaacuaucccaacuagaaaaaggaggacucaagcugagccggccuggcugaccuucuccucgucccuguccacaguggaucggaaguaccaggagaccaagcacacagcaugugguucugagcagaggcucccgcugacaucuuuacagaagcucugggagugugggguggggugaugcugacaugugaccugccuucagugugcagcagugacuccaacaggugaucacacgugacgaugcuaacaccccggcaucucuugaugcuugcacacucugcauuuggaaauuugcucucuguuaauucagaugucaugaacaugggucuguauggcacacacaagcucuuugagguucucgcugaucuuucagagggugaagggauccuaagaucuaccuagggacugcuguugacuuagggugcccgcugauaguagucaccagcagcacacguuuucucaggaaggauggugagauaugcugaguuuaacugcuggcuccauggcgauagccuccccaucccuaugaggcaaccuaacccugacucugauagguaccuguugccaugacaaaaauaaauaaauaaauaaauaaauaaauaaaucacaaucacuaccucucucccuaacaucuagcuaauggguuuaaaaauacaauuccugcuggcaaguguuuucuguuacaguccuuacaauaagggcacuaacccaaauaauuuauucucuucucuuauaacuuagucagcuaggacaaauacaacugaguaauugcuuucuauuuucuagaaaauauucucuuguccuggcuaaugacuucauuuaaaagguagauagacgagaacaguuuccaucuuaauuuacaauaauuagcuaagauaagagggagugacuugcccugaucugugggaguuccuucaaagaucacucaagcacuauuggaccucacugggcucucaaccauaucuggguccagagggccaugcucugaagacagugcaugcuucauuucccugccagugcaggaggcaauucagugcuuuccccagucccagcauacacagguauucauguguacauaugugagcaaacacacacacagacacacacacacgugagcaaacacacacacacacacacgugugcauauguggcaaacauaugcacauaugugcacauacccacaugcacacacaagcacaugcuuauuugcacacacacauacacagacacacacacacgggaacuaugguuauggaagaaacauacagcaagaaauggaccucuaugucucccuaguuaucagcucugugguucuaaauggcucacucaugggaaaagcauaaaaaaauuuucaccccagaaaaauaaugccugaaaacuaaaaccuuaucuagguuagagguugggcaauuugucaauauaaaguggcuaacuuuuaaaaagcuaugucuguacuucuugcugcuaaguuugguugagaauuuuggaaucucguuccuuaaugaaaacagccuuacaggaaggggagaagugauuaauuaugaacacagcugccauguccuaauuguuaaaaauauucaauuuaauuauuuagaaaacaucuagucacaguuuauguucaccuagggagggagauuagaaaacccaauauaauuagaaaugacauuguuacuaauuugcaauucaagaauuccuucuagaacauucugucaaccccugguguaccuaacauuucugcuccuggaguaacaagcuauggugguacccugggguuugaaagagaagaugcaagaaggauggggacauaguuggaguggaggcaacuuuauaucucugagguauccuuaggggcacugaguuauaaaaauguuaccaagcacaagaaggaaagacccuccacaggcaagaaccaaccaacaagaaagguuaagacagggacaguaacagcaacagaauguaagugugugugucuaaucuguuuaaagacagaaaagaggggaaaucuaaguaugagagaauaagagaaccccaaaccagagagguggguuuagggggaaagcuaaguagaaccucuaaagauggaaacauaauuaucaaaaaauuaaagcaggggccaccaugauguccaguggaugacgagcuuguugugcaagcgugggaacugggauucaguucugcaggagucacguaaugcuaggugggcguggcgguccaccauaaucccagcacacaagaggcggagauggaguccugggacaagcuggauagcuagacuaaacacaccaguguguucuggguucaacagagagacccuggcucagugaauaauauggagagugauugagaaagguuccugauaucagucuuaggccucagcaugcaucuauacauacauaaacacaugcauucuaagggcacaugcacacgugcacacaugugugcacacgcaugcagauacacacacacgcgcgugcacacacacacacacacgugaacaugugcaccuccgcacucauacaaacacacauauacacacccaaaauaaaacugaaagcucauuguaaagauaauagggucaaagagagaauuggcaaauugaaagauaaaucaagagauauuauuaacaugaucgaggaauagcagugcaugccuguaaucucagcacuuagggagagguaggaggacugagcuagacuucauagugagccccaggccugcauugcagagugagacccugccucaaaaaauuaagaacaacuuuauuaggaaagccaagacagagagaacaagccagaaaauaugauguagaggagacaucagcccacagcgcagagggacugagcugauggggcaaaaaggacugcggcaacaucuggaaucuggguucucugagaauauuuagucagcccuguucaagaugaauggcagaggggcacucagcaggagagugcuugccuagcaagccuaagguccuagguuugauccccagcaccaaaacaaauaaaagcacccgaaggaggggcuggaacugcggcuuagcaguggagagcacuugcugcuuguccaguggaucucucccagcaucagauucuggaggcucacaacuaccuguaacucagcuccacacaucacacacacacacacacacacacacacacacacacacaccagauacaaacaacuuuuaaagggcccagugaauugcaauugggaaaaauaaacaaaccccagucuagcgcaucagagguaaaaugcagaacccagggguggaagccgaacaaagaacgcugacaauuaccacgacagcugauuucucaauguaaccaugagucccaggaggcccaacucuacucuuuccaagugccgagagagggaagagaaaaaaaaaaagccaggaaaccugucaaccuagaagaauuauguauccaacaaaagcagucuuucaagaaccagggaaaugaagauauuuucagaaacaaaaccagggcugagaaagucuaccucccccaagacuccaugaagaaagccucccaggucaggccucggagagggaggggauucccgaagcaagguggaaguggaggucggggagcaaccuggauaaggaaagugggaaauguggcaagacgaaagucccucuucucacagaggcuuguaguccggcuugaucaaggccgucuccccagcagcacgaggccucuugucacagccuccucccuacuagagcccugcuguuuguauucaucaugcuaugcacuccaucuuaaagaagauaccaggacuguggagacagacagcugugcaagcacgggcuccccagcacucacguaaaaagccagaggugguacugugugcuucuaauuccaccaguagcgaagcagaagccagggguucccuggagcacacugggcagcccguccggcuucguuagggaguuccagguuuagugagagaugccgucucacaacauuagaucgagagcgagacauuccgaguucuugcccggcuuccacauacacgcgcacacacaugcacaucccaaacccucuccggcaccccccacuccccauguaguccuugcuucccucggcagucacuacguucugucuuccccuuuauuucuucuugucugucuacauugagcuccaaauagcuuuuuguccuuauuugaggaccaaagcuaaggucucugccggaucggucgucuuugaacauagcguggagguguccaccccucuuacaucacccaugggcacaugucuuccacugccuuccuggcuggcucuuguccuuccuggugagucucaggaaugggguggauucuucuucagggcaccacaaggaagcacaaaggucuagugauagauagguggcaaggaaugacaggaacuucugcucccaaagcuccagagaccagaugccagcuggaccguauucucucugaaggcccuggaggauggcccuccuuguaucauucuccugcugcuuccagaauacaucugucaaucacucuccuccucuaucauuuuguguccuugugggucccuguccaaacauuacucuuuuaaaaacaaauaagaaccacagucauauuagacauagcgccaucccaauccaagaucugaauucccuuaacuugaucacacacacacacacacacacacacacacacccuauuucuaccagaggucacacuuguagguuggagaaguuuauugaauuuaucccucuggggaacaagccuguccaugacacucauucuaccuacuauaagcacacccaccucuguugcaaagggucagggcacccccucuucucccuggggccagaugauagaucacuacaacuaacuuagcauuugcauuucuuuccuuaaaacugggggagauucaggccaugcaagcgauccgcccugaaaccccagccuuggggugcaggcaucacaguugaagcauguucgcuucaggauccuacuccuccacugguccccuguccagaugugucaccucuccugaugcccugccuccucuaggagaaccaaacaaucagccacagacacgcuuggcuccaagcgcuacucuuuaacuugaccgugucuucaagauccuacuucuagaugaggucacagugcugggguugggaaccgaaccucucuuucuaugggacaagaucagagaugugucagcaagugugucuuguguucacccucugccaucagccuggccacacguggugugacucaaugccuccucucaccuggucacauccugccuguccuccuuggccagcucucugcagcccagcaaggcagacuuuacacaaagcagucagagacaauggccccacccucauguauuuggagggggcaccagugaccugugaagcucucugcccauggccuagcccucacuucgaaaccuuacaauucuuguucauucugucuuggucuuaaacaggccccgccccccauacuacuucugcaggggccaagcaggaucccagucugaacucacuguccccgccugacacuccucuuccagggcaugagaguccuuucucaccccccacccccacccccaggcuucauuuaaauucaccaucuacuucacggagaccaugggcagccagccacccucagcauccuaagcuccacucacucucccuuuucuuuauaguaaccgccacuugccagcagcuccugauuccucugggggccaugguuacuugcuagggucugucaugcccaccagcauggaccgccaauggggacgcgagggagcuuugcugccccaugcauugugaaucuuaagugcccugaacagagccugggcacacacuguucagaucucuguggaagggcggaaugggguguuaacuacagggggugacgacagaguccacucugugcagaaggaaaggaauuaagacaggaaaccauccucccagcaacagagccucuggcugggcacggaggguccccguggggugccucauacguuucuuguguguuugagaggcggucacacuauugacuaacuuuagacuguucacuuucguaucaagguuagaaugugggaauaguagaaauaaaagauacaacagcuaagccauucguguuucacaaaugcaaaugggagagaugaauuccaguaaauggagaaaaaagaaacagaaacacacacacccuuacaaauacacucacacaugcauacaggcacauauacauacauacacucauacacacagucacacaguuacagucacacauagucacacacagucacauauaaauacaugcacauauccauacauacauacacauagacauacaaugcccuuacauacacauucacacacacacacacacacacacacacacacacacacacacaccagaccccaaacauggaaaguacuagaaaacaauaaugaguuuaagccaaucaacaguuauagccaauggaacagauucgguuuucaaaguaaaagaaaagguagcugcccuaauuuuaaagaaaagucugacuauuuuguuacuuaaacacaccaugaccagccccuaagcaguggauggggagacacauagaaaacaccagucccaacaaugcaaguuuuaaugcuaaaugcaucacccgcuguggcgaaggggcucacugcggacugcugaaauauuugguucauaggagacagagacagaucaguggggaaaggugcuugcugccaaaccugauggccugacccuuagaccgauguggcagguuagaaccgacucacaaaagcugcccuuugaccuccacacauaagcuguggcaugugugccaacacacauagguguacacacacacacaccgaauaaaugagugaauauaauaaaaguuuuaaggggaggacauacaacuuuaaacaaacccauauauaacuaauaacuucacuuugaaauagauaaagcaacacguuaaaacaauaugauaaagacucaaggagaaacugacagugggacauuuaaaauacaucuuuuuauacuugacaaaugaaauggaaaaaugcacaaaaaguuauaaagaagccggacgugguggcgcacaccuuuaucccugcacucgggagacagaggcagguggauuucugaguucgaggccagccuggucuacaaagugaauuccaggacagccagggcuauacagaaaaacccugucucgaaaaaacaaaaaaacaaaacaaaacaaaaaaguuauaaagaguuaagugagcaugggguuagguucuuaaguugcugggucaaagaaccggaucauaaaauuguauaguaaagagcuauucucuuaaacuccagcaauauggcaggggcaguagagauguccuauagagauguuucauagagauguuauagucucucucccuugagaugcagaagaaggagcugaaacaucaggagaguccugacagaaaggagaggagauuaaagggcccaggaaacuggugugugagaguggaccuacuauguguggucacaaaacaugccagaguauguuccacugggaagacaggugggugcacugucccaagugcccaguaccacucguuugcaugacaggacuggggaccaauggaagagaagcugguggagaacuuggcuggcaggagucacgggaugacagguccuauagagaccggugaaggccguuagaacccagaccaggagggauggguagcugacaagcuugguuaguagaagcccagcaggucaucagugaggcugacgagcagaaagucguagucuguuauuugaucucgggaccuaagucauguuucaggucuugagcccagugaaagaagugacgggccagaugcuauagagaaggaccacuggauuccacggcgaguucauccaggggaugaucuggccaagggcggaccaccacuuaugugaguaugggaauauuugcuauuuugaggacaguuggaugcagauuucaaguuggcacugauacucagagaccaagaguuaccauggucacccugcuauuuggaggccaagcaaaguucaccuauaugggauuaccuggacuauggguccauaugguaguccuuucuugugucgucuagcaugugacugggauuaaccuccugaguuguuuuagccccacaucaagguaccagaucagucauagaugcaggggaaaggacaaguagaagcugcuuaaacuguccucucuugugucgguugagguugcaaucuaaaacuucacaccccaagaagaugguggggcugaguaccaaccuugugcaucuagaagaaguugggauggucucuauccaaucuuugucuaccucuagugccgcuccugcagaaagcagaaggugaugaagggcugugaugagcaggcuccagugacuggccuggagcucucuuaccguuuuacuugcgaagacuguuaacucucgcuuacaacaaucacaauuaaauuaaaguauaaggagaaagacgcgaauacuugcaaccauuucuacaugagauaccggcuagugcaauugagcaagaaaaagaaaccaaggacauggagaucacagaggaacacacugacgcuuucaucacaggcagaugaggggauaugcgcagagcuuaugggauucgagagauaaacuaucacacagaaccaacuuagggaugcugggcaugaggucggcgcgcauaaaaaaauggacuuuacuucucagugucaguagccauaaaauacaaaaugaggauugcuuuuuuuuuuuuuuaaagggcuucgaaaacaucagcucccaaggaauaaaucugauagaagcacugggcugcacccaccgggugaguccacuggaccugacugugcucaggacuggaucgugaauccucacucagcuguugaagauuagcgacuacaugaaccgacaugugcaugaaucaugccuuuccugucuacuuugcucccuccuuccaagcccccauggagaagccccuccucgggggaacugcccgccaacccccuugggaaggugcuaucuauaucucuacggccaggcuaccaccaucuucacgaauccagcugcaccugcuugugagcacccuuucaggauguggccuguggacuguugacaucccuuccuagauggagagacugacaaaggucuuuggacccucacgugaguuuccagcugcuccucucagccauuuguaggcaaucaugcccuaauugcuccuuguggggugggguugggggugggagucuuaggacagugcuagggcacacaggcuggggaaggauaagggaagggacuccaucuguguuagaugaagacuccccagugcauccucucuggggccacgcccccuccccccuccacaugcucuauaaguaaguucaauaaacucauugccucuguaguggggauugggauggaauuguaccuugcuuuguucuuagagccuugggaagggcaguagacucuguucauaucccccagggaaggacuucuagcaacaucccuuucuccagccaguccauguuaaaacuuuccuuugaaguguccgucacugcaucucaguaaugaaucauguaggcgacugcccgguguccaucuucccuacuggacgcuacacuccaccaugagaaauggaucuggcauaaggaggugccccaggacguucgcggacugccugauuuaaugaauuugcuuuggccucuuagagaguucaucugaugcgcaggacuucaacgcaaccuucauauuucucauuucccccgugagauucccuccucgcucaucacccucuacccgcuugcacgauuuaccccgaggcaccuguguguuccaggagcugugcuauucuagggacacagccauaacuaagacauaugacaucuaaggacagcuuucaugaggagcagguggggcuguggcacaugcagcaagagguuuguagcugguuacagagcagagagggguguuccuuuuuuaugcaauccuccaaauaacugaggggagacccccucaucuuccccuugucacacacaauaaucuucucccaugaaauucugauuuggcagcucucgccgcugaguagucauguaagaagaccuuauuaauacagucagagccugugguagcugugauucauuuaaaacuaagauggaagagggaaaucaauaacacuuagcucuggucacuuuacauuucucuguaaccaagguaucucuuguaaauaccgcaccccaccccacccccaauguuugucaaacucacccaaccucgguccccaccuuccuugauccccaugacuuuguucaauucuguguuuuauucacaauacaccaggugaccacccagacgagggucccccacaaaguuaucacugagaaaauucuccuugccccagugaagugcuaugaucagauccacuacagggaugucaagcagcuccacaugccgucuggugcuggccgaugcugcccugaauuugcaugcugcaaugcaggcuaauuccacccuugacuacaggcgcacaggcagcccugagcucugagcagcaagaaacucugaacaggaaaagggguuccccgguacagcccaggcacaugggcucugacgucagcuuugcguuacaccccccccacccuuucaagcuugcuagcuucacguucccuggggcuuccucccacccuggaguaggcaggcagcccgugagcaguagcaguccuugcggcaagauuggccuuuuagcagagcccuuacaucucccuguguccuuaaaaggauggaggagugggcccuggcagggcagcaaccaagaagccugggcucugcucggcucugcucauuuucccugaaccauuauaaccaucuuguaaguaucuccggaaagagugaugaugucacagcccgaugacgucacagccccgcgccgccuugccuggcugcccacuguagugugcaguucaggauacucuaaucagccugucaguggcaugggcaagagugagaugggacaccugccacguggaugcccuucugcugagcugcucucagagcguugcugucucccguaccugcugcaugaacacaucaagcaccaugggaagggcacacacagaauugcuuccaguucacgaaagcccugugauggagcggccuacuuaggaaugugggcaaagcccugagcggggcuuuccacucaggcaucagucauuucaccgcuacacaucugucaacccgcuggagccucgagcgacacuaucgucaguuccagucugcagaugacggcaguggcuuccuggaggucacaccgguugacugaucuugccuuacucauccuugccuuaacugcugcugaccacugaccguggaccccaaguccuccagggcccacacuugagagagcacagaggauggcugccuuagacuuaguccuccaugcagguggcugaaacugcuucuccuugcacagcuccuucucgggcacguaaaucuggggguacccugauucauuauccagucuuagaagcuaccaccucugagaaucauccuacuuccuccaggagaccucugagaucucugugucagauccucuugcauauuaagccuuucuucuugcaugccagccacuguuggcaugucgacaccgccucgaaucacagggaagagaaucucuaugagggacccucuugaugaggucauugaugugagaggacccagcccacugugaaugguaccauuuccuaggcaaggaguccuggauuguacaaaaauagagaaacggaacugagcacaagucauaugaacagcagccacgcauggauguacgcacauacgcaugcauacacucacguacggaugggugcgugcacguacggaugcccgcagucagcaugcacacacacaguagucaugcaugcacuuacucuuuaccugcuauugacuguaaauaggacuaaaugcuucaaguucccgucuuggcucccucacaguuacaaacuggaaccacuagaagaauaaacccuuucucccuccccugaguggcuuguuaccagaguauuuuuaucacagcagcagauaugaagcuaggaccaaggccuuuggcaauguugcuggcuaggaugaggucauaccagaaguagacucaauggugauaucauuacaggacgcucaugugaagacagguauaugugaggaacaucaaggguuuauaaaucacauggcaagaagcuagccuuacuggaggcaagaagcuagccuuacuggaggcaccuagaaucuuaagaguggugugguccucccgggcucaauagugucccuccaaaaucuacauccacucagaaccucugcugaaaaaauccccagcuuacaccuugaugauugcugugguuacuaccaucaacuugacaagcuccaggagacaagcccucggaccugcugugagggauugccuagcuuagcuuagccucuggacagcagugaggugugguuaagugaggugggaggaucaccuuacccauggguggcuccaguccaccuuacccauggucuuagcuuaacuuuuaaaaaggaaaauaacccuugucuucuguuuccugauggcugacacaaccugaccagcugccaucaaaaugccccuuccaagagggacugugcgcucccauugugagcccaaaggacuucuuuucuccuaaaguugauuuuuccaggguuuuucuucaucccgggaacagggaagcuucccuaggugaugucaggcgcuaguccuuuggaacaauggcaccaugguugguuuucuuguuuuguuuguuuguuuguucugaacgccauccaguuuguaguuccuuacuacaagaacauaaggaguucuuuuauuugggaggggggcgguuuuuaagcaugguccuaggagaagaauacccagccugcugacaggcgaggcaucaaguucagaacuaguuagagggcugugcacauuaagccagcucuuaagugaccaccgagggucaaaagcaagccuuucugcuucccuagucuccauucugagucacggagcccauccauccacacaggagaaaggcauaaggugcucccgcuggugucuagguuucaaauccuuuaccugggauacacagaaccaaaauuccuccccuacccccagguccagagcagccccaccccccaacagaccacacaagccuuggacaagcgaaacaauguaucuccaaccccacacucucgagcucccuuccugaaggcacaaagccccaagguauguagguagguuuaacaggagccuugacccgguccuucuccaagucaccagcugccaauugucuuuccggaggagcagcugaacugcagcuucaaacauguccgcauacauccuucuugcucucugacacccaucccugacccugaaguacaaaacuccuccagcggccucacgccuccaaucucucucucucucucucucucucugaggcuaaucauuucucauguccacuucucaaggucaugucugcccuucagcuggagucucagggugauuagaacucgggaaagcugccugcuacuuggagggaagguugggucugguggggguuggggggcaguuacugccgggccuucgaugagcaggaaagcaauuuggaggcccuggagugcacuugaagcugugccccauaaaugaagaauggggguggauugauuuauaacucagagggagaaaacuguguccggaaugugaacgauguguccacuguguguggaaucccacagucgagccguggugccgagcggugcucggccucuuacagcacgccaguuuccuccgccccuguugcagccugcuuggacucgaguuuaggauuguugguagucauaaccuaggacuccuggguucuaagauguaaagaagcaguugugccaauggcagcgguggcagaaggcagugugccucacugcggcccucuguagucauagagcacaguagaauacucaggaguauccuuagaauguacugagucucugacccgcccacuccccccgcccccucccaagggccuccagggaccuuucuugucugcuauuggcuuugggcagacauagggcgugucuucucacacagcuguccucugcagcugacuccaguagagcuaguggauaaagaauucuacagucaguuccaguuggccuuugaggagucugaaagacaacauuuaugggagagagaguuugggccuccaggaagaagacagcacuggguuacauacaaguggaccugaagcccgugugcgaauguucagugaccccaccgugcagccuggagaaggcgcccuuugaggaaacgagccuccagccccucgagaauauuggcauugguuucccugucuguccuggguuggaguuuugaguucuggguaaacaaaacaaaacgaaacaaaauacauaaggauggcuugggccccuaacagcucuaacugccugcgugcggaggagggaccggcacccaaggcucaggccaccuucccaaccagccgucucguuuugugcauacgcggucuccccauccaucagcuccaaguuaaugcaucacccuaaccuuacaacgacgcacaaguagcugaggacaaccugauccugugaauuuacaaagaagcaugcaugccucaauucuggauuuaauacggcaucgccgugauuccaggaaaucaaucccucaaccacaauaaagagaaaaagucaacacucccugguguugauauccaggaaguauucugaugguguggaggagagggacaauagcugccuaucagggacccagggagcuacuuagagagugugucuacagggacacaggaggguaccucaggaggaugucuaaagaaacugggugguaccuuacaaggaugucuacagggacaggcuggggcuuaaggacaauguagacagucacauaagagggugcuucuaaaaaacuacaaaauacuaaugaaagaaauaaaaaggaccuaguuaagcacgcacacacacacacacacacacacacacacacacacacacacccuggggcuccacaugaaaggaucagaguggaagauaucucuggcuuucccuagagugaucugcagacaccacuuggccccaagcacaaggcugucaggguuccucuguagaucuagaacagcagacucaaaacuuuaugcugaagcguaaagcaagcaggcuagccuuaacaagcgugaaaaagaaaaaagaaaaccaaacuaccccaguuuaagauguacacagacccauagcaaucaggccagugugacaccggcgaucuggugauggaaauuaaaagcauaaagaucagcagaucagagcagacauuccagaaacacgccccacaauacaccacugauuucuguuugucagugugcaaagcaaauuugaggauaaaagaacagcuuuuaucagugaguggauuugaaguaagaggccaucuagaggcagcaaucaaaacuuccccucuauguuaaccacaggccuuauaaacaucacugggaggggucuccucugcaugucacucccucgccucuuuaccccacccccugcccuuuuguagggcccuaacuguccaccugauuuaaaacugggucucuggagcuggagagauggcucaguggcuaagagcauuggcugcacuugcagaggaccuggguucaauucccagcaaccacaugguggcucacaaccauuuccaguuucaggggaccugccauccucuucugagcuccaugggcaccgggaauguauguggugcacagccauacguggaaacaaacacucagauacguaaaauaaaucacaaaaauaauucugccuccguucuauuuuuaugaugcucauugucacgcaacaugcaugugguaccaugugacaugcaugcgguaccaugugacaugcaugugguaccaugugacaugcauguggcaucaugugacaugcaugugguauucuaguucucaguguccuauaucucuacuagaauguguccccaagggccacuaugucuccagaaccuagaaagaugggucuuacuaagcuguucaacaaauguucaucaucagagagaaaacaugaaacuccagagccaugggguugugacacaguggcugccaggcagcggcuaagaugaacuuaccauaaggcauaaaguaguaaugugcucauggagugcuggcuaaacauggcugggacagagagauggcuccaugauuaagagggguugcugaggacccagucucaguacccauguagcagcuuauaaccaucuuaacuccaauuucaggggauccugugcccucuucuggccuuugugagcacugcaguuucauagcacauacauacauauaggcaaacaucuaaugggcagaaaaaaaauggaucuuguucuuuaagaaguagugccuugcaccuguaaccccagcacucaggcugagacagaaucagauagaaucagauuguggguuucaggcuagucuaggcuacugucucagauaggguuacuauugcggugacagaacaccaugaccaaagcaaguuggggaaggaaggguuuauuuggcuuuuguuuccacaucacugcucaucaugggaggaggucaggacaggaacucaaacagggcaggaacucggaggcaggagcugaugcagaggccauggaggggugcugcuuacuagcuugcuccccaugguuuacucaaccuucuaguagaacgaacaaccaccagcccagagacagcagcacccacagagggcugggcccuccccaucaaugacuaauugaggaagggcccuacaggauugccuggagcccaaugucauggaggcauuuucucagucgagacucccuccucucugaugacucaagcuuaugucaagcuaaaacuagucagcacagcuacauagcaggaaaccauuauagccaaacagaaaccugagagauguauagcauaauuccauuuuauaacaauguguguguggguauguguuuaugaaugcguguguauaugucuauaaacaggagugugugugugugugugugugugugugagggggggggagggaguguuaguuaguuagacaggggguauuuucacuccauaaucuuuuauucugcauacauuuugacaauauguugucuuacacaaaaugaagcuauuuccccuuggggacagcucuucaucucuuaaguucaaacuguagcaugcuggagcuccacucugcaacagggagagcguacucuguuccccuuaaagccaggagcuaacaagaaggaagaaauccagugcucaguguaagagcuuugcaaauggugacuccuaacaugauacucccagugacacagaggucacagguguguccaaggccauccuuguacccauagcacuugaacacccuuccccucuggcccucauccuaggacaccgucacccucuggcauguguccuacuccaggacuggcccuacagauggaaaaccucuuucaguugugcaguuacgauccagugcgaggcugagauggggggaucuagcagggcaggcuuaauaaguccacaggaaugauucacaggagaggaaccaagccccaacaccugggagaggcuccccaaagacccuccuugaggggaaggcaccuuaugaggagcccuggcauagaagcacaacaggggcucuaacuuggaaacagaugaugccccccaccuccuuccaaucuguagcauaugccugagaaaauauaaaucucauaacugcagauauuauaggugcauauuucauuaccaucagcaucgcauauuuauaauuuagugauguguaaaaauuuauaaaggcacaacuagugguugguuaaugacagcuggcguggcagcgugugcuuagaggaucuuucaugucacccgacgucuggccuggaacagagugccacaugcauaaaacaggugacagaaagaggagaaacggacuuggcuuuaccacaaccgcagagcuggaagcacaaagcuuguucccacugcugucaaccagagugagcugcuccaagugggagaagggaugcccccgugggaggggcuuagcagccugaaccacagggggagaagggacggcccccugugggaggggcuuagcagcaugaaccagaugcuaaggcaccacccugcuucaaagugcaagacuuucuaacagaggcuaacuaaggcaagggacccuguugaaaacaugaucaaugcuguugccauauugacaaguacaccauuuuaucaugggagcagaaaacccaugucuuucccaaugugaguccuaaaauaacugccuuucaaggggcggcauccucagagugguaguugcagaggagucuauacagacccuaaagccauggcucuggucucucaagucuucaacccugugugccagacgacaggagccuggcccaggggccugggaaagcccacauuccaaccuggagcucagcacagcuuggcccugagugaggcuuggcagguagaggccuccacugcagaagaggagcuagccuggcagcccagagagcuccgaggccaagcuguccuuauaaaaacggaccagagaggaaggcauccauugagcauauauccgagugucuuccacccaccccgccccugcccccagagaguccaucaugccuaccuaccuaccuguacuggcuaguuuugugucaacuugacacagcuggaguuaucacagagaaaggagcuucagucaaggaaaugccuccaugagauccaacuguaaggcauuuucucaauuagugaucaagggggaaaggccccuugugggugggaccaucucugggcuaguaguuuuggguucuauaagagagcaggcugagcaagccaggagaagcaagccaguaaagaacaucccuccauggcuucugcaucagcuccugcuuucugaccugcucgaguuccaguccugacuuccuugguauggaaguguaagcugaauaaacccuuuccuccccaacugcuucuuggucaugauguuugugcaggaauagaaacccugacuaauauacuaaccucucucuccaaagaagucaugaggaaacuggcauuccuuaggcugucuguauuaugggugacggagagggaccuucuugaagaugcuacaucgauucucggacacgcaccagauuccauauaucaucuguuggucaagcaguaccagaaucuucccuuugccaggagagacucccccagaccucaucuggggugcccccauggucacccacaagaccccuuagaguucccaacaguuugauaaauauucaucuguuuucacucaguacaauuaaagugggugcauauuuucaaacuaucacucucagcgaguccaauugcacuacgaauuaaaaaaaaaaaagaauaauuaaaacccaugcuucuccuaacaacacagagcaaggcaauugccagacacuuuuaaugagcaguuuauguaauuuaaaaagccagccccucugcaaagaacacuucucaugccaggugucuugcuguacuuuggucaugggggccggccccugcugugggggcuccucugugacaccaacucauauaucuguguucccaaauaauggcguggaaggcucccugcaaacgcucgggcuguggcuccuaucggaaggugcauuuaacaugggcucgcauaaagaauaguggguaauugccgcuugaauccaaugugugcuguaucucaucuaugauacgcaauuuaaaagcgauauucuagcaagaggacuuuaugacuugcugucaugauaaauaaaaguuuauggcauaauggaauuaauauuuacuuugagugcaacgcggucuagucaaauaaaguugcuugggaaucacuuuggaccaagagagcaugaacaugucacccaccgaugacagaaccccaguccacuugucuccucuuacugucggcuaaucguucacaaucuuucgcugcuucggguccgaugcuauaaacuauuauuguaguuagagguacugauuugcugaugcauucaaugucgaaggguucugugggguugagcagccagagcaggguggacuaggagcaaaggaagaagaaaggaaggagagaccauguggcucccuccaggccuggaggauggaagccagcuuuagucaugugagucucuggugaagcugcuuccagaagggagccugggagucacggggcgugcagucucuagcuuuauugugaagagagucuuuaaaagagaaugcaaacucaaauggaaaucacacaguggcugccucauucuaaaguaaaugcauaacagacuuuuuuuuuuuuucuucauuccacauuaugaugacuggagauacaagaacaacagucaguccaagucccaaugaucuuaaguucucuguaaagugagcggcgcggaggcgucugggaacccuucaccacauggcaccacgggguuccuccuaagaccccaggauuaaauucauguccauuauuuucuguuauuuacccccuguagagcccccacaauaaaaccagggucugcccugauccaaaggaggcauaaaagcaaaaugagaaaauaauaaagaaguguucgaagccagcaggauggggacauccuagggccucccucugccuggucugagaaccaggcuccuguuccauuuuggagcagggcacugcugcuuaaggcagccagggaggagacggagguggagggcuuugguggaagauuccaggcaaaugagacccacccacaccagcuguugacucuggggagcugcaggcuccggguauuggaaauaguucugagucacacgguagcgggaggcaaauugcccagaccauaaacaagugggagaauuccagcgaaagcagggauuaguggggcaggcuggacccuccccccccccggcauagcuccaacugagucauacaugaaaaggaaaggcaagagauugcggguggcucggucugcggcgcagaggcaaagaugauuucagauggcgcggucugcggcuuucaaucacguuuuccagcauacagaguaccuuuuacauaaagccaggaagcuacugcuucaugcaacugcugugccaugaaggagcagugccuucccaagguacugcguauggaagucguguucuugaagcuggagaaaggaaccaguguggacagauuuccaggagggaggcugccccaaccggcccccugugggucaccucgcaaucccaacuuucagccagaagacauaauuauuaugucuaagaguaggaaacguauuucucgagaccucaggggcuucagugggaccaauagaagcuucagaaugaaggaagguggggaguucugucaccugugagaggccauaccaggcaucucugggggagccugaggcugggguacagccuagcugcugcaccaggcaccauucugucuugacucuuauccuguguaucucaggaggagcccacccuugcccucagccccauagcucgccgucccccucccaggacuucccagggaauuccugguguucuuucccugagaauucccaugacuguaacugaagaaucuaacaggcuuuguucauuucagucacaaaucauuuccacuggcuucauuucaacccgaaaccccgaaccacaucccaagacacacacgcaacacacacacaugcacaugcccacucacacucauacaugcacgcacgcacacacaggcaagcacauggagcuguccuguaaggcacugcugcaggaaaugggaagagcuguaaagauuaaaucaaagagucucaggcuccagcugcagugagaacugguguaguaccugucuugcuuuuacgugcgcgaaugcacgcgcgcgcacacacacacacacacacacacacacacacacucagagagagagagagagagacagagagacagagagggacagagacagacagagacagugagggacagaggggggaaggauggagagacagagacagaggcuccaucugcagcaaggacuguuguaguaccugccuugccucugcagacaagcacagaucuuggcaaagcccccugcagauguuauuaucagagaacacacuuuucaggcccugggccugugagagagaaagcgcaggguacgccccagguuugcccaguuuucugaaccauuccauggagaguugaagccaguagccugccuaaucacagaaaagaaaaaaaaaucagaauuggggguggucauugcccauuugggcucuacagagagggauguauguagggggauccacagaguaggaucugcagagacggauggccuggaggucccuggaaggcaccugguagaaggcaaagcugcccacaugcagagacccaagcugagcauggguagaaaugaggaccuuugaauuccuuccuaucuggauuagaaaaccuuugcuauguacauggaacgaucacucaagaguccagacaggacacgccuugggaucgaggaccacuaaccauaauaaggugccagaaaucuucaaauggcaaaauaaagacucaacccaaaucugucccucagaggaccuuugguuugaguaacagacucaauguccuacuggaaaacagacucccuacaucugccuuccaaaguagcucucuuggccaugcaucaucauguacccagguugaauugaucuccagauuucuuaaucaagaucaaaaggggcuuucggauggggaggggcuugguuuugcaaaguugggcucuuucuggcucguugguuuggggcgcuggggagguugccuagcuguuagaagcacguacugcgcuugcagaggauauuguucuguucccgcgccacaucagaaggcugacaaucacuuguaacucuaacucuaugagaucugauuauaguaucccagaagccaaauucagagagggacagacacagugggaagggaggcucagcuauaccaagcuucagaugggaguggugggggugggaggggggcaauuaacaacugagaaaagaaaucuuuaaaacaaagacccugggcugacaguagcucagugguagagagccuggucagcaugugucccccugugaccacugagggcaccugcacucgugucugcacacaugcacaaacacacacaauaaaaaaauaaaucuuuuuaaagggguguuuggguuuuuccagugcuggggcugagaccuggaccauggacuuucuaggcaagcacaucaucauuaagccaggaucuuucuaagacuacaauguuacagaguuaucuucccagguggucaccuccccccuccucagccauugucaucagaaguuugguucaaucaacccuccuuccaccuuggcagucucucugaacuuggcuuccaagugacaguccccugguuuuuucccccuccuuaaguccccgugucucuauuuccuuugccaacuuucccuuucuucuugaaugcuaaauguuuucugugcgagccuggguccuuggucauuuucccuucuuuauacucuuucuuuugguagucauccaugaucgaugacuucaagcaucugccucucuggucugaaugcucccucgcuggagccucagacuuggagagccaaugggcuauucaauuccuguacuuggaugucacuguuacaaugcccuaaagaaugucuucccuucccauaguacucuagccugcucaugguaccaccacucagccaguuucuuaccuccucaacuucagaaucgucucugaugcauccuccucccuuaagaccaaaccuggguucuuuuaaaacauaauuucuucacuuuauaugugugcguguuuuacccacaugccuauaugugcaccacaugcaugucugguaccuucagaggaccuccgauguccagaaauguaguuacaaaugguugugagacgccaugugggugccaggaacagaaucuggaaccucugggagcgcagccagugcucuuaagcacugagccauggcuucagacuccauagccaaggucuugacaaguucugcugacuauaucuucuggugcacuccaacucagcucaguccaacuccucccaguaugguuaaaauuuaccaaggucuuaucuacaaguccacaacagacagcugugggcucccugucagagcaaugcuaugcugcugccgcccgagccucaacucucauguguugcauagaaaugggugcgugcucucagugacuuuuauuuucccuuuguaaaacgggcuuccuucaagcccccaaguguccucccauggagaccgcugggacguuuggggucucacuugccucuucucaugcuuacacuguucuacaggagggugugcugcgagaguccacagaaagcccagguggcgagggacggaggguggcauucagcagacagcaacucaaguucucaguccaagagccugagaaauggaaccgucccaucaacugugggaaggaagcuggggaaaaucuucucuccugcgcugcugaugcgucugcucaugucuaagccccggcaagcagacuguggcauggcaaggacuccacaaauauuuguugaucaauuuuacagagcgggcuuucccugggugacuacacgcucauaaaauggagacucucuggaagcagcccgggacgcucuucucaauccacacucuccaccucacaaaggcggaucacuugcggaucuucuucagcuauucgaggugguuuaucacacgcccagaucugcgggcaucacuacucaaacccaaagaaacacggcgggccuccccuaagggggagcagugaccgaagaggcacaagucagcaggcaaagcucaguggaggcguuuacaucuccgcucuguggcacugacaggccacgguuguaauugggaagugggaaugguaugcaugugggcaaggcuccugagcucuggguucaggccagguccugcucuguacuguguacacugccuugucuagaucaccaagccauagagagcaggugacauucagacuuggguuuuauaggccagaagccaaggcugaaagcccagggcaugcaggaagaauaacaggaaguggauccacagagggucucuaggucagcaaacugccaagacacaugucuguauuuauugcccugcuguuugcagcagcuaagaaagggagccagcuaaggugcccaucaacugaugaacggauauauaauauaugcuacguauacacaguggaauuucauacagcaauaaagcaaaaugagucaugacauucacaggaaaauauauggaacugggaauuguguuaagugagauaagccaggcuugaaaaaaaaaaucauacaccauguuuccucucauaugaaaguguguguguguguguaugugugugugugugugugaaaagcagcaaaggacuaugggagaagagaugaaguuguggggggggggggaggggaggguaugaaaagagggaaauggaguaugugaugugacaccaaaggggagcacuauuuguggggaggagggugauuagcaaggaggaggcagggaaauagaguuaggcagagagagggagaugaacugaaaccaugaauaaaauguauaaaaugccacaaugagacccaccacuguaaacaguaacaaaaagaagauggggcugcuggcaggaugcugaggucaggaugagggcuguugccccuggcauugggaugcugagaucaggaugagggcuguugccccuggcauugggauguugaggucugucuaccggcuguugccccuggcaucacauaacaacugcuaggcaguaacuagaaggcuacaucuuccuucuuggacuuacauauaugaacagaaaagcaaauggaggaguggucuugggagcaggauggagauagagaugaauuucagggcacaucucucuagggagagcugggaacacacuugugaucaagagcuuuggacuuggaggcuauuggggagaugugcuggguaacauguggagggugcuggguaacauguggggggcuacuggguaacauguggggugcuaagaaauguggggguguugcuggguaaugugugggggaggugcuggguaacaugggggugcuggguaacaugugggggagguguuggauaccauguguauaugggggugcuggguaccaugugggggaggugcuggguaacauguggggggauacuggguacuaugagggggugcuggguaacauguugggggaaccuggguaccauguggggggugcuggggaccaugugugugggggaggugcuaaguaccaugaggaaggugcuggguaauauaugucagagggguugcuggguaacgugggggaggugcuggguaacauguggagggugcuggauaccauguauguggggggugcuggguaacaugugggggaggugcuggguaacauguggggggguucuggguaacauggcaggggaaaugcuggguaacauguggugguggggugcuggguaacauguguguggggguucuggguaacaugugggggugcuggguaacauguaggggguucuagguaauauggggggaaaugcuggguaccaucagugcugggagaccuuacccugggcugggcugggcuucucugaaggcugagacauggauguccuucaucaauccugacuagauagcccuauuccuaagguuucugcaggaaucuagccaggcacccauuuggauucuggagccugagcugagucugagaguuggagagagucagcuucagugucaggcugacauuucuaagaaggcagugcccaucucuucuuucagaaggugauaaagccugagcauggguggccaggcuggguagcaagggacagcucggauguagccugcagccucuccaggggguccaggccauucccucaagauguacacauccaccacagcaugcaaggccuccuccagaaaucacaggcgauuggcuguuucuguuaacuaaguuuggucaaagaauuccuuuuuccaugugagacggcaggacuacagggcaguugcaaauugauccccggagaaggcuccguccaaucagccgccccucuagcuuacaccacaggagcccaggaacaagccaccacuucagcaauccaaucuccauauauuucauuuuuaaaauauuucauuucuggccagcaguucuuagaucgccaauuugauuugguuucuauaaauggauuuuuuuguaguguagguggaaaauauauuuaauuucaaauaucugcaaacuaaaauacccaauauaaacaucccaguaugcuugagucaggcgugcaucccccagugcagaggccagcuuugagacagacaaccuagccucaggacaagagucucuacuguuuucaucucuggugacgcucucguuguaugaggacgcuggagagccggugcgguaucugcccugcaggggcucucccugcuuccagacauggcuagaaagcaggccacucacuagaacuccaaccaagagaccagccgaguguaauagccagcgcucuccaagggcaacccagccguugcaacagagccgcacugccuguguuggacccuuggccaccccucuacagccaaguucucggcccaucucuucagccagaaaaaauaugugaaggcacaaaguccacggcgcucagccuccugagcuccagcagcugcuguaccccagcaggcaucacuccagcugaagccauuucaucaccaggagauaaccugggccuggaagagcagcuaacucugccgcaggucucauagcacaagguguuugggucccucugcaggccccacaggaggauccuuccuggcucuccagcucccagguugccccaacucccccagcaucccucaguucucccuggucauauguccuuucucagucuagauccacuguuuuguuuccucaggacauccuaggucaggauggcaucauuuugacuugacuuaagaauugacuucuacaucgggucccauucugagaucccagggagauguggugcaauccaguguacccccgugugugaaggcuaagagaucagguacggacagcuugcuuuacggauagggaaucuggguccugccucuugcuaucuucucuuacccaggcuagcccuucacuggcuaucugaaccucucggucucuucaguccucugggacaaggccucuaauccagcccucucccuccauccuucauucacccccucagugcacuuguuacucacagacacccccaaaucucagaggugucccucagguccuucaugucuacacuaccacagugaacaacaaccagcuugaguccuaaagcaaauuaacaauggcuacaguuacugaaucccaucagaagcgugggcuagggugcggggccaaccaggcaaugcccucucccacugcucacuuaguacucgguucuugaugcuacucuacucuugaugcuacucggacuuuucagucaggaaagccccuugccacacugcuccaccuccacccugaacaccaucucccugccgugcguguccugaaaagauaacuugcuuuauccuucccucgaguuugcagcuucucuagggaucuaggcagaucaucucagcuggcagaacaaaccccaccacagucaucacagccuuugagauagggucucguguagcccaggcuagccucuaacugacuagguagccaaccaugaccuugaaccccugauccuccuccuucugucuuccaagggcccuuuuaauaugucuucagucaaucaguucugccccccccccgugagccccgacuauacacacagggugcagcaaaugacaugugacgagcuagcucugcggccaggucgcuuguagcauuuuacccaugugaaugcugguauuucucuccagcacacccauuuuacagauaccaggaggcagaugaugauaacagcggagcguacggagagcaggucucuacacaggcugcucugaggaaaucuuauucacaucucauggaagacaggaacagcacggugugggugugugagggugugggaacugcagagaaaggugagccugcaggucacugacaggauaguucagagcagccccugcauagaagacugggcagggagggcagugguacagaauccuacaggaacgggggcuacagacacuggcuuacacgugguuucuuuucugucucccguguucuccucuauaaucaagcaccgacauauauuuguagaguacuguaauuggcuugaauguaggauagucagaucauccuggaucccugucaucaaccccacugcaagauguggcagacacucuguuaucugcuauccugaucaccaccugucaucuauccuuccuggcucaaggcaacaaacacaagcccccuugucccggaggugacgauguucacacccuccucgggcggcuugcuuaaggagggugggcggccuggcuuuuccugcccauacaaccugcuccacacagccuccaguggaaccacagcucacagauggugagagaggucacggggaaccaguuuucugagucaaagaaagcaucaaaagggguuuuaaugguaguaagauaggcuauuaucagacgucccaagcuagcccacugagggagggaaccagcccuccuuagguaggaguuggcagcuggcucagcgcucauccagaccguguaccuccugaucuguggcagugguaagcaaggugacagauaaaaagaacaagaaggguguucuauggguggaggagaaggcuggagucaggcacagagcaggcagaauaugaaggagacucaucucagcugccagggacccaaacuguucugagcuaggugccagggcacugaacuugcaggauccguggaaaggcaugcuagggcagauucuauguucaaaugcuuaucuccaucaguaaaccagauaguuuccacagaaaaugugcccgcucaguucugcuauaauggugacaugaucauauccuucaauuguacaaagaagggcuggggugcagagcccuagggacugcugcaccccuaaagucuccacggaaccacugugggugccucaucucaggguaacccagagcccuguggccaagaagcacagccccagaaggggauagggcuggcaagacugagggcucccucuuacccaaucuacaaagaaggaaucaauccaucaauccaugaaucaugcacgcacacacacacacacacacacacacacacacacacacacuuuucaccucccauaaacaucuucaaucaaaaccccaaaccaaacacggauuuagaaggcaucgcugugguaauuuaaaagccacuuacuaccuugugcaacuaacucaagcugguaaauugaacggucggcgauaugaaaauauuucauuagauuuuuuuuuuuuaaugccgaauuaggcuggugcaauuauguugguacucaggaucugcauuagucugaaacuauuuuuaacacuuuuucuaauuuagcaugauuaauucuuucacuuacggacacacuuacuguucugauuguuucucugucuugacuucucucugcuuagguaccuaacucauaaaggauucuuauugcaggggcugggauccgauuucucgggacauuuacuuaccuaggaagaugguaaucugcuuguuuuugcaacaauuaucuucuccacggggcagaccaggccguugacauuaacuguaaugcaccuugaccuauuaaauaggugcuggaaaccucaaagcucagaaggcuguuuuaaaaagagauucuugaauugcauauucaagaugcauauucugcccagcuuaaacuaaauuuaaaaaaaugaccagucuguguuuuaaaaacuagacuguagcugauauaccaauauggacagagucccaccccuagaugaagagcuauaauguguguguaugugugugugugugugugagagagagagagaaagagagagagagagagagagagagagagagagagagagagagagagagagaagucucuuuucuccagggagguuaugcaaucucaaagaauaaguccuaaguucacauaaauacacacaacacuaaauggccucaguaggguuuguguguguguguauucauguguguguguauauguguguauucauguguguguauuuucauguguguaugaguguguauucaugagugugcauauucauguguauguguguguauguauauguguguguaaaaaauaauuauaggaaaaaaggucaugcauuugagaugggagacacaaggagugggggggggugagagcgaggguuggaaaugauuuaaacaguacuacucauauuugaacuucucaaacaaacaaacaaacagaugauaaauaaauaaauacucuggaauacguuuaacagaacgcacuuuggggacagggccagagggaccccaugucccagcgaggaguggcaucuggccagagaaaacagacggucgccaugaugugccugcucucuguucucuccuucaggaagcauaucaguggaaacacucggucuguguuuguaaagagucuggcucuuuaagucaaaacaaacgugugcugucacauuugggauucuuguuaagaaaacauuuggguuuuuuuuuauguuuguuuguuuuuugcuuuucaucaauucucccuuaaucuguuucuaauaauaauaacuuuaaaagcauacaguuuccagcgccaguaucuuucuccgagacgcacccuguugccaauuauaaagacuauuucuauccaugcagacacuaaugccauuaguccaccaagagccuucggagaucauuuacauagagacugcuuuuacaugcuaaauguaaaaugcaaaaugcagagcucuccuggauggaauggaacgggaguuacaagccucccacagaaggcugcuauuaccugaacugcuguuuacugaacagggcggugacacagccaacuaggaagccauuaccucagcagccacugugaacccaugccauaaggcacuucucacccaaccuccccaggugagcuggcucuugcugccuuccaugacacccacaugggcaccguggccaccguagcauccugccaccaccacaugcuccuucugcagcaugcauccacagcagccugucucuguaaaucucaggcccagauccccaguguagagcaagaagggccuagugcacaagcaggggacuugggaaguaucauagcaucacccaagagggccaagaggaagcugaggagacggguugcucuacuuccuuccuaggggugcacuguugagauguggggaugggguggggacuuuugacugacugggaaggccagaaggucagaggaaagcagugugaggacaggcauccagugugccagcagucuagcuagcuagacccagagacuggguacuggccauauacgcguauuaguauuaauauuacaguauuauuuguuacuggaaugcuugcaaccacagcccaggucuugguagccauagcaaccuagacucagccaccgaucuuuauuauuauuauuguuucuuaagauuuauuuuuuuaagugugugugcaugagcaaaggugccucuauagguuggaaggggaugucaguccccuggugcuguaguuacagggggccacuauuaucacaacagucaaaggguccaagccuggauccuggcagacauaacaaucuaggcuuagccgcacagccucugucggucacuuagugaaacaaccgcaaaaggcacaggaagaagaacauggccguaucgggaaaagaaacagaggugucaugacccccaacucuagcuuugagggucuugacaugagguuuagguuuaaacagaggcaagagguaucuaucuguagcuaagugguuucagguccggguguggguccagccaucacuggcucggcuccugucucuccugcaaggucugaccgguagucagaacuguguggaaccucuuucuagaauucuaguucccuucuggcugccauacgguuucagccuuuuucuucucccagagaggcacaccuggggcaaaucccaacuuagggguccacucauuucaguugucugauagccagagggaggguacaggcacgugagucuccuuauugucauugcgacgggguuuccauugcuuuaugguuaccacgcuguggacugagcacagggcugcaacaccuggcuaaaucccaagccuugauaggacuguucggguuuuguuguuguuguuguuguuguuuuuguuuuuguuguuguuuguuuguuuguuugcuuguuuaaagacgagcaucucugaaauuugugggaagaaaagcauccagcagaggaugaauagccugugaggguggugcucugcaaccaccacagacgggccccgcccugggggcagcucccccccccccccaccguagucuugccuacuugggguccaucuccugacuucccuuccaggacaagaacugguccucuucagccuggguacuucccucagugccucugguugugggggcaggcauagaaagaugagcucucaaaacccagcccgguuuugauugaggccuuuuagcauucaagcccaugaugucccguggccuugcuugguggguucccgaaguagcaaaaacagaugcugguggagagaucugggccccaggcgcuauggaaagcauugggcaggaggccagcagguuaccucugcggaaaccuagucauuuuguuuacgguguucugacaaugcuuggggcugcucagagcugcuucaccucgugccaggcugcuugccauucugcugcgguaucugcagcucuaaagaugacuccugugacuuugacagcuuuuggggccaugguuccccugacuuugcggcuccaaggccuaagccaucuguagcuucuuacuuccggcgccugaggccccgaaugucaaaacugaucagggaaagggaaaugacuaaaagcuacacuagcagagcagaaagugagugguggggagaagcaaggagaggcaggguccuuccaucuugagcaauaaaaggagaagcccucagaucugagucugcacccggcaucugcccaucuuccaugcaguacauauucaaaacaacuagaugagaacacucccacacuuaggaucucccaguggcucuccccguucucagcuuaaguucuaaaaauuccuuugagguucaugggucaugcaaaguuuaguucucaucacugcccccuucaggcucugcacugcaaguacaccaacugacauuuaugccuuuccucuaacacacgucccuucuggugccccagggccuuugcauaugcugcuccuugguucucugcugcuccccucuccucacugacagugucaaugaaacaccucaucuuccaugccuccuuuauagguccccagacaagcugaccaucugcuguaagauuucacaccucuaguacuuuuccuugcaauagcugacauaguuuucucaaucaauuagaggguuaaauuguauuucugucaguggauggggucaguucccauacauccucucuugguucuuguaagaugcucaauaaauauuucaagaauaauaacccccccuuccaaauccaggugacugggaggagaaaccuuugcaauuuaaaguagaaaauccaggacacacuggaagagacugggcuugagaguuagggggucuugucugugagcagggaucucugaugagcuaaguggcaugaauuacauacacaucuguggagccuguucaucauuggucauacagccaauuaaugaaaaauuaucaucugagaacugcguggcacagcaaggcauacccucaauuguguuuuucuugucauugauguuguuauuaaagggccgacuggugggccaggaaucuuccaacugcaguacccacaagcccagggugaaggcacccucccuguucaguucuccuugggcuggguggcagagcuacauguugugagccaucuaaaacaguugcugggaacugaacuugcguucucauuaagagcaggaacugaauuccugaauggguaugaagguaucacuggcaggguaaaguguagcagccucaaguucagcaacuaggucaaguacacaguaucacggaggccuuuagaaagaagcuccuugauugaaagaguccagugacaguguaugugaaugccaaugaaauuacccacaaaauacaguguguguguguguguguguguguguguguguguguguguguguguguguguaagaaauguucuggggcuugugagaugacucauuggagagaagggagagagggggagggggagagagacuuacugccaaaccugucuacaugaauugauccccaggaccccaugacagagagagagagagagagagaaccagcucccauaaguuguccuuugaccuccacagccaucaugugccaugugccauguggcaaguauaaccuuccucauagaaauguaauuaccuuuuuaaaaccauaucucucuggaaggucucccccaagcaccuuccuuacccugucccaauuccugugccuuuaguugcacuauugaaaucagaaguguaacucuuacacauuuauuuugucuuuauaaauccacuuaacuacuugucuuagucaggguuucuauuccugcacaaacaucaugaccaagaagcaaguuggggaggaaaggguuuauucagcuuacacuuccacauugcuguucaucaccaaggaagucaggacuggaacucaagcaggucaggaagcaggagcugaugcagaagccauggagggauguuccuugcuggcuugcuuccccuggcuugcucagccugcucucuuauagaaccaagacuaccagcccagagauggucccacucacaaggggccuuucccccuugaucacuaauugagaaaaugccuuacagcuggaucucauggaggcauuuccucaacugaagcuccuuucucugugauaacuccagcugugucaaguugacacaaaacuagccaguacacuacucaaagcauguuuuauauaaaguuuagagucagcacuuuaauguccauaugacaaguagguagaguuuccacauugcaaauacagaucaacuuggggggaaauuauuaccugaaggacaccaaguauucaaauucaugaacaugguaugucuacuccaugaacauaguaugucuaccccaugaacauaguguguccagcucaugaacaugguauuuucagcucaugaacaugguaugucuacuccaugaacaugguaugucuaccccaugaacauacauaguguguccagcucaugaacaugguguguccccucccccaugaacaugguaugccuaggcaaugaacauguaccucuccacugaaaguucuuucccucaacuguauuuauggcuucaaaugcugaguacuuacauauuuugcuaacuucauacuagacuauuucaauguguuccacugucacaaaguguaucuuauugacaucuguuuucuaacagauccuugccacucuuuggaaacauucuugcuuuuuauccauucaccugguuuccgguggucuuucugaauucaucuaccaguucaaaucaguuuuucauagaguuauuacuguuuucagcaaacaacacucacucuuuuccacccauaaugccuuucagcacuuguccuuguauguugagcuucuugcaaacccuccccccaggccagcauugggguggagugacagaaggccguuucuaacacaacaacagaaugcuaguuacaaucaucacagaagacuuuuuaagauguuuauuuuuuuuaaguacauauguguauauaugugggaacacacagacacacauuauacacacacacacgcacaugugcacacacaugugugcacacacacacacacuauauauauauauacauauacauauauauauauauauauauauauauauauauauauauauauauauauuacacacacauguacacacuuaugugcacacagagacacacaugugcgcacacacacacauaguccagguguagagauuagaggacagacacagguagcugucuucaccuugcaccuuguucaagacgaggucucuuguuuacugcuguguccucccagucugcuggcucaugagcuuccaagaauucucugucucuaccccguuacuuuaguaguagcuacguucacgcugcugugagaaaauuccaugaccaaaagugucguauggaagagucuaucugggccuacgguuccagagggauacgggcccauccugucuaggaggcgugagagcaaacaguaagcggguuaauagcugcaugagccaggagcuuacauccccaauggcaaucaaagcaaacaggaagcagggcagguuacgcccucucaagcuccacccaccccgugauacacuuccucucagaaagcugcauccaccccagacagcgcuagguaagccgagccuacccuucuggcuucaugugaauucugggaauccagacuagguccucaugcuugcccagcaagaacuuuacccacugagcucucuccauccugagauguccuuuaucagauaguaggaaaucccucuaugccuacuuugcugagaguuuuuaaaaaucaugaaugaauacacaauuaugccauuuuccguagcuguugauaagauuauauggucgauauccuuuguucucugaacacaggcaauuacaucgauuuuuuucaaauguuaaaucaaucucgcacauccccaguuaacccuauuaaucacggugaauuauucucuucacacgaagcugcauccccuuugcuaauacacuauuaagggguuuuccaauuacauccccgccgguuauuggucuguagucuucuuguaacgccccggucuugacuuaugauuaaccauuccagccuugugaaaugaacuucuugagugaagcgcuccaucuuccucuuuccugaacaguguucaguaagguuaucauuauucuccccuuaaaugucugacagaacucagcaugggagagucuucuucauaggaaguuuuauaauuauaaaaucaauuucuuuaauaaacaugggaugauuuagauauucuguuucuuauugugcagaccuuaguuauuuuucuugcucuuugagacaguuucccauucuaucugugcuacccaauuaaucaccauaagguuuugugcuacuuucuuacauacacuggauacaguuuucccaauggggccacuuuucauucaugauacuaaucauuuguuguuuuugucuuugcuucuugaucacguuagcucuagauuuauccauguauugaucuuugaaccgcuuucuucuaguuuugggaauuccguacauguauacauugaaauaugaucacagcugguucccguuucccucuccagcuccuccgguugcccgcagcgaauccccaaucccgaccuuuugccuuuaucacucaucugggagauaauucccguuguugguucacuugcagcuucauugacgugcugguugggauuuugucgaugugacagaauccaggaccacugagaagaaggaaugucaccagagaagaugucucugucacauuggccaguaggaaaguuugugggcucuuaacuaaugauuguugugggcugggcaggcccaucccagcguggcugaucacgcugggaugaaaaagcaggcugaacaagccaugggggagaugacaguaaccagcacucuucuguggccucccuaccugcuccuaccuccaggcucccaaccuguaugaccucccucuaggaugggcuguaauugacacauucacuucauacaaaccuuuccuguuucagcuguuauuggccaguguuuuaucuagcuaaguccacugauugcucuccaucuuauuuuucuacucugauacuaaucagcucuucuuuuuccacccgcuaaacagagaaguuuguuugaucuuuuaaacacuugcucaugcagaugagauggauugauuuuuaugcacccucuaagaagaacugagaacacaaccucccucuaagacccaauuuucccacagccacaguuuugcuacaucggcugugaguuuucauucauuaaaacaacaacaacaaaacaaaacaaaaaacaaaaaaacaaagaguuaccuaguuuccuuugugauuuuuguuucuuuuaucauuguuuagucuccaaguaucugggagugucugggauaccucuuuugcuacugauuaauucuguuaacuucaaugcacugggccacuuaugcucauugguuuacagcagucaacuacggaccuacaguuagaugguccccacgguccccucaauucuuggcccaaagcagcuccuaguaguucuuuuuauaaucccgcuguuccuacgaguucacagagauguccucucuucccuuccugauaguaaucccuugggucauuuuauuuaugggucauggggugaccauaacuuuaauauuuugggaagcugucccugucuucccagcagaaccauuauuuuacaggauccauaguaucaucuucucuccacaaccucaguuugucagcugccauuuguccugccuugggacagggucucacuguguagcccuggcuggccugggacucacuguguagaccaggcuaucuucaaacucacagagaucuaccugccucugugccucugccucugccucugccucugccucucugccucugccucucugccucugccucucugccucugccucucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccucugccaucaaaggugugaaucaccacacccagccuugguuggauauauucaaagaacuaacuucugcugacaugggcuuucucuguugcugucuugagucuccauuuuguuucaccugcccuguaucugucuacucagcugcuacucugacaugaagcuacagggcugugugcacagauaccagaaagaaauucucucacuguucugugauucuagugccagcaaaucugauaucuguuguggauuccugugcaaaugcacaugugugugugugugugugugugugugcgugugcgugugcgcgcgugugugugugugugugugugugugugugcauguggaugcccacugaggccagaucuccuggagcuggaguuacaggugguugugagcuccugaugcagggacugagaaacuugaauccucuggcagacaauacaccuacucuuacccccugagccaccucuucagccacuaggauagcuuuuuaaaaagacauuaauccuuucugaccaaagcuccaccuauccauccuuaaugaugcccuggagagacuccucuugcccuacagacacacagcuccugcacaacauucugcugggaggcagaggaagaagagcaucuaucuggcaggcccuccuuugguucuuuuugagucucauuuguuuuuaauuuauuuuuucuaauucccucagaggagguuuggacaacuguuuuagaucaaacagcgucuauccccgaggucuguccuccagugauacaugcaguagcucaggggcuaucgccccguaguuuauuaagauuauccacuucccuucacccguucucacaccuuuaaucccagcacuugggaggcagaggcagguggauuucugaguuccaggccagccuggucuacagagugaguuccaggacagccagggccacacacagaaacccugucucaaaaaacaacaauaacaacaacaaaacaaaaaaaaaggaaagaaagaaagaaaaaaagaaagaggaaaggaaaggaaagggaagggaagggaagggaagggaagggaagggaagggaagggaaggaaaggaaaggaaaggaaaggaaaggaaaggaaaggaaaggaaaggaguagagaguugcaggcuggggagggggccucuccucuuggcugcauagccuuauuuugugauguuuggaauaaaaaaauaguaguauuucauauuuguauaauaugcccgucuuccccccuaguugaaagcucuccucuucauugccggugcucaggaauuaauuuuuauugcuuuuguugacgucuuuguauuuauucuaugaugugguucacugaguaucuaggcuccauuugauuuuuacaguucccaucaaauugggggaaaucaugaccaguauuucuuuaaaauguuuuuguuguugcugacugcuuuugagacagggucucacccccagguuagacuggaacugacuauccuccugccucagccucccaaguguugggauuacaggagcacaccgccacaccccacuccucuuuacagcaucuguccccgaggucugucccccagugguacaugcaguagcucaugggcuauugccccguaguuuauuaagauucuccacuucccuccacccguucuucccugggcgguuuagagaccaguggcucuuaccgcuuuagguccaauguucucugauccauuuuauucucugucuaaccugcuacaaggcuuacuguggcagccagacucuaggguggacccaauaaaaccuaacuccuggacccaucccccugugucacuaacuccuggacccaucccccugugucacuaaccuguuggcugugggcauauuggugacuagcgucuaaccaauugaaauguccgccuuauagcaggguugaguucuaagauuagguauagaaacugacuucugucuuacuagaaaacaccacucagucuguaagaagguccguacggugagguggggaagguagcccaugagccauggccagcuaagagcuucaugaagcccuugguccugagaccaaccugaauccucacacaagcacgcccuccucacccaagccuucagggaguccccagccuuuggcugguaccuugauuucagccucgugagugacccugacacagagggcuucucugaguccugcccauuuucugacccuccaaaaccaugagauggaggguaugugugaccagacgcugguaauucauaguguguccacagaggacacaucugaugagguuucgcuuugacuauaacauuuucugaucgaccuugcuuccuguguucaugauucucugugaauaauugggggcccguguauagcacacacugagggcuucccgcugaccuggucaucuccaagccugugucucugagucccacacccuugccacucuucucaagggacugauuucuuucucccagacauggcuguacugucaugacucuuucauugccuaacaacuuuuuauugaguucgggguauugugaacaacgcauuggugaugguggguuucguuauacgguugaaagggaugcugacuuuugcuucgucaggcguagugugauugcagcucacuugacguuugcugcucugugcuuuuuuuuuuuuuuuuuuuuuuuuaacacacaaucauucuggggccuuuacaacaagcuagucugagcuugaccauuucccagggcucugggaauauuuggcuuacaauuuuacauuaguuaauuugucuuguccccacagacaaaugccugacaagaagcagcuucagagaggaaggguuuacggguccaaagguggaggguggaggacagcauaggguggcaggcagcagggucaugaggucacuugcucaugaccaggaaccagaaaagggccaagaugcaggaccagguuacaaggcccacccuguaaugagccacuuccuuuagcuaugccccuaccuccugauggucccauagcuuccccaagagucccaucaucuaggcaccaaagagucaaacacaugaguucuuuggaggagauuuuuccacucaaaucaccacgggcuugcuuuugagcaaccuugugacauacuacuacgugcccaugcugguuagugguuagccaugagcucucaguugccacaaagauuccuggauguuuccuuguuuuguuuuguuuuguuuuucucaagaauuuuucucaagaaucuucccuauaaacuccaggagucucugcuuucucacacuccauucucuucuucaaagcaacuccaguacuacgcucugcuggcccacguacacccaugccgcggccuggaaaccccucuggcuagaucacgaaagccccuuuauuucuuuagaucacacagcccugagcugcuguuuaacacccgacacagcucugcguggacuccaguugguuuaggugaaacgugagcucguugucaucacuauuaggucuuuaagcuuucugggagauguauaggaaagaaugggcuccacccauuugacuugacuccaccccuuuggcuccaccccuuugggcuccacccauugggcuccaccccuucgggcuccuagcucuacaagugcggcaagaaucuacuggaaagucccacagcuacccaccuacaacagauuucuuauccuaauggugacggccguugugccuuguguggugugguaucacgugauucuuguuuucggcugagauguugcucucacgguggaucuggguaucuucuaguugguguggucccagcagaccccauggaucgugaacauuugucuggcuuccacauagccagccucuggcugaugacccacuuuguguccugaggcacaagccgccagggaguuucaggugggccacuaugcagaauacuccagacaggacacuucugacaucucacaggugcccggguuacacccugagcagaggaaggcaaaccuuuccccugcagauccugucccaagccaaguauugcucuagcuucuauccucugaagucaaagaucucagacgugaacccuggagcugucccagcagacucgaaacaggccaaggucugagcgcuuucugaaucacgacacuuuuaaaaguaccuguaaagaacaccaggaacaccuuccuucugcucccccaacuucucuacuucccacacaggaaacugacacccagagggcuuaaguggcuugccggugccacucagcccaggacggaguuacccaucgagaauuuucaaaucugccuccagguuccugccacaccucauuagugcuuucucaggacccuugaaacagaauccaaacuccgacccacagcugagcuccugaccacugucuccugucuccuccagccacugucaccuugcccaucucuccccuggcucuaaucccuuugaugcaggagggcaucugaggugucucugaccuuagagcaucaauagcauccugcccccugggaaugauccacccagcaaaagacaguucuuccuagucacuagacagugggauguuccugcuuugggacccacaggaucccaguagaucaucaauagccaguguuggcaucugugcaugggcccuucgugccagcccucucuguuucuacauccaccacuaaguccuacuauguaggguagacggugugguagcuguggacacagugcucccuccucagugccuagcaaagcccaguuacaguggguauaagucaugguuuucaaaugaauggauggaagaauccgauaaucgguuauccacugaguguaacacacugcucacucucuauucucauagguacuaggucagccaaguuucagguccgaggcuagaccuaaugcccccuguggggucucccagacaacccuauuagcccugaguuacaugcggcccaugcucauguccacagaacagacaaccccagcauggagccugguccagguuugcucacaacugaaaccacuuccuugucuuugccccccccccaccccauaccccagugccccacagcuuggcagagaaggcuccggcuggcuugcuuacucuccaaccuaccgcaucugcauaagcgacaaagaagaauuucagauuuuccuguuucccucccaaacaaccagggaucugggcuccuccaucuaccagccaaagcuuuaauauuuaagcugcgagcagcagccgagcgcugucgagggaagagagcucagcuuuauucuccccugccauucuccugugcgcccuucgaaucuccaaccaacacagcagacaaggccuuccccucucacugagcagcauccucaguuccagauuaugaggcagagccugauacaggacgggguggggcagggaaucagaaucagaaucuaaaucacggacugcugaagagccagcugggucuccagccucuucguuagcuagucaggugcggcccaguagaggauacaagcuguguuuauaauguuuuggugacagaugugaagugaaaaagaagacacuauucaucucuagaggggucgcggggagcuugccuuugccccguugaauggcccuucauccguacaugggccccuaaacucaggacaaggagauguguugggagggacucaggagaagcuggagggaggaaugggggaugggugugaucaucuuaugcauguaugaaaguuucuaagaauaaagaauaauaagguuuuauuuagccuacagaugguguguguaugugugugugugugugugugugugugugcgcgcacacacucugcacagguucuugugcauaugugugaauaugcaugaagaggcaucaaucccaggcaucauuccccugguaccaucauaucuugguuuauggagauagggucucucacuugacuugguacucacucaggaguugggcuuggauggcugaccagggaacccucagggauccacccaucuccauucucuagcauucgaauuacaaguauggggcacuccaugcagguuguccuuguagcuucugggacucaagcucaggcacucaugauuguggacaaacacuucacucagcuaaccucagccccaggcgugacguuuuuauaccaggaacagauucuauagacgcaucgugucacagagucgucaggguucaaauccucaguagccaugugugacucggaguugccggucuagaaaacuccagauaagaguccagccacccacaggugacaugccagaaaagucaccccauugcucagccucagccugucagaauuuccaagaaagagcuggcauagagacucaggauaccccagcccccagagccccuucuucagccagcugguguggcagccagagaaaaggcgagugaaaaaauccuguagcucccuucuggugcuuggacuaauucacuugaauuuauuugacuucuuuaugaaggacaggugaguacggggcaccccauucaucaugaggauaagacaguccccgaaaggggucuaccagacagucacccuuucuguaaauaaaugcaauguugacugccugguacagaaaagcuaaauggaaccgaagucuggggauacccuccccccuuuuccauccauaagccaaaauauugcuaaggcuuuuuauaaacaaagauaaugaguuguauaauuuauguaaauuaaccaaugcugccgcauuuucuagaaguaacauaaacugcauuauuuauuugaugugcuuuuuggaguaaaaaaaauauaauuauaauuggauauuguaccuaacagguuucucccauuguuuucugauuagugcuggugguuuggaauaucagaugugagcucgccaagcgugcgacacucgggaggccuuuccuuuugcacacgaaggugacaagugucugacccaggcacuuggacacaacuucuguggcagaaugaagcuucgugcacgaguuguucugggcacaccccagcgcuggugucaguuauuuucagccaaagcuggcagaggguacucgcugaucagcugcucugggacaugacugacaccauuuucccucccuaaaaacaucccaguccucacuacucaacgcggaauccccagcaccaaccccccaggcucacccaaaggccugcucuaagcagggccagucccuccacauggccaauucagaguccccaggggacucugcugcuggaacuuugagcaacccuccucuaaguuuauucucagugaagggacuccguucccugaugcucccaguggagacugguguugcuacugcgaagacaccaggcugggucccccagcucgccugccccccgccugccagcagcaacccacauucccucacaucuaacagacacugaaaugagcaacgcagaaccccaugcugaaguucuuaauaucacccauauuaggagcauuaaaaaugcaaagacagauaaugaagcaaaagaaauuaaagaaaggcccgggaaaccucgcagccuuggaaauacuucugucccuuaaaugugagcugacaucuguuggccccugucacaugccugcuccuccucgcucaugggaaaaguguacaauccuggaaaccagcaaaugcagggagcuggugugucaccuuguuaacgcagcagaaugcagaggacggaccuuuauuggaaagcgauggauccuugaaggaccauaucucaucugggacuggaggucaggaccucugcuugcccugccuucuaccccggcugcaagcauccccuccucacuugcagggaugaagaaagccaaacaucucagauggaaaagcaaguggggaggggggaggguaauuuacagaauuuauuucaucuccucucccuuaaucacguaacaacaaaacccucaaacguucuacauucugguuuguguccgacacaaugugcaagcuaauugaguguaaaaaccgucgcucugagucguaucuguuaaaguagugugacaauuguucucccuucccgcccccccacccccccagcucuguuucauuucugguuuuguuauaacucaguccguucacaauaugucauugcaaacacuauuugcaaaagaaaguauaaaaacagauucuuuauucugaacugcgcuugguuuuuuaucucuucucagccucucugcauuuagaccaggcuuccaucuggaaggcuuaaaaaaaaaaaguuauagacagaauugccauacauaacgaagcacgcucucaucugguauuuagccugagaauuuuauugccagguguugcgaaagggggaaauauauggccaaaauacugugcuucgucucauuuccaaacauuacacuuugcgucugaaaauauucauuaaucuggggacgaagcugcgucaguacaguuaccuaagggacuuccaggaaaagaaagaugucaucaggaaggaagcuucagcgggcaagggcagggaugacuguggacccugacucugccucugcauaugugggaaccagaaacucagagcugccauccccccaaaccuccacuuagccaccuaggaaccggaagcccagcuccacuuaacacccaacuccucacagcaauuaaagaguuaaagucgguggcaaggacugcaacauggcccagcugguuuaaaugaugauuacacuagcaggaggaccugagcucagucccccagaguuaaugggcauguucccauaaucccucugcuagggacauggaggcagggggauccuugguguuugcugcccaggcgaucuagcugaaucacacuccagguugaaagagagacccugccucaaaaaaaggggguaacagacugaggaagauuccauauuaacauauggccucaaaaugcaugaauaugcaaauguucugaaaccugcaacauacaugcgugugcacacacacacacacacacacacacaaacacacacaagcacacaccagcaaaagaucuauuuccuucuauauuuuuaagcaggaagucucauuucuuucuuaaagauaaagauuuuauuuauuucuauuuuauguuuugccuacauguugaauguaggucuggugccuacagagguuggaagaggguauuugaucuccuagaacuaguaucacagagcauugugagccacuguguggcugcugggaaccgaaccuggguucucuggaagagcagccauugcacuuaacuacuacccggaaagaaucauuacuuuguggaccaauuaauuagcuguguggaaagucaagcaaaauuccguuugugaggaguuagcugcugagcgguugggggaacccacguaucacaggacauuaaauuaacacuuaggucuaauuauagacauaaagcagugucagaaucagggaagguggguugccagcagcuuacuccacaugcgaggacugggcauucauuucagggcaggcacauggcagggauaagucuugucauuccuuccuguggucccuuggggagaggucacagugcacagccucugccugagauuuugcaaagaaaaaggaaucacggagcauuuuuuuaacuucaagcaaugagacaaggcaaacccuuugagaauuacacugaaacacuuauagccuuaugaucucuggcuggacauuacagcaccugggagcacuguuccaagguagugggcugcacagccacacucugcugucuucagcaauggaaccuaacuaacuucugccuggcucacugugaucugagaaugggcguagcccuugucuuaggguuuuacugcuguggacagaaaccaugaccaaagcaccucuuauaaggacaacauuuggggcuggcuuacagguuuacagguuuaguccauuaucaucaguguccaggcaggcauggugcaggaggagcugagaguucuacaucuucaucugaagaccacuaagagaagacugacucuucugcacugggcagagcuucaaagccuacccugacaaugacacacuuccuccaacauggccucaccuacuccaacaaggccauaccuacuccaacaaggccacacccacuccaacauggccacaccuacuccaagaagggcacaccuacuccaacuugagcacacccgcuccacgaaggcuaccccuccaaauagugucacuuccugaaucaagcauauucaaaccaccacagcccugcacuucuuugaaugagcaagauccucuaaaggcucagguauuugaacacuugauccccaguugauggugcuauuuggggagguuaugggaccuucaggagguguggccucucaagagaagugucguauugucugcuuccugccugcuguugaagcagugagcucucagcuuccuguucuggcugccugccaccaugccucucuggucaguauggacucucucucuggaaccauaagccgaaauaaacucuuucuuccacaaguugcuuucggucauaguguuuuaucacagcaacagaaagcaacuaaugcagcccgcagaacauguggaaagagcaccccuccuugaccuuggccuagacuuuguguaugaugaguucugcugccccacuggcuucaggggcaaugccuuacaaccucguuucuacuggagaucuaauugugcucaugggcccuucaagaauucaaugaacauucaugacauuucaaacaaaggggacauaggcucacacacuaaccugauccccauauacuccuccagagcugaaggccaaccugggcggggaaucuuuaggcuguaaguuaaagaguggcuggagagguggcuggguuguaaagcagccaccaugcaaccaugacgauuuaaguuuaaaucucuagauuuaaacccaaacaugauggcacaugguuauaaucccagcacucuuacggccagacgggaaguagagacaagagaaucgcucagaguuugagguccagcuaggaugcuguaugcaaaagggacugucccagacaagguggaaggcgaaggcugacaccuaccguggcccugacuguggcacgugcaaauucacacaaucgcacacaagaugcaaaagaaaaguuagacaggagcaaacuaccaugacaugcugcugugaacuagaaccaccaacaaaaggaugaaggaucgucgucuucaugaaggaugcgagggacuagagggagggaaaccccacagccacucgccguggaauuuauguuuccguaagugaagcauuaggaguccugcguagagaagaaauuauugauaccuaaguucccucaaggaagcuucucaagagacccauuccaggucucauaauaaucuguauucuucugaaauggcaaugucugaucuuugauuuccccaucaccaccgaagguucaugaaucauuaagcgucacacccucagagguuugguuuauugcgcaccaccuaaaauauuuaauaaaauaaauucuaaauaaucaauccacgagaggaguagacgcuucuugugcuuuuguaauaaacaucugcgucucgcauccaucauaaacugcacauaagucguggcagggaagaauaaaggacccuuugucauuuccucacgccguuguguaaauacuuaagcaggggacagguuacaucugcaccucuccauggucgcuacucuauggagggacuguacgacaucccacgcugcaucuuucuaucuccaggaaaacgugguccuuuaaccuacccaguucugcagggcugucccugugcacuguagcacacucacaucacugagguuugccuggggcucuugcgacacuccacaguggaaccuggguucaaggaacaagccuagugucuguggaacccuacuuucaaggugucuuuuucaagagaccuuuacugccugacucucaggcuggagacaacuuagugugagauaaauaaagcauaugccacgaggaccuuuugcuaccagaaagaaagacaaugaagauguuccaacuucccuguuacaucaucaguggaaguguuuaacuaggggcuggggagauagugcaaggaguaagccaugcaagugugggacuugaguucaaacuuccagaacccaaacaaaagccaagcauaguccugugcaccuauggucccacuguacauauggugagauugagguggagacaggggaaucccuacaaacucccuagcaagccacucuggcauacacauuagagauggagauuuuacacacacacacacacacacacacacacacacacacacacacacacacacaaauauauuuaauccacugagcaaccaacuacccucccucaaauaaaguugaagaugaagacuucuauacaugcucuguacauguccacaaucacauacaugaacacauccugcucacaguacacacacacacaucacagagagugucuggcugaaagcauggguauggggacacagcagggcuuguacuucaggcuucaaaggguuccuggcauccugacaauaaccccccgccccaacucuggccauaucucacaguaccuuaccccuucuagaaacaacaaucacaauccaaaacagggaugaguagauagcacucaaguccaaauccagcccacagugcaucuuuauaaauaaagguucgucaaaacaagccccgcccacuccuggggcaucaucugugguuguuuacacaaaagguagaguugaauuguuccgacacacuggcuaauugcagaccccaaaauauucucugucuagggcugggacgaugucucaguucauauaacguugccauagaagcucaaggaccuggaucagaucuccagcauccaugugaaaagcuggauggcgcaugcuuuuguccccaacgccacggggaaggcagaaaacauagacuguggggcuuacuggccagcuagcucagucuuaaagguuacuguggcuagggacuaaggaagacaccugauccugaccucuggcauccacacacauggacacagguauaugugcacauacucuugcacaugugcacaugcauacaccacacacauaaaacaaaucaaauuuuuaaaaaauauuuucuacuuggaccuuuacaagagaacuuccaccaacucaagauuuguucaaacaauauuuagguagguaccaaauguauauacagugucacggccagagcugggccagugugcagaagagacacauagggcagaggagauaaggacagggcuguguccccagaaggcugugggucagagacaacuggcaucuucugcuucagaaaauugguauucuucucccguacugccaagggcgacugaguaauggcagacucagccacaucaucagagaauuuaguuagagauuuuuuuuuuuaagugcugguagugaagcaacaaauugccacacugacuugugaaauuccccuuuugacuuuuuccuuaagacagaacaaaacucauucaaaaaaaagaucuuuuuagacugacuuacuuuuaguuuucugcauaugaguguuuugccuuuuuguaugcacgugcauccugugugugccugguacuaacugaggggacuaggggcacuggcuuccuuggggcuggaguuacugguggcugugcaccaccaaagcucgagugagcucuuugcaagagcagcaaguguaggacccugccaauagcaagauggcacacuuggggguaaguugcauacagagggauuugugagucacauagggggaucauuaaccaaggccccuuggggcagagcagauaggcugugagucuccuugggugacauggacuuuguggucuacagaccaccugugagcagccggaugagacacagugaacuccgggauuucugcacugucucuaaguuuagccagaguagacuaugaucccuuggguacacccggaaggcaacugcccuuccccaggauuggaacagagccauagaaauggaaagcuagcuaacauccgggagaaaacccugaaggcacaacaagaguucuccuaugaagccaucuacuuccuaccuaccacccuugcuuuccagggagacagaugagguggagacaacaguuaaaagcacacaugcacccagacagaacacagaggcuagccaguggcacccaagcaaccucaaccuuggcagccagaggaauggcuacuccccauuguugguucaucagucacucuuccuucuacccacucccaugggaugcugcaaaacccucccccaccccccuguuuccccacagcuguggcagaggugcuggaagcacccgaagagccuguggccugaacacucuauagagcucucuguguucccucuccugucuggagagcauugguggcgccacccccccccccccccccccccgcagcagaucacacacagggcauggagcugcccacagggacauaucccaaaggguggggguaaguuugaugggaaugguaagauugugaagacacaagacuguugccauccagucaagugagggccaggugcauucuccacccuagaaacaccugcaucuccaucugaucgcccaccaagacgcaaguauguaucacugucucugugaugggcaguuacaaguacuuggguagcucuccugcugagcucuauguagugguucagucggaaaagggcccuuggugaguuugacaguggugcucaaggguuucugugguuaccgcuggaucugcuaaaccucccacucaugggcucgugcgcuaacgugcccgcacauuuaggaaacguuaggauaaaacuuaaauauaagcucagaagcucaaguugauggucugcugagcugccucccccaggaagcguguccaccucacuuaaggcucugaugauagucagagaaggauguuacagaaacagacuaguuccagucugcaaagacacaaagacaacuaauuguauccgaagacagaccggguacagagcagccaguacaauaugaguucuaaacacagcuggugccacuuuuauaauaaauaugcccugacagauauuugagauguacuuggcagagaaauguggaggucagagguugacaccagguguccucucccucuuccuuuggagacagggugugucuuguugagccuggagcucauugacucagcuacacuggcuggccggugaacuucaggaaccugccuuuccucccgucccacucccaacacugggccacaaaugcaugcugcgccuccuagcuuuugcgugaguauugaggauccagacgcagguccuugcacaugcacagcaagcauuguacauacugagcuacuucaucuccccagcccuuaacugugcauugagucguccauccuuuucuccuccucucccguuuucuuccucuucucuccucuuuuaucaucucccuacaccucccacuuccaaguuuuagcuaugcaaggaauuaaaauuaaauaccaacagcauaggguagccaggguaaaugaagcccaggcaaggugauggccacaaagguucucagacccuaggaagggaaagggaaguuugccgggcauucuaacgcccggauaauaagcugccagagagaggacccugugguuaaaacuaccuguuacucucccagaagaccagaguuugguuuccagcaccuaugucuugcagcucacaaccaccucuaacuccagcucuaagagaucuauugcccugcuuuccaagggcgcugaacucgcgugugcaaacccacacaugugcacauaauugaaaauaguaaaauauaauuuugcaaauaagauaagcuguccuauguaggcaugagggcccacguucagaucuucaagacccacauuuaaaaaacaaaacaaaaacaggcacgggaacgaacgucuguaaucucaagccuuggagaacagagaaauaggaaguacauugaggcucgcuggccaugucguauugaaacaauugguguugucucuacacaucaucaagugugacaaccucaucuucuuccacaccuaacacacugaugucacccacugucuagacaccagacagacacuuuacagcauaggagauauaaaauguucaaccaucuaugugcuaggcacacugauacaucaaagacagcacuccccuaaaaaaggcaugagcgaaguccuugggcaacaccuccccagucagggcuggaacccuacaagacucaaaagucauguggccaugacacaggaggaaacauggucugugugagggaugcugucagccuuuacugaaaacagaaacuguguaucuaucaaauguacagggugguggcaagcaggcugcuggccccucagaggcucuguagcucccuuguuucaauaaccuggguucucccucucuauuuacugcaguuucccagacuugauuuggacaccagaccuguuugaggcuggcuacugcaagcauuucccaucaucugcaagcaagacaccuauuuaucuuauggcugggaacggagcugaagcgaucuggcucugccacgaggcagcuauuucauacccuguuaaucccuaaugcaguaacuacaauaucguuuccacuuucaaaagaggugcuuuuuuuuuuccuucauuuuuuaauauguggccuaagugcucaaauaaagaacaucauucuaaugaggacgaguccccagauguaaccucauuacagcccacgccggccuucuagcuuuaaggcaguugauggagaagugagagacacuggguucuuuccaggcagcagacagaucagcaaaaugcucacauccaaaaugacagucagagggaacggacuggcauuucuacccugggcaugguccaggccagggaccuccuuucaucacagaaugauggauucuauaaacagcagggcaggguccagccucaauaccaggcccauucaccgacccccaaagggcaagggggauauuaagaucagaguggagggcccugcuguaggaugcuaucaugccagcauaacagccggcgucagggcaucagagcagcugagacuauucguaagucacccuuaaggucaggccugcugaaguuacuucaucggagggguuggagagggucaugugacccucuccuuagagcucagcaaugcuuccagcaccuuggccacagcgguucuacccugagaaaauguggccucauggacuuggaagcaccacagagcauggacuaaucaaagauggggcuacagcuggacugaugugagaaagucaaucguccuugacuuucuggugcuggggccacuuuggggagaccuggacucauuuaagcaacuccucacccuuucucugccaguaaccccaauaaacucuuugguuucccccaguucauagaauugugcuucugucugucauugauuuuuuauuuggagagagaaagcagcuauuuaaagcuacccaugaaaaggcccacgcaauaauccaggcgcagccaggaagcaaguaaccaguuuguccagggcugggaaaaaugccaccaauccagucacuugcugaggacagcuccacaaauuguuucucacagacucugucacuaccaugcauuucccagccuuuauccaugaccugagcagcuucccaggcugcuuucccuccaccuaggcugcugcccucacacugagucugacuucagccuugccuacaccuuccacacagggccuuggaauucucccagugaccaucaaaacccuacuaauggugcugacguuaaggucuugcucgccaauugguucuugaucugucaguaaagaagccaugggccaauugcuggguggaaaggauaggcagaacuucucaguucccacagcaagagacagaugcaaggagaggggaggagaggagauaguguggggggagaauuaguucaccaugcuucugagggagaucuuggacagaguggccacaggccacuccuacagguacucuguugggaguguuuagcugggacuagaugugacugagcaacuaaaguugagggcagguggagaggugcagagauaagaguauugauaagggcacacuuuuccaggcgggaaacaguagcccccagcaauugugcuaagaagcaaguugaaauugaacagcugugugugccugugguuuuuauucguggauucaaaggaagcuggaugggggcugguaguguguccuauucccagagcuuaggcaggguagcaaaagcuacacuaaacuuguuugucuccuggugagacuggagaccacacacccuuugcaccccugcaucccucaguaucugucacagugcuaguggguggugagcacccaguggauggcugaaggagcauacaugcugaauagcgugggcugagcugaccuggaaaccuaaggucacacugagugccaggaacagcaguuaagcuuaaagucaagaauguucagccuccaggcccagcucgggggcuucagaacauucucugauggcccgaccucuccauccaugaaacaggugugauaacuuguguccugcaugcgugcuuuuaggagaaccaggcaaagccaguaugccucguucacaggagguuucuaaagucgugacuguccacgcccugagggcacagcuccuguaucucuggggacccagcagcaacgagaugaggaaaaggggaauggagaguaaaucuggcuaugagaugugccagaaguccgaggagaggggagaugacacacagaggaucugucagcaucuggggccagagaaaagggccauaaacgaacuugggaaggaaucuuccagaacugcugucuggcugauaggaucugacaggugugaaugugacuacgggaauucuugaggcacggugaccuucagaagaacgucaugccccuucccuggguaauggcaguucagcagacagaagucagcuugggggcaggacccgcuucagaccugcugaggucucuccuuugugaugcgcugacaccucaguucccuucccucuccuccugccagcuucugucaucccuggaagcuuacugaacaggcuucuccuuggcucccagacaagacagcugauagagaacuagccgcuagccagcuucaaaagccgcaggcugcucgcacccugugcccagcugaggaaaucaauguguggaggccccagccccugagaacaaaaggagccagaacccagcuuucuuucugcuugcuggaaguuuuccuggccucggggaaggcuuauagcaagugauauguuaaacgauaggcccagaugucuuuaucaugcccuuggauggaggaagcccgcugggagaguaaagaauucaaggcucugaagccuuggcuguccauccagcaggcgguagcugggggcgauuaggacuugggggacgcaggugcuagucacaggaccugccuggugaaucuacagugaacaagcagacuccacacaguaaagucuuguacgugacaccacagcagcugguggagguggcccacuaggcuucccagcccugcuccagaucaccagcuaucauagaaacacggaggaaguacaggugcugauauagggggaaaaaauccuucuucuuggcuauuuaaauuuuccauaacuauggagaggcaauuaauucaacaagaaggaccccauucccaugaauaagagagagaaacuuaauucaaauugcacagaguacuaucuucugaggaccagugugccagagggcacaggggaaguggucauuuccagugcugguagguauguaauuugaacagucgcucaagagcaauuuggcauugucuggacaaacuaaaacucucacacccagcaauucucgguccggauuucucccaagagccccugugugaggccacuuagugaaacaguaauuaugaucccuaaagucuggaaggcuucuaaaaguccagggaccugcuucaguauuuaaguagagaguccuaccguuuagauagaaccguuuagaauguaaaauaacauagauucagcuuagcaggugauauuaggucaugaacuggaagacaagaugucaauuauucccaauaguccccaacuuccaagaauucauuuugcaucccacuucugguaacccaagcccauucuggacuccuggggacacuuagucuaaugcucagccuuccgcaccucuccgcacuguugagcgucaugugcaaacauggccaccuaugaguccacggcagugaacgcacaucuuucuuucucuacagacagcacagcgauucaccaaagcagguacgguaugcacccuguauuggauaucugguucagugggauaauaagccaagugaaauggggaaaaccagccaccgagaagcagaacugcaaguagccuuucucucucuccaaaagccggaaacaaaggccgugccauuggccaacgcauugucauggaggccucucagucccagcacccacaggacuguucgcagccagccguaggucauagaagacccuuccugguuugcaugugucccccuccuccagauccgagggaccaggcuguagacugcaaagcugagaaccacaaauaacucccaacauaaauauggccuaaaaauagccauaaaucauucucacuccauccggugacaauucuaauuuauaacaagagggaggaaaaugaacgcgguggcuuuuuuuucccuaggcuucccagcuacugcugaggacgaauuccacccugcuguuacuuacagccaggaguuccugauuuacguauuacuaaagaugaaauauaccguaggccuccgggcacgggggcugcuugcugagguuuagugugaaauccugcaggcucccuaugucccugcauaagcagcuuccuuucucuugguccccacccaagcuuucucucuguguguaccuauucuucuauuguggggccaucagagaaagcucuccucccagagaggaagccccaccucucugggcucccugcaagaagagcuaaugcuaucuauguauuagcaggacgcuggucacaauccuggagaugguucuuuccagcagcacauucggguaaucugcacauuaauguuccauacagucaauuaaaccacacugcacacgaggcagaggagaggggacuggaguuucucauaccgaggcuuuucuuauucaucaucauaaaacaauucuuauugguauauuaaaaaaaaaaaaacacacacauaaaacgaaaguuaucucucuccacgggguaauauaauaaaagccauuugaugcuauuuuuggcagccauaaaagcacauaauuaauauaggggagaaaaaucuccacgacaaagugugucacgaugaaacgucagugcccaagggcaacccucagaacucaagugggcucacagucuucgcugucacugcgaugugcuggacacucgucaugacagaagcagcgaggacaccugccuuugaccucccugaaauggcagcucgaucauggaaggcuucugauaucuuugcccaugguaguggugaccacaucccuuuggggguggcaaguaagacuuuuggugggacuguuaaggaaugaggaagagcagguucuggcuaauuagcagguccuaugggccaccugguuggagggcgccuccgaagggaagggcccucucuaaggcugcccaugucucagagacagaauagcaagguugccuccaggaaaucacaagcugaguuuguucaccguucugcacccucuuugcagaucccucucugcgccaacucuggaggagcucuccagacaaccuaucacaucauuauccuuaaccucugcugaagcugaaacacccacacggagauagacuauuggucagcccggggaagaauugcucagcccugaagggcauuaccagcuggcugaagcaccuugcaaggguacuuccucaugaugacaccugccuucccugacaccugcaccccccuccccccaaugcacucagaaacacacccauggcaagcacagaagaggaaccugcaggcaccuggccaauccccauccacacaccagugacacccucaauagagcacuuagaccaugguuggaggcauagaaaagggaggagaaacucugggguaagagagcaggagccaaugccaacagcagggacuuggcaaacaagauuucuuuagacacuggugacgggcaucaggucauuugcaagagauuccaaauucucugugguggcccaaaaaugacaugugggggggacaggaaagccuuuuuugcccuuuaccucaacucccuggacuuugagcuucaugugguccucucuggucguuuucccaucuuuccucuucuuccagcaguacccgucuuuccuguacuucacuuucuuccuguuguagaguaucauggagccauucugcggucugcaaacaacaaaggguuaaauuacugagagaacugagcagaagggaaauuuaugaagaaggauaccacagaccaguaaaagucucuauagaaaaaaaaagcaauaucccacauuuucugggacguaauuuuucaccuuuuauugcgguuccccggauuaaccguguuuuauggcagcuggaauuugcuuguggauuugguuccuaaugaauuaaaugugucaaugauaggcuuaaaaaacaaccccuuaguaauuuccacaaacuaaucaggauauauggugugggcgcccugagcucuguagcgaaaaguaagcaaaacagagagagagagagagagagagagagagagagaaagagagagagagugcaaaaagagccgaggguguuguagcagccugcaauaucuuaucucuuguagaaggauuuucuacacaucuuuuaauccaucauccagcauuagggaauaaauaaguuuaacgcagacgcuagaugacuacguuaagaacagaccaauggaagcucugggugccgaggccaaccucucuugauucauugcgugcguuuagauuacugcuggauacagaggggcaugaagauccuccuucccuggcaagcacagcacccgacugcuccccaucugagcuucagcccucagagaucuuagauaacacgaggaacacucaucugcucuguccacggccaggguagcuuaggaaaauggcagcccgcuuucuaaaugccaaggacaggguggauauuccugugauguuuaagaugaacaagcagagcugaggacagggcucagucaauaaaguacuugccauguaauauagcacccauguaacaagcugggcagagugcuauagcccaggacuuaggagguggagucaggaagagcagauguucauggucauucuuggccaaacaaugugcucaguaccagccugggacauacaagacccugcaucaaacaaaaccaaacaaaaccuuggauuucccaaagaagaggcauuacucagccacagaaagcagagaaguaguguguguguguguugcggggggagguguaaaggugccauagccauauauuuuggguaggaaucuacaaagagagagagagagagcuaagggccuccgcugcugacagcaggugcuacaguaaagccauucccagaauaaagucucugcaggugcagacaugggcagauucagcccugaagccagcgugcucacccaguggccgggcugugugccaccugcaccugacuacugggcacagaaaggcuugccauggugugugugugugugugugugugugugugugugugugugugugugugccuguguuggagccaggggcacuccauccugcucugagccagaucuucaucugcugcacagcagugggucacauggaugcaccuuggccagcuucuuuccacugugguagagguggggggaggaaacagccaauccuuccuccugccucuaagcuuggcuucuucuguugcccaaugugccauuucaacaucggacagaacacugaguauugauggcauaaucuuccauugucuagaaaacccaacccuccagcgugauuacagcuaauaguaguucccacccagccuggcugugucaccaggcagccgcaggaagacuagagagcaauuccacgggagauuaccuacucucguggggccucccuacacugaacuguucccugauuaggcacaauugguuuguuuccuuccucagccugcaccaacugaaaugauggcagaaaacagcucugcagcuugacaggacacugucacauaccauacccaucagagccuaccagucugcacuggaacccccauaguuggucuccauuucuucaugggagcgagguugcagagaggggagggauuguaugagucuccuucagacacaguagcucuagccacuagcacugcacccucaguccacggugagcccucucagucccucgaacaccuagcaaaagguccccaaaccccagcucccauccuuaaggccacuggcuggaggggugguggguggcuggaaggaguagguugaggcaagcaaaaggacucuguggcccugcccucccucaggaguggugaggacacauggaaagaggacagggacacccugaucaaucaaaacgaagcaaaaccaaacaaaacuaccuucugaagaccucagaguaagccaccacuucuagggaccaagaaauggccugugacuugucccaacccugccauugguaaggauugcaaaagguuccccccaaagaggggacucccucaaacucugucauguacaguucuguugaccucagcuuaaguuucugagaguggccuugucugucacugucacuuuaacaggacaccauccccaggggagcuucagcguucagcuaaaaugaccucaaugaauggaauccucagccaauucaccgugacugacaaagcccagcagugugcagcccucuccucugguccacuucaguuugcuucugcccuuugugauauggagggaggcuucaccacaguccaggcccuggcagugauaaaggaaaaaaugccccccacccagagaaggagccaugugccucacagaacagcaucagagaggcugugcugccaucccaacgcaagcacagcaagucugagccugagggaagggauccaagaaggagggagggucaaggaggugggcguuaggguggagaagaaggacucggccuuaggcgcugacacagaggagcuucauuaauuaccgguccacuucagguggggcagagaggcaggaaugcagaugcaggucgaggauauggaaaguguagccaacaaccuaacccuguccagccuucugugcccuagucauucacagguaccugcugugaugggagauaucugcacaccugucaucugcauaugaucucaccugcacaucaacucgguggaggaggcacugccggcauccccagauaacccagucuuuaugcugcagugccugguaagucuguggguaccagagaagccaaggcugcuaggugagcagagacuaaauccuggucugcucuccuggcugggaucaguagagucccaugcaaccuuagcaagcaccagguaucaggaggguggaggccagacuuccucucuucauaaagcgaagccugagcuaucuauucuacucaucuauagcaucuggauguaacuccagagcuguuccagguucacuuccugugacugggguagaucuggggcuaucucaggcauacauucuauaucuggagaaacccaggcugucccagacuugaccucccacaacuaagauaauugggauguccagggucuuuccuucugcuacagggguaacucuggguuuguuccaggcuuccuuuccugugauggauaacucuagagcuauccuggcuccacccccaagcuaagguaacucuggcugcucuaucugguccucacacuucuauucuggaguccauggagaccuacugaggaacaaguccuuuauuuacaucaacucugucaccuccacacucccuacuguggcuucuugagguccugagcuagacucucaucuuccuuuuaggaucuccuucugggacaucuaagccaaggcagacagucugagagagccuuggggaaacuucccaagccccacugguacugcacuggugcacaagagcuacagcggagaauguggccguggggagcuuuguucuaagcaggaagccucuauccaaguaacccuuucaucuaagaaacuaacaguuaugagaaucggcuacacucugcacaguggaggaaaaaaauuccuuggaguacaggaaagcuuugcaaacuauaacaauguuuaaaaugcacauacgugugcuauaggaagaugagugcguuggagggugggcagagggacagaaagaugacagagacuggacaguaugacaguuuaaagaagaaggucccugguaggcucagaugucugaacacuugguuacccauugcugggguuguuuguauaagguuaggagguguggucucucugaaggaagcugggaugagcuuugaggcuucaaagccaggcaacauucccugcuuccuuucucuacuuccuguuugugguucaagcuacgagaccucagcuucugcuccagccaccauugcugucgucuguuaccaugcuucccuccaugacugacucuaacccucgggggcuguaagccaaauagaccuuucuccuacaagucacuuugguccuggaguuugaucauaacagaaaacaaauguagauagauggauggauggauggauggauggauagauagauagauagauagauagauagaugauagauagaugauagaucauuagauagaugauagauaguaaagauagauacacacacacacacacacacacacacacacacacacacacauauauauacauucacaugaaagauaauugaagaauguugauagaaugauaagagccugucuacaauaaagacaaaggaaaacuuaaagaaaauuuaaauauacaagaggcuugaauaagaaagugauccaaccugaagacaacugcaaaaucuucuaaaaguuuuaaaagcagguuuugaugcauucaaaaauguagccuugguuagggugaaguauggcccuaaaguaugguccuucccuugaguuaauuucugacaaggagaccaccacuaggauuuuuuuuuaaauguagaauuuuuuuuaauaaaauuacuuaggggguuagagagauggcucaaugguuuaaaaugcuuacagggcuuuuagaagaccccucuucaguucccaggacccacgcggaagcucacaaccaccuguaacucaaguuccagggcaucugacauccucuucugaccuccugcaugcauacagugcccagacauaugcucucucacacucaugcacauacaaguacaguaagugaauuuaugccauuuuauaagacauaaauaucaagaagaaccagauaaacccgguaaagaagcugagagacaggcaugguggcguaggcuguaauccgagcuauuuggggaggcuggggcaggaacgucaaaagaucaagauuugccuaagccaugugucagugagggaaggcaccagcguuuuagcaugcaauacuaagaucacaggagaggaacuaggaaaagguaccuuugaggguuaccccucucccacugacacaucaccucuaagcagaccaguaacucuccaucuaauagauaaaaaccguaacacuggagaagaaaauauaaguggacucuuuuauuaucaaagggaacgacacuuuucuaaccacaauucaaaacucagugauaacccgugugagcuggcuguaucagauuauaucaggcaaaggcguuagauggcucuccacagcggcugcuccauucccaccccccugccaugcggaugcgagggugaucugguauccucucacccuccuccaugcucugucuuuuggaccgaagccacacuaguggguguguggucguuuuaauuugcauuucccuaaugacuacugguguuaaccaucuuuucauguccguauuagcuauucguagaauuucuuugguaaauucuauuugaaucuuuagcccauuuucaguuaaauugcuagauuuuugacuugcugccgaagcuccuuacauaaaguccuaauggaaauacuuuaccauuaagcccauaaauugagggaguuuuuuccuaauuuucuuuuaauuuuuguuaaaaauccagguuaucauuuuucuccuacuaacuaguacuauuagggaugaagugacuuguuaucuaguccaaggucauaaaaaucuccugucuucuucuaagaguuuuacguuugcagcucucucauuaggccuggggugcacuuuguaguagugugugaugcugggaugcaagggucuaagcugauuucugcuauguagauaucugauugucucacauccaucuuucagacugaaaaugucuauccugccucgccacccauccacugaauguuugaaaauaaacuaagcauaaacauaagguuuuauucuugacccucaagucccgcccuguucuccauccucgugccaaucauuuugacagcugcagauaugacaucagggaccccgagucuuccaaccacgccgccccuguacagucauuuuuggcuauuccaagaccuuuggguucccauacccauugauuaacuugacaauuuggggaucgaggauaaggacugaagguuuuuuguuguuguuuuuuuaauguguaugugucagugccugcauagauaucuuaucaacauuggugugcugaugcaggggccgcagagaccagaagaaaguaccgaauccccugaaacuggagcuacacgguugggcccauggggugagugcugggccuggaacccugauccucuccaggagcagcaaguguucuuaaccucagaauugucucuccacgcccuggggaagaggauaggauugaaucaagaggucaguuuggagagagacacugcccugauaguacugaguguuucugcuaugucccauaaugcggcuuuuaacuccaugaacguggaauggucucuccaacuaugugaaucugggcucucccugaagaagacauuagaguuugcaauguacagguauuaaaaguuaacucgugcuaauuaauuuauucuauuuaauguucuuggugaauggaauuguuuccuuaauuucacaccagggcucuuucuuucuaccuccucgauguauaacugacuucucuguauugagcucugugaugacaacagcugauaggauuugaggucgccugggaggcaagccuacaggcacaccugugagggacugucuagauuaggcuagcccugagccaaccucugagggauuauguagauuaguuuagcagacaugggaagacuauucccuggccuugggaaccaaccgugcuggauaaagggagcuugcuagcuccagagacaagacaccuugugugcaagcugauccucagaaccuauguaaauguggaaggugagacugacucaagguguugccuggucaccacagggucaccaugucguguauuacaacuaggcacacgcauaccucuauaauacacgauaauaauucauaauaaaauaaaaggcaggagaagaucugugcuccagcauccagucaggaaguuccuuuccugacugugguaacaaugugagcugccaccucgagcuccuggcucugcagcuuugugacugaugggccguccccacgggccgugaaucaaagcaacuguuucuuuuuaaaauggcuuuccucuggguauuuucuuagagauacaggaaagcugaccguggcagucuugucuguaccuccagcuuccacauucauuaguucccgucaaguuucuguagauuauauagacauccuacgugugaaaucaagacauacacaugaaugacauuacuuaguuuccuccuuucugccacggcugucuuuuaucuccuuuucuuccuuuaucgaccugcuuaguccuuuaguucauuggauagaaguguugugagcaaauacuuugcauuguugccaguuuuaaggaaaauguauuuauuucuguuuuguuuugguuuuuuguuuguuuguuuuugcuuggguuuuuuuguuuguuuguuuguuuguuuguuugguguuguuguuggugguuuuuuuuuuuuuuugccuuuaaguacaguauuagcugcaucaaagauguaaacuugugugaaaauggcaaacagcuccgggagccacuuguccaggcuccgccgccgaccagccacgggacaauuugaacaguaguaugagaaacacauacaguuagaacucauuaaauacguuuagucucuagauucauugugauccuaaaauaaacaagcaauggccauaaaggcacacacugcucagugcuggaggacgccagggaaaaccugaggaaaaccagaaaggugaggagaaagccucacacauccaaccuucccugucaaagggcucuucuggguuauccaaugagaauaugcucuacaaaagcccuccagccaauagaagaggaagaaggggaggugggggaggggaaggaagggagccagagacagucccauuguagcaaucucaagugaguuagcacuucaggcgacucaccagagggagacgaccugguagaaagagucccuccaugggaacacacucugcuacugaacaaagacaaaagagcuaggagagagaacauaaagugugggggguguggggagggaucugggaggagucagagaaauggggugggggguggguaugcaugaucaaaauauaucauauauuuaugaaauucucaaagaaguaaauaaaaacacuauuaaaauagaagaccuuaaaaacuggccucagggccuagcuagcauccacuuuauccguccccuagaggggauagggacgcccuaaaagacaccguguagggacacucgaggacaaauggucuguuuucucagccaguucuuugacacagaacaagagagaguaggagcgagcuggagucagaacacacaucacgacagacagaaacacgaccaucaaccgcagugaguguuccuaagguggggauugacuggaccaaacaauguguacacauauacuuauguguguauacauguuuuuauguguguguguguguguguguguguguguguguguguguguauaagaaugaguauagguauguguaugugucuauguauagauguguauauguguguauauacauguauaggcauguguaucuacauguauaugugagcauacauauuuguaugaauauauuuguauguauguauauauguauguauguauacauauauauauucauaucuauacauauauacauaugugugugugguguguguccauguggguauauauguauauauguguauauguguaugauauguaaguauauguguguuacuuguguacaauauauaggcauguuucuauauaauauauguaugguauacacacauuacacacauacauauauauggaauuugugagacgauaugaaucuugaacagucucgcuauuuaaaaauaugaguaacuugaacugauuacuacaaugcagaaguauauuuuaaaaggucucuuaucacuuagaaauacagauuaaagcacuuacugaugaaauuguacaucugagcuauacuucacaauagcauuaguggguggaagggcugggggucgucaagagaccaggcuggccaagcacugaccacagcugaccccacagggaaugugacugucaugggaucagccccuuccuuacacaccuugaauaaacaccucugcuuccuugcagagaaccugacgugagcaagcuguuuagcaccugcccagcacguaacacacaucucaugacaacuccuacuugcuuguuccuuuucuguggguucucccucaacagcaauggcgggaagacugagagggcaaggcaguggugcaucaugggggugcagcugggacacacaucaugaaaagaaccaucccuaaacaacaaggaaggcagaagaugauggacaggcgcugaucagagagaggcuguguccaugagcgguuuccuacacacauguaagguggagaauuauggaauaaccaggaacugaauccaacacuaacuucaaccucaaaacugaagucugcagcugggcagcugcucagucagcaaagcccuuaccugcaaaccugaggacguggguucaauccccagcacccguguaaaaaaaacagauggcaucaggcaucuguaauccuggugccuggguugggggcagagcgguggaucccgaaagcccauuggucagccugcccagucuaaucagugaucugcagagccugccucacaagugugacggaucauugacaaaggcagaagaggacacucagcauggaccucuggacucucugcccauacauuuauacgugugugugugugugugugugugugugugugugcgcacacgcgugcgugcgcgcaugcacucaagcacacagaggcacacacugauacccaacauccagacacucuuuccaaucuccaacaucagacagaagucaauacacccacacagcuccgguucgaggcucucuccuagaucccucauuuucaacgugaucacuuccagaaucucaaaaagagcaaacaccaaaacaaacaaaaacccaucagugucauccaugcagacagugagacccaacggcugcugaaggaaccggguuuuuuuuuuuuuuuuuuuuuguggacuagcccucauacggcugcccugccgcccugcggcccugccgcccucacugcagccugcugcauggcucuaggugacagagaucauuucuugcuccacugcauuucuaaggugugucuucgacacuuucccuuaaagcaacacguucuugcacauaguaggacucugaacauccagauggcuccuacacaugauaagcacuccccuuucucuagcuaaccccagaaaagcuuaguggcucuguccacucuguugucuuugccuccagcccuguccuuccugccagaggcauggaggagggccuaguccaggaaaaugcagcaugugcauuuccaucggcagcaagccaugaccccgagaguaaagcagagccucaugauggggcccagaccgcaauaccauucucaaggccggugcuaaaucuccgcuccagagggcaguuagaaaauggaaagugucaccuuuaauugaggcagacguucuuuauguaccugggccucuccugaucuuuucaccaugaauagcuugauuuacaugcaccauuagaaccagguggccuggaccaaaaugucaaugauaaccaugacaauaaggagagcugucacugacuaagcauuugucugguccuagaagccagaaaagucucuccaccagcuuccaucuuaaucuuucaguaacuucaggugggugucagacuccuuggugaggagacacggaggagcccaaagucacacagcugauaaggugagggccagggacguaaaacgggcauuguaccucucugugggaccugacuaggaauccccagguacucaugagauuuccccccaaggcacuuucugaucagugugacacguauguccguccaucuguggagaagcgccuugcacaaggccuccgaaaaggcugacugagccugauguacaucggcgcuguggcucuuccuguuguaggauggggagggaaaacggcugguaaaggacaucuccccugcuuaucucaacacagacccagggagagccaugauaaauggcuggcgcacacagcaagguugacagagcacuggaccgaaccccaagaagccauggagacagcucggaucucacaggacacggggcugguuuauuagcccgcagccaggcaucuucucucuggcuuguuuauagggaccucaugauuuggaggugggauggggggaugggcaacaaaaggcaagcaggcuggucacggccauucaggcaugguaacuccgggauaucuguagaaugaugggcaaaggggagccaugaggucugccccaggcugcaauccaccagauaugaaaaccaauugcuuucuauaauaaauucuaacaggagccauagaaauaacaagcugaggagaaagggacgccaauuugcuugauuugauuaucuccuucuugggcgguccagccccagcuucuuuucauuaaaauaagggcaaauugaaaaucguaaaagagccuuucuuaucagacaauaaacgaccuaguagauucagaagcuccgacaccccaccaaggagccaggaacgcccggcuguuucggcucuugacacaggagaccaguaggucccaggaagcugcugccccaacagcuucgucugguaggguuuuuuccucucucuaaacccaagaagacacagcugauagcaucacccagcagcauggggucugcucugcccaucuugccugaucucugugaaugccugcaaagagaccaucaccagacagcuuugggaaaagagaccuuccugcuaggggugccaggugccccucuguaaggcccagauggcuuuguguggacaguaagccaggguaugaagagcuuucagaacuccacaauggaagugcguuuccccaggaucuuuaaaugcaggcugcuaaccacaguuuuguuuaucuaaauugaugucagaggucacagggugaaagggcuauggguucauggggauggaaaugaccagaagucggucuagagugggucugugaggacucacuaaugccucgugccugcagcucccacaaggcccucuaaaacuuuuauuaugacaccuggcaauuuauucgguuaauguuuaccgagccgcuguuauagaccaggcacucaggugggcuacucugggcgcuacccccucgucugcacagcuugcagacuuggggcuucugggacaaagauggggaggaauuccacagugaccuggcaugcuugcugacugcuacaaguagguagagagagacgggcagccuggagaccgaucccagucugggcagagguuugucacugagacagcgccaagucuuagcggcuuggggaacaugccucaccugguggagggcaggcaggaagggcaggggcuagaguggacaauggagccagccaggcccaagggggugggguuaauucuccgugauaaaagagucaaaucaacaaggcugaucaaaccacaaacugcaagaagggaacagccaggucuucgaauuuuaaucugagugugugugacacaaacugggugaccuaaauuaacacaacagaggcaguuuuggguagcguagggcuuauaccauccgugggcugugacacacagggaguaggaacuaaaggguagcaagcagaagccacugugcagaggcaagcugguagcuggccucgcuguaggagcaugcgcaaaacaaagcccgaugcuuggggccuucuccuccaucccagccaccuuccauucuuggggugcuuucucucuuugcugucuauuuuauucagugccuaacuugggaagugugaucuuugccacauuccuccugacaacuucagggaucugucaccgaccccgcuaauuucucuuaaaugcuagaaaauuuaucccugugcuuucuuuugguccauuccuaaauuuuuuuuauuaaugggacuugcgaaugccaaaauggagcuucaauuucccugguaacaauacucuggaaaaaaaaaaugugauauucaggcagagagcaggcacccuccagacaauaggcggccacacccccaaggggcaggcgaagagcuuccggugggccuggcuucuguccaucccucucauccacacagggaagaauugagaaguggaagggaggcuagaguuggcgugucugagauggguucuaauguagucugggugggccuugaacuggcucaggcuggaagacgagcuugaggagggaggauggcuucuggagcggcugcacugcuggggauugaaccgcaagccucugcgggucuucucuuugagccacacccacugcgugaacuacaucugucacaucugucucaucugucugcugcucagcuuggcucggcuaguucuucggccuccucgcccugucuaacuuguaaacagcacgcguacuucacaaaugcuugccgaacagaaaaauaaccaagaauggaaaggaacagaaaacaugauucuguguuuggcgaauuuggucaaacaaaaggagcaaagaggacaggaaacaucagccgcacaauuucagauacaaacaguugcaaaggaaaagaacuuucuagucccgaagcauguugcagcccaggcucagacuccccagccccacagggcaacaggaacaucauuucaaaugccacccggagcuugcuucgugcucuaacccagcgcgucucaucuggccaaguccaugccuccacgguggggccuggcgcucccaccgacccucaccugucacaucccaccaccgauauuuuauuaauaauccaauguaaaucugggagaaaauuaaugugucaucuccucgcaggaaggacuaaacaucucaaugugagggucuguugaaguugucauuuaucauuagcacgcaauucaaggcaagcuucccacacucuggugggagcuuucgagacaaugaaucucggggaauuagccucugguccaauuauuccugcuuccccccaccuaccuaagagauaaauucugucuccgugggaggaaaaaaaaaauuaaaaagagaagacgagaaggaggaggagggagcuugcgauucuccuuccugguugaaaucaauuuuucucaaggagacaaggcaauauucauugugcgagaagggacuaaggaggcccgcuaaaggccaauaaauggagccguuccgaugaaaacuuccucaaaucaaauguaggggaaccucuuaaugggcuuuguucuucuuuuccauaauccauaacuauuaagagaaagaugggcaaggagaggcuacuguaaagggauugcuguguaaacaucacacggaauuuucuucuagggagagccagggaccacuguaaacacugggccccuuucaccguaaacacugggcacccaggcaagccaggaccauggagccugucuuaggccccagggaguuuguacucuagggagaaaugaggacuaugaacaagcagauucauaaaagccagugaggaagaugggucacagugggaauucuauguguugaggcagaaauuguuuuuaacuuuuuuuuuuuuuuuuuuuugcuuuagugcaaaccauaaaaaauucauucuggcaaaagagccauauucugguugcaaccugaucaggaaggguggaaggugggugguggcuucuccaggcagugagcguaggaggcccaguccuguccaggugaccccacaacguggcauagcaccacacccauagcuuccagugagccuugcucaguuacagcaggcagagcuccaaugaaccaugucuguaccuggaggcugacucuacuggcucuuucaguccuguaggugagguaaccaagggcuuacagcuuggcuccuggggcaggaaacacauagacucagagcaggagucccucuggcucugcucucagaugggcucaccuccauuugggagcugaaggggacuuagccucuacauggcaacuggcccugacaagucugcccugccaggccguacgucuccaccaccacgcuuggcaaagcaggauugcucccagcccuagaguugccaugaagagagagagagaucuucacucugagcucaaagcagccgcuuggcucuccagaagaagacccaccacagagguugcguaccaagugucucuaggugacauauggggcuguggugugcagcuagcuggaccugcacgggucugcaugaugcagaagagaauugugucuggcugcccagcccaugucauggcuuagaacucauaucugggccgacaccucugcuuccuucccccuuccugcccauucugccucuaagaccugccuguuuauagcuucagacccagcccagagggaauauguugccuugaucugcucauaagggaggcgucuauuggcuucaucguguggacuugacugcaccccccagguugggagcccuuagcugugugagacuagaucugcuuccuuucauacaguuucaaccaugaccccgucccaagcucuuaagggucccuuggucuauggugucugaucagcagugggcauagagcuaagccaugugguagucaggaugaaagcucuucuacaagaaaagcuacacaacaggccuuggaggcccaaacgaucacaucuuggaggagccaucugcaccagcuccuccccaucugaccuuguucccagaggcugugacugacaccagaagucauccuagcugcccauuaccucuccuggaucuuuugggcuugagcucccaagcaugagagcccugaguggugaccuccauucacaggagacucugagucaggaacugucuggacccugccugauucuugcagugacucauggguaggagauaccaugcucucauuccucuccaagauggauccagagaggcagaugguuucaaaaguucacauagcugucaugguggcccuagcauuauccuggaucgagaggucugaucccaggcaugcauuuugaccacauggccuuuuccagaagcuaagccugaauucagagccucaggaaaaagccucacccagcuugugcccuuugagaagaggcuuuccggggaguugacacguccuggguaucccaucccccuguccagucccuaaucauggacacucaugguccugccuuccagaguccuggauggcagccccauucuacagcacccuccggauccgccccugacuuuuauuaguuauggcgagacucgagcugcagguguuugguccacagggaccugggcaccuccucucuccagagcucauaaaucagagccucauggucuaacagcuacgauguuccccuaaucauguuacugcaauauuaauaaggcuguuuaaugcaaccggauccuucuaaauugucacauaaaaauuugguaaaugucagacacaucauuuaauagaaagcgaugcuuuauugccaggggaucuggguggcuggaaggaggagcaaagagcccaaccaggaugaccucaggcaggugaccucaggcaggugucaggaacaaagcauuccuggcaugggcucacuucaggccuuucuucccuggcagccagcagucucccucagaguccacuguaagccagacacagggcaacacccuuguuauaguggacuguugcucccacuugagaagagcaagacagcaugcaggaauacugccccacaaaugagcaauuuagcaugcauguguugggcucauauauccaaacugcuucagucaaccuccucaggaaggacagaggcugcugcacugguauggaagcacggggacauagggagauaaacauugagcacagccuaaugucugacagggaauacagacacguugcuccggcugggauggagagauagcuugauuggaacuccagcauccacagagaaggcugggucuggaagaaggcugcucagucuccuccuuccaggaaggaugcucagccaucacuggaggagaguggguaccaggcuuccaaauugagagugccacucugagaacucauagaugagaggaguaugugguucugugccugcaaccucuuucagagaggagacagacacagagacgugagguugggacauccugcuguuaguccugggacauacccuguuuccauggaguguuuaacuccaggguccuaggacaguuucuguuccccucuagucauuaaaacccaggaugagucucacuucucuggacucauuaacaucaaccuugccuggggugcccaccucaccaguccuuacgggugacuggacaugcucacguauucuuaggaccacucccccaagagagacaaguccaagcuucauaaacccaauguuuucaaauugaugugucuaaggagugugugugugugugugugugugugugucugugucugugucuuuuguguaugugugaguguauguuugugcauaugagucccuguguguguauauguguaugugugucugugucugucccugugugugugugugucuauguguuuguuuguguguguguguguuuggcuguguauaugcguuguguguauguguuucuguguguguaugucugugucuguguguauguaugucugugugcauuugugggugugcaugugcgugcauauauguguuguguuguguguguguguagggggaccacauuagccugaguauacauguggaggucagaggucaaugucagguaucuuucuucauugcucuccaccuuacucuugagacagagacucucaaugaacccgaagcuuaccacuucaucuagauuggcuggucucagggauccuccugucuccaccuccucggaccugaggguuuguauacacacugucaugucuggcuuuuaugugggugcuggggaucaaacugggguccucauguuugcacagcgggcacuuuacccagugaccacaggcuguacacacccaguuuaaaagaauaacccugcugcuugcuagugucagacaaguccccaggucacugauguggggaguaacagaguccugugggagaagaggagaaaggugaccauaguccugccucagugugcugcccacuccagcaggcucccugcccuucccccuuugcuuuaguagacuuacuuccaaccugcuugucucagacagggagacucugguucaaggaggcugggucaggucaccaugcuuucugccauucagaggccacaguagugaggaugugccauacugugaaccaagacuuggggcagcagccauguaggauggcagaaaaauggcacuguaguagggguggcaagaugccaucgguccauccagaagacacugccauccagggcccuggcagagggcugggcaaggacaccugccaguuuuaaauacucccacggugagaggguggacugguccuccugccuugcccuugauaaccagcugaccccagcucagccucuacacucugccagccugcaggcacggagagucucagaucugguacguuucuccaaaaugaugaugcuguuuaaaaauaaagccaguacgcagcagauuuccuguaaaaaaauccuuaauuuuagcaagugaaaauaguuuuagaaaucuguuucuaucuuggauuucugugugugcucaaagacaauccacuccaauuuggccaguuccaauuuugccucuuucuuuugaguagaagcugagccaccccacaauggcacugccugggacagggcagggcucaugcacccuggccaacuaguccaggcuugccaaguucauugauagcuuguucacagccugaccuuaaaccgccacucuauuuucagguaagcuuacagccucaccuauaaucaaaccagcucuggaggacccagaggcuccugugacaggcuccagccuccuguuuccagcgagacccugcagaggugcaguggggcacauggccacgcaucugucgugacuguucaagggagugacuaugguuuauaaaugugcugucaucaucaaguacucacaagcucucugacccucggggcuaaccaggccauugggcagucuuccgcccaacuccuuaacagagcccagaagaugggauggugccuucauuaaaucucccacagaugcgagcggaaaacugcgaucuaauaaaguuaaaugcaucuaauaaaauaaaauuugagauuaaaaggaaguugccuugcauauucaugagccacgugaaugcugagagagggagcgucuaaucuccuuauucuuggggagcugagaguuauugcacgccaggaaggguucuuagcaaagcuuggccccgcagagcccaaggaaccaggaauccacagaaggagugcuuacugccgucacuuuucauuaccauuuauuuggaauaguuucuucccuguaaucucagcaacucccugugcauuuugggacagugacugcuggugagccauaauccuuggcuaauauccuauaagccugauucauaagccacaauuacuuauaucuggucacgaagguaagagucacuuccuccacgaagucuucuugaccucaugaugacccaguauguguuucccaagcagccuugcucucccugucuagcauccacuccuaaagcacaaagacucacacauagaggcacaggcauguaugugcacaugugugcacucuuauaugcauguaugugcacaugugugcacucuuauaugcaugaguaggcacaggcacagacaggcacauggacacacacguauauacacacacugcccuguugcaaucuccuuccucuuugggcuguaagccuagcaaggucagagacuagcucagcuuugucaugacggccuggcauauacuuggagaaacauucaaguuguuagaucaugaaggggcagcagagccccaaguuguggcucaugguaagauguaccaagggguggcucguggggcuggggauaagggaggugcccucuucagcaaggaaaggagauucagagagaaagaauucucaaugcugcagagagugugugccggacucucucggcugcuccuaggcaggcaagacaccaagaagagggagaagcugggcuuaggaggagagaacaugggaaaccaggauuggagacacagucagcuuguugacaaacuccucugugaggcaagaaagucaacacauggaugggacaccgccaaaggcagaggggugugcugugcaaggagccaugaagugucccauguggcggcauggccccuggagcaccucuaggagggccagcauucacaacccaacagaugcaaguucacccccacccaagcccagauacuauuucaaagucggggcaugaagugggacuugcaaggacaugcaaggacauggucuaaaaggugccuuagccugucguugacagggcaaaggaaaggagcccggaacggggaagggacggcagggagugcaggaagggauuaggugugccccacacgcuaagccucugccucccccagcaggcacacgcagaccugcagcucggauccucauagccagaggguccgaggagcugggccaggcgaugaaucaucacccugauggggacagaaaacaucagcuuugcaggucccacggccugucugacacaacacgcaagggauuuucccgacaguaucauccguuuagcugauggcccugaaguauuucauuuagcuggaaaucacgccugguccauuucccagagccggcugacauuaugagaagcccgugugacgugccugcaggaaggcagcucaauaccccgucaccugcagucagggccccacuacccucacacgggagcacggggcucagguggcuucuagagcagaauugcugcuuccugcuaggaugggcucauagcaagccgggguguguguguguguguguguguguguguguguguguguguguacaugguuuggaaaacaguuuaucacacggcaccaaauugucacaggucucccuggcuauucugucagacucucccauucccuuccuggauuuaucucccuugauggaccaggaguuuauuaucuccaaacuauuccaaugacucgaaugcaaggucuccggcccugauuccacagccagugagcagcaacgcucagggauccugacuugauccaugaauucagaggcugugcccuucacugugguccaugcccccguccccaagaccugcuuuaugguaugucacgcuaccugggaagguuuuaggaagggcucaagucucauaaccaagggcacggucagugagccugaucgagccugcuccguucuggaagaauaccuuucccaagaccaaagggcucugucgcucucugagcccuugugugucagcacucuuuguggcacaagcuggagcacuuggguguccaucagacaugcaaaugaacaaaugggugaaugaacggacaaguaaauaaaugucacgccugacugaacacugucaccuacggcuccagccgagcgccaccgugucccccgucacagggcacuucccaucagggaggcuucucuuacagaauucaauccuuucugaguugccucuaauguucugcgugauggcuucugagaaagccaugccaucaaucugugaagaagcccagcauuuccugccucuggcccugcugccuggcaggcuccuuggcgaguuccccaccaggacauacucugccgcuaagugaccacaagaccagauuggaggggggcagcugugucacugucugaggggugugaggccugaagggugggaaacaggagaugguguggcuuuaaugauuacaagucuuuccucagacaccaucucugcugugucucuccgcucuuggacacuucccgucuguaccugggguuuggaggaggucaaaagucaaagcuggacccauggcagugggcugagauaaggagcgugcuuggcuccugggacauaguuauuggguuugguuuuuaugauuuauuuuuauuucgugucuacgggugaguugccugcauguaugucugugcauaacaguuaugcagugccuggagaagcaagaaaagggcgucgugccccuagaaucggagcuacagaugguugugagccaccaugugggugcugggaaccaaaccuggguccucugccacagugguuaguacucagucucagagccaugucucuaggccuguggacucagacaugugugcucuggaagcacuccgguaggguaacagccauggguggaugugcugggcuaggggcacagaaaggaguuccuuucucccugcugagcucagaccguaccagccauggccuucuagaguaacgagugagauuccugaccuucugggaggauaagagccacaggguugaggcagccccugugcaaccauuugaauugcaacaucucccacuugagagagaagagaggcuugcaaggccuaagaaacucauaagccucaggaagcucacaaaaccuacaagauucaggaagcagucaacuauuggguaggagagaaacucuucagaggagcugccuacaguuugggcagagagcuccagaaauuuugugugucaccacccaugcugggguggguuuuuuaacaaccgccagacccccauaugcuccuguaggauguccaaauaaacucgcugauucaccaagcuaaacuuagguagcaucauuucuuuggucuauugucagugcccucucugggugguuuucaccucuuuccagggugucacguagcaccacaggcacccagauacuaucagaaccagagauccucugugaagagcagcugcgcagccccugguguaggucacucugggaugugcaacugaggcuggucugucugagaccggagcauccauagggacaaucuugaugagccacaggguugaggcagccccugugcaaccauuugaauugcaacaucucccacuugagagagaagagaggcuugcaagcccuaagaaacucauaagccucaggaagcucacaaaaccuacaagaaacaccuguuccuauccaguacauggugugcugucugccguggaugauaagacacgcuaacagauacugagaagccugaguguggcauguucuuaggggcaaucccagaguggccaccuuccuccauguaagugggugacaugcuuccuuaaugaauggggcccaccaagagaguacagagcacccccucccagugucuggagaaauggaacucauugguauuagacauauggggcagaauugcaagcagguucugcuaauaguugcacggccccagcugugggcaauaagacaugcaacggagccaauucuauguguguugucugcagggaaaggagaugccacagagccacagaagguaggacucaugagaggaugacuuacagaagucagguuagucucugacugggagagagagagagagagagagagagagagagagagagagagagagagagagagagagagagagagagagagagagagagaaugaauaugaaggugucagcuugcuauuucccacagccaaggggaaaggaacuuaagaugcauccaugcugaagauccacuccugggauucaagaacuauaagcccaugggggaaacaggggaggggggaagagugggaggcaugcgcaccagaagcugugccucggaccugaccuuugacauagaggaaaagucccugguuuugccugugugagggcguccagggaacguacgacaaucagggauugcucuccaucugaacugcuaaagcuggggaaggcuuuuuaaagagaaaugaaagcuggagagauggagagacgguucagucucuaaaggcucauaaucacaacgaaaugagagcuucucacaggcuggccugagacucugcaggacagggaggcccacggggcuacacucugagugccucgggaguggaagaucugaguaccguaucgucacuccucagacaagagcuggagaaucugagacagugcaaaggaacuuggucccugauggacagguccaugggagccauuagggacgcucagguccugccaacugagguucccacgggagccuauuugaguuccucucugggacuagauggcagaggaagggcagauauuacugauggaacugaggguuccgaggaugguguucuggguggggcuguguucaaaggaaagccaacaaagaaguuaguggaauggaagagaggguagaaagaccaugggcgcccaagguuagggggagcagaggaaaccagcgccaucuggacuugucaagacccacacucauggcagcugugguuguauucgcaggacugugcaaaucaggccagucaacagugcaguguggguggggacgggcucaugggccuccaccccucgcugaggagugacugacucauggcugcuaaagaacgaagaguuuucuuuagggguggggcccuuguuagguuggccauaggcuccuggauaccacauucauaugggaacacuaguuagacacaguggguugcucuuuauuuaaaggaagggggaaaagaccaugaaguugaugaagaugugggggcauccugaaguuuagagggaugaguguaauuaaauuguauugucuauguguaugaaaugcuagaagaguaaauaaaagcccuauauuaaaaauuaagaaauuagagcuggagagauggcucggcaguuaagagcauuggcugcucuuccagagguccugaguucaauucccggcaaccacaugguggcucacaagcaucuguaaugggaucugaugcccucuucugaugugcauuaaggcagaguguucaaauacauaaaauacaugaauaaacaaauugaaaaaaaaaagaagacguuaauucaucagggaccuuguaacuauuuugagcuuuaguggcuuugcugaaccccauaguagaccauuaugaaauggauggaucucagacauauucaucaugcaaccaagcaccaaggcaauccaagggaauggagaugggaaaccagacaaaggaaucauuggggucacucaaagauuugugucaagcccaaguucccaggggaaaaaguugacagagucaaaugugccaugaggccccuggaagaugcuaaaucccaaguaacaggcaaccaacgaguuaguggggcuacggagguagcuauuuccuccagguacaccguguaccauuccuagaagggaugaucauucacccaggaccuugucaggaaccaauuauagccaauggcaaggcaauagcuuuggccuggugucugcccagagacucuaagucagagggagcccuguagaggguaccaggcagaagagguggaguguuguauaguuauguccucugaauucaaacauuuccucucaggagcauggagacucacaagacucuggaaucuuacagaacuuacugaguaagcaggcuaauggaacaagauucuuccaggacuuacauaagcaauaaacggggaagauccucucggguggagcugccugcgggcuguguggggagccacaggggguguagcuuucaugaguucucacuugucugcaacgcuucgcagcugcccaagucagacacauucauauaagagacccucgcucuugaaugaccccaauaaaagucggugguuugacaagcuagauuuggcugaguuucuuugaucuguugcuggugcccuaucuggggugaacagacauuuguccacauugccuuaggaaaagucccacaacuuuguuuuuccuggacucacagagaacagagcaaggaugacagcccaaagacugcgaguagcaaacucucaguggucaacaagaaggaagacgcuaucuucagagccuaaggagggaaacuggcaggacaagaaucuucccagaaugcccugcuuccuccuugcucuguaagaccugaagcauaagauuuuagaaguuguucuauccuuugaagggccugggauuucuaccauggcaacucagaagugaucuauuucaaaccaaaaguaucugagucucucacuccgagaaugucuuaagccccuuuaggguuucaugucuggauaaggcuuucucaaacauggacucuggauaaugucagcucaggcagcugugacaaagggucgcagauugaacccacaccuucacgggucuggaggggagaagucagagaugagggagcugguagauucuucuuccuucucuucccuccucugcucaucccuuccuuuucuaaaauuaccuacaugcauacaugucugggcauacgugugccgugccaguagauccucuggggccagaguugcaggcagccgugagcugccuagugugagugacaggagcggaaccuggaccuucugcaaauguagcguuugcuaucaaccucugagcaaucuuuuccagcuccugauagauuuuucuagaugaggcuucuuucugaccaccucacuuugaguccucacaaggugggcaaaagagugggagagagccaugcaugcccaguccuucccacgcugaucccaucaguggggccccgccucguagccucacuuaaacagaucaccucaaacugucaucccauuggaccaggggugcucagacaucuggaccguuccauucaauaaauccuucauaaagaccugcacacagacucaugcauauggacacuuauacagagacucaugcagacucacacacacacacacacacacacacacacacacacacacacagaucugcaccuaugcacagcccacucgaucacacucgugucagacagcugaaccacaaugcucucuccucaauacgcucuaauagcaauuaccuucuugaacaacagacccuacagacgcagacacuggaaacacagcauuuggcugaguguccgucagaaagggcagccaacggaacaaccacacagugucaggcagcucacggggagacauucagccugugugagagaguaucccuuuccagcacguccuuaagacccaucuguguacaauuagcgcaaaaggccuuguuaauaacaggccuguaucgcuguuguauuugaaacugaugucacuguaggacgucucucaaaaggcuugaagaggcucuucaauagccaagguaaugauggccagaaaucccucaucagcuaacucacccuccagaacuacacaggccaaugagaacagaccaaacacacuaaccucacaccauuauugugcuuggggggcagagacacuguaauaccauguuaccuauaagaaaauauguagcaguuugcaauaaagcuauuucuuuucuuuccuaaaauguauuucauuuucaauugugugugugaacaugagugcagugccuauggaggccaguagagggcauccuagggacaggcgcagaacagcagauacugcugcugaagacaccaugagcauaaaggagcagaaaagaauuggggguugacuaugccauuguacacccugacggggcuucaguuacaugagagcaugcacugaucuaagccuaucaauaguuuacucaguaucugcaccucucaccguauuuaaagucugucgacugaaagaacagcaaagaacacuugaacuccaagacacaacugugacaaccaguguguuuaaggaugagacguguuugacucgcuuugagaugcaagguuaaaauaagauggauggauggauggauggauggauggauggauggaugaguggguagguaggugggugaauggguggguggauggguagguagguggguagguagaugguuggauagauggacuugugauaaaguaagcaaauguugugaaggagcuggagagaugacucagcagcuaagaguacuuguugcuuuuguaacgaaauuaaguucaguucccagcacacaggcugugcagcucacacaugccuauaacuccagcuccuggggaucuagagcucucuucugaaccacaaggguccugugcacacacacacacacacacacacacacacacacacacacacacacacugagagagagagagagagagagagagagagagagagagagagagagagagagauuuuaaagggccauguaaaaauguugcaagaaaguauuggagauuuaucaaaagggugaagcagccaacauuugacugagcugggaauccaggaguccagauggacauaaauaaacaaguacauaaauaaauaaugcaaggcagcgcgagcccuucagugcggcagggcacacuaaacaacaagcaaauuuagcaaaaucaccaucuggcagacauuagaauaauugauucaauaagaaucaucaauggaagcuaagauaagugggcaaaaguuuaaugaaaaauaagguguuuauacagacccagacgguccucccacgagaugugaauuaauuacaaaguggggaagcguuuguguuuucaccaaagaaaugggcagaaaccaucugaaccagguugcagagugggcacugcacuuggcaacgcugagcccaagacgcagugaggaauugagucgcugucaugggugcuaugacagaggcauggccucuuuaugcagaagccccuggugacccacagcaaggcaggugccacagagaaaacacaucaaaaauggcagugcuggggccagagagagcucucaggguuaagagcacuuacugcucuuucacaggacccaggucaguucucagcacucauguaguggcucacaacuguccaaaucucaaguacacacacacacacacacacacacacacacacacacacaaaguggaaacacaguuuaggaaauaacuccacaugcagcauauuugccauaucugcccacggaucugaguuugauaccaggcuaucaugugaaaaagaaaacccauguguggcagugcaugauugcaaucacaacucuggaaaggagauagguggaucccuggggcuugcuggccacacauguaccugcacacauacaauuaaugaaccccauaucccagugagggacccugccucaaaaaucagcuccugaggaugaugcccucaugugcagucacauccagaaaugcaacuucguaacauacaugugcauaucugugcauacauaaacacacauguauaugcauguaccugcacacacacacacaaacauaagcaugaacuugcacacaagcacacacacauacacaugaauacauacaaacauacauacacauaucuuugugcacacaaacauaucuacaugcauuuauaugcacauauacauacccauaugcaucuguacacaaacaaauauucacacauaccuucaaacacauaaauacacgcauguccaaauauguauguguacacauguggacagacagacagacagacacacacacaccugcucacacacacacacagguggggaaucugaguuaagugcauacaagaauuucuuguuuuguuucuagaacuuuuaaaaaaaaauuaaguuacacaaaauuaaauuuuuuaaaugaucaaaaggucacagacugugaccaaucuuaacugguccaaaacugggagacaucugugacucagaaucccagaggauucugagaacuucuggagccacgugcccauuccgaggagacuuacggugguugcagcaugaguuggugcgcugugcagcagacagguggcgcucuugagcugaaacccgggguuucugcacacaucacuccagcuaguucuaacagauugucgcugacagaggacgggcuucucucagagagcgccaaggaacggaccugacagcugccuccccccacaccgcucuggaaccaccaucaaagacgcaauuaauaagccaagggcgagacuccucuuucucacacagcuucagauaugaaucaaccccaaaguguuaauagaucacccgcuaucucuaggaccaaauacaauuugcauuugagaugacaucugcaauauuuuaaaagcucaagucuaaaacaacaaacuuggcagcuuuucugaguagcaauuaacgcggugacuaaucccaucaaggagacaguaauuggcguggagaucuccccucacaccagccgcagguugagaaacuuaauccuaaccucuuuuuaacaguguaggcuccggagccucucugcucaucgagggaacaaacgcaguuauuaaggacaaggguaauuacccuccugcuccaacaacaaccacaaaggauuguguaaacagcaggcuggcacaggguagccuggaucacagagaaagcucuguuauagccuaguccagguaggcgauggcaccucugccucuguggagggucaaccccagccccagccccagccccagaugcagcuuccucugcaaagauggcaagugcugaucuacucagugaagagcggagugcgagcagagcgcagccugugggcggcugggcagugcagcuagaccccugcuggcuuacgcucagugcacucgauucaguuaccguuuccaagcaggugcucuccccacaucuguggacaucccuccugucccccaggcccuuggugcacacggagcuccaaguuucccccucugagccacagcacacacagagaggcacacacugacucugccuccugcaggcuggugcccuccguggaacagcauguucuaaggugcuaaacauuauaaccaaaacgugggguuaagggguuuauucaucuugcaagguacaaucugugguggagccaagucagggcaggcaccaggaggcagggcuaaggcagaggccaucacuugcucaaguugcuuucuuauacacccugggaccacucgcccagggguggcaccacucacagugggcuggacccucccauagcaaucauuaauuaagaaaaugccucacagacuuacuuacaggccaaucugauggaggcauauuugcuccauggagguucccucuucccagguaacucuagugugugucaaguuggcaaaacccaaccaggacucaacagguuccugagacucuccccugaugcacccugggucaccuaacaugaggagaccgaugggaagguucuagcaacaacuucccaaggucuuggguguucaaugucacccaguaucuaugacgugaugauagagagucuucucaccacgcacauuucagcugaccagguaacuguagagcucucagugaggucugggguguaucuucacagugaggucugggguguaucuucacagugaggucugggguguaucuucacagugaggucugggguguaucuucacagugaggucugggguguaucuucacagugaggucugggguguaucuucacagugaggucugagguguaucuucacagugaggucugggguguaucuucacagugaggucuaggguguaucuucguuaucaaaugaauggguagccggugaguauaugcacaugcacaugaaugaucauaaaaacgacccagcugugacaagcacugacuacugcgcuuguuggcaaagcaaguggagcuagaaaaauaggggcaaagcgggugucagcuguaccuggacugccaccuauggucaugugcuacuggccauggaagaaccgagcaagaggcagggggccuccaucucuuaagggacguggcaccccguguacaauggaugagccagcacuugauugggcauggaaacuucuucccugcaggcuggcucgauuaccuacuaucacuuaguaacacccuggguuugggcuagcagcugaggggauguccggggcugggaagguaggagauuuccuucauccaggggugggaagggcucaguucucaugaagaugggaagagcuguaaguagaucucaaauccugaaggagaaucagagagagggaggagaggacggcagaggagagaaugaacaccaggaauuuggucaggggcggguaaggagggucuccagggcaggguguuguagauguccuggcucugggcaucacggcagggaacagggcugauccucaauccacucacuggaaguggagcuccuaucaaaggugggcacugaguugcuggugacugugcaggacgaaaacggggcggagcuuuuagacagugcgcgcauuugcuuccucgcaaagcuucgauagcuaggaaagagugagcagcacgccggucucuucguucacuuuacacagaaacucauugccguugcugucgcucacacggcaccccagacguuugcuggacagcccuggugucacgcagaggcgucuucuaccgcaaacgucuuuucuccaauuacggugagagccccuuccgggugggaacugggaauuauccaucccuaagcccuguacagagcccagcaaggcuccaaacucagcugcuaugcagugguugcuaauguggauacuaacacugcaguuacagauccaagcacggcagcucagaacuuccuccgggaggccuguccugaggcugguguaccucaccgcacaggcacaaugagguuuuguagaagcaccugucggggucauggaaggggagccaguguccgucugaguggcaggaacagccagagacucgggcuaugaaaauguacagcccacagaaaccagccccagagggcucuuuggauuggaauuuaagggggaaaagugcuucuccaccguccauuguucuucagauugacagaauuugaagacugaaagcaguuuuauugggggaacaaaacuacuaggaaaccccacguuaggagaucaaacaggaacggugucaauaaguaggggcacauagaggcugacuuucagaagucauuaugcagaaguccagcuugcaguacaaaauaugcaggaauauacuuacugugguauguguaaaacuucuaagaaaagaagaacacuugugaguuagcaccaagcaugguaggcaacagcuccuagaugagugacugacucggugucggaaggaggccaccugucccuggacugauuuacaaacugaaucccuuacuacggagcuacacaaaucaacgcuagaaguucacucaggaaaauaaaauuuaaguauaucuuggaggacaaggagaagcagaggugucacucgggugugucagagacacaacucccaggcaccacugccacaggacagccauaaguaaagcagcaauucuccugccucagauguggaacaggaaacaaaguguggguagucacuggguagucacccaacugcagcuggaaauucaguguaggauaagcguggcucucaggccacugcagaagggaguguuuuguuuuguuuuguuuuguuuuguuuuaauaacuguugcuggaacaacaggcaaauaaucuagaagaagauaaaauuagaucuauaccucacacucaacccaagcuuaaaccccaggugggucaaagaagcacaucuuaaaaaggaaauugcagaaauacuagaaaaugcaucaauuucaacaauucggguguagaaccaagguuuucuuacuauaucauaaaauuauaaacucagggacagagagaaaucaguaccauauagcuauguagaaauaaagauagcaguuaugcacaauacaagauaaaaaauaaaaaaagaacugaaaagguaucacaguacaaacaaacugaaggacacugcaguggcuacaucagugggagacaaaguagacuucaaagcaaagagguuagcaggugcaaaggagaacauugcacacagacacaagccacgcacaggcacagacgcacagacgcacagacguacagcucauagacgcacagacgcacagccaaaaggguuuguucuuucuccuuugggaaguaaugauuacaaacacacaggcacuagauaacaacaacaaacacacaaagaagcgaacugaccgaguuggguaauucaacuacaguccucggagauuucaaagcucugauuucaguaacagauagaagaaauaaaaugcuggccaggaaaugaaaggaggccccggggcacacaguucacaugcgagcaagccuagcacacgucuggggaugcugaagaaacaauccuggguuuggacaucauuuuaagcgugggggucucuaaaaaguacagaucagagucuaacgaucuuccuucugggcacacacucagugagauuauuaucaguucacaaagauacugaagcacuauguucacaguugcauuauacauacacgugcauacgcacauauauaacaugcugcccgagcgcgcgcgcgcacacacacacauuuauuauaauacuagugagcuuuaaacauagaacaagucuuuccaauugccccaacauggaugguguauguguugggggaugauaugcuaaauuaaagaagccacagaaggaaguaauggcugucugcggugucacacguacaacccaaaccuccaaauacacagagacgaggaacucaacaaugauugccagugguagaugugaaggaaggaccggggagugcaggguuugaauccaaggcagcacauguagagagcaugaauaguccagagaucucuggaaacaccaugagggccauggguagcaagggguagagaacagcaaacgcaacauuaacauucucaaaucacgggucuagugaugaacuuauuguaucuugacuucacaaagaguucuaauuugaucauaaaaagcagaggaaaaaaaaagacuugacaaagacuaggagcaagcauuucuccaaggaagauaagcaaauauucacaaaaggcacucagagucagcagcccccaggaauggacuaucaaacccacugugggauaucacagugcacacaguaggaugucccggugcacacagugggaugucaugguguauacagugauagaaaagcaucagucagcaacccagguugaagaauggagcucacuggccaccagccucuuccugagcagcuaguuccaggucccaaaggucccagcgagaaacucuauauaaaaaaaggcacacacaacacaugcauguacacacauacuaacacacaugcaugcauauucaauacacacacucgaaugcaugcacacacacaugaacacacucacaugcaugcacacauucacaugcaugcacacacucacaaacacacacaugcaagcacacguacacgcaugccaaguacacacaugcacacacacauacucacacauccacacucacauguaugcacacucacacacaugcacucacacgcaugcacacacacacacacaugcaagcacacauacauauauacacaugcauucacacacaacacaugcauguacacacauacuaacacacauguaugaaugcauacucacacaugcacgcacaugcaugcacauacauguauacacacaugcacaaucauacaugcacacacauacacaaucauacaugcacacacaugcacacagcacacuuuuguaaauuuuuuguuuguuuguuuguuuguuuguuuguuucaaggguuucucuguauagcccuggcuguccugggacucacuuuguagaccaggcuggccucaaacucagaaaucugccugccucugacucccgagugcugggauuaaaggugugcgccaccaggcccgguuuacuuuuguaaauuuaaacuaaauauugaagguaaguugauggcugcauagaguuggggguggggggagucuaauuuagauagaaagacuguaggaugguagcuaaaugaaaaggcauuuuuugagguaacaaaauguuaacuaagagcaggucuuaucugucaucauacuaaaauccauuugacauugugcacuugaaaucgguggauuaggguauccccuaauggcugagaaauggcugagcacuuaagagcuuugguuucacaggacccagguuuaguucccaggacguacaagguagcucacaccaucuguaacuccagucccagugcaugcgacacccucuucuggccucugcagggacccaggcacacacauggugcacagacauacaugcaggcaaaacacccauacacauaaaacaauauaaauaaucuaaauggguggauuauacaguagauaaguuauaucacaauaaaaucgcucauaaaacuguuuucaguuugacaagaagcaugaugaucauaaaguccccaaguaucacuccauaagauauuuaucaggguuuuuuaaagccagaaaauacggagaguacaggcgccugucaggccgccuuaaucaugccaucaguuaacaccaaccaggaaggggguuagacaugaggagccuccagauaagacaggcuaaaaaggcugacaucaccucuggggugcuccgagcuacgcuaagugaccgguuccaaccaugagagaacaucaagcacaccagagacaacggggcauuccacaaauaccauuauucuccaaagguuugaauccagguggagaaccugacuuacaagaucaaagaaaagucaccgugguuagaguccuggagcaaaauccaggacagcagccuccuuggucugcuaugaaaaacucuaaugggggaauuguugggauuuccgagagagauggggauuaaauaacaauaauguaucaauguuaguuucuccacgucauaggcuuucucaaagauugggaggcaagucccaggcaguccaagagaaaaagcucccauuggccccuagcaacacuguggggcgagaaucuugggugaagggagagcuuggacucaguuuggaaaaggaaggaggggagacaaagaccucucccugggggaacugggugggaagucaauaaggacguguacggaaacguggaaauguacagaacaggaggucaaacuuaggaggaaaggagaggucaaaggugagauaaaauggagcagucggaaggagacugagcaaaaccagagggagccagggaagccguggguguugggagagauggcaccaaucagaaacaauguuacagauguagccaggagauccuggaagaagccagcuuggccagcgagcuaggagugaccagugacagucacuuuagaagugaggccaaggaggugaggggacucucgggugguucugagagaacccccacacuuuugaacauagggaugacguguaagggacagguucugcaaucuucuccagagugacaaccagagaguaagggacacuggcugguuuacaacucccucugcggaaagucagggucagcagcacacacacuugauucuccuuagacacugcauugcugggucugggaccacugcccugggacauccugagcacugggaagauagcccuucucugcucccaguggcaaggccauccaugcugugacgaugccuacgacagacaugggccugcccugcugaucucugcuaagggagacugaguaagaucgcugccuucugcuggcuucccaaccaaggaaaugcugucccugagacaggcaggggaaaaagcggaccacaggggccaaccuggccaagccucuccuuccucuuuguccucaccucccccacaaugagugcuaacccaggaaagccugaccaucugacagggaagcuauaacagacagaccaggaaaagaacagaaauucugcucugauccaccaagcaauggaucagagcaggaugcauagcuaaacaaagucaaccauaauuaguuuccuugggcugcguucuuugcaugguggggagugcacgauggaagauuacaugccaaguggcucacccuaaccuuuucaggagucuuccaaagugaauauguguauucccucaggccccucacagcuagucccugcuaagccagacauuaguaggucuacccauugcaucucacuacauauagcaagcuucuuugcucucugcucuggucuuguggcuagaucagucaugcauaccagcaaggagggauauguguauccaucaagcccaacuacuuauggcugggaucuugucuuugggaacuguaggcucuuucaggcucuuuccuggcccugccagucaacacuuaagagaaaaaaaaccuuccucuccccuugaugaagccacuucuagcucacuauccaaggcagugucaugcuuaacacaucaggaaaugcacauuucugcaguccaggauggguagauagaugauuggacauacaaaugggaacagaagauugcagauagauagauagauggauagauagauaaauagauaacauuaccuaaugauagauagauuacaugaugauagauaguuuacauaaugguugauaaauuacauaaugauugauagauugcauaauaauagauagauaauagauauauagauaguuacauagauucauagauagacagacagacaggcaggcaggcagauaggcaggcaggcagauaggcaggcaggcagacaauccacccuauucccuuccuauaucuaaggcuuauaacacaaugucaggcaaccaguccgugucuaucgcauacuugcaaaugucaagauaauaaaauauucaccgagaugucaucagagaaaacgaccacaaugagauuuaaaaggaaggucggcccucagaccuagucugaacuuucucuagaaacuuuuuuugagcagacuucguaacuaaugccuuuucaucacgacucagaacuggaaucaaaauauuaacacugcagcuuggcggucugugcgcgagaggcauccugguaaauaauuccugcuuauaacggcaugcuguggcuuuaaaucuuaccccagacaugaaaaaggacaguuaaaucaacuuuguccauuuaaauaucauuuuccgauaucuagaacccaucucuuuauugcucaacaacccuuagcaauuucuuuugcccucauuuauuucugguucccaggggaauccugucugauuuauuggaaauuaguucucacagcuaguaaaugcuuuaaacuguuuucauauaaaucacucuaaaaucugugagcacuggaguugagcuaaaaugaucucuuccaggaauacuacugagcucagccacacccucuguucuguggacgggucugacauuccuggagcaaagacaucaaccagaccgggcccucucuucccacuuucaucuuccauuugcagauagcgaucauagcauauuagauauuggcaaaccagcuuuuccugaagccuggaaacaccagggcacccagggcaaugugaaugagccaucgguggugggagaaugccacauuuccuguguccaccagcccgugucugccuccaucugucaggucagguucagcucugucguaguaacagagcguuuuacuuacugaucacaccgcauggcccuuggaguucugcuggggagucuggggccucguugucgcucagagucacagugaagggagcuuggcugugaguuuacuuucaaaauggucaggucaggaaaaggaagaugggaguggggagcgagacucugaauuugacaaucagaaaggugacgguggcgcuuccguucauccgcuaaaccaagaggcacaguuacccaaacaucacaaggucgggaggaauggaaaucccccuccauguucagaaggugaacaaaaccaauggccaccuggcugcucagcccuugugcccagggguaggccaggugcugguguguguguguauguguguguguguguguguguguguguguaugugugugugugugugugugugcgcgcacgcgcgcgcacgcgagugcacauguguucuuguguucauucuaccagacaucuagaaaccuuccuccaggccagcacacaggauccuacccugagaaguguggcggcucccacacagcaguggguaaaaugucuagcgcgauuuguaggaaucaaucugaaaaacaaaugguuguuaucaggguaacucccaggaauagacagagcucuucacauugacaaagaaaagaagccuggaaggcacgaggggaaacuaaaaaucacacaacucaaacacucucagcagaagagaagagccaaauaguucucuuagccccgagcuccuucaggggcugagagaagguggggucaggcgagggacagcuggacccacgggcgggcgcucugcaccgagccacggcuuuucuacuuugcucccuccucuccccgacucccacagacaguccuguuuucagaagaaacccuccaagcauuaccaugagacagcaggauaaaaugcugggcacgguaacgaauugcguacagcacggcguguagaaaucauuuuuaagcggagaacacccuucauggaccaaaaugaucuauaugcggacagacagggcccguguaucuuuuggagaaaugaucggaccuuauucaaugauuuaaagaacggcacuauaaaaaaaauaauuccacauauaaauauuuaaauauaguuuauuauauucaauaccuguccaaacauagccucucuauagaucuuuuuugccaacugcgcucaaaacccuggacuccaugugguacuaggaagaauguuuaaaaccgccgagaaaacuucaccaugcuuuggggaagacggagcuguuuuuuaaaaguaacuuacaagaacuaaaaaagguuauguuuugagcagauauugacaagagaaggggagugcggagggaaggaauuugguggaaguguuuauugcuuguuuucagguucugcuccuaaaaacacauugcuccacgagccagaaauagcucauacuaucagauacaguuuuguuucugaagcgcauccuuuaggggcugaagaccucaguuagaaggcugcucgccccgcgcacuccagacucggcacgccuuguaagcggggugugguggcacacgccuguaacggcagcaccugggccgugaagggacacaaguucaacgucagccucagcuacaaagugauuuccagggcagccggggcuacaugagucccuguccuaguuagcuucagcucggcaugcccgagaggagagaaccuauaugaagaaaccgccuccaucagauuugcuuguggguagggcauuuucuuaauugcuaauuaaauguagggaggcccagcccacugauggcagcaccauuccuaggcagaugggcccuggcuguguaaggaagauggcugaaugugagccaggaagugagccagcuucagcuccaacuccagguucacaccuuggugucucucauugaugacccuugaccuguaagccgauuaaacccuuuccuccccagguuaguuuuggucacuaugguuacaacagcaacagaaagcaacagggcaugcccugucuucacacaagaacaaaauauucuucaaauucaggcuccacgugggcauauguucauggauagaggcauccaucggugugagccucuaucugcaucagacggagggacacuggaaggacgguaaagucgacaccacguaccgcuuucccaggccucuucaaaugcccugucauuucggccucagggaggcauuaagaggaaccugcaucuggugacagcuccaggcugcuggccucuuccauaaaaucucccucgccccaugggcacauccugauuuuccagcuaagcagcuguucuguuccucuccagccgccguuccaagggccaccugcagggcucacaguguauccacuucugucauaaaccugagaaccaccaccuggacucugcacuugggaccagccaucgaguguguguguguguguguguguguguguguguguguguguguuugaccccggcuugucucucccucccucugguaggcucgugccaggagaacgauucugucuccugggcuggcccuuuauuguucauaaaguucuuucccccaccaccuucucuccuccuccucccacagaaguucccggaacucuccgggagucaggagcaucagcagguaugcggcugccacgacucacagaagaccauaaauuccaggcugugcuuggcucucuggagagaugugggacuugacaaauggcaugcucucuggagagcaaaggccucuuuuuuuuaaaggacaagagaaggggauuguacagagauggaauuuaauaauaaaaaaaauguuuauuacaaaagaugccagagcccucagagagcucugaugucaugggggucugaauuggggcgcugaaccccuggcugcuaccugaucugagcucucugcagaaggucaaggagaaacuuguagagucuacccagagaccccgugugugugugugugugugugugugugugcgcacacacacaugugcacacauguacccauguuuguacggacacaugugugugcacacauacaugaaggccagaagacaaccucucagaauugacccaccuuguuuuucccaccuuguuuuuugagacaggguuucucacugaccuggaacaugccaaggagaacaucuggccaucccucgagucccaggaaccagcuugucucuguguugcucauuguugcuggaguuacaagcauguaccacuacacuugacuucuuaaaucugguuucuagggauggaaugcuggucuucaccugagcaaggccagcauuuuacugagggucuugucucacuccaccccuuaccccaucccugccucuuccucucucccuuaggaauuuccuuuguucugugacuuugggcaaguccuauaacccacuccccccaccccacaacccccacccccgcuaaguccacuucuuaaucuguaaaguaggaggcacagaucucacucagaggauuguggaaaagacugacaguuuugaguaugucugugaggagacaguuccacggggucugguccucgaagccaugccacugcccuggcauguggcucuuggcucaguggcuagcugugaucaaggacacagaugucccaucugaguaucugcuaguccuaggcuguagcuuucauacauuugugcuuccaggaguuccuccccauaaugucccagcauccccugccagggcaugugacuuugucucucucaccuugggguuuguuuauaaaacccuggcacgcucccuuggaaagaauacccaaagacauuccggugccagcagaaaucaggugguaccgucccagccaaggcuaacugcccgccaacaucagaaacccccccugcccaguggcagcccucaucgaaagauauggagggaggggcugggugcaaacacccucccaacacagaugccuuagaaacccaggcccugauucuaguuccuucuccugcugcugugacaagagaagcuuaagaaagggaggguuuaaaccauccauugcuauccgaaggcauguggcagggucacugcacccaccaucaggaagcagagagagauggaugcuggugcucagcucgcugucugcuuuugacucagucugggaccccagcacaggagaccuccaugcccacaugcagggugggaccucccuccucaguuaagucagccuaguaacaacuucacaggcacgcucagaggccugucuccuaggugacucuacaguccaucaaaacgacaaccaauauuaacccucacgcucuaaccacagugacaaccagugagcuacaaacugcugguccgagauggcgguggucacacagcauccccacauauggucaugaaaauagcaucccugacuucuuucagugagcuucuacugagacucagcuucccugccuuggcccacacuccaacgaacggaagaaaaggacugugucauagauggagaugccagugcacagagguagccucugcgcccagguaaaucaaaaaguuccagacucucugaaagggaccccagguucccagacaccagcuggucugucccucccagacacuacaggaagagaaugccuuuucuuagagaaauaaccaggucggauaauaucucagugagacuuggguuccugggggugcuggccaaccaugcagaagcugucagugacgaaucggauccaagacaucccucccauccguuaccccccacuucagucccuugugccuugcagcugugccagauguagagaaaauuacauguucccugaaacuuaaugaccaaauuuaaagcaauuuccaacuaaucaggguucuguuaaguugcuuuuauuaauuuaacgguuuuaagggccucacaaacgaugccguuggaaaucuuugugguggaaucuguucacuugggugaaggagggauggcgggccaccuggccagcccgccucagagccaaggacucugcaaagacaccaaguaagacuucuggaaaugccuugguguugauugcccagugugcaauggacuaacauccuucuccucucuccaugcuaucugggaugauugacagcugguccugucgucuacugaccgcgaaggaauggcgcuugccaccggaaccagaguaucccccccucccccauaacccgaaucugcugaaccuccauucaaagcuaggccccagaaccaagcuaucgaauguccgaccuggcgauucccuauuucaaacagaaauaaaacugcuuauuucauauuaagacugcugacaggccuggcuucccucccauguccaagggcccuucuaggcagagcugcgcucaaauuaaagcaaacaagcagaaugccaggcaucugcuaaugaucucugaauccugcaagcacaggguguagcgucuccuuucaaaagcugagucagaauuuaaaauccauaauuuaaaaguuacuauguauuccuaacuacgaaaauguuggaucauuacagaaauaaauagccucuaccuacaaagcugugugacuuuaaguaaauaacuccaccccucugagcugauuucugcacauguaaaacauggcugucuuccuucacagggugauuuguggggguaaaugaguuguuuaaaaugcuuacagcagagccugccucccagugagcguauggauaaauauuaacuacagccauuauguguacuuggaauaaaugggcacugugacugggagcuuguguuuuaugacuucuucauaaggcuuacuguagcucuauuuuugaauugcaaaacaaaacacuaguuuauuuuccuguaauaaaaaccacucaaacaauuggaaguauaacaagaaaaacuugaaauucucccuccccaacuaacuuucaccucuuuuucagaaacaaucacagccaacaacuuugcgcauauguucccagagggguccguguuuaugguuuauuaacuuuguuaauuuguaaaauguuuauguaugugugucuuuguagcuaucuguccaugucagugcaauauuugaagaggccagaagagggcgccaaguuccaugcagcuggagggacacaugguucaagacaucacaugggugcugccaaccaaacucagguccccugcaagagcagcaagagauggcuuaacuacugagcccucucuccagcuuuguguguauggcuuauaaaggaauaaauacugccugcucuuguagagaaguuggauuuaauguccaucaucuauaugguggcucacaacuaucuguaacuccaguuccaggggauccaagaccuuccgguuuccaugggcaccaggcucauacccagggcacagacacgcacacaggcaagacacucauacacauaaaacaaaauaaauaaaucuaaauauaaaggcauacauaugcauaugggguuauguaacugaaugcuggagucaugaaaaguuuggcaauuaaaagaucccugcacagacaaggagcaaaaaugaauuccaaauccaacacauaaugauucugaaggcuuucucaguguucucugaugcugaggguucaugggaaaacuuucccguguugcaucacgggaccucauaccaugucacaccaacagacacugaaucaccugagcucagauucaagacuaucguuacguggugaguuagcuuguuuccucuguaaacacagucuucuguucuuacaaaaagcaaguucauaaucuggagcuguggcuccaugguuacgagcauguucugcucuuacagaugacccggauuuggugacucacagccaauuuuaauuucagcuccagagaaucuaacacugccgggcucagcagguccugcauccauguguacacacacacacacagagaaacacacacacacagaaacacacacacacagaaacacacgugcauacacacacacaaacacacaugugcguacacacacacaaacacacaugugcauacacacacacaaacacacaugcucugcacacacacccauacacaggcacacguccacacacaauuaagaauaaaucugaagugauuuaguuacagaagacaaugguuuucaguguucccucccaucauuccccagcacgugagcaucaaauuaaaguacccuuggauuggcguauguuaaacuguuugaauuuaaaaauuaccguuugaguugcugguuugagauucauaaaaucauuaaaugaauuuuggcuugagguuaggaugaaauuuucaacaguuucuaaaauauauuucugccgguuugugcuguguguuuaugcaaagcaguauuuucaacauugaggguuauaaaaccaaaacaccagccaccugaagagcacugacggugccccacguccugcagcagcaaacguucagccaagauucaauucuucuuguaaaaauagguaaucccauucaucuaacugugcaaacuggcuuccauuuucaauaaacgauaaacuuauaugugcgucaaauauuuguuuuaaaauaaacuccauaaaagugacuuuaaagaaagaaaccuuaaagggucuggagagauggcucaguggucaaaagcacuugcugcucuuguggaggacccaaguuugguuuccagcauccauguugggugacccacagugaccugucacccagcuucaggggauccaacacccucuccuggccucugaugggacuacauucauaugcacauagccugacacagacagcagacagacaaacagacacacauacacacauaugcauauacauauaauuuuaaguguuuucaauuaguauguuuuauuaugaguaaagauucagcuuugcuuauauacccuaggcagguaaaaaugauaaacacuucucuguugaaaaggaaucgugaacaaaagguuacauagcucuggcuuaccuuauacuuaguagguacaugcauacacaggcaugcacaugcgcacacacacacacacacacacacacacacacucacacacaagcacacucucauguagucacacauauaacuuuaauuucuucuaugucuugcuuuuucccuuacuaacaaacccugggcuucugucagcuuuuuaaucuuacucuuuuuuacucuugauuucaucuuacucaucuccugugcacgugggaugugggcuggcugaggcacaccugugaagaucagaggacagcaugagggaguggcuaucaugugagugccagggguugaauucacauugccaggcuuggggacagguaucuuuaccagaggguccauguggcuagucucaggguccauuccuuuccacuguuccaugcuacuuacuucaggguccauguggcacaccuaacuuucccccgagugacagacacuuagguuuuucucuagcaucucccacccaggaaggacucuguguauggccuuguguccuagaugacagcaaaugacucggguggagugacagacagaacacaaaguuagaauugcccgguggaaaacagaugucugcguuugcacguuacccgguagugaaaucacgcuugaguuaucacaccugacaucacuucaugcuccucagaaugguuaccaguuuaaaagcaggcagaguuuuuaaugggaacagccaggggacaggccucggggaagaagcaacagcguuguccugcuaaguggacauuuuacgcugccucccgaugacuccccacaauacucauagauuggcaucuccccacccucaucagagaagcuuccauuggcagucaauggagaucagcucagagaccagcaacugguuggggaacagagaacacaugguggcucacaguguucagcacuaaacaggacaucuaugucacaccccuccucccgagguggaagaaacacuauaagagccagagacagugggggacuguccucaacacaacaggacagcugugcauagacaucacagagguugugacagugugcacaagaccugugccugcucaagccagucaaaaucccagcaugcagaagggacgucacagagucccccccuuacccaaggagcgccugccaacugaucacuucuauuuucuucauggauguguauguaugauuucugguuuuguugggguuguuuguguuguuuugagacaggauuucacuacuguggccaugacuggccugggacucacuuuguagaucaggcucggccucaggcucacaagauccgccugccucugcucaccaaaugcuagcuuuaaaggcaugucccaccaugccgaguagagagucaguuucaaaaguguggcuccugguagauuggccaugccgccaaggaugccacacauuugaaaguaagcgagcagcacaaguuguacuugacagguuuaaauguuuaaaaagaggaugcaaagucggguggguaaggaauggaggaauggauccccgugguggugguggugguggguugcaggagggggaaaugagagcagaacacccuguccaacauuuucaaagaucuaauaaagaugagaaaaauggaggugggggugcuggggugauggcucaauugugaagcacugccuuggaacacugcuauagugcacugccuuggagcacuaccuuggagcacugccuuggagcacuaccuuggagcacugccuuggagcacuaccuuggagcacugccuuagagcacugccuuagagcacugccuuggagcacugccuuggagcaugagcaccugacuuugagccacauaaaaaauccagguguguuggcauucacuaguaauccugacccuggagagaugaagagagagagaucccaggggcucaguggcuggccagccuaacuggcaagcuccagaccaguaaaggagucucaaacacaaauggcaggcaccgucugagcaauggcagcucagggugaauuacaguucccacacaugugugcaccaucuccccaacacacgcauggcgauaagugcugacagggaaauccgaacaagggggccuuacuuggggcgagguguaagugguaccguagcuaugaaacuaaugugacagguccuugaguaaucagccgugaacuugccguuggccaggcuguucugccugggagcaugcaccuaagagagaaaugagauggggaagguguaccagagucuguagcagacuguccucacggucgggagaggaaaacaagccagauguucaucgaggugagccgauaaacaagagauggagugugacagaauauuguucucuuuagaggugagaagggagggcggcauacuauaggaggaacuaaugccaaaggcacagggacagaagaucugaugguggcugacuggcauugggaaaagaauggacauucuguggauggaugcuggagauguuugcacauaguggggcugcaaccaacaccaccaaacuagguuuuggcuugguuuggcuugguuugguuugguuuccugacacaggguuucucugcauaguccuggauguccuggaacucacucuccauauagaucagguuggccuugaauucagagaucugccuaccucugccuccagagugcugggaguuaaguuggaugccaccacugccuggcuaaugccaccaaucuguucacuuggagaugugucuagaaagugaugugugcuuugucauaauuuuuuuuuuaauguaacuguguuuuaagcccuuucccaaaucuacuuuggagaagcaguuacuucaaagaguucugggugguggcuggagagauugucuagugguuaagagcacuugcuguucuugcagaggaccuggguucaguucccagcacccaccuugcagcucacaacuuucuacuauaacuccugcucuuagggagaugggaugcccucuucuggccuucucagguacugcacacauguggugcacauacacacaugcagauaaaacacuuguaugugcaugcacacacaaacacacacacacacacacacacacacacacacacacacacacagagagagagagagagagagagagagagagagagagagagagagagagagccaaacagcuauccagggaugcaggccccauucacuguccaagacuagagugaggggggcaggcauugccuagaaacaccuuacccacaaggauuacaaugaaaagugggagggaaggguauguggguccugaaaucccuggacaggcacacugggguuccucuuacucugucacuuucuguuuguuuaaaaaugaugucacuguuuuaagaacacaucuuuucaguaagaaagugccaucaaaccuuauucagaaaaaucuccaaggccuggguccccagcugcacagauuuuaugaucuaguuuuuaaaauuuuaauggagagacaaacaggggauugacaacuuuuuauuccucuaaguaaggauguuuuuaaaaagccaucugcuuucaaaauuguucauaaaagaagguaugguuugcacugaaacagcaacuggggcauaaacgagucuuuccucaacaaggaaugccauucccucaaacugacaguccaugguggugcuguccuugcuccuguguucuggcuggcuggccaaggcucuggaaugggaucauaucccccagcccacccuccucaccuacaaaugugucaacuucaaugugucucagaugcggcagcccauccugcccugggcccugaggcccuguggcccuuagucccuguggccccacugcccugaagccccguggcccuguggcucugccaaauugucagggccagugucucagagagccucaccucuccccagauccucuguucaccacugagcaucccagcccuccucucugaaccuaugagcacagcccuuccccaccaggagaugcugaacacaauacccagaagacagaagcacaggucaggaaagauucuggagaacgccuugcccagagagacauguuucaccagaagccacauggaugauaucaaccagcagacuguguaaccccacucaagaaagagucccugcuacaccccaccagggaggcuguugacuacaccaaccagggaauguacaaauaggacccaccaggagcucugauugcaccacagugucucccgcaucccacccaucacacuaaaucacacccccaaggaaaccaugaauuacacccaccaguaagauccugaaugacacgccgccaaagcaacuguaccaugucccuccauggagacuacagugcaauccuuugcaaagacuguacuaaccccaccauagagacuaugcuaugcuucucuguggagccccauguugcaaaccccccuucagggaaauguugaauggagcuauguaccugguucuauaugucucuccacucucuucuugcccacguuucucucccauaaugcucguucuucaaggcucagguuuccugcaaagacugacaccuaacacacuguuucuaugacaucauguuaaugagugaguaaauuaaccaugaacaaggaaacuccauaaaggaugccugccaggaggcucucccagcugacuccugaucugcacuuacccagcaggugggaucagugagcagagccccaguccccugggucccagaacagugcucuuacugccaccuggaccccaacagcagaggacaguccccagagucaaugucacaagugcccuuaaaccaacacagggaggguggccaaagcgacauuccccugcuggcugcagugucugggcacuagcugcugugugauaccuuguucaaauccuaacucugcuaggaagagaugccgcugcucccucuuagagagggaguuuaguuugaaaaauugggagacaugggagauuugcaaagaacagcagaaacagcccuugucuagccuuucccagauucgcuaauguuaauguaugccuucccgcccuuucucuuccugccuccuuuccuccaucaggacacacuacagcacacacagagacacagacacacaggcagauacauagacagacacacauacacagacagacacacacacagagacagacagacacacauacacaaacagagagacagacagacagacacagagacagacacagacagaucuaaacaggcaggcaggcaggcagacagacagacagacacagacacacacacauugauucuaaacugccugagcaucagccaggccccaaggcccccgugccuccuguguguucucuauaaacacauacaucuauaaacacauauaaacaucaagacauacaagagccuaucaggccauccccggcuucucacagugguccuggaaaguccuucagaguaaaaggaaagacaggggacaugugugguccuagauccaucugguaucuuauggcccucagggaugugcaucuuuuaguguccuuuccuccaaacaguuggaguuuccugcuaugaccuuggcauuuuucuucauaugcaagucgauaauuuuugcacaguucccucuauguagguuugucuggcuugucugucauuagugucugaaguacagccugggcaggacuaucaugggggcaaaguguauccugccugaugcuucgggaagaugugggauagccaccacuccaauauuagcagcaccagucaugacaacucaauccagcaggguuugccaaacuucugccuguaaagucaagcuucugcuaugaguuuuggaggcuaucucuguaaauuccuucuacgcucauucgcggugucucagaacaacaguuucucuuagguucucguuuauggucaucccacagcucaccagugggggccuggcucuaggcaacuugguccauauugcuaacaguccuggaucaaacugugccaggcuuucuuguacagccguggaaugagucauuucucugauuucucugguuccuuuaagugaggaaguuguuuagaaagugagacagaggugcuaagcuugcuacgggggugucagugcuucuaacacaucaacacaugcacauaugccucucucucucucucucucucucucucucucucucucucucucucucucucucucucucucucccucucucucucucuccaaacucauagcuggaauugaaauucuaaacagacacccagccuucccccugccugcaugcagaguucccuucacugacucccaagauaucuggcugugucuucaaucuugacaauaaguaauuucagaauugcuaguccaggagaagcuggggggggggggguccaacuccauaaaguauucgccuuugucacuuuuaaaugucauguugccacaaccugaaaucacuugagaagagaauuucaguugaaaaacugucuagaucagcucggccuguggacaugucuguggagcuuuucuuuauuguuaaugaauggaggaggacccagccuacugugggcaccaccacucccuaggcuaugucggauaggagaaagcuuaaugaaaacugaagcagcgaggaggaagcacaggagcauuucuugcccucuuccuggcaugccacaugaugugagcagcugucucaagccccugccucugugacuuaccugcaaugacagacuauaaccugucaaucaaauaagcucuuaauuccccuauguugcuucugcuucugcugcuuugucacagcaacagaaaugaaacuagaacacuuugcaagcaugaggguccaaguucgauucccagaacugacauagaaaagccaggcagguaugguuagcuaugcuuguaaacccagagcugcaggcacaugcacacacauacacacacaggcacaugcacaggcacacauacauaacauauauacacacacgcacaugcacacacuuaacacacacaggcacaggcacacauguacacacacacacacacacacacacaaaggagcacacauuuguggauccacagcccuuuagaaaacagcucccccaccccggcagccacucgaguuguuuuacagcuguuucacacuagccuugggcggaugguggaaacaccaagucucaguaacuuggagagaucccccgcuucucggccugguuuauugccuugcuucugucuuuaucccacgcggggcuuugccuugagcucagugcuuucuuagaguuaugaaauaucgacauaauuauuaaugucaaaaguauacagaaagguaaucucagggaaauuucaguuugucccuucucggccuccccauggccucuccccuccacuucuguccccaccacccccguaagccaucaaucucauucaacucugccuuccacuuuccgggagccuucucacuaaaauacagaaaugugcacgccuccagcuuacucucuuuaguacacaaugguaggagcuaagcaaacuccuugauguuuucaucuuguguggaacccaggcuggccuccaacuuccuguguaaggaagaaaaacccugaccucccggccgcccugcccaugcccgugcccccaugcuggcauaacagguaugggccuggauugggcagucuuagggauggagcccagcgcucugucuguguguuggcaagugcucuacaucccuggccugguggguuguuuuuuuuuuucuuuuuaagacaggguuucacucuguaguccaggcuaccccaaacucacagaauccuaacccccacccccugaaguacuggaaauguaagcacacgccacaaauccuggcucuuaaagaauuucuucaagagguuuuauuuaagucaaucuucuuauauguauuagagaaugugugcauguauuuaugugugugggugugcacaugugugcauauaugugugugugugugcuuguauguugcuauaugugugugcucaugugugugcauaugugugcauaugugucuucaugcgugugcaugaccaaacauauguccaugugauugccgaaggaccauuucagauguuuuuccucaagaauugcccaucuuguuucucaaggucucucacuggccuggaacucuggaacucaccaaguaggugaagcuggccaggaagugagccagggaucugucaccuccaucccucucacugugcaaucacagguacaucacuguccuuggcuuguuucacauggaugcuacacacagaacucuggcuccugggcuuacagcucuaccugaaccaucuuccuagucccuuuaggaacauuuuucaacuguaaaaccgcucacugugagugugugccgucuacugaguuuuaaugagagcaccgaguauacagcgucaccacaucccacucaggcgcccucccccacccugccucaccaagaccucacaagaugcucuaccccauuucacgcugugacucaccucccugggagauacccugaguuagcccauggaggcugggcccuucucuuuccuguugcccaguacucuaguaugugaaccccuuacugugaacucacagauagucaaccacccagugguacccacccauucagcuugauucccauacaaaucgcccuugccugacaauaacccaacuuccaauuuuccaaccuuauaauaggugcuaaaguuggugugcacuccgcacauauauuucaaauucuguguucugacuuuucccccugaggcuuguacucuaugauacaagcacgagguacacacuaacacgacgacaugcuccacacuggcuacauuuucaaccuacgaugucuucaaacuaugaugggcuuaucaggcuacagucucagccaugaggcugugccuguauuuacaacugccagcgauucugcagcaaggaauguuguaaauaaauagcuguuuguucuugaugccaguggcagguacguuacaacagucgcacaaacauccagauaaagagaugauaagugaucugauucauuggacacaauacauagccccuguuccuguaugucaccuagguuuaguuugugcugggaccaagaacaaguaccagcagugacucaaaguaaugcuguaaaggguagauuguaagccauccccauauaggaaggggauuugggaauccagacaaagucauuaaguguagaaugacucucucucucucucccucuguguguguguguguguguaugugugugugugugugugugugugugcgcgcgcgggcauaugugucuuucuugcucucuuugcauguauguguacuguuauuucaauguauuuuagcauacuuccuagaagaaucucucccucccccuccccucccccuccccucccccuccccucccccuccucucucucucucucucucucucucucucucucucucucucucucucucucucuuccucccucccucccucccucccuucccuccccaccaugagcacgcauguguauguauuuccauucuuccaauguauuucaguauacuucauagaagaggaauuucugggcccaaacauaaaugugugguagccaaaucucuuuucauaagggucacaccauuuacauccccacccggcugccacauguuugucuccuuccagccuugccaacagaugugcugcugagccuuuuaaucuuugccaacuugacaggugaaagcagcggcucagagccccugccaucugcaugucucuaauuacaagugaagcugcacgucacuccauaggcuuaaaggcaaccugugcacucuccccaugaaucgccuuucauaucuucugccagccucccccaccccccuccccaccucuguaacaguucucuguguuuuaaaaguagugguuucuacuggauauguuuuauagauauuaucccaaucacuugcgccugacugggcuuaugauacucucuguuuugucucuugugucaaaguuguuuuaugcacucgaucucagccaaaaggcccacaagugauagauacaaaguuguuuuaagcagucaauguaucaaccuugucuaggcuguggaucaggcugaggaaaccugccccacagcugugcuacagagaaaugcccccacguuuuucuucuagugcuuuuaugacauugguuguuagauuuagaucugagaugcauuccaaguuuaguucuuagggaugguguuagaccuguguugauaauuucaucuuuuucugaagaucuuucagccaucucaguagagugaauugaaaagugaaugucucugcuccugugaucugagaucuguccccccccccccgcccccuuucuuaacaaauaacaaaguguuauguuuguggguaugugcacaugacugcaguugccugugggggccacaagagggcaucaaaccccacagaaagcacuggguuuacaggcaguugggaaccauggaaugcugagacuugauacucagguucccucuaacagucuugugugcucuuaaacacuggacauuuuuccaguccggauccugacugguuauacugaacuucgucauguacucaggucuauuguuggacuuuuuagucgauucuauuucuacucuguccucuuaugcaugagcaccaugcuguguuaacugcgggagcuucuuagcugguuuucgugucugacagagggauuccuccauaauggcucuuuuuuuuuuuucagggccuuugugguuaaugcauauucaguuuuucacaugaacuaaaauuccaguugucucugcaaagggcuuauagguauucucucagagaucauguucaagccaucaauuaucuugaaaaggaccaacauuuuguguuacucagcucaccaggaccagcacgggggaggccagcagaugucugugugcucaggaccacucuucugugcccaggcuguauugaaaaguucuccuugggcuuugccaacaucucucuaaguucaugacuaaguauccucuuuguugcuauugugucuuacagcuguuuuacauuugaauauaauaagcauccugagggcuggagagauggcucagugcauaaagcccuugccaugcaagucugaagacccaggcucaagccccagaacccacaggaaacgugaagaagagaacugacuccacaaucuauugucuggucuccugucuacacacauguaucaugggcaaauacacaugugcacacacgcacacacauucacacaauaacaaucaaugauaacauuuuaaaauaaaauugaugugaaucugauagugcuuugauuauucacaauugaucaaagugcagacaauauaaaugucaggggagugcucagauagauaugggacaucuaugcuacacacacacacacacacacacacacacaugugcccugacauucaaagauggccuugggggaguugcgcgauauugugugccagccuauucagaugcaugcuacucugccuggcuuuugggcacugggaauccaggcucaaguccuuauguuuuacagaccgaaccaucucccuggcuccguuuuugcuaucuuuuguuuugaugguugugucucucuuauuaauccacacauaaacuuuugugcccucucucaaucuugucuuuuuagcaagcauguuguccagucuguuaacguguaauagcaggcaugagguuuucuuacucaucaccccauguccugcucucugccucaguagcuuuuuuucuucccuucaucucuugcuucccuuugguuuguucaucugccagcuacagccaucucacucauuuuccuacauuuuuuuauuaauaaaagugcucaggggagugaaucuuucucugauuccugcuuuaaaugggcucuacagauuacaacgggacgucuuuucaugaucauuacuucuuuuuaauguauuuguuuccugauuucacuucguuguaauaauagaaggauuuuuuuuuuuuacaguuccacaugacagggucuuuuaagcuuuguuaauaacagccaguucuaguguguucugcucagacaauauaguucauggugcaucugcuuauagaccucacagagguugugugacaucauacaaaaugaguuuccauaugcacucagaaagaaggccuauucuauauggcagaauacauacagauaugugcacugugugugugcauguuuccccagucacuaccuggacaaucaugucguugugcuuuaacacaacuugucugccuuguguugaguauagugugcuaaaaguuauuggguaaaggcacucacugccaagccuaauggccugaguuugcaccccaggacccacagauggagagagagaaauauuucauaugugugccauggcaugcaauugcccacacacaaaauaaauaaauguaauucaaauuuuaaucucccacuauuagacuauaagucucucucucucucucucucucucucucucucucucucucucucucucucucucucucucucauuucuucugcaauuucuguauuaaaggcagcucccacguuauucuacauauagauucuugcacauuuugugcaauuauuuugacuucuucaccuuuuguucugggauacaucaaguuagacccugcaggugagguaugauccaggcuguugcuuaccuuuccacguauuugggagugguagccucagagagccuuggagauccuuugccuggucacagagacauccaggaacucauuuggagccccgacucuuccaaaaagcauucuugaucuuagguuguucucaaaauucucugagccacccuucuggaaaguuccucauggccaccuccaagccaugucuugcugcugagaauggcuauaucgacccuaauuguuuccaagcaaugagcacacacguagacgcacacagcaaagaacaucucugaggugguggcuugucgauugggauauugguaggcucucuugagaaggagccuaaagaaaguuucccucugugugcucuugcauagcugcagggagcucuccggagccucacuaagucucuggugccucuucuccauucuucugacuaggacucucgccuuacuuguuuggggcaaaguccugccacagggauagccaagcggagaggaacccucuccacauacagaagggacucugaaaaccaaagccugcagcccuuggcuaagcaucaagucaggguguaaaugcaagggcccaguuagaccuaauugauuagcagaguagaagaggccccaagugaaccuaggguuaaucagaaggcuggaggaacgaauacgguuuaccucaaggccagcaacacaagcuacacagucgaaaugucaccuagaauuuucuagccuaauuacaaaugcggggccuucauuugcuuaggugagcaauggucauuagaaaggcagagacaccaacagauguuaacugcccccaaaucuuuuuaaaauggcauccuggugagggcuggguugggggugaccuucccuauccugcaccagcucugguaucccugggcagagaggaaagccaacaggagguagggagauguucagucacacaagcaugaagagccaaggucgguccccagcacguguguggagggugagagcaauggucugucccuggaaccccagggaggaggaggcagacgcacggaucucugggacucacugacuaaaucauuaaguuccagguucagugagagacccugccucaaaaaaauaaaauaaaauaauuaaaaagucaggcaaauagcuggggugggggcggaggggggggaguuggcuugggugcaaaagugcuuacaagauggccgaccugagcgacccuuggauuccacacacagacugaugacuccuggauaccacccucugaccgccacacccacacugcaguaugugcgugccuguacguguggguaguuuugguuaacuucacacagccuagagucaccugggaagagagagagccucggcuggggaaccacuguuuauaucacacuggccuaugggcguguccgugagagacuguauucaucauuaacugaugcaggagggcccaucccacuguggggggcaccauccguaggcaggagguccugcaugagagagcccguggguaugagugugagagccagccgguaggcuguauuccuccacugcuguggcuccaugaucuugccuuuagguuccuuccugggaauccugucugugaccugaacauguaagccagaugaaccauuuccuccuuaguuguuuucggucaugguguuuaucacagcaacagaaaaacaaagcaggagacacgauaacaaauaaaauuuuaaaauuaaaaaaaauggagagugcuuaagaaagauaugcaguuuugaccucuucucuacacacagaugcacacacaggcaugcacguaugaauacacacacacacacacacacacacacacacacacacacacaccuugugcuuuucaaauguccacccuguuucuucaaggggacuucucaggaagagaggcucuucaaagucaggcagaagccucaguguguaggaggaguuuuugaaagugggaggagcuuccaugaauaggccggacuucuaauugggaagcacugguaugugggaggggccucacugggugggaggagcccuaguguguuggcuguugacauuagaccugccuuuaugaagacauucaccaaaguguuuuucucuucuuugugagaauauuguuaaacuacuuuugagaccucugaggucaggugggaucugugaucaaugucggcccagagacgugugacgucaugaucacugacucucccagggccccucuauuccccagggccucucuauccccuucccaggaaccccauaacagcagaaccagagcagcugggcuagagagcacuuacuauccagcucacaguggccuugacucugaggccggcagacaccugcccacugccuugggggcccggcacagaaugcuuucugaacacaacagcaccauuccuccccagaagaggccucuccucggcagacaccaagccaccuccuccuaacuccccccacaccucaauacuccagcgguaccugcaaaccaucacagucccaaaucacagucccaagugccccuugccuuuaaagguauacacacuccugccccaaagggagacagcugcagugacuguaccauaagccauggcucuugcaagccauaucaggaguaaguggccaauuuaacaaaugucagagaugcacaaucucccccucccaauccccaaaaagggaaacuggugucugaaggaucaaauagaacacgugcaaauguuccucucucucucucucucucucucucucucacacacacacacacacacacacacacacacacacggggggggggggggaggcauucgcaugugcaagcacacacagccagugccaggaacagcuagcugccuugaggccucugaaacuaagccuucgauccucuggggaaggucuuccccguggaucucugaguuugccuacaggucauuuggggagaagaauggagaaauggccauagccuugaaaauaucgaaguaucuaagggccagaaagccuaguuucugaaaccaagagccacuaggcagagagagauucuugcaaagaacuuaccuucaggacaaucccuagccccuccucucuccgcagcugggcccucugcauauacaugauagcuggguagcuugguggucugugggacuccuaaaagugggaaugcagcuggcucugacucuugccugcucuugggacccuuuuccuccuacuggauugccucguccagccuugauguguccacucuuacuguaauuugauacaccauguuugguugauaucccugggggggggggcgggaggaggggggaggcugugcuuuucuuaaggaaaauggagaaauagaucugaaggagugggaagguugugggaguggggggacugggaagaguggaaggaggacaaaccacauguaaugugugagagaauaaagcacacacacacacacacacacacacacacacacaccaugcaugcaugcacacagacagguacauacagccugcaggcaggagggggaagacccugcaacugcagccucugagccacacaagaaaucauucaaagcucagagcaggcuccaggggacacuacaguuuuugauggggagguguggcuagcucuaggcccaaggcaggcccuuccagagcuccugcuggcuguggggccacuucagccccucccccaggcuguaacucuuggggggguggggggguggcgcagcuccaucccccagccacagggaggaaagcacguuuuggaaaggucgggauuccgcauuuuaauucugauuacggcuuaauccaacacagagagcauuuggcauggugccucucugcugaacguaggaauguuuuaauggaauuguguuaucaugggacugugcggccaacuguucaaacaagauacccgcuccagcuuucuugaggagcuaagcaggcucacagagaaaagaaaacagaauaggcauucugcucucagacauuuaugucugagggggugaaaaugucaugaugccuuuugacaugcagcuguuugcagcuguacuccguggcuuugaacugucccaagcaccauagucaggcacuguccacugucccuugcagagcauccuggggcauaagauguaucuccuggggguauuaaaguuccugccugcauacuucggagugugccuggcccgggccugaaugccuguuacucccugcucacucuccucccuaucucuaaaucauacuggcauaggagagugugugcacacacacaugcacacacauacacacaacacauacacacaaaaauaccacauacacaccacacacacacuugcaccacauauauaccagaggccaccaacaaaaugauuugcuaaauuucugguucucuaccuucuaauugcagaauuuggaaggggaagggguuaaaggucaugugggcuacacagugaguucagagccugccugggcaaugagaggccuucacagaucucaaaaggugggggcagaagacuggaagaugguucagauggcacaguucuuggcuuucuauguaagaaggccuaaguuuuaaucucagaaucugaauacaacaaaagguucgggguggugacaggugccccagugcuggggcuugugggccagacagccgggccugcuuggcaaguuccaggccaaagagacccugucucaggaaucaggaccugcagcauaacaccuuagguuguucucugaccugugcaccuaaaccuguacuuucagguggacaugcacacauaaagacacuucuuccuccuuuucuucuuccucuuccuccuuuuccucuuccucuuucuccucuuccuccucuuccuucucuuucuccucuuccucuccucuucuuucucaucuuccuucucuuccucuucuucuuccuccucuucuuccucuccucuccucuucuuccuccucuucguucucuuccuccucuuccucuccauuuccuccucuccccccuccucucccuccuccuaugcagggccaagcugggugcucaggguccugcuggaagacucaugugauagaguagcuugaagcaggucaucuacugaacuucagccccgcaccccaccccagcaaggagccaaccccaaguccacaguuccucucuggaggauggagacacagcuauaucuccugaauguuauacaggucucagcuccccgaguauggucgcccuccuccgguggcauccccuuucccucaccaucuccucagaagcugcuccgauauguaggccacuggaggguaggcagugugauccucacacccagccugggaggaagaaaccacagcucaguucuaccucauggcuucucuccuggaaucuucuagucgggcaggguguucagguuaccucuuuucuuauccaaggcacuguaaacagugacuuuuguuuuguuuuguuuugaaaaggggucuuguauauuuuugugcacccaagauuuauggaaauaauuaagaaauuugauuacaauuccauuguggcuauuuauuuggagaacaaaccuuuuccucgacgccuuccucgcugugacuaaugcacuuggcuuucuuuuuauuuugaaagcauaaauuucccuugcugaugguggcucuguacaguguuugcagaggaggcugcuuuuacuacguuucugaccugacaaguuaauggaagaaucaggacguugcuugcacagcugacagcuguuccagugggaaccaugggccuggagagcucugaccacugagccucccuagccucugugggccguuuucccuccaggcaagaaucgaaaaaagggcuggagaagugucugugugaaccagauggagggcugacagcacaagguuccagaaggacccagguaucuuggagaguggggggaccucaguaaccaaaauggcucacgguggaggcuggcccccgucaguccugccaaauccugcagggucuccuuggauuccaccuggaucuugcugguuuccacuggucccuuuuagguucuucuuaguucugagaguguguguguguguacaugcaugcuuggaugugugugugugugugugugugugugugugugugugugugcagaagagcuuggguguuccuugggcacuccccacccccauuagacugcuccucucacuagaauguggacgugaccguggggucuacacuggcuggucagcaaggcccagaagccuccugucuuugagcugggguuacuguuguacgcucucaugcuaguuuuuccgacaugggccugagcuuucucccaguacuaaacuggguuucacaggaaacccaccaucuuccucccucaagaaaaggaccauauaaagaaaaaccccagaugugcacagcccuggauuccacggcccuucucguuaccacacuuuuaucuuugggguacagagauuccagaaggcaugggaguacucaaccccgcaccaacuccccaccaccccaugcuguggagacagucacucccaguuggggugaccauaucugcggugugaggacaggugguggagcugggaucccgguguagacaugcuggcccuccagaggacagaggacagucacacgcuauuucugcauccuuuaaggaagucacggcuuaaggagauaagagggacacaguguccuggagcucaugagucagccuccugcccaggcugucaccagccaggcuuuggcacaggguggacugacaaggcugcuucauccucuccagguacuagggagcugaucuaauuuuagcuccagggcccagaacuguccacgcaggagaucauccagcaccuggcuguccccucgaccccagggaucacaggcccaggguccggaaaggccugccucacaccucaucgcagggggcccuggggaagccagucgcucucaggugucauccgggaaguaaauguccugcugccaaguacaaaugucccccugucuucucagggaaggccuggcaggguugaaagugcagggcuggcagggaagcaauugucuuaaagaucaagggcagucuccgacuggguuccccugcuagggcugcaggcuccuccucccaccccccagggcugcaggcucaucccgcccccaccccuaggacugcaggcuccucuccccacccugagggcuguaggcagcucccaccaccauccuuagggcaggcagggcucuucccucuccucuuuuaggagcagcuuagccuccaaagccucagcuuccuccccccacaaccccaguccucugccuucaaaagcccccauacuuugccuccgaaucaggaaguaaugggagauuucuguuuccauuucccuccucuucccccccccauuuauuuauucauuuauuuauucccuuuacaucucaauggcagccccccucccuccucuccucccaaucccccucccauucccccccccccccccccgugucugagguggagcggacagcagcccagguguucaucaucugacaaacagguaaggaaaacguggguaucucggaguacuacgccaccaugacaaggaaccgaaugccagcuaacaccacagcaugaagaacuauauaccaaguaaaggcggccaguuacaagguccacgggauguguugcucugucuugugauacguccagagugggaaauccuugcugaccaaaggagcuaggggaaggaagaacgggaggggaggaccaagcaggugcgugucuuuccucggauacugaagauguuccagaguugaagccuucucaccauguggugaacacucaagagggcagugaagugcucacuguaaaaugucugcuggacuugcaagaugccugcaugggcaaagcccuugccccaaaccugaagaaugaguuuaguucccagaauccacagggugaaaagaaagaacgauucuuguaaguuguccucugaacucuacaugcaugcccaccaccaaacauacuaaauauguaaaucaauagccaggcaugguggcacacacccucagccccagcacuugggcagaggcaggccgaucucucagauuucuaggucagucagagcuacaaagugagacccugccucaaaaacaaacaaaccauauuaauguuuaauccuuaauaaaggaauuucaugucaauuauaaguuugagccagaggagcaauucgaagagaggaguaauuuuggggaucugaaaggauggaggauggaugugggaacacacagcaacaugaggagcagagccugaggagaaaaugcuugccuggguggcaggggcggagagugggcagcaguccagacauucuuaacagaagggacagccaagacaagccucagaggaccgacagggagggcacacuucucagagaucccagcaggaugcaucuggacuagcaaucacguuccuacagccagagauaaauuugucagugugugcauguguauaugugugucugcauguguguguguguuuguguauagguguguauguaugugugugugugcaugcgcauguguguagguguguguauauguaugcuuguguaugugugaguguagguguguaugugcauguguguguaccuguuugucuguaugucuguguguguagguauguaugugugugugcauguguauguguaguuguguguguaggugugcauaugugcauguguguauaccuguauaucugucuguauguguguguaugcgugcaugugugugugcauguuuauguguaguuguguuguugcugcuuaggagccaucuaccuuauuuuuuugagauaaguuuucucauuggcuugagauuuaggcuagcaguccccagagauuacaagcaggucccagcacacacaaccaugugggacccugggauccaagugaggucuuacaaaaccacagcaagcacauuccuaacagggccguccaccggccccugacucuugccugucuugagccgccaucaaacaaaaugacuaaggaauacaacuccucucccauuccaggaggagaaaagcaaaguacaaguuuaccaagacgugaaaccggcaacagauggcggcucuucaggaagaugaggaggguggauagauccaccuugaugaucuuuguugcacuguuugcagugaucaccucacaaacagaagcuaaaauccgcaagguagcaagaaaccaaauaacuggaagacacaaguagcaagcucuguucuuuauaaacauccacuguccauauuuacuggaaccagcaccaggucucaaacaucuaaagaguagauugggccaguaugcuggauuguuugagaaugccccaccccuaggcucauagauuuaaauacuugguccccaguugguggaacuguuugggaaggauuuggagguguggccuuguuggagaaggagugucaugaaguuucaaaagcccauggcaggccuugucucugcgucuguguccgugcugucucugucugucucugccucucuguguccucucucucucucucucucucucucucucucucucucucucucagccugcaacuugcagauaugaccagcuacugcucuagcaccaucccugccugcugccacacucccaaacaugaugauaaugggaacuguaagcaagcccccaacuaaaugcuuuauuuguaagcucccuuggucaucaugucuccccacagacuaauacaaccaauaaaauggcucaucagugugagaugcuuggccccaagccuggugcaggacccacacggcacaaggagagaacugacuccuguaaguugugcucugaccuccacacauacguuaugacauaagcauguccgccaguguucacaaguguucacauaugugugcacacagaugcaugugcaugcgcacgcgcgcgcgcgcgcgcgcacacacacacacacacacacacacacucuaucuauaucaaucauucaauuuuuaaucuagauauacuuguauuauauaaguaauguuuucuaaauuacuacgcaaacuagaaaucaaaugagaaucuggaagcaaaaagagucuaaaagaauaaaguuuagaaaugagggaaccauuuuagacaauuuaaugaaguaaucauaaugcaagucauaaaguauugugaacucaaugguaauaggaauuauacacauuaaaaugugguggauaauguacucauuaacuuaaauuuuuguagaaaaggggacaaaaugaaaaugaguaagucaagcuugccacuuacgacaucaggaauggaugggagauaugcucacaggauacaggaaguagacaucaggaauagaugggagauaugcucacaggauacaggaaguagacaucaggaauggaugggagauaugcucacaggauacaggaaguagacaucaggaauggaugggagauaugcucacaggauacaggaaguagacaucaggaauggaugggagauaugcucacaggaaacaggaaguagacaucaggaauggaugggagauaugcucacaggauacaggaaguagacaucaggaauggaugggagauaugcucacaggauacaggaaguagacaucaggaauggaugggagauaugcucacaggauacaggaaguagacaucaggaauggaugggagauaugcucacaggauacaggaaguagacaucaggaauagaugggagauaugcucacaggauacaggaaguagacaucaggaauagaugggagauaugcucacaggauacaggaaguagacaucaggaauagaugggagauaugcucacaggauacaggaaguagacaucaggaauagaugggagauaugcucacaggauacaggaaguagacaucaggaauggaugggagauaugcucacaggauacaggaaguagacaucaggaauggaugggagauaugcucacaggauacaggaaguagacaucaggaauagaugggagauauguucacaggaugcaagaaauacacaucagauaugcucacaggauacaggaaguagacaaugaauauaggaagaaguccacagagcagaaaaucuacgaaguagaugcaagugagaaaugcaaaaguucuuuggaaagaacaauauaagugacaaaauguugauggaaaacaggacaauauuaggugagaaaagaacauuacuggagaagucucagagauuaaagcguuauugggaagauagauggcugucucguggcaguaaguagggaacaaaugaaaugaauggacuccaagagaauaaauguaucaaaacugccuuaagaaaauauggcuuagaaaucuuaauauucuuauaaacacagaaaucgaaguagauuaaaacaccaggugccacuccggguuauuaagcuuucaaagagugaauaaucccaaucuuacacaaaguuucuccacaguguaacuaucccgagcaugucuggcaucuacucugacaagagcaucauggggaaagcagcccagagcccagagugacucagggacagagagauaaaacucuuugauaaaccucagcaaaccaaagccggccauauuuaaaaauggcgacacugugagcaaauuggguuucuccuagcgcagaagaguuagacuaauauuaaauaaauaaauacaauucacggaagguauugaccucaugggagaaaaauauagccauucuuuuuuaaaauuuucauuuaaauucauauauuuauauaauauauauguguguauauauuuauauauugcauauuauauauuuaucuguguaaaugaauguuuugccugcauucaugcuuaggucccacaugcaugcagcucccacauagaccuaaagagguucucagaucaccuggcccuggaguuacagacugcagugagccgccggguuggugcuggagaccuagccuggguccucugaagaaccgugggugcucccaacugcugccccaucucucuccagcccgaacauggccguucuuaacagcugcuuuaaaaguacucauuaccaucaacggaucauuugugauuaaggaauaaaaaucuuauaacuagauuaaaagaaaacuuuccugacauccccaccccuaaaaaaaauucauaucacgcagcaaaacaaacaaaacaagaccuuggaaaacaccaucaguaacuaggagacauagaaaacuaacucaacugucugucuucugucugugugugugucugucugucugugugugugccccuuucuccuucccuccuuacagugcaucacauagcccaggcuagaucagauuugcuauguaaguugagcgauaccuugcguuucucugucuccccugugcugggauuacaggugugcagcaaccacagggugcugaggacugaccccugggucucaugcaugcuagguaagcacucuaccauguccccagcccagaagagucucuuuuaauauggagcaugagacaagaguuccuaugaggaccaguucucaacaguaucacacaagaagucccggucugcgccucgauacaagagcaggaaacaaaggcuguaaagucaggagagggagaagugccguucuccacacacugacgaugugauuagagagagagagagagagagaauccaccacgcucuggcggcaaugcaucaaauuuaaagcucucaccaaaguagcuagacauaaaaucggcacgcaaaaguaaauuaauaucauuacaacugugacaaacagaaaauauaauuuaaaagaaaccaauuauaauuguaauuuaaaucuaaucuuucuaagaauaacuuuucaggguuuaucuuaagaaugcauucaugaauaaaacaaagagcuuuuuuuuuuugguggugcaggucuguaaucccagcacucugguggcugaagcaggaggauugcugcaaguucagggucacccugagcuacauauagaaacacugucuccaaaaagagauuaaaaaaauaaauuauaaaauugugaauaaauauauuaaagaugccuugaauguguauuagagacacaucaugcuuagauauagauggacuucaaauacuuugagagcuggagcuuggaaaucagccucaggaggaggaaauggcaaaguaaggaaacagaccuugguggcuucaggaagguaaucuaaucauuuuuuagcaaggcagaguaauggggagaagggcggggccugccagagccaugcucgugacacuggagcuggacaaagucccuucagauuguccuccaaccucuacaugaauaggcacacacacacucacccacacacuugaacaagaacaccaacauauacauacacccaugcacaugcucaaacauauaaucacucguauacucauauauauguguauauauguacuuaugucuacacaaauacucauguaucuguauguacuuauguauguacauacauacacgaauaaaaucccuggugcaucaauguugcuacaaccaaguucuguuccgcagcuaacaagugagccacagugcacacguguccucacuaguggugugcacgcguguagaggacggaugagacgugucagacccacaccugugccuguccgccaagggaagacagacgagcaggagaacaaaggauggcuccuuugugaagguuucaagaucuacaagcaaugccgcauuuugcugaggggugaaaaauggaacauaaaaauaucuucaaggaugagggugccuucacggggcagagggggugugcggugagcacuguacaugucucucugcuccucuuucuaaaggacagagcaaauagggccgaggauaagagcugaggaagcugguaguagguacacggauauucuaauuuucacccaaguuguacgugcccguucuacgaacgaguuaaugaucuguuuaagucgacauugcuacuauuucauguuggcaacaguugcccaucuagggugcuucuauucauccaucugucacugaugggcccuuaaguagccagacuagucccaaccucacuauguaacuaaagagcaccguggggcuuccaauaucacccccugguucuggguuugcaggcucagccaugacucuguuugcuucugcaugguccugggcauaggcuagugcugaguccuugccaacgucagugauuuggccagccuggauuuagcuuagcuucucuuuaaaaaugggcccuuuuuaaaaagccagugaaguucggguuauuaauaccacacguucaacaucucucaacuauaauguauuuucaacagcuuucugaaacacauuuccauaaagaaaagugacuguucugaaagggacccuucugagguaagauauuccuguaggggcuggagagagggcucagcauuuaaagcacuugaugcgcccuuaacagagggucugggcgcgguucccagcagucacauggcuuggcagcucacaaacacccauaacuccaaggaguaguuccagggaguccaacacauucuucuagccucuguagguucugaauauguguguaguauacauauaugcaggccaaaaaacucaugcccaugaauuaacacacauauacaugcagagagauacuccuaaaaagagcaauaccauuauagaggcuuuugccauggaaacaggagacaaagaaggcauacauauuugccugacuuguuugucuuggcauccaaaggacacagcaccccaaacuacuuacaccugguugacaguacuauucucucaguuuaauuaauuagcccuuaugcagguagaauaaacuuugcuggauaaaacacugggaggaaaaaagagcaaguaaugacaauccucagacaaucugucccuauuucuccugugacgucugacucgauguucaacauuguacaugcuaguucaaagcaguccugaccacaugcauggacccccaaaugccaacuguuacauagcgugggugccuccacuuugcaagagguaagguaccaguaagagcaagggaugccagcuugaauacaggcccucuggcuuccugccgccugcccaucaaaaccccagcauccuagagaaauccccagauuaaauaaauaucuggcagaggacuauuggcaaaaaugauaauaaauucagcucaguucccaccgcaaacuggcaaacuccaucagcaaaccaauccaaucugucugucucaacuucuaaauagcuguugauggugccagccggggccugugggcuccugaaagcccugaguuaguaucucaugccuuguuaucugccagaaauacugaggugaacugaggguaggcauggcccccauaaagggucagaaggagaaggaaccgaaggaguggggggcggggaggggaaacuucuggcaugccacacgcuuuugccaugcuuaagugggcaaugucccucacaggcucgugguuuuguacgcuugauccccagcuguuagcucucuuuggggauacuguggaaucuuuaagaggugaaguguggugguuugaauaugcuuggcccauaggaaguagcacuauuaggagguguggccauguuggaauagguguggccuugauggaggaagugugucacuguggaggugggcuuuggagucucuagugcucaagcucugcccagugugggacagagaccccccuccuggcugccuucagaucaagauguagaacucucaguuccuccagcaccaugucugccugcaggcugccauguuacagccgugaugauaaaggacugaaccucugaaacaggaagccuaucccaauuaaaugcuugucuuuauaagaguugucuuggucaugguuccucuucuggaagcccuaacuaggacaugaagcuuaggggucacugggucacugagucauugggucauugauggugagugugagguuuauagccugguucugcuucucacaauugcuguuacaguuuggccagacaacucacguuacugcugccaugucuuccugucaugacagagcauauccaccgaccgugagccaaaagauacuuucccacauucugcuuccucuuggauguuuggccacagcaguaggaaaagugcuuuggccucuuugggacccuucacagacaucuggguuuacacugguauggugcuguggggucuccaucauuuuuuuuucacagaguaagagcugaaagagaugcuaaaaacuggaacucaagaugggaacacagaggcaugcuugcugaagggcaggguauauggugagauggagucacugugacacaaacauaugggaagcacugagccaaguacuucauaagcauuggcaauggggagcacugagagccgaguccucccuaaguaucggcccugcauaccccacucuuagcucuugcccuauuaauccucccacugugacucuuugggucccacagacuaucagcaacauccuguaccauaccccgugucuguucucaggcuucugguuccaugaaccuggcuacccccaaggaugauauggccuguguguuguaauuugggaagcugaggggaagcuggugccuccuuguaccacgauacugguuccagagcauccauccuccaucugaaccccagcccucucacagcugauguuccucccucucauaacugccccccguuacauucugggcaccugggcacucugaaccaugaugccugcauccuucuucuccagucccaaguugaccaucaaccuggaugacuuggcaucugcacugacugguuuugugugucgacuugacacaacuggcguuaucacagagaaaggagccucccuugaggaaaugccuccaugagauccagcuguaaggcauuuucucaauuaauaaucaagggugggaaggcccuuuguggguggugccaucccuaggcuaguaguccuggguucuauaagaaagaaagcugagcaagucagaggaagcaagccaguaagcagcacccuuccauggccucugcaucagcuccugucuccagguucccacccugugugaguuccuguccugacuuucuuuagugaugaacagcaauguggaaguguaagcugaauaaacccuuuccuccucaacuugcuucuugcucaugguguuuugugcaggaauacaaacccugacuaagacagcauacauaccuaucuucugaacuccccaacccccaccccacccagugccuuucagcuccucccccuccugccccgagugacuuuucucaacaucaaacccuggccacucagccuccagacagcaaggacagaugucucugaaauugucaacuucuccuuuucugaccuccaucugccaggcagcucucccggaggagguacugauggucagccucauggggacaggugaauuccuggcuacucagcuucugccuucucaaucacucccugcccccugcagccuuaauuuccccuuaccuggguugcaaagccuguuguuaccggcucccccaaacaccaggccuccuuccacaaagcgauggacaggagguggggaagacauggagaaggggcugagggagagauucuuagccacauucauuacaacuccaggcacggcccacacuuccuaauugccuuucugccucucuuaccgauguuggagaggcggcaccuggucucagcgccugccaaugggccaccguucuccuggacaagucaccuccccacccccagcaaucuccucuugucugacuauucggaucccaccucucucggguguuuccauccauauuaaaauauacucuagagucuuuguucuguaaaccgggcccaugccacaucucacaggauccauagguucucugaggccuucagagcccagagucuagaaggagacagggugucauuucucaccucccgacccucaggucacaucggccugacuccacucuacugaaacuaagcagcuaagaccaugaggaguaucgacguccaugcgcaguacugcuucucagcuucaaaucccuggacugucaguagcagacaacagcagugugggcaugcuccugaggugaacccuguccccguggagucuccaugaucuucuggccuccucuucucccacagaggaccaaucaagaccccuggcuggacucuugccaaagcuguggguggacucuacuggucagucuuggacaaauuggucauuugcuguaucuguggcucugccgccaucuuuggcuuuacuuugucugcacucgcuguacacacagccuacacccauccuacacuaggucugcauucacuguacacacagccuacacccauccuagacuaggucugcacucacuguacacacagccuacacccauccuacaacaggucugcacucacuauacacacagccuacacccauccuacacuaggucugcacucacuguacacacagccuacacccauccuacacuaggucugcacucacuguacacacagccuacacccauccuacacuaggucugcacucacuguacacacagccuacacccauccuacacuaggucugcacucacuguacacacagccuacacccauccuacacuaggucugcacucacuguacacacagucuacacccauccuacacuaggucugcacucacuguacacacagccuacacccauccuagacuaggucugcacucacuguacacacagccuacacccauccuagacuaggucugcacucacuguacacacagccuacacccauccuagacuaggucugcacucacuguacacacagccuacacccauccuacacuaggucugcacucacuguacacacagccuacacccauccuacacuaggucugcacucacuguacacacagccuacacccauccuacacuaggucugcacucacuguacacacagccuacacccauccuacacuaggucugcacucacuguacacacagccuacacccauccuagacuaggucugcacucacuguacacacagccuacacccauccuacacuaggucugcacucacuguacacacagccuacacccauccuacacuaggucugcacucacuguacacacagccuacacccauccuacacuaggucugcacucacuguacacacagccuacacccauccuagacuaggucugcacucacuguacacacagccuacacccauccuagacuaggucugcacucacucuaugcgcagucuacacccagcaccccaguacucugggcucugauucggugugcaucauucccguccccggccccccaggggaccccacuuccuuucuggugccugaaaucggguguuuuugcuuuauuccugacucuuaacuuccaucuuuagcugcagagaaaacuaaaacuucagucuuugaaacuaauccucugcuuugcaaauaaaguggggcaaccauuuuauuugggggaaaaaaauccaguccguuaccuccuuccaaguuugauccuaggguuaccaagugacuuuggaauucuacacacccaaaagaaauggaaacauaugccuaugcaaagcucuguucacaaauauuuaacaaaagcaucauucaucauagacaagagaagcugggaauaguaguggaaaacuuuaauuccagcugacugggagucagaggcagguggacucgggagccagaacauuccauacagcucccacagacagacccuugagcccucuucucacaggccugacccaaaggcaaugacuguucugacucuugugcuucuuauucacacagaucuguggcucuccauucaccagaaauguauaaaauaccaaaaggugcaucacuugguuuccacccaguauuuaacucgaaaagccucaaacauacagacaagcugaauuuuacagagaaaacccaguucccaccaccuagauucuccaaauagcacuuuucuauuucugucucauagccaucuguccagcaccuucgacccuccauugaucuuccuuauguuuugaugcauucugaagucagcggcaggcacugguacuucugcugcgcagcuguaucauuagggagagcuccgucucugcggcuccuuuguuucagguaaaauuuacagagaaugaaacgcauagaacuccagcgugucacgaggugaguguugacaaaugcuggugcggauggaaaccaggcuccugucaagauacugcaaaaccugagaagugccucccauggccuuuccaguaaauuacagacaccgucaucuacaacacaagcaauaacuguugagguuguuuucugccauagauuaguucugccuaaucuagaaguucagaucaagaaaaugugugcuauacacuuugggugcuuggcuucuuccacuuagcauggcagaguuugugguagauuauuuuaaaaagauguguguguguguguguuucugugugugugcacacaugccuguaucugggugugugcuuguguaagucugugucagugugugugccuuuguguuugucuuucugugugucuuugugugucuggugucuguauauauguguguauguauguauauguuuguauguauguguguacguguguguauauaucucuguaucuguguguguauucaugugugucugcauaagucugugacugagugugugccucuguguuucucugugugugugugucucucuuucugugugugucuggugucuguguauauguguggauguaaguguauguauguauguauguauguauguauguauguaugcuaaugcccacagagaacaggaugugugguccgagagcugguguugcaggcagcugugagcuaucugacauggaaacugagaucaaaguccaguccucugcaggguugaaagcauuguucccugcugaguugccuuucccucuccuugcaugguauuccugagacucacacauggaaaaccaauucuuuuauugugguuaaguguuauucuauugugcaacuccacuucuguuugcccauucacccacuggcaacuucuggacuuguucucuguuuucaguuacugagagucaaccuccaggaccauccuuacgggagucagucugggaacaugugagaauguacuguauacauacgucugucucacaggagggauugcuggaucauaggauacaugugugcuugagcugcaagaauccaucugacgcaguucccugauguuccagcuguuuuacacccccaggacauuccucuguguucacccucuugccaaccuuugcaugcccgcccccacucuugaacuguagccaguagguaguggauugucgcuacagugugacuuuucacuugaacccuccugucuuugguguuuggcagcuacuuuuuaaucacacuaagaaaaaagagaagccccucuaccuccaauuugccaaaagcuuuucuuguuaauguuucuauuguaagcuaccaaauacauuuaaagcauccaaauucccccugacacaugauucucaagggacaugucacgaauuucuguggaggagcuggcgagauagcuuggucuauaaagugcugugggcauaagguucugaguucuguccugagaacccacauuucaaaagcuaggcauggugucuacacacauuuauaaacccagaacauggaaggcagaaacagguggcucacagggcccaauuggccaaccagacuagguuucuuggcaagcuccaagcuuuugagagaaccugacucaaaacccaaggcagccagcaccugaagaaugacacccaagguugaccucugaccuccacauucacacaugugcauacauacaccaacacacguguaggaaugucagaggacccguacccccagagucuacuguuucuaagccacuauacuggucccuguuacugguaaggauaaugguggcaguggugacuagcuuucauuuucaugucaagaaagccugacugggcucuguagcaccuuagguagcugcaagcucacaaugugcuuucuaugugguauuugguccugcuucuugcagcaggguggacgggacauucugucagaggcguucccucagagggugagguagcucuuucuccuccuguguuccacucccuuuggcuuagacgguaucacccagccugguauaaguugccccgccaaugaacaggcuauccauuuggaggcagcacagcuaggaaauagcacuuuucccugaaaguaaugcuugucaacaggaagcccgguucgggcagaagccacgcacuugucaguggcuugaagcacuuaaugucugaugcuucuuuucccccuuauaccaagugacagaagaucgccuggcucccgggaucuguguucaguuuugcaucacaaccaaguuucucaaggaguggagacuuucuuuuuuucaugaauacaaaaucuuccuauuaugggucuuuuuuuuuccauuuucauuccaaacacugcaacaggcagcaaaggguucaagccauccgucuguuaucugccucccaugcagcuccuacagcaucagccugauaaacugcugugauucaauaccgccauacgcugccugacucgcuuccagugucuaggaaaugaccgcaaggagcuggcgguuucugcugcuggugcaguaugcagauuuugcaaacaagauuuaguuucacagcugguuuucagaacagcuuagagucaaagauucaaacuacagaacgcagugagcaaguucuuaucaaaaugucaaaaucgauuuggccagaaaaccuuggcaggcaacaucugugaaagguuaggggugugugccacuccccccucuccccgccccccaauucacacagcugccaaguucaucagggcaaaggaaccaaagccuguguacaugugaaggcagggcacuucagagccaccagcccucucuuugagaagacuccagggagauggggagccuacugggcaacuagcaagaaacaaaagcauccuucucccuauccauggaggucuuagcaacugccucuagucucuacagggcauacaaguggccuuguuacagacagggaaaagaaaauugagaaaggggaggggagauggggagagggaggaagagagaguugagaaaagagcagaggggagggaaaagaggaagggagaggaggggaagggagggggaagagaggagaggggaggggaggggaagggagggggaggggaggggagaugauugaaagugaagcucugguccaauucucccuuucucugaacaagaacccucaucugccaagagcaagguggaagugaaccccaaguuuggggaugcccugguuugcuucucuguugcugugauggacaaacacaguuuaaguaaggaacugguuuauuuggcuuacacauucagguuguaagcugucacuggagaaguccggauaggaaugaagaugggagccugaagcagaaaccauggagagacaguucuuaccggcucuaucucccuggcuccugcucagccugcuucucucacaacccaggaccucuagcccaggaguggcaagacuuaccgugggcugggcccuucuauggcuaucaaggauccagacaauucccagagaccacucugauguaggcaaucccccagcugggucucccucuugcgaggugagugacucccagguguaacaagaugcgauaaccuguaaccagaucagggccuccaagaugucuucugcaacuggcugauuucguuacuuuucucauagcugugaccagacaccugacaggaaauagcuuaagcggggaggguuauuucggcuguugucugaggggauacagcccaugaugggagggaaggcacagcacccgaccaggagaugcucacaucuggacagaucaaaagagaauacucaggggccuucagcuuauagaaggcgcccacccacauucaaaguggacacugccagaucuuccucaccaacccgcacccccauacacacauucucauuugugcucgcugcccuccccacccccaaccucucaagaagcucccucaaagacagccucggaggugugucuccuaggagauaaagucuagucaaguugacaauggagacugaccaucucgguagaaacaguguuaccaucugugugcuucucuggagccugaauguacagaggagccaagcaucgccaguggggaaggaacgucggagauaccgccugcugccgcugucagagcgccuccaggcuggugggagaggcugagagguggguguauggaucccauaaucaccagcaccuccugcuccauguaggcucaugcugaggucaaaacuaauuacugauucucacauauuuuuucccacuucagacagaaucauaacacuauuaagagcuaauacauuuauuacugugauucucaaccgggcaauauuaaaaccugugaaagugacuuugcaaauuaccaaacagucaccaagcuaaugaagcaaggcuuuuaaagugacugaggaauaauuccuauauuauaaggacagcaaucugugaagggagauuugguuuaaaaaaaaacacauauuauaaccuauaauggagaauguuaaucuguggcgaauccaaucagaacagaacaaaaagaaaaacagagggaagaggaaacacacaggcagagacggggcacaagaguccacaggcaggaagaugccuggaaggaggugcccaugggcccuuguggucccugagcaucacgccaguagccugugauggccuugccagcauuugggaucacagcagaggcgagccucugagaaugucugugagggaguguguagguuaggcuaacugagcuuggaagacccacucagaauacggcaguguugguccauaggcggggaucugggagaaaggagcugagggccaguacucagaucucugcuuuuggacuauggauggcgugugaccagucaccuuaugccccugcuccaugaccuccccaccaugauggucuguccauuuaacucugagccaaaagaaauccuucagaaaagcaacgaguacaccuacccacagccacggcgccuguagcccuguagcguucuccugaaaacgcccugaggagcccugucugucugauccuaagagcuuaggcacagugcucagcggugugaggcucagaugcucugccaccaucucagacuacagucauacccugggaucugacuccaggcaacauagucugagccaagaggguagccuggggaaccuuccaauuauacccaagguccgggcgccacccaggcuaucagcccagggcugcaguccacccagagcaagagguggugcguggaauggggugggcagggccugcauagaugcaaauggaguguuaguccaugguacaacccccucggaagcagcucucuccauagcuacaacacuuuacaagguuccacaucaaagcccugugcagaacaaagccaaggagacaagcaggaaggcuggccgagggagaggaagcccacgcuucuuguuagcagcugacagcaagcaccgggcucuacuuagucaaccaaauccgccuuuaugcagaagcgguucccucauccuuggcccagugguuccaaccggugcuccccccagcagauuucgaauccuauuauacgguaaacaucuguggcauuaauuuucgcccuguaaacaaaugcaggcagcuguggcagaucaucugaugagucaaucacucugaacagcucucucugccugcuuucuucacgcuggcaaaaaugaaauggggcucucagcccaucuguggcaccaccagcagugcggucccugugaggaaacagaccacuucucuuugugcccgaccaagacccuccuccuuuagaauaccuaacaguaacgacccuacaccaagaacacaggcuccacguuuugcauuuuucccuccacggacggacuugauccuugaaaccccgagaaucaguuuguucugugcgaucacuggcucucagcaggggugaccugcacugccaggagaacacuggacaguguguagaugaaccuugaagggugucccagcuggagggagagaauguugguaccuacugaagggcagccagggcugcuguuaaagagccaggacacaccaauggugagcaacaaucucgagggagaguuuguguuuagaggucacaucuccagugucccaagcugaccucaaacuuaauauguacaugagggugaccuugaacuccugauccuccggcuuuccucuuccccgugagcacuggaaauacaggcacgcagugcccacuuugcuuguuugguuuuuuaagcagauacccguccccaccagagcagaagugcuuggguacagagacuucugcguuucugaggaggagaggcaguacccuuccuccccagugauucagccuaggauaggagaaguaacagucuggcucuauuaugcccugugaccucuggucuucccuuucccagguuccaguuggagagguuuuccugugccccacccacgaaccacacccagccuuccuagcucaacuguucccugccuguguguaugaugacagagccaggacaggcccugugccagcaagaucccaucuccagcagcuccacugagccugccucauuccgugucaaugcuguuagugcucaggaugcuucacagaggcaugcugggggcucgcuccgaggcgguggcuagcuagcaguccauccauguaggcuucugccaccacuugcugugagaucagcacaucuguguuucccagggcaguuucccuucaucugagcuuugucuugccacugccaccuuccccagaaaggcacagaaugcagaaugcagagcugcuauuccugauggagaccuccguggagaccgggcuggcuccugcacgggcacucgguguguagucuuuccggcaucucaugagccucagcaccccaugccuaagucugagcugcuggcugccacccaguccccacuucuuccuggaauugggcuguacccaccccauugguucuggagagcucaacccccacucccaccccacccccaccccucaguggcccugucuucuguccucagcagaaccggccgggaagucuaacccugcuguugagacccaaccgagaaaaugcucucaucguagccuuugugaaaaugagaucaccagcaccuccuaagaggcccuaagcaugcuugauuaucacaggcccagaaggucagagaacugacccaggacggcacagcugccagggagccagacucaaccagcugaggccagcaucuccacgccccagaccucagaaaagcucugcugcuauauuggucuggagggaaggcuaaacaugagcaaauauccaggaggcagccucuuuggaccccauccugcaccccuacacucugcuuggagucacagucugacccacuguucaaaagcaaagcccccuugccgcaagggaggagugucccuucccagucuaaaggggaaugccuagaacuccccaaaaagguguggccuuguuagaguagauguagccuuacuggaggaagugugucacuguggaugccagguuugagaucaagcuaggcaugauuagacagucuccuucugcugccuuccaaccaagauguagaacucucagcuccucuagcagcacggucugccugcaugccgccauguuucccaccaugauaaugaauuaaacuuuuaaaacugcaagcuagucccagucagauguuuuccuuuguuaguguugccauggccaugaugucucuccacagcaacaaaaccuuacgauaccuccugcucaucaauggggcagggccguccaccucuacccagugaacucucugccggcaauggcaagaaaguacuugucccaucccucagggacacucugacccaccucugccuugcccuacacucuggaugacuaggucaauaucacauggaaacuuccaggccucuacucuacccuguaccucaggaguacacaccuacaggagcuauaugcuucugauaauaacacucaggggaagggcaccugccucgugucuacaaaucucugguuuugauccccaguguuggagggagaaggaaggaagggagggagggagggagggagggagggagggagggagggagggagggagggagggagggaggaaaggagagggagggagggagggaggaaaggagagggagggagagaaggagggaggagggagggaaggaggaaggaaggaaggaaggaaggaaggaaggaaggaaggaaggaaggaaggaaggaaggaaggaaggaaggaaggaaggaagcucuuaggacaggaagggcccagcuauagaacagcugauuauaaccagcucuuccagaauucccucucugcugaacucugagcagacucuagggaccugugacaaauaaguucaggcuuugaccuuggggaccaaaguugaauuaggugaagaaguaagaaaccagacagaacaagaguggggcagaugcugccgcugucccuguucugcaggaccuaccuuaucugcuuacuuaagggugauggccacacagcccacaaagcaccucugucucucugaucuaccccacaugcacucacgugugcacacacaagcacauccacagaguucauauagaaaguguucauuacacagaaucacuacuuuugggaacagcugcuuucugcucacagaugagaaaaacugaacccuaagugccaagaaagcugguccaggcucacauagcacauagagaauuggaccuuccagguucuuugaugagagaggaagggagggaaggagggaaagagggagagagggaguaacuagggccugguggcaugcugggauucugggcagaacaacucaggcuggcugucugcaggguagaacagggaacccuggguacacacagaaaagguggcaaggcuagaacugggucuagcuugcacuccaauaggaaagaccuaaagcaaccaaacaauaggauggacauucggagcaaggacaguccucuccacccuguccacagcccagcaagugguggacauguccaggaaggcauaugaguccccacccacccacccacucuguucccaagccccaagucaacuucccuggcaaccaucuccaggcuaugugccagucucagcuuccugacacggaaugaccaggcccuccucuauguucugugugcagaagcccucaggagcugguagucaaggaaagaaguccagggugguuggcagucacccacagcacccaacagccaugugcacagggucacacagacacccaaggucugguucucgacagagacccaguggggggugggggaagagucccucccuaccugccuucucucuccuucugacuugcuuauucacuuaagaguguguuccugagccacacccccacccccaccccccaccccggaagauccacagcugccuugggugggccaggccuggggcccugaagacugcccacuagaggggagaggaaggacugugacccucuaguccccuagaauuaccagcugugguaagaacggcagauagaguggccauuaccaaguccccggcaggagacagcccacuggaccuuucaaacuucucauuuaaaaggaaaccuuucagggcuggugugcugacugguuuuaugucauccucacaccagcuaaagucaucugagaggaggggaucuuuaagaaaaugccuccauaaggucaggcugcaggcaagucuguggguuuucaucuugugauugaugggggauggcccagcccacugugggugggguugcuccuggggaagggguucuggggucuauaagaaggcaggcugagcaagccaugaggagcaagccagucagcagcacccuccauggccucugcaucagcuccagccucuggguuccugcccugccugaguuccuguccugacuuccuucaguaaugaauagugaucuguaagugugaaugaaauaaacccuuucguccccagcuugcuguuggucaugguguuucuucgcagcaauagaaaccccgacuaaggcagccgggcagauggcucagugagugaaguaggugaugugcaguugugaggaccagaguucagaugcccagaauccacacagaaacccaggcaaggugguccuuauguaaauuccaagcagcagggaggcaggggaggcagguccuuggcauucacugccccguaguguaggccaaacugaugagcuuccgguucagggagaaagcauccuauauuuacuucuggccuccaugugugcacacacacauccacauaguucuauauccauuguaaguguacauuacacaagaaucacuacuuuggggaacagcuacucaaaucaauugcacuuucugcucacaggugagaaagaaugaacucugggugccaagaaagcugguccaggcucacauagcacauagagaauuggacccugaccaugcuauucccacaccucccucuccagaacagggacucauaccuccccaccagccuacugaauaccucccuuaagaguaaccucgucccaaccccagggugagguuucccucugcacaggcaguuccaaguaggucuaagcuggauccuuggggcuccuggggugaagcauugcauggcucuauggguguacagagaacuaccccagcaugcuuugcaugacccuggcucugucccagcaugcuuucacgacccuggcucuguacuguccaauagggcugccaugaacucuggcugcucagucccacccuacauccuugcuuucucagagagcugcaguccuacagccugacuaggcagcugccaggucuaucugucccaaaucgccuucuucagagagacuccaggcucucccacacuguucuccccucucagagcaggcuuggcucgggcaggcaaagccuauucucccugcccuguuaagcacagcucuucaaaggcacaucucacguugaguuaaacccuuucgugaagccuuugguagcuuccauaaauaccauagaugaauaggccagagcccaugaaagcccuuauuuacugcaggaugaagggccaggaggagcagggcgagagagccuggaacacagccauggggcaggucagcuuaggagggcaucucagcucagggcuaagguagagagucaggagguuuugugagaaggacucugggcaaagaauaugucugccccucaugucccacaaagaaacuagcuucugucacuucccuacaaaacaagcaaacaaacucccuuccauuaggcacuucaggacgcuccagagcaagccucauauguacgcaggcugugugcucugcggcacagugggugcuaggacagcuaaguaugcuugccgcaagacccagugugagagucgaggacagccucacugaaugacagagggacccggguggugacagggacgagcccaggaaagcuaucuccugaaaggcaagaaugaaccaaagccaugucucugucagcugugucguagcucacacagcucagaacaugcggaugcaggagucauuugacuagcugacagucauuuucccaagcuaacgccaaaucaccuuuucagucccuccuuuggaaauggugcucaccuauaacugaggcagcacccaggcugacugcugagcccuggugggagggaacuacaggugaaaggaaacuugccacaggaacccagguugucuagaacagccagugagaagaaucugcuacacacagggcugggaggaagccugccauugacacuuggcaguuuguuuagguguguaaaauguaauuaauuuuaguuucacacaucucaaguggcucuaaacgaugcucauucuggaacauucuaaaugucucauggaagauuuuuuuuugguuucuuauagugaauuauacucaaagaugggguuaagacuuuaaaauguauaaucucacauuaagacugaagccaucugcauccccugauggucagcccagagcccagagucuuggcucuuguaaaaaucucuccuggaacuuggcuggacauaagcugcuuccauugcugggaacccccuugcccuccccuucucugcacacaacucucuggcagcagcccaaagcacccaagaagguuuccaagaggaaaagaggccuguauccaggguucccaaggugggccuuuaucaucgggcagaaaugaaagccgggcccaacauaggaacaguggccaaguggguugugugucuccgaagcaccuggacagcagcuggcccagauucacuguuugagggaagagccugggccucggggagggagcaucauccauugucaauaacaggccuggaggccucucugcaucacuuguuuucccuaaccuucugaggcugccuccacccuaccaugagccucauucccuuccaucaacagaagccagacagcaccucaacucagacgaugcugucugugacuagagcucugaaggagccuuucucucagcucugaaggagccuuucucucaguccuaagucaaagccaggccuaagcccagagagaaaugaacauuugcccuuguaugugaacuguucucuguccacccaaacccaguccacaggaacucugccugauucugggacaccacucacuggcaccuccaucuauaucauaggcucucauuccagccuaccccagggaguugcuucagccggacaaaacaauccuugcucuguuccauguguuggucaggucccaucccacccccaccagccacuggcgauacuuuguaucacucacccuagcuucauaagcuguagggugaugaccaaccccucucuccagagcaacuacuagaaagcaggagaagcuggaucguccagagaccacagagcaacacacuccagggcaaacccugagccuaauccugagagugggcaguaccauuuccugucacauguguggauggugcagggagcuguuggcuucccagaaagcagaggcacuagggaacaggaagguucuuuagaauccauagagaucauggcccaggguagugugacaagacaaggcucuaugagacugcagggggcacuugggcagucuacacacacacagucacugugaugacaaauguccccucauggucuugaauacuugaauacguggucaccaguugguggcauugcuugggagguuauggaaucuuugggaaauggaaccuugcuggaagaaauauaucacugguggaggggugcuuuuuguguucagagucucaccccacuuccugcucaggcucucuacgucaugcuugcauuugacaaugucaacagccagcuuucauacguugcugcuugcugccaugucuguggcuugaugcugugcccccacccccaugacggaaucuaaacuauuagaaccauaagcccagauaaacucuucccuuucuuucuuucuuucuuucuuucuuucuuucuuucuuucuuucuuucuuucuuucuuucuuucuuucucuuucuuucuuucuuucuuccuuccuuucuuucuuucuuucuuucuuucuuucuuucuuucuuucuuuccucucucucugucucucugucucucugucucucugucucucugucucucucucucucucucugucucucucucucugucucucucucucucucucucucucccaagacaggguuucuuuguguagcccuggcuguccuggaacucacucuguagaccaggcuggucucgaacucagaaaucugccugccucugccucccaaguacuaggauuaaaggcaugcgucaccaccaccuuggucaugauguuucaucacagcaacagcaagguaacugauacaauauugcaaguaaaaagauacacuguauccaugcagggaaggcugagcucuacccugcaugaaggaagguggagguacaagcaaucaagcugcaggacagagcaggaaguaggaaggacacacugaugggaccggaauggaccccccuccuccaggaggagcucuugacuccugcucugcaaaaaugcaguugcaagaggugauccccauguucucauccagaucugaugauggacaggucuucuggggcacguaagaagcugcuuguuuccuuucccauugggagguuccagaagcauccuugagaagaccuuccaggaccagaacauacucauaaugucucucaccacugauaauauauccuguucuugcugagcuggacucuguggaagacacuguucgugagaccaagcucaagaacagagugacacuucugggcugauagcucuuaccgagucaccaccagggucagucugagcgaagccagcacccagugugcaucaggaggucaugcauugccuacgugccuaucccagguaccaugacauuuuaauacauauguauauugugucacgauuacauaaggcuacacaugucuccuguuagugcauaugugugguauaugccuguguguguuuguguggauacacaugugugugaagggcagaggugggugucuuccucuguggcugcccacuuaucucaauagauaugacagagucuuccguuggcuugagcagcuggccagugaaccccugggaucuccauguuucugucuccucuccacugcgauuacaagcaugcauuucacacccauuuuauauaacuuuauuuuauuuauguauaugugucuguaugugugucuguaugaguguauguacauauaugugauggggggagagggacuggcuaccagaagaaggugucagauccuucaaagcuggaaugaguguuucuggagugcccagcuugcuacagacauacucaguuccaaacuccagucuucaagacugaacagugaagguguuccuaaccacugagccaucucuccagauccacgcucagcucuuuacacaggugguagggaucuggacugaguucuucaugcacuugagugagucagccaucuugccagcuuccagcuaaaccucccucccucucucccucccccucccucucccccucccccucccccucccucucccucucucuccuccacacacauuaugaaggccacagccuaggugucacucuccagagucuccccaacucuccaggaaggagcuaggauacaggggcccaugauaaugcaucugggagucaaaaaaauaaauaaaauaaacaggcccucagauuaaagggaugccaucccugagaugggggggggggguaucagacagcagaaacucaugagaaagguguuggcaggaacgugcaggaagagugugcaggggcccugcuaugccucacacagggcagacagcugaagccaagucggaaacacuaggugggggcaggagggggggucucucccuacuugagcagaauucugugacucuuccgauuucuggaacgacuaggagguuggacacaccacauccuccguccuggacagcgucagagggaugagggaccagccuccaauuaacacaacggacaaacccugccacgggcgcagagaacaggcucgauccucugucuucugucaguacauguuaagaacaagacggaagguagcugagaguagggggugcuucaacuuuaagguacauuuuuaauuaaaagaaagagaucagagccgugaugcggcaucauaaagcagauaauuuuacagcuggauggucucccucugauguacuugaaaaccauuuucaagcgacauaaaguuuaacauaccgguacaucugccuacccgcuagaaucuacauggaauuuaaaauuuaauuauauuaaagcuuugcuacagugugcaucgcaagcccaguaaccaaguggaacgucaggagaaagcuuuguuugguuguguuguguuccucaggauccccgcccccuuuccgcuggaauucaguucagggggaacccaguacugaguuugacaguugaugaagcuguccgaaguguuuacugcacacauaacaaaccccuggggacccgauuauuuacucuccccgccggugcugcuuaggggcccagucccucccuccucaccuccuguguggaaagaguugauccaguguuaaguuugugucugugucaccuuccucagaugggaaacuuuuccuaguaaccuauuagccacaggugcuuccuucgguuaaacacgcaguccuggcucggggccaguucaacagggacgcuugcccaaagauucaggaggaccugugcuuccucgccaguacuggaagaugaaggaaggaagggaagaaggaagaaggaagggaagaaggaagaaggaagggaagaaggaagaaggaagggaagaacaggaaaaagacagagaaggagaggaagggacugcgucggggaggaaguaagaacaagggaguaugagagaggagcccucacucugugacucagcucugugcggugcaaguuuucaaaauccacauaaauucuuuuuauaauaauuguuaacuauaaaaacgcacguuuaaauugugauguauuucucucuagucaucauauuuaauuucuggauuuuaaauuaauauuaaaggaguuuaauuaauaguaaagguuuucuuuuuuaauguuugggagucaaggacacaggcccaaaucuauccguucugaaaagcuacacugaaucucagugaugaacagggcccuggcagggccucuuagagggacuccuguccagagaugcccagcagaugggggggugcagaggcaaaaaggaggcacagacgagucaaagcacggguagacguaaguaccaucgcaugagucugagcggcagcuuugacguccaaggggaucgaugagggaaucucagagaccaucagggcuggaacugggacuuugugguaauugugucacagaccugcaucaggagaagagccuggaagguuuagccaggagguuagggagacaguccugagggagucccgggcacuccugcuuuaaaaggucaggacaauaagagcugcacaugggguugacacagagugacggccacagcaggagacaaggaaacagcugcugggacaagaagaagcgacuggcaugccagagccaaugguuggcaauacacugaggacagagccagagccuuugauuuggugaccuaagcgucauguuggaggggagaggggggaggaagagaguggagccuaggagcagagcaaacauggaggcagcagcuagugcuggcccacugagggcacagaagagacuguugcagcucucagggaggcucuagucuguucuuuaaaaggaaccaccaaagacugcuccaugcugacaggaaugucccaggagagaggggguaaccgggcugauggacagugaggggguauuaacaacacccccagcagauggaaaaaaaugagacccagcacacaagugucugggguccaaacgggcuaccaacugacccagggccaagcaugccccguggguggaccaggcaggaagcagagcugcuguggcgguggugcgugcuugugaagcgugaggaggcaggugggaucccgaguucccgagccugggcuucauaguucaauaaaccagcaaacguaacagcagagagcaacuccagugauauagaaagcuguaaugaggggagacagucccucgugugacagaacccaagacaugaaacucaaaggugccugagaggcuucaggaagagaggaugacagcgggguacaguggaguagaggucgggcaccaggaacaccccacacugccuccaggggcagcugaaccagggcugugggagcagaaauggcuccugccugagcagcccgcagggaagcagcugaguuucccaagggcccugguuauggagcucacucaacuccagaccuccuucacagccugggaagcacggagacgucugcggucagccauacacuaucuucucguuugaaagcccuccucccagcuccucugacuuccugacuccuguggguguaccagaugagacacacacacacacacaacacacacacacacacacacacacacacacacacacacacacacacacaccucuaaagauucaaagaugacauccgcaaacaagagaaagcacgugauguuugucuggguuaccucccucggaaagacuaucuccagcuccauccauuuaccuuugaauuuuauaauuucauuuuucauaaaggcaaauauauucaacuguacaaauggaccacguuuucacuagccagucuucagcugauggacaucuaggcugcuuccauuuccugguuacugugaauugaguggcaguggccauggaugagcggaugccucuguggugagguguaaaguccugugguauaugccccagagcacaagagcuggauucuguggcagaccuagucuagcuuuuuugagggaucuccacacugacuucuauagggguugcacuauuuuaaauuugcaguuuuguuuguuugcuuagagauuacaacccacucagugcucccggacuggacuaaaauccauuaaguagcccaggcuggccucaaacucagcacuccugucucagacucucaugcuugggcuuuacaaguacgagcucccaauccaggcuaauuagcucuucaaagauguagacucagacagagcuggagaguaauuccuaauaauucccagggacuccuaggagaaccagcaguggcucuugcagaacaaacacuaaauugauagcccuuuggcaaacugcgagaagacagaaucgccgggaacagugaaauccaucaccucguguccuccagacagcgggcgugugggagggagccugggggaucguucugugguaauuauuacagugucauaacuucgaugaaacagacaaucccuuaaaagacaacgagugccaagcucgugcaaaaacauacagaccacaaaacaaacuuuuaucuaaauuaaauguguagugaaagcuugccggcucaggcgccggcuaucuugccugugaaugccagcaaacauuuauagaggacauaagacugaaucagcacagacuccuccacaauauggaagacagaacauuucccgcugguuuuaugaauguaacauuauccuaguacuaaaaccaggcaguggcaauguaaggagaagaaguuaucagccaguauuccucaaguacgcaugccaaaaaucuuucucaaaagagaagcauaccaaaacccccuuauaaauaagacaagaaugcuucauguucaaguaaaagaccgauuucauauuccaaaacuaaaguaacuaauaugcaauugagagacuaaagggagaaaauaauaugaucaccucaguaccugacagcauccaggggccuccacccauuguaaaaacccacaacgcuccaacaagggucuguaaggaucuaacaguaugguuuccugggucugauaacauccaauagcuaggcaccaugcuuucacugggggaaguuggacauaagggagagaccucucugaacuauuuuaugucuugagggccaguaauuauauaaaauauaaaaguuagcccaauccccaccccaaauaugcuugcaaauuauaaggggaagagaacgacuucaaucugacaagaggcauuuaugaaaaauguaaaguuaguugacuggcgugguggugcacaucuuuaaucccagaacuuggguggcagaggcagaaauaucucugcgaauuugaggccagccugguccacauggagagcaaguuccaggccagucagagcuacacagggagacagucccugucucacaaagcaaagcaaaagaaagcccccggagccaaugccaugucugcaguuggagagucacaauucaauaacagagugggaaccaaguuuuaaauaggcaaagauuggaaaacauuucauuacagaagccacagcggcggugagcgagcaccugggaaacugucaacaucaccaucuucagaaauacagcuaaugugccccuccuccugcaaaggcuuuuaagugagugagguggggaggggcauaguguguuugagguaaugcaggagcuccugggaacagggaacacacaagcacucaggagagcugccuguggccuccaacgugagagacgcagcccaggcaggccacucuuggcagagguucccagaagaaacaagagucuacgucccugcaaaaaucuaaaugcacguguucauucaccuuuugauaaaaaauauaaaaguuagcccaaucccccccaaauaugcuugcaaauuuuuuauuugcuaauaaaacacccuucagcacacgugugcaucacaggguagguaggcgaauaucaggggugagguaacacuacuuggcuguuaaaagcucuggauuuuaacacgugcaggaauguggauggaucucaaaaauggucaggugagcacagggcucaggguuaaaagcacaagccacaacauuuagagagagguuuaaagaaugcaaaccuguugguagugacauaaaacaaaugcucguuuagaggugggggcggggcaagauggacggaugauggaggagcacacacccuugacuugggugccuuucuuauuccaguaauggcagcaccuacaucacgccugcgagcaucugucaaacucaucgucguuggacagaaagggggaaaugcuguggguugcccgaugcuguuuguauucugaugucaauucugcuuccucaagaggggcugcccccgacgagcagucgaccacguacucaggugaucucgugugaaccuucuccccguuuugacuggccaauaaaggcuggagccuaugaaugggcaguggaggggaaaggugggaggucuuagagagcaggggcaggaaagugaggagaaggagaagugaaggagagaggaccgaagaggaggaagaagcaaagauggagcaguaccgcguggcaaggaaacauugcaaguagcaaagggucucguagcuggggacugaguuuguauagagcgaaaucugcccaaucuaggcauguagcugauaaauauaauaacuggauugugugauuuuuauaugggcugauugggguugagaauuucugcaacucacauauggacaguuuacagucacaagucacaccacaaccagaugguuaauaaacacacuuauugaucaagcacuguagucaccccaucuuacaaauauagaaacugacucacaauugacauaaacccagagccaaggcuucccacagcaaggacacaguguagauauuccaagugaaugagggugagagcaagacuaguuacgaagcuccucgcccucguggugacugugcgcagaacucugcauggugacugagcacaguauccuucauggggacuaugagugguacuuuuugggaugauugagcauagugcucuuucagugaggcuggcccuagaaagaaggcaguccuagaagaggagaggcaaggcugagcuaggccccgcugcucuuucauggccuuucuggagagggcucagggucuacccccaucuguacuaagaacugcgugaacagcacccacguguucuaguauccaguggaccuaaagccauggcaagccuugcccuguaccuaucucugagagccuggguaagugaaugguauuucauucaugauuaaaagcaaggcuaaucuuuuauauuuuauagaguucuuguaaaaguuuaaaaauaaaguggaguccagauuccucauccugaguaaaaggcuggccuuguucaucugccuggcucugcccacucugccuuaccacuccaggcugccucuggugcugccccauggccuuuguacacacucggguucguuucagauguguuacuguguagcuugccuccuguccuagcagugaugucaucucuaaccaccuauguggggagacuccuugacuccaagacugcugauccagaauucgcuggcccaggcuacgcuggggguuguuacaguagaccaucacaguaagacaaagggcgugugacaaagggcguguggcgaggucuggggaagacaaagccuugucugcuggagaagcacuucagaaagcagaguugggguguuuuuacauagugagggggaggagcccaugccagcugcaucuucucgcacacaccagaccagcauauuccaagacggaagagggugugcacgugaaacaaccguuugcacaaguacugagaacacagaggaccacucucgugccaggaaagagacuacacaccagcugagguccaugacucuggacaaggggcgacuuugcaagcaggccuucccaaagacaggcucaggguuguucugggaaccacagacaggccugacaagcuaaauaucaucuucaugccaccuccugacuaagcaaaguccccuguguguccugcacagccuuggucgcagggguagauuagauggagcugugucugguuuagcaccugucugcugcacuacagugugagccucuccagaggcagccaugcuaccugcugggcggugaggugagcuuucgcggaucuguaguuagugaguggaggauggaagaagaaaucagcagaaggggggccucaggagagggcucagcccaaagccuuugcuguacaagcaugaagacugggguucuaagccagcacccagguggacaccaaccaugguggguggcaucuacaauccuagcacuggugaggggauggugaacaacagguagauuccagcgauuugcuggccagcuucaaguuaagcaagagauugucuaaaauauuaggggaaagcaaucaaggaaaacuguaaccuucacucacgcauacagaggcacauauacacgcacacugcuacaggcacacauaaauacacacacgcauacacacacacacacacacacacacacacacacacacacacuacacacaucuggcaaaguggcugacaggcauugaauaccaggaucuggcaggucuauucugauuaaucacuugacuuucugggaccuuggggagacacccacagcccugagugaagaagcucuguacaaaagcagccugggacaucccuagggguggucagcaguccagagaagggggaagacaaguucaaagucugaacaauguagacccucccugaagucaccucaggacggcuggcugagaugccucucuccccagaucccccaccacccuuggaaggagcggagaucccaaggaguaacaagagccuaggguaccaacaggcugaggcaggaacuucaaacccagugcugugcgugaaacacgguuggaucuucaguucuuaaaauaaacaaaauuguaaagccucccccaggucugaaaaaauaugcaguuaguuuaaagcaggagauacaggugaucaauacgaaucuuuguauuuuuaaugggaaucauuacucaaaauaugucacuggccaaucaauacaaaaguuaaaacucaucaauauuuaaauuuuucccauugacaucuuaucauccuggccaggaaggaguucagcacaucgcaaaauccauuauuuaaucuuuugaguuugcagaguucagaauuaaacacuacuuggcuggugggugucaguuagcagccuggacagaggcuguagcagagccgauuugggaggggacagaaggacaagucauggaaaaaucugcauuauggucaaucaggcugacacacccuggcugcuggagcuggcaguccucugugauguccucugugacauauggaguggccaucuuggaggugugagauucugcagagguggccccucuguggccucugacacaugaccuggcuucaggucagagcucagauuccuccagggggugucucuggaggccucucaggcucauuucuuccagccuuacacuauggucucucucugucuuugucucugucucucucucucucucacacacacacacacacacaccagguugacucuuguccucgucucuuguuuuuuuauaguauucuuuucuacuauaaacaucaucccaccacccuccccaggccugguuaacuccuucaucuccucgggucucaccgucucuuacuuuucgcuaggagauauuuccuuacacaauauggaugggugagugaucccaugcugaucuggagggcagguucugcgucaugauaucauccacugguccauccacuccugcauccccaucccccagugugguaccugggacacaagaggggcccagucuacaucagauaaauggauccagaucagaaaguguccccaaagcugacuggaagaagagcaauuuggaugggucggucauaaccuaggggacagagguaaauauccacuguugguucgaugcccccccccaugggcgcucuagugggggaagggguguucccaugggaacacggggagcuggggcagagaauguaagacacagagaaauucuccaucuccuaaaaacuggagacugcauuugaggagaagacgggggugggagcagaggcaggggugucacuaagaguagguuucagagaauucaguacccauccugucuucaugaccuacugcucuuggcuccagaaacaguuauuucauuagagcauaaaagccucuguucucuaagaguucaucucgaaccgcuagcaacccagcgaggagggcaguaaaucuucgccuacggcaauuucauuccugcccuaucggcccgagcccuaucuugccaacacaaggcuucaccguggagcuucgggaaggagacccaugaucugaaacuucaggaaccuauguaauacacgcugcuggcagagcccgagaaaugguucaaaaauccauuagugggcuggcgagagggcucgguggguagaggugcuugcugucaagucugacagccugaguuugauccccaggaucuguguggugggagaaaaccccaguccccuucaacuauguacagacuaaauaaauaagcaaauaauuauauacucguuagguguccugacuugcaguguggucuuggcuaauacaucacugugacuuuggaauaugaacguggagacaggcauugaagaggagauuguauuuaauucugcccuccaguggcaaacagaacaacccagagaacuugcuccuaauggcagagggaccuuguguauggcaggagcguguugggugaaugucacagagcacaggaugggggacucacacaggagaagguguggugguuugaauaugcuuggcccaggaaguagcacuauguggagguguggccuuguuggaguagguguggccuuguuggaguagguaugccauugugggugugagcuuuaagaccuucauccuagcugucuggaagccagucuucagaugaagauggagaacucucagcaucuccugcaccaugccugccuggaugcugccauauucccaccuugaugcuaacggccugaaccucugaaagccagccccaauuaaauguuguccuuauaagagcugccuuggucauggugucugcucacagcaauaaaacccugagacagaaaggaaaugguucagagaacaaaaguggggcccucacaaucaaagcagugugaacugagaauggcuaggcacccagaagguaccgagacaggacagucaccaugacgugcagcaucaugccccagagucuacugugugucugaaugguguaugucuaggacggggggugggguggacgacccaugagccagcaugugcucaguggauuuuaagguucaccuugcacauuaaaaaaugcaguccuacauauaagaugcugugggguaacugggaguggacguccucguggcucaaaccuaaagccaugccccugggcucaggccacacaggccaugacuacuaccuagcuuuccugagauaugggcacagccacacuggccucaccccugcauaugggcacagcuacaauggccuugccccugcauaaagaccuccauucaccauaucaccaaaagugcccggauguggaaagcaagaugaaugaggaacagugacaaggugagugacacacaggacuccagaagucuugggaaccacaggacacccuccuuaggagggaaugggggaaagucacagacacuggcaaucacagggggcugcagaggcucaggagcugcugugcugggcuagcagacagcauuugaaaaugaaggcacagccacccucucaacauugugacccaaugaugucaccuacaaaauuaacacucacauaacagugugaucaaguuaccaaaaagaaaagaaaaaucacaccaaaagaaaucucaugauguuuuaaagcaaauuaauggccugugguggcaguggugguggggggaagggggagggucuggccagccagauggagacagaauggcucccuauuccagggcuaccuggucacccuucucucucucucucucucucugcuacuggucauucauagagcaucagcaaccaaauauaaggagccucuaugagugcuccuugaaacccaacugugcaccccucuccagcaggaagaacucgagagaaagcccaccgggacuucugcgcccucacagacgugugaauuuauaguuauugugggccugugcuggguguguuugccuguggccccgaugcuuuuauuacuggccucuucugcaugagaauagcugaccauucguuagcaaccgggacaugccguuaacuguaacaucuaauuccugcccagguuagcgcuugauuuacccagccauuugcccacaccaugcaucaggagcuggccuauuuucaugacucuggguaccugucaggauucccugugccgucuuuaugcuuuuacuuauuucauuguguauauuuacugugccugagcauucccacacagcuuuccauugcacagugagcacccccagcccagccccuuggucccccaggcaaaagagagccacugugggaccucucuggugucaccucucaguggggcccuggugacuuguaagccccucacaugccuucucugggcuauccuggggagcgagcuugggaggaccauucaucagggcagggaugcucuggaaggucauuucugggagcaccauggagcuucuggcuccgagagaggccauggaugaggguucuguauguggacuccuaaggucaggggucggucaccugcuccuucuccucuauucgaagcggcuccuccacucucaugccacgugcacgcacgugaccuugugcaucuguaaagccuaggcaccacaaaccagagcaagcacacauaccuccagcugcucccgcuuucauaacuccacccuuccacaccguucuuugccccuugccacgucugcagacaccauaacauagcucuugcaaagagugcucaguaagccccgaugggcggguccccucugguauguugccguggagagcuuugggucaguacacagcaguagugugacugggucauaugguggagacacuuguaguuuucugaggagccccuguaguggccggacuaacagauacucucuuaucuacacgguguauacauuccuuuccacuggagcacagucucgggccagcgcuggaacaaagcagcaagucucagcagcaaagaaaggcagcagcaucuuugcuucccccucgacagaacgccccagccccugugcuugauucucacugauuguggguaccaggccugcagagacagugcgacgauccuuaccugcuuaugcacagagucgcugacuuugccugccugagguggccauguguggauggccccagcucccucugcgcuccuagaaucacuuucuuuaaaggacaguuuuacaaaauauguacuauugugucuuauacauuaaucaaaaucauggcuccgagacuuuaauucuccccggagaacccuggagcgguguuuuuguuccaccaauggaaguggccugggcuuugcaguuugugguggggagaugcugagaccccugcugcuuugauacccaccuccuguucuuaggacucuccuugaacgugaacagagcacaugcuuugagcaugacagaaugcgugcuuugcuucuggccugcagaacaccacaaaggucacaggacaggcucggugacuucucucugugaggucuuaccuggaguccucucccuugcuggaucuggagauacagacagugcugggaagcccugauaagagggagcuagauccuaccagaaauggaaagugagagucugggaaaauggaggcggcucaguggguaaagugccugccagcaagcuaagucggaucccuaguauccucauuaaaaagaaagaaaaaaaugcugaagauggugguaugcauuuguaucugggaagacagagacaggagaaucccuggggcucacuggccagccagccuagccuuccaagucaagaagauacccugucacucagaaacaagguggacagaaccugaggaucagcaucagagguugaucuccagccucuacgugagcauacacauguacauguggauuugcacacacacacacacacacacacacacacacacacacacacacagguuggaagggagauaaaaacacagaagaauggaguccugcugacaacuguaagaaauauaaccaagcaagccgaaacugacccuuccuaggaacucagagccuccagauguuagugcccgugaccuagccggguccgcccuggacuccugacccagacacuaugagaugagaagugggaugaucaucacucaccacagagcagucacugucagcagucuggguuuugaucucuuuuaccaucccugugaccuuaggcuagucaggugggaacuucaggguucuggucucugcucuguaaauguguaucaggggcuugcugccgggauuaaagccaccugucaaaaugaguugucauucuuuuucuuaaaaaaaauguuuuccuuuaaagugugugugugugugugugugugcgugugugugcgugugugugugugugugugugugugugugcaugcauguguguguguguaugaguguguucauguguguacaggugcccauggaggccagacgauggcaucagguccccugaagcuggagagcuggagcuguaggcaguggugaacugccugguaugaguacugggaaccaagcuuugguggggagcacuucugugguuaacuuugacugacuucuugcuugugaggcugcugacaucugucuuuguuuauaauuaagaugugcguuauacccugacaaguuccucugcuuucacauauguccucgagagacuguccuacccuaaaggaaauggccuuggucaaacauagaaacuguguaccauaaacucgccacauaagcauuuguggccauuguuuaucuuccuagauuuggccaugcuuucuguugcuugccuuuaaaagacacugagagaaugcacuugcugcuguugugguauugaccagcagugcucccaugucugucucuugcaucuucuuucuaucuuuccuaugaucauccucaccccccaggcgugguucccagguugacugacuggcaggcucuggcaaacuuggguucugcagaaugcuucuaacgacugagccagcucuccagcccuuuuucuucuguauuuaugcauguugugcaugugugugugcuuguguguacacauuuauguguaugccagugugcaggcgugugcauguggaggucagagguggcuuuugugugccuuccucaaucacucuucaccuggugcuuugagauggggucucccacugagcccagagcucaccaauugguuagacugaccgguuaguuaacuguauggaucuggccaucucuaccuucucugguacuaggguuacaacacacacacacgccacacugggcuuuuugcauaaguucuggaaauccaacccagccccuucugcuugcgcggcaagcacaucacagcugagccaucuuccccaucccuauuuuucucuuucuuauuaagacagccuuuagcucaagcuggccuggaacuuacaguuaccuaaagcagccuugaauuuugauccuccugccucagcuucuucuugauugcuggggcaccaggucuacuucaccauauuaagauugcuuugauuguguuugcuuuugaagucuuaaaacuucaccuaggcagucaguucucauccuugcugacugguggauaacauucaaugugguaacagggauacaauguaucaaaucaauguaauaacagggauacgauguaucaaagcauggagccuguugguuauaucuucauccccacucagguguguggacaagugugcaaacauguuacuugaagcacuuacuauccuuuugcuuccugauuggccccauuucccuuguaaugaauuccaggaucuccuuggucccugagggccgugcuuccugaagcccgcucgauggaccugcuugugacgauuggugauacauucucuugucucagccccauggagggcaggacagcucuucucaacauccuucucugugggcccaaguuaguaagggagauugcugauguagcauuuuuuaauggagggcccugagggcaggaagucuguacccucaaucucaccucuauggagcaccacgggguacuaaggguacucacuaaggacccugcuaagaaaaaccgaggaaaggucacacugguaacuugugucagcuuaguccccaggagacccccaggugagauaggcuuuuaaucuuuauugucccuaugguacaucagaucccugcccccucccugcaggaaugccaguuuuccuauuguggggauccucugagcuccuagcuuguucuauacauacacagagcugccugcuucaccccuucagggagcccagacagacccagagcgguuggaucacagcaagccugucuccccuggacaaacauuucugcugcacuuugggcucaaggguccguccacauugaugccccaggacacacacuucucaggacacaauuaaagauggccugugugguugacugccaucugauucugcugauuguuuugccugggaugggaggcugaggcccccuccccugcccacucaucugcaccuccuguuugaagcccuggcuucuaugggcuuccccggcuucugccuugagcuagucucaaccugagaccccagcaggacagacagaaaggugggguucccacagccucacaggagcuuaggacugguuuggagggagcuugagccaauggagucauuuuaaugaaaaggaucaagcgcuagcaaauccuuggaggaaacagaaggcguuuaauccuuuaauuucugaaauuugaacugacauuagggguccuuuaagagcucugucaaauuaggcagcgccugagcuccagaccccaggcugccugugaaccacguggguaucugggaaauauaggaguuagaagugacuaacuuagcaaacugcucuucauucuacacagugcucugcaccccugaacccccacacucugcuccccaguauaaaccucagcucuuggaguccucucacccacaggcaagcaugcccugauguggcucucugcucugcagucuauacagcaagcucccucagguuuccugcccuuccaucaaggucccugcccgagccccugacacacaagacucuaucaccaaagcacauuccccgccugugcugcucagagcacguuugcacaagcaagugaaacacuaguuaucugaaacauggaggcaggauucucguaacagccaagaaccucaagccauauguagagacgcagugagaaacagcucugacucuaaaaccaucugggaaguaaaaugauaacgcauuaaagcccagacaaaauggcugccguccuggugcuguccguuccagaagccccugguccugucccuacccuuaagugacagcauuuccucccucuucuccagagguuguugcaucugucaguagagauuagagugggaagcucugagaccagaaccacccacacgagucagcacaugcuccgggccugaagaacgcagccucuguagcacagcgcccuggcuggcaaugcuaauugaacuaacucguccaaagcccucugaggucccgggagggcugaggcacagaacagagagcucaucucggaaaaccagaaacuaagaaaagaggccuggagagguggcucaguggguaacagcguuggauaugcaaacaugagagacugagcuuggguucaaaaccccugcaaaaagccaagcauggcauauuucccccuaagcccagcacucugggaggugcagacaggaucacugcgcuugcuggcuacagacacaguuccagguucagugagagacccugccucaaaggaguaaaguuaucaguagaacccuugacaccuuccucuccccuccgcaagcacgcccauaggcgccugaacccacccauaggcgcacacacagaccaccccucucccccacccccaccuucccaccacgcacagcacugaaguucaaaggucauucugcaaauuaauugaggggacuuugaccugggauucuccacccaagccagagugaauagaaggcccaugggaauauccugaagaccagaaauugagaagaaagagagccaguauggcuucgaggccuaggccgagggcccugggauuauuucccugucugauccucuggguagccuggggcuggaacccuggagaggcaaaaucucuugugucaacauggccuccugucaggaauuuggaaucaggaagccagcacagcuuccuccggucugcuacagguuuugaagcaugaagcauaucacuaacaugaaggaauagcauuaaagguuaauuaugagccguggaaaggcuacuuuugcauauuucaccucuuggacaaaagcugccuucucauuacuaugcuagaauauaaauuaaucugugaagcacuuaaaaugccacaaaaccuuccuuaugauguuaaugucaugaucagcuaugccugcgcuggccuggccugucugugaggccuucuugcccaagucugucuguccuaggugcucugacugaaagccacuuguccccggucagucauuucgucuaaaggugaagcauccuuucccagacuuuuucucaccaccccacccccauacaaaccccaccccccaauggcuccucccuccagguuuuuuguuuaaaggggccaaacaagcacaagggcaagagcacccaugcaaagcccaccccagguccaugcagcccucagccagccguaguccucaacccaggagcuguuuuggcugacacagccucugucuauagcuucugacagaaaaggacgauucugggcuuaauaaaguuagacuggguuucgcugaauaauuuaucugcacacguugcacuucagcaaguugcugccuccggugcuuaugccaagcuccccuggagugagcuuggagccugcuguguagggaccaggagagauggggacacagggcugccaaagaaggcugcugccaacaggccacagggagaagcaggcagaagaggagcagguacacccaacauggcugccuagagaggcagagccucugccggggagcgagcuacaaaauagguaagagaaugaggucaccucugcagccacagaaccacacccuggagagagaggcccuggaggccugggucagcacugugugacugugguacuccaucacagaucaagguccaguccgagccagaggcugagcauggagucccaagccugucacccuaggucucagaagacuggcaggaggacagugaagucaaggcugcacagggccacacaacaagacccugccuuagcccccuccacaacagaaagugaccagagacuggccucgagggagagggacacaggaaaggaaagaggaggccucugaagcuaaccaaaagcuaacguaacgccugcuggccauuuaugaagagaggugucuagaacucaagauggaggaacgcuugcucuuagggaagaucuggaguuggccuucagcgagguuccuuuccagccaggcacccuugaacagaccauccacgccuccaucuucccuuuaaaguagggaaagauggaaccuaaguccucagaagcuacaaaugcaggaaguccugcagagagcacaccuguauccaucgucccugcacacccccccccacucagggaucucaggcaggggacacagauacaaacccaaccuccgggcaugagaugccuucaguacgucguuccccagcaugucucacauggucuucaccacugcccugagagggaaauguuugccucacaggaguggcaagagggaaaccugguacucagaggaaugaagggguguguccccuacuccucugcugucacaugcucaguaugcucagcauacagcaagcagggguaaggggcacucaggucuguccccaaagucacccuucuuaaaaugacucuagacugccugcucugcuucccaagagaaguguccaggaaagccaggcgguggugcaugccaugucuguaccagagaggcugcaacaggaagauugcaaguucuaggccaaccuaggcuacacagcaagguccugggaagaagacaagaggggaggagaagaggcaggaggauaaaggagagaggaaagggaagaaggggaaagaggggguaggagaggggaagggaggcagaaggagaaaggaaagaggcucucaaacuagggaagggggaggggagaaagaugauguggggaggggagagaggaugggggaggggagagggaggggagagagagagaggaggaaacaggagugggaaaagggagggaaggagcaacugaaaggccauaaccacacuggaauccucuagagcccaucuguuagguggaagggcaaaggaagguucugauaggagacugaaacuguuaacgcacugagcacggugggaggcauguccagugagggacagguucacagaagaagucagaggagagugaauggagagaugcuaagaaggcugagauuagccuagggacguggguguccccuggcaacugaaaagcaagaggaccauguccuucagcuccugcuuccccagucagcccagccuuucagacugaaacgcaggcguccgccccacagagcagcaaggcucaagucugcgcaguggcaagccuuucuugguuaugagagauaacaggaggaagugucacugccuggacaccagggucccucagaaggacccugaggucauuuucucuugggaagagagccauuccacaggguccagcuccacaaaagggacagggcugugcuucugaggcgagagaacagacuaccuaccucccuuggaacagcaagaguccaacccaacuucgaaaacugcucauucgccugcccuggagggagcuuggcuuguguguggaugugaagggccucccaggccgcugauuaacuguuacaagaagagcacccacucuccccugcagcgggccugaauaauucauagucugcauguuugaagaaaggcagggacugaacugggucaggcuggcccagccugcuggggcaauucaaccacugggucauuaucaaacacagaggauaagcaguuggauuaauuauuggcuucucaacucuuucugaagcccgguggcuaaaagaaaaaaaaaagaaaacaucgcaaauugaugucucuuaaacuaccucugaaaucucuagccauucagaagaaggguuuaaaagaggguuuaaaagaggaaggggguagaaccccuaacgggccaggguaaagaggccuguggcccaggaaaacugcucugcuccauguuagccgggugcccccuggcagcuucuggaagccaguguguagcgguaucaagauuuccugagcaaauuaagcuaucacccugaguccaggagcaagauccaggaaggaacugaaugaaucgcuugaaagucagauaaauuggaagcagaacugcuccaggcuguagcuagcucauuuccucagugaccagggcucucucuccaacccaccugaggcaggaguguuagaggcuauaucuacacagcaggaaccaagcaucgggaggaggcagagugaccccacagcucauugguucugucuggggauuggaaggguuaggucgccagaguccccagauucuaaggacucugcuuugccaugcuggccaacagaaaaaugauucaucuguccauguuuacugagccaccugcuaguugucugggguaccauaguaaccagagacugacuuuguagaucauccugggccugcaaauggguuucuacagcagcuguaggcugguuucuggggcccacaggaagauggugucgugaccagucauaucugucuugggcacuggaggaucaggcauguuugccacccugaaaccaucuagccaguguguguguguguguguguguguguguagcaugugcacauauccuuaugagucaccugccuaagugagguggcacauguacaagcauguagaagugcguagagauccaagaucaaccuugaaugucacuccucaggcugauuucugagacagggccucucagugugccuggcuaagcugcccagucaaagagcccaagagggacccuccugucucgaccuugucaguacaggggguuacaagaucacauggccaugccuuuuuauuuguaaugggcucuucccuagccccuguccaucuguaagagaaggaaguugagucccagagaggcaaacauugcuugcuaugggcccugggccagcccuaccugauuccccucacugcccauugccugucuucuccuaauguauggugaugacagguggcaucugagugucucccuugucacccuuccugggacuuacaggcugugcgauccuuccccugacagggacuggcaccaacagccucccugcagacaacgugggagacgagcaggcaaugaaacuggcucuugucugccagccgcuucauuacagggccacaucagcaagggacuucgggcagcucugacccagcagccagcaaagagcugggugcucagccugacaaacucagaggaccugaacccuccacuccuaugggagagagcuuagaagugaccuggccuccacuggggccugagauaagacuguagccccagaugacauggucacugcagcuuuggggaccugaaguaaauguggcaacucagaugucugaugaucugacccagcagacauggagaaagaacggguaaacgcuauucacgucaccaagcuuggaggugauuugaagacagguucaacggucaaugagaguacaucagauagaagaaggaaggcaucuggggcucccagcucagccugcugggcacagaugccucccuuccacgcuccuccauucugcacacuagucuguugaacguuggaacccaggcuuucaguucuuucccuuuuccucccuuaaccucaucucuuauuccaaguaaagaugaauugcuucggguggucaagaguuugaauccgaacacuccagaggccaaggcaaaguucaaggccaaaggcagcaagaaagcucagcaugccaaggugcaugccacuaagccugacaaggcacauuucauacaggcacugguauggggugagggcagaaccaacucacauggguggucuucugccuuccauaccugcagcauggcucuucuaaaugcucucucucucucucucucucucucucucucucucucucucucucucacacacacacacacacacacacacacacacacacacacacacacacacaagaauuuaauucuuuuuauuuaaaguccaauacucaggaaccagaggcaggcagaucucagugaguuagaggccagccuggucuauauagagaguuccaggcgagucaaggcaacacaguaagaccuugucucaaaaaaaaaauuuaagaaaaguuuaagggcagccuaggcuacauagggaguuuuagaucagccagagcuacacaaccauugaagggggaugaaaaaaagaaaggaaauaaaaaaauaaaaauaaaaaauuuuuaaaaagaaagggaauaugagacagggagggggagagagagggagggagaagcagaaggaggaagagggagagagggagagggaaggggagagagggagaggggagagagggagaaggggagagagggagagagggagagagggagagagggagagagggaaagggaaggggagagaggaagaaggagagggggagagagggagagggggagagagggagaggggagaggaugagagggggaggaagagggagaaaggggaagagggggaaagggacagagagacagagacagggagggggagggaaagggagagagaauuauaugcuuaggaucuuuaccaucauuaugcauaacccaagaugcaggagcaagagagcucuguguguguguguguguguguguguguguguguccagaggcuaggggcuagagccacuagggagucugaaaaacaauuccaggagacauauagcaacacccuguucacaugggaagugcugggcacaccucccucacuuccuucucagaacacuaacaucuuccuuucugcugugcaaaagaggaaacugaggcaggacacauuuaacuuucugcuaacaaauggauacaacagggguucgagucaagagucuggcuccugacuaccacagggguuacagucucaucucagccuuccuguggaccucaugcuauagaauggggugacuuacugagggcaccauggucacuggggccagaugaugcuuugauguacagggcuguccugagcacuguaggaugguugugaguugggaagccgugaacagccaaaugccaggagcgcaaccucuccaucaggacagcccaagcaucgucagaugcccuggcaagggaaagaaaccauccucgauugagagguacugcaugguccugggguccuuggggugaccuucaaauguuuccauccuugugcccuaagcagcacacaggcacaaggacaacagagccuuuuggagcagaccacuauagaugggaauccuaguguguagagcucucucacuucuggggucccaguaucuggaacguuuucaaugcuggggccuguuuacauggccaacaagugugucgcaguaucugagcuucaagagcaucuuuuccuaagugagccagucuggagucagccuugcuucuuuuucaggaccugccagacucuuggcagccuaaacacaaagaagccaucuggccaaugcaggccuccuccccgguguucuuugcguggucccuggcuuucagccccucaccuagcuucccuugaccucuagaacuuugucacugaugccaaagauaccaauuccccuguggucuauggaugagagacguccaaaugccauucuccccacacccauucagagcacacugccccccagcacagucugucaccuucugauugacacucacccuccccaaugcugcugugcugucuuuccgaugaaaucaauugcagccgauugacuguggcccaauuugcauuccuucuccacuccaguucacacacacacacacacacacacauacacacacacacauacacacacagcacgaacaugcacacugcaugcaccacagucuucuuuguguguauguugucuagacugcucucugguuaucuccagugugugugaccuggcucuccaaguagauucagggccaugcucucuucugccacagcaacccacagugcccaccauggcaggcucucgauaaaggcuuacagacaggccaacguugugggguuacuuuggugucuccuuuccacccccacuugccaccacuacccuugugucacaggcugccccuggugguucaagauuccuccccaaaggcaaccacuucuauccccacaacagugauuguaucuuaacucccaaauuagccagaccagccucccagaccagaacuaagccucgcaccucccaugucacaccagaaaggcaagagauuaagccaccugccuguuggaagccucuuuccaagccaauuaggaauaauuucaggaaaguggguucagaggcuucaguguccagagcucuccucugacgcaaaggcuuaguguuggaucaguguccucccggcaaacaagcuccacugaaaaaugauaaugaacagcucggugggauagagacagccuggcccacuggauucagaacacugggguacccugccacugagggugggaggguggguagaagugauuggaaaccacuaagagagacacuggaguuuuuaaaaagcaccccaacaagaaucaaagaggccuaggcucuagucccaacuucuguggcuaauuaguggaguagccuugggcaagcaaugcagacugagccugcugucuuaccugagcaucauuaacgagucucuccucccucuccuguccuuuccucucccccccccuucccucucccuccucuuucucucucuuuccuccucucucuugcccuagucucuugcccaguuuacuagaucccacaggcauuaccugcuccucagagcuaugaagacuugaaaccugagguuccaacaggcuuugcaaagucagaaacagcucacaguuccagcaccuuuugccgggcugugcucuuagcaaaucaacauaagccagaucuaaaaggaagcagcuuaguuagaagacacaaacacaaccagaaacugccccugcccuguaccaaaagcucugauggguuaagaaacaugugcacaugugcuggagaacuugaugggacccugcagcuaucuucagacagauguuaaggugugugugcucacacacacacacauauacuucuuucucaggauccagcccucuuuucaucuggccugggcuaacaucauacugcgauucuguaauuugggaacaaacaaauagcuccgagcugcugcgagcugcugaggcaaaggaaggcaggaggagcccuagccuugucugucacaugacucugccucauccugugcaccucaugcaaugcggguccuggucuagggaagcucucaguagaccuagugaaaauuuccaaaacaaaggucuugugauuucugugaaacagaccguucuccagaggaaagagcccgaacuuuccggcagggguaaacucacaacacaaugaccuuaacuuaguaaauuaauuccaaagcacaauuguuuucaauccucauuuaaaaucagccuucguuaaucuagauuuaaugacauaggaaauggaaauucccuuaauaaaauaaguuaugaauauuuaucaucccauuuuaccugaaaauugaauaauucaucaauuaacuuuacuauuaauuauuuaaugcaaaauuaauaaacugagaaacucguacggaaccucacagacccucuggcaccagcuuaggaaauuagacccuagagaaacagcggagcuauggggaaaucccagcagacacggaugggauguggagcuaaggccagaauucuuuuagaagcagacccaaacugcuuacucauaaagggaacagagaaauuuuauccccccaccuuggaguucugcaccacagccaaaaauggaagugcucagagucuggcaagucuuuccagaacaauccucccaggcauucucucuguuguccaucacagcauccaucaguggcaacacacucagcaauggacccagaggagaaggcaguccuggccgcccagguccacaguguggggcccucugcccugggcaucacucaaugaggaaagaugcacgcagagaggaggggagguguggguugccagggucauggaaagcaaagggauagcauuaguaggaaugacaccugauccccggcaugccugucccuccaugcuccugguugguucuucugguccuuccuaggugagaccacaccaucucucacacaccaucaagaagacagugucucugucuucucauccaucauggauaguuucucugcuucuacccuuucucucucucucucucucucucucucucucucucucucucucucucucucucccucucucucucucucugccugugugugugugugugugugugugugugugugugaguauggggguacauguauguauucaugugauuauguguguauaggcauguagaugcuugagcauauguguggacagaccauagguugauucucuuggaugucuuccucucuuuccaccauaguuuuuaagacaaggucucucugaacauggaucuugauaguucagcuagaugcgcuggccagugagcuccagggagucucccgucucuaccucccgagcaccaguguggcagguguuugccaccaggcccaacuuuuacauggguguugggauucagugucagguccuuugcuuguucagaagggucuuuacugacuagccauguccccauccccaauagccacuuauugaaccacccuagucagacucuccacuuacuaccuucucaaccccccacuucucaaccccacaucuccaguuucccacgcaucccuucugcugccaccacucagcuaugucauucugcaauagcuuuagguccagucuuacacgcccuauuuccuuuacacuguggcucugugcaggccacacagccaugaccagugauaaucgguuccccugcgaguucacacaugcacuuccaggcaggucucuccccuaagcccagccucaggaugguggccuggccgucuuucccauccggcagucuacuggcccagggagcaccccaucccugcacucucucucagcaucccacuucuuagaagucauucuagcuuauccacuguuccaucccaaugcccagcacagugcacagcauagcugcucagagaacugacugacguaauaaaggaguggacgccagccaacagccagccaccugagguggggaugugcauuccugcaguacuggaagaaaggggcucauuuuuaaucagggaugaaggcgaugccuccucccccagauggaacuguguccagcuuaggaccagaggacagcucccccgaugucuguaggucaaaugcaucuugggauuccgugacaacggaggcagagggcuggaucuuaugugcaagguuggcauguucacaccgcaggcuuaaaaacuaaacgacuugucuguuuucacuccuccagguuugcucuuugcauaauuucugucuuucucuacaacucugccucggcuggcagcaggcucacauagcugauaccucaaucuaggcaccagcugccguuucacauacaaacucacuuccaccacagcacagugccauuccuacuuaacugccaaagggaaaacagccuggcccagaaauuccuauagaucccaggcaggagggugcugggaagccagagcgagucuuccagaagcuguggccaguuuccugcccugcaagcuuuguuuccuccuucccuagagauaccucagagaagagaccagaagcagccaggacagaguuuuuucuuuuaguagacauuuuccucuucucauggaaacuccucccaguuaaaccacagugaggucagaaagacacauucccagaaauccuuuuuucacaaggaaugaucaccucuagaagggugugugugugugugugugugugugcaacauguguuguauauuugugaauguguguauacauguguagugugcauguauugggaauuguguguuucuacuuauauauguaugcauauguguuauguauacauuuguaugcaugcuuguguauuuguggcugaacauacuuaagcaugucuauacuguguaugagcauguauuggauaauugggcugguuucuguacauauguauauguggggugugugugugugugugugugugugugugugcauauuaugcugugugugaauauuaugcuauuugagcauguuuguguaugcuugucuauacaugccuaaaaguauguacaugugugcacauauugggaauuggauauuggugcaaaugugugugcacaugcugugcuauauugugggguguggacacccauguuugcauaugucuagcacauauggaucagaaagcuguaugugcccaugugcugcauuguucugcaugugcauauaagagaaugccugaguguacucaggagacacacaggcugugcugcucuggagggagaggcacacgcaguggggcuugagaaucaggugcgaguucugcccuuuguuuuauuuagcuugaacuuuguagcuccauaacaaaaagacugugggaaagcuaagaauagccaagccagcaaccccuccuggccaaaggagagggcugggaaccacacugccaggacauccagaccuuugguaauuacucaccacauggagacugagagauugccaaggggucguguggagacaggcuuuccuacuuugucaugcgugagccuaagggccaggccaccucccuucccucagcagcaauguaauaggucaucgcuggccagggacacauggcagaugccaguacaggagcacugcagagacacuagaaaaccuuaaguuuccagcacaggauggagcaaagaugccaagaagagucugacaggcaacaaagggggccuagaguagucuguggccccuggcagggcagaccagggucccagggcuugugugaauacauuggggcuuugccaacucucaguaccaguccucacugccaggggccagaagacagcaucacaugaacaaugucacauggcaucauucaaguacaacccgagaaagacacagucacacccgugugaagauagaaaggcccaagaugucaccuucagcuuacauguauagcucuugaaaugaccauagcugcuuccugaaccccaaaauuuaggcccagggaguggccacaccacauucuucugcuaaggccaggugggcuaugccaugaagcaugcuaaggaaguuagagcacuggaguuuaauaagccccucuuccaccuucacauacagcacagcuccucuaucccucaaggaagaagcugcagacugaggcaccgucugcuuccuagaaacaaacuccaggcagcuugaaugagggagaaaugugagugagccagagggcaggcacgaagcugggucucuucagcggcagccuagaaguuccugacauacugaucuaugugcucacguauuuuaaagaaagcuaagauauggaggaacauggacaaccggagccagaagagagccauggucugaccccagcaggcuagagauguggccaucagugugugcagcaagcacuagagacaggaccuggcuccaagaaaaaaaggggggaugugaugagaccaacagucagugcucacaccuagagcacucauaauacacacauacaugugcauacauauacacauacacacacauacagagacacacuuacacgcacauauauacccacacacaaacacagauauacacacacacauauauauacacaugaauacacacauauacauauacacacauacauacgcagacacauacauacacauauaugcucacacauaaacacauacauacauguacaaauacauacauauacacauauacaugcauagacauguacauauauacauacauacauauacacaugcauauauacacacacauacacacauauacuccuacacauaaacacauacauacacacauacauaguauauacacacacacauauauauacauauacauagauauagauauacacauagauacacauacauagauacacauacaucacacauauacauacauaaacacacauacucacauaaacacauacauauacacacauauagauguacauacauauauauacauagauauacauacuuaaguaagcauguauacauaaacacauauauacccacguacauaaacacauauacacacauauacauagauacacauacauaaacacacacacacaaucagugcuaccaauuccacaagcagcaagguacaacugaggacacaggaagcucaccugugucucugaccacaguccucugacagagcccagcauaggugguaaccuucccugcugggcagcuggaagccucugccucugucucggucacuugaguagaccuugauggaguuccuaggggcuggauuccacguucucuccccauuuggcauucuacaauuccaaauaaaaaccaggaucugggagagagccacucccacacagggcacacagcaagccaccagauaauuucucaggaucugggucacagcuaacuaaccccucaaccccagagagguaccucagacagugaggaggcucccuggaguccugaaagguucccagcacacacacucccuggagccucaauugcugcuuugcuaacagugguauagcuuguacuuguucauucacacaugaggaauguguccagauguguccaugugcauguagcucauguaaguaggucuccauccuaguguagcacaaaggccaucaugguggaaggaauguuauuccacuuaggguaagggaaccccugaacugaccugcugcuguauagcuguucaaucagaauuggaacauucccugggggaaggaggagggagacucgggagacucaggaagugaaggaaacauacaagucucaggaaauaaacaaaacucacaaggcuuaggaaacuccuaaagauuacaagacucacaagauuacaugagcaguaccaauuaauggguagaggagaaaucucccccagccagccugccugcaagccacucagagauccagggacauaacucuugugagggucaucuacggacaagugacgcaggucugagucagauauauaucccuuaguucauaaagcuagaccagggccguguuguugcacuggucuguccucagugaccugucugacuggcuagauaguuguuuacacaauaccuggguaagaggaugcccuccccacuggcaccacccacugcugcaacccaccaaccuugcucaucugauaccgagaaagagccgcagcagcagcuacaucaaauuucaugggcaacacgagagucaaugauuuagccgucuuagagcucacagcagcuucaagucacagaugucacuacaguccaucuccaacauauuuuucucucuuacccccugacuaaguaaaucagucaucuuuuagcacucccaaauugacccuuccagaugucucauguaagcgaaacuaugcgguguuugccccuuuguaccuggcccugucacucagguacguguuguagcuagcccgugagcucugcaccuugccugcacugggucguggaauaucccgguggaaucuguguugcuuuuaucauucugucuggucauugggcaugcuuucacuaggaaugagucaucacuauccaaccuaaagaucuauugcucaaaggggccagugggucaucucuuuugucauuuacacuggauuugagcaagguaacaccaacuucacgggaccugucaggcccccaaccccucugcucacagacugaccccaccccugggcccugauguccagggcuccuccuccaagccacaccccugcacuguaacagcucuacacacugcacgcacuccugucaaagugaugcuucaguaccaagcucuuaggaaaccgaagaggcagccuggccuuguccuugggaacuugccuucccauucauugggaggcagacuuacaacucuggacagacugucauaagacccacugacauaagcuaagggagccuuaggaagcuagcaagaagguggugggucgcuugcuaggcccagggaagauaucugacaagagacagccucguuuggaugugagaaaacaagguggugccugaggcagaguaaaggcaaagaugggggugaggaagaugauggggaugguguagccuacucuaacuacauuggguguuuggaggugggcagucagggguauaaacugaguagggcauguugcgacugggagacaacccuagagaagggaagucuccugggaagucuccugggaagucucuaagacucucaagcaggaucuaagacaaggcugauaggaaaguugguagcaaaggcguacagcccugaacaggagcacgccggagagaucucagcacccugcgcgugguaagagcggggagcucugagucuucagaaagcagaggggaacauaagcuccugacagagacccacgggguggccaguccgagucuggaccaaagcggagccacggggaagaggaaggccaggcaggacuaagcuggaucuuugaaaaucaagcagcucugggaagaaccugagacaucagaugaugcaaaccaggugugacucggggagagaggcggaggaaggcugagguaauccaguggucacauccagugacccuggagagaggcucccuugcugucgguaaucuucagaggaggaagcuaaucugagacaaaauguccgccugucgcuacgggugaggaagagccgaucugaggucaagaggaccugaaaggauaagaggagccccccaagcccccacauucuccugacucucccaucucccugucuuccgucuuccugcucagaguuuuacugccuacugaccaaaagcauuuaguguucauuauaggaaaauucuauuacuaggccccucugugucggugugaaggugcuaucuauaucaauccaauuaauuaauuagauaacgaauggaguuuuccagcucucucgccagcauaaauaggauuccugggaagagauggcucucacuucgaucucaagccucgcccauccugguucauagggaaggcuguaggcuucccagggaauaagaaauaaauuaccaggguuucuaaaccaugccugcaccucggagugggaaauggggaauccagcccaagaaacacucgggaggcccaccuggcuggcacaguccagccacacuggcccacagaggaggcccuaacuggcacccacaucucccagaagcuacuggggaacaguagaacaauuucccuggcugucuuauuacucccugccaccaugaacuaugucaggagaagaugaagagcuauauuccuggguucaaauuccaguuccaaugccauuaagcccgggaaguccuauagucuugcagcccuuucccugccuggcagagcugugguauggguuuuaagacucauauguguguguguguguguguguguguguguguaugucuguauaugagagagagagagaaagagagagagagagaaggggggggggucucacaggaugccagauccucuggagcuauaauuacaggugguugaguuaaccaaacaaugugggugcugaaaaccaaacuuguauccuguggaagaauggaaagcgcucucaaccucugagucaucuacucagccaugguauaaauuuuaaaacacagcuccgaacucagcaaaugcugaagagcgcagagcuggcgugcuggccaguccugaagcuagauaugugcagaaagagugagauggaucaaguccaggacuccugcuucgcagcccccagagcuucaccucuuacccacgcuguucaucucacuuguacuuggaggggaugugccaggcaucuggguuacccaagaacaaaggcaacugagaaaaccuccauucacacuuggguaaaaaacugugaaauggcaccaggaagaggcaagggaccccucuggaaggguaugggugguauuugaaagagaccgcauagaggaagggagcacacaaucuaaagccuggaggaggauggaggauaacgcucuagacagagggaggacucuacucaaggucaugaauccaccuggcagggugaggaggauggaggucccugcagucuccaaacgauaucaugaucccacuaaacacacagccaggaccaaauaaagauggccucaggguaaguuuucaggcuuaagaucucagcuccuuauaacacaauaggggccauuugagcauuccucccugagcucuguggcauccacacugccacccugauacccccaucucugggagcauccucgaaacacaccucauuauuaacagguguaaggggcuucuggggccuucucuauaauuggguugagaucugaucugagcaagggcgguauuugucccuaaugcccccagcaaaccucagaggcagacaugggucccucugcaguuccuauaccaacaucuauauguggacugauuacaacaauuaauuuaauaaggauucuuccacacaaacaauguaucauuuuauuagcaaacucuauaaaugucaacggugcaauucauucuuauuaauuuucuaaaaugaaauuaacaguagcugcaaacagaacuuguauugccuucccaugcagcagacagaguauugguaccauuaauucccuaauaccaggaggcuggcuuguggggacucagcaguuaacugcaccaauuaauuucaauacuggaaaugguggaggagggggauccaaacucaacaacuaauuuaggaagguccuugaacaaccggggcaacuuguccuucuccggggaccagaagcuuucaagcguaaagacagagcaugcaugagaauguaacaggaguccacguguucacucugccuggaggaaagaaguucagagccccagagccugaagaaaauccacucgaugccugaaguccccaagguccaggccuccagcagacuggaggccguggcucacaggcaauagcagcgauggccugugaaggacauggacagucauaccugcaaggcaggugacagauguuaugucaccugugaugcucuugaggacccagggaagacaggauaggagcucuacuucuaauaaagaagagaaaggggugugggggggaggcugggcauggcagugcacacaugugauccuaacaguuggguaucugaggaagagaggggaggggagguaggaaagggaaugagggaaggaaggaaagacggaaggagcaacgugguacuuuuuaaggaguguaagauuuucacacaauagucacaauuccacagauccauagaaccccucauuccaucucccgugcaccuaucccucuuccucgugucaagaagucucuugguccacuauacuccaaaaagucacugaguucaguguggccagaagauaaguccuccucucaauugauccccaauuuccuggucuuaaacaugaaagagagcucccgccuugcuauguucuaaagcacuguggugcgugugugcgugcgugcuuaaaacccaccauguucuggagaacuucgccuggccuuguaaauaguucuuuuguccaacuuggauucaagaagcaugguggccaauaucaguaacuugauagagucuagaauggccuaagagaaaaaccgcauguaugcuucuuagcaguuccuaugauaaguuuaucaagaagagaagacacaccuuaacugagggugguaucaucccaagggcuggaauccuggacuugaauaagaagugaguugagugucguguucaucucucucugcauccugacuacaaacucauuguggcccaguggcuucacccuccugccaccaugccuucccugcccagaugaacuguuuaacuucagaccuugagccaaaauaagucuucacuuuuuugaguugguuuuccuucagguguuuuguccaagcaacaagaaaauuaaugacuacagccaucuaaggagggaacggucuaaaagccagaaccuguucguccauagcucgggacagauagacggaccacacgcagggccaguggggcacagaacacaucucauccuaaucuugguuccagcugacaaugcugaagauuuuguccuuguccacaugucacagacugagaauuccaccacuuagacucagcccugcagucagagagcugcaggccaccuuccagauaacgugagcaccuggcccugucacugcuaauagaaacguccuagcaauuggaagagaguggcugcaaaucuccgacgguuuagcacgaaacauaucaaauaauaaaaacguaaaagaguugcgcaggaaauaagaagcugucuuuaaaaugagccccagaucccuggcucaccaucucucgccuauaaucacaucauuuucgugcacaggacacgggucggcuacauuuucaacaauuccguccagucccagguggcaagagaaguuaaguguuuguggcaguuaguggguucaaggacauuuaccgcguaauguuuagccauugcuucugaucugggagcucucccucccaacagucagggauaacccgacuuuauugauguauaaaacacaccaagguccaggcagcaguuaaguuaguuuuccuuuucaaaaagugucugcuacugauggcaggugggcacuuucccaaaaauaaauugcccucugcccugcaccugucugauaaguuucugaaugccuggcugaaggauggagcccagagccauccugugaaaagccccgacagcuguugcccggcgucucagccuccucauugcguucacuacccgcgucuuggaccaauuaaugagugcuccccuucacaggccauugagcacaacauggcccugucaacucguuacccugcauugaguggcuggauccgguaauccacaaaaaucaaucaucuauucucaccauauagaguugaaaaacugugauggcugggacauuaccuugucuuaggggaugugguuagccauucuucguguuucucaaauguuauuaaauaagccgcaauuuccugaaacagaaaaaaauaaaaagauaaugauaacaauuagcucauguuggacccugagaagcagaaagaaaaaaaaguuguuauuuuucccccagcugcugugcaucuuggccaggcuggaacgcggacuuuucuagaaaaacguugacccggacucagcuucucuuugauucucugauccccuuccacucaaccagccacacaaucaccaucaaagccuggguuucaaaagaggagucagcggcaaggacaaaaauauuucucuguggaaagaaaacaucagaaaccuuugaggucccaaaugccauucaucggagggagggaagcacaugccagcaacagggcucggcguacacuccgagucuccaaacaggacgucucucagcuuccucaccaaauaggugcauccucucagcuugacucccaacccccacccuggagccaaaucacagagagacagagagacugagagacagagacagacagagacagacagggagggagagggagaaggagagagagggagagagagagacacagagagagagagagccuuucccacuguuaucuugaucuauugagcagagucucagagaagagccaagucagccgaguuucaggcaaagacugagaaaaugugggcaccugaagguaaauuaaauauuuauaaagacaacaacaucaucacagauagaaaugcugauuuauuaauaauuucuacaagaagccagagagagagagagagucgccagcguaagucauugccccguuucuuaggcaugacauggcccauuacuuccagauccaaacagaucugcuaacaugaaauuggcugggauuguaaguuaauuaagguuggguugguacacauuucccuugaucuuaguggcaauaugacacagagauugcugcuguggacugucaaggaaaugcagagcacaggggugggcucccuuucagcuccugcugcagcugaagcugcucugagcuucucagaguagagcaggcugccugcccagaggccgggagcaccuugagcuuacgcauaauggaucugaccccugugaccagcauugguccacauccacuuggaggagaaggaagagacaugggucagugacagguaagaaauacgacuugccaugcugugaagaccaccaguccagugaagaccaagaccuucugugaucauaguuauccuaggguuuuacugcuaugaagagacaccaugaccaaggcaacucucauaaggacaacucuuaauuagggcuggcuugcagguucagagggucaguccauuagcaucauggcaggaagcauagcaguguguagguagacaugguacaggaagagcugagaguucuacaucuugauccaaaagcagccaggagagucuccuaggcagguaagaggagggucuccaagccuacccucaaagugguauacuuccuccaacaaagccacgccuacugcaacaaggccacaaccccuaaagugccacccccugggccaagcauauucaaaccuccacaagaguaaguguccguugccacacauauuggaaacaagaguccaaaccaguauagccuggaagacugcacccuacagaaagagcucaggaagcagccaguaaugaccaaguuccuaccauugauuuuuagcuaaagaaagaaugagucccugugccuuuugacauuuuucuccucuccuugggaaaaauccuucccugggcucucagcauaggucaauaacccuaugcccaggccagcccuguuucucugguuauccauccuccacucucccacggcgccuuucucggugugcaggauucaucaccccguguccuaauugcuuguuuacuccgguaacauccccauaggaccaugcaagaguaagggcugugucaucgcugauacauucacaggacuuaauaguguccuggggcacagggguaaaccugaaaaugucuauuagaugcaggaugaguguguagauggguagguaaauagcuaggugaguagauggacuggaagguagaugacuagauggguaguuggguggccagaugcauaaguggauggaagaguauaugggagggcagagagauggauacauagaugcagaggcagggauacauagaugcauagaugggugggcagggagauggauacauagaugcagaggcagggauauggauacauagauguucaggcagggagauggaugcauagauggacaggcaggugugugaguagauggguggaugguuguguggguggguggacuaguauguggguggauggggggagaagggugaacacuguaauuaaauaugcauucauaagugaaauguauacaugucuuuguguguaaugguacauguguuugguaguaagugugugugugugugugugugugugugugugugugugugugugugugugugugucuaugacuggagauaguugacuugagaccuaaaaaucuauagaacugguucuggaguaaggcuucaaaguuacuucauuaauugaguugccacagaaaggcagcucaguaucacugcaaagugccuaccugcuauaagcaaauagaccugccuccagucugccaaagaucagcugccuccuguuaagcacauggcucaacacacccagaccucaaaggccucucugcacagaggaaaauaucaccuucaggggcaguuauaaaaauggcagcccuuaaaucacugacagccacagugugucaauggccaaaagcuuccauguuaaguauuacauguugugggcuacgugucuaggggucccuuaggcuauagcaggugacaaaauaguccaggccacugcuaggcuuacagacaucucucucucuccucuaccccaacaaccaacucucccacauucacacuuucagugaaugauaaugcucaggugaugcuggugucaaccuucucaagcgagcauugcaucccauucgguuucauaagaugcugagggcaggccaugaccaucacacacauggucagccauguguuagguaccagcucucugccauaauuuuagcagacuuacuuucuagaggaagcugccauguggucuaggugccccaugugcuggcuaguuuuaugucaacuugacacaagcuagagucauuugggaagagggagccccaaguaagaaaaugucccuacuagguugaccaaggagcaagccuaugguacauuuucuugaucgaugugagaggguccagcugacugugcagugccaguccugggcuggugguccuguacaagccacagggagggagggagucaguaagcagcauuccuuuguggccucugcuucaguuccugccuccagguuucuacugugacguccccgggugacagacuuugauauggaacuguaagcaaaauuaaaaccuuuuuuucucaaguugcuuauagcugugauguuuuaucacagcaauagaaaccccagcuaagacaccccauaucccugcccuagccaaggaucacaccccagugacucuaaagauggggugcaguaccugccaacacccuugcaucucucacucuacuccacagacccaaagacccacagacccauggaccuguggacucacagacacauaaacccauaaacauacccacaaacagaccuacagacccacagaccuucacaaacauucuuacacccacaucuaccacagccuggcaggguuucucaucgcuguugucgcccaaagaggaaaaccucucuggacccuugcugcacuaaagauacuuacuaagcaccugcucugugucagcccaggaauaaguaaaggcuauaucacacuugaacucacagccaaggaggagggaaagacaugucagccacauagcaguuacagagcccuguuacugcagagccaugguguguucaacugcugagccaaagggucugcacuggucuacuaagccaguguauaggcaagcaagggaccaagaaaucacauucugcaaugagcuuccuuuggccgcuggcuacucccucuucuuccaccaagggauauguguguguguguguguguguguguguguguguguguguguguguguguguguacgugugguguuucucccgaccugugacaccucccacacagcuuggaagaguacccaucucauuucuaagaaagaaaacuaaauccuugcacccagacccagcuucugcauggucaaggugacuggacucgacaccaggcacucucacaugccauugcuagucucuagaugugcuggaggugucugggucgccugucuaauaccaucuucaugauguacagucuuacuagcccccugcccuuaccagaguuuguccccucuucaccagaugggcagacaguggguggacauugcccuuucaaaccuuaggaacuugcuggguagacugagacacacaugccauggaaccaaacacucucaugggaaugaagggauacucaaugacugggagcugcucuggcagagaaacugagucugguucccagcacccaugucagagagcucaggacugccucuaacuccagcuacagggacucugaagcccucuucaggccuccauagacaccugcacucauguguacauaccggcacaaacacacagaaagacacaucucuaaacucuuuuuuaaaguauaaaauacagauauaaacguucacugcagcauuauuggcaagagcuuagaaagaagcagaggccacccggucuguagauggauggacaguuuacagaggaaacaugaacggggggcggggugcggagagggguggcaaagucccauuccagaggcuacaacacggauaaugaaggcacgaugcuaccugaaugaagcuuacaacaggucauguguuaagaaugccacuagugacauacacagaacaucccaacuaacuggcagagaaccuaaauuugugaugaaggaugagagggugaggggugacuggugagaagagguggcgucuccuuuugggggugguauagauguuaggaacuagcaggagugcuggcuacacacugcugggaagacacuaagugucacuaaugcuacagagcagugguucucagaugggucaccuaagaccaucagaaaacauagauacuuacauuaugauuuauaacaguuauaaaauuacaguuaugaaguagcaaugcaaauacuuuuauggcugggggucaccauaccguggggaacuguauuaaauaaaggguuacaguauuaggaagguugagaaccacugcccuagaguguauuuaaauacauuguauccuaauuauuuuuuuaaagaguaagaggagagcaaaugcauccaguuggaugugaccaggugauggagaugcuagccugcccugccuauacagcagacccagacugaaagggccaucuuggcacauccaccggcuggcuuccuguuacucucacaaccucagucaucccagauucugcgucgacaguaggaaggauggcccacugucaggguaaagggauucacggcaggcuccaaagcaaagacuguccagcuugcagauuuuaaauguucaguuuguccuuuggauguucaaauagaaaaacuacugccaaaauacagcguguguguggccagggcagggacagcagcccaugggagauagaauucaguuuuguggacucugcuuuacaccagcaagggucccugccaacagaaaggcagagggauugccccagagucacuguugugaagggugaggguccagaauggggcagucuagugaguccccuacuacccaucauuggaggucagugaugcccccaggcauugaaaggacuucaugguggcagugagccacugggggcgaggggacuagagccuguggguaagggguacugcugccuagcuuggcaccuacaguuuuguccuaccuugcauccaacucaccaucuuugcucacauugcccuuaggucaucaugaugauggugguggugaugaugaugaugaugaugaugaugaugauggccuagucucccuggggaaucgucaggcugucuguccuccaucccacagugaacugcagcugcugggaccugcucugcaaugacugugguacucuaggacuccuggcacauagcacuuucuguuguacagcucuguguggagagucugggucccuacacagccauagaguccuguaguucuuggaugcaaaggugacugcugaguagguagaacacugcauggggguuaugcagaacucuuuuuacacacaauaaaaacaugcuggaaccucccuuggugcagggggaaggggcaaggaugggcugugugggcuguugcuaugggacacuaugcccaugcaggguacucuauagaaaugaccaccugaacagcucccaaacagcucccagcuuugcccucaggacgggagccccgcccucaggacgggagccccgcccucaggacgcgagcuccuuucuccaacagugaguaacagcacugugugcuaccaugugucaucuugaaauuucaaggagcuacauuuuuuaagguuaaaaaaauauuugaggacuuuaauaauagguuuuauauuuuaagccgaguguauucaaaauagcauuucccuaauuuuagagagcaguagagcugucuccuguucucuauacuguuuucuaaaacuggcguguguuuccauucccagcccaccucagccaggcucgggggccaaacaaggcugguaugugggaugguggcccuaaauagacaccgugggagccugugacagacugaaccuucuggcagucagguggagucugggugggggagaggggccaccaccaacagacacuucccugcagccacugucaccucaguuucccucagggugaaggagccgugucccccgugugggaugugagaggccuaccucgaguggacucuagguaucccagagaagcugaauacacugggcuuauuggugcuggaucucucuccagggggcacccucucaaagacaguucucagaaaaaagacaacuacugcccuggcaccggacaauccuuuuagucccaucuuccagacacaugcucaauaucagggaaagaaaaggucuguggagaggccauggugcuuucuguaauaaauuaaacaagugccacuauacacauaaacauguuuguaaaugugcauauuuguauauauaaacauguguuuaaguaugcauguguauauauguuucaguacauaauauguuugaguauaauguguguauauuugaauauguauauguaugcucauuuguguguguguguguguguguguacacgcgcaugugcaugcaugcucugggguauguguauaccuggguaugcaugugaaugugacuguuuaagguguguguguguuuauauguguuuuggcacauacauauuauguauguuggguggcauauauguucauguguguguuggguauguguauuuguggauguguuuggucuuguguucauaauugucucuguguguauacauguauaugcauauauguugguauaugcuuguacuauauucuccugagcuucaguaauaaaaauaucucuguggucuauauagucucagcuaccuuuugcauagaaaaauggguuuucaaccaagggguaauuuuagaaguuuguuuuuuaugagagcgcuguacaaggguuuuaucugugaggacggacgcugaggggagaaggcacugcucuccuagcagcuggccccagcaucugcuggagccacaaaaugcaauuauauuacucccaaaugugaaguaaaaauaucuuguuuccaauacucuugguuuuaaggcucauacugagcguccucugggcauuucgguggugccagcucuccgugcgauguacuuuauuagggaugugugauugucauauuaaugacuucuagccaauguguuuacagugcgaaaaaacuuucccagaaucugccacucacugcacuucaccaaaaauaauuggcccugauuuaaauaaauaaccauucuauagccccuucccagugacaggucacccugaauaaagcugccggguccauuucugugacagauuccaccgagguccagugguguaggguccuccggucuaagggguaagcucccaucccuuuuaucaacagcugggccauccaggugaucaggcccauaccugcaugagauacucuggguccccacccauaagucaaaccaacacacccaacuugaaaugguuagcacccaucagaagcaaugagcccacagucuggaggcuuuucauucucuguuuccacauggagugagccaccgcuccacucagacuguacgacgcugauagugaagguguccgggagacgggugucuggaagacuuccagaguagcgaugggcucagggucccugucuaacagccuggacuucuuaaaaaaggaagccuagcauggcugccugccuacuguacaguccuggggaggcgcucauguguccuucccagugccagucagugaagaagcaaugaaugaacaaagacacucggagacaguccuucacaccgccacaguuauauauccguacgucacggugauuauuuggugaauuauugagggccuacuguguaccagacucagaguccuaacaguacaaagagaagugacugaugguccuugcaaagacagcugggaagacagacagggcugugcgauccagggcugucuugccaagugcaagguccacgaggauguucccuuagcagugugaacgaugaacucaugccgaggagaaaaaaaaggcaagguugagccaaagagcuagcacuuggacagcaccagacugugcagggggcugccaggcaggcuggugauggagacucaggggcaggaaacagcaugugcaaagacaggaaacgagaagaguaagugcauucagggaaaccucggcaaaugcagcagccagagucgacagggucuggggaagaugagccgaaccuaagcaggagggugcggaggccccagacuggggagcaauuaaaaugccaggcaaguggaguucccaccaugauaggcgggggacggagaaggcuuuuaagcagaagaaagauagagagggucagggaaggcuuuuaagcagaggggagacauagaaggauccaugcuuuggaaaugucgcuuugauggugguggagcagaggggggugacggcuggaagacugugauggcaauccaggaaagaguagggagcucgugaaccgcggcaggcugagauggggaugcacacaaaguggauggcggucaaagaggagccagcgaaaugcggaacucagucgaugggcaagugccaaaaucagaggagacaggcuggaauccaggggcgccacagguagugaggacacccaggacagcgagggcacccacagucagccucguggcuggauccacggagucaggcuggcugacuuuccacagugguuccuuucucccuuuuguuuguccuuugugcugguugaagacuggagaggggcuucccagcugcucuaggaaaacaaagcuagacaccuauggguguugauauggaacaccuacuggcuggugcagggggagcccaugcuccugugggugagccugaguucuacagccacugcaucuccauccagcuggcuuuccucacuagcuaccuacaagcauuugacauuaaggcuccugcugugaccguuaugacguuggauacugaguggacuggaagacugugggcugauagaggcuauccgggaagacagcuuagagccguaccuaccagaacacucgcuguuccuuacgguggucaucuguugguugaagugguccagagauuaagauggccccagcugugccagcugccuuguuaguacucagcucucccuguccugcucaugaugcugaaacugagcccugaaacauuucuccuccugccaacuuagaagaauguuaagauuuauaaagagggagccucgaggauccaggaagaugggucaaucaguaaaggacuugccacaucagcauggggaccucaguuugguccccagaacccaugcuuaaaagaaaaaucaaaauguugggcauggugcugcacacucgaaaucucuguacagaaguggagacaggcagaucccugggcucaugggccagccagucuagccuacuuggugagucccaagccaaugagagacccugccucaaagaaaaguucaccggaugguaccugaggagcaauacccaaggcuguccucuggccuccacauucgugugugugugcacaugugcacaugcgcacacgagcaugcacacacacacacacacacacacacacaccaguagacccacgcaaugauagagucaagaggcacagcucuucugguuccugugagucuaaggugauguaauuacuuuagcacuguuaccuagacauggaggccaguggcaugcagguggcuuugcccaccagaccaaauccauccaccauccaccauccaccauccaccauccaccauccacacgcuacuucauccagcucuuccuccauugauuccucauuugucaguggccacucuugcaaaccucagcucauccucuuggcagcagcauggucauuuggaggucaugcgcuuuuuucuaaaggucuggaugacagccaguggggugcaggaagauauucucagucucuggagugucucucccucugccuagaggucauagcuauucuccugaccaugguaccuuagguccaucuuguaucccuauaaggagucagucaucaucuacuggguagaagaucuaucuaucuaccuaucuucuaucuaucuaucuaucuaucuaucuaucuaucuaucuaucuaucuauuuaccuauauaucuaucucuauauaugugucuaucuauuaauuaccuaucaucuaucauuuuuccauccagagagagagagagagagagagagaaagagagagagagaagguacuuguggaagucaaaagaggauguugaauccucuguagcuggaguuugcuauaaacuuuccaacauggaagcugggaacuaaacucugguccucugcaaaaauagcaugcacuuuuagccacugggccaucucucuagcucuggguagcauccaugcucaaauaaaaaugugggucuagguggauccuggccaacacaaaaacugcccucagucaaucauaccauccauguccuccauugcccuguccuauucucuuaagacaaggccucucacugaacuggaagcuggaagagaggcugaggcauacagcggggaugagaaggagaggaaucaugucuuugggaaaauacccaguguaucccagugaggccucuacaacaagcuccaaaaaaguccaccagaugguaguuggagaccgcugaagggcacauauccuguucuggggcuuuugacaccugaguccuccuauauauguggauaaagggcauuucuucuagaauauaaaguuacuguuuuagucuccagacauugcucuguuuucagaugggauagcacaauuauaaugaugucagauaauauauguacauuagcucguuaaacacacauauaugguguguauauggcuauacaugaccauguauauucacaugguaagaggaugaccuugucugccucugcugcucucuaccccauuccuuaaggccaggccucucagaggcucacugcuuuggguagcuuggccagucagccugcuucugagcucugccucuccccacugccuugagcagacacauauaacugugcaugcuucuuacgugggugccagggauuugagugcagcagguccuuaugcucggacaggacugacgcagaaagugcucuuaucuacugggccauuucucuagccauaaaaguuaacucuauuuaaucagcuucuuugagguauaaucugcauacagugagaugugccuugcuuuauauguacauucagugaaugucagcaaauacgugauaugcaaacaugagcauucaucucuaucagcacauucaaaauauaaaaccuuuacagcaccaugaaaugaggauucuauugacuauaguaucuuaggcauucacacacaccuacacucuaucuaucuaucuaucuaucuaucuaucuaucuaucuaucuaucuaucuaucuauguguacuggcugguuuugugugucaacuugacacaagcaggaguugucauagagaaaggagccucccuugaggaaaugccuccaugagauccagcugaaaggcauuuucucaauuagugaucaagggugggagggcccauuguggguggugccauccuugggcugguagucuuggguucuauaagagagcaggcugagcaagccaagagaagcaagccaguaaggaacaucccuccauggcaucugcaucagcuccugcuuccugaccugcuugaguuccaguccugacuuccuuuggucaugaacagcaauguggaaguguaaucugaauaaauccuuuccuccccuaacuugcuucuuggucaugauguuuugugcaggaauacaaucccugacuaagacacugucuaucuaucuaaucuaucucuucucucugucucugucugucucugucucugucucugucucucucucucucucuccacugcugucugacuugcacaguggcugaugggaaaucugcaggaggcauccaucuuugaccucugucgucugucuuucaccuccuucuggcugacuaagcauuucucuccaucacugauuugaagcacgcugauuacagagcaucuuucuguaguuuucuucauauuugcugaccuucuugaaucagcaaguuuacugcugucuuuggguuuggaaaaccaccacccuuuacaugguuuuguucaauguuggguuuagaguccagggccagagcacaugcuagccaaguucucuaacauugagccgccaaguagccccuguaucuuuaaauuaagaguggcaggcuucccuguggcagauuuaagauucuuauggauccaucugacucuccuugggcuuaucuuuaaccuuuauagaagguauguucuauagacgagucaccuagagauauuucagcccaaacacugccaugguuagauauuacugaaugcuccagguauucaaagagaacuucccaaacugacaguaaaaacugaacaccucaaggguaaggggauggcucauuugauaaaacaccugucuagcaggcuugaggaccugaguucaaucccuagaauucauauuuuaaaguaagcccagugguggcagcagaguagugcugugaagguuggaaacacaggggauucugggaccuucuagccagcgacucagccugcuuagugaguuccaagucaauagacccuguaucagaaagaaaaggucaaaacucaagguucuccuuugguuuacacaccacaccacacacacacacacacacacacacacacacacacacacacacagguaugcaugugcacacacacacaaccaugacacuuccauucccacuugagcacuaaggaauuuucaccucucaguguccagucuguagaguuuugccucuguauccacaggcuaacagaccaacccaggggaaccaucgauguuucuggaacaaucacucugcaaagcccaugccuccuucauacccugcccugagauauucuaaccaccucagccucugcuccugauccaugucuccucccccgaucagggucucugcuugggauagaacccugaacccaagggcugguaaugcaaagagcugcauggcucacagucucugcaguggcugcaguauggacccauagcccaacugcuaaacacuuuuuugugcacuuuguccacaucuaucacagcaagaggacaaaucugguuccgguuacuucagcagggccagcagcaaagccuuugcuauaugcuccgacagauuuuacugugcucccaggcugggaagcagucuuuggauaaaggcuauagauugccucaagaaguaggguuaaaaccuugaauguacccuuguggucacagggacagcuugccgcaaggccuaugaggagcaagacaagcuucagcgcccaggaguggagcaagagaugguaucaggccggacuccacacugccuccgccccugagaauaacaccugcccaucacccgugcucccaauggaggacacagacaggaucuacugaagaacggagaagccuaagagcagagcccguggcuuccagagccaugagguaaaccuagaagcagaagcucugcuguaagaaagcuggcuucuuccucaaccuuggcaggauucugucugcacagaaaagugucacuaacagccacauacugccaacucccacuaagagugaggggcaagggaaagcugugugaaagcggggugcagccacaugagcuauguggagucucuucccuuugagguaaacucugaauuccuggcuaaauaaaucaagaggagagagagagagagagagagagagagagagagagagagagagagagagagagaaagagauucccuuccuacccauaaugguuuguucuagcauauuaaucaauacagccauuuugaaaugguuuuccaucaaucaaagaggccaggaaaaccuugaugacaaugacaaugaguagacaaugacucugguuccauggagagaggcagaaagggacguccagucuucccaccuccaggacaagcaaagccacccaacucuggguagcuccguguccuuacagggcaaacaacaccagcacucacuaccacccaguccaauaagacuaauaaaaaaggaaacagaagcaagccaucuuaaaauaacacauccaagacacaagcggaaaccauugaucagaagcuccacucgcccucacagcagacagcuucacagccguucuaacacccuauaauggaaucccauuaucuacgaaagaaauucguucuagagggaagucgcaaacaaagagagaaucagaggaggauggcaaaagagaagacucccaccauacaccucugcuccugaaggagggccauaacacuccagcugagccagacacacgagcgugcaaagaggcagcuuauuucugaaguuacaaaauugagcaucaagggaagacacagccuagggaaacggggaccaaagagauugucucucucuuuucuuaaagauuuggggugugugugugugugugugugugugugugcaugguuugggaaacagugcaugccagaauagaagugggguccccuggagcuagaauuacaggugguugugagcuucccagugugggugcugcaaaucaaacuggcaccuuacacagggcaucucacuagaauguagaguucauaguuuuuuuugccuggucuggcacacaguaagcccuagguaugcucuugucucuacccccaccccacccccaaccccugcccagcucuacgguuacaggcacacagguggcaugccaagcuuuucauuugcaugauggggcacacguguggcgugcauagcuuuucaugagcuggagcucucaauucagguccucgggcuucugcugccagcaguugugccuugugagucgucucccccagacccagagccugcuucuuucuuucugggugaaagcugaacagauguugacuguaccaagugagaaaauagaccugacaaucaccuuuccaaacauuccagaggaaccuacuuuaggaaaauacagggguuuucacuaaaccagggagcaaggaagauucauuagcaaacgccucaaaaccuuaauucacacuucaaacaaacaaguuaauuguguagcuaacagagugugacuugauuauaggccaccaguggccauuaauagaugaaagguguuuggguuucaauaguguuugaauuucauaacccacccgcacaaggggagguaggcguagacaccagcuccguuugcuaacaccuguaaucaggaaucccauguggcaagcaagcaccccggcuuugagcuucugggagugaagagcaaacaaaaggagaauucaugaauuguagacaggcaauuucucucugcugcuuugaagaggggcugaguuuggucucagaagacccuuguguaugcagaacacaaccuuccuaucuuacucacaacccaaaugggccaccgugaugcugcuacagagggggauccacagugaagacagucaugggaccagauuguaugcaacacacaccuuguagccaugaauaaaccugccucaaguucccuuuggccagaugagucuagcccucacacucugagacuccauaagaagauuaacagggagcugggacuggugagagaacuagauggugaaguaccugaagcacaaguguggagccccagcacccacauaaaauugggugcaguagcaugcaccuauaaucccagcacugugaagaugcagagggggcugacccugggcaucucuggcuugucagucuagguaaguaauauagcucugaguucagauuuuuaaaaaagauguuacuuacuaagguggagggugaucaaggaaaacuccugaggucaaccucuggccuguacacauauacacaggcagccagaagcacaaaugcacacacucacauggggacacaggcagccagaagcauuacaugggguaauccccauggaucucugucuuuuucucugucugucucugucucugucucugucucugucucucucucucugucugccucucucucacacacauacacuaugcacacacucacauggacacacacuggcaccccaccuuaacacacucacauggauacccccucagaccucucucucucucuuucucucucucucucucucucucucucucucucacacacacacacacacacacacacacacacucacauggacacacacacacaggcacccacaagcacacaugcacacacaugaacacacacaucugcacacucacauggagauaccccccacgaaucuuucucucucucucucucucucucucucucucucucucucucucucucucucacacacacacacacacacacacacacacacagaggaaaagcccuuuuccuucuuucuucccuuucucuaacaucaagcagccagaugaaagaugaggaacccagaagcaccguugugugucacaccgauccgcacggcugcagggcacgcgccucagucaauccaauccauuuucuagaggacuuuguaaggagauagcgcacagaaugucaaaaccauaaaaggaucaugcucuccagagggcugugacagggcagcacuggcagaagggaggcuccgugcaguauuugcuguuuguuucugcuuugcuuuuuuuuuuucccugugugugccuguguaggggugagcaugcgugucagugcauaugcacauaugugagcacauguaaacaugaguagaggccaaaacacacacucagguaucauuccucaggguccauccaccucauuuuuggagacaacauccccacuggccagucaacucuucgggccauccugucuccaccccuaagcauggggguuacaggcauauaccaguacaucuggauuuuuguuuaaaaugugggucuuagagauaaagcucacguucucaugcuugcucagcaagcacuucacuggcugagucacauccccaguccuuugugucuuuaugugaaaaugaguuucuaacaaaggggggggggcccucuggcccuccguguccaaagugauacuggucuacagucaaugccaauggucuguagccaucugcaccccagagagacacaaggaagcaacacucauccucccuuguaagcacuuggaauuccuugaggaucugagucaugcguuuggggaaacacgagccucugcgacagcguucuuuauaacuuuaugaccuucgaaggcaagacaccugaguacagguccuaaggugacugagacaaaaagcccgcaggccagauuuaggcuaaaaacccaaaaugugacaaaggggaggggugcuguccucgguccugaaccagcgugguggggccgcuguccucggucccaaauguucgcuuggaaccucuguccccgguccuaaaauagcgugcugggcgcugucccugguucugaacggucacugcgcauggugucccgggucugaaccgccauuguggccgcuguccccuguucugaaucagaacauguggcguuggacuggggagcugucccugguccuaaaccaucaggguuggguguuuuguuuguuugguugguugguugguugguugucugguugguuuuauguuguugcucuugguccugaaccaacauaggggcuguuggcccuggcccaaaacaccgcacagggguugggguucagggaagaggauauguugucugugguucagaaccaauaucuuugcuggggugcuaucccuggcccugaaccaaaacucauaggagcuuugccccugcccuuaaaccagcacugccuuucauaugugugagggagagggaggaagacugucccugguccugaaucaggcucuuuuguugcuguccgugguccugaaccaacgcuguuccagggcugugauuuauaggagugagguuuguuccugcuugugaccugguguguguacacgcuaugcacacaccugcagacgcugugggaagacguagcaugaccaccacacauccuucugaaauguggccucucacugaaccuagaguuguuuugcagcuuagguugguuccagccauuuccuaucucugcuccccacagugcuagggucaggcaugcacauccauggccacucagccuuugugugggugcugggaauccugacucaggaucuucaugcucuuaccgacugagccauuucucugggccaaggaggcaaugauuuuuguaggugcuaaccauaucucuucaagucaaauggagaugagaagauagugauugagaagaaaaaugaagagggcacaugcgugcuguuuucucaaaacgucuuucuaggaauuucauuccaggugaauauauugacauauguucugggucacgacauaaaauuuauagcuggcuucuuaccaaggacaacguauuggaaaacugcuucucuggacuacaguugcugugacauguccuugaacauuaagaccccaacucugugcucagaaaauggucaaaauguugguugugaggcagugguaguugaaaacauaggauguaauacagagaagcauguaaaaauggaauuguaugcccaggagaaggagagaugagggguaaggagggggaaauaguggguuuuguacuacaguuaccagcaucgugaggauuucucccuccugcuacauugaauagaagguggucuuccaacuuuauucacagcuccacugugauuucaagaaggcagccacacacugaccuuccacacccagcccucaggcaggaugguuuuggcuacuaagugguacagugaccucacccucuguaccucaggcucagugaagggcuuugguuuaguggugaaggcacuacuguacaccagcagugacaauugcaccuauacacaagcuguuguggggauuaagugaaggaauuuauguaaagucacuuaaaaccagaccuggaacucauuacugaagcaaaauggcuaaauauuacuauaauuucacuuagcuaauaaauucugaugggaaaugaaaaaauuccacauuaugcaacaauuuaaaaccauucgugggaugcuagggagguggcucaguuaagagcacugcuugcucauccagaggacccagaugcaauuccuggcacccacauaggagcucacaaccaucuguagcuccauuuccagggaaccugcuacccucuuuuggacucaugggcacugcacacauguggcacauacacauacaugcaggcaaaacagccauacacauaaauaaacaugggcuguucagaugcagagcagcuaaaagcauuuuacugugcuuccuuccaccuuacaugaugcucauguaaaugugcaaggauaaaaaugacuccucugaacuacacacauauucugugcuacuccccaucacuuaugcacacacacacaugcauacauacaacauacacacucacacacaugcacaaacacacacucacacaugcacaugcacacuugcacacauacauguacacaugaacaugcacacacauguacaugcauacacaccacaggcacacucauacacauaguugcacaggcacaugcauauacacauguacacacacacacacaccccacacgcacacacacaugcacacacucacacacacuacaugaaaacucacauacucacacaugcacaugcauauuugcacacaugcaugcacacauguauaugcacacacaugcaucacacaugcaugcacacauguauaugcacacacaugcacacaugcacaugcauacucacucauacauacuacaugcacacucacacacgcacaugccuauuugcacauguacauguaccacauuuuaaaaucauugaggaauacuuuaacccuuauaagaauguuggaaaacacaauaaaaguuguauaacauaaucucaaacauauuuugaggaguuggggagacauuuuaugagaacauuaacgcugguuggauucgggcauaaguacuuaaaucaauucuauuucugugcauuuucuucuauuuuuuccauuuuuucuacaauuagcauauguuuuauaauuaggagaaaacuauacuucaaagacucuaacucaaaguugaaauggcuuuaaucuugaaaugaaauguaccauucugcaaggcacauaauaacuccguagauggcugaggauggcugugucuuuccuucagacuauagcacaggauguuugccgacucugaucucucugugacaccccgcaucuacugaaauaggaauuuuacccaaacuuuugaucuacuucccacccgaggguaacagugauagccuuaaaagacccaggauucaggccccgcagcucagaucccccugcccaccucucaguccaaaggauacuacuggacaacacacaugaagccaagcacugagcucccaagagccucucauauagccuuggcaugacucuguaguguagguggugaccagacccacuucauagacaccaaaguagaagagcuaagcauuuaguccccaguuggugggaguuguggaggcuuugagggguggugccucacuuaaugaaguggucaugugcguagucuggaggccugauagcccggcaccgcuucuuguucauccuauguuccuugacuguagacaugaugcaccuaagccccuugggcuccugccaccaugcuuuccauaccaugauacacugcacucuuuacuugugacccagaacagacucuuccucucugguugauugcuguguacuuggucacagcaccaagaaauauaacuaguaugcucuacacaccacugccucucugaagaccucccccuguaucucuucagcaggcaaagaccacccuaauacugacucauccccaccccucgagucauucuguuuccucugcuucuguagcaucuacagcaaauccauucauucugccuucaaaaguggcuguaguccaacacaucucugccugccacccccuggagucaagccagccgcaccucucaccuggauggcugcaaugucauccucccugcucuccccaugacacccuggcucucccaacaccggcccuaucucucucaaagucaaaagaaaggucuuuacagugaccugcugguccugugugauauggcgcucucugccucuccacuccuugcuauccugcucuuugcugccuccugaacaucuggugcaccccaccccaggacccuucugccugcaaucucauaauauguccagcucccugucugccuuccuuugggucccagcucagaugcccccuuguugguaagcauuaaaaagcaacaccuacggggcccuguccaacugcuuuccuguugguccaaggaggacgugcuuccaucugacuuucuggggauucugcucuguuuuguugacuaccguuuucugugccucacccccacucccacuugaaugcagaggccucuuucaaucauuguggaaccuccccaggccuuggaacacuggguuaauauaaaaaaauaauaauaucaaauacaugaauguaaacaaacuggaugacaaucaucucucuaauaaacuucaguacuguguuccaaacuuacaucugagaccuucaaaguccaccucccccugccucugggcacuaagaagcacugccugagaaccucacaaaaucagagacaucaaccagcacccacagucauggagaaagcuacugugacccuccuuggugucugagaguggucacagagccagucuacaugcguacaaaggccaaggaacauggagcaguaauuugccuuuaaucccacugaggcucagaagaugccgugcacaggccagcacaaacacauccucuccacaggaggagcuaccacaacugccgacccuccuaacagagccucaggccuccauccgcacugcucauuuugguaaugauccccccagguaggaggccacaguaugggaggcgcagcccaggcucuuuguuuuaauuggucccacgcauuucugauuuuuagagcaccccucacuuacuuggcuuaaaaagucaaucucugcaugauccaauaggagcccagagaauagguaagagaaucucgacuauaacauuugcgcuuaaugguuagcuauuaauuggcuuuuucuguggguguguaaaucauuucaguuugguucacuggcauuaaugaaggagcagugcucaucaacgguccacauuccacgucaccuuguaaaaccacagcccaugcauuuaaaaaauaaaauaaaauagauuuaucacgauucaaaaugcagauagucauuaaaauaauaauuaaaauauaacuacaaguacaauaaaaguuccaugauaacagccuacaccuuaauguauauuaauucucuuaaugauuuacuauauacuucuuacagggucaaaucaaugucuauaccaaaaaaaaaaaaaaaauucaauuaaacccuauucacuguaucuuucaagggagucuauuguuugguuuugucucccuaccaggccauuugucaguuguucucacccaagauuacaaacagaaaggacaugacccaucaaggucgggaggaaagcauccaggcccagucaguccacccucgccaucucccgcucauuuuucacuagcgaccuuguggaggggggaaagggaggcgcugcuggguccauauucccaaauaaaccuuuggccugcaggccauaaccuucacaacucucccaccccacucacuggaccagcugaaguaagcugaaguaagcuacugcgagcaacagacacuggcuuccccacccccaccccggaacuucuugcccuaauacacagaccaagucagcuuguccuuuccaaacucucccuccccugcguugaggugaagaaaaaaaaaucgugucccuggucccugcaccaaugccaguggcuugccaagcuuuccccuugccugagugcguuuaugaaaaauuaaaacccagagacuauucccaugcuugggggcaauggacugccagggacggcuuccuaaagcugaaggcuagaggucagagguuuccuagaaucucuucucugcccucucccugucauucagcacagaugggcaggguggagagccagcaggaaaacccuaggggacuuagacucugguugggcccagugaauggaugcagagguuaggguccgcugcuuagccaguuccucgguccgugaccacuagggggcaaccagcauccccguaucugccaguggauaagguccugagcuccaauggcaucuaucuagagaguuuugagauuuggaagagggaagaaauaagaaguucgugucacacccauuuugcaggcaaagaaaaccaacucgcugaaugacagcuuacuuugggacccagcauuuagaaaggacgcugaaagaagcccaggcgauacugaaugcgcaugcucuugugaacggcuucgaaaagcuacaaauugccucucuccuggcccuucccgguuggcauggcaggggcuccgguauguguuugaaaaggccccucucacugagauccccucgcucugcugucccuucugugcacaagaccucgccucucagaagacccuuguggguccagagaacacuuggaccuccggaagcccaucgaagauggagagaacaggaacggggcuaaggagagggguagacagcagagguucucauuaagcaaggcggccucaugcuguugcaagacuuuauaagccucagcugcacaaugcuguuuaaaauauaggugcaauuugggccugugguuaauacuguuuaauuuuauuuuguacuguguaguauuuccccaagcugggccuaggcugauuugaaucuuggcuccagguuuugcugucuugacaaauuugccuaguuuggguucccucugccaggacccugugcccaugucgggcuuguggucuacagcuaauguccaggauccccucacaggacccacagaccaaaaggaggacucacaacuagcuggucccuuggggguagaggagcuaggccacacuacuggcaagagcucuccacaccuuuggcaucagggucauucauuugcauauuuucaaccucugugccuuaucugugugcacaccagguugugugcaugagauucguggcuuggaaauuuuugaucacauggcccuuggaggaguucaaggcuccaaaaaagaaagcauauuuucuauuccuggcucccuugauuggaagcaaugugacccugggaaagccucugcauaucuuggguauuauuuuuaucccagagggucucugggaagguuggggaagaagacuggcccucccuuggcagagugaggcacacaguagguggucaguaaaugacaaaacccuuccuggacagugaugggcuuccccuguggccuuugggucaaagaaauccucguaaaauaaagauguuuucagaaguaggaaaaggaugaacaggcuccugggguccuuugggagccagagugugacaggugggucuguuaucuucuuuuggaucuguagcucugagagaccaagaccgcagccaacucugccccucccgugcccugaggcucuugagcaacucccugcacaggagucuggcuuccuucuucacugucaauuauauacaugaaaacacgccaauaaauccgcucagcuggaacaccccauaaacacuaguauguaaaaagaaagagaaaagagauuuucaugcccggcaugcugagcaauaagaaaaagagauagagacugcuggucccuuggcagccccugaguggccaggagggucuugucaagaggugccccuggcucacugacgagaucuagcaagccgggucagucaaauguuguggagccaugaauuuuuccccauuccaauaaagugccuuuuacuuuauucauccagauuauguagaaauggauuuuuccauaaaaagcagagcucaggagacaugauggauuuucucuggcaccucacgggugcaugucuaugccuacugccgucuucccagcccaauagcacacgccuugaucggccugucuucccuucuggcugcucauuggcuuucaauaauuucucagaagcccauggguagccacuaaauuuaaacuccuguccugaaaacucaaauucaacucaauaagcacguauugacauccaaccgcacacaggauaugaaaccagguguugugcugcaaagaggaacgggagagaggaacggucuccuaagcaggucagcacuggaauauucuccaguuugagcucagcacaaggaacuucaaggacuggcaaaggacauacggaugugagcaaaagaauguaguaccauuugcaagaggacacuucaggcuacaaaaaucgcagaaaacucuaaccuggagcaucuuggagaggaacacagguuauuucaagccaugagaggucagcagaugccacucacccucaagaaccagaggguaagggauggggugauggcccagugguaagcaguuuauuggacaggcacagggaccugaguuccacuucuagcacccacauuaaaacgucagcuaugaggccacgccugugccuucaacacaggacaggcagagcuaggaagaucccugcagcuugcuagccagucuaaucuaaucagugagcuccagguuccacgagagacccugacucacaagagaaggugcagagcaacuaagaaagacauugaacaucaacugcuggcuuccucaugcaccaaaauguccacaugcacucagaacccgaguccugcuggcaagaacuaaaaaaacgaugcuggguaaccuguggaaggcagucccucucuaagaggacagacacccucagguguucuagaaagugucaggauagcugcaugcuaaaauuagugaguuuuucucaucugcuccuuucuguguccuugcaagaaucauggugauuggcaugcacacagcacacacaaauauuggauggguagauggauggauggauggauggauggauggauggauggauggacggauggauggguggauggauaccuaauuaauccauaguaaugugaacaaauccaaguguacccugacuaccuauaggguuucagagaagcagaauaagaaggccauguuuaagaagaaaacacaugguacacagaauccuguuuuuuaagaagauauugaucagagacaaggaagacauauaagcauucccagagacacuugacccuguuuggccaauaucauucacagaagaaugaugcugacucuaacaagucugaagcucaaaauguccaaaucccuucugugaacaaaaaccaacgagccacgcgauuagguuuaucacagcaacaaucucacucacgauacaaguuuucugaauucauuaccuuuccugucuaucacgguuaucaaauaccugacaagaagcuuaaggagagaagagguauucccacucaggguuugcaaagcaugaugcuaucaucauggcggaagguacagcagcugcguuugcaugucaaaugucuggugcauaaucauguguuugaacacuugguccccagaugauagcaauguuugggagguuguaaaaaaaaauacugagugauggagcuuagcuggaagagguagguauagaugugggccuugcaguguaaucccuggucccacuuucuguccaaagucuguuuccuagccuucugaaacaugagcagguuccuaccaccacagaagcccuccaugucauccccaccaugguagaugguaucccuucaaaccacaagccaaaaaugaacuucccucuuagguugcugggcauuuuaucagaguaaugaggagagcauugaauacagaaaaacugguaccaggagugggguuguugcuuugacagaccuagccauguggcuuguggaucuccggaacguuuuuuacagaugggauauggaagaguuuggagauacaggcugaagugcugugagcugagucuguggggaauuacugugaaagugcagacgcuugaaacagcaauaggaaugugacagugagaaccagcucaugggguaucagaguaagaggacaauguugggaaccagaauagagacuguucaugaugcauucuggcaaaaccucagcuuucuuucugugucuugaaugagacuggauucaaaagcagcagacuaagacuuuaguagaggaaaugccaacaacauagcaugcaagccauggcacgguuacugcuccccacucuuagauucgcagugacaagaggcagggaaaggugaggaugugcagggcugugggaaaugagcaucaacacaguuagagcucaagacagggcaaaugaggagagcucagacagagcagcugcugcugucaaccaagauuagcgcaauuaaagaggaaucucgaaaccuuguccuggggcaauaaaaaacaugccuugagagaaagagcccauuccauucacuagcagccuccagauaugacaagacaacucauuugaaaagagaguuccugcacaaagauggccucuagggccccccgguucuaccaaguccacuuaagugaaugcuuuuuucaggcuuacccaucaaggcacauagaggcaacugcagcuaugguccaaaggagguugcuuacaucuugggccaguaacagaaauugguauugcccgugugguacugguuuuugcaggaaugcuagauggugcaagaacuugugaguuccgguggcucacaccgguauucuagaacgccaggucagacaugcuauagacucucuauagucagacugccuacauggagcuccuggacaagcauuucacagaguuguagaggugaaggcuaagccacaguaggaauccugagaaaucagacacaucagaaauguggacaccuguggugguuuaaauaugcuuggcccagagagcggcacuauuaagauguguggccuuguugaaggaagugugucacuguggacaugguuaauaagacccuccuccuaacuacaugggagccagucuucuccuaguggacuucagauaaagauguagaacucucagcuucuccugcaccaugccugccuggaugcugccguguuccugccuugaugauaaugaacugaaccucugaaccugugagccagucccaauaagaguugucuuggucauggugucuguucacagcaguaaaacccuaaaacaaacaccuacugaggaauggugcagggaccaaaaggaaguuagcucgagagaggggccauaugugcugcaggcaucagagccugagaggcuacccaaaccuguuggagcccagaggauaccaccacaagcccccaaauucugaacaaggaacuaucggaucuugcauuuaccucgauggauuuuggucuuauuuugauuugacaauuccuuacuagucuccauucccucuuuuggaaugggccuguuuacuuugcacuguuauauccuggaagcaugaaacuuuaaaaaauaaauuauaggggauuacaguaaagaaauugccuggggucucagaagagucgucggacuuuuaaacagugcugaaacuguuauguucauggagacuuuugacauuggugugauuguguuuuucauuaugaaauggcugcaagcccacagggguaaggggaggaaugucaugccuuggauauaaaaugccccaccggcacaugagcuugaauaguugguccccagccacuggugcuacuuucagagagguuguggaaccuuuggcaagugcaggccacauaggaguggauuucugggagugacuuagguuuacaucccgcccacacgccccaggccuucuuuacuuccugaucaccugcagccgagcgagcagcuacccuaacuuucacugcuguaaaguuaccacaucuuauccaccaggacuaacuguaucccucaaacuguaagcccaagugacccuuuucccccgugaaguuacuuccugaagaguggacaaagcacaggagccuucuggucucaggggcuccuggggagcaaagguaacuucaagucagaugucccuacggcugagggucagacagauugacuuagcaugucuaaugcuuaauguuggcucuuucucuaagggaaacaucagcuucaacauuuggccaucugcccuuggcgcaagcccuacaaaacucaccggaaacauaggagccagcugagccacuucauuuguagaggugacuggagcuccguaacagaagaaagcuugcuuguuuaggcagcaggcaaaugugaucucccucuaucuaaucaaaguguuucucaaaggccauaccugucuaccucaugcuaagugguauggcuuguuuauccuuggcaguguuugugcuucuuccuucuccaaggccacucaggguggcucauagugaggccucucaggugaaacacugaggugggguuaagccauggugauuuuguccucuugggcuggagccucaggagcagagguggguaaaagggagaggaagagauggugccuagaacagcuaguggcaagagacaagcagucccugaguagaagcagggauuggaacauggccucugcuucuccacugccaucucccccaccucaaaccguuggaugcccucuucacucccuguuccucuuucaguucugcccuaucccagcucaaggcccuaagcacaagccaccaauaauaacuucccuuucaagccugagcuauugcucuggggaccuaccucuaagacagcccccgacuacuaccuagcaucucuauuagguguaccaacaccaccucaugcugacacaucuaaauccauguucuuauuuacuuccucaaugccauguuuucccaggcuucaccugcucaaucuguagcagcauugaugacaccuuagaaaucuagaaaugccauggguuucgaugcugaagauaucguaaaguugucuauuucucaucaucuuuuuucccagacccuaaucuguggcugauguguuuugcuuacaaaagagcggucacugcccaaucggugccuagacuaucucccaacucaccccaucccaccgccagagauccagaccucagaagcuauccacuguccagccucccacacugucuuagucaggguuucuauuucugcacaaaacauuauguccaagaagcaaguuggggaggaaagguuuauucagcuuacacuuccauacugcuguucaucaccaaggaagucaggacuggaacucaagcaggucaggaagcaggagcugaugcagaggccauggagggauguuacuuacuggcuugcuucccugggcuugcuccacuugcuuucuuauagaacccaaaacuaccagcccagggauggcaccacccacaaggggaccucccacccuugaucacuaauugagaaaaugccuugcagcuggaucucauagaggcauuuccucaagggaggcuccuuucucugugauaacuccaguuugugugagguugacacacaaaaucagccagcacacacauacacacaccuuucuacuauaccuagauggggcuucugaugccucuaucggcaccuggcgccauuccuaugaucucuggguuucugccccaaggcauggcaucccuuucuucuccuuucuuucuccccaccccccauaacacacacacacacacacacacacacacacacacacacacuuuccauuugcuucuccuauaaggaugcuuuccugguccuccacaaaccaaccuucauauccuccuucccagcugaacucaagauucuucuuccucaggggcccgcccuagacgagcacccacuccucuucgcaccccacacugcuugugagucuuuuuaucugcuucacagagcuuuuuaugaacaaaauuacuguguacauuuauuuguggggugguaaagagugaacugggucucccuacauuuguguguugaagcuuucacaccuaaugugauaguguugcagaugggggggugucuuugggaggucaugaugguuagauaagaucagggagggagcccucaugaugagauuuguaacuuuacuggaagacagagagggagagagggagagagggaggggaaccccucugcccugcuuagcuauaauuaucaacuuugcacagccuagaguugccugagagaauccucaacugccuaaaucagacuggccugugggcaugacuguggagaauagucuugauuauuaauugaugggggagggcccuucccacugcagacagcacugucccgggcagguggcucugggcuaugcaagaaagcuggcuaagcaagaucugugagugagccagcacugcauucauccuccgugguuucugcuugacuuccugcccugcccugggccgcgaccuggaaguguaagcugagaucaacccuuuccuccccagguugcuuuugggcagagagccuuaaggcagcagcagagagggagcaagaacaccucccccacgugaugacucaaaguaaaagcagcuaucagccaugacgaaggacuucaccaagaagaacacaaucagccagaaccuugguccugaccuucccgggcccagcgcugugagaaaucaaugucuauuguucacacgcacacacuccagucugcgaugcuuuguuggaguggcuggcggggaccaguucacuggcucaccuucugacuuguccccuccccgccacacuagaacauacacugcaggauacagaaaaugccauuguuuuuuccagaggcaggaagaugcucgacagagcacaggugcuaaaaacacggcuacaaacuuguucccaccccacagcuacgacucagcugcgcaugcgcaaaagcacagcugucucaucgucuacguccaaaagcaagcaguagagcggggagcgcauccagauaccaaacagcuucaaaaccuaaauguggagggaagagcaacaauaucucuuaagaaaucuuuuuuuuaagaguuagaaguuuccaucugugagacaaucucucugccugccucccaucugcaaaacagccaagcugaaguuuucuggggugcacccagcagaacauccccuccacagaugcaccccaaaauaaaggauggggauggggguggggugaagucuacuaccaaacaaggugcaccacacucaguacccccaaacuguguggguggaugcggcagagcccuuagccucugucccucuucccagcagcaaagcuaagccaguuugaugugucgugcacucacuccccuugaagacaaguuagaggcccagcccccuaauaaguguggcuuuaguuggcaggagcaacucugcggauguaaucguguuaagaugagcucacaggcucaaaucuagcaugacugugaccuaggccacuugagucagagauaccccgggugucagacaccuauggaugaaagcagaggcuagagggacacaguuguaagccaagaauggguagcucaggucacccgugaagauaaucuagugaccacguguucgauguucugcagaacgggaauagggcucacucuuaagccuggccagaacaaaggugugaccaaugcuugucugaccgagccaaacucucugggcaaagacagaaggggaaggcugaggggguucccagacugucacaucaacuuucgagccaaaugaacccggcgccuggacggucuguacgcucagauggcgagucuaucagaucuuacagcugagaccuugaaaggcucagaaauaaaucaagagggaaucagaggggagagggaagcagaagaguucgagcggcgaguggugccaucuaggccuuucuggcaagcuggacgcaggcaguuccagcauaaagggaccuuuguggcuuggcucucaggccaguguucugucugcuccugaggaguuggaaccugacuccccaaugauuuccaugcaguacaagagaccaugaaacuuucuagggcucaugacugcacugguaaaauguaaagucaggggcgaggggacaggacaguagugaucuguccuaagacaccugagccuaaccccaggucuauguaggaaagggacugcccugugacccccuucugugugaggcaggagacuccuguaaugaaucuacuacacucccccacuuuuaucuauugacuuccugaagccucaggguggccaacuaugacugcauuggagggggugagaugccaaagagauaaaaaaaggauuccccccccccacaagaugagcaugacccaacaggacugcugccuuguaagagacugagaccagagggacaccaagauaaguacauggaacacaggccuuaugaaaaaccggugugaagacgccaugagcaaggccucaggagaacccaggcuggcagacauuuugauauugacuucugagaccccccuggcucucgggacuuggcuguggcuaggccagcaggcucacacagccccuugggacaagaaccugacaauauaaauguuccuaucauauaaacauccauggaagacacaggaacgccacagaagcaguguauaaaacgcuaaaugacaagcugcaggguccugaggacuggccuagggagcggccgaugucacugcuccguguuguaggucuaugacuuuggcucacauccugguuccagccgguuugcuguguuacuugagccucaggcugcuccucucuaaaguaaggcaauaauagcaaccgcuucuuagcauugugugagauucagaucugauuauagcuuuacagcaugaaaguaagugcccagcacaauaaaaggcucaauuaauaccaccuaguauauucuauuuucaauccuuucucaacgcauaugagccacugugguugcuucgggcauaagaaggagagagaauuuccucgaagaagaaaagcagagcgagcaagcgagagagagagagagagagagagagagaggauaccaucuuaccaagacccagaaccugggacacaaagauggcaaaguuuccuggauucuccugaugccccaugauaugcuguccccagcccugccuccccacucuacaaacaaaaucugccaacugagccaaucucucaccucuggaggucagugaggaagcaggggugcugauggaguccucccugaccugccugaagagaggaagaagcucugacauacgagaggcagcagccagggaugagggaaggugcugggggggggguuucauuaagaucgagaugaaagggggccugggaacugagcggugacccuggccacagcugcccacagcugccaaagaugcccacagcugccacagaugcccacagcugccacagaugccacagaugcccacagcugccacagcugccacagcugcccucagcugccacagaugcccacagcugccacagaugccacagaugcccacagcugccacagaugcccacagcugccacagcugccacagaugcccacagcugccacagcugcccacagcugccacagcugccacagaugcccacagcugccacagaugcccacagaugcccacagcugccacagaugcccucagcugccacagaugcccacagaugcccacagcugccacagaugcccucagcugccacagaugcccucagcugccacagaugcccacagcugccacagaugcccacagcugccacagaugcccacagaugcccacagcugccacagaugcccucagcugccacagaugcccacagaugcccacagcugccacagaugcccucagcugccacagaugcccacagcugccacagaugcccacagcugccacagaugcccacagcugccacagcugccacagaugccacagcugccacagaugcccacagcugccacagaugcccacagcugccacagaugcccacagcugccacagcugccacagcugccacagcugcccacagcugccacagaugcccacagcugccacagaugccacagaugcccacaacugcccacagcugcccacagcugccacagaugcccacagcugccacagaugcccacagaugcccacagcugccacagaugcccacagcugccacagaugcccacagaugcccacagcugccacagaugcccacagcugccacagaugcccacagaugcccacagcucugaggugagagaugcaaacggcuggaccacacugacucugagccuaagccucgcauuccugcgaccccagggagcacaggagugaccgcccuguacagcagcagaaaggucacgaggacagacaacauaagaagaaaggagcgcgugcaugugcgugcucaccugugccugcugcuuccguggcagaaacgauguagggaucaagcacauaaaagaaagagguguguguguguguguguguguguguguguuuguguguguguuuguguguguguguacauguguguguacauguguguguacaugugugugcacagaaaagaaagguaugugugugcacagaaaagaaaaaggugugugucuguguguguguauguauguacauguaugugcacagaaaagaaagagggguguaugugcacaugugugugcacaaguucccuaggguaaccgcagccacuggaagcuaggcuucuguuuuuguagugugaguagagaguggguaggggugagcagugcacauagaugcacgugugcacauagauacaaguguguacauccaugcuuauguggaugacaucaagccagagcuucaugccaaguguccuccuccaucauucuccaccuuguucuuugaggcaagaucucucacugaacuuaaagcucacugauuggcuagauuagacagauggcaccagggagcuuacugccucugccucccucccagcacaugcuuugaugugggugcugggguccugaacccagguuccuacauuaaugcaguaaauacuuuaucuauuaguccauccuuggaguuguuggauuuuucauaacugcuucucguccucccauggugucaggauagaaugcugcuggugugggcagagcaaggagcccuggcugccaugcucagaccuagaaccugggcagaggaucucuagguccaggugcuagcaugggggauggggaugggggaauguggccuccagugguccacuuagaugacaccagagagcaucuaccucuguccacugaauaccuauuugcucuucaguuauuuucaugcugcacacauauaccaggugucacuccacauagcacaacuauauuagugucugccauggcucucugagcaguagcaauggguaccaacuacuucuauccagccccgagccugguuccacaggaagaaccgaggggagccaugaacagggcuucuuuacuuucucccucaaagagauuacaucugaaacaaacccaggaauacaccuaggaaacacccagacaaggugcccuggcccaaggcaggaagccauaccaaggacaucuggguuucuucagagggcaauucagcucugacacagcagacauggaggcauggcugggucuggggaaaggccccacacagcccaagcuggauaccuaucugaggggaagaauaggaggauacagguccccacccacuugggcacaaguccuagaagugacaguggcccagguguccucuguggccacugggaugaggaggaaaugccaauggcugaaccaggcuuuaucugggagcaaaugaugucaguggacccauccacuggagcagacaguuccccuugcauguuccaugaccugcuauuaaccuggguccaggguucccacagagaggacaacaccuucguguggaaaguuaucuuuccucaccuggcucacacugacuuggacccauccuagcugggagggaaggcucuagcuguagcugaugaagaaugaucacagguagaccagagggaccaccaaacuaagccguucccugguuccuucuaucuaucuaucuaucuaucuaucuaucuaucuaucuaucuaucuaucucugucucucucugucucucugucucucugucucucucuaucucugucuuucucugucucucugucucuuucucucucucucucucucucucccucucucucucucgaugugagaccagcaaccacaggacaaaggaagacccuucuguuuaacacaugcucagcccugcaaacucgcagaugugcacacuccuugcccucugugggguuucagucucauggggcagaccagucacucaggcagacgcaugccuucccacguaucuccaaaguccuggaauccucagacccacuugccagucaucuggaucucagcaagaaccacccaacacccuaagaaucgccaagucuacugcacauaaggaugucgugaauuucacuguuuuuccugcuuauauaccugugaaguuggcuuuuagaaacacguuguucugacugugauacaagcucuuccaaagauccauucccuaggauagcuccugcugaaucagucagugugugagacaguuuacacacugcagcaggccaggcugggaccaggggauccccaccuggguguauuuccaagaugaaagacguaagacaggacugggggccacaccugucaucuagagugacugccuucuguuaagaaucuuggauugcaaagacaaaaaagugcacaccucaggcccagguagaagagcagagagccaggaccugcuuucucugcauauaugagcucacauuccagucauaggaggagacgggugcagaagcaaggcaagguaagccuugagaugaagcgagggaguuggagaagcugguacucaccucccuagggaccacacagagaggcccucccccuaggcaccaagccccacccucauggaagugcuccagcuguguucaccugucaguguguccuugaaccugguucucugcaguguuuguucugugcugcuauucuaacagagcacaguuguuaucuucaaaaagaaaaugaacucaggcucgguggaggacuuucucagugacaagcucagcucuucaacacccacauuuaaaaaaacagacauggggcuccaaagcaucuggaaccccaacauuggugagguggaaaugggagaacccuagaaacucauuggccagccagucuaaccaaaccugagaacuccaaguuuugugagagauucugucucaaaagaaaaagagaaaagcaauaaaggacagcugauauuaaccucagguguccacacagacaugcacacacauacacacacacacacaagacagcauauuaaccucaggcuuccacacacaugugcaugcacauauauauauauauauauauacauauauauauauauauauauauauauauauauauauauacacauaccuauacacacaugcuugcacauacauacacacaugcacauacacauacacacacacacaugcuugcaaugugcacacacaauagaggaagacagcauauuaaccucaggcuuccacacagacauguacacacacaaaugcacaugcacaugcacacacacacaugcaugcacauguacauacauacaugcaagcaugcaguguacauauacaauagaggaagacagcuaauauuaaccucuggcuuccacacagacacacauacaugcaacaugcacacacauaaacacagacacacaauaucaaaaaaauaagaguaagaaguauuaacaaauacaaauagcuagaaaagaaaugaguccaaaauggcuuucaggugagccacacagccagggccugauaagucagaccccagucccccuuuccacgugguggcaaugucuccuaacugcacaucgcuauuugacugacucaugauaaauuauuggaaccgugccuguaaauacucaaaagcaccgcaccaacaucaaaagcagucguaaagccgugugcgugagugcguguggagugugguucagacggcuaaauccucugaugugucagcucaaguucccugagcugacacugucaccucugggcuucggaggccaguugugcagccuucggcagcuauacugaacccuguccccagaagagauucaugguaagacuuccgggacucuacacgucaagcagacacugaggaacagcaggacaggaaccucacagaaggaacagcccaccuugagcugaugagcagugggcagaaagacccauucagggaggcugcugagcccugaagcccugccagccaggaaucaaggcucagaaagaaguauggcagcaucccugagugccuggccaagcuuacucuggugagggugugugagcaggucugaggccagaggagcaggcucuuguccuggggugcugcuguaguccccaagagacagacacauccagggcacucaguaugcccccccccuuuccaggacacagguugucaccaacuauagcauagaaaaggcucagcaaauggccaccagugagcucaugaccagauggcagcucucaccaagugccuacuguacacgagcauucuggaagucccuucuuguacguucuuucauuuguuccuaggaccaagacugcaagacacuaugaggccucgagauugcuaagucacccuggagccccugagacacagagcacauauucuuuugucuucagagagucuuguguagcuccaaguugcuauagaaccaaggauaaccuugaacuucagaaccuccccccuccgucuccugaaugccgagauugcaggcuugugccucuacaccuggcuuauguggugcugaggauagcacucaggauggagccacacaugcuaggcaagucucuuccaaaugagcuacauuucccuucccaggguguggauacuuagugacgucauaaaggaaaaguauguuuauucugcggcuuugcuuaaacaggagaagguaacaguuaccgugcacauugucaccaacccuuugagcagcucacaggacagguacuguuacugucccauucugcagauggcaacacugaugagcuccuagagccgggcaugguaguacagaucaaccugagucugaaccuaugccucaccugcuuuucucaucgccuuguaguugggaagacuguccccuccuagccucucucuacagaccccgacuacuggugcgguacacagagcagaacacauagaagggaggagcccaguucuucagacacuugugggucuaacucagcccaagcugcagcuggccuacuaauugguucugacaaacagcagaaaacuaagaaagaaagaaauaagccaggguggaauaaauaugcauggugcacagggaaggccugacacccugagccguugucacugucaccugcagcuugcacacucacaaguccaacaaggauucccaggaguggcccagcauccuucucauccauucauccagagggagaaacuggcugucaccagugggagaugcccauuggccugcaggagaguuguaggucuccaugucucuuccaaaugagcuacauuccucuucccaugguguggauacuuagugacgucauaaaguaaaaguauguguguucugcggcuuugcuuuugcugugguaaacuuggggucuccccugaggaaaucaguuggauaccucaggaggcuccugcuuaugcaguaaaauugucagccuugaggaaauaaagaacagguauguagcaagaauggguggcaagcaagcaaagagaccaccaccacgacuucaccacagagagaaugauagugugcugguuagcauuaacugucaaccugauacaggugaucccugaaucaccuaggaaagugagggacugucuacacugaguuggacuuugagcaugcccaugggggauuaucauaauuaaauuagcugauguggcagcccacuaugggcggcaccauucccuaagcaccagguccugagcugcagaguggaaacaucaagcugagcacaagcacgugaccauaucugcauccauacucccucugcucuuuacuccagcuaugaugugaccagcugugguaagauccugccacugcgacuuccccacagugagggcuauaaccuugaauugugaacggaaauaaaccuuuuuccccuaagcugcuuuuuaccagaguuuuuuguuguuguuguuguuguuguuguuguuuuguuuuguuuuguuuuuuuaaaucacagcaacagaggugaacauaaaaaagacagugagagccaagacugguggagcagagguccuggagugccaggauccaggauugucacaagcagucuccuccuagaaggucuugaaguuccagaaagcauucauucauucaucauuccaucaguccauaaaugugugcugagcaccagccauacaccaucauccucugagagcugaugaaaucacagccaaccaaccaggugacagccccccuuuacaguaccaaggcagagacacacaugccuggggaagcaacagugguacaccugcccugggaaauggugaagaggucuguguccuaggaacagagugagccagcugguauggggaggcuaggaagguccuggugugagguccccuuguaccaggcaccucagcuucugcccugaggaaaggggcagcagcaggaagguugagucaaagaaaguggugagaaagcaagguauccaaagaagccaugagagccaugugggcaugagccagcgcucaaucucaguaucuucugggcagcucugucaagaacgaaccaggaggaaggcuuuugcaccaugucauccuagcugaacacaagaugguaaugauguggagugagcauggagcccgccuucaggaagagggguacuguaaagggagucaggguagcggggaacugagagcagcgcaggcagagacugaugggagaggacccugcagagaagagggaggugaggaaacagccagcucugggaaagagggacauaggggcugcccugguggcaucaggcacaggaggcaagccuacaagcaacaggcaugcaauacuucagcaggucugcaaauaugcucucucucucucucucucucucucucucucucucucucugugugugugugugugugugugugugauugugucuagauaaauagauaugaaaagauauagacagauagauaucuauauacauguauauauauaugagcgagauaaaacaucucucuauauagaugagauauagauauauacauaccuaguuacauacauagaugcauacauagauacauagacucauagauagaugauagauagauacauagauacauagauacauagauaaauagguacauagauacauagguagacacauggauggauagauacauagauagaaagauagauagauagauagauagauagauagauagauagaugauagguagguagauagauagacagauagauagauagauagauagauagauagauacauacauacauacauacauacauacauacauacauacauacauagauacauagauagacacauggauggauagauacauagauacauagauagaugauagguagguagguagguagguagauagauagauagauagauagauagauagauagauagauagcauuggaucuaggaaauugggccugcaguugaucuuucccuguucucccaguggcucuuuuucuccacgggcuuucccauauaucuccucaggauggguucccuggguguaccccaacacugcgucccuucuguacuguugcuugaaggacugcccagccuccagcaauacauguuccuauucaggcuuaaucaaaugcuucccuucuccaggaaugcagaggguccucugcugcuuccugcauugcaggugucuccaacagugccugccacaccaugagcuauuaaaugacccuaggaugaauauaaccaaucuuauuggcuauccguuuguuuugaaaacaggacaugaagugaagauggaagaaacccagaggcccagccagaucugucacauuucccuaggacagaggacucauguuaauguguggggggaacugacugccaggccccacuccagcagccuccagcucugcuuccuccuuggccugucccacagagcaacucugccuccaacucaggguaugcugaccucagaagcaagcagguugcccugcuugugacucauacaguccuggggggucuuugacaugggcugcgaccucagagucacagaucagcuugcaugagaacccacaggcuuaaaggagcucaucucagaagccaaagaagacuuucaguucugaugcuaauuagcugacguucaggaaccuuucccucucacagcccuggggagcucccacuauugaccuuccugaugucagccugcaacugggaagacacgguucaucugcaacuuuaauucugaacuaauuccuaaaaagcuacaagagcuuugcaccacaggccaaggaggcaugggagagccucagaaguucaguaaaugauaucaaaugcccuugaggaaggccucguuacagcuggucgcccaccauaggaacccgauggagcaugccaugucugaugaagcucggauuccggugcccgagugugggagugacaucagcacaucacacugugcaaugaagccaaucccugacuccagagcagcugagagaggagaggggaaggaaaggacacagaacagaugcguggagacagggagcgugaggggacgcucacagaggagggcugcauucagcacagagcccucagaaagagggcccugcugcggggucuccaggcaaaggcuucuggaagcuggauccaucucaugcagguagcaaaagcaaaggugagacucuccaucccuccccaaggaagcccgugcuugggccagaaguacaaggcggugguaaugcacccuaggucgauucccagaaaaagaaaucccugaaaccucgucgcuuacaaauuucaucaauaauuaaagaagguuuguuuuacucuuaacuauguauauauaggaggggugugugcacauggguuugugcacauguguacacagaugcccacagaguccagaugagagcaccagaugcccuggagcuggaguuacagccgccaaacuuaauacaauuuaaaauauaaaucuuguuaaaacucuacugauucaucaucucaacagcaaaaguggcauuuaaacuacaaagaaguccccgguguauuaaaaagcuacugagaauauuuaagccauucuuuuaaaggagcaaggcagugggcuugcacaugcgggauguuuaaggguuuuuuguguguguguacauguacacucgugcaugugugugaaugacacaucugcaggggcuggcagauaguguuggagccucugaacuggagugacaggcagaugugggcugcccagugugagugcugggaaacaagcccagguccugguacagcaaguguccuuaaccgcugagugccucccccugaagugguuucaucacaucuagaaacuggacaaacugucagcuuggaacauacucguuucugucuuuuccuuuuccacugcaccaugaaaguccuucaucuuaacuauaaguuaggauuaauacagcccaccuuucuacaaguccagacuugauauuacuggauauuuaaggugaagcucagugguugaucacuugccuacacacaugaggccuuagguucaaauccaaccagaaagaaaaaggaggggggaagggaggagggaagggggagagagagagagagagacagagagagagagaaaggcuucuugcaacuaacucuuaauuaauuccauugacaggaaaacuucuaaggcgaagagaauagcucagugguagagcauuugucuagaaugcauaagacccuggguucaauccccaguacuaacucuugauuguauuuuaguuuucaggguuuccugcugugaccucccucacucuagauaucacgcuguaucccaguaucuucucuuaccuuagagugaccccccuuucucugcuacacucaaaaacuccuugucacaauaauuaaucaguucuauuccucgagcaauuauauucaaauuaucuucgcccauggcucugaguuccguccaccaagagagcacaucuugauucccacuuagacaggaaguccucauccgguucugccuccuggcuuccuguguaccguguuccaggcccacagaaaaggugcacaauuaugacccagaguugucccugcucuuaggauggccagcuugugagaauucaccacugguuaaauagugcaggccgagccaaggagaccuagcucccaacugccuuugccuacauugagccucuuaggacauggagcacugcccaaagccacaguguuccucuguuaguguccugggcauggcuaugcugucucugagaaggcaguauugaauccuugccccgcucccgcuccccccugacuggucuggagacuccccuccaaucuuaggggucacagggcacagcuccgaugucagcucauuccgugcacagguaucaggaucugcaaaugugucugacacagcugcccuugccacuuuccuggucucgcugauaggagauggccacuugaagcugaucuuucaacaaggacguccccaaguacgucugaagccuucacagaagggcagcuacuucaaguccuaaaucucuucuuugucaaggaaaacuagaacaagccaccuggcgauagaaacacuggauuuugugcagagugacaagagcucugcagccagggaggccggggacauggcuagauggcacuugagcagaucuccugcugggcugacaccucacuaucgcagaacaaguggaggcucuggacuuaacaagggcuuugcuaucuaauccucaugaucuguccuggagagcagcaauaagaaaccuagggagcagagaaaagaagcugcagagagaucugagacaggaggccucucuggagacacagacccacuggaaaaaaaugaugcuccuagcaucauuuuugugccccaggaccccuaaccaaagggcauggaguggaaguaagaaggauacagugacagagggugggugcuacauagcaauagccuucaaauggagccagcaacauucucuccuggagucaagggggaggcguguaagucucagaaagcacuugucaugguuugaauaugcuuggcccagggaauggcacuauuguggagguguggccuuguuggaguagguaugucacuguguguguguguguguguguguguguguguguguguguguguguguguguguaugugcuuuaagacccucauccuagcugccuggaagacaguauucugcuagcagccuucagaugaagauguagaacucucagcucugucuucaccauaccugccuagaugcugccaugcucccaccuugaugauaacagacugaaccucugaacuuguaagccagccccaauuaaauguuauucuucuaagacuugccucggucauggugucuguucgcaggaguaaaacccucacuaagacaguacucaaaacuaacaagguucaggauaaacuaaggauucaggaaacuccugagaguuaccagacucacaaggccugucgccaagguuacauaagcaguaacagucaaggggagaggagacucaaagacagcagcugucacgcagccuccauacacucccuggcucacuaaguuggacuggaguggaaucauuccuuuggucuacaguuggagcuguaucugggguaaagagacauucgaucacgucuccccagggagaaaaaagagucaggcagcaucauagagggggaaagggaaaaacggguggcgagaaucugcauaggagguggacaccaucuuucaaggcugugaggagccagcugucccacacaggaucccuugucccuccugcagcuuuagacauucaguccugacuucauguucggccuucucugugguuuagcugcgucaugcugaagggaaaacacagaccacccaccccaaacaugccuuguucaccaugcagcuuguggcuguaauccggacugucuccucucucgucucagugauaacaaacagaguauuugcuucuuuccggugcuacauacacugcauguuucaggggagggaccugcuccuuguggauguucaaggguuccagcugauacggcucuaggaagacacauuguaaacccuggggcuccaguucuauauguauugacccaaggaagauacauuguaaacgcugaugcuggcuaucccagcuccugcugagucacucgccccucaaccccaauuucagaggggucagggaggcacaguucccucccggugaucaaaagcaggaacagagaugggcaggacuccaggacaaccaugucacauuaggcucuauccuaagucuggaagagagacacuccuuauauauuuuuagaugcagaaaucaaggcucaggggcauuaaaugcauguaucaaaggcagugguccaagaagcaaggagcacagcacucagaaugggacaaaucucuccgucccacacucucuccccagagcaaugagucacuuccuccucucucccgccagacccugauucuucaaaggauccagaggcuucucggucuagccagcagagucaggugcucaaagcugucugcagagugagugugucaauucuacccuggggacacaugagucaggacgggauguuucagccuuucuccgucagcauagagcucugccaauaccagagucagaaccacggacaccccugggaucugcuggccagagaaccugggguccacuuggggggcucucuggggauauaggaugaucuuaagucucaucuugcuucugcucuggaaugugcucaguugcaaacaagccagccagaaggaucuggaacguuguaaacaaauguccuccagguuuuucaucagugcggcuuaaccacacugcccgggagcuuauuaaauaaaguaaauuaggucucaauuauuugcuugcacaccaggcaggaaaaaaugaaauuuucaauuuaaaaguaauauugcuauuaauaugcaggagcgggucugaaauuggacuuucugcuccuuccugaugagaggggucaggggagcugaaaggcucucgcaaagcggggcuccucccuuucgcgugcccgcuggagcagccccaggucugucaaggguagguagcacaugggaggcuagagaagcagcucugaaagggacaguaucauuaaaccacuucauuuaauccccggugauuuuccuuggcugugacaaccucauugcuaggcccccugauuaacacggccuuuguuaucaaaaaaucuaaacgagugcauuccagugccagaaucugcaguuuuucauggaaacggaucuagaaaggggaaagugugugcuuaacacuuaucagccucccauucagagagcugcuccccccccgggccaucugcagcacaggagaaauuccgucaaccacccuugaugaucugggcuccaccugagcuucgagcucuggaagccaagucgguaucuugaauggucaccuucagaucccuccuucuggaagcuguucuuccucaagggcuuugauggguauauaucaagucuaaugaaauagaaacaaccuuucuaggguagagagggguaaacaucuggaaaguggccuggaaauugccuaaugauaagcggauggggagccaaguaaagggugguggcuggcugguuccauucuagcagaggacaggauaagcaagcaagaugcuucaagccacugacagggaggcagagccagggacggccagggaucuuuggggacaggcuggucagcucuggaucucucaguggggugauuucaucaagccacacuuaaaugcuccaaaccucugcuguacauugaaacauggggcaagcauugguacuggacucuugugguucuucuggagaugacaacauugggcacaugaaguauugguuucuaugugacacaugggagaaagaaagagacuugcccauaugaagggcuggcguggaggaccacauuuuucagggucucuggggagacauuaucaucaaugagaguuuguuuccagaggauuccagugucaacacagaaaaccuuuacauggaugaguguggggagguuagugugugugugugugugugugugugugugugugugauauguacgugaacaugugcuguacccauguacauaauauugaaccuguguguguccuauguguauguguguuuauguguguaugugugugcauguauguguauguguguccaugugucugaguguguauguguguguauguguguguaugugugugucuguguguaugugaauauguauguguguguauguguguguagguaugugugugaguguguguguguguguguguguguguguguguguguguguguguguguguagguguaggucagaggacaaccuccaguguuguuccucacgaguaguccccuugcuuuuuugagacagggucucucucacugggacaggaggcucaccagugacccuguguccacaucuacagcaugagauuguaaaugcacacaaugacuccuggccuuuuuguguggaugcuagaggucagacucagguccccaugcguguguggugagugugccagcugagccaucuccccagcuguuucagugugaugcugggcagugccuuguucacggugcuaggcaaacaccgagccuuugcgcuguucacccaguccugcaggcuuucaccgaaauagugaugacgguggaaggagacauggcagacuggugggaagaggggagggaaggggggaaggaaagagggaggagggagaggaggggagaggggaaggaaagagggaggagggagaggaggggaggggggaaggaaugagggaagagggagggggacggagggggacgggggacacuggagaaaggaaaugaggaauguugagagggaagaugccaccccaggugggcucaagaggauggugacaugcuggaauaaacuuccucucuaaagcaacugaagagcugacaccucugaaggccaggaagggcggggcugccucccucugcucagucaggcuccaaaugccagggcuucaaggucagagaggacuggcucuucuuucaaugcccuccaccagaucugugacggagguccuaccccgcucacccgcuagccacacccagcucagagccugcgugucuucugagccacccccauucugaguucuguugucagucacagggcacagacacuggaguggccagcggcucaagucugccccugccaugucucccugcuuccuaaccaguuggaccaaaccccuauggccaguccaccgugagugcacaaguccgguagccgcagccacacggcccaugcucugcagacccugugguuuuccaugucugugugacaucccugcagagacguccaugaggaagcaacacugaggcggauggcucuguuucuccuauacaucagcuccuggccuccuccccccacagucugaaucguccccuagaggauccagggaauucauuucccuuccccaagucccauauauccuccaaacacucccaggaauguccgugugcgccugcauccagccugcuuucugcgcugccugucaccuugcagagaugccaugcuacaggaaugucacugcaugugacacggaagggagucgaugcaggagaaggcucagagcagcucacagcagcuccagcuggcagccccaaguauuugcuaaguaaaaagcuaccaaaccuccuaccucuagagcccuaaagucuccugccaaccacccacaaagagagaaaggaagagaaagaaagagagagagagagagagagagagagagagagagagagagaggaaggaaggaaggaaggaaggaaggaaggaaggaaggaaggaaggaaggaaggaaggaaggaaggaaggaaggaaggaaaaacuuugacuggaaggaaccuccuccaggagccacugcuaagaacggcacguguuucuuacccuccacucuaacacacacacacucucucucucucucucucucucucucucucucucucucacacacacacacacacacacacacacacacucacacacacagucacacucaugcacacucacacacacacucaugcacacucacacacacacucaugcacacucacacacacucacacacacaggucauaacucuggcagcugacccuuuucaccaccaggagccaggcacuaggauuucaugcacuguugaccgauuagcccguuugccuuggggaacacauagaggggguggggaggagauaaaccagacuagccacaucugaaucauccucacccuaaaacugcuacaagaaaagggacucagagaaugcagcccucaguuuguguauaaaagcugagagugacccucaggcaucaggaacacaacacacccugggaccuuuacaagggaccgugggagucaaauguccugaguggguucaucucuuggcucugccaaacagugcaccugguggaccacccacacguggaaaggaguuaggggaugagguccacgugcaugagcguuuggggggggggggugucuauuccgauuuccugauuuccuuuugcuuucuucaggcagcggacuuaagacucuggaacaccuguguucuaccuuguuacagugaccucugguggucaugagucagacguugcauaaguucuagcgacuggguaacgcgugccuugaagucuucugagagauucugagcagaagagcagagaagugagggucagguguggcuggcagugggcggaagggagaaggcuggccaucaccugacccugaguaacccagucaggcuuuggaccaugccccaggcucugggugccagccugcagccugcagccauggcucagcucuugcugccccccaccccugccaccagcugguagcaucuccaugccaggcauagagggcacaggcucugggagguuuggaaaggagaacuuuuugggggaacagaggacuucuagaagguuugagaucucaucucugccccaagucccgcucugccuacuugggagcuccugagauaaauugggggauugcacgcaagcccccacaccaagagaaagccagguggggcugcugccuacaaaccacccaggcuaagagccacagcuucagcucagcaccuccagaaguucaccuuuauacgugccacugccgaugugagauucucacaagacccugcaguuccugguuggcguaaagcuuggcuuugcaguucagaaucugaagacaggaucacucuccuggcauucuuggagacucggaauggauggagggguaucaauauuggcucaauuuucccuucucuaugagaagacgucagcaaaccuuccugccgaggaugguacaaggaucauuaaaaggaaaauguccaugguaauugcgccuuuaugcauauuucuccacucggagaucccguaacacaauaaagccuccauucccccagaacugucucuucagcauguucucgcauuaugcuuaauuucauaagaguuucucggccccacauaacgacacagcucaaugcaaaaucagauauaaaucuagcuuaagagacucucagcaggaauuucaucuaaaacuguaaauguuaaaagauucggguucugauuuauguuguguuguguucaaagagagcucuuagccagccgccuuaggcugcgggggcucccgggucaguagcaucuaugcccuggucuccccagguuggacccucucccccuuguggcuaagaagcaacuucaaggucacuuccuuccccaaacagcagaacacaucacacaggguccuccacgucagucucccaccuuuccccaacucuauugagcgugggagggaggucaaagggagaaccgagauuugggaugcuggugugcaucacacccggaccugaucccggcucuuggauuccuaagugcacuguaaaccccagccaaugauggcgucuaugccuggcuagguccuggacagggcacuugagaugcuggcuguaaauccccaauaaaaggaaugaaucuggaggaggcauccaucuauugucugagcguauuuaagauguuuuuaauaugcagauuauuuacagaccaggcuccuacggcuccgaagcgagcauuacaguccgucauguaaaaccauaucugggcgauuuuauuacagccuaucucgcgcaugccacgcucagacaacacauaauacacaaauuauuuacaucgugaaaacaucgcuguggccccagcauuccacuuccaacaaaagacaacaccacggcaguagauuacauugaaauaugcuggcuggcuucugaaacuuccaacuuuauguuccaaaaugcuaaaugccaaaaaauaaaaaauauggauucgcacaguuaggguuuggcgcucagcaugucuaaaaacgagcuucacggguagagcuaccgugagcugggagccccccaaccaaaaaaaagcaccccaaauaagucaguguucugcaauuguaaaauccauuuauuuaaagaagcuugaaguuuccaagucuuaugaugguacuuaacauauuuaaaaauaugcacugcaaagcucucaaaguuccuggauucauccauaaaaaaaaaaaaaugccuugccacuucuaauggacuccacccaacuuggagcagaaucugugggguacacgcccccagaagaaaaggcauugaaaugacuugucuccauaucuuuccaggaaagugaauuaaauauagauaugcucucacccccacccguuuuaggcugcccauuuuccucccacaccccacaacccacgaaaacgaggagaaaauuagcaagccuguuuaagcuccuggauaccugauggcgacagaucccggggccccgguuuugugccucuuagaacauuuugucccagacuuugacgccauuccaucagccagguugacacaugccaauuaguucugagcgauucacagcaucucaccccgcauaccugccuguccuccaaguggcucccauuuguuucccaauaugccauuaaaugagacuucuggauggaugacaguucagauguagcaggaagcuuguuuuaauucagaccccucaugcccagauaccaggaaggacccagggcuuagugacaaaugucucuaaacaagggaguccacuucugaccccucugccacaagacaggcgagagcugcuuggacauuuuguaucuuuauagauguagcaaaaguuucgagaacucuuccaaaauaaagagaauggagagagagaggaaaggaccagagaaagaaugaaaagaagcagaagaggagguggcugccgcaguagcucagaccagcaguaggcugcaaaggacaauucccauagaacaauaggaaguaaaaucaggagccagcccugcuccagacccaucacaggcaucuucugccaugguccucauaggugagcaucuucacagacuguagaaacgggcuuucagcaccuguaucacuacgaaaucuacugcuucauacgcacuacacaugagcaucacucucugagcgaagcugugccugcgugcagacagauuugagagggagcugcguagaccggauaaacugucagaacuucuccugguaacuguggaagcugguugacagcacacuggguuuguugggggauagggggugggggaaacugaacuguguuauacaacugaaaccaaaaugaccuacuugcagacugaagucaaaauacuaguucuucccuuaauaucucauugcuuucuucucgggucaaugucuguguggcucuuugucuguuuuuuguuuuuuccuuuucuuuucuuuucuuuucuuuucuuuuccuucccuccccuccccuccccuccccuccccuccccuccccucccuucccuucccuuuccuuuccuuuucuuuucuuuuuuaacacugcacuaguuacaaccauuugcuaacccgcuccaccccaaucaacauuuaagauacuuuuagugacugcaccuuaaacaacaucucgaagugugucucugaaggcacagaauggccccacuucucaggcacuaugacuuggguuugaaguuuaguuuuuguuuucauuggcuggcugagacaagggguuucauuggcuagcugagacaagggguuucauuggcuggauacuuugguuggcaggccagcuggccaauaagcuucaaaauuccucuucauccuccccugugcugggauuagaaaccuuugccaccucucuggacuuuuuaaaauguagauucugguauaaagccauggucaaaagaacucuacugagcuagcagcuuccuagccuuccccggaacucauagcaggaaguaggagccugacuccaaagcuaaucacuucguuucggguuuuugugggcguuuugauuucuuuuucuuucuuggggaggaguguuugguugacugcuguuuguuuguuuguagacaaggucuuacguagcuauggcugacuuuggacuccucaucuuccugacuucacuucccaagcacggggauuauggguaagcacuaccgaguaccaacuggcugagaagagagacuccugucgcuggcccugucugccucugcuccguacuguuccauuuuggaagagauaugagaagagucucauuagggacgguuuuguuguuguuguugauaaugaugaugaugauguuaccuuuuuaggauuuuguguguuacuuccaauuacgugugugcugugugcaccugguaaugaggcaucagauccccuggagcuggaguuacagauaguugugaaccaucugaugugagugcuaaaaacucaacgaggacccucuagaagagcaagucaucucuccagccccuuugcucuggacuuuucucuuggaaccaacggccccgcccccaucccuuucgcuguguauagacuuuagcauuagucgccggugauucuaacuaguaaaaugcccuuaaaauugugugucagcaguuuuucauauuugugugccuuucuguuuagaaguuuguuuuugccuuuuagguuuuuugagaaaaagucucacacuguacuucaggcuuaccuagaauccacucuguggcccagcucugccucaaagucauggcaauccuccugccucagauuuccuaggugccgugauuacaaguauguaccagccugguagagcugaucacuuugaccaucaugauuauagacugugacgaaaagaucaaacccaaaugccccugccccacaacuuuugagauucacuauguccccagguuguguugguuuuaaauuuaucuaaaauucacagaaaauccuccccaagugccuugcagacuaauacucagacagucccacaggaggauuugcagggcgggggggugggggggggcaggcacacucccugaucaggcccaggagaagccgguccacugcucacaccauccucccccgcacauccaccugccucggcagcacaggcccucuggguccuucacagacgcugcucuuauaaauacccagccugucuucccagaugcguucaaaccaucucaaguauuccacacccauuuuucuuuaucagacagcugcaaccaggaaagguugagugggcacguaaguauaucaccuuucuuuacaucaccuacacaauuaauucaaguaaaucuuuaggcaaugcuugaugcaucugagggaccuuauuagccacgaccuccaagguuuucuuguuuuauuaccuaaaacauuaggaaagauuccacucuaaggguaauuacggagccuuccagcagcaucagggcauggcagaggcaaaugacagaguccuccaggaaauaaggccucuaagaggcuacaggcccuggaugcaccagcucaugacacacaaccuuaagguccccaaaccauugcaucucuguugccauagaaacgaaaggaauguccccaaagaguagugacucacucuuaguagcaauacagccagccuugcuacaaugaaacgguccggggaguugaaugaggagaagccacggggauaugucugaggagaagaaagcaucuuagaugcagacagcauggagaagacacaggcuccaagucccagacaucagguuccagucuuuauagcugacugacuaugugacauugggcaaguuacgcaaugcuuacaaaugggagacaucuuggcuguggaaccagggagaggcacgcaucccagguggugauggagcagagggugaagcucccuggcagaucagagucucgacagcuguuggcauuaguguugauaacugggagacgggucuugccagccauuguucacuuagcauuuuccacagcuuugagauuguaucgcacguuuaugguauuuucuucuuuuuucuguacuuuuugauauugacagaaguucaaacuuucuagaaccuauuagaaguaacauccaugugccacacagacacgucuccugaucauaauauuuugucagaucaauuuauuuuuaagaaauaguaaagaagggaccaaagagauuguuuggucuguaaagcaccccccagacagauaugaggaccuaaguuugauggcaguacccacuaccccccacauaugcauauacacauacacacacaauacauauacacauacauacacagacagaucacauacauauacacacauacacacaccacacacauacauacacacacacacacacaauguacaugcagugacacacaucuaugaucuggugcuggggagaugaacacagagaaacucuggaacccaugggccagucagucuagaugaaugggugugcauuuggcuauugagggaccuuaucucaaaagcuaagauggaggacaacugagaaaaacacccaguuuugcccucugaccuccacauguaugugcacacaugaacacagaagauaaccagagcucauagcucugccuccccucuuuuuccucaccucucaaguagcuguugacucccaguuagguuuuauuuuguuuuuaccacacaagcauugcccuagcuggcuuucacugucaaccugacacagccuagacacaccugagaaggaaaucucaguugaggaguugcccaggucaaaucugacaccagugucagggacugucuugauuguugagcgauucagggguuucugcuuccaguuucugcccugacuucccucagugauggacuuugaccuggaauaaacccuuuccuccccaacuugcuuuuggucaugguguuucaucucagucauaguaauucuaacuaagacagaaagcuuuguucccagugugggaacaaaguuccaguucccaguucccagaaaaggggugggaacuucaagaggcguggccuagugcuggguccuuaagugaccaaggacacgcccuugacugagauuaaggccacccagaguguguuagugcuucuuccuacugcugugaccaaaugccuaacaaggaagggcuuguguuggucaacauguucuaucacagcaacgcaauggaaagcaaacuaggacaggcccauauucauaaaucacuuauuuuuauauuugaaucguguauggauuguaacacaugguacauuucuuucuaagcuuguuuuacagaagugcuuugacuucuauacacauaaacacccucaucucaguuucacugcuguguacuaauccaucuccaucccccaaaauacguuuacaauuuguggguucuucuacuacugaaaacuccaugaguugucuccacauucccauuagugcagacagugcuacagagaacacucuacacacaacuccaggaacagcuguaucugccaucaaggaagccucucugaugugggcccuugagacagcccacaagacuuguuuaagggucggagaggucaaccccacuuuuacaaaauacugaggagggacuuuccuuuugacauguugacacuucaggggugagggaaagcagugguggcuagcacucgggaggucuccgcaagauaaaagcaauaagcaucggaaauaccacuugcacgcgcucucucccuacucuacucagaaauuccuucguggggauggguaggggugagaagaagaugggcaagguaagagggagagcaaagcucaggugcuguaaaaggaccaaugggaaggagaucuaggugaggagggaggagggaggguagaggagggaggagggaggugggagaggaguaguguagaggaagguagguggggaccaaugucuagaccuaaggauguuugaaaagaccauauggaaaccuaccauguuauaagcuuuauagaacagacagacagacaugaagacucuuacaaaagaguuucauugaguugcccuaccaaagaaguuauagcuggcccaauaaaaauccugguaccauguaugggauaccuccccccaaguuguuagucaggagugacccuagagauccccccaaauaauacaggcuguauucauugcccuugacugcccaccagcacuugauggugagacccuaauugcuggcgacaccacaggcuuuggucacaggacauggggacaucaagcuagauggccaggaggcucccuccauggagaccagcuuucguaacauucuguggcugcuagagggaaaaggcuguaaaaaguaaaagcuuuugaguccuaaaaguuguaguaaugacgucaagguauagcaaugcauguaacagucucacacauguugugggggcgaacaaccaccuucagguugaaccuggugccuauuccaugggaagaaacacauacccaacauugugaaugugcaugggaagccaugccugggagcucgcaggcccuagggaugaaccuacugcucagaggccguggugugaagccacccucuccguguucucgucgcuucacuccugcaguagugcugccucaggccucaucagagaaguuccagaagcuuguagcugaacaugcagagaaugagggagggagggagggcucagccacaagucacgcaugaucgugcgcaccuggaacccaagcucuaaaaugaauccuaggggggguuauuagcuaguuggucuauccaaaccagcaagcucuggucacacuuacacacugccucagaaaauaagguagaaagcaauagagaaaagcacagggcaaccucugaccucugcauauaugcacauacaugggcaagcacccccacaagcaugugcacacaauguauaugccacauauaaacacacacaugcacauacaugugcacacacaccacaaacacauauacacacagagagacgcacacauacaugcacacauacaacacacacacacacacacacacacacauacacacacaggcacuccuuccuggaaugauaaaaacaaaugaguuuagugaaguguacacugaggaucucccccauaggcuggaggauggugauuaucuugguggaaagaauuccaugagcauuagaguugaaagagaaacucuccgcuucucgcuggcugccaaccuacaaaccaacaaauguucuuuagacucaaguaucugucaggacuucugcuccuggccaaaagaggagccgagaagccgacaagugcaaaacguggcuucucuagacauggaccgcuggcauggaaggaccgugaccugugagagaugguaaacacacaaggugagcucugcagcuuucuugggugacuugcuaugaaguuuccaggcuguggcagagaaaggggacccaggccuaggaguccccuugaauugaggagaaggacgucgaaaugggggugaaucaagcucacuggaggucucaagacacagcacugggaaagauacucagaggauucgggagccaugcagagggcaccuccaacuauucaugcaaauacagauucacacaugucucugagaagaccauccgaggccacacagcaaaccagccaacgggacauagacggucauccccuucuggcacccggaaauagaaugacaccuguucccuacaccaagcacggaaaugugcauaauauauaaggcguagaucucccaggaggagaaaaauuaacuccagacucaaagcugcugaggacccaaguaacaaagcauaaaaacaagaccugaaauguuucaucugauguuccaagugauguaagcaugcuccagaacgaagcucaugaauauucauaggagucggaauguagcaagccucccaacgugguaaacuguacugucugagaugaaacggaaaauucccagguaugcaaaggagcaggggaaagugacuuauaaugaaaaaaaaucaaucacaagcaagucagaaauuauacaaugauggacuuaguggauaagaagauugaaggcaagcagggaaggcauggggguuguaaacaggcccacgcaaaguuucuagagaugagaacugcaaacaaaauggaaggcacaacaggagugagaacacggugggugagaaggacaaaaaauuagauggccugugcacacacgcaauggaaaagacccaaacuaagaggcagagauaaaagggaaggcuguaaaggcggggcaucaggaguucacacucauccuuggcuacucauugaguucaaagucagccugggcuacaugacacccuguauccagacaagaacuacaaacaaaaagagagagcuggaggaagaaaaggagcauccgugagaaugucgagaacgcuuucuguggauaacguucccaguggaggggaagggacaggaaaagauuuuaaacaccaccaccaccaccaccaacaacaacaacuauuaauuuguacauccaagaaacuuugugagccccaagcacaagacacguagacaaaugcugucaacucaacaagaucaacuugcucaaaucuagcaaugaagauaaaucuucagaaaaaaaauuaaaaagacacauugugugcagagaaaggaagauguggauaucuuuggguuuugguuguuuuuuuuuuuuucuuuuucacaagaaaugacacgagaaagccaaaacccauacagaugcuucuugaaaguucugaagaagaagaagaaaaaaaaccuagcaaauggaauuuuuuaaaaaaaaaugauaauugaaaugguauccuggggaaaugguaacuccaugguccagagagagacuuuuaucauuuaagugucucugaaaugcagcugucuaaagcaaaaugaauaaugguggagucuaagguugaucacauugcaugaauuuaaauacaugagauucagaaagggaugagguaagacacagaaacauaagacugcuguccuauguuugcaaccccaucaugugaccaugaauggugauguuaugauguauauaaaaacucugagauaacuauuacaacaaggagguaacauugauaagccaaaaagcagauaacacggaauuauucuuuuaacccagagaaaggugggaaaagggaaaaggagaaaaaacaauagauguuagaagcagaaaaauaauagaagcauaauuauacucuuaaccacauuaaaaguaaauggucuaaauacuucaaauaaaggacagagauucuuagauuguaguacaacacaagaccuaauuauauguuguuauaagaacacagaccuuaaauacaaagacaaaacucguuaaaaacuaaaaggaggaaagaaaauauuccccucgaaacacuaauacaaggaggcagagcuguguaugguggagaaaggguagcauucagugucuaggaaguucagauaggaggguugugaguucaaggcuagcuuagacuacaaaggaagacucuguaggaaaaaaaugaggggaagaaggaggaaggauggaggaggaggaaaaaagagaaggggaaagaaaaggagggaaaaugugggaggaaggaaagaagaggggugggagggaaguagggggaggugggggaggggaggaaaguaggagaaaaagagggaggagaagggagggggaagagggggaggggagggacgugggagacagagaggaggaggaggagggagggaagugagggaaagaggaggagggaaaauaucacacacgguaaauuucagagcagaaacacuaccaaggaucauuuuauaauuacaaaggaagcagcugauggagggaacaagaaguaaacaagaaaacgucaacacacacaaaccaacacugggagaauuguaaggagaaauagauaagucggcagcuagaguugggaaugaucaguaacugacuaaaaugaacgagcagacaucagucugaaacgcuuccagugugaccuaacucacagccgcgugcagaacaucucuggaacauuccaaccggaaaugccugagcaagaaugcauccuuaagucuaaaagugcaccagugcagccguaaagcacccugguugacuggagacucucuccacagugcugcucuguccacaggagaaguggguuagaaaugaacagcaaguauuuaucaggugguuuuuauuagcuaugaauaugagacugucauuccaauuggccguauuguugccgaugaaaauacugaacuguuaggcaaaaaucagaauuugaggaaacuugugucuuccacugugaacucacucagccgcuuacaaaaauuaaugacuuuucuggagcuguaagcggugacacccaaagguaaucuggggcgugucacgugacaaggcaugcuggcucuuaagaucuuguaucauucagugaaccaguauuuucaaaauaggcagugucauuuuuacaauuagaccgcagcuaguuaaagaaucucuccagagacuuguaugccagacuuuccucuaagcccaugaaauggcucagugcaaaaaggcacuuuuaaccugacuaugccugauggccuaaguuugauccuagagcccccccauacaaacuugaccacugaccucacaagugcaccaugguguacacauacuuacacacauguguacacacacacacacaaauaauaaucaaaguaaaagauucucuaccaacacaagaacaagcuaauagaaauuacuagaacaggguaaaaaaauauugcuauacauucauagauuauuuaaugacaggggcaugucugagcaguguuacuauaugugggaagccacaugugccguugcagaguggcacugacuacugcuggccaccacgcauaaguuuggacaaacaaccaauguguacauaugcaguaaaguuuuuugcaaagacacugccuggcccgggcaugauaaugaggcuuugagaguauaaccaaucagaugugagacaugcaaaugagguaugauaaugaggcucugugagguacagagagagagagaguagccaaucagaugaggaacaugcaaaugaggcauagugcauaaccaauccgggugugagacacgccucuccuaggccuauaaaagcagcaccaguucugggcucggggucucuucgccucugcaaucaagcucucccaauaaacguaugcagaaggauccuguugcagcguccuuacugcuggccaguccggcgugcgcaagaacuauagugcagacagaguagaguaugcuuccccaaaccaauggccacagcaucucuuagcccauaaucuuaaagaagggccagaacacacaucgucuguguugcccaacguaucgauaaaugauggcgguucccaaucccauauugcaacuaaccucuaagaauguaucugucacagccugggucuuucuaacuuucauguguucgugguaugcauguguggauacgugaucacaugugucugaacacauacauacauacauguggaagcccaagacuaucacuggaagucuuacucauucuucuccauauuccuuaaggcaggaucucucagcugaacccagagcuugccuauguagccgguguagcuagccuccucauucucugguucccauuuccaccuucugagcacugggauuccaggcagaccaccaugaccaaccagcuugcaugugggugccagggauccaaacuagaguucuucuuucugcugagccacuuuaguguggaucuuagauguuccccaaaggucaugagcugaagguguaagcccccagccuguccagcugucagcaggugcuuccgugucauaagguggagccuaacgcaauuauuggggguaggugggaccuaauauaaggaagauagauuaucgggguucauauccuuguaggucauggggguuccggccaucccuuccacugugucuauuugcuccccaguggugagcaagcuacgccauucccuucccaccaugaggcucccucgccucagauccaaaggcaacaacacaaguaaccauaaagucucuggaaccaugagccaguguaaaccuucccccugacucuccuggugaugugucacagcaacagagagcagacugacacaguacaacuugagauuucaguaucguauucaaaggaauauccaaagaaaaccccucaaaacggcccuuaaaauaacaccuuauauucuauuugcacaccuguacaaagccaauuuuuuuucucacccaacguaucaguguugucaguguugacagcagguacagguucgagaccccagucugucuuucacaaagccaaacaugagcgaaaugugcaaagauacaaaaccaugucguugcgcaccagaucucauuuuguuuccaaaaauauuguuauuuuuauuauacaguaagccauucuggucaacacaaaaugguuuuauuacuguuguuuuaaugaguuaauacauauuuuaguaaucgcucaguuuuaaugucuaauacuguauauauuacagcuauaagucauaagcagaugauucugggagcccuacagaagcucugugagaggggauuguguguguguguguguguguguguguguguguguguguguauguguguguguguauguguguauguguguguguguguguguauguguguguguguguguauguguguguguguguguguauguguguguguguguguguauguguguguguguguguguguguaugugugugugugugugugugugugguauaugugugugagugagugugcauguguauguguaguguaugugugugagugugauggguguguaugauuguauaugguuguguguaucugauugugugggggggguauaugugugugagugagugugcauguguaugugugugagugugauggguguguaugauuguauaugguuguguguaucugauuguguguguguguuuaguucacugggaagcacaaagucaagagagagggacagaacaggacucugaacaacagagcggcuccugagccugugggcccaugcagacaagugcuccaagaugccugagccacuuggcggacugagagauaggcugaucagagaaauguccggagagagaagagaagaccuuggaagaagccugagauuaggagguggggugcaagacucuaaacugcacuggcagagggcaaugggggaccuggagggaggggguccccugcacuggacaggccuacuaaguuaaaggaaagaagagaccgaauaagcuuggucgcuuucacugugacuucugacuuugaccaacacuaagccacccagaggcuggcuggcauuaauaucagcuccacaaguaagcugacacccccugccuggugucuguggugcagcuugcugguccauggucucuacauuuuuuuucccucccgggcuuaguaucugccauacacgugaacccagaaaacugucaggaagaaauacuuuuuagagucucucuggcuggcaggagcauguacgcaggcauuaccagagugaucagagucugagggucucuguacccgugcccagcugcuacaacgcucagacagauggcugcaucccgcauugaagaccugcccaucaucagaugaaaucuaccucccauccauccagaguugccucagcggguuugccagguucccccgacccccccaccccccggcccaccagcacagagaccacggacacagcuccauuguccaaagcuggcucaguggaccagagaggaggcacaagugcugccagccagggagucaccacaucgccacccaaaccagcaagcagaaggugugugccacggaccagaccagagccuggauugagauuaaacagcagcagcagcagggaaaaugcaggcuggcguauauugaucccgaggucagggaaauauauaacuaagguuccuuagucccuucccccaggcccaguggaccucccucuggguugugcuuuuuuggccuuuggcuuaauugcagauauuuaaaugcagcgugggugucacuaucgauccucagagcgacacuuuaauguagauguucguccucucaggaacuguggcacccagcaagcuauguuuguguguguguguguguguguguguguguguguguguguguguguccgcacgugcgugugaguguguucuacaacaaagggaagccaucucuucuccacucugucccucagugacagauauagcagagccaaguuugacuucuuuuccagcucuaauuccuuaaccagggaucagaugaauucuggggccaggaaccccaacacugcaccucugaggagaagccagugggaugagacccuucaggaagaacauagauaggagugggcaagggaagucugugccagagaagguagugcguguggauccuggggccagggucagaagcguuccgcgccuucccuuucccacccagagagcucucuucagagacggauggcacagcuuuugcuuguucuaggugagaacacagacaggugacuggaguggccccuagagccuccucccacccucauccaucuccuaggcacaacugcccaacagucugacaggucugggaggcaaugcuacccuguccccugccaggagcaucuccugcccuggucugugcgaaggacgcccucccuguaaagccacauuaggcuggcacuguccucccugacaaggggaagaccuaauccugcuuaccggcagcucagguuuucccagaccauccccucuucugccacuuugcagucaucaacccaggucacagagagauccacugcagccacccccagcccucaagaagaaccacacagccagaggcaaccucucgcuuauuuucuugucugcccaguaccugcccaggcccaggcccaggugcauucacacccuccggaaguagacacccaguaaagcccagcuugcugacaagaugggcuucuugcaaacccacaucuccucccaaggcccugcaaggugccuuugauaugcagauccccugguuauucaccugugcaccccugaagguuggacugucuccccucccugggguacaacuucauggucacugcccuccccccaccuggcuguuugcuggagucuccagcccugcugcagcagcuaccacgagggagagaucauuacauucagaucagcuaccacagcaauaggucaggcuuccagaagccuccccccaaacgcugauuaaugggcaggagcggccccugcgcaucucauugcgcacacggccgcaaugaaaccaucuuugcuuuacaguucugugcaagacauaaaagugggaaguaucccagccuuccgagggagcaggcuaugaauacagaagcagccccggguuauuaauccaacaccauuagucuuagggagucaccccagcacugacccccuggaaggaaaucucuccagcuguccauuccucauuucaaauuauccauacagucccuguaccgaccaccggugaguuauuugauauuuuggcgaggaaaguaaacaauauaaaaagcagcggaacuugggguacuauaaauuccaagcaaguuauuuucggagagaggaaggcugauucauaggguucucugcuucccaggacuaauuugguuugcuuuuuuuuccccuuuuauuaauaggagguuagcaccccggaaagaucacauuuuuguucucggcugcaccugucaaggggaucccaggcucgcagcccagcguuugaagguuuaucccagaaugguuuucauggaacaaacacagcucucgccgcaugcuucaaaacccugagauggcaggcacuucgguucuuaaaggcugacauggugugacuaguacaggcugccagaaauccccgacauaucgccugucuguccuuucgucucuugggagcagagagagcagccucuggcuuguauuuucuuccauuuucuaaauggauggggaucuggcagugguuugguuuuuuuugcuauuguuuuggggguuguuugguuuuuuuguuuuuugggguuuuuuuuuguuuuguuuuguuuuguuuuguuuuguuuuguuuuuuggucuacccccuccacccuaaugauuuucacaacaaccccugaccucgcauauucacucucacgcugaacagugcucacaccugacacuucagcuucucugcuuuguuucuguguucagccguauucaagccugagccuucuucucucucuccccuccuucagggacucugcaggacauguguuggguugucaugucucugcucuccacccuuacccaggcugcugucuggaugaugucuaucugucugcuacgugacuggcucuuucuuuagcaaaauguacauucuuuuguuuaucucuucaguuaaggcuuucaggaggucugguuuucauuuaaaaauaaugguucuuguuguuuuguuuuguguuuugagacagggcuauaccacauugcccuagcuggccuagaacucuauauaggccaggcuggcuuugaauucacagagauccaacugccucugccugaguucugggauuaaaggugugugccaccacaccuggcccuaaauaaugcuuuuguuguuguuguuguuguuguuguuguuucuaaaagagcuggccaguucuuuaaaagucccauuuguuccaccagcucuuacucaauucuuauauacuuuauuuacuucacuucuucauacuugguauacuaucuguggcacuuugaaugagagaugcccucacagacucagguauuugaauacuuggauguugauagguggcacuuuugggggagauuauggaacuuucaggaaguaggcuuuggaggaaaugcaucaugggaggugggcuuugaaaguuuguauuaaggccucgcuuccuccucuguucucuuaacuuccugcuguguucucuuuacuuccuauucaguucucuuaacuuccugcuguguucucuuuacuuccuguucuguucucuuuacuuccugcucuguucucuuuacuuccuguucuguucccuuuacuuccuauucuguucucuuugcuuccuguguaugaaugaaacauguucucugggcuucucaacugccaggugagacuggugcuccagcaaugccuucuccagcaaugucuuuuuuggauugugagauaaaauaaaccuucccuucccugaguugucuuuagucaggcuaugugaucacagcagaguuacaaacaugcagucauucucaggugacuccaucaucccuaccuucugagacacagauuucuuuccuggcagaacuugucucucaucucuugugguagauuuucuggcuuccuugaucauuauugucucagauccuggcuacccugagagucuuccugcaucuccucauaagacucuaauauguccuaaagcaacauaucagccccagaggggcccuguagcuuacaaacccuucaggguuccacuugcucagaaccaacauuuuucagguuuuuggcucagaguuucuauccacaugugcagugugggauauguucucaugacuauauagaguuuagaauuggucucucuguguguuucaggucuuccuguguguuucaagaaguuccuauggcagccauagccuggggguggccagugacuaaggacauuacugucccuaaagaauucuguuuuauauugacuuccuucuuggucuguuuuguauuagaaacacaguucuaacucuucaagccuugacggacucucacagacaugccaggacauccgucuguccaucuguccucugucucgcccuuuuuucugacaccaguauccuucagucuugccuuuuggagugaaccauccaauguuucccuggggcuaggggggaggggagagagccacacacagcacagucacaccuugaucagaacacaacuagagucagccuagacccugcccaagggagcaaacaucuuaccuaacauuuacaaaaauacacgaacccaagucgcagcaagccauccuucaaacuccuugauauauggccaagaaauagccugucaucaauauagagucagacccaagccuugggccucccucgcacugcuggggcuucugauugaaccaagcacuuugccuggcuauucuaaacacugugcugcaacgaucauggcuuuugaagcaaagggugcucauucacaugccagacaaaucaagggagaguccaggaugaaaccccaucccuaaugaucucucuacauagguagccuacacaguacuaccuaccggacacccaggagucaccgaauacccuucucccuagccucccucaauuaccagccaaaugacaagagaaggguuagauuauagagagcuucugaacacugaugucacaaggcacaccggagaugaaggggcagcugcaugaaccuuggagaagccggagcaaaccggugcaggugaccucagcuccaggggacauugcugauggcuuccugugaccacugcacgcuacagcccgugcaugccucaacagucuaaaugcgcagaaccuugcaguuggcuggccgcauggccucagcaggucacuucauuuccccucugagccucuggggacaaacccaggagcuacugcacgugcaggccuggccgguagcugccacaccucaccagauggcagucgauguggacaguguggagaggacccagaauuaaacugucccacacagggucucaggcucccucugaccaggaagcagaaugugugccuuccugaaagcuaaauacugaaaaccauuucuuguagcuuuucugcuccaaauacccggggucacgcaggcagaagugacauaugguaaaacauugacaucugagguguguuagcuaaguugugaccagcaguggccucauuuuccauuaacacagaagauacaauucaagaaacccccccugaauggauaucugaaguggaggguggugcugaacccucacagugcucuguuaauuugcuuagauuagacauaccagccuaugauaugguuuaauccguaacuuagacacaggaauggucaauaaccaaaaccaaaaaugcaucauccaugugaguguggucccaauuaucauauugccccaggccugcccgucuugugacggugugaggggacucugugccuguagagugaugcaggaggugaucugugaugagccaugucuuaguccugugcccuggcugucuagcaucauugauaauggguaaccaaggguugggggcauugaugucacacuccugugacacuguggccacguucaagccaguccaugccucccucucccccugauuuucuuccuccaacuuccucgcccugcucacuggcccacgaauaguuuucauuugauuuuuuuaaguuucuuagaucagagacuggggauagauuucagugggcaaagugcuugcuguguaaacaggaggaucccagaaccucuguaaaauccuggcagggcauagcugugucuaucgauuguccuggggccagagaggaacucuauaaagcccuagucagcaagccacagcugaaucaaaccggcaagcuccagguucgaugagacucagugucucugaaagaaagaguaggagaaacuaaggaagauauucaacaucaaccuuugguauccauguacacaugaacaaugacacucacacacucucucucucucacacacacacacgcaaacauucacacucucacacacucacaacacacucacacacugucauacucacacuuacacacagacucaccuaccaugcaugcacacuuacauauacucacaaacucacaacacauucuuacacacuuacacacucacauacacacucacacuuacacacuuacccaccacacaugcacacucacacacauucauucacauauucacacucacauauauacucgcacuuacucacacccacucaccacacaugcacacucacacaaacacacacauacauacucucacauacacacucacacucacacagucacacuuauacacucacccacacauacaaaccagagaaaggaacaagauaaaugaggagcggagugaaaagaugcuccaucauaaaccagaacucuuugggggacagcuugguuugggggucuagagcaaaggaagccaaguguucauguucuuguuuccugucuugaggaaguguucacaacccuggggcacugguaaaccagaccccagcucagggcaccuccguuuaugcuacuguuggccuacaguuuauaugucauuucaaauacugccucuucugcugggcuggcaggagcccugcaauccuaugucccuuccucauaacaagcacuuggugaauuacaagcacgggccuggaucgcaucccuaguccaagugacauccucuggcaaguucugcuggccacggagcaugcuguuguucugagggaaccuuuuuaaaugucaccaacacaccuuuacagaugcugagcagaugaccagcaaaggcaugggcauaaagaugguucuagaagauucucggugucaacuucccuacuggggucccggagucagggggagacuggguugaagauacaagagauagcacauggauggcaccaauaccaccaccucaaagcacacaggagucugccccaccuaccacgcuccaccuaccacaaugcccucgccagaaaggaagagcgagggugggggcggggggcaucauaggaagagucccucuauacucagggguuaccacugaucuucacugucuggggauauuccagguacaauguggccuuccugggacucacauuagaguccccaggcagcuccugcagcuggccuuaccaacagaaacaggaagccaggccaaagccugggcugggcucuuccaggccgggagcucuaacagcugugaagggaauuauguucauuauguuaauggagacaaaaggacccgcugcaauugugaacuugggaccauucgcugggcucgggguccuggacugaaaaacagaggaaggaaagugagcauccaaaagcacagauuccucacucccgugcuacauggccggcuccuucgagcuuaugccguaguggcuucccugccgugaggcacuguaaccgagaccugugagccaaaauaaaucauuucccccuuaaacugcuucugucagaguguuuuaucacagcaaccggcagagaaacuaagacagaugguuugaccccaacacagggagcacaccugcaggggggaccucagcuguggggcagagaggcacccuaauucuggggagauuccuaccacguggcuuuucuuggcacucucccuggccuagcugaaucuguggcuuaagucuggcagggcacaguagaggaaggacaggaagccugcaacagcgccauggaguucucuagaauuuauguagucucuaccugugcuuucugcaauaacaaagauagcaggguguguccucucagggugagcccagugagaugcccuacaccagaagcacugagaccagcccuucagggcuacucaaucuggacuguagcagggucuccaucugaaaacuucacuguagcguccagccaagccagccugagaccacaagaacaccugcucagaagacaccuucugaccuaucaguggcgagugaguccacaacucuuccaacuccugagugaccugggaaggucucuucaccagcuggagcccaggaugucagacagucggguaucugcagacaggacaccucugaggauaaaaaaggccuuucuugcaagcacccuccaugaaagaagaucugagaucauccagcagaaagccuuggaggcuggggccucaggagggcuuaguuuguuacugucacccacgagucccacccgccccccaccucugccgaggcaggcagccaucacagguagaaaacagccacuucugugcacacagucaguccaaaaaggaccaccugcaggaugccacccuaaaccuggagaccccaguaauggaggcaggaggaaaaggagacacaugaaagugaggcggaguugaagggacacguaccagaucaucucucuccagcuaaagacacgaugaagacaugggguggggggcuacucauuuccuccaaacauucaaggcucaacagagacuagcacacaauaggucaagcagaugccugccuaaggaguguucugauuaugagugggcagauagauggggagagagagagaugaguaugugaaugugugagugugugaguguacguguguaugugagcauguguguacacagguaugugugcgugugaguuugugcaugugugucuguguauguguaugcaugugugugcacccaugugugcaugcauguguaccugaguguccaugugcacacaggugccagugagugugcuugagcauuuuacagugaggucugcacuuucaagggucucucacuguccaccuuguuaucuggggcagggucucucacugauucagcugguguggccagccagugaacuccaacacucuccccuccaucuuccagaaauggacuuucagguggcgugcagcuacaucuguucacauuugggcuggggaaccaaacacaagucuucaugaacauacaccaggcacuuuaccaacugagccgaacuucccagcccgcaagugucaguucuacaaaaguagcucauucaaaaauagucugcacgugaguaugugaucaacgugucaauauacuccggcacguaacacacaugcauaccacacacagaauucuccaggcacaugucacacaugcauaccacacacagaauucuccaggcauaugucacacaugcauaccacacacagaauucuccaggcacaugucacacauacauauugcacauaaaauuccuauggccuuuucauugccuaaaaaugugugccaaauucacaugagagacuacauaggaaaaacaacaacguaagcaaagucacauggcuagagccagcacagcaggaucccaacccaaagggucagagcguccagucuggagccugcuucauuccagcuccauuucugaggcccacaggaauggaacaccacagaccaagccugcugagcccucacaggacugaggccuuuccuucagcucuugagugaguuacugauggcuaccuacagucaggcauaaaaaaggggaaccuggggcggggagagcucagcacuuagagcgagugcuucuuauccgggccugaguucaguucccagcacccacccaggcagcuuaaccacuuguaaauuaagcucuagggaguccaacacccucuucuggccucccugggcccugcauuuacacacacacacacacacacacacacacacacauacacauaauguguaauuuaaaauacaucuugaaaaagagaugggagcagcacauagagaagcugcaggucagagagagaccgacccugcgucauagauaaguaaauguauguaugugugcauguaugugauguauguaugugugcauguauguggaugccaccuaaagaaugacccucaaaguuguucuguggccucuacaaauacacacuacauacacaucacacacucugcacagaugacauauacaugcaaacacacauauacacaccuaaacacacacauguaugcagauauauauaugcacauaaacacacauacaugcucauacaugcauacagauaugaguagacacacauacaaacauugaaaagugucauauauacauacauacauauauacauacacacauacauacaugcacacagagaauuuugagaagugucaauaguccaugcacucagaugaaacgugcagaagguggcaguaacccccaccccugauggcagcuggugaugcccugagggcagacaauggaccugggacauagcaacagcugggugauccaggggaaggaaaggcacucccccaggcacaggguggugucuuaggguuaccaaggcugugaugaaacaccaugacuaaaagcaacuugggaaggaaagggcuuauucagcuuacauguccacaccaccauucaucaucgaagaaggucagggcaggaacucaagcaggacaggaaccuggagguaggaacugaugcagaggccauggaaaugugcugcugacuggcuugcuccccagcccaaggauggcaccacccaccauggacugggccuucccccaucaaucauuaauuaagaaaaugccugaaagcuggauccuguggaggcauugccucuacugagguuucucccuucagauaccucuagcuuacguuuuaacuacccaagacagugggccuguggagaucuuacgaggcuugccucuguggaggugagggugcaguaagaggagacagggaggccaucaggacacccccccucggcucuccugcugugcccagugagacugucgccaugcugcgaggaccacuaggcuuacccacacagcagacaagacccucucagaagguccuggaauggcaaauguucaggcgcgccuagcagggccaggcgaaugaaaagaacaggggcuuagucucuccgcaucuguuccgcaagauacucuauccuauaauuuucuaaauuucuugacuuggaauaauaagaucagaggcuccaagcaggaaggcaguuuacacaucauuuagcuuguggugucugcaucagggcgcccucagguauccgaaaaaguguuccauuuucuuucucugggaaaagcaccgaaagucucugucacugagcagcucccagaaugcccugcucaccuuggaugcaccaaccuugagagacccaggcagacucuggugcaaagcucagaacugcucagcaccggugacccuucugcaugcccaucugugggaggcugaagucuuugugcgcacagauaagcauuggaggagccaggaugucaaacgcacaggguugucccuucaaagggaggaauacagaaccugcuauucacccagaaggcuggggguggauguggcuaacggccuggugacauuugcacugucugcauggccaaaaccagagcagauccucccacagacccuaaccaugagcuugucaaucccugaaccccaucuuuauggaugaugucacgugugcuuuacaaagcacuucgauguagucacuuccuaagcuuuauuguauacacuggguugaguuaauuaucaccaggauuaauuucaccaaauuauacugugcuuaaauaggccuaaaguaaacuacucgggguuuugaaccaacaccagcuacuuagucauguuaaacugaagcaacuucuugccucccucagauacuuacucugcuggccaugguggucccaaggacucaggugcugguuaaagggacucccacaucuauccaccucaggaagaggacgaugaucccaucuuugagaagacagccccuucuucaaacagccaggcuuuucagugaguggaguccugcccagacucccuggggaaggcaggucuuccugcuuuguuggguugucuuagagcagaggcaggacuugacuuacagaaaggccugccuuccuuagccauggcucaucuagcagggcaagcuggcacagaaaggaaaaaccaguucccaguccccagcucuugugggcgucgggauucccaggaaaagggagccugucaccagcuccuucacagcugacugcaccccaacccccucaggccuggagcuguuuauagcuucacacccuaaacacagacuguuauuuuggguuuugcaugccuggcccaaggcucagcuucaauucaaauucccacauaugccacuuucagcagguaccaagaccccacgugugcguacgcugccucuggguggguuuugaacugccagggcuggaccagugcccagaacccaggccuuggcuuuggccgccucugcccacuccuugccugcucaaugccacuggcucagcggggccagucaccuggguggagcagccucucgcgaugcgggacccacacgaccaggcuauuuuaagaacaguauuuuaggaagagcaucguggcuggguuucaacuaucaagaucacagccaagccuccuugccccugacuuuggaggagguuucagccacuauuuguccuuugggcuugaaagaacagucucgaggaggcagagaggagagauccaggggauccuacacgcccuggagaccugcagaggugccuugggucccuaagcauccagcacccacucaaagcuagcacauuaggaacugcccacagcugugaguagaaagugguacccaaggaccgaccccccaccuccaccccacaguccuugcagucaugagcaggacaccucugagcugugccucuuucaccugcgcccugaggauucucaggcccacuguaugcagucacuauuacaugaacaaggcagagcccuaaauccaucccacccugcagacagacagcccuucacaggggucagagaguaccucugagaugacagcagggccggccaucaaaugaggggacaguguucccucuccacugagccgugccccugugguaguucaucuucagugugaacuagguaggaaggaccuagaauccccaaagagaugguucucugguuugugguugguuaucucgauucaguucacugaggugggaagaugaccuaccucaaagaugagcagcgccuaucccauaggcuagagucccacacugcauaaaaaggaagaaagccagagagcagcagcaugaucccugaucccugacuguagacguagugagaccaucugccucaugguccagccaccaagacuuucccacaauaggucaguaccaucccucacacucaagcccaaacaaaaccuuucucauuucugaucauuugccaagucuuuucucucagcaacaaguaaccaguguaaccccucaugacacacccaggccuggggacguggccuucaccauagugucuccucugccaucuccacacccuugaccuguaaccaccaacacccaacaccaucuucugccuugaaaacccucacccaaccucacagcagaaaaacaaacaccucaacucaaacacaggcaaagggcugaaauacgcaucucuucaaagauguacaguggccgagaugcucguaaaaaucuacucaguauaauuaggcaguccaacaagugcaaaucaaagucacaaugagauccacuucaugcuaauuaggguggcuauuuuuuaaagggaagauagagaauaacaaguguuggcaaagaugugggggaaucagaagccucgugcacugcucgugggcauggcaaacauuguagccaugguggaaagcgaucuggcugcuccuugaguaaauaaauauagaauugcugugugugccaacaauuccacuuccagguuuagccacacaauagcuugaugcugggacuugcacagauauugauccaacagucuucaaaguggcauuguuaauaaaagccaaaggguggaaacaaaucgggugcugugugcuuauacacagauggguagaaaaaugaaaaauagugugugugugugugugugugugugugugugugugagcguguguguguguacauauaugugaaaguaugugugagugugugugaguucaugugugaguguguaggugugugugugcaugugugugaguuguguauguguguaugugugugcacguaugugugaguucauuugugaaugugaguauguguguguaugugaguaugugagcauaugugagugugugugugaaugugugugagugugugugcauguguaugcacaugugugugagugcaugugggagugugugggaguauuguguguguauguaugugugugaguguguaagcaugugugugaguguguguaggaguaugugcauguguguguaugugugugacuguauaagcauguguguucauauaagugugugcaugugagcaugugugugaauaugugagugugaguauaugcaaguguguaugugaaugugugugucugugugaguacauguguguguacaugugaguaugugaguaugugagugugagagugucugugugaauguaugagcgugugaguuugugugugugugugugcgcgcgcgugcgcgugcgcgcgcacgcacacauaugugauuacaugaaauauauauaagaauagcaagugugagugacaauggacaggaucugcccaaccugcaacagguccaagaggaagucagugccacccgagcagaaggcauggaaagccaacaggaacggaagucagugaguccuggagggcgagagccuggcaagacugcagaaggauuuugcccuugacucccugugauaugggagccuaagaaggaaggcucacagcagcagagcagucuggccugaccuucauccuagcagaaugccuguggcagccgaguggagacaagguugaagaaggcugaaggcaggaauccagagcccaagacagaggggucucagugaccaggcccacuaagugauaccaagugggaggcaagugugcccagaagcagagcccacagggucagugggcagacaugacagaagcacacaggcaucguuuggggcuucaaggcugagacacuagaaugauaagcaugguugugaugcuaaucuuuguugucaacuugacugcaucuggaauuaacuaaaacccaaauggcuggguacaccccagaggaauuuuuucuuaaugaaacaauuugaggugggaagacccgcuucuacucugcacaccuucugcuuguaccccacauaaaagacgaggucucagaagaaggaccuccuuuggccugcucguucuugcucucccuucacuggcauuacagccugcuucuucaggaugcuggcauagacugagacucacagacuacuggagucuugggccucuguugggguguguguguguguguguguguguguguguguauacacuuauaugcauguacauauauauguauauauauauacauauacauauauauguauguacauauacguauauguuuguauacauauauauauauaaaacguuuguauguguugaauccuaacuaauacaaugguguuaacugggaaggaucauaguaucccgugugaggauuacgggcgcucagauccuggguaagagggacaaauguugacaccagugacuuuggaguucagaagaggagccaggcugcagacaccaaacaggauguuaaacagagagacugggaaaccaacagaaggaaagaaagggcagagagccaccacccuccugacuuacaggaaggaaggagcaggccgagggaacaggaagagaaagcacagcccaagagggcaaaggaaucuaccaaaaguaggaaugagguguggcagccagcaucaacaugggguagagguaagaccgggcaagcacggcuggcaagagaugcagaaggagccagcccugugcuugguaccacggagggcauagccuugggaagaaggcuuuagcggcaugcuaaggggcaugugcuggaguguacugcauccagaaaucaugccuccaggcugccugagcacgacuauaccuggaggcaggcucuugugugucacugcccugggagcagagaaucucuggucauuuccagguugugucuguuuagagaaagccaagaggccuuucugcaaacagccugccugcuuccuaguacccauuagcuuagguguuuggcaaaaggacuuagaaguuggaaaggccuaaguguaaaucagagcucuagggccaaccaguguugcguagcugcugcuucacacaagcucauguucaugagcugucagaaucagguauggauagaccaucauggggguaggaccaggcacagcacaggugcuuggauaggcugguggcaguauuugcuggcccgcuaucagcugucuuccuuccuguccgauaacuccauuucuuacagcuguguguacccagccucuugacuacugucuacacugcugggcugugcaucuuggaacccucuguacugcucugggugcucacaauccagugugugauuugauucacugacuccugacugguuacuucagaaggcacugcacagaccauggcugcugaggguccuugccuugcaguugggucugugugggcuagucugguuucgauugcucugcucgcugcucggaacucugcacacacucucguguccuagauacguccuguccugcuagcuccuuccugcgucuagcaccuuccuugccuucucugccacucucuauucugaaggcagaggacucuguauggacaccccuccauacucagaauacaggacggucucuugucacuauacaggauggucccuugucacuauucaagccuccagcuaacuugucacgucugagcacucuauuuaaaauaagccccuccccaguuuccugcuuuuuuauuuucuucgggguuuuuuaucaugguuucucuguguagcccuggcuguccuggaacucacuuuguagaccaggcuggccucgaacucagaaauccaccugccucugccucccaagugcuaggauuaaaggcaugcgccaucacugcccggcaguuuauaacuauuuuauucuguguucugaagugcucuggauaucacaccuaucucuccagucuuccaaacccccaauaaagaccccaauaccaugccccaucucuccagagucuuccaagcuuuuacagccuggggaugacaagcuauagguggaucccgaucuucccaccuacugucuguuucuuacuugccucccucacaaacucuuuccucauuccucauggauccuaauguaguucaugugcugccagagaggcccugagagccugcugcuucuauaguucaggcugccaaccuccugugacauucccagccagcccaggggccugcccauucacgguucccagucccacauaaggaugugugaauaaagucacacaaggaguaugaauaaggucacacuccguauuccuuuccucuaagcuuaccacucuuugucuacccucccucccucucucccucccucccugccucccucuccucuugucccccucuuugggucccagccuccaaccuuucuguugcugugauaaaaauuaucugaccaaaaacaauguaaaagaggaaaggguuugauuggcucacacuuguaguuaccaugcaggggagcuaacaggaauccaagcagcuaguggcaucauacccgcggccaagaacaaagagaaauugcuggacucauguugccugcuagauuucucuugcccuauaugaaucagggccuugccuagggaauggugccacccacacugggccgggucuuccuacaucaauuaauaaucaaaagaaccccccauagacaucccaaaccaaccuggucuacccaaaaccuccuuuaggcucucuucuuaggugacuccagauuguggcaaguugacauuuaaagcugucauaccucgccucuacccuccauccucuggaucuccugucaacacaccaccaugcuaugacuuucucaccucaaaaaucucucccucgaccccaguccucuccaaccucaucacuccuuuccuacaauaaucuucgccgcggcaaagcauaagcucugucuagauccaaguggguuucacgccgccuggggcgcggguacagugcgguugucacuugacccucaagcugucuggagcucuugaagcaugaacacccccaccccuucccagcccccugugaggcugcagcugacaaucuccagcagccgccccggcacagcgcacugcagaggaauugcccgcagcacagaugguagagaugaaaagggggcagaacagccagguggcugaagggggcccugaggcccagggauacagccagggccgcagagcuagaccugggcccuggagacacagcccuggaagggcucagacacaggugucugcccugcccauccucagcgugcagccuagggaggguuugucuccauuuccucuccaaagucccaggagcaucauaguccuagaccagcucccugaagcccccuguauccccacccugaagccucaggaguuccugguguaagcuugaacuguucugaggagcaaacagggcccagaaagggaagggucaggccaaggcccuccagcucccucccaucccugagccccugugagagcaggggucagaggguacgagaggcacugaguucuuccagugcuacucagccaggaggguggagcagcaucagagccucccagugcccuggccaggacaacugccauucccucuccagcaaggcuacaggaggccugaaaaggccuuuucuucccucggugacuuccccagccccaccccacccuuuaugcaaaggccgcucaaagcguaagaugaggucggacauuucauucgcuaaauaacucggcuaauuggggauucuuccagaaguaagcagaaagcucacucuuucuguacuuaauuauaggaaacaaucaucucaaauggauauuuuacuauuuguguuuauuggcaaucuagcugcuuucagagacauucauaaaggguccuaaggccuucuaaaaucugaauuaucaaguugaagucauuaacuuguaaaaacauccuccaguaugauaggucaccugauagaguccugcuuagaacucugcccccaccccgacgucccaaagaauaccacccacccacccggccuacccagccccuccacucccccuggaucuucaucugaggcagguaggcccuucucgcaggccacagagacgaagcacauacccagccugcuugcuccucaugccuggugucugccuaaugcccauuuaaagcaaccaaaaggccauaggaacuuauccugucagaccaaggugcaugcgcacagaccucacagcucaauucagggcucuuaguuuguucuacuuccugugaacucucucugcagugcccaccagugcuguguucccucugugggucugucagaaucucaacugaguacauuggagacccagaaaggagcgaaggucuccccucucccucagccccacagaguauccaccggccacucagccaaucccuccaaagcaacugcugcugaaagaaauucacaggcgaagcuaggaggucaugucuuccuggccggauccgccuccuuccagguacuuaguuuucugugcuaaucacagaguggaucucccucugggcuugcuaaagcuaggugcauaugggucagcacaaccacuggcaauugugacuaaagggccaugacuccagggcgggcagcaggcagaaugagcccgucucuggggggagaugggguguucucacauggaaggaggcagaugggaaggcacagggcagcacuugggucgggagaugugggagaggcaggagcaggcugccaugggcccuguucugaagagcccgagaagcaagacaccucaccaccugagagaugaagcaagaugugggggaggguuagagagcagaaggcagggggagucaaggagucuugaaagcaccugaaggagucgaagccaacuccugugagacugggggaucccccuagccccugggaggcaguccugaugcagggggaggacccugacuugggaggaugcccuuucauucucuggaaacucauuagggugggcuccucacacaggagcuugggucccuagcgacaccccuugcuuuccaccuacuuaauguucucacguuucuguuaggccugagcacuccuuacgggaugauuccaggagaggcucacacucugagccacaguugucaauguaggccuuuuggccaaacccuccccccaaguccccacccuguccaaccccagcaaggacucugcaaggccagccccuguagcauaucccacugagcccucaggguugaccuucuuucauucuaaauaaauaaauccccgccaaacuguagcccaccauccuccacucuugcccccucacuaccagccccagcccaaaagccuaugacagcgcuauucaaaucacuugugaguggccauuauuaacgcuguuuuuauucucugccuccacuggacggccucgcugaggaaguacaguuuaugaugggcuaccacaaaucuucucuggaaggcgagagaaaguaaaauccaaguaacuaaaugagcuaucaggaaacagcaaaagaacuucgcaaaauagcggccuugaugguuugguuuccggaaggagaggucaaggggaaaucacagcuugugaguggaguggaggcgaaggagggaggcuuguggcuccuuccacuggggacagaccccuauccucaaaggcugggauugggggacagaggagaagcuggcuacugaguggaaccaagagacagcucaggaaagccacgcagaaggaagcagcugcguccaccccagcuuccgucucagccaggccucagagcucagagcuaggagugucuccucugguacaccaucuuccucauaauuaaugagcagauucucugcaccugagccucaggugguucugaaguacgaacagggcuggauuuguucuauucuguuuuucaucagauaaacaacaaggggaauacagcccgcacccgccuuccguagcauuucuaggaugagugccacgaugcaguaaaauacugcuuuuuuuccuguacuuucuccuucucugugcuuuuuacauaaccuguaauaagcauuuauuaguuuauaauggaaaaaaucaaccucagucuuagaaaucucuuauccaaccagcucuuuuauccaggauuuuaaggacaauccauugcccaaggcacaacuaaaauuaaaccuggaaguuucucaaacccaaacaucucggcaggucuaugaagcaaaucccaaauuuucuucaagucgccucuaagcccagaaucagcuccuaucuuccuuuucccagcauuccaaacucagacuuaccguaacuccucauuauuccccagccucaaaguucccccaccacccaccccagcccuugacccugagcaguaucucccagaugccagcuccacaccagcuccucugagagcucugaccuucagccucuguguccgugggcuucuacaaaugacuguguuugucugaguguggaacccacaaggggggugaacuuacaggacucugaguguauacagugugguagggggugaacuuauaggacucugauuguauacaguguguagagcuuucacgggaaaacauuaccgucuccccaccucucucuuccuucuggaacuuccuucuucuccucuucucuuccuccauuuagaggucccugugugcagagccuuccauggcccuuucuagccuggccaguagccugccuauguacagaacuccccucaaagcccacauuugcugcuauauugcuuucuguaauuguucauauaguaaccaggcuucucucacacaccaagggaacucaggaaagcauugacaagccaaccuugcucacccauaauccucagacccuggcucagaggugccccauauuccagaaagaaguagaaaggaaaagcagagaaaggcagaaggaagagggagaggugggaggggaacuuccaugaauuauuuugcugaucagcucucgacuguuugcugcuaacgcuugggaccccagaggcaggcuccuucucauccgcaccaggagccuugugcaaguucucagacagggucagccauuagcaaacggggucucugucuagacugugugucagaauccaaccugauggcccaaaaaccugacuucagggugggugucuaaacagauaugugggaagcauccaccauggucccuuugcgugaagggaacaugggagcuggggacuucuacuuucucugcagcaugaguaccacguacacauaccacucccgaauacacacauacaaacauacacauaaugaaagauaauagaaauaaaucuucaggagaaaauaaagaacaucaagagauggcgccuaugauggugguacagcacccccuccuccuccccacauccccaucccccagccacuaccccacccccuccuccuccccacacccccaucccccagccacuacccccuccucucccccaucaaacacccauggcugcauugugaucugcauguaugcguuugaggugagguuucuguguaugccucauuucacaguaaaccaagaguuaaucgguaacauauucugaagagaacauucuagcaacaagaagggaccgcauaagcugauugauugggcaaguggguauuuuggaagucauucugaagugccugccucuccuuccuggacccaguucuccagcugaggcuccagcugccucacacacaaguucaagugcaauugaaaucaaaccccuacuuuugaaaaaauaccauaaaaaauaaacaaacaaacagcaaaaccccgcuagacugggucccuuugcuccuuggcaguuuuucucucuucaaagagacaguucuucaccacuaaccgaaugggggaaucuucauuuguaagaggauccaucuagaaaauaaugcaguguccaccauaauucccacuuccuaggcacgcugggcaauuuuuuauuucgaggaaagcaaggaaggucauuuucgguagcuagaugcguucuugugcccaaaucacuuccaaacagcuuacacugugaggcggaauuauacuucugagacacacugcauagccugacuccuuuggggagauaauuuucaaaauaaaaauaaugaugaugaauaaucucuuguuugacauauggugacagagcucacgucaccucucacgcugccuguuuguuccaagggaacaacaccgaugcuucugggaaucuagaaguuugugcuguaggcuucuuugacccagaacacggcuuugaucuugcuggugugugaaggucaacauucuucaugugugugcagugcaugggggagguguuuguuggacggggugcuuguuguggggcucuuuauaggggggggagguauuuguuaggggguguuuguuggaggaggaugggguguuuguugagggggaauagaugugguauuuguugggguggagggaggguuuguugggguggaggggggagggggguuguugggguggaggggguguuuguugggguggagggggguuguugggguggaggggguguuuguuuguuggggggcugugucuguggggccuaggaaugagcuuuguuucauuucuuagcacugucguauccguugcuuuucuguaugguguuuuaaucaaacaccauaagagaguuuauuugaguuuaugguuucagaggaccagaguccaugguggcggggaggaggcaacagguaggccuggagcugagcaggaagccaagagaucgcaucugaaccacaggcacaggcaaggaaagcaaguuagaaacaguaucaguccuuuaacucaaggcucaccccacccuccagagacacacugccuccaacagcaccaccaaggggaaaccuggcauuuaaaucuguaagccugggagggacauucucaaaccaccacagccauccaccuuggguaacugguuuugggugguugauguuguuguuguugugagacacuuucucucauuuuccuggaacucauugauugggcugaauugacuggccaaccagggauccauccaccugccucugucuccccagcaaggcuggaaccacaggcacuugccuggcuuuuuuaaauccuggguucugggauucaaacucagguuaucaugauuucaaccacacaucaaacucuuuuccaacuauaccaugugucaugguuuguauauguucagcccagggaguggcacuauuagaagguguggcccuguuaaggguagguguggccuuguuggaggaagugugucucuguagguguggccuuuaagacccucauccuagcugccuggaagucaguauucugcuagcagccuucagaugaagauggagaacucucagcuccuccugcaccaugccugccuggaugcugccaugcuccugccuugaugauaauggacugaaccucugaaccuuuaagccagccccaauuaaauguuguccuuaugagaguugccuuggucauggugucuauucacagcaggaaaaccuuaacuaaaacauuaucucucagccuaaaagucacuaccauuuaaaaaaaaaauuacacacacacauauauguauauauguguguguacauauauauauguguguguauauauacauacauauauauguguguauauauauauacauauauauauauacauauauauauacacacacauacggagagaaagagaaccuucugggcugguggcaaggcucaguggguaaaugccuuguuaucaagcaguggucaaagaaacuuaaggguucccacccacucaguuucaccauccuuguccacagugaaguccagacucuccucugucgaaaaccuggauuacugugauuggguuguggugucuuuaggggguggggccuaaggagaagucuauaggcuauguuggagcugugcaccucacaagagguuaaacauggcuccuccccacgcucugguuuccugucagcuaagugcucucucacuccuguucccugcuaugucacccauuuaugagguccucauuggagcccagcagacacugguacuauucucuugaaccuucagaccuacagcuaaauaaacccucuuugaagacuggggagauggcucaguaguuaaagugcuuaccacauaagugugaguaccagaacucaaguccccagaaccuaucuaaagggcagguggguguggcaaucugccuguaaguuucagugucuggaaagugaaaacggggguggggguggagcaaucccuggagcaagccaacucaccagaacagcugugucugcaagcuuugggcucaacugagacaugcugcucaauggauaauguggagaacagucaugauaccagcauugagcuuccacuugcgcacaugugcacacaagcccaugcacauguacacaugaggaccaacauaucaauaacauagacacaggucaaaagugggaagcauuuuaaaaaucauucagaaaacacuaauggugcaaaggugagaaacaagcauccauuugcuguggucccugccguggcugucaggaaacugcuaacuucagguuugcucugugaaacacugugggccaugggcuugaggagugccuggacagaagcuguggccccagaaucccacucagcuuuggcaaaagagagccauaacaaacuaucaccacccugcauucuggggagcacugggccucuggguugccaugaagcugcaaagucucugggcgguccuugugaacuaggugaagcccccugagcuagaagguggaacaggagagaaggcucaugagcugagccccugaacugacaaaggaugggauuccagagucuggccagaugugcaugcuacaggccccgcccccagcuccaacggguuuucucuuagugccuugaauaaaaacauagagaguugucucuugaaaucccacaaauagcaauugaaacagaccucagggguggguugugacagagugagccagcuaugcagaagucacggggugggaggcuacacuucuuuauggcagugugucccacgcuauuuuauuccagcacaguccacaccaguccauaggguggggcucagagucugucuguggguucacaaugucucccaacuggaacacaggugggugucggacagaaagagcgugggcucgucgggcauucacucaguugccuuaaccaaaaguagaaugagcagcuagagagauaagaauccccacuguggacacaggaacugaagggcagccuggaacgggagccuuccgguuucugucuccgcauguagcagauccucugccacaggccuccauacccaaauaccaccaggagagagcuggucucccaggagugucuacacaccugugagcacgcuaagaccaccacuucucuucaaauuucuggcccaagaaggauccucacagaaccaucaggacacaggaaccaaggaucaacuguggacaggauccuucugaucucugucugcacccuguaccacaccucuccauacccaaauuccucucagagagagcuggucucccuggaguacugacacacaggcuugcaggagggacaagccaacgucagagacagcaagaccagcuaacaccagagauaacuagauggugaaaggcaagugcaagaacauaaucaacagaaaccaaggauacuuggcaucaucagaacccaguucucccaccacagugaacccugguuuccccccaacacaccagaaaagcaagacuuugauuuaaaauuacaucucaugauaaugauagaggaauuuaagaaggacauaaauaacucccuuaaagaaauacaagagaacacagguuaaacagguagaagaccuuaaagaggaaacacaaaaaucccuuaaagaauuacaggaaaacacaaccaaacaggugaaggaaaugaaaaaaaaaaaacaccuaggauauaaaaaauggaaauagaaacaauaaagaaaucacaaagggaaacaacauuagagauagaaaaccuaggaaagagaucaagagucauagaugcaagcaucacccacagaauacaagagauagaagagagaaucucaggugcagaagauaccauaaaaaacauugacacaacaguaaaagaaaaugcaaaaggcaaaaagcuccuaacccaaaauauccaggaaauccagaacacaaugaaaagaccaaaccuaaggauacuagguauagaagagagugaagauucccaacuuaaagugccaguaaaucgccaaaauuauaaaagaaaacuucccuaaccuaaagaaagagauacccaugaacauacaagaagccuacagaacuccacauagauuggaccagaaaagaaauuccucccgacacauaauaauuaaaacaccaaacacauuaaacaaagaaagaauauuaaaagcaguaagggggaaaggccaaguaacauauaaagguuuggcaguuccucagaaaauuggacauaguacuaccugaggacucagcaauaccacuccugggcauauacccagaagacguuccaauauguaauaaggacacaugcuccccuauguucauagcagccuuauuuauaauagccaggagcuggaaagaacccagaugucccucaacauaggaauggauacagaaaaugugguacauuuacacaauggaguucuacucagcuauuaaaaauaaugauuuaugaaauucugcugguaacaucagcuccaagagauguggcgcccccuuuuggccucaaccagcaccugcacacaugugcacaccuacauacagacacccccuuauaugcauacauacacaggcuuagcacagcccuguuauauacaaaugcacacacacauaggcuuagcacagcccuguuucacacauacacacacacaggguuagugcagcccuguuguaacacacacacacacacacacacacacacacaccucauacauacuuacuucaaaaggaaaaugucaagaauagggaaggcagcaaagauuuugcuuucugccuagaucagaaacuauguauguggcugaguguucgguccugguuauuucaccucaaagugacuccaucguccaaaacgacucuggcuugugucaaaaggacauaaaaccauccagcaggacaccauuugaaaucaacagaaacaagaaccuccugacacgugaagugcuugaaaaaggcaggucaccgcgcagggugcugagcauucagauuucgacacguucgcacacgggcuaaagcugagagaagggacucagagguacugagcccggcagccguucucucaacaggggacaggggaaggggugaaggagacaaugaacaaagugauacauccugaccucauggaguccaggggucagcagucaccaagagggaagugcugaugaggaaggacuuguaaucagcuuuuuacagcacugucacuccaaagcaaugagagacacaacgaacagacucaaugugcgcaugcgccaaccaagagccugugaguuggucugcaucuccuaaaugcaccacuugugaccauguuuuagauaaucugagaggaagagggucugccggcucucaagucccuucugccuuguaagaaaaaaauaacggucguuucucaaaagggccagagggucuagagagauggcuccguggguaagcguaccagcugcguuugcagaagaccuggguuugguucccugcacccacccagcucacaggucucuguauuuaacgcccccuucuggccuccacaggaacugcaugcauauggugugcaagauacaacauaggcaagcugucacccauaaaauaaaaauacauaaauaaauaaauaaauaaauaaaauuuuaaagugccuugaaccagcuuauauccaggaagagaugaacuaauaaacuggaucccuccuagagucugcuagucuacacuccaaaauaguucaccauuaauauauauuauacuauacuauacuauaauaauauaagcuuaaaaauaagcagaauguaaaacaugcgcuaugauuuuuuuaaaaaauaccccgacaaaagcaacccaugacagaaguuuuauuucagcucauaguucgagauucaguccgugaugaggaagacacuucuaugcugcgccugcagagagcaggcaaggccggugcucugcucaucacccgagaauucaccuagucuggauaaccccucacaguuguccuugaggcuugcccaccagguaauacagaggcugccaaguggacaaucagucuagacuauggcgaccucucccuccacucgugggaacuacauuccaauugggcugauggcacuuuaaagggagcuggccagggugcaggaugacaauaucaagucaccuccaugaagacucucuaaguccucagaaagagcccaguggagggucuuggcccuccugcucccacagcccaggccuaugauccuuucagaguaacagcugcucacgguggcuucuaagcauuggcagagcugacaaacagagcugaaugcaaaggaaccaaguaccagccccagggaagggagcacccugggaauguggggguugccaagauccaggugggcacucugggcaggacgacauaaucacuucuuguaacggaaacugaggucccacuuuggaaguuggaguuucuagagauggauggugaggccagugcacuuaauaccacugaacuguacccuuaaaaugcuuaaacuggcaaguucuauguuguguauauuuuaucacaauauaagaauagggaaugagugaauaaauaaauacuugaauaauguuaugaauauaaagaucugagcauguucccugauacacagacauccaauaaaagaugacuuuauuaaaaauacaugagcgaaauaaacagagcuauaguguuauaauugauucauuuauaaauaugcacugaucggcuggugucugucagaugccucagcuaaaugcgcgagggacaucggagggcaggacagacacaaagcgccacuggcguagccccaacacuuaagcaggagcaagagaagacaaauaagacacagaauaagucagguggagcugagcgcucagagaaagggugugcgaaggaggucuacaggguguggaggaguuggguggcucagagacgccaaggagucaggcuccuuggauccaaggggcaccagauaacagauuguggggccgauagagagggacagguguggcacuugccaauacgcaagcugagcucuggccacugcugugggguggaagcugccagaugcacagacuuagcauauucuguuccuaaaagaagcauuugauagguagccgaaggguaauuuagugagcugaccaugggcugaggaaggaccucgcccaagaagcaucaagaaaggagcagacagagauucuuaaguuuuaaaggaaauuugggaaggagaauauuauucaaguuccuauaacaagaugagcauaaacaggcaggggcgggguaaagaggcagggggcagggugaguagucggggcgagcugaagagucaggggugggguaaagaggugaaggggggauaaauaggcaggggguggggugaguaggcagggggcaggggugaauacagaagggcaggggugaauaggaacugggcaggaugaacuaagaaccaguauuuaaagaaagguauaaagaccucaaacugaacaccaggcagcaugccaacagggauguaagacagagggguaguagaugcuucugaaaagagccuguaacucaagaagauagacucgucgugaaaagauaugagccuaagaacuuggccccagaaaaugcagaguaauaacuggccaagccacagaaagaaacugauaaaucaagagauuucuuuggagacuuuaacauaucccucucagaaauugauggcgcaugcacacaaaaacaaagaagaaagagaaaaacaaagaaaagagauuuauuacgguugggcugacaaaugccuagagaauuccccaagagauguugguaguuuugaguggggggaggggcuccaaucagcgucgaaggaucagcaucauacauaucauacauuugcaugacuagggcccuaacagaauuuaaaaugaagaacgauguugccgucauguuauuaaacuaccuucugaaaaccuacaucuguuccuagaucugugcugcucucagcuuuggucugagaagccucacucgggggcacguugugcucaugcagacucaaaacuugcccacgugcugaguaugaguaacugugagugcucagcuggggggucgcgucaacgacaccuccauagaacccccauccaagccucagggaucaccaugggucaggggaugggaagagugucggagccgaccaaaggggaggagcagcuaugucuaucuguauaggaucaagccagucaaacuuucagcaccggacggccacacccccugggcggagccaugggcaguugaggcuaccaaaggugaccacuggcagauuaccugcgccccaguggauagccccgcacccgugcgcauaauggaccacacuaacugaacucaaaaagaaucuuuuauugcugugguaaaacacuggccaagaacaaauugaggaagaaaaugaucauuuggcuuacauucuccaucacaagcugacugaggaaaauaaggcaggagccuagcagcaggaacuuaaacagagcccauauaggaaugucacucacuggcuuucucuccaagcucaaguucagcuagcuuucucauaccucccagaaccacgugcgggcuguggcaccaccgacagcagucugggccuuccuacaucggucauuaacuaagacaauaccccaggaagagacucacaggacaaucugugagguaacucccucggugcaaauccuuuccccaagucugucuagguuugugucaaguuaacaaaaaaugagaacagguggggggagaacagguuggagacggagggagagagguggggagacagagagggagagaggagaggaagggagggagggaagagggagaggaaaggggagaggaugggggaggggaaggaaaggggucaugaaauugaggggaagauggaaucugguugcugaaaucaggaaagggguuuagcaguggaugaauaucaccaaaauauguuguacaaauacaugaaauuuucaaagacuaaaaaaaauuauggggucuaggagaugacucgguagguaagagcacuuagcugcuccugcaauggacccaguuuccguucccagcacccacauggaggcucacaaccaccgguaacuccaguccugggggauccgaugcccucuuccagucucugcaggcaccaggcacaaaccugguacaggcacagaaaguaaaaacaaauaaaucuauuuaagauuucauuuuaaaugacuaucaaaaggguugcuugcuugcaaguucauuauaucugcaaacuaaaaccaucucguugauccacacuaaaggaaacauauaggucggcuagacucacagccagagucugaaccuacggacucaacagauauucacagacagaaaacacuugggggagaguugcugaauguguguggacaacuuuuuuuuucuuuaaucauucucugaacaaugcacaguguuuaacagcauugcucccggacuacaggagucggcuagcgccaucuaaaagucuggaugaggguccuguugguuauacccaaacucaccaccauucuaugaaggguuggaggauuugguaucuuugugguccuggaaccgacccuugcauggaugacaaagaaucauauuaggccacauuagagugcugugucaaaacuuaagggaugcaaagaacucuguuuccaacaacagaggaauaacucacauuggauugacucuucaacagccaacauucugguucuaaucgugugauugaaacagggucucaucccucccuuuguagcucaagcuggcccagagcuaacucuguagcucaagcugcccucaaacucauggcaauccuccugcuucagccucuugagugccagaauuauagucaugagccauaucauauggccaccucaacguauuuuucuuuuaauuugaaaacuccaaaaagagaccaaagcagaaagaagcaugugggauacaggaaggaagagaaggagggggagggguugggggagggggaggaaaggggaagggaggaggagaggaauaauggguuucuacauuuguugguuucuuaguguuuugucuguggcagguuccagugagugucacagugcagcaaacacuaagaaaacugcaaguccuuccucaagagucggagagcccggccuguggagcucacaccuaacuccagcacucaggaggcuacaaggucuacagcuccaguguaguggaagcuagagagugagucaaaggagaaagugggggauggagggacacaaagacagagaggaagagagacaagacagacaccuggugccaccugaauaagacaacccuggcaugcaaggcgaacagucuacacuguggauucugcucaaacaagaggccacuuauugagaacaaccagagucccaaaucuucaucucgugucagucaccggguccccaaaacaaucccaaauuauaauggauguaagcaggagaagagcccaugucacgagaaggguggggccauggaugcugacucugagaugacagaaacaucugucaccagcacgucccuucauucugaugauauggcuuguuggcuaggcuuuccuuagaacgagcaaaccaacuccucaggagucugagacccagccagcccuaaaucugucaccugccugaucucauuacccucaaggaggcuucaaccacuuuuauccuucucuuccccuucuucccaacaguguaccuagacuggcccaccuucccuccucauaggucccgcccacauucgagcaaccaaucaaaagccuuauccaagucccuccucuaugggaaaggcugucacagaucaucuuuacaaggacuguuguccaucucuuggucacacccuggcuaauugacaaucaguggcaauuugacgcaaugcugaaauuagaagagaaagauuuuaaaaacgagagcuggagagauggcucagucauuaggaacacuggcugcucuuccaaacgaccgagggaucaauuucuggcacccacaugggagcucacaacugucugugacuccaguuccauggaaucuaaugcccucuucugggguccuacaugcaggugguacacacaaacacauacacuugcguuaauaaaaugaacaauaaguauguuuuaaaagaaaacaaaggagucucugagaugaccccgacuaugauacacaggaaccuccuaucucaaaaaaagacaauuuaaaaaaauauauuaaaaguaagauacaaaaucaucaacaaauuauuuuauuugaaagaaauuaauucuuauuaacauaaguaaaaauuucuggggccagugaggugacugguggguaaauaucccugcugccaaaccugaggaccugaguucaauacccgaagcccacugggaaaggaggguauuggcucccacaauuuguccuguaaccuacacacacacacaugcacacacacauacacaugcacacacacauacacaugcacacacacacacaugcacacacacauacacaugcacacacacacauacguacaugcacauacacauacacacacacacacacacauacguacauguacauacacacauacacaugcauacacacacaugcacauacacacauacauacacacacacacacacacacacacauauauauauauauauauauacauauauauauauauauauauacaaagucuaaaaagaaacuugaaggaccaacuucaagauuuauuauaaaagccccagcaaucaagacagugagguagaaaugcuaauuuagaggcagucuauaaaauguuggguagacugaauacagcccagaaugcagacacccuuguauggucaguuuacuuuagacaaagguaccaaugccaaccaagggggaaaaaagaacaccuuuucaguaaacagugcugaacaaauaaauagacaucugaaaaaaagagaugcgggagacagcaagauggcucagggggaaagaugcucaccaccaaggcccaaaccugaguuccaucccagagacucacgggauaaagagaaaaaaaguucccccagguuggccucuggccucuauacacaugcgguggugugcaugugggugcacacacacauguagacacacaacacaagggaacagaaaguaccaaagcaaaggaagacacugucucccuccuugaaucagacacuaaaaguuagucacggauggagcuaaaacuagaaagccuccagaaaaauacacagugaaguguuuccacaccaagaaaggagaaagaccuaggaaaugagagccgucuagggggggcaagcgauaaaucaucccucagcaaaauuaaaaacuucugcucaggaaaagauuaacagcauaaaaaacgaaucugugggcugcauccuagaaggaacagccugaaaucagcaucgaagcacagucaggagcuacugugcacaggguacuccuacgagccaacggcaggagaaagcgagaggccuucacgagcaaagggcuggaaggaugugucgaugguuaagaagcacccaaaaaaagugcuuagucaucuuggaacuguacauugaagccacacugagauccaucacgaaccaucuagaaaugccagcauuaaagauggcgauaaauguuggcacaugcgcaggacagcuaggaucugcucagucuguugguggaaacagccaucccuugagggggaagucugagggggguguuuuauaucuuuuauucuuuuggggcugcacaugagcaacgguguacaugaggaaaugagaggccucagcgggggcacucaggccauccggcuuccaggcaagugccuucaccagacgaguacuccucuuggacucuggcagcuugcuugcuuucucuucuuuuaauaaaauaaaaauauaacaccuccaauucuuaggcacuuacccaaaagaaacaaaagcacguguccuucaaagagacuuguauaaaauauucccagucucuuuacuccuaacggcccuacacaggaaacauagcagaugccaaagagaggcugggagugagcgcagagccgcucacucacacaaugaaacaccacucagaaagggcagugacaacuuacaggaauccccgaagccugcgcagugaagccaucuccccucagagcacagagcacaugaauucauucguaugagguucaagaagaggcaaaggucccgcuggguagcuggcucaggagaugggcgaugcaccugcagcucagccaugaacacuggaguccugacccccaagagcccacggagaagccacaggagccuaaaagccucagcucugagggugcagaaacaggagauccccagggcuugcuggccguccaguccagcuacagugaugacuccaggccuaaugagagacccugccucaaauaauaaagugcagagaagaggaggauaccugaugucagccucugcccuccgggugugcacacaugggcaagcacgcccacccagcccccacacacauauaaaaaccaugcaaaagucagcuagaauaaaaacagucaaauacugacggccugguggugggcugacagggaaggcacuaaaagaacacucuggaauuguggaacuguucugugcaccaguuaauaugugacucgugagaucgugcaucuugguauagagaaauuuuaccaaaagagcaaauaaauaacucaugauaauacguggcaacauauuucaagauggugugccguuaucaucaguuaauauagcucggcgaauggauucgggauaaagcaauauagcaaugauggcggggcaguaccagggauugaaccuggagggccgcaugcgcaugcgcuaggcaagugcucucccacugagggcuaacauccuaccucagcaaaaugcuaagugagggagcuaugugaggccuuuagccugucucuacaucuggaauuuuucauuauaauacugaaggggaggaagaaaaauaaaugggacacggcuagagcuguguguagaggaacuucaacagcccgcauucaaugcgaaacaagguuuaaaaauaauccgcuaagcauuugugcuuuaaaaacuggcagcgacuucuucccgaacgaacgacgcucugcuuuuaucagggaaggaggagcugaggaucagacgggcuccugagcccugcacagacaaagucagccaaugguguagcacgguagcagaaguguagggugagccuucugucgccguccaccuccugucuggaguggcuccagacgucauucugggcuuuauccuccccuuccccaguucugugucucuacaucucuuacacccaguucuaaggacaggaacagggucagugauucaaaacggaauaguagcuuucuguuguuguuguuguuuguuuguuuguuuguggucuugguuuuauuuuguuuuguugagauagagucucacuauguagucuuggcuggccuggaacucaccauguagaccaggcuggccacaaacucagagauccaccugccucagccuccugagugcugggaucaaaggcaugugccaccacugcccagcuuaaauaauguuuuuuguuuguuuguuuguuuguuuguuuguuacuucuagguaguaaaaaguuuaaaguuugccuuaguaguagcaaacaggcaauguagaccuuccagguuccagagccuuugaauuucccuucagagcaaacuugaauuuucccagcaagucacccuggggagacagcucuuggugaacggcgagggcauccaccagaugaagaggcuacugucuugcuuagaagcagcaacuuggcagauaccuugagcccuggguucucauaaaucuuguuugagaggaggaagagagagagagagagagagagagagagagagagagagagagagagagagagagacccuuucaauucccacuggaaauaugcaaagcagccuccacacgguaaaucuuccuuuucaguccuaaggagauaacucagaccuauuaaccuuccauguuauuuucaacuucauuauuugagcugacacgacaagagaccggugacggcucuuucuggcagagugcauguaaaucgcuuucucuaaggaaauuacuucucuggccugaauguuauuaaucuaaauucucccuuagucaaauuguugcccauaauaaauauggaacagguuaggauacucagggaguguggcgcaacuuggcagaggccggacccacugcuaacauguccccucaaggagaggcauggccuccgaugguuccugucucagacccccgagggugagguugcccgagacggcuccugacccugcucccaccuuccucucuaagcaccgucagucuguccuguccacuccaucuucaauauccuggucaaagccugcuaauggccuccccucuagggacaacuugccaaggaagcuuguggucuugaggcaccacauagaauuugcucugcccaaauguucuacccagcucuucaaaaucagggccuccucagccucucuaggagucaggcagauucuucauuggcugcuccugaggcucuggguuaaaugcaucuugauaccgaucggccgggggaggggagcugaucucaauugucaauuugacuggaucuggaaucagcagagagacacagcucuggacuuccauccuggauggaagggcagcagcaauccuggcuucuugcaggccuucagcaccaguugggacuauggagacaugcagcaucaugguccacacagcugcuggguaccaaucuuuccagcaccccucucuccagcaugugcacacccaucagggaucuacccagcaugcaucauguaaggcagcugcauuggcugguuuugaugucagucugaacgagcuagaguggucugagaggagggaacaucaauuaagaaaauaccuccauaagacugggccgcaggcaagccugggggacauuuucuuaguuagugauugguguaggggaucccagcuccccguaggcagugcuaccccugggcagguaucccuaggugcuauaagaaagcaggcugagcaauccauaagagcaagccaguaagcagcacccuccauggccucugccucagcuccugccuccagguuccuguccugcuugaguugaugacaaacagcaauuucgaagugugagccagaaaaaacaaacaaacaaacaaacaaacaaacaaacaaacaaaaccuuuccuccccaauuugcuuuuuggucaugguauuucauggcagcaauagcgacccuaagacaccaaucaaauuaaucucccuuuuuauacauucauucuaucaguucuguuccucuagagaacuguggcuaauauaccacuuaaaagcccauccuaggccaggagagauggaucagcaguuaaguguguggacugcucuugcagagguccugaguucaguucccaggacucaccuuagguggcucacaaccaccuguaacucuagcugcagggcaaccagcacccccuucuggccucuaggggcacugcacuuguauaugcguaaccacauauaggcacacauauauacgacauuuagacguuuaaaaauuaaaaugcaacacaguuucuaaagagucauuuuguuuauuaccuaagucuuuacaaacaucuccaucuucacaaccugaggaggaggguagagguugcuagcucgauucuguguggcccaauccuaccuguuguauggggcacuuagaacucaucuccaaagaugcucauuucugacaaggcagcccaaaagauggaggaaacugcuugccaugaugcaggggguggcggagcauggaaagcuuuuuuuguuucuacugggguucuuuccaggguaauuacaagaaguugagaaucuauuuggggacuuguagcucauuaaaugaguuuccaucuguguacccaccaccuaagaaguauugcuuuguacaauuccccggcuuuauuguguggaagucaaucuacagcguacaccacugaaaggauguuucaauagcuccugauuaugcagaauggagucgggcuuucgucaggccugccuccugcgcucccuaacccuugacggggugccaggaugcuggggggggggggcugcaaaacuccagcuuccagaauacccugggccuuuugcuccccaguagccuggguggcugcucccucuucaucccugcagagcucgacgcucacugagagaaccccaacuggaggauucaccaaugagauuccaagcaugucuuagguugaucgauuuuauuuaagggcuaauguucccagggaggagggggaacggggugggggggagcucccacugcuggcaaaacgccgguguuagccugagcccccugagcuacagaagaccaaagcacagaagccacucugggcugcacggcauggaaguaaguggcugaagaacggagucccuucgccauguucccucucucuucuccagggaagguaccacagagacucaugugccuuccuuccuaaacuccaucagaaaccucucugccggcagccaguuccuaaauccuuaccaaaggauuuuccugucucugucuaccaagacuuucccaagauucugucaauuuuaacuauggcccugccaugcaggagacagaaggcugcaucacuaucacucugugacuaggaggcagaauguaucaaaugaucaccggugaguuugaggaacaccacaugccuugagcaccuccaaucccuaaaugggaaaaucuuugcagagaccacccugccaaggaaguggugacaauaccugcagguaacaacgugggaaacaugggggccuucggaaagcauccaggagugaccucucuaaaagauagugugcacaggggccagggagaugguucaggugguaagcaucugucacccaagcaggaggaccugaguuugacccucagcacacauaaaaaagccgugugaggagcacacaucugcaguccucgccucaguaggguagagacagguggaucucugcagcccccuugccacgcgaucuagcaaaccagugagcuccagguucggugagagacucuggcucaaaaauuaagguggagagcaacuaaagauaaugcccuacacgauauucacaugcgcuugcacgcacacacacacacacacacacacacacagaucauguacauacauacacacacaaauaauaauaaugugcagaguuuuaagcauuuccagaauguuccaccauuccugaaggaaagaaaucagccugagaagaguuaacccucccagucagagaguagaagaugaaacucuugcccgagcacagagguacccagagcauccggagcauaauaaauccacgcaugcagaaggccucucuccucauuuguuagucagcggugugugaaaauguuaaugaagggagcuauaaucuaugagaauuccacuauuaaaauguaguucacgucugaaggcgucugcuuacacacagccuacugcucaucaauccucccugggcauugcuaauaauagacguaauugccucgcuccgucuagccaccuucaccccgcgauucuaagauuugcuacaacugcuauuguagaaauuauucucaugcuauuaacuuugagcuuuauuauauguguucuuaaaagaaaauaaaugcauagagauuguaaauguguaucagguuccuggugaaaguauuuuuuuuuaauauaacacacugacaaaggcaccaggauaggugauuuaacaguccucuucccucacucaagccuaaauuagauggcgcagguuuucguucuccuuaggagaaaauuucuacucugagaacagcagcagguugccuguugcaaaaagagaguugggaagaagcccgugaggugggugcugugcacacagcucaggugggggcuccuccucacagugguccuuuccuccuugcacagacccucuugcuuuacagauggccuucuccuucucagccagugcuccccuucucagcgaguccucucaggaaguccucccuuuaucguaagcccuccugcuucacagugggcccucucucccccauucgugagucugcccucuucacagugacucccaaagucuucgcagugacccucacucacuauguaccacagcgguaugccugagcagcucauggccugacccacagccacagaagacuccagacucuuucacagugcgaauaaucucuccaggcugaugaacugguguguaaggaucaggaagagguggaaggagaaagggagaaaggaggacaggugccucugcccugagcccacaggcucaccuuucugcgggcaggcacugguacagccgcaguucaggggaggggagagaaggggaggggcagaagauguggaacucggucuuagaaacccacuuuuggauauguucuaugagcgugaaucaagacaguccagguaggaaguaugucuuggaaugcaacacacacauagacacaaacaagcacauguacacauacacacacacacaugcauagauacacacauuugccuaacacaugcauacacacacauacacauagacacacauauguauagacacacauauauacauaugcauacacacccauucacacacacaaucccucacagacacaaagauacauauacacccauacagauacacacauacacacaugcauagauacacauacacacacccauucauacacacauacacucacucacauagacacauauacaucuguacagacacaaggacauauacacagagacugacacaugcacauacccacaaagacacccacauacacucacguagacacauagacauacucaccugcacgcacucacaacacacauacacacacaggcauagagacacacacacucacauucuuucuggaacuaaaggggagaguaccacaggauagaaagcuuauaacccuguucguaugcaggaggguuuggagagcaaaccauccagaguagcaugggguggggcugaaggcuggggcggcagcucaagagcagaaagguggaguguuugccaugcaugugggaggaccugugugagugagcccagcacccacgcuaacaaguccacaguggugacccugcaucccuggggcucccuggccagccagccugacucauuuggugaguuucaggccagggagagauccugccucaaaaaacagggugggcagcaccugaggaaaaacaccugagauugucuucuggucuccacacucacacaugcaugugcaugcauacaaacacacgugcgcacaccacacaugcauaagcauguagauguauacacacauggacacccaugcaugcaugcacagacacacacagagacacagucacacacacacacacacacacacacacacacacacaugcucaaggaagagaacaacaaauaaaccuuagaaacugaccagaaggccuguaaccugaagagcugaagcccacugcccacaguagugaugagucagcuccuuccaccuuccaggggugcggacgaggucccccuucacuugccaaccaaugucccaguuacccuggagcagggugggagagggcaaccauugccuagcagcagccuccagguugcccaucaccuuuagcccacaugccacucccugggaguauuuagggaaguccgugcccaggggaggcuacacacugugcacccacgugcucagcagcauuuucucagaagugcucugugggcucaugguacaacucaguccagcagcagcgggcagggucaaggagcucagcuucugacccugaggccaucggacuguguaagucuuuaaaacuuguaacuguguuuauuuggaaacacaauaaaauagaucaugugcuaucggggaaacuaugcauuauagacaugucuaaggaaaggcgcacaagacuguagggaggauguggccauggaaaagcacgcagacaaaagaguagaaacuggguaaaugaggcagcugcugccgguuucaucguuugaacauaucucaucagagaaacugcacuagacacgccuuuaucuuugauuuaaaauucuaaacaauaauaaauaaauuuaaaauaaaguggaaugcagagguuuagauuuucuggugaauggagagagcccccaucguguccaguguuugaccacacggccccaguugguagcaagugauggagugaugggaggcuuuguggaagcaaaucugucccuggggacaggcucugggaguuuauagccucagcccauuugaauuugcucagugauuuguguuugaggguggacauggggugcucagcuuccugcuccuggcaccaugcucucaaggucacugcugagccucccugugucugcggacucucaucccuguggagccgugagcccaaauaaacucacguguucuucuggucgcuguguuuaucacaagggaaagguaacuaacugagggauguguugugaugguccagaguuguuuguuucagacagguagcacaggcugagcugggacccucaauccuccugccuccaccuuuccaacugaugggacucacaggacugugccacuaugucuacacagaauccaauuuuccccauaaauuuggccccuugaguauaugugugucugcauauacccccaaaaggcucaggugaggaagccauauaccuagggacagcagcuccacucucagcaccuaugugcuggggcuugcuguacaaccuagaggaagucccucugggcccucaacuuccaagaaaacaccucacagaccugcccacccccauaguggcauacuuucuccaacaaggccacaccuccuaauagugucacuuccugggccaaguauauucaaaccaccacagcccauuuggggugggcaggucugugagguguuuucuugauuagugauugauguagugggcuguggugguuuggauauacuuggcccaggaaguggcacuauuaggagguguggccuuguuggagaaaguaugccacuaugggggugggcaaugagacuuuccuucuaaccacgugggagccagucugccacuggcugccuugggaacaagagguggaacucucagcuccuccagccccauaucugccuggaugcugccaugcucccaccuugaugauaauggaggacccucugaaccuguaagacagucccaauuaaauguccuuauaagaguugccuuggucauggcgucuguucacagcaguaaagcccuaacuaagauaaguguccagcccauugugaauggugcugcccuugggcagggucauguaaggcagggucaucuaagaaagcaggcugagcaauccaugaggauugagccaguaaguacuguuccucuauggccucugucucaguuccugccuccugguuuccuccauccuuccuugaacuccugcucugacuucccuugaugacagauuggaaagaagucaucugagcuaaccaauccuuucuuccccggguggcuuuuauucauggucuuucucacagcaacagaaacccaauuaacuaacacaucuaccguaggccuggaaggggcuuccuucugcccuggccugugcuucacagcagcccucaggagcuggggacuuuaguagguuagcacccccagggggcuuuucugagguugcucuucugaaagagaaaagccggugccaugguggguuauaaaggucucacugacagagaaaaggauucgaggacaagcucuucucugucacacaauagaagcacccagcuuuccucucauccugccccaugaccugaggaaccagagcccuaggagggccacagcaagcaagagaaucacagagaaggaacaucgaagugucacgcacguuggggauccucuccaaaugcacagcaccccagcuuccgcuguauuuaauuuucucuuaauuuggggcaugcaagcacuauccuaaguguuuuagggagccaguaauggcccuucacuaaaauaauucaaccaucacuauaauuucagugccaccaucaaaaugaaauaauggcuguuuaccgcgucacaccuuucaaaugaccuucauuugaauacaaauuguggcuugaaauucuaaaggcugcucagguuccagaaggcugcaaagaucagcucaggaagggcugcucuuccagagccuccucccagcacgugaaauggcccucuucccccagagcugauggagagccauuuagcaccugagugcagaacgcaauggcccugacccugcacaacauggaacaggagcuggaggaggcugccaggaagcagcugagggaagccggaccugggggcagugcugguacugaugcuggacggacuuccucuggcgggcaagagcagaggcagcaguccaugaucggucuccagggccaucucuuagcuacguuccccccaccccacuccaccccaccccaccccuaggaucauccuagccugcucccugcuuaaccuugucaucucccuguucucugagauuuccccuccaggcacacuaacagccagagccucagccucagccucagccucagccucagccucagccucagccucagccucagccuccucuguccuuuuggagccacucagcaccccagucugccacuccgccagguguaagaggucgaaggccuccuggcugguccauuguuuucucagcaaauguuccaucagcauuuaccaggagcggccggauggaaaggacucauuucucuuacaucugucucagacaccccagcuuugagugugugugugagcaugcaugcgugugcgcguguuuuauuuaguucagggagaggagagugcauggauguuggaggaugauuucaagugucgucccuuaggcacccaccguucauuauucuuccuuggcccagaacuuugcaaagcaggccaggccagcugccugcgggcucccgagauccuucugucuuccuuucaccagggcugggauuauaagcaggggccacacacccagccuuuugugugaguccuggggcucgaacuuggguccucaugauaacaagacaaguucuuuacagacugaggcaucuccccaguccaggcauaugaaucagccccuaaauaaauaccugucgcauugaaaugucaucucugggacuucccagccccaccacagagccacgcuuucuuaucuaaagcaggaucucugacuuuuaucgcaaaauggaagcugaccgagaacccaggccuggccacuauuuauuuauuuauuuauuuggcaacggagguaaggacucgcugccuguagccuugguuuucacaucuguaaaggagcaauaaugauaccaaccaccuagcaagccaccaggaugagugacugccuccgcacacacuuaaaagcucaacccaguaaguaccaucaccaacaugaaccagcuggugccacagcaacacaagcacguacaguguguccgauuuguuaugaacacacauccacugccaccaucuugccuuccagccuguucucaauaacagcacacacucacacccacaugccaccaucuuccucucacccggcacgccccgcccccggccuggcuugggucuagaauguucucuaucuucucugccccacuggcccaccugcccugggauauucuccucuaagaggcuccuuagugcucggugcucacacaagcaucccgccugcucccaaggacgacuguucaguuaucuacucucagaguuggauugcucucggcaggaguucucauugccuggaaccucacuccggaguuugaaagccaacugaauucacggacgacgauaagugaagcuuccucucccuccuaucagacaccagcagacccuaccccaggaccccaggcuggaugcgcgcgcagguuugcccuggcuucugcugacuaaucucccucugccccugacugagaccuucuuuccccuucaugaagaacaggaaacacccacaggccuccccugugccucugccugccuccucucccuccaccuaaguccccaagcugacaaggcaggucaucagcugugugugcucgaucggcucccaucucuaucaguaaagugucacaggacccuagagggggcagcaugggccacaauguggauguccauaaagcaccaugaaaggcuggccgcagagauucucacuccagcuacgugagguguccagaggaggcagauccacgggcacagauaguagugguuacuggagcuucggggagucuaagagggcugagaguagagacagcugaaaacagugaguuucuuuuggggacacugguggcugcggacuccgggauacacgaaaggccacugagucacacacuaaaagaggaccgguuguuccgggguguaaguaacacccccauaaagcuguugauacucuuugagcaggcuccaauccccuuccucuccacccacaaccacacccgacggaccugaggucacuccacccacccgagagcaccugcccuacaaggcucauugcccgaguucauugauucguccuucuugcguucaacaaaccacagcuguacgucucccuggaauucaggaguuaugggcacucacaccuugcuccccaggggccucagccugaugacagacagacagcaguggcagcaggaagcaagcccaagguccugcagagggcaccaaugagaacugucugucccacucugcugguucugagcgugucacuccaccucucaggauaacucuuaucaagaaccccaaggcucacacaugguggccagaaagaaugguguggcccucagaaggccuggaaucuguucccaguggguacggcuggcugagguagcccauccauggccccaguccuccccagugggauccuccacagaaggguccuccucccagacaaguguuccccaaggaagacucucuccaaagaaguuucaugcaacagggucccccauaccagcauccucccccaggaguccucccccaguggaguccucccccaguggaguccucccccaggaguccucccccaguguugucucccccagcaagcuccuucccaagaggggucucccccuggaaagcagaggggcaagucuuucucagaaacaccugaugcagggcacuucgugaggauguaaguuggcaugauaaccugucaaaguuccaagugccuuguagacucuccugaagugggaaaaggcuaggauugagaccguaggugagugguagagaacuuguuucacaugcaugaggcuguagguucaaacccucguucuaccaaaaaaaaaaguggggaagaagacaaaaucuggaucccucccccucucucauuuguuccagcaaaagcucagguggaugaaugauuugauuaacauuuuuuugcccuuacuagaguaagcuguuuggcugcccugaaggaaugccccuugguagucucuaagcugacccuggugaaguggaaacguaagucaguuaugucaaaugauggucugcuggggcacacagguggaaggaugucuugcuaaaacaaacacgugagggaauguuuuccugaagcagacacaggugaaaggauguuuggauauagcaaacacuugaaggaguauaaauaugaccccacagacagugggagaugaguguugagccuugguuugguuugcuggaccucgccguucuucacuaacaacacgcguguauugguucaccuuacauaguguuguugagcucaacguguggaaaugcugcaauugagagaaacucgcccaagaacugcuugugaagucccuguggcagcuuucggauuccacagccucggcucaggccaguuggugagccuuggggucucuucaggauugaccuacagcugcuggguggugccuggugucugcuugcggaaagacugggcuguagcuacugagcuguauuugguguuugcuacuuggacuaaacugcugccaaagaagaucaagcuugcugaacagguccacucccccccucccuguauccuaauaacuuuccuuuuccgcuaucucugcuggguggcaggcuagaggagagguugaacccuuauuaaauggagguggcaaaaacauguaugccuacauugaaggauaaguguuugcucacaggaaaagcugguguugcaguacagguuucucugugaucuggggaugcauguagcccccagauugaucaaccucagcaacaccaagaaaugcuucaaaaggcauggagccagugaagacagguacccaugcuguggcucuugaccccugacccgugaccccugacccaugcuuccauggccaggugucaagccaccagaagggcuaucccagcaugagccgguguaguagcugcauguuggcaggacucucuguauguccagucccaagguucucacacaaugcaccuugagggaggagccccaggaacucucacuuugggaccuacucuaaugguggcgugugggcccuugaacuguauuuaauuagauugaaacaaagaaauguaaucuucccugcacucccggugccuuggaacaacuccaggcugacauuuagggggauucuccgaggugauuaauucauaucugccucagcagccacacgcaauuccuggacuuagcaacaacugacauuuuaauuuuuuuuuuuugagacaaugaccagagaacugugagagacugggcgcaucacuucuccaaagcugcuguugcuugggggaagccuggggaagaaaguaagggaugagucuuaaaggauuucagaaaaauguuucaaaacucugggaaagacaguaagcauaggagaggggauucugggaagagacaaauggcgugaacagaagagagugagacccacacugcaacugaaugaaaagcucuggguuguaucuguguguguucgugugcacacacaugccagugcauguaaacucccguguggaggcuagggguugacaucaugugucugucuguguucauauauacacacacaugcacacacacacauacacgugcacacgccaguccauguaaacucccauguggaggcuagggguugagagcaagugucuauguguucgugugcacacacacgcagguacaugugccauucuguguggaggcuaggggucaacaccauugucuuuuucacacucacuccauccuucugagacaggaucucucaccaguuacugggacugcugaccaggaagccccaaagguuggccugguucuccuucaccacugcuggauucucuaccaacugacuccuguccccaacccugagaaauguuuauaugcuguucauauucagccagcagcucagugucgugugcuggccaauuggacccuuaggagacagagcagaggacucggguucuguugccagcacccacauggcacccacauggcagcuuacaacuaucucuaacucugaugccaggagaucugauacccucuucuggucuccuugggcaccaggcaggcacaagguguauacacaugccuauguaaaacacuuauacaugcauacuuuuuuuuuuaauuagaaagaggaggagccaucaugucagaccuccagcagagggugcagggacaaagguagguagagggugcagcucuaggguaggugucuguggauggcaagaggacaaucucucugaauaaaagcacgaggaggggauggggccccacagaagauggaagagagaauccuaguuugauguggcccugagauggucccaagccacuauacugacguggauaucauggcugugacucucugucugagccuccguuuacuuagcugggcuccugugcagaaagccaguccuaaugccuggacagugcuccaggauguucuaccgugugauuaaguccauccucuucauugccuuccucugggcagccucccagccuuugaggcccaagaggauacaggcuugccucacaagaagugugaugggcagaggaacaggcgggcuggaggcagacaaccucaucuuucuacauuaucuccucacuucacagaaaccccuucgcccaggauggagccucacacgggaauuuuugacaucaaucccucagcuuaggaauugguugucuccacguacaggccacugugcaacgugccaccccauucaaaguuuauuuugcauuaaaucuccaagccagagacccucccauuggucugcauaaagcagaguuaugggucuaaguguuuuuaaaaauagaugcaaccccggaccccaagaaacugaagggacauuaugggaauacacagccacauugcuuuguuacuguaugaaaaauuggauucucucacuccaauuucccccuccugcucccggcuccucccucuccucguuccucaccugagucgcugugguaguuccuggcacaaagcacaagauauauuacagagcagagcagcccacgccaagcuccagggucccaagcugcuauguacguguuacugagagccaggcaagcuccuauccuccggaacauucacagagccugccauucuaggccggaugucaaaugagcuucgagcugcauuucagacguauuucaccacagggcuccuguuacagcgguccuggcacggguuguguaugagcacacgcauguauguacauauuugugugccacagagugaggacaaccucgggggucagucuucuucaaccaugggguucccagguaugggaccggggucacucaggcuugguggcaagcacauauuuacccacuuaacugucucaccagcccaagggaagcucuuuugagugauuagguucugaggugcgaaagcucucgugggccagccaccacggacauggcgucagcagcucaaguuuugacccaugccagccaccauaggaaugugcggaaguggcuccuccgugcucucaggccagaggacagaagucaccacagucagugaacuaagagugcuguguaucacagugacccuaagaggaaacugucucacuggaguacgagguucggaaacagagucaauacgaacaacggguuaggcuacaggucaucacauucccgagugaauuaaaguccuaaagucaaaagaggcgcugcuggagacugggauagcucagucuguaaaguguuugccuugcaagcgugagcaccugaguuugauccccagaacccacagacaaaggcaaggcauggggccgcagagcugguucagugagcaagagccuugcuacauuagcaugaggaucggaguucaaauccccgcacccaucuuagguguagcuaaugcaugccuucgccccggagccggguggaggagagaaagagggcaucacuggggcuuuuacugaacaccagcccagcuccagguuccuagagagaguccgucucgaaaguauaaggcagacacccaaugcccucucuggccuccggguguauacagguauacacaugaacacaaacccaaaauaaggaaacgaauuuaaaauaaaacagaaaagacaggacaugguaggcuacacuuaaaaccccagugcugaggacaugcagguugagagucccuggaacucaauguccaaucaucuuauuggugaguuccaggccagugagaggcauuuauaaggaugacggcugagguuguccgcuggccuacacacacacaugcacgcacacacacaaaaucauacacacacacucacgcacaugugcacauacacaugcauaaucacauacucauucacgcacauacuugcacaagcaugcacacacaaucacacacaugcauacauacaugcacaugcacacacauggcuaaucacacagccaccugcacucacaagaacacauacagauacaugaaaauaaauaaauaaauauauauauauacacacacacauauauauaugcauauauauauguauauaugcauauauauauauguguauauauauauauauauauauauauauauaugaauguacauguucacaaaauguggggacuggcuucaugucuaccccuggaggauggagucaagaaaacaugguagaagcacacuguaaugcauacacugcaguaguauuuaguccugaagaaggaggaauccugugacaugugacaauguggaugagccuggaggacauuaagugaagcaaaacagccccagaagacagacagcuacugggggccccaguuacaucaaguacccagggaaacccccagagucgggguucacagauggccgccagaggccgagggcagggcgugaggugugcuagccaguguguacggaacccaaucaguuacacaagaggaucucacuguggugaccacuguggugacccagugcacaaggccgugccugcagacagcagcgcuuccgcuuccgagggugcugagacagagcucccgcuggcuguucuuaucaaagucacagugugauggucgaucucacucuucagcuugauaagaucuagaaccaucugggagacaggccucugggugugugugugagagaucaccccgauuagaucaaucgagggggaagauccacacacugagagcagcgcaguuccgugggcuggagccucacugaucacaagagcaggugagcaccugugggugugacgucaccagccaccccaugcugugcaccugugggugugacgucaccagcugcccaugcuccaagugagccaacuugcccgaccacaacaaacugggccuuugaacuacaagcaaaaacaaacccauuuucucuuaaguugcuuucgccagaauacuuugucacagaaacaggaaaagugacuagcauggaaguuguaauaaaaauaaaccaagcuaagucugcauguggacacagaauaaagcuugcuccugcuccucccucugccugucauucagcuuugcccccuucgguaacagcuccuggcuaacggucaguucccaagacugaugcuucaggccugcauuucagaggcuaaaccaagagcguugugagguucaugcccagccugggcaauuuagcaagacccugucucagaagaucaaguggagaugagcuggcauuguggcucaggagugucgccgggcaugcucaagacccuggcugagucuccagcacugagaagugaggagggugucagagauucccuguggcaugcuuagaacacaaggucaauaaaggaggggucacccaccaggagcgaggagucugguccccguagcaaucacggaaggcacagagagagagagcaaaagcuagaugcagagcuccagagugcuuacagagcaugaucccaucgccaaauauggaaaaagcaaaaacucaaacacuugucaaaggucaaaucgauacuaauuuacuccaagguauaaagaagagccuuugccuuuuuuuuuuuucucuuuucucuuuugucuuuauuaaagaccauuuggccaggugugacuuccuuuagccuguuauucccuacaguuuaaguuuaaugcuuaagaaucagacacagaaagccaguuccugccagcuagagaugggggaugagagucucuuucccaaaaaggaaccugugcgcuuuagcaaaccuucuggaugaguccagaaagcagcagccaagcuccaggucucugccuccugcccuucgcccucccagcaagggcgagcaacaaagccccgguacugauaugcacuccugccaggauaaccuaccuccuguucagggucuggccagcacaaacagaggccuucccuaagacagcagucccaccccugcccuagacauuccucuacucuaacgaucuucucugcuucugcaaggcugcuggggagcugacaggaucagaucacacugaucagcacagaugaugucauuguggagcucugcggaggccacagacgagggccugcuucuccaggacagccccuuucuguuuugagagcuggggaaaucugagcacuaacgcagcacggacaagggcagcugguggugcucauccuagcacagacaucgaggcccgccauuaugcaacaugagaagucuuaaaagucaauguccaaggggcuggggggaaggcucagucaguaaagugcuugccauacaagcauaaggaccagagaucaaccccugggacccguguuaaacaacaacaacaacaacaacaacaagacauauguaggagcacaugccuguaauccagugggggaaaagggaggaaaugguuagauuccugggacuggucagaguagcugaaucagugacccucaggcccaaagauccugucucucacgcacacgcacacacacacacaugcaugcacacaaucauugaacaucauuguguaucugguuuuauuacuuccucacaugggcacauaugcacaacauugacuucugaccuccauguauaccuguaaaugcacacacagagagagucauugaacaccauuauguauccaguugucuguauuuucucacauguguacauaaauaugugcacauguaugcacacaugcacagaggccauagguccuccauagguauccauccuauuuuuaguaagauuuacucacuuuauuuuauguguguuuugccugcuuguuaugucucugugccaggguaucagaucccuggaacuagaguugcagaugguuguggaccaacauauaggugcuggagauugaacccaaguugucugcaaaagcaaguguucuugacuuuagagccaccucucuagccccuccugccuuaucuuuugauguagggacucucccugaaccuggagcucauuggcuaaguucugggccccaugaguuaccauccccaccaucugggauuacagauggguaacaccacagucaagcuuuuacaugggugcuggggugucagaacucaggcccuuacgugugcacagcagguacuuugcugacuaagccauuuccucaggccuggaugccauuucauaaagagauacuagggcuggagcgaugccucagggguuaagagcacuugauguucuuccagaggccucugguucaauucucagcacccacauggcagcucacaacuguauguaacuccagucccaggggaucugaugcccucuucugcucuuuugaguccugcauacaugcaagguaccuaagcucauauaacugcacauacaugcacauaaaaacuuaaugaaggggccaccugugguucuuuuccaacagagaccugcccagaacauacuuguacacugacaacuguaagaugcacagggugggauggagagggggaccuuccugcaccgaccugcuugcgagcugcuugggagacuucaguuccagacucucucucucaggucacucuucauccucacuaaugucucagcugacugacagccaguggcagagucugugagaugaucacagccuugggagcagaggcacaggggaacuguuccaagcauuuccacacccagucaacuacaggagcuccauggagagaagcaaggagcagcuggauggauggacaugggggguugggggggagaaugacaggagagggcaacaggaucccacucgcacacuccacuugcucucugcucgugacccuccgaguccucuccaccucugcuuugcagucacugaugucccaagggccacaguagagccagcugcucuggacagcaaaggggcuuccaagauuccccugggacaggaagccaaccugaaagcagugccaaguggaaagccagaucgccugacagccaggcccagcacagggauggggccgacugcagcagcugcuguccacacugcugccucccugggacacaccucgccuagccuuucagcuccacccuguguguaagugggggucuguaccucugcgcuccccaccccgggucuccucugcaccuguaccaugugcagcuauccucagcgcugcugcauucugccccuuuucccagcauccucuagccugacucuuuugaccggagcaucuccuauuccuccuccaucucuacacuugccaaguacuucccaugagccuucccuggaugcccagaguggauuauauguccauccgggauaggugcgcccguggccggugcuggggacccacacugaccacagucacucuuacugucuguuuauucauuggucugcauuggccuggccagcacagcacagcacagcacaccacgcagacggcccauaagaggauacacagaucaaaggaucucugacuaagaagcugccaugacuccuaggcagucugucggguggggagcugggauauuacucaugaagcucuguacucuggggcucugcucuucacaacuucacgaugagcaagaagggcuagcccucuuguccaaacucagagauggagugagccaggacaagaggugccugucucucaggaggccccugagugccagggaacacaguccacauuaagagcaguuuccuuggcacacaaagaggcagcugauacuccugggguaccaacugggcaaagggaccugguagaauucuuggggucaacacuucaggaggaaggggucugggcucagccgcaaagggagcagcaagcugcugaugcuguuuggcaauccauugaugcucugcgaguuaaugccuuauuauuagugugcauauuuauaacgcgcccuccaguuauuaacggugauauaaugccaacugagaaaaccaagggaccucagaaauauuuacauagcagcauaauuaagaccaggagcugagucacggagggagccugaggaaaaaaaaagggacauucuggcuucagcccugcucugaggcuuccuaaauucgagccagucagaauacagcugugucuucaccuugaauacccuagaccuucaaugaaaggcuacccucugggaaacuggaaugccccucacauaagacucuaccagacuucuacagaaagcccccgugcaccagccagaauagauagaagggaagagggcuaagcagggaccacagccuccagacuguccagcuuuggagccccuguccagaccaacauccccagagaaaccacaccacagaugcugagguccccauaggcagaggaagcucccagacuggcccacagccaagcugucuuucccaggaccucagccucagaacagaagccuucgacaaggacacgacgcuccucccucuccuuucucauggucuccucuucaacacccuugaccgcuguucaauccucaaccccgaagaccauucucagucagacugcagggauccaacaggggacccuuaacuaggacucuauguguguguauguguucacgcuuauggguggaugaacucgugugucugaggggggagggguuguacuuguuuauggggaagugugccuguguguauguguaugucggggggggggugcagagcagagaacaauccagggugucauuccuuaggagucucccacccugguuuuugagacagaguuucuuacugauucgucuaggccagcuggccagugagcccgccaggaucuacaccucugucuccgcaaugauaggauuacuggugcacagcaaugcacccggcuucuuauguggguucugagaaucaauuccaggucuccauaccuguguggcaaguacuuuaccagcugagccacuucccuagacuccgcgacuucuuuucauuagcaucuuucaaaauaaagaggaaaggaaccggcuuuaaaagggagggagggaggggacccaaaacacaaauuaaaugugauaaagcaguggaauauuauucagccccaaaaaggaugacgcugugaugccugccuuagcacagagagacuggaaagagaaagaagccagucagagaggaugacuagcugugaguccuuguguguaaguguccaaagagaggcacugucaguaauggucccagggagcaucaggcagggguugggguuuucucucagggugugaaaauggucucacuguaguacugaugguguaauuccgugucuauauaaaaagcaccugaauuaaaacuuaaagugagugaacugggcugcagagauagcugagcaggugaaaacuccuaucguucuugcagaggaucugaguucuguucccagcacccaugucagccagcucacaacugccucuaacuccagcuucuucaaugccaccagccuuuauuggccacacaugcacauacacacaaauuaaaacugauguguaagucgauuaaccauaaggcaugugggcugcacugugauauagagccuaaagcacaguaggcaggccucugcugcucccugagcacuucuguggcagucuauggucaaggucagccugcagcagccuccugaagccgggcccugcccacuuggagacaguuaguucccuuggucuccaggccugauagaggcacccguguggagucccagaaagcucacaggacuagaaaucuaccuuccaaaggacacaacgcuccauaguagucccgaacacccugcucacaauaaaugucagcccauuugcuuccggaagggucucugcucugcagcugaugcccaauugggcugauugagccuccaccacaagugauaugcaaauguagcucuugucauucuaauaacccagggggggaauguccccauuaaaaccacuggaacagcccuugguuuuauggccagcuaaguuuucuucuggcagcugauuagagaacagacugcuucguguuucuuuuccuuuggagaagccagggcacgcagucaccaagcuguaccuugcuucagcugccaccacugcccagcucccucccagccacggggacuuauaaagcauaguccccuucccagcagguguggaaaugcauggccucugcucagugcccucagucagaggggaauauaaagccagccuuauuuauaacaacugaacgccucugcuucucagguuagagcuggcugcuugcauucaugugcacacgcgagugcacacacacaaauacacacauaagauacacagcacaugcaacuguaugcucaaacauaugcacacacagacauacaaacaugcacauauaagcuuacauauucucacacgcaaacacauguggagacacauacacucgucagggaugcaaacaugcaagcauaugaucgcauauaugcacauauggggcacaaacauauauauaagcugguaugcacauauguacacugauacacacacaagcuugcaugcaugcacauacacggaggcuuguauacaaacuuguauacacauaugcagacacauacaagcuuguauagacaugcaugcacaaagacauaagcucguaugcaugcauguacaaacacauaagcuugaaugcauguauucacagguacauacaagguuguagcauauaggcacacacacacacacacacacacacacacacacauauauauauauauauauauauauauauauauauauauauauauacauauauauauaugcacacacauacauacauuguguggucucccuugccagggccauggauccagggccgagggcagggcagguauccugggugagacccucccucucuacauuucaagcacugcgcugagguccagagaaaaggcuucagauaccucuagcacaagacugcucuuucccugccucaggccacauuacagagaaagccagagaaugccuaggugcacccacagacaggauaucuauccuaccuccuccuccacuggaggcccugggagagaggagggacaaacaucagaucuuccacccagugcuccccuaaguccuccucaaagaccucaacugugaugcaaggcugaaggguggugagugcggcaggccaucucagguccuccaaguccugcagacaggggacaugugccacacccugacccagacagguggggugcuguguccuaugcugacacuacuggacauaaucagguaacuucaggaccacacagcagccucagcccucaaugaggauucaacguuaccuaugggacuagaagaacaagagccuuggacccuccuucccacugagucaagggugcauccuguggccccucuucagcccacuuagccaucaggucugaugaaagcagcuccgccuacuaggugaggagcccgcccacuaaggagcucugcccauauccaauccauuugcccuuuuuguucucugucaguagauggccuuuaauccaagcauagccauucccugaagaaaaggguccauggaucacucccuggaccaccuccacaucccacugucacucuggcaucuacaagcaggaacugaguaaugggaggcuuggaaugggaaaagagaaaggcucuggaggguuuggauacugcaggaaauggaggugggagcaggaaaugggggugggagcauggaguggcagagaggccagacacccuccuuccccuggagacccaccccccagaaagauagaaugaccuuggugaggugaaaugaggccugguacagaugcuuccauuguguagaagugggaagauauuacuacuguguaacguagacucugucugcuggucuccaugaggucugagcucauagcacacugaacagcaaggaagaugucucuacagaggugcaaaggccagugguucccggugcucugugaaacacccagagagcaagacaucgacaccuggaugcccaggggaaagcugaaggcagcuugccagccagaugucccaaagggcuggcuaaaagaaggcaggcucccauccuggccaccucaggaccagucacaaaaagagaaugugcagagcccucccugcaagucuagagcagccucugagaaaccggccccaaccuucccaccccaccagggacagccagcagccagaccccaccucauacugucucagagacugggugugccuguagugugcuggcaucaagcauccaagccaaagcuggccugguggcauuuaugucccuuggcaucugagaaugaauggccucaggucaaccaauccccuggaaauguuaaaauaauaauaaugaugaugaugaugauaauaaaaauagcagaggccacagccaguggccauucccuucaggaaucaucuucccccaccuccaccccaagcuguguauccgggagccccagacacccucacacuugccucagcccugccaccacaggccaggaugggucugaggccuggcagcacgcucagcaccaggcaggcaacacaaacccaggccacacccacucagcgcccugacacccagucagugccuugaugccuggcaucaagaugguaccggcucuuaaacuggcagaggugugaccucggaggaaaggcagccagcccuucugggaagccugggcucuggcucccaccggcaggucccugggccuucccguguauucucagucuuccuguguguucuccagacaagcuacucugcacuucacaguggaaucccuucuugcuuaacggagccagagcugcuucugcggcuggcuggcucgcauagagggcugugccugcagcucagugcaagcacucccuggaagcagacaaguggacugagaaugaaguccccucguaggcuccaccaccuacagcucagccagagucuuacgcagauguucccacccagacugccuggguuuaaaaaucccgcuucucccacuccagcugccugaggcuggccucuccgggaggaacuuaauucccucaccugcagaucagaggugacugagcugucccaucuuauauggucuuuaccagggcgaagugugucagauauauguuacgugaacagcucacagugacuuuggcaagauggcucggcagggaaaggcacuugccaccaagucuggauggucgagucccaggacccaugugguggaaggagagaacucacucccaaaagggaccucugaccuguauguuugcaccauggcacauacuuacauacacaaacaugcauacacacccgcacucacgcaaaauaaauguaauaaaagcuuagaguaggcccuucacgugguacagucggguacuacagcaucuacugccccccccccgcccccaguuuaaguucacgacucugagcacccacaaugggccuugugcugccuugagcccagaggcacaaaagccccguggauuuugucugccgaaguccccaucugacagaggacaggcugguaaacacauacgucugcauccagcgugauaagacuguuugggagguacgugaagugccgugggagcacggggaaccagugauuaauuuugcuucagggcuggggagucuuugcagaggaggugacauuugagcuggacuuugaaagacgagcucuccauggaacuaaaucuggacccagugccaagacuaucagccucgaaaaucaauccugcaacccggaggaggggcagcucaccacagacgcucccugccccgaggacgcccagcucccccacgguguggguggccagauucucucuggagacuggcccacauuuucauguacaacuugacaucauuuuccacugucuagucccguccgcucacugcuggcuuggggcucucguuuccaggcaaacuucuuuggccuuugccccuugaagacaauucaauuuuuuuuuccccuaguaagaaugaucgugaccuccguuaaauggaaucagccccuuuagagaaugcgucacuuauguaucuuggagagaagagcagaacucuagucaaggcaggguuucaucgcagcccugccgccagcugcuguguccggagauggccgcaucaccuccuccaccucacuuacccuugcuugucuguacauuugaguagccauugcaguagggcugggaugguucacagacuggaguacuuuagaacgggauccaggaaauagcgggcaaucagaucgagugcugguacccuuaaguaaacacauuugucccucccacuacccaggauucucugcucuaucauccuuccugagcuauuuugugauaagcucagaggauccaggggagcccggauuugaauucuguuucaucugcgugguguuggcugggcaacuuccaguaagccugcuaaaccccugaaggaacaggggaccuuguggacugcgucauagccugugggauaagugccugccccgaugccugccccacccauggcuaccugcuacuaaguuggcuacugccugaacuuauagcauaaacuguaccucgggcaccugaccuccaggcuguguccugcuuuccuccccaacagauucuucauagucacagcacgcugggggcccuugggaaauacuagcaaucugauucugagcugucuugagcuuccucuggacaugguugaccagugauagccaaugccacugcuuccugcagacccccuccacggugccucccccauccugugggagacuaagcccuacccauucaaccaucugaccuacauguacugcucuccguggcugccugaacuccuugaugagagaauccuacugucuccuuccagaacacucuguuagaauccaugcucucccuuggaucucuaucuaauuuuuuuucaacacaaacagcgcugagggcugcuauguuuuggggacucugcagacugcggcuguugcuuuggaaucguuggcagcaaggacuccaccaaaauacucaaggucaagagaccagcgugggucuaggcaauguguaccucuuaaaacagugacaaauauguuauuuaauuuuaaugagcguuuuugcaucucaaaucuaauuacagcauuaucaagcccugcuuugaacugcagguggcuucucauuacguguguggagcugccacaagcguugcuugugaauacuaauaacugccugauuuuacuaucuaucugcuaaaaaaaaaaacaaaaaaacaaaaaaaaaccaaaacuuccagggacuuagaaggcccggcuuuauaaagcaucuguggaggccaagccacauggcuauauggcuuaauuaaaaaaaauaaauacuguauguggccacccuggagggugacagcucaggaaguggcagaggggaaguguggccaggagcagagccguuccccgaauggcaggacucggaggcucaggcuuacugcagucucauugcauaacauucaaaucccccaauuugcuugcaguucagagagagaaugguccugucaacagauuuucugggugacagacuccaguaaugggccuagagcuggaagucucuggggaugugcuccacaagucuguaagguggacaggucugaggagaugcccgcaucugagacagcaguguggcugccccccaggccaggcuggauggggagggagggugguggggccacaguugugaaugagaaacucugcagugccugaguggggagcacugucaaacacguggcucacugcuggagcacuggcgcaaugcucagggucugcgcgcucuuuguguauacuuggacagguuuucagggugcgccugcuuccugacuggcgcuuuucucaagaggggcgggucuugaagggcaaggaugcugccacugucccguaaggggcagcagcaccgaaggcagggcuaccagcauaggacagggcacgcaaaugguccagcuauggucucuacuaggcccuuuacaucauagucuagauuuuaaaggucuccaaaggcccacuuaaauaaauaaauaaauaaauaaauaaauaaauaaauaaauaaauaaauaaauucugugccacucuggaggugacagcucgggcagcagcaggaccaucgacucagggccaaggugaagguuugcuuacugcucuuuggcaucaucagcaggugcugggaccuguaggagccugccuggaggaaguuaggacuuugggugcgggcacagaagccauagugaaccuggauccuccauagugaaccuggauccuccauagugaaccuggauccucguuuuucucugccaccaggaggugaacaguucccuguagcacacauuccugcugugccaauccccggcccaagagccacaggcccaaauuucucaaaaccacagggucauguaaaccucugcuccuucaaguugauugaucccagcaacacagagcuaacagaacuuccucauacccaaguccuuccuauguccagguucaaguuggcccuagguccugaccuccaccugcaugugguuaauagaggaaaagucccccuuagacacgucacuguccccauccucaaagcuugugaugauguuacauggugcuaccaugggcuguaauaugacugugacucaaggaagguuguguacuauaaacacaggccucagaguuuggaggugguguaggacuauuaugggauagcacuugguaaucugggcauugggguacuaucuuuuagaaagaaugauaguagccaccagaguuaacugcucucaagagagcccucccugguuucuaucucucagucuggaugugggauuagacccuucuucauggucuacuacaacacucuacccugaggcaacacgguguguguguggugguggugggugggagggaggcagcaucucuagagccaauggcgugcuguuuggauuuugaaccuccauuucuggggcacuuugucacagaaacugaaagccaauuacuacacacagcaaaagggacuugggauuaccaaggcaaugaagguaccuagucagcugcccuugaagugggaaagcuaccgagcuguucccaaaguggugucaugcguccauaaaagcagaagagaaauaaggggcagaaaggagcucggagaaaccagcaggaaaaggaccugcuccgcuguugcugacuucaaagacgacaggauggggcaugagccaaaagcaggaggcgacucuagaugcugggcagagcagagggaggagccucccuuggcguccagaacccagccugcggucagcuugaucccagcccagggaagcucagguaagguucuggcuucagaaccaugguccagaugugagguccuaaccccugaaaccugaggcaacccgcauggcaacuggaagagaagccugggagucgggcuccccgugggcucccugcugagcucacagcucccccacuuacaaaccauguuguuuuuaucagacacccacuuccauccuucuccuuaggcguaggagaagcuucguuuuccagcuuggcaguacugaucuccauuacccugcacccgagcucugcgacuuuacauuccuugggcacagacucuagauucugcucuuaaacuaggaacugcccaaguuagggcuagagagaugguucagugguuaaggcaaaggcccugaguccaguucacagcaucuccaccaggaagcuuacaauggccuguaacuccaguccuaugggaucugaugcccucuacuggccucugcacacugcacucauaggcacauacacaugcaugugcacauguauauacacacagacacacacaugcacauacagagacacauauaugugcauaugcacacucacacagauacacacagacauauaugcacacacaugcauacgcacacacacaacagacacacaaguacauauacauccauccauacaugcauacagacauaaaugagugcaugugcgcacacacauucacacucacacagacacacauacagacacacaugugcacauucacacacuugcccauacauacacauguacacauauauccacacucacacagauacacacaugugcauacucagacacuuacacacacacauacacgugcacacacacauccaaagacacacaaacauauacaugcacagacauacucacagacacaugcacauguacaugcacauguacacauacauguacacacacauaugcacacacaugguuuaaaaugaaaagaggccgggccugguggcgcaugccuuuaaucccagcacucgggaggcagaggcagguggauuucugaguucaaggccagccuggucuacaaaguaaguuccuggacagacagggcuauacagagaaacccugucucgaaacacaaaacaaacaaacaaaagaaaaaagaaaagaagcacaacuaagcuuaccaagcuaccaggaggacugcagcagcucaucuuugcaaaagccgagccugccugggcucuaacugacaaguucuucuaacuggugggauacggcucuaggaggacucugggcaucugaaggccugcagaguaccugguguuagccugucuugcaggagcuucaucugcccccaacccuggucccaacagacaggguaguuaaugggccaacucugaacacugcuccccauuucuuuuaagacaacaggaguucaugacaaaaauaguaaugucuccuucuucacggggccauccugggugcugccucccgagcccauuaagccuaguuaucuugcacaacauggucacauagguauuguugccaccgacaaguucauugaaagggaauuuauggccuaauugugcagcuguugccuucugggccgguuuucagagauguuccacaagcguggucauaauuuagucaaguuuuuaucucacaacuauacugugagugagcgaaugguaggccagaguaugaggcgggccagccauggauccagcaaaccccagaacaacaauaucgugaccccaaguuuuccagaaagcccacacagacccauguugccccugaaauugaccacaaacuucaaaagcacgccugagucugcagcuggcagaggucaaguggagggaccugccucuugaacuccuucaaggacugcaguguggacagaaguucagggucucuguacaaggagcagccuggggucugcugugcagcagugucuagguagguuugaacucagggaacauaguagacacguagugcacuucugugcaguaggguggggugggugagcuuuagcccccaaacacggcucugcuguagcaccuucucacauagaacauuccagaaacacugcuacagaggaggccugaacuuggcuuuccuaugcuuucucucuuccucccugccugucaccuggagggcugcuggcuugcacaggaccugagggagacagcccucuggguggcuaccucuucugcuucaugcaguagugcaguaccacagugcaggacuguggugcaaaauggaguccagauuugaccuucccagagacaauucccccaucagaauggcuucccccacccauagguagcacagcaggggccuccauggcccagucagaguuuaauuggccaugauuuccuugagcauugugaauaaugugccagagaaguagugggagguugggauagaaauuugguccuggaugggucauaggcagaaaccuguucuaccuggcagucauagagagaacagagcccagggcacauacagagaugcuaagccccggguacucuggugucccauuuacagggaagguaaagucaugagagaaugggccgcacugagggccaggacuccacuggucuaacugaccucagagcagcucucaaugccccuccaugcucgccacuggcccauggcuguaaacagcagaacucuagccucucugucuauccugggacugacucaaaacugcuacagucccaacauguugaggaccaagugccuucauccccagggcagaggaauggggagaccauggagagggaauguaagggggcagaugcugguccagugucuggagccauccagccuagggucucugcuccccacccccagccugacucaucugaaaacagcagccaaaaguaguggaaggugacuagaggggggaugggcgaucccuggaauaugguuaaugaggcuggaagacucacuuccagauugccagagccgagagccuccgcagagcaagaugcaaggaccagagacaacaaucgauaagacaacacugagcgggagcggaagggaaaucgaaaugcugaccuggaaaucagguuugcacacugagaaaggucaggguggcccugagaggcggggugcagggaccaagaggaagcccaucuugacgaggggguggggaugaaggaagcaaucagcugagguccagccaguaccaggcauagagagaaauaagcaucaaagacagagggugugcagggccugcuuacaaucccagcaugcaagaggcugacucaagagguuugccacaaguuugaggccagccugagcugcuggugaguugguucaguguguaagcaugggagcuccaacacccacauuguguggcuggggagaagggcagaaacaggaagaucgcugaucacugagcuuccuggccacucuagccagcaaagaaggaagaguccagguuuaguggaagaccccaugucucaggagaaugggguaaaacaugauagaguagggcuccggaugucugccucuggccucuacacauguguguaacaggcaugcacagcuguacacacacugcagacaccaaggacagagggaagagagaagaaaagaaaagaaaagaaaagaaaagaaaagaaaagaaaagaaaagaucaagaaagcagcuccaacaacagggcacuugcccauguaagcucucagagcugggacagcacagaagaccugcugagcucaagccagacauaauccaagcguggagaaaggaggagggcaccccagccaaggagcuaucgcagcugguagcuucuaagagggagggagggccugcuuccuuuaaggguguggucucugauaagccaacuagacucuagagcaggcaccacacccaagaauauguagguggcacaaacuggacucaauagucaaaaaauaacaaaaagaagacacaaaguuggguggguaggaaggaggggaggacuugagaggagaugggggaggggugagccugagagggauagggaggaagcaugucugggaggagcccaggaagggguagguagauaugaucaaaauacacugaauguaauucucaaagaaauaaagauaguuuaaaagaauauaucccagcuacaccugcacaaaacaagauagaagcaaugaacccuaguuugcucugcacugaacccgccccugcuguggggacuguguucugcugaacuuugaaaguuccuaguccuuaagaguuugcugcacccaggcuccuccaagcuuaggcugugucuuuugugaccuugggcaaaggacuuaacuuuccuguuccuucugucaccuuaccaauagaguccacaccccucucacuacuguauagcagucaagccuggcguguggcaaccacccuggaauagaagccuuucuuccucaucuccaaagccaaauucaagagucaagaucagacaaagcaacugagaggcugaggggugaccuggcaaacgcaucaggucaugggguaugagaaccugagaggcuggggagauagcacagcugucuaaggauaaaugcaagagccagagcuaagggacagaaagcuucccuugccugcauccagacuggggcuucugcaguaggagaggccuggccuaaccugcagaucccuucaaacccaaagaggucugggaacugagaccaagccugccccaguccccacacagcaccagacacuucuauauaaagcucauaccccuuacugguaacacaauggccagucaauguagagcccauccaggggugacauugucaggaaaccaugacccgggagcugcuuacagacgaacagacggaccagagaaguauaagcuaucaagaggaaagacagguaagucccucagugugugugugggugacuggagggcuuggcucccaguaaggaccugugccucccucaacagaccuggccuuucuggugauggagguaagcaccauuagaaaccgugugggaacgcaaaaguggcugggggcugaaggagcauggauucucuguggaagcuaggcuguaacuucauaacuuucacacuacagcuguggucugaugcccacguaaugcucagccauuuuaugccggauuaugugcuguguauguaccaaagagaucguuuuacaaaagggaaaaauggacugaguguuacauuguuuccgaacgucccccagcaagcuaugaaguacagagaccuccacacccuugaauuacagcaucccucuaucagaguagacucuggguauaaggaucuaggaaaaguagagcccuuagcggggccaugguggcacucacuuuuaagcccagcacuugggagacagaaguagguggaccucugaguuugaggccagccugguguagagaguggguuccaggacagccuggaguacacagagaaacccugucucaaaagaccaaguugaguccaaggucaaggagauccuagagcagacugacccuucugccuuggaucccaagcuggucaucucuaagaaagggaaaauccguugugaggugugaccugguccccaagcagagagcacaccugugugugguagagaaaagccagguuggcaaagaacacagcagggccaagcaccugugcuguaaaggaacacuguccaccuugguccuggaccagcgcugaccucugagcuccugugggcccugcagagcuaccccugccccagccuauaguagccaggaacaugcauagcaagagggaauauucucauuucuagauucuuugcucucuaucaggcugggcugggagccaggagugggaaccacaguuaacuccucgagcugcgacagcaguguggagagaacaugacgggguagccgcaggacgggcuauuaggcaaacauuagcaaccguguuugcaaagaauguuuaaugacugggggaauauucacaauauguugucaaauggaaaaguaagcuaggaaaaauaauacaaccccagcauuacuggauacgacaacaaaacccagaaagacaaaagacaaaagaacggaggccuugaugcucagaaaggggcuggaggagagaagauaucgucagcugcuaugugggcaggccugaggcagaucucaccaucucuguaauguucuucuguguguuucaaaugccugccacgaugaguauuuuuacuuuugcaauugacuguguuaaaauuuauuacugaaacaauauuucuucccaaagaaaauccauuauuguauccaauuugaugccagaaauguccaacaccugcagugauucaggggugaaauacccacgagggccaucugcugacacuuuguuccccagcugauggggacuggauggagggggauccggcuuaguugauggauucauccagugauggacucaucaucugauagagcuaggaggcaggccuuguugaagggaacaggccauggggggugggggguuaugguucuuucagugagagcagcccucaugggcuuguauguuugaacuuggucccaguuggugggacuguuuagggaagauuacgagguguagccuugaugacggaaggcugucacugggggcggacuuugggagguuuccaaucccagcacucaggaagcagaggccaguggaucucugugaguuugaggccagucuggucuacagaacaaguuccaggacagccagggcuacacagagaaacucugucucaaaaaacaaaaacaaaagcccaugccaagccuagucucucuccucugccuccugcuuguagaugacuuucaguuacucucaguuacugcuugcucagcaccaugucuaucugucugucugucugcccaccgccaugcugccauggugaucaugggcucacccucugaaacuguaagaaagcucccaauuaaaugauuucuuuuauaagcugccuuggucaugguaucucuucccagcaauagagcagugacuaagacaggauugucucaucucugagcaucugucugcuucccgggcugcuccaaggccacggugagggaaccagccuguauucugccccgaaugcuucaccucaccugacagccugaggccugacagcaauggaaccagcuugccaugaucugaaaucucugaaacuagagaccaaaacccucucccaccaucuuagauauuuuguggcagaacgaaaaggauggcuaaaacaauccccaauauuguuuugagaggggguguuaaaaaaacauguaagugucacucuagucgacuaacuuccagugucagcaucagacagcaaguuaggagggaucugccaggcagagacugaaugagugggaggugggagguggggguguggcucaaggaagcaacaggaaaggcccauagaucuagauagugaaaacauggccugagacugaucuggcaccucccagugugcacagcaugugucacaaccguacugcacacaacugauacuguuagugcaccuaucagugccaccaccaucuggggcacgugcauggcucauaucauagccaugcaaagcauugcuucuagcuacacuguacuugacaguuaacacugcacaccucaauuacacuguguuccauuguguucccuccucaguuacauugugcucagcagcuccacccacaccucacagucauccacagaugauggcaaaccagucagcugcaccuacaccugacaguauacaugaacccucagccuagacucagcauuuccaggcuaggucuagacucccugcuccaacuuggcgggagagauaaacaucucuggggcugaggacaaggcacagaaggcucuggagccuggcugaggggacuugggggaagcaucuccucuccagaccacaccgagggucuccaggaggugcuagcuacacagaucugcaccagauugcugcuucccagagcugccuccuuagcugccaugccacuccagagccuagucuaaccccauuuuacagaggagaaaauacuggucuuugguucuuucaaugggaaguuacugcaugcaggacaaacacaccaggcuccccacuuccaaacauugccccucccauucaucccucacacuguugcucaugacauagaagggacauaguugacaaaugcuagggaggcaauggcuaagacacagaggggcuaaauuacuccacuaaaggcauguacucagcagaagaugaucuaugauucaacagcuuaaugaacaaaucccacaccugcauaucccucugcccuagaucucacaccugcagaucccugcccuagaucucacaccugcagauccuccugcccuagaucucacaccugcagaucccccugcccuagaucucacaccuacagaucccugcccuagaucucacaccugcagaucccugcccuagaucucacaccugcagaucccccugcccuagaucucacaccugcagaucccugcccuagaucucacaccugcagaucccccugcccuagaucucacaccugcagaucccugcccuagaucucacaccugcagaucccccugcccuagaucucacaccugcagaucccccugcccuagaucccacaccugcagaucccucugcccuagaucucacaccugcagaucccugcccuagaucucacaccugcagaucccccugcccuaaaucccacaccugaagaucccccugcccuagaucccaaaccugcagaucccccugcccuagaucccacaccugcaguccaagcaggcagauguauauacuccuauuugcccugugauuccugcccucccacccauaccccuacccccaccucucuggaucccagaaaauuagaaaaagcacaguccuucuugcaagucuuucccuggguccuguagggagugagaacucaucgcugcuguuugaagaagcugggggcugggagaugcgguccugaugcuuauugucagagcagcuuuggaaggaaguuggugucaauggugccuagguuccuuucuuccccauuccacauuccaacacucucagacucaaaugcuaagcaauaacucaagcuguaauuuaaucuuaaacuaaagagauaggaagauacagguacguucagugagggaucacuugccuggcauguacaaggcccugggaccccuucuagcacugccagggacagagggagggagggagggagggaggagaggagagagggaggagaggagggaggaagggagaagaggggugauauauauauauauauauauacacauacauacauaugcagaugauaaaccaaugauauauacauagauaaaagauagaaauggggcuaaaugauagagaugauagauagaaauagaugauagauacagagcuagaugagagagagagacagauagacagacagacagagauagaauacacagucuuagcccaggcucuucuuagcuuuagucuucuaugcacagugagaacacauggagcagcuugaaaggagacagccacacccacccuuccucgacaucuuucgcuguguuugucuccccauuccuguccccugcaccuggacagacagagcccuucucgguauccaugagacacugugacuacaugaacugagagccagcuggcagacagacacacagauucaucugugcuuggguaucguggguccugcauggagucuggaggcagcugcaugucuggucccuaacugugcugcuggccucagaauccccccuaacccccccacaccuacaucucaggcuccuuccucccugucagacaggguaaugacaguccuuccaaagcuaguguggaagcaaacaaaaccaugucuggagggccuggguaggauucgagggcaaucaagccuaucacugacccucuggacucacuaagguuuuguaguuugggggaugguuccacaguuugaugccuugggagaaauguacuuauuaagcugugagacaagacugggucucaaauacacaaaaugacacccccagcaucgugcugaggagagcacgggagucacugugggucugccugccaccgccagguucccucaacucacucuaacuguucucgugggcggccugccuuucugcagcacagucagcucccucugcgugccucuagggagaucugcuuugccugagcaaacacuggcucuggggugggauacuccagaagagcaaacucaggaagagaccagcaccggcuuucccgaauucucaccacagcaucaucggaacacccuccugucccagguauuggaggaggccgugguucucauaguggaucuggcccuagcccuaucacuaucaacuuugaaaucucauccauucaagagcccccccaaccccuugaaacuccucuucuuguucaaccccauuuccccaggaaccuucaggcacugggucugaagcacaaacaauguauccuguuacaauuaaucgucagucucgaaugcaacaucuuggagcggauuagccacaaggacugcauuaguccgacuuaucuaagaaaagacaggaguucguguuagcaucucucuugcaucaccagaugguccggucuccaaguuucccuggaagauuaucccacuccccgggggagcagcaacaucagaguggggugacacacagagacaugccagagagcaagagaaccugccugcacggccuucugggaaggguuauuuuuguauuuucuuauccuuuuaauggauuuccuuaauugucucugggcuuguggugcaaagaaaacagguagagagcuuaggggucaaauguuggaccugaggggagauccuuuuauucaugagccccgcgcacagaacacuuaaccucucuaggcagcagucuucugaguccccgcaaagaggcgcucacgugggugaggagcaguggagcccuggacagaacugucagggcagugucugagcaucucccaccaccugucaaccagccucucccagugacagcuucuugucaacaaaauggggacaucaagguugcugagagggcgaaugagggaacccucgauaaagccuacacucaguaggcugaggcgggaggagcuggaauucccuggguucuuucccauuuucuccuuacuuuguacggauacacacagggaguggccggccaguugcagaggagccaagaccucacagaauuucucacucagccuuccaaaaugucauccacucugauagauagauagauagauagauagguagauagguagauagauagauagauagauagauagauagauagauagauagauagauagauacauagaugucuuagcagagggagaaggcauccaaacagguagccugcauguagcaauucuaggccuaacacagagucauaccugcggccaauaccucaggccucucguuacaugucuguacaaugaggaaaagggacaguuauuuggauggugcgaggguuagcguauauucaucuguaucuucccucaacaccgagguaccacaagauuaucugguacaauaggacaauaaaacaaaaacaaaaaucaaaaacuaaaacuaaacaggcacacagacuugaaagggggauacaaaagugucuuaauuuacaaauuagauaaucauauacauggaaaaucccaaggaguccacaaaaacacgauuaaauuaauaaguuccaaaagauggccagauagagcacugaugggcaaaaaacaaugguaucucuguacauuugcaggaacaacacuaaagaugaaauuaagaaaauaauuccauuuacagcaauuccgaaaggacaaaacgcucuaaaguuucuggcaagaguaguuaaaaagguaugcucucaaaaccacgcauuauaaggaaauuaaggggcgaaacggaaaggcagcucauguucacagaucaaaagacuuaacuguuguuugucaugaggacacugucuucaagaugaucucgaaauucaucacaacccuuaucaaaaucccagcuggccucucuguagaaacggcuaaguugguucuaaaaucuauagggaaauagaguagacccagacuagucaagaaaaccaaaaaagaaaaacaaaagacucacauuuccucauuucaaaacuuauucccagacuagcacagucaagacagcauggcuccaucaggagggaggacauggagaccaggguagagaacuuacaaacacgcccuugcagucauggccaacugaccuagaaaccagguaccaggcaacccagcggggaaauggugcugagugaggagauguggacaauggcgaugcaccccucccccacgccccacauaaaaaugagcucaguggagaucaaagaccuaggucuaagagcugaagcuguaacugcuaagaggccuggcacucugucucugugacacugaguuaggcagcaaugucuuuaaaacaacaaaaacaacaacgaagaaauaggaaaaggaagaaaaggagagagggagggaaggaggaagacagcccggcagucaauaagcugaacaucauuaaaauguucaacuucugguucccaaggacacugucacaaaaguagaaacacaaaauagaacuguuaaaggaauaauauaucuuauagcggccuugugcuggaauacguaaagaacccuugcaauucaggcgacacaaguucuugccacacaagucugacagccugaguucuaucccuagaaccuacagugccaagggagacccaacucccaaaagauguucucugaccuccaugcaagugccauggcaugcaugcacacacacaccacaacacaacacaaugguaguaagaguuauuuaaggaacccuuauaacuuaguaauagaaagagaacccaggcuggccagacagcccaacagguaaaagccagacaccaaaaccacccgaucccuuaugcacaccaaucacccugcagcugacgguugcaggauuuuggaggauucugagguugaaccuagcaucacauacauagagcacugcuuaagagaaacuucuguuuucaguggcugggauuagcagaaaccaaagggcagagaauaagacacuagagaaugcucaacuguacagggaacaucucuacugcaucccuccccccacacgacucaggaaucauugcagaagaagagaugaaaagaccguaagggccagagacaguaaauaaauacaugaaagcacggucuuugggacacagccaggcagcugcacccaugggcucauggcaguugugacggugugcacaggggcucuuugagcucaaauuccagcaagaaaagggagcguggacaccaagucucacccagccagcagcuauagcuauauagcuauauagccaguugguagcuguuggaagagggaagaguuaucuuuaaugguguggcccuggugagucagccauacuccaguggaaagucaugcaucccacaauacauggguagcacaaacuggacucgguggaugcagaaugaggccacaaaguuggauggguaagggugaucugggaggagucaggggaaggaggaauaugggcaaaaaucaauguaugaaagucucaaagaucucauuuuuaaaaacuacauauaagucaguuacacaaacauuagguaggauaacuuacgcuuuauuuauuuauuuauuuauuuauuuauuuauuauuuaguuauuuggcuuuuuugagauaggguuucucuguguauuucuggguguccugaaacucacucuguagaccacacuacacugaccuugaacucacggagauccaucugccucugacuccugagaguugagaucagagguaugugccaccaccgccuagcuagcuaaggcuguuuuuacagcagagauggggaacagaggguauagcaauugccaagcagagugcacggaagcuaagacccaaggcaaggaaagggaccugaaaaaucuggggggagaagggcaaaggggcaucuugccuuugugcugcacagaaggagcacacccaugaagggaacuggguguggcugcagaggacagagcggguggcaaggaggcagggugggaggcgcuaggcucuguccuaagagcucaguuuagagccggaggcccucagccaagccacgaacucagaguucagcaugaguuucgggacucgcucccggucugcacauacacguucacagugccaucauucagaaggaacccaaggguccacuuauggacaaaccaacagauaaaaccuguaggaugcuuaaaaagagugaaacagugacaccggcuccgguacagauugaacccugagagcaugaugccaggugaaggagccggucacaaguggacaugcgcugugugguucacgcaagagaacuggacaugcgccaugcggcucgcacguacgcauuuccacggcaaccagagucauagcgcuaaagcaggguaggcccaggggcuggcaggggcgggggugcugggugugcacugcagaguuuuggaaaaugaaaggcauuuggagagggaugacaaugaugguggaugcauggcaaggugacugcaccuucugccccuggacgggcuagcucguggucauguacauggaaaauguccucacauuuagauguggccauccaauguucgguagaacagggauaacaugcguguaguggucagcaugcugcccugcuggucaaagguccucaacagaaaucacuagaagcugaaggacuacaucaucccucacauauucuacacuaaccaaagcucgcccaagggaaucguguguccaacagcagcaggccagagucccuccuacccuagcugcccugugccgcccggaugaccaacccucuagggagagcaugcccuacugcgcuccucucagccagcucuccauaaagagccauggccuggaugcuggacuucacccaccaggcaaacgaaaaggaauauaagaccguaagccugcaugaaauugcccaagcacauauauaaggcuaaugccacugcuauauuaaaauacuaaauucauuuuuauacuuuuuuauuuaaauugcuggggccacuugccaugguugauuaaaaauucugaacaggguguauugugugagccaauuaugaaagaguguauaagugcugugaacauuacuuggaaaguacaggaaaccauuuguaaaaugaaaauucuuccuuuaaaaaaaaaaaucuguuuaaaaggugagaaaaaccgggccugguggcaacugcuucuaaucucggccuucaggaggcagaagugguagggucaagggaggagccggaggugaaggucauccuuagcuauaaaacuaguucaagggcagccugggcuacgggagcccaugacaaaguuaauuuaauuaaagaacaaaaaaagagacgcaauggaggcagaggcagaggcagaggcagaggcaggggcaggggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcagaggcaggaggcagaggggguuugcucugagccugugcaggcaccaagaguggcagccuagugggcguggcuuccccaggcuggcugcacaauccuagcccaccaagcugggcccaggccaagguuuguuuuccauccugaacuuguuucuccucauccuggagcucguccaugccugaacuuaugagaauccugucgugcagauucuguucuggcuuugagagggaagccaacgcacuuuggcucugcagcuaucccugagcuggaggagcuagcucccaguccagaggagacauugauucaugcacucagccagacaucggauggacuagcagacaagcuaccagcccggcuggaucucacacugaggcagggggauagcgaagcacaaacgcuuugggagaaaacagucauugugaaagcaaauccccaugcuaugaacaugcuggauguccuuucuagcuuuggcauauggagaaaacuuccacgaggugggaccugggcagaaaggaggacucgcacgaucugucugacaacucggaucgaaaggcaccugagcccauggagaagggagcucuugucugucacugggaaucaagcugaaaggggcccugagguuggagacaaggagacaaggaaacaggcuuccggcagacauguuagagcuccuuccuggaugccagcaggcagcacagagucccgagcaccgagccugcggggcugccagcagcuccaaggccugucuacacaucaccauggcgauucccuuccuugggaaacaacuacguuuguuuucuuuuccauauuuuggacggaggccauuugauaauuacaaaauguacaacccauaauguguccuaaacugucucugaauaguaugugguuuugaaauaauacauaaaaagcuuaauaaaaauuaauguggaaaagagacucaucagccucagcuggaaauaaaaucaguauuaauuacuuugcccgcagucacucugaugagcuagagauggcaagaccguuucccccauguaggaaggggauguggagcuaucccugccccucugccucucgagcccccaaggucucaucagcacaguccuguguaucaugguaccucuguaagguucgcuaugcaugucuguauuggguuccagggaaagaacuguaugaggguggagcuugacauggaacacgugacuaugagggcggagcuugauaucaggacacaccucuaucugcuggaguauccuugagagguucauauucucggaccuagcaguccccaggagcuagccggaaccccaaaccuugcuugagcacagaacuguagagcaucaaagcagcaggugacaaaucccccaccauccgugaccacagcccuguuauguguccggguagcucagccaggaagcgugaagccugaguucuggcuaguccacaccccagaaagccacaaaccaagaacgcagaugggcugcugggugccauggagaccuucacagccauuugucaaggcugggguucagggacuccugccccugccccacugcagcggggggggggggggaggggcuggacugcuccugcuaugaugcccccaagcuuccaguaccugcacuccagugaacuuccuuaaacagcccacccacccagcagccuguccuccagaggagauggggucccuccucccacaaacuacacacgggggaggggcauacaggagcuggccuucagucucagaacuccugacauccuugaggauauuuuauugacaaaaccacacgguuggccugucucucccuuuuguuaucccuuagaacuuugcuguguuccugugagguccguuaaugaugagguguaaguaacaaaguggacuccagggucuggcuucuagcucagucgcuuccggaagccucugcacaacagaucaccugucuugugggauuaaaggagacaaccgauuuagaugauucacccaagagccaaguacaggauaaauggcaauguacauuacuaagugagaugagauaguacugauuauggugaugaugcuggacauaaagacgauggagaugaggauggagacagagaugauggugaugacagugaugguaauggugaugaugaugaugauggaagcagagaugauggugauggugacaauggugaugacggugacaaggauguugaugguggagaggauaaugucgaugacaucagugacugacagggacccgaugacagcaguacuaugggguaccaugacagcaacaaugacacugguauacagguaaagcuaugguggugaugacggcagugacugugaugagugagaugaagauggcaaccgugacaacagucaugaugaugaagacgaugguaacacugaugcuuaugaagaccaugggaugcgcucucuggcuuuuaggcaaagugcgauccagaugaccaaacacuugagggcucagagcucugcucaugcccaaaucugcaaaccugagcucagcuuccucccucagucagguccugcaggcucagcagaugcaaucuugaauccuuauucaucaaagagaaggggggggggggagucccucccugcacuggcucacauccacugacaccucucuccagucaccccauccacaggcuuccacugcugacuggccaccacuacugcugccagccccaucagaaagguccuacgccaucccuguccuagaguccuaacugcaccauccccguccugaaacccuaucugccgugccagcuguuuguaucccgcuuuuggugggauuccaucccuuuggacuaaauaccaccacacacaaaacgcuguguagcuucucuggauaagaagagagaccaugggagagcugccaucauagacacugcuuauuaucuggguuauuuuuguugcagccaacacaaccuaggcauaaacaaacagcauagagucccaggagccaagcuggaauccccacaggcaucacuucgagcaaucugaugugcugcaugcaagacacagugcagaacgccacugcucagccuagaguuccagugaggaggggcagggucugggaagcugugucuccacccgcccaucacuucaguguuaaacuuccaacagccagaguucaugacaacaggaaucucagauccaagucuccuugcacugagauccuaagcccauccuuccgagccgagagaguccagcuagggcucgcucagccucccuccauccuuggauggugcuguuggcuauucucacacccaagcaucuaguguuagccuucauuucacacuccaggaagggggaggggggcggacccacucauaucuggcucagaaaggccuuggaaaaguuuacuuuuuuguaaauguuuucuuuaccaaagccaaaucccagagccgaugugaugugcgguggauuagacaauuaaagcaggcgcacagaauacaaaucugaguuuguucagcugggucgagaggaucucgccauuuccuuccucccccaagucaauuugcucagagagcggccuucucuccagauaagcacauugacuuuaaaauaacgugcgugccaacagcugcagcgcuacgagagagcagacagagccauggcagcgaaugauaauuaaauauauuuucaucauccgucauuucuucuucuucuuuuuuuuuuuuucugcaggugccaggguaauaaaucuaaacucgccucuuuugucagcuggcagugaacacauuuuaacuugagaucucuugggaggaauuaagagucacuuggccuuguaaaggagaaaggguuuuuacuuccaaacugccaaguggggagcucacagcugauuggcuucaugauacuuuauuauuugacaauauauacgcgucagguuguauuucagaauaccacaccuacaggauaaccagggcuccaagagauccaucaucggauucuagaauaaaaaccuauuugagaagauuuucaccacuauuucuuuuuaugaauccuagauuuaauguauuauugacuuagguuuauuccaauauuuuagaacuuuuucagcauucuucaaauccccccacagcccuuuuucuccuuguagcacuucacaggcaaagcuggugcugcgccgccugcagcccgaguuaaguguuuucgauuggcccgaggaguuugguugacuuuuuauuuugacaguuuaacggcuccugcuccccaggggcagccucacguuccuuaguuugcagccugauggaacugcaccccagccucucugccuuucuucccucucgcagcagcagcagacagguccucuguaaaauaccuucccugaagggcaagccugguuacagccaccagggaacgcagagaagucagaggggagguggggacuggcagaggguggugaggcugucggcugggccuguggggccucaggugguaccugcccaucacgaaccagcccggaguaguggggaggggcuugucagcucggccaaccacacccagaggugacuggaucacucagcauuuccaagcaacuuuuccccucuaacuuuucuggaaaaggaaacccucgccuuguccuccaucuaugaauccucaaacacuaacgccuaaggcuggugacaagggacaggugaagaagaggaaggcuuugaauaggcuuccuuggcggggaagaaacgacuuuacuaagcuaagaagaccaaggaccuugaacgaugguaacuucaaaagcauaguuaagguuuucaggucuucacuccucagaugagaccugaucuuggggagaaaaaaaauauacagaaacccuaaggguaccagauaccuuuauuaaacauuaaaccccccgcacuuacugguuacaggugggucccacagccauuccacacaguggggugcuaccugacacaguuccaaaggagacacuagggagagcacagcauuaggggcucccccaucaaagcccccgcaagcuuugauucagaagcugagaagccaauucgggaggccauguggauaugaagaggucucggaagagcugagagaacuggaagguaggugagaguggggacagccuuuugucaaaggauccaacgccguuaaaagugucaggacaguguaguauuggcuuaaaaauagacaagcagaucaauggaauagauccagaaauaaacccucacagauagggacagaucgcucuucacaaaagagcaaacuguggugccccgugggccuccucccaguuaacuagcaggaugcugagguaacccgaugcuucaaugagaaagacugaacccacccacuccuuacgugugugggaggggggaacgccucacccacuccucacgugggggggaacgcuccacccacuucucacuuggggggcgggggagaaaggccccacccacuccucacacagguaagaaagaaauccacggacaacaaauaaagucaacgcgugagauggcucacuugcaccugcugccaaggcugacuggccugagucugauccccaggacucaagugguuguccucugaauuccagauauaugcuguggugugcacuugcacgugcgcgugugcgcgcacacacacacacaaauaaauaaauguaauaaaagauaaaauuuggaagaaaugucauuaauauauuauuauauauuuuaaaaaucaaauuuaaaaguuuuuuaaaaaauaacagaaauacaaaacaaaaauaaaauuugggacgggagagaugacucagcgguuaagagcaccagcuacucuucccgaggacccagguuaaauuccaagcacccacguggcagcucacaaacaucugugacucccguuucgggggauccauccggugcccucuucugaucaccacagacaccaggcacacucauccuacauauacauacaugcaggcagaacacucagacauguaaaaaagacauuaaagaacaaagacaagacaaaaccccucuaguugagugguagagcacacacuugacagucaccgagcaagaacggaaacaacagagcacucuggaaacaugggagaauggacacgacucaagaacaauccguaucaacgagaaaggcagaaaugagcuuccguacuuaaagguacagggcugucaggcuggaaggaaacugguaagaagacccugugcuaugacagacugacagaggggagucucucagaguucaguggcaagaaaagaaaaucaguuaucuguuugguuuugagagagggucucacuguuguccuggcacucacuauguagaccaccaggucagccuugaacucaccacagagacaaucccaagugcugggguaccacaugucgauuaggucagaugaagucaaaaggcugaccacaugaagcaguacaauguagagaagcuggacuccucaccucauggugggugggaugguaauuaguauggccacacuggaaaacaaugacaguuucugcaugguucagccauucuaccccaugcuguuacccacugccccaacaaggagcugguuguaauauuaacuaauuuuaauugucauuuugacaacaaugacacacucaguauccaguucagguuggucugugaacgugucuauggggaaucaucuuaauaauauuacuugagguauguagaacugcccacugugggcaauaccguuccuugggccugcagacaugucuuuugggaaucaucuugauaauauuacuugagguagguagaacugcccacugugugcaguaccauuccuugggcuggggauccuggacuguguauaagugaagaaugcaagcugugcacuagcgugcaugcauaacaagaaaacauauccacacaaagacauccaugugaacgcucguggcagcauuauuuguaacuguccaaaaccugaaaacauugugacuaucugucaguagguuaacggacaaacccucucagacccguaagauagaccgcuacuccacaguaagaaucaauguguuuccuaucaugcugggaugcaucucagucaucacacugaguaaacaaaagaacaguacgccauuugcugcauuuacauaaaacccucaaaauggagagguggcccagcagugaggggcacuuguugcucuugcagaggaccuagaauucaguuccaagcacccauguugggcagcuuacaaccaccuaccauuucagcuccagggaauccugccuccucuucuggcuucugccacugccugcuugcacaugugcacacacuuacaugcagaugugcauauagacacacacuguuaugguuuguauauguuuggcccagggaguggcacuguugagagguguggucuuguugggguaggugugucacugagggugugggcuuuaauacccuucucuuagcugccuuggaaccaguauccugcuaguagucuucagaugaagauuagagcucucaagccgcuccuguaccaugccugccuggaugcugccauguucccaccuugaugaacuuguaagccagccccaaugauguuguccuuuauaagaguugccuuggucauggugucuguucacagcaguaaaacccuaacuaagacauacaaaauaaaaaaaaaaaaucuuaaguuuuuaaaacucuguuaauguaaaauggucuauaauggcaaaaggcaaacccacagcugccuagaagagggcaugccuguaagguggcacuggcgcgcauggcuagggagggcaggacagccuuccugucuugguucauuguucgaaaugcccugacucaccacguuguccauucuugaugcagcuuaguaccugucaaucaagcuccagggaagcuuuuguguuuaagugugcaaugaaagcauugcccugugggguugugugaggaggcuccagucggcacaggugccgcuugcccaggaaggggggggugggugggugggaaaugaguugucaaaagaaacagggauuugccugucacugcuggugaaaaagugugugccccaacucaaaagcacaugcauccacucacucauuccuccacccacagaugacagacgagcccugaggggacagagacgguuucucaccugccagaaaccagagcaggggcucugcugaugugugcugacugcuccgugccuuggccccaagccugcacaucugcaugcaggugugagagcacacagccacagccagauugcccagcuggcugaacuggauuugggcagaugacacuuuguaccuuaauuucuucagcuaaaaaaacaaaaaaacaaaaaaacaaaaaaacaaaaaaacaaacaaaacaaaaaaaaaaaaacgaggaaacagcaauccugcccccacggggcugucacaauccaaccaauuaacacccgugugauucucagcacagugucaggcauucuuaggaccucggugugugcuacauuuaacgcuuuaugacuacaucaccuggagggacacaugcugggauguggcaaggucuuugcuagagcaagugucucuagucuaucugauuuauaguacuuuguuuucaucauugaagucaaugagagacccacaugugcaaguaggccagcaagcucgggagcuacggcacccacuccugcaacacacaccagcccugaaccagucucuccacugccagugaggacuaugaccccaaaccagagaacagagacugaacgcccuggcuuugggauuucaaaagcaaagacccagacauggagcagggugagccagaguggugaacaagaggcuaccucccuagcugcaagcuucaaagaggcucaagcaccagcauagggccugagucuggaggucacuaaaccggaaccccagagguucacaugugacaaccaguuucccaagccccuaagacggaugcagacacagcugacaagagcuggcaaccuuaccuccuuacagggugacaaccuuaucuccuuguguggcucacaccaacaaacccacuaacuuuggaucaggguuagguacuggauauugagccuggggccuuaacaugcucaaagcacucugccuugaagcuacauauccagcccucggggaagauuucaguugguuuagaaaacauagaauuaaacaaaguaguguuucuguagcuugaugagaugagggagggauugaucuagaaguuaaaacaaguuacagaaagagaaggaccuguguuuguguacccaaguuguccugauguuuguccaccuauaaacuuacugugacaguuugucaauaucacauccuagaauuuccaggaaagggacucucagugagagacuguguaguucaaguugccuguggacauaucugugggagauuuuuuugacuauaucagucgacaugggaagcccugucuacaguggguggcacccuucccuagacauccuugacuauauaagaauguggugguuugaaaaggaacggcccccaaagguucauagucuugaauuggagcaguacuacuugacaggauuuaggaaauguggucuuguuggaggaaguacgucacuggugguggugggguggagggaggguuaaaaugcucaagucaggcccagcguugcucucuuccuguugugugcauuuggauauagagcucucggcuuccucuccagcaccgugucugcuugugugcugccaugcuuccugugauaaugauaaugaacuaagccucugaaugaagcuagcccuaauuaaguguuuuguuuugguuuugguuuuuuauauaagagucacugucguggccauggugucuucacaacaauagaauacuaagaaagagagugagcaggugagcugaguaucuaugcauuaauguauuuaugcauuaacccauggcuucugcuaguguggaugugaugucaccaggugcuucuagcuccugcugucuugacuucucaauaagugacuuucaccgaagaacucccuuaggguguuuuggucaagguauuuugucauagcaacaggaaaccuagacauucauggcugucaacaguaaauagcuaugccucuggagcaucauggcaugcagggacccucaacacagauggagcgagacuuggacucaggaggacagaugagcggacagguaaggacacagagcaaggggaacgagacuggugguauaaaggcucacaggggcaucugugggaccuggaaguauugaacgacccacaaaggcauuuccucagcuacagcaagagaaaacaaguugagucuaagaccuggaucccaaccaggggccaugcccugugaagucgcugugguacagaacgcugggggaauguugccaaguugaugcuagagagacaaaugcccccagauccucaccaaugaccucuggcauuugugagguuuuuguccauccccccgagggacagggagagggacaacugguuauuucucucaugcuacauuuauucugcuggaagagcugcccuuuacucaagcacuguguccuuccaacuuuccucugaucagacauuagcgguacccaggaccuggaauucuucuaagucuuacuuggcaaaauugaaaguccuucacccugagugccauccaucugcacaaaggacgcacugccguguaaagcaucacccauggggagagguucacugacagugagaccaaggcuaaaugacaagagaggaaaggugucuuccacagccacgaggaagccugguuccaagggcagggaggaggaaacagagaaacugggucuccucucaacagggggccacaauuugaggaaugacuuggaaagcaaaucuugggaaguguguauguguaugggggggucuuucaccagagaggcugagagcagaggacuuugagggaggagaacaagaaggugcaaaggucccaaggggaaaguggacaagcacagacuguagaaggccaaugccgcaagcccuggugagggccgccuauggaaggggagguguggaaggcagaugcgugggcagggagaggaaggaagggccggcacaccugcuuaacaggaagcaccccugcccaucccagaucagucaacucuacugacauaggcaccugcuggaugggggauuggcucugauccuuucagaaaccccauuuuguaaacuggggggcugcagagcucuugacccuuugaagcuguggcuuuuaaaacuucagguggagggcacacgcccacaaaaacagcaaaggggauauucagcucugcacggagcagagcacugcauuccuggaaaggccacagcgcagccaugggcuugaaggcacucuccucacagggaggguucacugggccacguccuggaagaaccuauguucaaguaccaccaggaauguggagcucaccuccaccaauggcuagauaguaaggcugaugcucagcagaaaagaaagaggacgcacgggccaccuaccccuuuccuauagaugguguguguguguguguguguguguguguguguguguguguguguguaugugugugugugugugugugguugccuagaccugucuaucucuucugcaaaccuuuccaauggguacccgggaugcaaagccugagggaugggaauagucuucucaguugaccaagggcugccccccaagucucuagaacuuuguucccuaaauguuccaaggcaucuuauacacaggggacccacagggcauauuaaaccccugggggugggggagggaugcaacccucaguaguaccuggggcccaucggcucgcccaggauggaucaucuucaccacuggccauucuuuggauggcccugugaggaugccaugccuacguucuugggguuugcugagauaaaaggcaagggccucaacaacaacaacaacaacaagagaaaaacaacaagaaacaaacaaacaacaacagaacagcauuugaaacagggaaugagggugaagagauccaaugugacccaggguuugcgaguucacaaauauuugaaggguaugcagcccaccauggcgauauggucacaaaggacaucuuagaaagcagguaugucgucaaguggcuacuaagcauguucaccauggacacacugaggacucugggucuaaacuacauagauacuguuagguaguuaagucuaaggauaucauuuaaaauuuaaucacagaaagacuuaggggccaacaacccagguacuucugaucugggagaaaaugagcucaacucuccucaagacauacuccaucccaaagugagagugggggcuagaugauuauacugggagcaucacacaggauggccagauacagucuugaaccagugacugaaggacuuacuucacccucccaccagccaaugaaggacuuauuucacccucccacaagcccaugaaggacuuauuucacccucccacuagcccaucaaggacuuauuucacccucccaccagcccaugaaggacuuauuucacccucccaccagcccuuuugccuugagugcagacuguucuggcacaauuaguaguuucuuaguagucagcaugcuucuccugugggcauagugggaggcaagacagcuacaaguauuggaaccacccacuaccccuagugggaagaugagcugcagaccccugugaucaggggcugccagaagcugagagcucaucuggucagcauggagugugucucuuugguagagagcucuauagcuguggggccuccaucuacaaggucuaacugggacccagucuugccucgcugcaguagggaucuggcaagaacacauaccaaacggucaccuugaggaacagucacagccacacucugcauaauggcccugaagucaggacuccagaauguacaggcaggacguucaagacaggaaggauggcagggacugugggguagcgaaggcaucggggaaaagacaugggguugaggcggcuuccaggaggugaacagugggaggagacucagaaaaagcucgcccuggucccaggcucuggaaacuccuuccucuagaccuacuggcccaugcucagcgggcagugcugguccaagggcaggccucagucacuggaacuggacacuuaaugccucacuauucagaugaagcugucacgguaucagcugugaagggcccagccuggccucggccugacauuuauagucacaguauaaucucuuaucauauccaaggcaacuacaaccaugucacaagaaaaaaaaaaaugccuggagaaaucggaccaaggggcagcucaggcugccagaguccaucaaaaucgcuauuugcaagauucuccgccagcucuacucaauguguugccacccgaagugcuaaauccccagcguaguaauagaaagaguauucauaggcacucucggcuuccaguaagauguaggaacuuagcucacaucuuugaaaguauauaaauagccucagcaaaggagcugggacgcgcuucuuaguaaauacagcugacccauuuuccagucuucaccaggaauggagagacuguuacacggagaguacaggacaaucuaaauauauacuuccugcucacagggccaagagcagaaaagcagagucgaugcucugugaguaaggggggaaagcuaggcaggggagggguggcuguggucaccucuguaugcacagucgccaaguggauggagcugaacucuaucuaaugccugcuuggggcaaagcgggccacguggacccuggucucugcaggccauucauuccucaggaucaccuagccagccucucucacaagccccuccuugccacugauuuuuuuguucauuggccucucugugccuuugucucccguggcucuccuucaaagccaugauggcuccuccuuuugucaccgcagacuuaagaacagugcuuggccggggacaggcacacaguaaauaucuauccgacgacugaguggccuggcuuguuacuggcuccagguaagcuucuguuggcuugucaccaaccaacccagguggcccuucaguguagggagcuaucggccggccuggagagagcggagcauuuccgaugcauugcauaccauucuucuggcaagagcuguaauauuaaauaauucacuaaacccggcagacuuaggggauucagaaggaaaacugccccagugauugcaugggaggcaagcaggagugugccuggcuuggucgcuacccacaaauggaugagaggagcugagcagccaaucguaccccugcucccaauugucuaaccagagauggcugucaugugcuggccagagcuacugacaagucugcccucccaggucgcugcagaaaagcagcaggugagcuggaugggccaaauagagggaagggcaucugggcuggugagccaggcuuuccaaggcucggucugagggacggcaacagcuggggaaaccugggucaaagagcagacagacagcagugagggcugccaaccgaggcgaaggaaguagccaugagugguucccucggggccuggccaggugcugccugccagagggggcuaucuucccuucccugggaaucagaaccagaaaucuccagcacaugucaguccuuagcacugaacagccagcucauguggaggagaggcugagaaagggccuguucagcccuuccugccugccucaggucccaugugacgucagcaggucacauccuggagaaacagucuucuuuaaagaaggugcucuguacagguugaagagugcugcuuuacagcagcaagugccugccauccugggauuuuuucaucuguuucuggagucugcucuuuuauugguuauuucucuaacuugacuuuaauucauagucuccguuaugaucauaaaagacuuuaauugauacuuauuugauggaaucuaccuuauucaugaaauuuauuacuucauccaaguacaagcaggaacuagaaaguggaguuugcuacggucgccgugagcgcgccgcgccuaccagagggaagagggagccgcuccagcaguguccuuccuggaacucuuaggaaaugggggcagggcuccaggacuccagugcuccaaauuaaaaccuagccucccaggggagccucagccuuggccuacugguugcaaacauaggaugguuuuaaaacaagucugcccagccuccggccaagaaguggugucugguucccuccucaugagcaggcuggccuuaauggcuugcuuguaccuaagagccuaaagcagaagugacuugcuaggcugcucugucaaaggccaaggucuccgugcaucuggauccaaugugagaauucaugacccugaaaccaucaugccaaaggguuacacagaaggaggggucccccaaaugucugcaucucccccagacucucagaaggauuugggggugcuuguuccagaacugaaagagucggcagucguaauaaaugacugcugucuugcacugacugcccugucgggaguaauuuguuacaaagccaagaacaaccggaacagacaagccucaggaaccccaggccccguccagucccugucccucuguuccuccacuugcuuuucugaaacaggaggacugagggccagguaaagguucuugccaguguuuggcaaaaugagaagaauuuuaaaaggggagugggagaagucagcugaaugcaccccacuggagcacgcuucgucuccaaggcacgcccugccuguuguugguguaccuuuuaugagaggaugguaacucugugggaacuggcuuuuaacugccucacugggucaaauuugagaguuggccaucccguaucacaaauguguauaggauuugaccaguuugugacauccugaguagcugucacuuggacauuugacagaccaucauucacgaaauaucuucauuaaaggagccucuucuuccacccaagguacugaugaaaccccaccccagccuaucagcucaggugcuuggcacugcuuuaaaacaauucuagaucuccgaggagacugagaggcuacggccccaacaagaagccagcacccgacccaccaaugcagggcagugcauugcacagagacacagugaaaccucagggaaaaggugucagcagaugcaguuuccaaaaacaguguuuucgggucacagagcagaaauccgccagccagaaagcacugcagcuuaauuccuaaaaugguaaagaggcagaaagguucaggcuucagccccuggcuugcuaugucccccugguugcucuguagccuggggcagcuuuacaggagccacauccuaggaucugaaguagugagcacccaacaccacugggccagggccagacaagcugaccuuccuaguuggaagccaggagagggggcaagugucuguguccacaggacaucccacagggacaccaaggaggggcuuccaugcugcgcuucccacgguauugccucccuagcucuguagccaacuguggggaggcagagaugaaccguguguguguguguguguguguguguguguguguguguguguguguguguguggcuuccucggaugaggcuguggguaggccaggccagugcugaugguuuccagacaguggauaaacaacauuuugaagccacaauauuucucaagcacaaauaguacaguaaaauggagacauuuauaugcaauugggagacauuuauccugugacaacauucuauuccaaugacuuuucuauuaccaccaaugauuaaugauguaaauucugucacuugagaugauggaugcagggcaacugaggggccuuugcauagauuacccaaacucugucuucuuauuggcucucaggacaaauguggucugugcuucaaaaaauagucuucuucuucaguccucuccugaagcagcuggcucaggauuuggggagagguucuuccucucauacguuugccuguucgguguuagggcugcugacguaauccauuuaagaauaguuaccuaauucuuccaaaacaggagcuggggaagcuguccuaggcauugccucagaaguuaaagaaacacauucagggucuugggguugcugggcgcaacccagccugccagaucgcaaagaagccgauaccccugaccuugucacaugauccuguuacccggugucuuccccaugaccugcccacagggagcccauggcaggggucgggggugggguggggugagguauucauggcagagauaccccuggcagccuuccuaguacuucacugugguucugccuccgcuuuuguaaagcccugugccauuaugaacucuggcuagggggccuccagcugaagucacuguccucccucuggggcccagccagccagccaggccuaagacugaggauuaucccugcauggcucuuggccucaaccucagugacagaugacuauguccucaagguuccuuuucuuaacaagugacucugucauuucugucuggauccacacucuuaccacuguggccuggauugaggacugcgcgucucuggccucaccguucuccuggcucagaucuugcugaccuggauguccccucugagccaggagacaucaccucaucugggccuuuccauugcagccugggcaucaccaacacccacaacccccuucaugccacccucaggauuucuccacccuccuaaacacaucgcgucccacgaugccugccacaccucaugaaccugcuuuugcucccugccugggacggucuucuugcucugcucagaacaagucuccugggaaggccacaugggccucugccuucccugagagcaaccccacgguuccugcuggucacauccaccuugucgccuuugagggagagccagauacucucucaucagcacaacgggcacacaacuaagccgacuucucuccugcagguccagcgguuucuccuugacccgcauaaggaucuccaugauguccugaggccuggaacuaaggcuaguucacucugcacucccaagggugucuuccacagagcguagguggggugggggcucucugaauaugcucacuuacagagcaggaaggagaaucccagucugaaagggaaaccuagacgaccaguagccucauucagaaggcggagggaggcucagagcuucgaggagagagauugaugugcagcagacauccaggccuguaaaucacgcuguuguaaaggccguggagagcugcuugguuuucccugcugaggaaacucaaggcugggcggggcaggccuuacaggaacucagggcugcgccuggaucuggcuggauuccuggcacuccuaacucaauuuggccaucgcucucuccgaguccuuucuuggaaaacagaugagccuucuacucugugaugccugagcuaugccaacagguggaagagccugauccaguccagcuggggugagaccaggaacucuuccccgagcugaggcgcccuaccugcaggcaggaagggacagaggaaaccacuccccccgcccccuacccccaaaccucagugcucugggucucucuuucccuacccuggcagccuggucaccucccaggcucuggagucuuagaacaagaaggcagggauggcacucagggaguggggacaagccuuagagacucugggcuccaacaccagacacaaagcaugauggaacaccaaaaacaacgaggcacacccaagagcuuaaggacucagaccaagagugagcggcugagacccagugugagagggccuuguugagccauuggaaacccucacaagcaggagaguucugucacccuuguuuggcagguuccuuuugucuuuaaagacagagauccacgugaucuagucuagccacagacucccccaacagcugagugaacucugauucucccacuuccacuucccagugcuggacugcagacauagugaccacaccauuugcccaguuuuaugcagugcuaggacuggugcucagagcuucaggcaugcuggauaagcacuguaccaacugagcuauaucuccagcuccacugugaucuuccuagugccacuaacccagugacugcaccuugcuccccaugugaguggccaugguugccaaagguggacuccaaaauccagggguugcuuccuccagaucacccucccguucuggcucugcuguguuccaugcccucagacuagggacucuggccuuugcaaaccguucccucuaaggagaaguguggacguggcucuccugaaggccugcaauggccuccuuggccaucaaggcucuugacuacagccugggcuccacccuuagagcagagacagaugguuauggcugacugcuaaagcccccaggaugugacaguacaggccaggagagggaaauuauaaagcacaggaauucagagcacuuaaaaguuacugcauuucuagggguugcuuuucuggaggacccgagaucaauucucagcacccacauggugguucauaaccuucuggaacuccagucccaggagauaugauguccucuucuggccuccccaguacacuacaccuguaagugguacacagacauagggguggugccuacguucuuggagaaaaaaaaaguauaaucuuuaaaaauuucauaaauauauccuuuuugaaagcucaaacuacuuaaaggagcccccguuugccugacaauggagaguccuggcuuuaaagcuccuguuaaagcugcuucuuuuucagaaaauaauggcuugaaauuaauuaagcccaagaccaaugagaccgagccaggcaaggggagcguccugaugagcugcagaaccaaacaggaccgugucuccucucugcucacuccugaagcagcuguggccaaaagccugccugcaagcgagcgagcgagcugcacagaauuagaauucagccgagcugcucuucgcaggcaguacaguaugucuucauuggggcuacaguaggcacacaaaucaagauaaaaagcaggugagaugggaaaaagguguuucuagagaggagagagaaagcagcggcgcacgcccagagugagccaguaagccucagcagcucccagccggugugcggccuccaucuucccagccacaugcaguagcuucgccucccacuccugaguguccgcucugggagagguuuuguccaugcaaauggugccccgugcugccuccuacuggucagaggccacagugauggcuguaguguggccacuagccagagcagucuguuguuacaugugugugcacacgugugucugaaugugcuugguuucgagugcacauucacaugugcaaaccucgggcaguacucacgcuccagagaacagcaacaaugucagagaccagccucuccuuuugacgccuacacucauguggaugaagucaauaucauauggaucccacaaauaacucgucauugugcccagaauccccauggcacugugagaugcagugaggaucaacauggccuccugcaccucggaucaggacacuaaugcacucgaggcucugugcuccagaccaaaaggacacuuacuuugccugcggucuuacucucuccuccugaagcccccagcccgccuggagacccaagccgacacuacuugugcugcaaagccucuggggcucuuccccagcuccucccacugauuuucucuuagcacagagccugguggggcauagcuagaguggcuaaauacaaaugccacgcacaaaaccacaggagacacuaaggaaaggagaucagaguccugggcccuugaggaggaguuugggcuggaaacucagggggcggaaguacccaaggcaaggccaaggcucaccaaaagcuucuuuuggagccugagaacaggaaagcaagcacuggaaacuuggggucccccacccacuccaagcugacagugguuuaggacaauugguggccuaagagcugaccauggugcugaccaccaggggcagaucuaggaggcuguugcacugcaguucugggccaugcugagcaguccaaggagggcacucaggccacguggcauagccacacugggucagagcagccagggagauagccacuucaaccucccacacuuccaggcacagaagcuggccugguuuugagcccaggagaaaagccagucacacucauaggaugaggacacacaucacacacaggaugaggacacacaccacacacauaggaugaggacauacaguacuuccuuccagaaaauggaacugaaugaagcagggaugucaaucaguccaggccacaagcaaggauggaagccugggguccuagaaccaaggaaagaggguacagguagcaauuuguccugucacuauagcuccagguguggaggcuggguucacacccugccucugugguguacuggcuagugccuuugaacaggccucauagucugggccuaaacuuccgucccuguaacugguugcagggucccuucuuugggugccagcuguagagcucagcaacaggcauagaggcuggcaacgugcgggcucccggcccaagcuugguccuuguuggcugugacaguagcuuccuacagacugaggcaaagccuucuauugggaguggggucaaagucacaucuaaucugguaggugccaguccaagagcaagucgccaagaaugucauccaaaauaccaccccaacacccacaaagugacaaggcuucacaacccccacuggauagucaccaaaugcaaaugaccaaacuugccuauuucaccagagacagcacaguuaucuggaaagugcuaaggaauguuagugucugcaauucuugauguaaagguagaaaaauguugagaaccuggacacugacagaagagauggagaauauuaauauuucaucagugucccauuagcaacacaacacacaucuucacacuugaugacuucuugggaauauuacuucauucugaaacuaacagacggugccaccaacucucacccugcuagccugcugagcacccugaagcagccagucagacaggacuggaccuccagggugauggcugcucaagccaaugagagccagcauucgagcacuuccagacaggggccuacaacccugcgaauccgaggugaaucuaaaagcugggcuggagaggaaugaaaggccuuuccuagggcucuugagcugagcucaucuccaggcacagggcaggacagcggcugucagcugggggggggggggggggagauccuaaacuccgaccaccgagaccugcccccauuccuacccuauuagagccugaaaggaagaggagggcauagaagccaggauucagaggacagagggaggacccucagcucucacuuguguagaccacugucacauucauuugcucaacaaauauugauugugcacauagcgaggggccaggaaugugcugaugccagacacacagcugcaaccugcagaccuucaacgaagacaccuacagcaacugacuuaaguucuuagucugugcuucacagcaguccuucggguggugggggagguagcuaccaacauucccaugucccggaugagcucugcaagcaugguauauguggggggucucuucucuaugcuggcaagggccuggugcaagcucuauccaggccauaggacucccauaccccacgcugcuuuacccaucuugagauaacuuacaaaggcagccuaaggcacagaggugcucaugacaauugccagcagacagaaagaggccuccuccccgacagggccaagcucagucagaggcgacaagaggaguggccucuugggccccaaacuucccagcauggccucagagccaaacugcaguuuauccacacuggcucugggucuaaggcuaaguuccucuuccugucuguccaagaagcagagggcacuagcccuccagggacucccuccccagcucccucuaacuuggucuauuaauuuaaaacccaggaaacuggccagaagugguaggcacaggggaugucugagagggucuaauuacugcagccgcuccaaauggaagguaacaccuugucuccucauuagcagauggacugcaauuuaggaugacaaccuggaggacagcgauggggacaugugcuccccugcagguccccaccucaccgccacuuuaauuuccucacuguugagugguuaugagcaaagcacucccagcagaaggcucugaaguucugaggaagcccugugauaugguucugggguguguaggguccaggcccagccaccagaagucccacauacagaccugugagguaacaggaacacacaccucagccuuuaaaaguauuuucucauuaaauauucagugugaccauguugacugugcucuauaaacagauaugguacaagaugggcuucaaggacacagcaaucuuccucaacagugacacauugggauucaaggugcagaggacggcuccccagcaguuccagggcacauaaaguucugucagaauuuacacuagcauuucccuaucaaaaacaaaaacaaaggacacuuccucagcuggccuugucuuaggagccucagaaaugucuaugcagugaauuaaccccucaaaauuccauccuagacuggcuuuuagagagccuccuuggggugcugagccuccugaguaacugugccccaaagaaaguagaggagcccuggcauacacugggaaaaaaaccagaauaacuuugcauggcuuuuccuagggagacauaaccuaggggagagaaggcaccgaggcucgagggccucguccagguggggucacucacaggagaagcagaacaagcacgcggaaggcaucuccaccaccaccgacagcccagccagucugucacugacuuccuaaauaguagggggagggagguagagcaaagcucuccugaacuucauggcccucccccaccgcaccccccugagggaaugcuaacaggcugggcugguacuguugcccuuggguugucacagcugccucugcccagcugagacagcuacucuauguaagcuguaugaguuucaggugaaggcuuuucucuucuacccagucagguauuccuggggagcuggagcaggcugggcucaucuggaucuugaacucggccuggcagacguggauuaacaagaagucccuuggaucgcugugcagccaccagagccugacaggucgcaucaccucagcucuggaagggcagcaagggcuuuguuugaucccagagcagcaaaggcugaaaagcagagcucuugaguuucaggagagcucugacaggccagcugaccuccaggaacaggagacuggacagugugcugcucuggaguuugugcgggcugacugguuggagaaaagacacuaggaggaaacauuccuuggcuguaggcuaaugcuuuagugagaggccauugaucccacuccacuccucuucggaguugaaucugagacaagaauaguugagaacuguaacguuugugcaagguguuucacaaaagccuuccucacacagauauugcuaggccacacaaucagcccaagguuaugggugaacacaccaggacuuccauguauugggacuuacuccugucccuaagcuagagucaccaugaaaacuggcagguggguuuuggcucagugggagcaugugcgacgcccuggguuuaugagccuggccauagccacgcucccuggagcuuccccuccuaacaaggcaguucugcauccugccaguucaacucugcccugagcugaaucuaucugccugggucuucuccagugcuccucucaggguagggaaccuaagcaccagagaacugcacccugcaacagaaccuccaaacccaccagcccaaaaugaagcuucccagauuauggcagcaccaguaucaggaccuggcagccagcaugcuuagaugguguugcuuagacacucucuagguuuguuuucaaguacagcuggauaagaagacaaacuagcuucccaggaguauuuugaauuaauucaaauauaaccuaucuaaacacuacagaguguaaaccacuuuguuugcccuuucaccucaauuauuaaaaguucuuaaaacuauccuguucacaccaaccacuucagaugaccacagcagacaguugucucucagaggccaagaaacccuuguuccuccacugcagagcacuggauguaacacggccagggugcuuguguuauuauguccuucaccuguuaucauggcaugaugccuuuuguuacaugauaaaauugaucacgcggcuccagcagugggcccgcaguguucgugugguucugaagacagugggauaccaagcucaccugucaguagaaaguucuggugaaaggguggauugccccagagcagcaaaaggagggaacagcgacacccacagccgcccuaggcuggaguucacaccccacacuguccaaggugacccucagcuguguuuuuggucuucucaacucuccaccccaaaaauauaaaaugaaggagggcuguacuucaucaaaccagaagccugcaacacaaaucccucuucugaggaaagcaagcuuguccgaggccagcuguugagagugaggugagcucugacuggcuguguacccugagcaccgcuggugcaugcagccaccaggccugugcuucagggcuacagagugcuaggggcucccuccgagucauacaggcgugaagagacaaguagauguaggcagccuccagggguaggacagaguggaaggccugggagcugaccguggugcugaccagggguagccucugacugugggacauaccuccaagaaaauuagaaaaguagagaauggggguauacucagaaaggaaaacagaggacuuaagcagaacuguggugagggucucuggaagaaggaacagggaucgaaauggcaauugcuuagguaucugggggaaagcaaguggccacuaugauccagaaaacaaggggaaaaagacuugagggagagaggucacaagggagauuucugagagcccagaaaggcacagggggcuggaggacugugcuggcucccaggaagaaucacuaaggucugccuggcucguggauuaugucugugaacaguucugggguggcugaaggcagucuucccaggccaaggagcucuuacucccaaggugggcuagcccaguaccagaugcucacuggugucucauaggaagggacaaucagcccaagggacagcaaacucacugacagccaguuacaugcaguccugucagacaccuugguucacugaaggucacagugcugcauguggucugaccacgcucagagcuccugacugccuucaucugaaccuaacccacagcccaucucacuuggaagcaugccugcaucaaacugcaaccacucccccucaagccucccagaaaggugggagguuguggggcaggacagagaggggcacugaggagggcagcugcugaggcagcaauuucaucuguccagucuccuuacaguagaguuccuugaggucagggacugcgucccaccauccaucccugagcccagaagucuggcgacucagcagauagcaaguguugacacugccgccuggcuccaggaugcccuguaacucucccuguuuucccaacucaaggacaggguggaaaccacacaccggauuuaaaaaagcaaacagacugaaaaaauuagaacagacaaaacgaaagcaucugcagacagaagccuuaagugcuggcuaccuggaagguggaguuuccucuucauccccuggggucccucaggagaaaggcaggcuugucaaggagcaugcugcagccugcagcucucuggccggucaacaccauuccuccucugcugcccacggggcucaggaagcaaggucuuaaacuuagcuaaaaugcauauuuugauuuacucaagaaacucaaacuggccccaggcaaauaauaacugcaugagaauauuucauuuagcaccuuccccucuuacucccuucagggagaagacugcugcacucagaagugagggggagggaaaauuaaauaaaaaacacaucgaaggaacagcuacagagugggaaaaggaggaaugugucucagagccgaccuccaaacucacagcucuggucugccucugaaacaaucucacugugccuucugcuguguaaacaguaaguauuaaaggcaucaauuaaggguggcuagcuccaguguucccacggccaaggucucuggcaugccucccaccacccucacuugcuauggcagcagaguagaagcaucuaaaauaccaccuuuucucuggcuguuuaaggcuggaggaagggcugcugccaacugcccuacuagaggacagaggcagauacgccacaaguuaccucugccccuccaacugacuucaguagcucaggcucagccaaagcacaaagcuugggagaguuccuuuuuaguaggcuggcaguucugucucccagggucccuugacagggcucuguucccauuucucuucuccccucuuugccgagaagaccaucuugggaaaacuacugggaggauuauuaggacccaaaagagaagaaguuccccccuccucugaccuuagauggaaagccugcacaucaaacagugguccuucuggcucaccacaguauauuuugggcaacacagagguucaggauuacagaaaggcacuggacuccugugaccagagcucaggcauuccaacagacuggccaagggcaugucccuuggggacaucucgucugugugagacucaaacccaguggugaagugguggcaccaccagccucuaugauaguagguacaaggcuguguggccccagaagaugcaagugagagaugcaggugcuguccccagggaugccaggggauggcaauggcaggguuaggcucccacguacuuccuuacucaggugcagcaagcacagagcaggucaggggcaggguucccuggaaaagcucauccccauucaccugagaacuccggguccucagcauggggacaguggcuuuagcagcauaauguguaauauaaauaaaggagauaaggcuaagaacaaggaggcagauaccaucacagguaaauggauauguguuccucuagaugggaaggcagcccagagagaaggccaagagggaaggcuggccaggaaacaggagggacugaggaauggagcaggaggacagugcccugaaugaaagggacaauggacaucagaaaaaaaaaauguucaggcacuccagaacacagaggcagaaaccagaccauggauugguaacugagaguuucaagcagagccaguaguggcacacugccugcaagugcagcccuugcagcucaggcagaggaaggcuaagugugaggccaaccugccagauagaauuaaaccuuguccaaaaaaaaaaaaaaguugucagugaauccccaaagaaagaccuacucaguguggcagggaggcagacacagcauaaacaguagugcaaucugggugaaauuucacuugagacagaacaagucugagcagagguggugagcaguggucagcucugucuagacaagcggucugaauucagcagcaggguacacucagguaacuggggaacugucuagacaugauggaugacaccacccuuaagaagugcuuggauagaccaaagcaagagcaguaggguucaaagaaggccaggccaagggcccaccuccaccaucauccacaccccuccuucccaaugugucugagcugcagcugccuuggcuuucaaggcccgcucuauggcugggcacaugcaagucccccagauauuccuaauauggggauaauacgggaguaauacaggguuucuauagauggacaacuggcaagaucccagagccaugggucagucagcagcugaccuguuugcucuugccucggcagaccaacaaugugcaccacccagaaacuaagguaugaaggauucauccaacagcagucaagcaaacagaucgcuauugcaaccugggauucaaguguacauaaaaggccucauacaccaggcauagugcagucagagguacagacgggaacucaggucuccuccuggccacuucccuucugucucauggucaccacuggcagguuuccuuggcauucauguccuuaugcaagugcugaguaaacacgucucauucuggaguuucgccgcccgcccgcgguagcuaucagcaguucuguaauacuccauuaaauguuugccagcugauagauguggguuguucccaguuugggguuucauauaaacaugauuguccaaguccuuuaagggagcuuucauauuuauuucuuuaagguaauuacuuaacaggggaauugcugggccauaauauagauugcagaggaaaaucauguaaaaccucagagacuguaauucuuuuauuuuuuuccacuuuuauguaugugcaucugcgugugccaaguguacauguggcugugaaggacagaagaggacacuggguccccugggauuaguuuugagugcuaggauagaacucugagagcaggaagcgcucacagcugcugagcaucuucccucacuucagcagccucugcuuuucagcagccguucccucacugacccccuaauggacacugcauuuucccggguuccugguaugcagcaugauuucaccacacuuauuaucugaagaccuuccuuugaauaacuccuguuucagacauucauggcuaacacucuuaacaacacacaaacauguacccacagccacagccaagauaugggagacuucuaucaucccagagcuccugggccuuugcagcggugaacuacccacaauccucugcagccugacuccuuucccaucaaaagccuucugguucuagucuuuuucugaacuuaagacauuugaaagucauccacuuucuguugggccucacugcugucuccacucuccuguugaaugacauuugggcugcuuuuagaucuagagaucaugagaagaaccacagaaaguguucauaaagauguuucuaucaacacagcaucuucucuuaguuauaccuugaagaggagcugcugggucauauaauaaggaacaguuuacuagauuuucuuaacguauagauuuauuuuuaaaccaaaccaaaccaggcuugauucaagguguggccugcguauucauuucuaccaccgagcugaguuucaggugcucugaaucuucaccacuuggccacacuucccguguuucggugaagacaguaaguguguacugguauuuccuugugguguaauuucccuggugacuauugacaagcauccuccaugcauaucacagcucucuguguaucgucaaguguauauuccagucucuugccugucuucccauugggucuuaguauucccguggccuaagaguugucugggcaucauacacaguccugggagaacccgcucugcucagugugccuuccaggugugccuuggguuccaugauccugucuuuuuaauuucugugaaaucugacauucacuucuuacagaauguaccgaaucaagcagucucuucuaacccaagccuuuggucuuucccucagguugcaccauccuguaacaugaacggcaucuacagccaucuugaguaucuucugcacagucgagggugaagaccaggcuuccuccucucuuacauggaaguccaggcgcaugacucugauuacaauuuguuggaagcucccuccauugaacuaccuuugcaccucugucaagaccaacugaccaagucuaucuguggacucucacauuugccccacugaucuccaugccuacccuucugcaguaccacucaccggcuugauugcuagagcuguauagguaggaagucuggaaaccaggcaaggguaaucuucuagcuuuauucucaaaauugaauuguuuuccuauguccucuguguuuccacauaaacgccaacaggcagccagcuaaaucuggaugagaaugacacugauucagaaccaacagguaccaugaccguuaccaaaccaucugacauagugcccucccuccucuuacuuggcuauugaaguucugaggucacagucacacacauuuucuuuaaaguguuuaugugagggaugcuaaccauagucaauauuguuuucaaaucuugaucuuaguuguugauagauaccccaucaaacgcaaauacucacauagguaauguuuugcuuuguuuggauaaaugcaguuuauuguaguuuuuccuaauuauguuuuuuuuuuuuuuaaaauaaagguuaaaauuuggcgcuccacugacugucugaaacuccagacaacagguuguuuucaacaacuacaaaguguacagaacaaccgggugugcuggcgcacaccuuuacuuccggcacuugggaggcagaggcagguggaucucuguagauuugaggccagccuggucuacagaguuccaggagagccagggcuacacagggaaauccugacuugaaaaaccaaaaccaaacccaaccaaacaaaacaaacaaaaagccagaacaaaacucaagagaaagcuuacuuucuagauuuggaucacauaaggugacaaaaugcagccgucagagccuccguugucuucuguuaccgaugcacucacucucuuguggggccaaugggaaccugccauaccacacagcagagcaggacccuguaggcacagcaugcagucaggcagcaaggagcagagaccucuccacacacacccaguauuacucugugugcaguaccaggaccucauccugggaagcaggggguggggguaaggguggggcucacgcccgaccugcagagcucucccucucauccucuucagagcuccugagagugagcugcugugaacagugcucuccccaacagcgauccacaagacgggucucaaucacagauaacugaauaaccaacuaaaaacacagcaggguuugaaauggggaaaaaaaaccacaggccccagauuagcaagaggccacaccaaucaccaaguuccugguacaauuaccgacauagggcagaucaucagaugaaacggaaucagaugaaacacggcauuccugccgugugacuguuucugucccuccugcaguuacacgaucugacuaugguccucaguugcaucugugguggcaucugcuaaggacuucuucagaguuaauuacagccuccaccacagaagcugccccuccaccacgcccaggcucucacccggugccucacacaccgacuucauuccuaugaggcaguggagcugugucucaagugucucaacuuagauguauacaacuuuuaacagaggaguaagucuccagcauuccacugccauucgaucaaacucgaggcaagugauugcugaguucccaauuaugcucaaccuuaaaucacuguuugcacugauugcagacccagcccugcagggaguugugcaaaagcauauauuuggcaagcuuucaaaccacggcaacaaaacaugugcugaggaaaaugauucaaaacauuaagaaagcagucauuuauuuuagaaggccuguucacgugagacaauaagcugcuucccagaauaggcgccauccaucaggaaccccuaagcccagcacacacuggcuggagugugccuuucagcuaucauggggccuuggugacuauuuaucauccacaugcauccaagguagaugagcagacugggugcaugcccacaauggcgcacaccugccaugggcagcaaagcucccugcuugagagcugugcccaaggucagaugaccucgcagacccuagagacggauggaccugaguuucaacauaagccuguggacacagaggaagaggauagucaggcugccuugaugcuggauggacaugauccacuucuauauuuuuaaaaagugguguguuggaacaagaaaggccauggcuucacauuaaccaggggccuccuccuggcuacagguacuuguagaaaucagguuaguucagcaaacugagccacagcucaggagagcccucccagugccuuuccugagcagccccugggaaaccaucuguaccaucuucaggggccgacucaugcaccaauccuacagcaaucccaccacucagugccuccugugaacuucaaccuguccgccugcauggaagacaauacacuaccaauaaaccggaggcaugagcagcagacggacccuacuaaaugagcacagugccugguucucucagucagggcacacgagaaguuuaacaaauauuuaaucuccucaaccaauuuuaggaaacagucagccaaccaugguagcaaaaccagagugugagcccugcucaggaacugaaccucuggagccugcuagguaacaacaucagagucauggguguuuuuagaaaccucuaaacaugacucuucaaaggagagagaaauuacagacacguaguuacccagaaaucaaugcaaguacccuagccauggaaagaaaggcuagaaggacacagcccuuucuagcaggaaacucuucugacucuucuaagacugggagugggagcuguccaaggauaacaacucauggcccaccaacuccaaucagcaugcccaaaagcaccaaucccaugaccucaugacuuuaucacuccuguuuguuagacagcaucaaauucacuguacacacaacuucuaacaauauauguaggagucccgugaccuuucaaccccagggucccugaccagcagcagccagguguguacaagaauacggcugcaaccuucuguuagaaacuaagccaccucguuaacuucaaacaccaucaaccaucgguccagucccaagggacaggauuugauggcaugaagugauaagauuuuccaguaaaagggaaaguucauuaggaacgaaaauaccagagaccaguggaggccaacuguccuccccacacccugcugaucuaaacacauccgcucacugccagggaaacccgcggcugcucuuccaacaguggucaacaacagccuugacuaaucccuucgcucagacccagcacccaguggucagaaaaggccagcugcucuguucccaccuuguuuguucuaaguccaaccugguuccuaguugggcaguuauagcaccuguaucuccauggcauuaggcuccaaucaaacagaagagaucuucagcaaccuaggcugauaaaauggcauuccaucaaaaguggaguauccaaggagcaguaaccacgucucgggguuuguuuguuaaagaguccauuucacuauaguuuaacagaggagucacuguuuacaacccaaccacuacaaaacagcaagacagcagcaagaauggaaagucccaccgggagcuuuugcucagcagucaggucuccugaguuucacaacccaguccccaacuagcacauucaagaccagagugaguacuucaacagacaguuuggagaggcaggauauauccaaaacucuaaguuggaaauguaauucuugucuucccuaaggaaguuuuguguaagagguccaacuagcuccgugagaacccucacuuuugcaauaucaacagcugucuauauuuucuccccagaucuaguauggucagggggggaacuaaaaagucagaugcugcuagcugaggucuagauuuuugccaauaccuguauauuaacagaucuauuuccaggccagagugacugcuaaaccuggaguguccuuaucauacucgacagagagaugucacagaagccacaggagauagcuucugccucucucaggaguggcccucugcagucaggccaugccagcucucuggccccagucaggaagucaaccaccuaucgagcucauacuauagccaagaaccaggacauuagcucuccaucccgucuggagucgagcauccacauaggacauguccucugaggguuucaugaugccugagaggggcuuaguuguccccgggggugugggggcagucuccucccacacaagcuccucucccacacacucagucaacaacuaccuguacucuccaggcgcuugacugcuaggaacacagcugagggacacagaccugagagcgcuccuguggugggggaagagacaggagccgagauaaggaaauaacugcuugacuaauaaacaaaagaugcagugugaaugacgcagacugaauacggcaguggcaucgucugaggagaugauccucggaaggagcccuggcugguacagaggagccaguacauacaagugggaaugggcugacgggaaagcuugcuagguagacaaaacagaggagccuaagagaaccaugucugaugugcuccagguguggacagcuucaguaaccagaggccaaguaaacaaccuguaaacaaguaaacaaccuggaggggggaggggaauggggaggaugacaaggcaacugccacucucacuucugggcagauaccauggcuacugaacagggaggcaaagagaggcagggcguccaaggaggaaaugggaacagcuguccagcaaaaaaggaggagaccuggugcuggguggagacauccagucugauccagguuagaaggaaacagacagauggaucagauguuugggauggggaaaggcaaaaccauggacacucagagcucuggcuuuaaccaacgaguuuguauaaacuguuuauguucuaugagacggggcguacucagcccaggcuggccucagucuccccagugcagggacugcagguguggcccggcccagcuuacccuucaucuucacucucuuccaugcucuuucgcccacacugacuucagcccucagcagcuucuaacucggaugcagacugcagcgcaucaaaccaggaccugccggagccaccccucucuucccagccccccuccuuccugaagagccuggcucugaggcccuccaucagcagcaccacucacagaacaacuuccuaucaccgggcuuuuaaaaacagguacuuucucuagcuugaguuuaucacuguuuaaaacguugugcuaguuagcaguaauuauguaaaugcaagcagccauuucuauuuuuaaaagggaaccccauuuagcauucuuacauccugagauguuuaaaauagcuaguccaguggugccuucgcuuuauucaaacuguuugcggguuuaaauacagguucagcagaaaccaaaguaagccaaacauuugcuuucuauuaaaugucuaaaucagaggauuaaaaaacaaacuacuuuacauuugacagaaagcggccaucaaaucagcaccauggcagcacacugacugccagacagcaaugacauuggagaaagaaucaauuuaggaaaggauggauggauuucuuuaaacucuucaaaaagggagaaaauacauuugagcaaaucuuuuaauuauagcaucuuccaaagaaccuacaaagccuuucuucuucccaaaccuaaugcuuuuuaaaggcagcuuugccccuuaauuccacaugaaauauucaguacagcauaauuaaauuuuauuccaugcuauuuuuacuggguucacugaaauagagggugcccgcaucuuuaaaacaaacuucccagcaacuuagcuuacacaauaaauagcugguucucaaaacuaaacuuaaaaugcaaaaccuacuuuaaaggccccugccacugcagggcagucacgcagguacugaaaagacaggcucgaucccacgucccaccaaccuucacagaagcuaccaacccagcuguuucccugucuuugccgcaggcaccgggcagcucauuuuucgguuucucuguggugggaaagguggcagaaguguagccaagcaccaccugcggcugagagaccugugguuucacuauuuggauaacuaguucuugguaagugaggaguaggccugaugguuuggaauuuuuauacaaacugaaaucauaaucacucuugcaguuaggaucaguaaguggguuacggaguccaacacaagagacggggaagugcuaaguaccucaaacaguagacaggacagcucauucugccaaaguagccaagcacuauggccauucaugugggcucaagagaaaaauaauucacggugauguaaaacuccacuaggaacaacaucuucacccuggauuuugccaaccugagauugccucugcugacaggauuacagaguucaagguuuauggaucacagccagacuguccgauguuuuacaaagagggcaagcaaaccgacaaccacgauuugcacaacagacacuagaaauuuuaaggacagccaccagaaaagaggcucgggacagcucuccugaaccucuggugccagacuacaacagacaacaguucagacauguuuucggcuuuaaugaagcuguugggcuuucagaggcucaaaacuuaucucaauccguucgucuuugcagagucaccuuuacuaacaaccgaaaagguccucauggcacacaucuguagcacuccggaggcaguggcaggaagaacucugaguucaaggccuggucuacacggugaguuuccaagacagccgggguacaaagacacgcucucaaaauaaacauacaagguggcacucaggaagagaagggaggggaucagaaacgaaagacuguccucggcuauacugcagcuagaaaaccagcuggagucaagucucaaaggggcagaaggggaaagcagcagaugcuaccuaccaaacucaccaaaguggcugaugcuugaagccuagagcgcuguuaccacaaccaccagugcaggggacucagcucagcugcucugagaaauggacaugaaccaaaagcaaagacgagcaagguacacgaccaccgcuauuuaacuuucauaggacaggaauggguauuaucuaauauacagccaccuccgucacacacgccaacgucuucucugaagacgcucugcuguuuccauccacaguccgacguuucuguaaggcauucugcuaucuucucaagaacuugcccuuaccgaggaucucuuucaaauagcucagcggcacuuagaaaaaaaugcugcacaucucucugccgccaagguuuaucugcagcacagcaugcacccagagcgcagucacuaagccucacagaagcagucccaguuacucgggagccauuauggugccaauguagucaaggcagucaucacuuacagaugagcccaugcugccugagcccugguuucuucaggccuaacaaugucaacuccagaacagcugauaaaggucuagaagaagggaacugucuacgggguaucaaagaauuauuaugcaugaacagcccgaugucagcacaaguccucucagugcagaggacagcagccuuuucaaacgggcauguuacaggagcugugugcuagaggugcugggcugcuugcagaaugguuaggaccagggucuguguucucacugggacccuccacuagaucaacccuugauccucuuacaucaucuagcucaugaaaaagggacaguguucucccuucucauccucagcauaaagaagcaaggugacaagugucuggcaugucacuuucuuuuuuuuuuuuuuuuuuuuuuuuuuuuuuuuuuaagauuuauuuauuuauuauauguaaguacacuguagcugucuucagacacuccagaagagggagucagaucuuguuacggaugguuguuagccaccaugugguugcugggauuugaacucuggaccuucggaagagcagucaggugcucuaacccacugagccaucucaccagcccggcaugucacuuucuuaaacugaaguacaugaaccucaaggagcuuccguguauuucaauaacuguacuuaacaguagcuggcagacuagaugaagaugugcguuagaggggucugaacuggaguucugccguucuaaaggaacaucuggggaucccuuacucacugugaaagcagacagacagacagacagacaguaguacauugucuucagucuaaguguaugagaagcagcuacgagauuacaaaacugcagagcugaaacacaaugccauggacugcccccucucucucuucaggcugcacacagcgguaaguauacaaauagggagaauacuuacacauuaugaugcuggaaaagcgcagaaaguguuucuaacaucaaauagccagagacauggaacgaagccaaaacagaagguggucugggacaagugccaggucuaccugcaguggaaacucacauacugaaggcaaacauuucagucuucagcaaaaugcuaaguggacaccuacacccgauuugauccaggugcauugauuauaaagacacucuucaagaaaacccggcaguaucaaagcaguauguguaaacucagucucaucuuuguaacuuuguuguuaaauuaugaagcuaacccaaaauaaagguggcuuuuuuuucuuuucuuucuuucuuucuuucuuuuuuuuuuuuuuuuuuuuuuuuuuuuauguaccaaaggcagggcuugcuguuaagcagaggaaacacgacuuucuuuuagcagccauccaggaagguucaucugucguuggcccuugagcucaucuuuuaccuucauucucuucagggucucacacacaggcuaggcucccucccuacuucacaauggccacauaaggcagagccauguccccaggcccuaaagcuguagagcuagagacagauucagugucugcuuuaccugaugccaaaauccaaaguacuagaaucuggccaggguaccucggagggaaagcuggcuacagagaacaccagggagcacauaaggucaucaagaccuaccuacccacugaguuggggccaagcugugccuguaaaucacacaaagcuagcaggcaggaccuuuucuuaauccaggaacugacagcaaugccccaucucaaaaaggcagaguaaggaaugcaucugaaaucauuucauagaucccccugggaaaucuaaauggcagcaagcccaucugagaagccccccacucagagcacugcuuucaacuugacugaagcuguugcuaagucaaccccauggcccaggcuuaguggaguaacuaacuggcaggcaugaaacacaagaaaaaagacaaaauucaaguggguguaaaucagcaaccaaggggccuucaaaaucacaaggaaaggcuggcaaaaaucuccauguaaagugacuccucuuuaaaggcuccugggucaaaguuccucugccugauguccucuguguaccagcagagggcacuaacucaugcaaucacucuugaaaagcuuaugauauguaauacaaacuacaggaacacugaaugagaacuagacuuuaaauggaugacgugcuaaauaugcgauuuuaaccgugacuuaaaacaauccguuucacugaaccccauaaaacuuaaagguacacacacauacacacagcagaagcauauauauguauguaaacaacagcaagccaaucagaucuuuagagugauaaaaagacauuucaaacuaaaagcagacaugaagaacuugacuucucuuccaucuuuggccugagcgaucuguaaccugguccaccucugccagcuccuuucacauaggcacacaacaggaacaccaaccaagaaagacuaguugauuucuuaauauaagaagccgugcuugaugaaucaggaaggagacguugacuguaacaaagucauagugcacuuuauuaagcggagcuucaaccccucuaagaauaaagagcaugcaguuguguucacuauguccuggguugcuguuccaagcaaguuaccacacccuuaccaggauuaccacguguuacccugcaccaggauuuacucacgcacacaauucugaggggucugugagcucugccucguuagccacuuccugcaauuacauucucagcucaaaaccuauacuucuucaugcgcuuccaccggagggaaaggccacucagugacaugccuggugcaggcagcaccacuaccacagcuuuacccucuggguuuguugugugacacacaaagguuuggacuucguguuccuuaaaaauggcuaugucugguuugaucgaagcuauuagacacuucccaagugaggacaacuuggguuugauuggcucuuuguccugguuuuaguggacugcuucuguguguaauaagcaaaguuuacaauugagaugcacaaagcugacaggugaaaugcacuacccuggagaaguuugacgcugcagacuugucaucagaaggcaccaucacuacagacucaccuugagauaauggcccacaucacagucuuuguuacaaaacaaaaacuaaagaguugcaggagugaccaccgagaauacacaaagggcaaagauggagagugaaggcugcugggccaggacuuuuguugucauucucuauauguggacuugcaagcauaacaacuggcccaugagugcucugggcaacauaggaauaccacagaguacaccuaucccauacacuaagccaguccugggaccacgaaguccuaaacucucaugaggcagcuacugauggccaagaugucguucccuccagccccacuuguccuggcuaacaccugcucacuagacagcgcgugggcacugggauuacuggguaacugaagaacugggcacugggaacugucagucacugcgaucacuggguaacugaagacuacucagggccucugcuggcuuuuccaugucccuggacucuccucagugacggugauacuacgccacgccagugcagugacucacauuccaucugucugcugcugcaccauaaacaccacacucacaguggcucugcgauucaugaucccaucaucuuggauacucuggcuucucgucccucccugaacuagcugcaaaacaagacuuccuacaugguaauuuucaauggcauacagcccauaacagcaaguuaaagacugagaaaaacgcaacacuaguggcccacucguucacugaacagcauuuauugauguaacaggagcugccuguaugcuggcgacagagacagcaacaggcccugcucucacggagcuuccauucuuugggaggcaguaaucaacacauaaacaggucauugcugugguaauaagaaagggaaguuugcuggggggaacaggggcacagggaauacauggugcaggccacuccccaagguaaguggcugcuguacucuuucacagucacucuggaugaaguuuaauaggucacucaaaucucuuucauucuuaguaacauucaguucauguaaacuugggguuuaaaguacaguuaacucacuaacagaacuguccugagacaaucaggagcuggcagggcagcgcgcucccccuaugcgcucugcuggcuuccgccccaugugucagcccucagggcuccagcucugugggccccucuucuugcugcgcccaugaacaagugugugcugagagccugaaauaaacaggugugaaaugggucaagaccgucgcuucuauuucuguuuuuaacugaagaaaaugugccccacuuccagaggcagagaaagaagagaacaugggaauaaaggccaacuaaaguauauuuuauacacacaugaguguguacauguacaugugucucuaccccacacaugaccuauuucccuaagguaagucaaaauugggccuuauguaaauaucuuuuugacaauguuacaguauaacuuuuauuaaacuauaacucugagagaccacaaaacuuuuaaaaaaucaaauuagaaguuaaaaguuaaaaaaaaaucaagguccaagcucaauuaacacuaauuuuacagacgguucuuacucugcauauucagcacacuccuggaguuuuuguguuuuucugacauggcgucccaggggagccguuaggcacaaugagcucucuaauucagauuaacaugucuaaguacauacugauagagcaggcgacaccuugagagugugcuagagugugucugugaugcacagcacugagaaggccggcuuaacucccagcaccuccagcucagcaccacaggccaguuucccagauucgaaaaauauaguauuucuaagggaugcugaaggcuuaagucaaggacacuuuuuaaucaauguaaggucuuaacaagcugccagagacuuccacugugacccugaaucuaccacagagcacgaaagugcaggagggaagccagcggcccaugccucccuugcuuaggagugggcagcacugagcggcagacagcgaaggggagagcauuaggcuugcuagucacagacaugggagugaaaggugcgggcauggcugccucucagcccucacaucagcacacuguacgcaggacaguguuggacagugucguucagggcuugaggggaguccaaggaccacaguuccaggcucugcuaaguguaccaugggccugaguaugaagaggauccauggccgucugcagaucaaaggccucaugcccgaaacccagguguuauucaacuaagugagcaacucgagcuaucaggauaaauugaagauuucagcauaaaucgcauguacauauacugugacaucucugugucaaacagcagcuucugacuuauuuccauugcucucugcacauuugcuuucugcuacaaaaaucuuaagaccugcauaaacaaaaacagcauuuauucuucucuucuccacagaguugugaaguuuacucuuaccugagggaccucaccccaucguuucucccacccccaacccugauuccuucucucaccaccacaugcuggugccaggcuaggcucuaggaaacaggaagagggaggcccagcaccaacuccagagagcuaacucacugcaugaaagagacugugacaauacacugugguacgggccaucauacuggggccacaccugcaggaacaguaaacuggagucaacugcacugaacagagccugagaaaaggguucaugagaaggggaucccagcuggccugcagaagaggaggaggaagaggaggaggaggaaaaagaggaggaggaggaagaagaggaggaggaggaggaagaggaggaggaggaagaagaggaggaggaagaggaggaggaggaagaggaggaggaggagagggaugggccggugcagcuaacagaaagcagaacagaaggggguggggggaucaagaggcaagcaaggugccacuggguggggacacacugucaggggccaggguuugguucucagguguguacaugaacucucugaugaagacaagggaugggcagggaccugcguaaagaagagcaaacaccagcaaguuuuuaaaaacaaaucacaaguuuaaauguuauacccgaauuucuuuguuguuguuguuuuuaaacacucuaguagcccagaucuaaauuaaaaacacugaacaaggaucacucacuuucccagucuagacaagcugaccucacuuccaagacuacaguuccaugcaugccacuuaaguaacugugcugacacugccuuucaaagccugacuuacaagugacagagaaggcagcccguccucugcggggccgcugagguguacuucucuucaagguuuacgcaugaagaggugagucucuaagcaaaaccgucuugguggugaggaaggaccugaacaagcugcagugaggccaccaucagugcugucuccuaccaugucuccaacuggcuccuggugcucccaucccucccucacucucucccuaggggaaagagagucugagagcgcugauguaggagugaaggagugaaguuucauuauuuccaaaacaugcuugagcuuuuaaaaaaaaaaaugcaagaauacacuuggaaaccuacaguucuccaccaacacuggagcacaggccuugacagccugcagaccuguguaucccucccucucuuuucacacaaguugcuacuaaagaccauauaacauacagggcucaaaaugggcucuuccuaaauacugugcucagaagaucuugaaagggauuccuaguuaaucuuaauauuguagagaaaaaaacaaaagggagucuaagguaaccucaugguugauaaggaguggccucagacuaagucugcaucacagcugccaugaaaagcagcaauagagugagccagggcgaaccugcauacucucaccuuuuccaagcuuuuaagacuaaaagauucaaggcugaaucgauuuuuauuaaucuucaaagacucagugugggucaaagcaacacaaauauacaaauacacuaauuugugcccaugcagauauaaacuaucuagugguuaagcuuuguggcagaaagcugaccugggccuugucaagaggaacagaaaggacaaagacaguguacacugucugcaccgcacagaaaugcccugaagcugcucaaacgccggcuucuguggggauucaagcaccuucaagacuguugagcuaaguauuacuaacugaauuugagggauuugaggauuaugccaaaauaaagaucggcaucuaaagauacauggaaauaaagacaagacuccaaaggcuccucuccccuugggagaacugugggaaacacucacaagggcaacaccuuuauuagcugcuccaggaaggccuugccagaauaaaagcagacagagggcaccagaaagccaccauguaaggaagagccuucagaaaugauggccucuguuucugguguuacuacgagaaauucugagcccagaauuucaguggggaagacuagcccucagaucacauggauguacagacucaccccacagcagaagcuuaaagcagggccccuaaaacacccauucagagacaucacacauacaggguggaagguagugcagucuacuaaagcucauuucauccugacuucuuuacagcagcucccuugacacugcugguagacagucugccugaggucuauguaugagcacaguuaccccuccauagguccagcuucaaguaccacucugagugccaaggaacuccagcgcuuccugccucugccugcuccuuccucuucaguccucagcauguguggaacacucagcucccccacugaacacaacucacagcagccucaucucagguuaauucacguauacuccaguccuggccgggccugcacuuagcuccugaaaacagaacccaaaacuaaugcucagcuuucuacccuuacuuccaucugaagcugcugguacuggguuuucccgacagcucugaaccagccauaaccugcacugccgccauccauuuuagaccugagcagaaccugacagaugaccauacuguuucuaaggccuucuuguauaccuucucugcuuguuucuucgcucucccuccuccuugacaccgcuggcucaggaguccaugcucagaccuguccauccaugguuccucccuguaggacuccccacucuacagccuuaucacuuccaggcacucgaguaaugcuaaugcuacuccacugucuggcucuggccgagugaggccucuccccugagccgaacaugccucuaacaccuacagcagacaacuuuaaagcucauuuguccaaaucacaccucaggcacccucccugucccucuucuucacccuauucccacagucuucccaguugaaagaacugcaugcuuacaguuucucugaguccaauucaacacacacaucacagcuccaagaggaugccauuuuucagcucucacagaggagcuccuaauacccaguuacuccugacuaugccuaagccacuuucagcucuucccuuacugggcugccugcuuccagucucuuuaagucaaugaguaggcaagcuuucuaaaaaguaccugaggcagcuacauggucugcugggcugggcuacacagcucaaacacagugcccgacagcccuuccuuagugagagcuguccugcuggucacuggguggcugagauagaugcaugagguagcggggcucucucccaacaggacuacaaguaaaccggaauuguaauguggaagaguaucacucauguucuucacccuauuuaaaaaugggaacgccauuugagcuuguuggcuguauacuguacaucgacccugcccugcccugcaguugggcagaagggucaggagggugcaaaagcguucucccaaucuguggcagaaagaaaaggcuacucuugagcuugggaccuggcucaugccuguaacucuagcacucaggaggcuaaggcaggacauggguacaaauagaacaucagcuugaaucaaggagcgagauuuuauccauuaccuuaaaaaaaaaagcaaaaagcaaaaagaacacaauuguggguaguuuuguagaugcugucccucacugaagaaaugagugucuuugcuaccuugaagcaagacacaugcacuacuuuccaaguagcaaaaguuaacuuuacaaacuugaggccucuauaaucguaaacuaugugcuccaaaguuuaaaaaaaaaaauugagagugguaagauggcucagugguuaagagcacugaccacucuucuagaggucuugaguucaauucccagcaaccacaugguggcucaaaaccaucugugaugggaccugaugcccucuucuggugugucugaagacagcugcaguguauucauauauauaaaauaaaucuuaaaaaaaaauuuuuuguucagucugccagguucaaauucacaaauguacaaagcugacugaaaucaccagcacugcccuacaaaggucaugugacauuucuggauacuaccaugaucugaacaaacaccacagaacaacucaccaaauacugaagucucccaagcagaggcagaugaauuucccaccagcuccgagacaaaaacacuguguucaaaggauaccccagguccuguggguccagccugucuuacaucuacacacauuguauuucucccaggcuaacugacaguuguuuauagaugguauugacaaguuaagucaaaucaaguuuuaccauccugagauaaauaauacacuacauauggcucuuucugggggaagccauacagaagggauggcagagggggagugacccagugcucagcaaagguaggacaaggcuucuaagcucugagcuaagccugugaaguacaagucuucaggacuggugcugcacagcagcaaaugaggcaugaguggagcagugcuguacagaacugccacaccugcaaugaugccuucagccccgugccagacugaguacaugaaaccuagcagcagaggcccaagaggucacaguaagaugccgugcacccuacacaggacuucccuguacggcucuggcuucuugugauggucaugggagcagauggaggucacugggaggucuugaauaguaguaagaucuagacagaucuuuucuguuagccguugugguuguuguguguguuaaauucuauacuugauuaaccauuaaggucacagugacauagcagaggccugcuguguggcaggcagcguaagucacaucucaacucugcacugcucuaccgcggcagcaccuaaagcaccaggacgccgcugcucuacuuuagcacuguauuuagcugaugauccuaaauaacccucugucagcuuuuguaacccggcacagaccacaugccuugugauccaccagcuggcugcgguaaugcccuugacuggaggcuuaaaagcucuggucaggacgucccugugauguauugucuuuccauaucagacugcaaugauuacccccagaagugucaucacauagagugcuaccaaaauuagauuacggccagcuagugagacucccucuccccucugguaccaccauggaggcugcugcucuugccuuugucugcaggaucgagacgacacagcucuuagguuuacaggauguggggauaagaaccaucugccuggccugguauuucuuuaauuaaaacuuuaauuacagauauaucucugcacagauauguguagucuaucagcuccugcucuuaauuaccugcacuaaugagaaaugaagagcuuguauucgcugagugucuacuaugugcaggaacgugugccagaggccuaaggggagccggagcccagcaggcgagacccagagacaagacuugggccaggaauuucaccuguuccucgaccuguccucuuggcaccaucucuagaaagaugaaggaauaagaaacagaaucugcacaggagacagaagaggacuggaaguaaggggucagccacucccacaggacuauggccaucaucuucugguggagucaguaacuggggaugagaacuacaagaugcugcuguuuccaugacaucccccuaagucugacgccaucuucuuuaucaacacccuucagcuuaggcagaauuucauggggaaugacacagagcacuucccacagccacaagggcaaaggucaucaggagggccgccaaggucaccagguggcaccuaggccaaauacucagcucuagagacucgcacagagccaccacacuccagcccgaggccucugcuucccucagaaccacccuaaccuuaagucacucgcucuuguggagggaaagcagaagauuaauuacucugacgacucuaccaacucugcuggaggcaggcaguuaauggcuagcuucggugcugccauguuugcugcuccacccuaacaggacugguggggcagcagaagaggcagugggugugaaggccuuucccucuccacagcagacuccucaucaccagcaucaaggggugaucagcuuccuugcaguuuaaaagcuuacacagcagcuauacagaagcccaagguaagaagccgccaaaacaacaccagcuuauccuagugccuaagugacacugguuggugacuuaaagcaugguguuucucagccuacugaauaaagccauguggcaaauuaccaaaguccucaagaugaacgaaaucaggauagaugaccguaaacacagccuaaggauacucagacuaaugaagggugguaccuacuccuuuaaaaaaaauaccaaaacauacuuuuaaaagcccacuggaacaucuacuaugugcugggacccccuuggaggauuuguaaauauauuacacugugaugauagauacacuguaaacaucagggauuuacuggggggucgggggagacagugcagagcuauggaggaagaaaggagaaaggaaaauuaaauguugaagacaugagagaaaagaaagguggcagaacgaggaaacaagaauggcccuuggugcuuaguucuaguuguuuaauacagccuagcacuuaggaggauggucuugacgaggaacucucuagaccggguugucuugugaguacacuggucagggacugucuugauaccuuaauuaauaugaaagacccagccugcaagcggguagcucagucccugacucuuaaguaccagcgccggcuuagcacuagguucagggugugcugcucgaagcucuagugaggaccugaugugaccugaugugaccagcuggcucaagcucugcuaggacuuccccacagugcuggacuacagcugcaaguuuuaagcuaaaauaaacacuuuucccccuaagaugauuucuguaaguuuuuugguuuuauaucauagcaaccgaaauggaaccagagaccucuacucaggaaccucagaacguaagcacaaugcuggcuucucugauggcuucucacucagggcuauuucgcagagcaauggcagaggcuccaggcacuggcuaguguugguugaacaucuaaaccagcagagagagccauuuuaguuuucaguguaaucugcucuggaaggaacagcacuggcccagauauuccagacagacacauuuccaugugugcacaucauuuaccugcuuuucucuuucuuuauaaaguaaacguccaggauuucugaucaguaguucccagcuaggaaaggaucagaacaaggguagaccauuuauccaaguuuuaaccaauuaugcaagggacucuucagcacacagccaggauuaaagaagccacuguuuccagugaagccuuacuaagcuuagggcaguucuguuacugucugaugacugaggggagagaugaacccagcugaggcccugcagccaaaauagcaaagcuguccugugcaaggcagcaagugucagugacagcugcucccgaguggcagcucuggagcaccagggccauaagccugggaguguggagaccuaccugagcaccagcacaguccugcaggccgccuaccuccuggguaaaucugacgauuaaaauguguagacaguacugggaagaacaugugauacagauucuuacacaugguggcaggcaggucacaucccuugacuuaagaggacacugaagacauaugcaguugagaaaaacacugggcugcucaacacccugacucccaauaugcuggcugcagggcuuaccaagggagagugaagggcaagugcagcuaaccaggcaaacagugauugccucuuuacucgucuuuaaucuucaaaguccaaaauagguaaauaaaagaaccuuuaaaaaaaguaacaguaguaggugaggccgcuccugguagcgggacucugagagaugaggaaguggaguagcucugcccugagcuugccucuguccuuacucaccaugucugugggucuucuguugggacugaugagggguggggugagggcuggggcccacagcaugaacaucugcccuuagcacugcccuacagaccucacacacuccggcugcuagaacucaccaugauccugugagugcgugcuaucacugucaccccauuaaagaggcaaaaacucaggaauagggcggcuauguaaugugcugcagucagaacacuugcaagaggccaaggugggauucgaaccucagcagccuggcuccacagccaugguccuggcccuucaccacgggguucacuaccacugccucuuggcacagccauaggaugaggugguuucaaaagcaccuuucuucugaguucucaguguuucauuuauccucccaacaacccuaaaaaagcaaguaggagacauacagcaucuguauuucauacacauuacaaugggagcagcaagaaaauggcuuacaaacuccugccugcgcagccaagcuccuaacucacugguuucaacccaaacucacgucuucugaagucuuugugauggaguuuuuuuuagcucugcaaacugccuuaauagacacgcauagcauguccaggccuucauaguacagagcagacucucacucagacaccgauccuuucagagagccacaauuacauaaacaauauccauaggguucacaaccugguacaaguccuaagugccaacccaacauuauuuuguugaaacauaaguuacuagcucucugagacaaaaauagguuaucuucaaaauguacuaagcuguuagcuuuagagaaaaaucuaauuuauuuaaucacagugacagugaaaacauuucacuucugcaucuacuaauguguccucgcuccuacuagauuuaugaauaaaguacgagacucuagagagccaacucugucaacagagagccugggacucccuuggguaccaucaggcagcugagaggagagggggugacagcaccaucaccugccacucugaguccaccaacucuuauaucaagggcauugcuuugcugcuggaggacacggcacccaaaaaacaaagacacaacuaagacggggccggggggacuuuggggagaagaaaaauaccccugcucaacugugcagugcacuaugaugagaacuguuuuaaucacaagaagagucagguucaguccccgacucccagcacaggcacagucccaggagccuucaucuaguucuuaacucuaguguucugcaauucugugacaagaaacccggcgggcaggccagaggcaguguugcagggauguagguguaaccugcaaaaaccaugcucagaggcucggaaaggacugaacuucaaugcucgucuagaacuaaagugcguucuguguucaucugugcucccugggcaugcuaagagauuacaucuagggagugguguuuuaucaguuccaagaauuaagcuuguccugcuuuauuuuuuagauaaauacaaacacaaaaacaaacaaacaaaaaacaacccguauuaacuugaaaaauggcauaaaucaaccugguauaggguccaccagagcugaccagauuucagcaaagacaaaaaacauuguggaucagguaaaccauugauuuccuuuauguuuaaaagaacuagauuauuacagaauggggagaggugaaacuuaaugagauaacuguauucuucuauccuuuuaaugacauaagcuuaaacuuuuucucucaguaaaacuugagaacacaaaacauaauucaaaauauggcacugaagaaaacaauugaaacugcugcucuuucuuaggggaagguggcaacagcugugugaggaugugaggaagaguguggguaaguagaugugagugugcgugugcaugggaaggguggaaugggaagggagacuucaggcaucugugggagauuucugagcauguguaugugagcgucaugugagcaacagcuaagucguaguuuuugcaaaacauggacagaaaaggaaauaacccuacauggggaaauguacucauuaaacuuaaauuuuaaaaagaugaaaacacagauuacacuuuauucuuaaaaaucaaaaugaauuuaaauacagaaaaugaagacagcauuuugcaacuuuaucacucaaaagagaaucucuacuugaggaaaucagugugcugcaauuggagagaugaaauguuacagcuuguacaccaaauuaaaaaugaaauuaaauuaaaaaaugaaaugguuaccaagguaaugcaggucaggggaucaaaggugaagggucacacauuauuaaaaagaaauccaaaagggcggcugcaucaugaucucugcaaaacaaaggagcuccaguaaguacaagcagcaucucccagacaacaagcaaagcucacgcggcucucccugaaacucaacaguccucccugauuccauggagagccauuuuuauuccgguacaaaaccaaauuuuaaucauguauuaccaaccaaaaaagaaaacaaauauuuaaccaaucauauugaagccucaaauguuuccaauuggaaguggcuaggaaugcuggcauuucauuccagucggaauccagacccuguuuucuggacaugacaaugcuugauaaguugccaacauaucaggaaucuaauuuggucacagcauggugaguugauuuucuuucuuuuuuuuuuuuuccuucuccucaaggaaugaguuccaaaauugaguuuuugcaaauuucuuucauuugaaguagcugcauaaaauucccauuauugaaacauuuaguauaacaauguucuagaagacagcaauaaagugauacaugauaaaauaaacuguauaacuauaccuauuaagucuguucccacauucaacuuucacugcacaagggaaaggacauuuuaagcaaaauaacagcuugcuaugucuguuggaaucacacaguuaacaggagccugacaugaggaagaaccagggagugaggagggaucugacaggcuucauuucucaaccagcguuauacuuacucaguuccauuaacaaacucauucauguuccuacaaagaauaggagagccgaggcuuugacauuuaccuaccaccuaguuguggcaguagcugacggccacaacaagugaguagugacaucacaguaaaugcucacuuccugaaaauugaucagcacagacaauuguccucacugccuuuacuuugaaaacuaagccugagcagguuguuuccucauucgggauccaggguccuuaugcagaccagagcgugccuaagaagcccugugugcaguagcugccgccugaggcagguggagcagcuagcagagggaacucgguguggugagcacuccugagcaucccaucugaccagcacuuccacucuccccccaccuuagucucaugccgccacaucugaagcuugaguuaaccccgcugaacucaccuccccauaaccuuauauuuuaaaacauagacaauugucaaaaggauuauuaaaaagaauaagauauuccuucuaguggcuuauggcagacaauaaaacgauccuaugaaugccaguuuuugcuuccucugauuagguuuuguuaaaauaacuguagaucgcaugcaugcacuggaucccaguguguuagucagugccauaaggccucaucucuaacaccacugcucucccuuaagcugcacagcuaugaaaaguaaacuagcauuccauuuggaacacucaucucccacagccuggcacacacacauuugcugcuggaaggcaugcaggcaacguugaacacugcagaaggaaucaauaccccaucaaaacaaugcacacggugcuuuaguagcaucauuauugagaccauuucagcauguuuguaacaaaaggcaaaaagcuagcaguguggcguuaacucaaguuuuguuuuccuagacuauuucauauuaaaaagaagcaccagaccuguucagaucaaguauuguguguaacacauccacuauuaaacaucuauucauaacaucuucuugacaaugacuucuagaugcuuuuuuaaaagucuucuaaaucauucuuaaaauuccauaccuuacagaaauagcuccccaaauuucuggcuauuauucacgagucccagccagaaguguuaggccagaccacccaaggccaaugugacuucuaaguugacagaugcucccuagcacauccugaccuuccaugggaguggacuugugcuuccuaucuaaacacucuaacacauggcaguucugacagcccuugaaugcaacugcgccuuuggugacaacaauccagaugguuuuuaaaauaacaaucaauuaaaaaauguuaacuaguguuuucugguuugggaagaagguaagaccgagggaguuuacuaagauucuaacaaguaacuaaucagcacucaggaaaguagaguccacacuagcagugccagcaaagacucagcacuagauccaagauguagagagcagcgcuaagaccacuggaccugcugaggccagcaugggauacccucaagcggugcucuagagaacaggucugcuaaguaccuacuugacccaacaccauuauucuggaacacaagcucuauaagguucagagcuugauagcugcacucuucauauaaggagcuagugcuagucccuuuggaauuuucugccuuuuagaguauucccaggccucaggcagcaguagaccucauaaaccaaaaauacccaucuuccuuuucuucuccagaagccucccuugccuucacuaaagccacagucagcuagugauaaagaccucaccaaaguaacagaaaauggacuuaggaguugcuacagacuagaacauacccccagcuauggaaccauggggaauuuuuuuaucaagccgggacagagcucuagaccaucucagagaaacuuuacaaagcuacaguuugucuccuucuacaacuaguaagagaauuaaacaguaaaugcucagaaccucuaaccagccuccaaagccuucuguguguccuugaucuaaaucuauccuacugcuagcaggaugccccagggacucucagccgacugucggggacaugaugagcaaauucaauuccuuuucucuacaaaucuaugagcaagaggaaucuaugagaagcucacuccucagagcaaagaccugaugaaggaaagaaguguugccauguuucccuuagacguuaacuucugaaguaacaaacacagaagaauugggaaaaaauguacaauaaagaacucaagaaauucagaaugagggagaguaugagaggacugaagacacccauagaaauagagcccuagacauuuuucuggcucuuugcaaaguggcuauuaacucuguuguguaaugcuuucugcagcagacauaaaguacaggaagcacuugaacuauagguguagagugugcuaucaugacuguaguuaaguacuguggcuguagguguagaguguaaagagacaaucugcaaaaagcugauuaaggugauagggcaaauuuuauuguuuuuaaucuauaacuauaaauacauaaaucccugugcaauugcguagcaucaaagguaccugaguuauauccagcuuuccaguuaaagcagaggcuacaauucuguuauuaguucaugauauggucuauauuaguuugcccugcaugguagaaauggaacccacuacaaacaccagaaagauaaaugguuggcuucugugucugcaguccccacauucacagguccugugucugcaguccccauguucauaggcccuguguuagacccaacacaugguauagauagccuccuuuccuuugucaaacaucaccauuucuucugguuuuccaaguuuucaaagcaccaaucuucuguuucaugucucuaagaugaacuaagaugucuauuuucuccaaaccuuuuuaugaaugauagaacacucuacaccuacagccacaguacuuacuacagucaugauagcacacucuauaacuacagccacaguauucuuauuauagucuuuuucuuacuauguagcucuagcuagucuggaacucauauauagaucaggcuagcugucuaugccucccaaguccugggauuaaaaaugucugcuaccacacucagcccuacuauauuccauugugggagguacaguagcacacaccuguaaccccaaaauuaagcaaguuugugguaagaggauuuagagaugugggccaagauggacugugcaauaagguaagaaaaugaaauaaaaaggcagucaagaguaaaaggaugauuuagagggaggcagaagagacaaccuaagacauuuaccuugaacaauaaauguaaccauucuuucugcugguuuagacuuguucacagaggauaaagacaauugggggaggaacugugagaggaaccagaagacuucgagagacagccgugcccauggcauugaggcuguucauggcagcauguacuguacaguuuucacacacagaggcacacacacacacacgcccaccacuguacaaaguaguaucacauggucucacaugcaagaacuaaacaagucaaccucaaaaaguuaacauagugcccugcagugguggcacauaccuuuaaucccagcacuugggaggcagaggcaggcagguuucugaguucgaggccagccuggucuacagagugaguucuaggacaacaaggaauauacagagaaacucugucucaaaaaaccaaauuaaaaaaaaacaaaaaaacaaacaaacaaaaaaaacaguuaacguagaagaauagugguuaucagaauccaugguuuuaguugggagccaaaaauaaaauauggugcagggaaagggggacagugugcauucaucacucugagacaggcucuuguaucucacguuggcccaggcuggucucaaacucaugauaauccuacuacuucagccuccccauauacuggaauguuauagacaugagcuuggcuagaaggaguaacuucuaauguucuguaacagaggaguaaauggugaacaacaauuauauauuucaaaauaacuagaaaagauucugaauagucucaauacacacacacacacacacccucaaguuaacagauaugccaaucaauauuucuuauuucguacacugaauaaguauauuaaaacacuguaauacauccuauaaauauguaauuacuaucaauuaaaaacaaaaauagaagccgggcgugguggcgcacgccuuuaaucccagcacucgggaggcagaggcagguggauuucugaguucgaggccagccuggucuacaaagugaguuccaggacagccagggcuacacagaaaaacccugucucgaaaaaacaaaaacaaaaaaaaaauaauaaaaauagaaaggcucgggagaugguccauggacaaaacacuugucauacaaagaaucaaauuugggagccauaggaccuguguaaauauguaagugguugcacccaucuguaauucuacaagauaagguguagaaacaagaaaaccuccagagacucaccagcuagccagcuguagaagcaaugagcaaaaaaucuugcgucaaacgucaaacaggguagaaguuaaagaugacaccuaaugcugcccucugaucuacaacaugugcuugaacacuguccuuccgaaaagacacaucaaacgcaauaaauaauuugaucaaucaauauggcuguaguaaguuguuaauaugcuugucuaacauguaccagaccuuggguuugaucccagaaacacauaaccagggugcaguggaaaacgucugcaauccccacagaggacacacagaaggaucagaucagauacuccagaccauccucagcuauguuacacaaaauccagguuaacagggcuacaugagacugucuaaauaaacagcuauuuuaaagagggaauuauuucccauaugccacuuccucaauaaagaaagugguauguggaugaggaugcuuagcgggagcacaggcacggacguagccucauacucacucuaggaaccaggccaugccaggacugccuaugcagagaaagucaacagacuucuggagaggcaggcccuagaagcuacuacuccugagcucuuugcugccugucuauuaccacuuccuguucaugaauaaggacacacacagaugcuguauacuuaaauuuucuucaucuugguuacccauacuggcugcauaccugaaauuaucccaugaccaaaaucgauuggccuacuaacuuuauaaaauugaguaacccuugguauagucaagacccacuccuuucuagaguuauucccaugguaaggguuggcaaaauacacaaguucccccaaauauaaauguaaaagaaguaaauagaaaagaaaacaaauucaccacgcuggcuucaucaaauuccuuguuugcagauuucuuagcaacauacaccagugcucagcuauauuuucggacugggugagaugcuggcaucuaaaccauccaucacaccuaaacaguaucucaagcuccaacagcaggaaacugcaacucuagacaccaaacaaaugacuaaggagccugccuuccuggcaaggcuugggugagucugggcaguccacaacccuuccucuggaaugggacccagggaggcuggaccuacuggccuccugagguaacgagccauuaaguggcaaagcugcuaaaaugcuagguuuaaaagaauucaaggcuggaaaaagagcuucuuaagugaaaugcuugucauucaagcaugaagaccuguguucagauggcaagaaaccauguaaaguagguguggaagcacacaucuguaaucccaggugugagagcacacgucuguaaccccagugcuccaaaagcaagacagaagagacagaacacgcacgcuccagcuuagccacacagagacagggcaggagucauccacauacucuauauacuugcuggugccacaaacuuguuuuuguuuuuuuaaaagaaugaaaaugcaaacacaguguauuagugguuucacucuaccaagacucaaagcucuuaggcaccuaaaaaugccuucaguuuuuaaaagcucaagaggauggugucugaaguggaguggagggggagggcagaggagaagacagccacuaagaaggaaaagcaacaaagcuuacuuucugacaauauuacauggaaaccuacgacuguagaagccuccucagaucuaacuacaugcauacauacaaagaguuaaaauggaguugucuuacaaugggccaacaacacccuuacuagauacuagaggcuaauuaaaaagaaacuaaacaaacaaaccagcuccaggaacagguuacuuuugggggaguuggaggucagugagauccccaaagaaccccaaacauuacaggguauugccaaugcuauuggguuaccuuccagaacuugcuaauuuucagaccguauaaaugaaaacaccacacacugaucacauaaaaagagguaucaaccuaguaccaacauggaagcaccaucucucccggcuaacuuccauagcgcuggaaggggcgaugcucgcuaccagagaagaaaggccauccagcuuacucagcugugacccugcaagcuacaagaaagacagccugguaaggcauggacacuauuaugaggccugagaaccuuuggcuacacagauuacagauaccaggagggaacccacuguuacucuaagaaauaaagaugguguuaaaccagcuccuagugaguuaacauuacacccauagacuuaagucauucucaaucuucaugagagauacuucuauauauguaaaugaugaucaacauagagaccuacaacuggccacggugcagaaaaucagagacuggagaguagucagcccuaaauggacauacauaugcacucccuccuccaaaggcccagaaaucacugaguaggagggggcagaggaauuuaguaagaggcagaggcagggauggcuacaagggaaacagcagggcaccugcuucuaugaacucacagcaguugucacaacauguguaagaccuaagcaagccaaagcuacacugaaucccagcauggagagaggaguaggacaugaaguuucauccuuugcagggaaguuacuggcaaguuaagcugcugggagaggaaggguccauuuucucuacaaucacugccccuggacaaguugacaauauguaacacgucgagaauauucgggcaauacaaacugguggcgggggcgggggugggggcaaaggaugacaaaaacacccaauuccuccuggaucauuuucucaaauaaaguugauuuagaaagcaaggguagaucugggaagaacugggggaaggaaguugacugaucaaauucucaaagaauauuuuuuuaagucuuuaaaacacaaagaacaauacugcaaaggugggguggccagcuauacaacuuaaggauucucuucaaugcagaggugaaccaggaaagucugccguuucuuccuuuugugaccuugggguauuacuucauuuucaacuaugccuuuuauucuucauuuauaacaugaaaauauuaucccugcaucacaagguugcugugagaaguagcugaagugauaaaagcacuaucagcacccaagcggaggacaguaaauguuagcucuguggcagcacgacacagcugcccuguaacaccuuacucaagcaaggacaguaugcguuagcucuguuccagcaugacacagcuggccuucuaauaucuugucugacucuccagcuuaaaaggggcacacucauugggggguagaggauacagauucaagaugguaaaucuuaaaguuggaauucaggguacauagcuaaaauucuaaagggcuggucuguggggauuuccuccaugcccaacugauucauacacacuccacagaccacacucugcacagggcacugcagugcagaggcucccaauucuguacucaguaagaaaaugagugaagcaucaagaaggcugagugcacacuucuugaccugacacucauccacucacugcuccuuauggaguacauaggacaggaagcaggcuucuuucuagccauggauauggauggauggauggauggauggauggauggauauauccauauccaagaacuuguuuauuagcucaaaguaaagaguguuugcuuuuugacaaaaauuaacccaaugggcaaacauuuaucaagcaugccuaccuuggggcagaccucaggaguggguaacaaggauagauacagagaaaggagcaaaaguccuaguuugaucuaccauagugauccaggaacaacucagaccaagaucaagaaauuucagacagcauggguauacugaaaagauguaggauacuauaaaaacucccagcaagggcaucucauugacccugcaggggaacuagagaucugagggaaacaaaguggagagagugaacaccaauccaagcaagaaaggacuguagaagagcuagcguagagguagccagcagccaggccucgguccuguggaggguacaaaguccugaggaaaaagcauuucuaaagacuacucuggauggagaccaaauuaaaggcuaugcuacaggagacauagguucugaagaaccccaaaacagucuagggcucaaggaccuuuuccaucugaagggagugggugggcauaaagaauagaaaaagccaggaaaacgugggcaaugugcaauacagaacaaaagaagggcaaaguguuccaaaugacccucaauggaaacaaaacuguggccauaccgaggacagauuuggcugauacuaauagcaaugguuaauagcucaugcugagaacagguaucuuugaccuaauuuguuaaggaugguucuuuucuuuucaaccauccauaacccccaucuagucaugaggaaagucaacauaacaaacccaaaccugacaacaucacacaaaauauuucuccugucaaggucaacaccaccaagacaaaaaggugacaguuggaugaagucuaaggagagacgacaacuaguuagugugguauaucagacuggguccuggaacagcaaagugggaggacagaggguuaaggaaguguguagcacagguucugauggcagcaguucacuggggaccacugagccagcacguaauaaccagagccagacgcagggcagagcucaguacacugcacaacucuccuaacauaaaagacuugccuuaaaucugacccugagauuugacuagagcuggaggcugagggucuuuucugaacaggacucgggaggaaacugcuagcucuacuucaacaacuaagcaggagucuccagcacaauuccagaggagaccucagugagguagcucugcugcagaucucucuagguagaguccuuggcaagcugggauuaugcagggcaauaaggaagaagaaagggagcgcccaggagguagguguaucaccagcacagcacuauagaaguggaggggaaagagaggggaaggaaggaaggaaggaaggaaggaaggaaggaaggaaggaaggaaggaaggaaggucgguccaaacucauaaagcagacagaacagcaauggcugucagggcugacuguggugaggagaugcuggccaaagaguacagacuuccagcuguaacaggagugagcucugggaacucagugcacauccugcugguaccagcuaacaauauuacacugcuuauuuaaaguugcuaaaagucaccuccccaacagacaugcaggcaugcccagcgcacgcucacugugcucauuguuauacacuguacacacgcugagccgucacaccuuggccugccaugcguacaguauuaccaauuauacaucacagugugucacacccuuuaaaucagugucacucauacaaccuauguucuuggccucuuuaugaucccuuuuuuaaaucaaagguaucuuauuuacauaaaaugaaacuagccuacuugauaaaaucuccuuggcucucuuuuuugggguggagggaggcagcaaguaauguccacauuuaauaguaccagacaaaaggcauacagucaagaccugagaaaauuccaucuuuaaauccaggaagaagagaguaagaggagcauccagcaaagaacagaaaagggcaaaccauccaagagcugggagggcuggugugagcacugugcuuuguuccugguauggaacucggcugcugcucuuggaguuaagaugguguugguggcaauuugaucugagaccuguggugagguuauuguuguuacaguugcugagacccaaguuugcuacauagcccauguuggccuagaacucacaacaauccuccuaccuccaacuccucagggacugggcucacagguguaaaucacaugccuggcuuguuagaacucuggaucacuaaugauccaagaaagaaggugcuacagaauaacggaagcuagguucaaacugaaaugcuugaauuacaaaugaaaaaugagaaguuagcguagcaagaagucuggaucucaaauuugcaaacccauguucauagcagcauuauagaaaccauacagaggcaccaugcguuaucuacauaauagaaugccacucgguuuuaaaaaggaaggagucuggagagaugccucagaaguuaagagcacaaauuguucuuauaaaagacccaagucaggucccagcacccuguacagcagcucacaaccaccucuaaguccagcugauggggacuaaugaucucuucuggccucugcaggcuccugcacccaugugcacaaacccauggucaaauaguucaaaauaaauacacaauuaaaaauaaaaguacaucuuuaaagccagaagggaaagggaugcuaacauaugcagcugauggggacuaaugaucucuucuggccucugcaggcuccugcacccaugugcacaaacccauggucaaauaguucaaaauaaauacacaauuaagaauaaaaguacaucuuuaaagccagaagggaaagggaugcuaacauaugcuacaagguggagaaacuuugagagcauuauaccagucacacacaaaaagauaacacugccugauucccuuuacaaggucacuggaacagcaaaugcacagaugacagaauggaaggugucagggacaggacaggacaggaugugugaugaggacagaguuucaguuucuaaaguuggaugaugauggugguugcacaauaaaaaugaacuuugaaauacuguacuguacacagaaacagguaagacgcuacauuuucuguuguguaaauguaaagacaccugccugucugagcaucagaacagcucucaggucaucaugaccaucucuguacaacagaacucggagaggaguacauggacgagagcaugguuuaagcagagagacugugggugcuggugccucccucaaacccucacgaggaaccaggcagccagacuagaccaaggacauuccuucagccgucacaagaccuaacaauauuugugauaugcaagaugugagaggcaaugaagugauggcuauagaaacaaagacagaaacuacccaguccucucaucagugccaagacccgcuuuaaauucaguuuuccucaacaauacaguuucuaagaucauuugagcucauuuacuggaacuuagaacucauucaaaaaaaugaauauacacuguaaagcuauguucucuuuuugacagguaucuaagcagaaugaccaguaauuuucuauguuagaauaaaggggagggucacuauguaagggaagaaaacagcaucaugaagcucaaaguaaacagaucacagaugacaguccacacagagcccagggcugcacagcagcacagguaacugcagcauuucaagucgacugggaaaaaucaacaacucagcacaaguaguagucugggaggaaaaugaaaucacaacucugccucccccugcucauguggcuucucaagagcuuagguacauuaaacaccuaaggagaaaacagaagagaggcucugcagagaugacccaaucacauuacaaggcaguccuucugcuagcuuccaaagucagaaagagccaaaguuaguguacacuguucacagggcuggcacccagcacguuaagaaagcuaacaauuaacuacaagugcuuugcacaagaaaaacuauacauguuugcgcgcgugugugugugcguguauauguauguguguauauauacauacauacauacauacauacauacauacauacauacauauauauauuucuuaaagaaaaacacuuagaaagcaaggacuguggaagaaaaaugaagagccaacuucagggaaauaauaucaaguuacacaagccguuccaaaaugcuaagucacaagaacauaaaaacaaaugaaauuuaaaggaaacaaggagucgggcauaguggcacauaccuauaauuccagcucuugcgaagcugaggcaggagguugugaguucaaggccagccugagcuacacggagggacccugucuccugguaacaaaggaaguaggagucgcucaccaacagacugcaggacuccugagggagagcacaguugugcuuaaggacacauggaaccuguacccucacaucugacuccugagaguuaaauuuuuacauggcaaauauuuauccucugacaagcacaucuguccuaacuacagaaguaugcaaaaauaugugaaccagaauguuaagugcgcuauuuuuaaaaggcucagcuauauuaaacaucuaaggguaaaaauccaaaccaacaugauguaagaacaaaauagagauugcuaaguuuuuguggacauccuuguucugcaauuaugcauauucauagccacacauauguagcaacauggaaaauggccauaauauucuguguuauaaggagaaaccagucaagguagggguguguguguguguguguguguguguguguguacgaacuugugugccacaggagcacacaggacuuacucaagcaucacuuaaauccccaaaagggcauuauuauggcuuagauauguuuuaaacucuccccccaaaagcucuguaucacaagucuggcucucagggguaacgguguguagccucugugagguggaaccuagaacaaaguccuuggauuagagccagacaggucccuggagcaacaaucagcauaccuauaaagagauccugguggguucuuggacuagcccagccucucuggcuuauuuugagacccaguuucuccuccacauguacuccugaaaucaaccaucagacucucaccagaggcuaagccaggaagccaucugaucuuaaacuguuagccucccaaacuguaaguuaaagaacucuuacuguaaaguuccuagccuuaggcauuuuacuacaguaacagaaaauuagaauaaacuuucccaaaaucaaauuucacacaguggacuaggaagugcagucauccgagagagugucagugugugcggcuccacagcucugugugcuaggguuucugaugauuggccuccaccccagucacucacacaugugaguggccuuacaucaugaaauguaauaaagcagucucaggaaguaaagagaaaaucuguggcaaagaacagacugauccauggguucccuuuuacacaacauggagucuucuuagcuaagacuuacuaguccuuacaugaacaccaaaaucucccagccuagagaguauucugcauaagcagccagaagcagacugucucaggcuacagucaagucaugcggggcauugugcaaucuccacaugaaaagcaucagcaaauaaaagacaauccuucucaagcuugccuaaauucaaaagaauuauggccuuccaauacauucaagcaaagagcacccauaggcucaacucagcaaaggccuacgaagauacgcacuacagaaauagauuauuaacugaucuaaagagugacgucaauauauagucaccacaguucaaaagcagcuuaaaacaguuuaauugccacaaaauaagcacaacauguaugcauacacacacacacacacacacacacacacacacacacacacacacacaaagcagaauaauguuauaagcaacacaggguauaaagauccuuaauauguaagagcaguuucauguuuaaauuacugaaaagccaccucucuguuaggcaagguccucaaggagcacuagaaugugagaucuggacauuucacuagagugccuaacagaagauaaagccagggccaugaaauaagaaugccugaaacccaaagcacauauggacacuuagauccauccagaacaaacggaguuacacuucuucuaaguuuauuuacauugcuguguguauauggggguggggggggagauaaugaugugggguccguucucaccuuccuccuuuauggaguccugggauugaacucucucaugaggcucacacacaaggguuuuagccugcugacacaucuugcuggcuccuagccaugacuggcauucugggcaucaguaugaauaucccuacaacagcaugcucauucacaaucguccuuucuuuccucuacaucuccuucuuaacuauuuccugggaccacguaucauuaacuguucccauaacugucuacagagaacacacacuaggcucuacugagccuggagacagugaguauaacuccagccugauaugucucccaugcuacucaggcugcugaguucaccuccucgaacuacugaacagguuaccuauugucuguuucccccuucagaaaugaguuugugccuuguauaucacaaaggcucagaauaauaccuagccuacaagguucaaauauuugcucagccaaugaauguccucuuuucugguugguuacaucuccuauuuguccaagaaaacacaggcuuugucccauaggcccuguggaaguaccuuggucugcacucucaucauuuccuugccucuagcucccuuuguaacugguucaguuuuauuugcucuucagcuccaaauccaaauuccuucuucuuccuuuuuuuuuuuaauuuuuaauuuuuuuggcuugaacaaguaacuuaccgucaccacagaaggucacugaaaacccagcaucacacucucuaaaacugaagucgaaacuuggaacaucaacagcucccucccuuccaaggcgccauacuucuacuucagggcuacaggaaucuauaucuaaauccuauccccaguugcauccaguuaugccuagcuucaaugcugacaucuugguaccagcaugccaguuuucccuagaucccugcaaauguauuccagccucuggaagccagccaagugguagugaagcaccuaaagcagagugcaaagcucuaccccuccaucguagggaccugcuguaggacaucccguuccuccaguagcuuaaggccaggagcugcugaccauuccgccacaguucaacucgguucuauuuucuaacgucccaugcucccuucuugcccacaugggacaagcucucccacacuguagcccugccuccccacaagcuuccucuaucuggaucagucaucucacagagcuaaugccucacagcuucaauggcuucgcaucccuuugaauggcuuucuaaauacacgucuuccccucugaugaccccucggugacgacucuaucuuaucagacauauaccucccagagacuagucaauacuggucaaguuacuggcuggccccuguuagcaggcuucacucaccucuacaguuauauucagcgucugcucuguggucugcucuuggaugccuagucuggcacaugaagagcauguuacugaauuaauacauaaugucuagggucaccacaguccuaucugcccauuguacccacucgccaucuuaauaggucuagccuucugaggguucaugcuauuagugaguuguucuccaacauccaagcuccuacagcaggugcagccacucugccuuguggcuuggagauuguaccacauggcuggcaauucucagcagcaugugucuagggacaucuuugccguacaauaaacuagaggccugcucucuggguaugaucugaaucucuacaagggcccaucagcuguucaugcguguacuacuccucauauucuucagucagcuucacuuauaacuaggcacuccuugacacuucagucccuuguuuauaguuaguaacccuucauacuaaaaucuucuuuaaaauuauuagcucuucuuccuuggcuggauccagacugacaggaaucugaaauuguaugcagcgcaagacuggagucacauuuugcuuuaucccaaguaaccaacuaaccaaacauucuuuuugauuauuuacucacaaauuuacuuauuuauuuuugcaauucuaaagaucaagccugagccuuauacaugcuagacgagguuccacacaugagcuacaucaccaacccaacaccauuuacugcaguguguucuuucucugcugcacugcaggacacccgugugaucauucuaguuucugugcagguguguggaucucuuuagagaucacuuuguccaguggacuacuguucuccuuacuaggucauauuuucacuaguuuauagcaagucuugcuauccugaagcauaagucuauauacuuuguucuucauaagcucagccuagccuuuucuaucuccacagacauuuuaacauccauuugucaauuucaaccacuccauugucccccgaaaagucugauggcauugccugauacuaugucaaaugcauagaguuugcaaacagucaacaucuuuaaaaagugcauuuucuaguuaauaaauacgguauauccugcuguuugcuucucuggcauggauuguacugcuucaaauuuucuucuaaauaaugugcuuuucuacuauggcaaauagccggcuuuacuacacuuucuguuaguuaucugugcagaacuacaguuguaacuggaacuaauuaguaauaauuacuuauuacuaguguuauaaagauagugguauauauucaaacagacauauuccuucuauuucaauuucuaaacucuucucuuaugguucugaacucagggaaacaucaguaacacauaaacagaugugcgugcugccgaugaguaacgugugcccucaccaggcuggagaggacagugccacucucaccaguaaccuggcacugcuggacagcuucucucagguaguucuguauguguucacacuaucacaauuguggaauuuacucuauuagaguagugaucuagaccaaucaauuuuuugaauaaugaaucugucucuuaguaaaucugauauuuuaacuuuagugucuugaauuuuucaaguucaaauuaauguucuuuaugcaccugagaacaauguacagccaaugccugugaguagcaacauauuuauucauguuccacugugcugcauuuuuagcauuuguucuuuucaaugcaccacuucccgguuccacuguaucuaaucugcugauaaacccauucacugagaccuaguuagucacaaaccuucauuaucuaacucagaaucucugcauccuuacaggcucagucacuacccaauaacaaacuuccauuuaucuguaaagguucucauuuuguccccucuuuuaaaccaugguuuuguugagcagaauuaucccaugguaguuuaccugcucuguaucaauuugaaccuccauuccccugucuucugaccacucgccucuguaaaguuuucuacaaguacaccaggaacaaggacccaagcacguggccuuccaccagcaaaacaaaauccaccccauucccauucuuuuguuuaaacucugcagguuucccuucuggcauuuuaucaauuuuuuggaagcaagaggaaacaagaacaucuucaggccagugaaauggcucagcagguuauccugcaagcaucacagccugaggagaucccuggaauccaugagguagaggaagugaaccaacuugcuaaaagugucucucuuaacucccccccccacacacacacacaccaacuugcuaaaggugucuugucucucuaaccacacacacacacaacuugcuaagagugucuaaccacacaccacacacaccaacuugcuaaaagugucucucuaaccacacacacacacacacacacacacaauucucaauauucaaugagucuuuccuuucuuugcacuaugagauaaaaaagaaauaguaacccucuuccaaguauguaccaaaaucuucucuccaguuacauuuaaacuuuauggacuuuuuauaacacauagaaaaccuaaauuuacauguagucaaauugauuuuuuuuuuuuuuuuuuugcuagucaaauugaucagcuuuuucuuucugguucuagcaucaugacuagaauggccuuuagcaugucaacaacauguaaauauugacucauuuucuccuaguauuuuuagcacucuaacuuuuacauuuaauuuuuaagauuuaucuugucauaagauaugaaacaaugacuuaauaguuuuaagggauaaaccaacuguucuaaauucaauuaaauaacuuuccagcccuuccucaagauaguacuugauaucauacacaaaauguaaaaauauauguucaguauaaauggauccugcaagcccagcaccacucaucaauccugcaugcucccugcuucuccagccucccuuggugguaagcagggacuuggaggcugcuuugcuaauagcaccauuucugggccugggcacaaccacaggauaaaagcagggcaucucugcccuugccuugcucugggucagaaugcuacucaacuaacucuucagcagacacacugaucacuugagaaacgcuugucuaaagauggcagucauccccaccccaccaaggcuuggggcacaaagguaugaguaaggguuuccaagguuugaagagauacaaugcucaaaaaacagccgugugaucguguguguguguguguguguguguguguguguguguguguguguacaaucaguugaaauucccccgacagcaguaacccucugucuguggcugcacauggccgagcgggccacaguuugaucacgacagccugacuaaaagcauguuucucacucccaccuccgcaccuucccuauguaaaccucaagaucuagugagucccaaaagacacggcugaggaugcucagcacccugcccuccucauggcuacacucaauguucauuccucugcuauuucuuggucucaccuguuucuguuugcugucagccccuucugccuacaacaggaaagacuccauaacucugcaguucucaucuucagcuccucagugagaucauuuucuucccaacccuucagcuacuccaucccagucuccuuuccuuucugacucuagcuccucuccagggcuucuuucuuugcccacucaccccacuccucuaagaaagcucagcuaguacucuugucuuccuuggcuuuucccugaaccugccaccuagagaucccaagagugucugcuucaguggcuggcuuaugcuccacgcuccacuauaaaccaugaacucgacaugcugcaccuguaguauauucuguucuuugugguuccaucucacuccagccacuugcucagucuccucugcuccaccagcagaagcucagaauuaacucacuaagcauaaaaaguauauuuuaggcugaaaauauaaauucugaaauccuuuaucuuccuauaagcaaaaucucccccaaagaucuccaaauaauucaacugucauuaaccccauccccuggaacagcucaaacugucucaggcaagaagacagccaagacaacacaagccacaggcccucauaucuccacuccaaagcccuucucucccaaagcuuguguguuuuccugcagaugccuccucuuuaccuauucuauuaauguagugggauggcucaacgucuggcucuuuccuauuacaguucucuguaaaugcccugaaauaagcaugcaccacguauccaugugcacgucacccacuuuagacccuacugguacugguucaaagaucagaaucuucucuauggccacagcccagaaacaggacuaaaugaauugcuauaguuuggaguccucauccaauuccagcuuuuuuccacaccacucucuagaacagugguucucaaccuuccuagugcugggacccuuaauacaguuccuccugcuguguugaccccccaaaauaaaauuauuuucauuacuacuucacaacuacaauuaugcuauucuuaugaaucacaaugcaaauaucugauacacaguauaucugauauguggccccugugaaaggggccaugacacauagguugaaagccagugcuuucgacuaucuacaguaacugugcaagaugaagaccuaaucggucacugacugaaaucuuaccucagugugaaauguagagccaauccaccagcacacagugcucagggccugcucuucucccacucacuacuuguacaugcaguaaugucauguuugcucacuaauccugccugccugauaaacuccuaauaccuucaaaauguacuccaguauuuuguguccacacagugucuccuacucaccugauacaugcaaucuccugacacucuuagcacaucaugaugcaacugagcuccacaccccuagaagacagaagagccucuuuuauguccuagggauugccucagaucgaggauuucuacugacagaaugccuccuguccaaacuugguuccgauuccuccgaauuacucucuucgguggccauaggagacaggcuuagagcccaguguuggcauacauccuaccaaggggauguggccagaacucuacccucguaccugacuauucugaguacuggaucccuguccuccaccagacccucuuggguaugccuuugcaagaaucucauagguugguuuagucagaaccccgaaaccaauaguuucuucuugguaacuuuccaccugcaccccucccuccuucccccuagcuccuugcccugugugagggcagacuugggcccauucugcccacugcaaaaccucacugcugugcuaccucaacagucuaccuugcugcuugaacaagugugcugagcgauuucuucuacagaaguacacaacaggcacucaaaacuaccacugaaacagacuaacagauaugaugcuuaagaacacauccaaagacugcucaauggaaaagcaggaaaguaacauuugacuuaaaccacagaauuagaagaaucucauuaugcaaaaacaaaaacaaacaaacaaaaaaacccguaacccuaaagugcaauaugcaauuauacagcagcuuuauuaucauaaacucaaaguaugcagaauuagucucacucagcagcagcaacggcaccuuucucuguugugacccagaguaucagaaaucuccaucauuccccgucacgugacagugagaccaaacacuguucggcugaggcuucuaucucuaacuguggcacaacugcagcccuggacacagaagcaacacaagccauggcucccugugcaugaaaaguagaaaagagcgauuucugccaagugcggaggaugaaaguguucuaauuccucagauuagcaaaauggauuuuugauauaggaguuuguuauguacaaaauguuucaguacagaaugcacggccagagcgcggugacaagcuccucccaugguacaaguccuacaacuuggguuccucucaucaggaggccuaacaagccccagcuccuuccuuccugcucucuacagacucuauaaguaagaagcaauuccuaaccucaaauccaaauuacagaaaagggccccaaaaucauacaucuuugaaccguagacagcuaacaaauaacacuggcuagacucuacaaacuaccugccaccauacugccaucaccugccaccacaggacacuauaugcuaucacacuagaaaccacaugccaccacugaacacaacccaucaccacacuggacacuaucugccaccacugggcugcauuuuuugucuuuucuguuuccugcaguccuauuuacagaagauaggaugguaauaaaacaaacauuguagacccccccccccacuccaccucuauccaaggagccuccuucccuucccaagcacauccucugccagaggcacgcacgggucuaacuuuuucaauccccgugcuuuucuuucuguauguuucaccuguagccauuguuuaaggagcagcuuuccugagauguuauucacauaccuuaaaguacacccacuuaggaguauucuuagaauauucacaaaguuaugcaaucaucaguauagaagcuuuuagcacaaaagacuugggaaaucuagggcucccuucuguggauuuacacuagacuuaaaagacaaccacggagacaaggcccaagccgcuagagguggugacacccagaaauggaggagacaacccaugcuuuccaacgagcuggaaacagacaugacaagagcuaacaggccaccuaccuguucacugacucuuccuucacuacaagcuuuucuccuccauggccaggcuugccagccaacagcagcuggccaccaccagaggcucagcagcaggccuaaggaaaugguagcugacuuucucaacagacuguggcugccgcccgugcuagcuagcagcugcguacgcugcuccccuuccaggcgccucaggagaaggugccgugaacuuccugauccugucccccguccccuggcacuuguuuccagugucuccugagagucaccagcuuaucccugucauaaacagucccugguucugcagcccgcauggugggcgcugucugccauacucacaugaaaaccuuacaacugucucgggcggcuacauucuaugagacucuucugugugcagcuauguucugccaucuauuuuaaaccauauaccauuuuaauggccuaacuauuaaaauauuauaugcaaacugaaaacccuguaaauccaaagucuaucuguguuuauauagauguaucacaccaaggcuguguguauauagauguaucacaccaaagcccauaaaacaaaacacugccagcagcccagaagcuggucuacacccuccccacucuccaaagguaacuacaccucacaccuaauccauaaauucauuucaccuauuuucaaacguuuuuaacuuauguacggcaucacaauacuucauucugagugcacugcuuucguugcaucaacaaccaugcuuguuaagcacgucauucccggaugaagcagaaguccacucaccuugacugcuuugcagugcuguauuacacaggcacacuacaaccaaguuuguguuguauuguuggguauuggggcugcuuucggauugugagaacuaggaauacaguuccugaaaagguuuccuauguguuuugggauacacacacacaagcacacuuuuguuaacagcauauauaaggagcugaacuacuaagaugcaagcugugucucucucaacuuuccacagugguuacauuaauguagaugcuggcugcuccuugccaguagcugaugcuguccucuucugucuggccaucuuuacaugcaaguccccugcugugguuccacuuugcccuuuccugcuggcucaugccacuuagcaucaucugguuuuacuguccaccuguggugcugcccaguguccuguucacuuuccuguguuaucucuucuccuaaauacucugacauaggccuguguuagccaaucucacucuggggccugacuuuucguucauucaaagaggucauuuagcagagagaagcacuguuaaugcaauccaauauauucuaaauuuuuaccuuauaauugugcuuucugugucuugcuaccacugcgcagaucagcaccaguacagugagcaguguguucugucugugucacagcucuuagcucaaaaccacacucaagugaguggaacugucuugaagcacaggucacccagacaguagaaaaggcugccagccccagagacaaguguacuccuccaguucgguaucacacacgaggcuaugcacaucaaugugagaagugaguucuaaacacugcuagaagggugucuuacagcauccacccaagcaugggcaugaucaggcacacgcgauuuaccugucuacauaacauacacacaucuacccacgaaccuaaaguuuuuacccaccuuucaaaaauuaugacauuaaacaggcaagguaguuuagcagguaaaauccuugucacacacagaaagcugacaaccugaauuugauacacaggacucacagaaagguaggagagaaucaacuccauaaagcugucccuguccucuguccuucacuugcccacuguggacuauguacugccacccuaaaugcauaugcacauaguaaguaaaaauuuuaaaagccagugacaaaaaaacuaacugcauguucuuuaugaccaccuaugaaacuguccagaccaccaagggcacacacuucuaagaagccaccgguaucuacagacaucaccuaacagaggagugugugccacugaagggguaugauguaaucaguaacugugccuaugcuaaagaagagggcuggacacagggucagugcucagacugcugaguuuuuauuguacaggcuuauacagagagcaagacugaagggauuuacacacauucucuagucaucaaacacaucaggugaacacccaagauuaccaccaggcuuacagagcucaggacuagaugaacccacacgugucccccugccacaccaagaugauccucacugaaaaggaauaaauuguuucugaaccagaagagaagcuugcaccaaaagauucccaaaaagaaacucaggaauuggcucacugccaaucuuuauggcauggaaagacauucagcauuaaacaaauacaaguaaacaugaaagaaaacaaaggggcagaugggggagggauaagggacgggaggggaaaggaggggaggggggaagaaaggggaagaagggggaaaggggaagggggaagggaagggaagggaaaaaaaggaagcaaggaaaagaggcagaagggcugaguggagacaaaggauggaggaagggggaaagaauagaggaaggaaaggggacaaaagagagaaagggaggaacagggaggaaacacacaacuucucugaggcucagagcuguccagcuggagaagugagggguagugguggguaacugauaaaggguaggacagauggcaauggcaagaaacacuggucagcaucagcaggaagccacaauaaugagauaaaggagucagacagcaagcaggcuagacagccaggcaccuaggagggcaaaccccaugccuugucuccugggauagucuuggaagaaccuaccuccuuugggaagguuccaacuggaacacaagcaccacaggguacauacccgugcuucgccacaucacaccccagcgacuaacaccccaucaaaccugcugaaaccucccugagacaauggaagaaaaacugaggcaggaagcagagaagugagggggauaacaaaggauggagcuuugcagagugugaugcacucaacagcaccaagcugugcccaggccacagcugcucugggcuccaagaggagacgacucuggucucaaaggcuaggcaaguacacaugcaaucacuaagcgugugugaugugggcaagcagaggagguaggacacugugcuucacacucagucaggcuucauguugcugucucuaccaacugcuucacgguuucucucuccauggcuucucaccgucagagcucccugugucuuuccuuugcaccuccugcaccucauguucauccacacaggacucccaucaaaaaucaccacaguggccucacaucuguccuuccucacuccucauuccaccccacccugccuaugggucaacgcucugcugacaccaugucccaaggucaccaagagucuccagguggccaaagcccaauaugaugucccauccuauuuaacucaacuucuuguaaccuuuaucuuuaucuacggccuguacaagggaauaaugccacucagacagcuacaucuggccccacauccuguacauaugcuaaaugguaaaaccaaucaaggaacaggggcaauuuagguuggcaauaaacuggucuuacaacagagagaguccccuggacuauccaagggagcucaggauucccaaacugggaauguggcuuucccgagcuacacucauccaccacauccccaguacuauaaggaggaagaggaggaggaggaaaugguguugaaaguaacaggaggagggaagcagcagaagucuaacagagaaagaagcagggcuacagaagaaagcugacucuggagaugaaaaaggggaggcgagggacagagcucaguggcagaacacuugccagacccagacaaggcuuagggcugaagggggagcuagacaagauucauagacuacagaaugugaacggccucuagaaugcugcugcaacaacagagccucaggaaagguagauggcccuuucacaccuugauucuagagcaauaaguguuauacaaugccuggcauacagagccagauaguaacaucuauguuguaagccacuacaacugugacaaucugcugcaucagcaaacaagaaaccgaggugucuuuuguuguugguuuuggguguuuuaagacaggguaucacuaugucucccuaguuguuagagacuacuauguacaccaggcuacucucaaacucagagacaucugccugccucggccuuuccuuccgagaacuggaggcucccucauuucuuuccuuugaggcagcgucucucuacauagccucugcuaacacacagagguaaguuccuccuaagaaccgcugggaccuagggugggcgcacuuggauccucuccucuccaaguuugccaaggauaacucuuuugguuucuacuauggcuuuagugagccagguggucuaagccaggguaagugagagcagcccugacacagcucagcaccacacucaugagcuccuuccucguuuguucaaugagggcuccaaggugcucagcacagcucuaagugcucaggcuccauccaugagcagagaaugccgggguccaccuagacccagcacaaguaggauccagagcucaaggcuauaagcuggggcugggaagaguuuaguacuuaagauaacuggcuguucuugcucagcaccuacauucgucuccuauaacccacaggguagcucacagcaucuauagcuccagagccagaggaugugauggccucuucacacacaaugcauaucaggcaaaacauucgugacauaaaauaaaaguaaaucguucuuuaaagaugcaagcaguauaauauauuagauaauggcaggugcuaauuccaaacacuuaaguaucacuauccucauuuaugaaauaaaaacacacagcagguuuucuggcuugcuugaagaauggauuauuaaaaacuuacuggaaauuauccuuauccuuauauaaaaaguuugguaacaacuaaagcauguaacagaaacaauucuuaaauaacuguaucaagaagccuacauuuuguucaaaaguucaaaaaugaaauuguaacacucacauuaacaaaaaaccugugagagcuucaagcugucagggagcauggagauggagggucccucucuuccacucuugcuucaccccagcucaucuaauggacgcuuccucaggaacgggaagcagguggcauuuuccuguucuucuacuuuuucuuaacuuugaugaagacagggguauguaugugccuucucucccauguguucugucugaagaagucccuugcagcuuucugaauaagaaccccaccuggcaacagaacaagcuucccucuggggcagcuucaggcgauggucugcccucugccacagaauacaagaugagaagcucucuccacccuuggccuuggccuucucacugcacuaaggucuccuugagagggauacaagauaaaguccccucucuuagcagucucagcuugcuccagccaugcccacugagaggccccucugcccaagcucuucccuucccucaggcauuucagguggccguccucaccucacuguucagacugucuuucagagggagccguuuuucuucacaaaccccuuuggaauuacaaucaaaugaaagcagagcuaaaugaacuuggcucccuuggaggacugcacagaccuuggucaaccuaaaggcugauguccucccaguuucuuuuucuccucaaauacaaauuguaggcaccuuaaauuuucccuuuauuucaauucuacauccauggugagauuaacagaaacccauccaaguauggaccuuugacaaugcccuuccuucuagagaaaacugccccaagcucaucucguucugauccaccacagcccacacagggguucuguuauuuguuuccuuuuucucaagaugaggucuugagcaucuccggccucaaacucucccuugcuaaagaugaccuugaacuucugaaucuucuguguaaaagucaucacacccagauuacguggugcuggggaucaaacccagggccuuguuuguguaggguaaacacucuuaacaacugagcuucaaagcagccccaccuggggucucagagcagaagggccuugugugucggucggggaguuacacuuuaggugcucucuucagaccucagccggcucauaauuaggcagcaucugguagguugguggcagguagauggaucagaagguaaguuaugauauuuggcuucagagcucugcugccuucagccacguagaccagagagaagacuaccuccaugcccccuccucagaacaacgugccuucacacuccugaccccaucacucuuacuuuaaaagaccuuccuauauacaacacuccaaguuuuagaaacugcauuuaguaucaucuauauacuuacuaaaacaaaaaacagacucuagcaagcuucaucacauuuccuguauccuaaguucccaagugggguguaaacagcaaaccugggucuccagucaaggcacacuaguuagaacacaucuguacacugagcaucgucuccugaacacaugcuagauccaauccauguguccaauccacaggacacaggagcagacauuccaaacagaggcaguggaucccagacucaggccaugcagcugagaaugucaacuucuccaggcaguuucccucucuaccucagcccacugccuacagguuucaguuucucaaacucuggaagucacugcuauccaagucccucggcuacugaaaaggguggaguguucuaucccaacuacaccugcaugcucuucaacuucuccaagcgagauucguacccuaauguuucuuaaucucuggaaacaauccgguaacuuaugaccgggauuaaaagacaauuucauuuccaaugcgaaccaggcacaaaagcuuaacaauaagaccaagaacucaugaccuugaagaagcugguauuaacuccuaagugugcugaccacagugagcccagaggcagugugggugaugaaaacauucuggaaacugaagcaguggugacugcacaacuuugucauuauaguaaaagucacuaaacugcacacuugagaaacaaaaaugagggaugauuagcaguaaaagucacaacuacaaugccacagcagagcuuuaucuagcuucccaacugccccacacuccaaacucugaaagcaauaguaacuuucaagagcaaucuucaaaggucaaugaacacuaucaccuccagcuggaggaggcugggcagaccagugucuuacguaacacaccugaucaagcacagugccaagagcagagugccgugugcaccaguucugcaacugcacugggcuacucagcucagauucugugaaaccauuacuaggggucuaugagucugaaauguuucacaucuuaauuuaucaucugaaacaguaacaccaauuacaaacauauucuaacacaaaaauucauuguucaaguuugugguuugugauuauauuugccuugguacccaagagugucauuuaaauucuuguugggcuaaugagaaaaaucacagaagugaauuuaaaacuaaaugauguauuuguaccagggucuaacauuuacagaaacgcugugcaaaagccaguuucucaaugaggaagggagguagaaaaacugucuagcacagaacaguaccacaugccaaguuccaaagaacugagaauggcccagucuguaagaugcucaagcccaagagagagauuuagcaaggcaucaucccucccauccaccagcaccauucaaauccacuugguugguucugaaguuucugggagugucauauaccuugaaacuauauuaauaguaaaaauuacaauuaaaaugcaacugcaaagcugagcuccaaaacuuaaagaauuuaguuauaucuauccuauucaucccagaugagcacuuacugagcaguggcuacuggccagauguuguucuaggcgucacacccugaaguaaguagcuaaaccuaagcugggaggcugacagcaaugacugcccuguagcggggcccucagcauccacucagacucuguaagcacugcccucugccucucuugccaguccucaaagucaaacccccgaaaugagcaguaaguuuuccuugccuguucuccucauccguggagcugacucugcuggcacugugauggauccugucuaucugugccucaucagcguccugggaacuggguagcccacuugucacaggccugaccugacaggaucagcuguugucccucucacagccuggcucugcuccugcugcucacacccacauuucaugcuucuguuuaaccagagcagccugcccagauucagaaacugucacuaccucuugucacaaaaauacccaagacaacaccuccuucaaggcuaacugacuucccagguccucaaagccaacacaucuccauggccuucccgacuagaacacuguguuccagcugagcucacauucaggaagcuuccagaguccuaaaagaauccccaaacugugguuccaaacuuuagagcuaacauuauauaauagaccagcaaagccaaucacugaaaacugcagcccaaagcuguaacuuuuuaaaaauaugcaaagaaaaaauuaaaaauacaaaaguacuaaaaacuauaugccuacacacaaaaacgauuauggaaauuuuaacagaauaaagcaguuuguauuuaaaagucuaaaugaaacauaguaauucccauggucuuuuuucaaaacaaaacaaaacaaacaaaaccuaaauauagaaagccaggaaagaugcacacaacuuaaaagggucuucuccuaugagaacaugagaugcgcacucugguuuccucuagcuguuggcagcuuggaauauaucaucaguagcugugcuguuugcuucuaucacagauuuaaaaacacacacacacacauuuaaagcacuaaaaaugcaccuuaggaacuggagcgcuggcucagugguuuaaauagcauuaacuaacugcucuggcagagaacuuggguuggauucccagcaccacauggugggucacaaauauaccuaagcccaguuccagaggacccacccccucuucuggccuccuaagggaccagguacauacauaguacacauacauauauaaauguaggcaaaacacucauauauaaaauaaaucuuuguuuaaaugcaucuuucacagaacaucuugacgcugccuacaucgugugaugccguaagagcugagucagaaaagagagggauugugugcuuacuccagaaaauagaacacuaauaaguucaaaaacagcugugccaucaugugacugggaacacuucacuacaaaaaccuguuggugccagugaguccaugucugaaggaaugucaucugagaccuagcucuaagaaagcaacaguuaaucccagcacuugggaggcagaggcaggcagauuucugaguucgaggccagccuggucuacagagugaguuccaggacagccagggcuacacagagaaacccugucucgaaaaaccaaaaagaaaaaagaaaaagaaagaaagaaagcaacgguuaaguuuugaaucaaacaguuaggugauaacuaaacaaaaacaaugccauacuggacaacacaacagagcagugacaccuguaauuaugaaggagucaucugccaucagaagcuuacauuggcauaauuaucucugacucuaggcuuuaaaauuauuaacucagaaugcagaaauccuguaguagucguucaucaaauaccaacuaccacacacuagguuccaggacagugcacacuccagcaggguaagcuggggcaugccugucaucccaaacucugaguaggccgagacaggggcacccuaaguuaagccagccugggcuacaaaguagcccccaucuaaguaaguaagaaauccauuguggccuuugcaacuuccuggaguaugagccaggccuaccaccaagugacacauaaguauagcuucuacuuuccauguccccucuucauuaucuggagacuguaacuacucaucaugaagaggcaaagugaccaugugguaacacaugccuguaauuuaggaggcugaggcaagaggauggacaaacauauggagccaucccagacuacagagccaaguaccaggucaaacaagacuacacaacaugaguguuucaaaacaaauuaaaagcaaaauuguuuuuuaaggagccaaugagaucgcucaguagguaaagacacuugccuguggcaaccugaccuaagacucuaggauccuaggaccuacaugguggaagcagagaaccacuuccuuaaucaucuauacauacaugcacacauacugucaaauaauaaagacgacgaacagacagacagacagaaaguaaguaaguuagcuaguugguuuuuuuaaguuuucuuuuucuuucuuucuuucuuuuuuuuuuuuuuuuuuuuuucugagacagggucucucugcauaguccuggcuguucuggaacucacucuguagaccaggcuggccucaaacucagaaauccaccugccucugccucccaagugcugggauuaaaggcgugugccacuaccgcccggcuaaguguauuuuaaaaagaaaggucuggggagaugguucugcccacaaaaugcuugaugaggcugccauuuaguuugaggucuuacaaugaaagcaaagacaagcaauaggcuacauuucagugguacugcacagggccuggcauguacaaguucugggguuaucuccccaacauuguaaagacagaacaaaguucuuugcaaaaaugaccaacuccagaaagaaagcucagugggcuggagagauggaccagucaguacuugcaacacacccaguuaaacggcucugcagucccaggagccugcuacacaccuaucagccugaauucaauccuaaaacccucauaguaaaagaagacacugauucccaaaagcuguccucugauuucuguaugggcauuguggcauguacacacacacacaacacacacagguguacacacacuaaacaaaugaaauuaaaaaaaaaaacuaagaaaaaagcuaggcuugaucaaggggugcuuaaaaucucugugccaggggcucaauaaccacuaaccuacucuaccugacaaacuucaggccaguaaggaacccugucucaaaaccaggaugauaacugaacaacccuaccuaggcugaucucucucucuccacaaacaugggguaggggugcacauauaugcacacauuacacacacaagaaaggaaguuuaagaaauuaaacucagaaacaaucucuauagaacaagagugcugccuugacuaaauuacccagcccuuuucuaccuacacugccucaccucuaaaaggaaauaccaucccccuuacauucuaagauuuagaaauaauuugggcucaaucacuagcaaagugcagguucuugguagucaacaacaccuuaguggagacagccuuaacucucccuguagccaacacauacaguaugaaaguggguuucucaaaccacaaauguuuaaaagcaaguaugaauaaaggaauuucucaaaagucaagugagucacacauuaucccccagaguccaacuguggggagggugugggauagaagaacaugguggcuggguacacaggcuauagagugagauggagacacaagcucacugacacucagcugcucucaggccacaucccuuucuagcaugagccccuuguuccaggaaggggaucuagagaaaagcagucuuuguacaaaaagcuucucaacaagccaacuauuucccacagcucucagccaucacggccaucuaggccacucuagaaagaaaaugggaucuuagcacucacaccacgagccaguacagagaccucaugggcaagguagacaacaggauuucccucaccugggaacacaaagucccagugagagguacguccauccaaccaguuugccuucagguuuugggaucaccaugaagaccacagaaggaagaacucaagaaaugcccagacagccaaaccaaggaaguggugccuccaugacuacugaccacuuccuccucucugcaguccaagccagguucuuaacacaacagagacagggugugcggggcugucaccacgggcacccuagaauuaaauguucccaccuaagccuuccaccuucccucugcaguccucuaguucuucuaaagccaagaaauaaagaggaauacagagaggagagagagaaagaaagagagagagacagagagagagagacacacacacagagagagagacagggagagagagagagagagacagagagagagacacacacacagagagagagagacagggggagagagagagagagagagagagagagagagagagagagagagagacagggcaugcacaugagugaauaaacuguaggccaaucuuuaaaccagauuuuuccucagagccucgguguugagcugaccaaucacuguaaaaaaugauggcuagagaggucuccugccagcugcccaucacccucagcaacauguuccccucugggcuugaugcugcacacaccugcacaaaacagucuaucuuuucucuucuagaccugcaguuucauacuucaguugucugaaagagggucaacaacagcagcuggaguauggagacaacauacucauuaaucacauccucucucaacacugcuggacaugguggcucaugccuaugauagcaacaguuggaaggcuaaggcaggaggaccaagcuggaacaacauaucaugaccuagucuuguaugcacaaaguccuugauugauguuuuauaacacagcuaauauguuagaaaguggagccauguaaguaaguuagacuuagaagcaaauaaauaugucaaagaauuugccuaaaaguuccauaaaaguuuacagcauugauguaaauguaucugccagcuaaauuucagacucggccacagucacuucugagacuucugagcacacugucagguagucuguaacaucaaccaucacuagcccacacgcacagugccuauuccuauggaauguaacuggagagcaugcuuaauuuuguauguuuugugacaauuauaaacuugggcuaaagcauaaaaauguggugucaaaucugugucucagggggcaucaagaagcacuaaguuucuguguaauaccuaacauaggagagaauuccugcaaagcuucaaaacucuacaguacuguugacaagagacaguccaugacuaagaugcaauuuuagcauauuuacuuuuuuuuccccaggucuaaaauauaugaaauccuuaauaaguaaagcaugcuaguuagaggagucuaagcuaaugcuguccauggugaagcugcucucccuggagagcaaagaccuccaugcaaguaagggcagcacauaccuccaagaacuacuccuugagacaaagcaggaagcugaagguucugguacuuaaaacuguaguuugugcaaauggagagauucauccccacagccucccaccacucccaacagaguccaggugaagagacaucacugcuccucucgcauccaucagcagggaggagggagcugcacuggaugcuaacuuacaaggaagcagucaaccaaccacacauuuaugcuagcauggcaguaaccagucgugugaauuaaagaaaugcaguuuacaaacugauaaacacacacccaguucucaccaccacaguaaucaaagucgccuuacauugaaauggcuaauacccaauuucuaucaccacuacuggcuauuaccccaccuuaaauacuuagauuucaaacuaaaacuuuagagagcaaaacaaugcacuacuaauauuaagauccccacauuacaauugaucaaagaggaaagucugcccaggacaaacuuccuuuccaucuacuccaaaccuaccuaucuggguaucaaguauguggccuacaauccagccugcagugcuaauaaacuccuauuaguaaggcaaagcagucaguauuugaagcaaacucuuucaucaccaacggccugauaagcucauucccaacucuacagacuuggaauuuccagagcacuguucucugucucacacugggacuguagaacccaugcugcccugagauagagggaaagaaaccaccaaaugcaagaugcuaagggcaagaaaacacaaccgacccucaugcugcguuaguggagucacguucacacuguacugccagugcaagccaagcacaccagacuggccaagacacaagcuaauuugugccaacucaagaucaggaauuguuuucauugacagguucuuuguuccaucuguugaauuuaaagcuagcauaaaguacuucuauguaaaacauucuaacgaguccaaccauaagauaauauacucuuaaaaauugaaauguaucuaccucauuaguguuccagcggugccucucuuuggguaaacuugaacauuucggcagacauucaagcagcuuuuucgguaaaaagauuuuuacaugacuacuauugcuguucccaugaucaucuauaaagaaaaaaacaauaaauucagagaaagaaagagaacgccuccuuuuaaguauacugucaagggcagaagcaacagcucuacuguggggcuuaaaccaagagcacagagagccucgcuccucuaaguuccucaccuacacucuccgguggacagcagcaagcgccugccugugagcaucacaaacagccugagcuucacccaucacaagcaagcagaggggaagcaccccagcagcacccacaccagaagcuacuucaaagacucuuccaggguuucuuuaaaaaaaaaaccucagaauuacaaaaugacuuaaucucauaaaaucuagaaacuguguguuaaccaaguuuaaaguuucaugguuuugaaguucaaagaaauauaauuacaugugacuuuuauucauaaacuaaauguuccuccguccccuagaauacaaaucagauuuacccuuugcaaaggaaaucacaaacucucaugaagaauuuaagccuguagaguugacuaacagguaacauggaagcucuucugaucacuuuaaguugauuuccaugaacacaucugcagaagucaugcaguucaucaaauguagcuccugcuaagugagccugcgaauucacugcauuagacaacacagcaggucugacuuccugaagcuuccuucccagauccuuucuuuauauuuaccuccauuauucauuuacacauugcuuacuugucuacuccuguaaagcaaucucuuccuaauccauucccugccucuaaacucauugccaguugugguaaauuccagucaguuucaaauuacccacuccaauuuuuuaugcuaacugaaaucuccagucuccaccuaaggggccguguacacugaguccuggggacugcuuauuacaauguuaacucaagcugcuccaguccugugcucaucagcacucugacaucaguaagaacacccacccggagucuguagcccauacccaugcagguucugccucucugugugugaccuuaggugaguuacuuaguaucucuaguuuucccacaucaugaauuagagaaugagagaucauuuaauucucccuccaguacaaauuucuauaaaauuuagggcccuucagcaucagcucgccuuuuaagucagcagccucacggucuccagcugccaugugaugacaugaacagugauauacagagauuuaucuguccaguuaucucugagcuucuaguuaaaacugucuuuugagggguaaauaaaacaacaaaacuuuucuaaggucacaauauuuuuucccaaacauuucucaucugauuagcauguuucuucuucucauggauaaggucaaaagaaauaaauacugagaucaagauuagucugagacaauauaccacaccauacagaaugcuuucuaggaauuaacuugagagucuuagccuacuaauucuuuuuugguccaugaaauacacagccaauugaacuguaacacaacuaugugucuguagcagugaaaaacuuaggaaacuguucuuaggaaaucuaagauuaauucaaaauuaagauuaaauuuuaaaauauugcuuaaaacagaaaggaaaucaacuaauaggaagaugguaggacauuccuacuaacugcuaacuguaagaccuuuguagucucauguguccaugcauguucccaacacuucaucagggaggccauaagacuuaaagcacaugaggaagaaucaaucacaggaguccugcucucuaccccaaugcggguucagucucucuuuuaaaaaacaaaacaaaacugugaagcacacaguuuugaacauagaggugaaaucaugaaaucuauauucuauucaauagccauggggcaucuuuauguaaacagcacuaggauaggacugagucaauauaaagugugccuuguguauggacagucaccucccugagaagccacuuaaagcacaacagaaaagaaacucuaguuucuacuucuauuuguggucacaaccaaugcuaaauuucugucccuuuagccucuaaccuggcugccagcaguaaaguaagugugugugugugugugugugugugugugugugugugagagagagagagagagagagagagagagagaugcaaagacagagacagaauguugagugcacauagguguaagacagaaugucaaaugagcgugugagaauguugaauuauguaagagaauauugaguguaugagugccuaagaggggaaaugcugagugugugucagugugugugagagaauguugacuagccaggcaaugauggugcacgccuuuaguuccagcacuagggaggcaaauuucugugaauuugaggccagucuggucuacagagggaguuucaggacagccaggacuacacagaaaaacccugucucaaauaaacaaaaaauaaacaaacaaacaaaaaaaagagaggcagaaacuuggaagcuaaagagauagauugccaguuacaggaacuggcuacugucccagaggauccagguucaagucccagcauccacauggcaguucacaaccguccauuaacuccaauucuaagggaucuaacaccuucaaacagacauacauguagacaaaacaccaaaguacagaaaauuuaaaaauaaauuaaaguauaaaagaaaaacauugagugugaauugggacagaaaauguugaauguguauguauguguguuuuuguguguguuuauguguaagagaagguugagagagaguguguguguguguguguguguguguguguguguguguguguguguguguguguaaaagaguuuauauucaugagagagagagagagcgagagcucucaauggugcaccugcgugaggaaagcuccaggcaggauuccucuccaauacuagcugagacagugguaaguggacagacccaaaggcaaacauuuaaggaggagagcauagagccaugugagcacugucacugucacaauccaccagcgcucucgacaggacuaugcauugaggguugcucugcuuuuaaccugcaccauucccagaauucuagguucaggcugaacauaagccaggugcucucaggaacuauaaugauggguaaaucaccccucccucccagcuuauacuaggcaguuagaacucaaaagggauaauacuaaacucacacuucauaauucaaaguuuggcauggugguagacuaugugccuagaaacacaggguccugaguucaggccccagcaccauggaaaaauaauccaacuucagugccucugguuuaaaguauggcaauaaaaauuuuuuucuaaauuaaaaaaaaaaaaaacuguucuuuauauuggaacagaacuguucacauaguaauaccacauaaaaauguaaucuuaauuaaaagcuacuguuuaauguuuuuacaauagcuguaaaugauuaaauaacagaacauauugcuaguuuuaaacucccacuaacaaacaguaucuuaacaguaaaacuaagguauaagccgguuucaacugucccuccauauucaagccaaacaguucaacucugacacugcgaagugggaauaucaacuacacgacaggcacacacuucauuaucguuaucuagcaaaaacgugugauacaugacuucacaauauaauuuccuaaccuacuucacacaauaaaaauguaaccaguggggcuccugaaauugacagauggugugcuuggccgacagcuauaauucuagagaaugaaccagccuuucuagucaaccuucaaauauuuucuaaaugauaauguuagauucauaguguaauuuaacuaaaucuuucgaaaauguacaaaaauguucacucaacuaacugaauucuaaccuucaguuuugguucugaaaauugagauuugcauugccaaaucucugacucaacuccagauaaaugcacuuggccuguuucuggguccuccguuuucugcaagcuaaggcauaaguauauuaacuagauuagccugguaaugauaccuccauugucuuucauuuagaauacaaauggggcaguucggggccuauggccacagagaacagcuuuccucagguggagcaaugaagacucaucgggaucuaggccucuagagagagcagcacgcaugcucuggugaagcacaaguccuacugcucacucucgcgcgggcaugugcucgccggugcggagagagaauuaaaaggaagcuccacacuguucuguuggcucuaagucuuaugugcuuagauuucauuagugggaucagggaagcaagagcacacuggugcaguccaggugacacaguacucacagcaacacacugccaugacuaaccuaaccuuccaguuccugucacacaggcgggacuaagcacugacuccauaaagagcacugguccgagcgggugcuaugaagcaaaugaaacccaucuguaauuccccgggagucucaaugguuaaaaagcaguuaauaaauuaauaguguuauuuuacaaccucucuuucccgucuucauggagguaugaguaccacucucacccuuccuagucuuaggcagccuagaguuaccauguuuucuucaaccaugucacuauguuccugguccagguuuaagauuauccauaagacagguucuguaaacuccuauucauucuacaguugacguuucaauauaaacuauggggcaggaacagacaaagcagaggcauggacgccuugcacuaagugacaccuaggcucuggggcucucuccuguccauuucccucagcuccagcuucagcaacagguuacagguucuauuucugaguaggaggaagacacuccuggagggcgaugguaacaugccaggcaccagacagagcuguauacuaggaucucguuuaaugcucaugagaguaaguaacuccacugggauucaaaacuccucuuuggcuccugcacaacagcaccucacccucucugcagcaucugguacuagacaccucaguuacacaagugcuguacuaauagcagccccugaggggcucugaccuuucuguguggcugaauccacugcucacagaaagcucacaagcugagcacuguuuauguugccugaaagaaccaaguaacucaucuaagaucacacaacagcaaaaggcagaagcccaggacuuccugguccagggccgucuucacugcacuugaaggaguuacucuggcugccggucccacccauaccugaaagucaaaagcuuuucaaauccuaccuucuauagguggcacgguguugagaacacaguaggugcuaguuccgcagaauacacuuugggaaacgcucuaaggaaacagaaaauaaaauguaaaacuaaucuuugaaagagacauauucuggcucuucugugauauuccugccaaagaugcaaaaccugaaucuaaccaugagguaacaucagauaaauccaaauguggguauuccacaaaaugaccggccuaggaacucucaugccaagguuucacaagugagacagacugagagccacugaaagccaucugugacccaggagaaugaagaggcuacugaacgagccccagaauucugacuggauuguuuuuaacaguggucaaaagugaaauaggauuggggggaacauguuagaagugucucaaugcuuauuuccagguuguagcuacuguaguuaggggaucaaaauguucuuguuugugagacauacacaucacagcauuuaggagugguggagacacuggcaucugaucugcaaaugguucugagauaacagugcuuugcauggaggcugaagaucacuuugaaacuuaagacaaaugugaaaauauaagaacacacauuaucuguaugauaauuaauagagugcacauauacugugcacagaauuaacauguaaaaagcaauguccgugacauccuuaucugcaguccauaucaacauuacuaaccauaucccagcaaugcacccaacaccuaacucauacaaaagucucagcugagaccaaagggcauggaggaacaagaggaggaagucagaagacaugggcuuugcugccaagaacuugggucucuccagucaauuauuuucaguccuaagaauaacuucuuguuuggcugcaauacuaaaugagauuuuagauuauuuaucauauaucauaaagcacauauuuuuacacuuggagaaacaaaguuucaaguuaaacagacacccauagcguuuacaugugaaguacaaagacuacaguuccaucacucacuagcuguccgugggaaguaaccaagccuagagaggugauaugucaccagagaaaggcaagaugacacucccuccuaugagaguacuccccucucuuaucuucuccaaaguaaggaaauuuaacuaucccaccaccuuuauaaacaccacucuugcaauguuagcaaggauaaucuuuaacaacuuuaacauuucuaagaguaaagaaguuccugacuaaacaugacuuucacgaauguucccuuuccucucccagcugugaagauccagagucucagaagugaauacaauggaauugcccuauacuacaacuccuaagccuguaacagcuaucagcuccuuagcucuucucuucagugucuggaaacuucucuuaagacuuucacuauccuccuccacuugcuuuaaccaauagcagcaaccuaugacggcaucugcacugacaaucucugcaaacaucuagauccaagaaccaucccuacaaaugaaagaauauggcccguguuagaccugcccagcacacaacagcaaucacaagacaucaggaaacacggagaagugaagcaagcaaagccccgcaucucccucuccaucugccagccuccaagcaagcaugccaaccacacaaagacaacuguuucccauucaaggcguaacauuuucugccuauuacuaaaaacaauuaacauuguuuuuaaguguagcuacuacucaggacaucuuagcaggcucaagucaaagguuucuaaaucacaagugucuguugagacacacuaaauauaaauagccuuccaaacaaugggguuuucacaucuagcuuccaagucuaauaguaaggaauacaaagugguaacacagaguucagacacuuaacuucaaaaccuccagauucucauagcacauaagccauggcacaagacaaugggaacaacgugaggcagccaccuugaccagaaucaagggacuuucacaggaccacaugagcaccauaucucucgaggccucucugcaauagugcaguggcuuggccaaaggaagaccugcuaguuccaaggucugcaaagcuggagccacccaacuuucuugguuccucaacucacugcugacaauucaggacagaucaaccccaaaaggacagcccuguagcaugggaaaguagagguauggauccaaguccucccacagcaguguguguccugcugcucuaccagguugacagccuucaggaagccucuggccccaggguagacaugcuagggauggaggggugagaaacaggcacuccucccacaacacacgucuuuaaaugacuaaaggccuugagagaaagaaggagaaggaggaaagcucuucacagucuuugcaguaaacacugaggauguuaaagcuagucuacgaagcuuauuaaaucaaaggggaaagcagccauauuaaaugcaguaaaccuuugucccaauuacaagugauacaucaaacauuuuugucaccugcucuaccaagacuugggcugguucuugaaaacccacaguccugacauauaagaaaugagauuaaagagaguuaacuguuagcaccucacuagucugaccggggcauucuaguuauaguaucucaugaguaagacaaaguaacacagagcauguuaauaugcucaaacacuggcuauaucuacauuagcacaugcaaaagucccugacaguuguucgucccuguuugcagaagauucuccuccaagcagcagcucuggcauccaugccccuucuaucccauggcagggacuuccugggucucugggcuacucugcacugggacagaugggacagcacaugcucaugcccacauaugcaaggagccaagucagaaggcucacuccccugcucacuccacuggugagaacugaccacaaagccauuucuaacugcagcagagaaaggcccagaaaagggaacaggcucaagacccacugucaucucagcauagcaccaucuguaaacugccuguaacugcagaacacccacuucuuuuagaaugucuucaacuaaccaaaaacaccaccuaggucacugugcaucuacagccaaucuagucguuuuucuucucugguaaacauuucuaacauacucaaaucugacuacauaccaagggcauccuugaagggaugucugccuagccugcucacccuauugucugcaaugcuucacucaaaguaggccacauaaaggaaguucagguguuuuguggcauuuauaaaugaacacuauuuccaggaguucguggaaaggaaagagcaaugcccugggcuuuacucaaggcccugggccucugcuagcacagcacagccacaguccacucuguaguuaucagacaugacucugaggugcugucccucaguacuccuguaccacucaggagcagaucaguagccaugaacucccucucaguacaguuauguuguggauauuuuuuuagaacaaguccugucucuucauucaagaaacuggacaaaaugaauugucacggacacuaagagccaauauuaaauuuuugguuacacuacaagcuuguuaaauaagaaaagugcaaggucugucaaaagauacacauuuggagacacuccaugaaaccaggcuaaugacaucugagacugaagaaccuuuagagacugaagaugcuuuauccuuucccugaacuacaaaaggccaauaggggaggaggucuguacaaaaauacauuaagcuuauuuaucucacaaccuuucacaaagccugaaauacccuaagggcuguggcucuaccauaacccucucaacacuccagaagaacagagacaaaaccaaggcaaaugcuugcaccaaaaggggcaagucuagaaggcaguucuuccuuuuucccagcaggcaaaaaacaaaaacaaggagacaccagcugcuaagguagcuggagaacuuagagacucccaagagaugaaucuacaggcaagcaagugcuaggacaaagacggcaaagcugcagaaccacaucuggaaagcauccagccuuacagacagccagggaaagagaguugauuccccauaaccagagauguguguaggguauaaaguaacuucagaauuuuuggagggauuuuuacagguaagaaccaaacuauugucauaauuuuucuaaguuuaauuuucccaggacaaaaguauauucaacaaucugaaaauaaacagugcuuaauaagugucaucaucuguacaaauguccaugcugcaauacacauguucugcaaacaaccauaugagcccuagacucuguugcuagugacuccucagagacggagauaaaauaucagcagaaucacccaggcccuccaucuguacugggugacucugugucaacuugacacaagcuagagucaucagagacaaaagagccucaguugagaaaaugccuccaugaaauccagcuauaaggcauuuucucaauagugaucaaugaggaagguuauaggugaugccaucccaaggcugaugguucuggauucuauaagaaaagagccuggcaaaucaggggaagcaagccaguaagcagcacccauccauguccccugcgucagcuccugccuccaggcuccugcccugcuugaguuucuguccugacuuccuucaaugaugaacagcaauguggaaguguaagcugaauaaauaaacccuuuccucuccaaccuuuuuuuuuuuuuggggggggggggggucaugguauuuuguugcagcaacacauacccuaagacaccagcuaacaccacaucaucacaagugucaucucacauaaaaucuugguuuauuccuccuacaaguaguagcagacaguauggcuauucuagaaaaagaaugagaacaagucugggcacuugaccccuaucacuggcagggagacaagcucccagcagaguuccuagccuccagggaacuugggaaugcugccccacuaagaagugcccagagucagggcaggaagaagcucaggcuaacgccaagcgugccucagugcugaccugucuaugaucuucacagcuucucagcauugucuggcucaugaacaauaccaccuaucaccuaacacuacaguccuuaaaauucaacuaaagcuaaaggagagaaaggcaaugaggcacauaccaggacaaugguagacucgccugccccaacuccaguagaauuauggacgugcaccuugaugugaacagagcagagcuagaaaggaagccaggcacugggaagacccaaggaggcuuuuacaaaaucagugugcaucgccucaccugcaucacugagaaaagugacucucaacccacauuccuagcacgguuaccauuaaacuacucaaaguucuaacacauuuaauuaucagacugccaagcccagggaagaacagaggcagcaaaucagagggaaagaaacaguacuaaaaucccacacaucagcagaagcaagagugccuagacagcaaagacagguuuuguuuguuuuugaaaacaauaaaaacugaacacaaggcuuagaaagauacagcagcuuggauucaucugccauaaaaguaaaggcuccacucacaaggccccaaacagcacaguagcacucacagcucaguuccauaaccuauguccaucacaaugaagccaaaugagcaaaugagaugucauaaacuccaugcauucuacauauuaucaaagaccagucucaccccuuuguuuaacauauaaaauacauccaaauggacugacucauuuaaucaacagcacccagaaacagaaggcgucgccuguacuagucagguaaacaagucuauuuuuaucaagggagauucacaucagggccaguaauaagacgguaauauuaaugacaugaaagcugacuccuccuagugugaugauacaggcuaccugaaaagcaucaccauauggccacaucucuuccauaacucccaucacggcaagcaucccaucugcauccacagggccuccacuugcagcacugccccaaugucuccuacucacauugucccucccucccuacgguaggaagcaaacuuccugauggaccugcuacaauucaucauguugacaucuucccacacucugaaggcuguaugaagugagcauauacuugcuuuagaccacuguaagguuucauuuccugggugaaacagauugcgacuucugucaucuuguuacucagucuucuuaacuugcugauaaaggaaaaugccaagugggagaggcucauuaaagguagucucccacuaagugaauuuucagaugacccuggaagcuuggaagccaauucuucuccagcugaaccuucgaaugagagacaaguccugacuaacacugaaaugguaaguucaugaggcccuaggcagaacuuagccauguccuucugaacuccagacccacaaagaacccuagaguaauagcugucguguaauaagagggaaguuugugguaauguuuuacagcaucagcaaauuaacuaucaggucacagcccaacaacuaaaagcugccccauuuuuguuucucucuuuaagccaucauuucacuaucauuucauucaauugucugcauauaccaacaaaauuuaugucuuaauguguacgaguucugcccucaaguguaucuguguaucacuuaugugcuugaugcaugcaaaagacagaagaggguguuagguuccuggaacuggcauuucagaaggcuguggccugccauguggugcugagaaucaaaccuggucuucugcaggagcagccaguaagugcucugaagcacugagccgucucuccaggcccacaguacucucucucuccugacccucuccaagucucacaccgugggauccuggaccuggguuccuguucaguugccucucuggccauucuuuccuagccccuauguauccucuuccccuuucuacccucaaauaccuucucuuccccauggcaaccucaagcacuacacagaguucuccuaauucuuuugcuaugauucauccuacccaaccaaaaggcacuguuacuacucuggacagaaggacacugagcccagucaagcaaggcugcugcuucaaugaagcuugccccugccccagagcccuccaguugcacucaccauuuuccauuuugcccugcaccaggaagacugcccaccaugcacuucaacaucaggguccucucacugauagugccaugaagaaagaaagguacugaacuacuuuuaaaccuugccgccaaguuuccaauguggcugugcacauauacuuuuguaucaucuuucucuaauauuugcuucucagugccaguacauauggcucaaaaucuaggaagcaccuucuaauauggccuacacucugcuacaaaauucauucacucuacacucauucacagagggguguguacaggcguguguacacucaaaccuacuagcucuuucuucagacaaacgcugucaagauucuugucaggcaugauuuucccuagaccacuguggcucauuucucaacuaguacaugaacuucagcccagaugcucaugcccacccuccagaagcauguauauaacugaggagaaagaagagugaucgcgcaaccccaaggcuguggacagggagcaggcugcuaugacacacugauaccugauccaaucuggacagaggagaggccaagaaggcuuguaagagucucauuuaaaguaaacucagagacagacagacagagccaucaagcacaugagagcugugggccugcauucuggaagaagggacaccgucuaaucaagagcagacuuauaccuugccuacaacaaugaagaaaugcagauucuccacaaaagcagacugaaaacuucaacaugcuguggguauagcugagcuguguaugaaguggagcaaagaguccuuguuagagaugaauugauuuuauccaaucuauucuacuucucuucugaaaacaacauuuguaaaaguaagagucagaaaauaaccuaacucucuacauagcuauacuacgagcccaucuggucaccuggaacucucuaaaauucuuuccucgguaagauuccacaagcucuccaaaguucugcccaaaauccuccugccucucaggcuagccuuuauucuauaucacauuugccuuaagagcaccgaaucccaucugcaguucauaugauauccuaaugucagucuuccccuuuccucccacaaccccacugcuccaugaagacagaaauagagacugaaucuguccuuuucugagcuuugcacagacaguuauuaucugcugaguaaaugaccugacucaaaagcgcaguagcagauucccacaguaaauacuagacuaucuucugccuccaaccacuguauaaaugccagugccacuugucccaccuccaauaauuacauacauacauacauacauacauacauacauacacauguauacccccacauacaaauaaugugcugagucuauauuaaccaaauguauauuaaacagcaguaaacuuuuagagcacaggaacacacugaggcaucuccaggccguaagcgcggcugcuuguugucucauccccuacaaagucuagcaccagccuaacagugaacaugagcguuacaucaagacagcucacugcugugaucauuucaggcagcaguaugcuuucaaggggagaugcucaacuucuugagcuaagcaggaguuacuaagcauauaggcagauccauuagaaugauuuuaacuccucaaacagauacagauuuagcauaaucucaauagcauuuacuguacaaacuggcaaguugguucuaauauucaaauaaacacaaggaauauauuauaguaaaagcaauccuaaaaaagaacaccacucgaggccuacacggaccugcaagccgagcucucaggauggugaagcagcaggagugcaacaagugugagcccaaccugggcuacgacacucagccucaaaacaaaacaaacaccacuauaucacaaagcuccaguagaagaugcaguccacgugauggcagaaacaacacguauagagaaagcaaacgagggcugaggcuccagaaaaaauccuucacacugacaguaaaaccacugucuacacaccucaaugagaacagaacaguguucuucaacaacuggacauuaccuaggaauggaaagucuaccccauaccacaaacaaacaguaaugcaaaaaugaaccagagaucuaaacacaagcacuaaagcuauaaacuuagaagaaagcaugggaauggguuucaugaccuuggacgaggccuugccuccuuaacugugaugacaacugacugggguaacaccuuaucaaagugccucaagagaaucaagaaagugaaaagagagcccacaaaauggaagaaaauaucugauuaagaacugauagucacaauguagaaagaacuuuuccaauccagcaggaaaacgauaacugagaguaaaaacaggaaugccuccgaagacacacguccccacacaccucagaagacacacguccccggacacaccucagaagacacacguccccacacaccucagaagacacacauccccacacaccucagaagacacacguccccacacaccucagaagacacacguccccacacaccucagaagacacacguccccacacaccucagaagacacacguccccacacaccuccgaagacacacauccccggacacaccucagaagacacacguccccacacaccucggaagacacacguccccacacaccucagaagacacacauccccggacacaccucagaagacacacauccccggacacaccucagaagacacacguccccacacaccucggaagacacacguccccacacaccucagaagacacacauccccacacaccucagaagacagcacguucccaugcaccuccaagcagaccccaacaucagucacugggagauacccaugaaaaccacacugagaguuaacuucccgucuacaagaaccaggagaaacagcaaggacagacagacaguagcaaguguuagcuagcaagggaggaacuggaacccucaguccugcugcuaggagcacacuccagagcagccacaucgcacaagaauccagguucuuuaauaacagaguaagcuauaaaauagcauuucuaucuuaggcacgguaaccaagaggacacagaacaucuuugaugacacaaccucaaugacuggugaauagauacuuggaauguggcagacaguuacaggauuuggcaccccaaaaagggguaaagagacaugaacuucagagcaucaucagucacacaacacgauaccauaaauccacagcuaugagguguccaaaccagcaaacccaucaagacaggaagcagauuaguaacugcucaaguuaagggaagaaugggggaugccuccuaaaacauacaaaauuuuauuugugcauuaauuguacaaaauaauccauuucauuaugacauuuucauacauuuuugcagugugauuugauuuuagcagguuuucuuucuggaguaaugagaacgcuguggauuuggagacagcugcacaacuguaacaaaaauggucacaggguauaugugauguauaaaaucuaucuuaauaaugcuauuuuuaaaaaagaaaucaagcuguggguagugacacuuguaaucccagcacgcugggaaguaaaggcagaaggaccagaaguucaaugccagccucagcuauauacacacagacuucuaggucagccucagcuccgagagagagagagagagagagagagagagagagagagagagagagagagagagagagagagauaugacacacacagagaaucgauuccuuuaccuccuccuuugguuggggagagcacaaugcugagcaaugcucccugcacacuaucuacucaaggucaucacuaugaaacaccgauugcuaauccccuguagguguggaaaguucgaaggcucuccacccuuuagucuuccaaacaguucuuucaaagucuucaauguacuuucuauaauucuaugagaaaucaugaagaagaagaaaaagagagaucaggggacaggaaggagaggugcccaaugaggugcacacaaguggccacaggcacaaacacaucuggguuccuccucccauacccauucucagggcacugccuuccacuguuucuagaauuuauauuuauuaucuuuaauuaggugcauauguguguagcuuauacaaaugaaugcagucaccuacagauugcccagagcuggaauguggguacugggaacugaacucaagcccucuguaagagcaaaaccagaaagcacucuuaacuacugagucuucucucuagcccaugucuuccaaguuuaccuaaggaugcaaaacuucaaccacuaagcugauuguccauaaccaggggaaaggaaaugaaguccacacaaaaauaugaacuaugagaccucagcugacagugacacccaucccccaaaaaaugucugacauagcugggaacgcccacaaggcagaaagcacacaaaccaccguacccugggcacccacuuuacacagucaaagcgcacgcucuggacagucacacauccagaaaugauuuauuucucauacaccaaggacagcugaccaauaccuucagccucccaucuguagcuacaauaaacauuuucuaugacauuuguuuguuugugugugcaccucuguuguggagguuagauaacuucaggagucaguucucuccuuuuaccauguagguucaaaggaucaaacucagguggucaggcuuggaggcacaguaagcggcacaguaucauuuacacuacuugauggagccaguuuaagaugccaugaccccugcuacaaaggcacaaucucuucucugcuuagccccucuaugucaucacucaucuuagcccaccuccaccaagacaaaaaccugguguuuggacacaaaacaagauucaguccaacucugucuuaauuuucuguaccuccugagccaucaaaggugaagucagauaaugaugagcacuagagucaagacaugcucgagccaugacugguggccacagcagacaacagccgcauuuaacuuaagcuaagaaacgaagaaggccuccuugcuagaaaacuaauaggcaacagaagagagaagagcuuuggcauggaaaaugggaucccagcucagcccaagugucccuagaaaaagcuucuaguguagauauaccaagggcagucccagagucuugcugcuuuacggugucccagaagccuuaguacuagaacugcccccacugaaccuggccuauguggccaggcucuugcaacccaaaaugcauuuauucuuucugaaacaagauuccacuauguagagcuagucuagaaacacucugcagaccuggcugacuagcccagaaugagaccucaccauggccuucucuucugucaguggugcuacaacauacccaauacacaauuuacuguuguaguaaucucugaacacacaagguaguggcagcaccccauacugugcauuaaaaccauucagaaagauccuaaguuuuuauuauuuuacugaaucaccaguucuaucucugcuccuucaucaaaugaaccucugcagggcaggccuggcaaaauaugcagaaaacagcaucgagcaggcaccgcaacugaagcaccagagcagguaacgauauggcauaacuacagaggccagaggaacagaccaagaggacagacgagagucaucacgguguuugcucaggcugagaggccaucucaguaccacacuugccaucagagggcaccugcacaagcagcaauggcuuacacguaggauaaugugacugguacagaaaacacaagucucuucccacccaaaaugccugcaguaaauucugggcucuaaauuuggucaaguaaucgaugaucaauuucuggaggaccccuaggaagaaacacaaguccuuaaaagcucugagugcccacucgccaccccucgauguuauagcacaacagccuccaucaauaaaauuaaaugagcaagaaaccgccucugaagcugugucaaagcaaaagacucagccagcauauuuccuaacagcagagaugggacaaggcaaagaauauuuacaggaacaccaggaacuugaacuucuccuccuguaucguuaaguacaaaagaaacucaaaacaugaauuauguucaaaacgucccacaacgcacgaccuggcacagcccagggauugugucuaagcaaagaugcuauacuauugacugcagcagaccacagcaacuccccaacccacaacaaguuuaauaggagagucuguguuuacugaauuacuggcaaucaauacauuuuaauaacgcuuauauuaaucaacuccaaaaaacacagcuaaaugaauauaaauacuaucuugaacacacaugucuggggucagcaaauaauacuuuuucaacugcagucauauauuuaagucuuuaaguauuuaagucuacuuucuaaaaguauaaacccucauucauaccuaaauaaaggcuuuaaauccaccacagaggauaccuaagaagacuguuucuguauugaaaaucuucaguaaaaaccuuaacaauuuuuuuuuaacuuucuuuagacagagggggcauuucuauguacagcaagcauaaaggagguaccucagaggcuauacuucaaacuccccugucaagguguaagccuacauauuuauucuugaccugguauaagaacuucaaaggaaaaaagaagucccacagagcagccaguaucagcaagggagcugcaaaguaaacugcaucuauccaccuucacucccguaccauccugaggaagaauggggagaacuuucagaggucauuucuaggacagcacuuuauccaucugaacaaucuccuuacaaucauuaccaacuaacucaugacacagagcugaggucugggaaaggcaagauggggagaggagccagagucaaaaauaacaaauggaugcaugggaauugucugauaaggacaagagauaaggaggccaaagagagaggcuucuaccucuggccccaaaaguagcaucaaagucaggagcacccugcugguggagcuccuuaguccaaggucaccccucuacuaaggggaagaagcagcccuacccaggaaccacgggggcuuauuagaagucagcagauuagcuuaucacugcuugauucagggaaggaaaggacaagaaugcugaugccaagagacaucuccaauauguaaaaccuaaucauugaagcccccaacuuuucagacauccuacggagggacacaguuuugaaaauuacaaagucuuaacaaaguaaacagucccuucuugggaucagcaagauggcuuagccaccaagccugacggaaccugagguugaucccugaaauccacauggaggagagaacagacuccucucaccuuccuaugucuccccuaccacauaauguuaaaucauaaccaaaaacaaaaccuggggcugaagagaugucucaacaguuaagagcacacacuguucuuccaggacucuauagagaucaguucccggcacccaugucaguagcucacaaccaccauccaccuccaggaaguuccaacaccuuccugggaccugcaaaggcaugguacucacucucauucacucauguacacacacauaauuaaaaguauaaucauugaaaacuaaauccccagggcuugagaagaugcucaguggcucagagcacuggcugcuuuuccagaggacccagguuugacuccuaacacccacaugguauucucaauucucuguaacucaguucuagggaaccaauacuucugacacagagugguauacaacauacauccaagaaaaacaccaaaacacaugaaucaauuuuuuuaaauguaagagcaaacuuuaaauauaauaaaaaugauuccugucuucaacauuacuaauaguugagugguagcuuccacaaagcccugcauccuauacccagcccuucaaggggaaaacuuguaccuacacaaugaauuuuuacauguacuauauguaaacacauacagucacaugcacaugugaauacacaaugccauaauucuaaauauuuaaauaauuaucaaaacuauuuaucucuuaggaaaaauaacaacugaaaugugugccuucaaaugcauauccagaagcuaacugcuuucuuccccuuaguacauguaccaaaauaaagaaacaaaaaaacaaaaccuagcucccagagaagucacucaucuguuaccaucagaccacucaaaacauauaaaguuccaucauaaggauauaaggaaauguaucugagaugucacauggcuuaaaaugcugcccccagggucugggaaaacagcuuaaucaguaaagugcuuuugcacccauguaaaaacugggugcaccagcacauuuccaccacugggggguugacucagauggaucccuggggcuuuguggccugccacuguacgcaauuagcuccaggcugaaugucucaaagagcuggaaggcaccacaccagaagcuaacuucugggcucccuguguaaucauuuucauuuguauggugggggagacauguggaggucagagcaaaacuugccgaggaggucaguucucuuucuaccauguuugguagaaaguuuggugacaagcccuuauucacuaagccaucuagcuggcccccaaaacaaaauauugaacauaaaacuuuguaccuuucagagcucuguaccucuagaggaucucuaaaaagcugugagcuguaaauaggauuuacacaugaacacacaaaaugaagcuuaguauuaaaaaaauuccagaguaagauacauuggcaaaguccuuaguucaucucauagugagugcgcacgcacacacacauacacacacacacacaguuuaagaaagagguaucaacugcaaugacuauaguuuuaucauccacucuaaccaugaacugagcuauaaauggcacagccuagaaguaacauaugcuauuuuuaaauguccuugccaauuaaauagucagaaaaucaguaaagcccccccccgcaccccccacaagaaagcaaggaaaauuaacuuguuuagagcuaaccauucaucaaacauaggcuugaacaaugccagaagccagacgcccagccucuguguuggcccuacagagaaaaauucaagugagaguccuucaagacugucuucacugggucagauuucaaacagcaaccucccuggaggagaagcuccaucccauagcuacaugaggguacaauccagagaaaugaaaucugacucuaacucgggauguuaugccuuccacaacaacaguauaucaaaaccagaaauguuaaaaccauaaaauaaucaagauauuugaaauacuucaagaguaaccaaaugcucagaguagcccacaugcucugcaacagcagcagaucugagcccagccugccucugugaaaugaagcagaauccuccaauucagcaaaugacacaauaaauauucucuguaacaaaggaaacauggcauagcacucuaaccuuauagcaaaaacacaaauuuuguaucaauauguucacaacacagcucaacacaaaaaucagaaccuaauuaaaacuacugcuuuagaccucaagcugucuggccagcaaccuugcccaaacugaauugcugcagaccaaccagcaggagcaacuacagcauuaucuaacaacuguagugcuucaucucuuguuuuaucuuucaugguugacuuaugaacugacugauggcaaacugauaugugaauaugccaauucaaaaacacaaagaaaaaaauggaagcacaaaauucaugaaugaaaaugcugacgucauagcucaacucucagagcugaaggacacaagaaagugugcaccugucuuuagggauguuaacucaaagucacuuagugaagaaaggacguaagucagccccuccuugcucagaacgaaugaagaaaggugagguaacagaaaaaccuuugcuagcccagaaaugagaaacaggcaaugcaugaggcacaaaucagcacugcuugugaauggcccaacuauuucaggugguuagaguuaauacuugcacuuuauaaagauuuaggaguguggggauguccgggggugggggugggguccaucauaaaacuguucuccacuugggacugaagaaauggcuuagcaguugaagagaacgugcuguucuucuagaagaccagaguugggcucccagcauccacaaucaagagcucacacagagucacacaaaacacacaaauaauaaaauaagcuguuaaaaaaaaaaaaaaaaaaaaaaaaaaccuuucucccagggcuggagagaugauggcucagcaguuaagagcacugacugcucuuccagagguccugaguucaauucccagcaaccacaugguggcucacagccaucuguaaugggauccaaugcccucuucuggugugucugaagauagcuacaguguacuuauaaaauaaaucuuaaaaauuuaaaaaauaaauuaaaaaaaaaaacuaacaccuuucucccaccauuggccuauacuuacaaagagcacacaacagcaacaagaauagcuggcucugccacacuacaccugaucauaaguaauucuaaacaagcagguaagacucacaggccuccagaacaacuuggauuuuuauauuagggaaaggauacuuuuauguuacaaugcaagcaaucuauuaacacaaaguuuugauucauucagaaguauuaaagcaucuaggaguaagauuguucacaguuuucaucuuuuggcagaacacuaagaauaaaguuuagacacaauuuuuuaaauccuucuauucaagacacuuaagccacaguuguugaucccuaagguuaagauuauuacaaucuuagaaaccaucaguggucucagagccuuugugaccucucccaacacaggacuacaaggacagucucacuaucugugcuaugguacaaauaaccauuuccacagcuuaaaauagacauucaccaaaauggauuuuuuuuaauuuaagcaauaaacaauucugccaauaaacauuuugaaaaggagaucuuauuaaguuaaaaugcaaacacgccaguuuuaucuacagaucuggaaugcuggcgaucaccucagcuuccaccagcaccuuugauagaacaccacuacccccuuguggauucauaauaaaaauucuuaucuugaaucuaguuuugaaauguuccauucugcuaaacuuccaccaaacuacaguuucuucacuaaaaacuauuuuaucucaaguacuuucuaaaugaagggaaggaaaacacauuuuaggcucaccaaggccaucaacaacuuuguggugaauagcgaguuggcauuccacuguucugucaggcugucccaaucgcugauggcugauuuuaucacuucacuuccuaagaaucucuuaugauucccaaaaaccaagaggggacauagacccuucagaaagggacuaagauuuacaaagacagaaaucccugccuuuacucacaugccuucagaaauaauucuugacagucucaagcaacccugaugaaagaaaacuaaaauauauguuuaaaagcuagaaacaaggaguggaggggagaggaucaguagaaugagcaccucuaaaccaaaaauggaggcacaugucuguaaccccgaaccuggcuggcagguagaaguucaaggucauccgcaagcacauagaguagucaaggccagccgaccaacaugaagggacaaagauggugauagaaaggaagagugcgucuggaagcaucugcacauagcucugccaucacacacacaagucucacugaugcaaguuacacaggaucacauaucuggcuucuccaucccaacagauucuagguuuaacaaguguccagugacguggccaaagagucgugguggccugcacuuucauggaagucaccacacaauucucaaacauauucagaacuccugagaggacacaguaaguaaccauugccuguauuucuucaaacuacuaaguaggaauaaaaaggaaaaaauaagcugcuuggcagguguuaccuuguaguaacugauaaggaaaaauggaagagagacucucagaaaggaugcaaaaugccccuuagaauacauaccaaagguaccaacuguggcccagcccaagcuagugacuaaacucacaagagucaucagaacuagccuucaggauggccugcugccuuguuggagauuauuucgcuacauuuacuguuucuguauuuaggggaggaguuaaagagguguuucgguuggcaugaggaagcacagcauaacagcauaacgugacuuacuuugucuccaaggacugccaugcuuggcauuucuuucaaagcacggcacugugcaugcaaagcuacccugcagaaagcagagggaagaagacaguccaggccaacaccuccuucaaagucacccuuugcuaacaguuucaggaagggacaucucaugacuugaaaggcccagcuaaaucuaaaggggggaaaaaguuacugcacuuuuccaaaauagcaaaggacuuacgcacuuuaaaaaacaugcaaccacaucagaaaaugagcagaccaauggaaugaacaccuaagagcccguaaaacuaaagauaccucgguccuuccaucuuuaugcuaugucaaccaucugaaaaauuaagagcauuccucugagugagugagugagcgagcgagcgagugagcaagugagugugagugugugugugugaaagagagaguugaguuugagaguggguguguggaugugggugugaaaaagagaguaugagugagagagaauggguguggggguguguaaagugggauuaaugugacuggcugggccucucugcacuggaguguguaguauuucuuuuuaaaucaagaauaaugagauuuuaaaaauguucaagaaacauuaccaguuuuuacaggagaccauagauagcauucuacaaguuaugaugcucuagucagagaaagagaacaugaacauagugucuaaacacacugauggacaacauuuacuauggagaguaguacaggcugugcucauuguauaugcaccuucucauguaugacaaauacuacaggguggcugaccaccccaucuucuaacgacaauucuaacacucacaggacaacugaguacuacacucaugauggcauuuaaaagaaaauaugacugugucugaacaauuuugucccuaaaccugaguaaaacauagggagggaaggagggagggagggaagaaggaagggagagagagaggaauggagggaagggggaagggaacuaggcaccccuuccuaaagcaagauggacaaagacucagaaccagaacaccccuacccucacuacauacaucagccugcaccacagcacaaggcgaggcagaggauuguuaacuguaccugaagaaucgcacugcaaucaaaccagagagagagagagagagagaagccagagaaaugcagcaaaaacaaauccccaaaauccuacagggggaggcucgcaaaccugaaggaccagcauuucacuaggacuccaauuagaaaugccacuguccccucgcugggacagugaucccaugccaccuaccuauccaacagguagagaaggaaaaggagauagagccugaguuacucagaauaagccaagucugaugguucuguaagacacacaguauugaagaccacccacaggacaaaaaugcaaaagauacauugucaaccugccaccacaaaacaaacaaccaggggacaaaggagacagccacccauagacuaaggguuuccacaggagugaaggcuacaggacgagcuucuaccagucacuguggagaggaaaccuggcuucagagacgaagagaaggagcacacuucagguuaacucugaccagcgucaacacugcgacguauaccucaccuggacucaaaacaaucaggcuuuaucaaaauagaaaagaaaaauauaaaugucaguacuauuaaacagcauaaagaauuaaaagacacaugauaaacuagugaguauaccuggcucuggccuuggagugguggccacacuuaaacauuagauuuagauaacucaacagcaaaacacgagucguuuugccuaaucccugagaacaugaaccacaggaaagacaagaagguuuuucugcagcacuuauguaaaaacauaucugacacuggauaccaugcauaggcuacccaguaaucaaugcugcuggucucacguuuacuaacaucccaaucuaucauauauaaaaaugaccucaaaguuacaucuagacagucagacuaagagugaacucuaauuucuuguacgugcacacaagcauacacauaccugcagugugguguuguggagagcugcuaaacgccccucccagaacacccuccucccccguucaccacccuacaccuccagggagcaaggaagggguugcacaggauagcacgccagucaagugcauuuuuguuaagauuacaauccaaaaaaaaaucaaaauucagaaaaaaaguuuauaagacuuucuuaaagucaaguacagacagacugaaauauuauucauaaaaaagcuaccaugacccaacaugggagucaggcagacacugaauccccacaaaucccugcucacagcagacacccacaaaaagggcuccagaguuaauagcugagugauggauccuagacacgacaaugacuuuuccucagaacagcagacacuaacauaccaccaaagacucaaugggacaacugcaggaggcuaucaacaugagacccacaaggugaaagagaaugcucuucaaaaugcaaugaggaggacauaaggacuggcccagaguaaugaaaaagguggagggaaugggccccagaggggcuauuucaagaucagaaagaagcgaaaucccacccacacauggacuaacgcaguaaacucagagauaaacuacuccuuucuuacucuagaaugggccauuuuagggagggauauuaaaacuuaagaaaccagaaaauguggcugagaugggcacagcacacauacacaugcauacacauacacacacucgcaaacacacacauacacaugcacaaggcuggggggcgggggggggggggggggaggggcuaguccuuaaguuuaaggccaagcuguucuacauaacaaacucuaagauagccuaaguugcaaaacaugacccugccucaaaaagacaaaauauuaaaauuuuucauaaaauacaaaggaugaaaacauggcuaaggauggccuagacucuucuccaaaagcaggaacgagugaugcuccucuucugaaaaggaagcugaagcacuccgaccuugaggagaggcugcugugcacauguucacaugcagaauccacugagggguaagauggagaaaccacaacaucucccagaaauagguaagucaggucuaaaaggagacuagagaaaggucauuuggccuuucccaaaugcuggggaaucagaaauggaagaggaagugaugucugaacgaaaagauaggggguggggcaaaguaauuaagagaagcgggguaaccugacuaacugcaagagaagaccuccaccgauucccacccuucccggaugcagucacauagucagcgcaagcagauccacuugagauccucacuuuagcacaagcggugcagcucuggugguaccuucaguaccccuccuugcacaguccaugugugggguacucugauggacagggacaacacccaaggaagucaacggccuggagaaaggugcagaagagccaucaccagaaacgagaagacucucaggccuacaggaacauacacagcagguaaucaacucuucauuuuuccaaggcucacuagcacccuagaaacaaucaacuccuuuaggcugacaacagacacaagauuuaaaacagccuaaaaaugggagacacacaggaaaaucagagcaagagcuuuccuuucuggcagcgaguaccaugcugaaaagcaaagccagagccaccugagacaccuccuuacuugggaaagcaagguggagggcucccuuguuaggaaaagaacuucaagagaacagaaacaagaacacacaacacacagcuggaaggugaggcucuacacgaagucugucaaaaaguaagaugacacugcugagcgagagcacgagacagggaggugagcaccugagcagaggcagggcugugggccccagagaaagaaccuggaaacccugccaccuucccgggaagcagcggcaagcacuuuuccgaaggcaccuucuucuaauuucuuagcgucucucacuucacuggcugaaauacaacagggauguacuugaagccgucaguuagcucccaguucuaucagggagaggcagccgcuucuccauuuccuaucauuuccccaaaacacaggaaaucgcuuucuccuacacugcagggggaaaaaaaaaucaagauaagaacuuucacuccccacagaaucaagcugagaauacugucccuagauuccaaauggaaaagucugggcauucaucagcaagcacuccacacaugggagaagugccuuucugcuuauucaguacaauacaaaugacaaaugaaggaguagugugacauugcuuuuaucaacgacaccuuggcuucuucuaauccugaagccaccaauaacauacauggguagguauguacagauacacacauucuggcaaauuaacacuccacccacucugaccauagagcugccaccugacccuucuaacuucuucuggguauguauagaaugcuauugcacauaugcacaaaguggucugugugugucaacaacugugucgagcacccaauuuccgugaugucaaagagaaccagaacagcaaaaaguagagaaauugccccuuugcuugaaaggugcaagauccaaagaaauguuuugaucccacuagagacauaccagggccaaaggaagauucugguacaacaaggagcacacaagcuaccucuucucaaauggcaugugggcgacaagggugucuacacucccuauucuggauagaaaggcauauggcuucuccuuacccagccaacaugaauacaauuugagaaaauuagagaaagucaagguaacaggcucacuaaauauggcugacugggaaacaggagccauaaggagggucugaguucucucagaaaaaaaaaaaaaaaagaagaauugggaaguuuauuuccaagaaagauucaaagacuucuugagagugggaugcauaaagucugguucuuucugcucagaagacaggaaucagaacaccaaauucaagggcacuggacccuuuucccagugggauaguguuaacuggugaagggugcccccuaagauccaagagugaacgggaagcaauagauccuucuuuuccugcaagaaacaaguacugaggucccuuacacucaagugguaggcacaucggaaguccugccugcccuacaucuuacuggggcgcccacccuggcccagacagggaacuccaaggagagaggcagacagcuagggagaggagcauuggagcguccgguuuucccaacaagaaagagggcaacucgaaggguguucaggaaaugagcucacccuaacccaggaaaguguacggaaagaguacagaucuggaagaagugucugccugccuauuuagaaaugacuucagagcugcacagggccccacaagccacugggugagcuaagaaggaagaacauggguagccccgaguccccuuguccuggccaaaaaaaaaaaaaaagauuaacccagcgugcagaggcuccgcggccccacgagaguccccucaaaaaggggacaggcugacacggaacccucagugcucggagaggaucggggucacggaagguaaagggcauggcaguguggagaccccacccucccgguagugagggugcaagggcaaguguggaagagcaugcugugaggggcggggaggccgcgcgaggaccccggcccugcugggggaggggucgcccggggccucggccgaggggcgcucggcacgaggggggcccccuggcggggacccgcgcggggacaccccccacgccggcgcuaggaggcgccgcgcggcccgaggggggcuguggaggggaacguccggcccugacgccgcuacggccgccggcaccggugcccgcgagcccccgcggcccgggaaacuuuccgccccgcggcccccugacaccccgaccgacacggcggggaugccccgggccgggugcgggaggcgucgcggcuucuccuccuccucgcugggcccggcccccgccccgcgcgccccccgccccggccugccgcccccggggcugggugcggggcgccccgcucggccggcccgcgagucaccucaggacucggccgcgcuccgccccccccaccccgccggcgcccuccccgcgcccgccgcgcccccgcgcucgcgccccgcgccgccgaugcccgggauguccggcgcggccccgggcucgccgugucgccgccacccugacagccccgggcccucacgcuccggcucucaccuuccggcuuguuuucggcagccauuuccccuccgcgcgccacauccuccuccuccucgcgaccgggaccccgagcgcgcgccucguaccgccgccgccgccggcccagccaccccgccgcc

SEQ ID NO: 12339 - RNA, 51545 nt, Mus musculus
cgccgugccgccgugccgcgggcgcugccgccgccacccucggccggcugcgggacucgcgcugcggggcgcggugggcggagcggcccgggcuuggcgggugcgggcagaggcggccuagagcuugcggggucgaaacggggggguggagguuuggggggcugggggggccggcggccgccaucuucuugccgagaccgccucgcccgccgcgcggguccguccggcagcgcacggguuaaggcuggcaccgcgcccggcgggaggggggcgcccaccuuccuuccccccccgcgccgggcaugcggggcccgcugggcaccgaggaggagcugccgcggcuguucgcggaggagauggagaacgaggaggagaugucaggugagggggcgcggggaccugcuggcccgggacgcgggaggggcgcgaggcugcgggcugcgcucccgcccugcuggcgccgcgcuagccaagggcgcggggccgggcgagcucccgggcgcggcgcgcggggcggggugcacugggacccccgggcaaagccguggugggggccugcgcgggcugcggagcgggagggggcgcggcgagccggggucagccgcgugcccuugaaggcggcgggaagcgcgcgccgcgggcggggcgaggacgggccgcgcguggggagcuggcgaugcccgagccggggagcgcgggcucggcucccggcgccugacagucgcuccccagcacuuugcccaggccgcccuggguucuuugcgcccuggugcccgccggguucccagcccacccugcuucccugucugugggccugacgccccagggccaccgccccugcccuugccagcugcggcucagaauucagccuccuucguguuugugccucagggguuaccuugcaggauuuuucaguuaacugcgcccguccuggcagggccucacccugucaccugcccucccucccuucugagggguaucacuucuuagcuucccaaguccauggcuccuccuggacuucugagggacuugugagaggccagaagggccuccuucucccaggaaucuacaucccugaggacgaggcuauuucacacacucgcacccaggagagagcagcaucucccagccuagcaucucaccaggggccacacccccugcccucaggcaccucuugugcuggccagcuuguuuguuuaguggauuuaacgcugucgcaggagccugcugcucaaacccuccccuuucauccaggccuuccacggggugaggugugcagggguaugguuucuaguggcugacugcucaagcccaggcugaagcagccagacccuuucucucugagaggaaggcggcggucaagcgcguugagaaaccuguggcuguuuucuacuuagcagccugacucuucaaagaucccugguggugauuggggcguggccuuuuguggcauugacagggacgaugugcagcugacugugggucaacaggcccauuucuaggucuuccauuacaccgccaguguccccuucuucuuccagccuggccuugcuugcaucaggguuuagggcuuggugaggucuuggauguccucagaaaggugcacacacaaggcuguugggguuggaucuugguucaguucuuaugccuaaucugccuuuccccuccugagcaggcagggguauugucccuuggggacaaucaagucccuucaggagcacuuccaaggccauacagaggagacacuuggcuucugucucucuagcugggaauucugagcccuguccaucaaccacuccgacuacuuugccuccggagccuccaggauccuaggcuagcaucuuuccaggucucuggucuaaguuucuguccccccccccccagucccccaaccauagacucccuccaggacuuccuagccauuggucaaugacccuucuuuucuuagacccagcccauugguccaucuggucuucccacugccgcuucuccccacacagccucacugggcuccaacuccugaugccugauaguauugcuauggaacccagcaggugccaucuugucccggggcccuggcuuugaccuuuacccgacuccuguccuuggcucacaaguuuguucugucuauguagauuccagcugcauugcaugaugggacaccgcuuuccuccucaccacagacucucuggcccauuggagggguuauuugcucuggacccucugucaguacccccaagcggagucccuaacugcaaucuggacggaggguacccgagaaauggugccuaaucgugagaaggagucucuagggcaucucuggugcccugaaugugggaaccugcuagcccagucaagucugucagcaguguuggcugccuccccgcuaggcuagcugccucucagggcccucuuccgcguggugggaggagcuccaggaaagugaccucguagccccgcccccccggccagaugggaggagccaguguuccggaagccucacacuaaggcccaaccagcagcaguuggacuuggguuugagggagucugugcacuguuuccuacagggggcuuugcuuuggccagcccucuccaguucuguggugggugggugggacugcugugaggaacagagucagggaggcucagaggugugcagcugccagauucccagaggagugugcugcucagagggaggacuuggacuuggauggauggaggaggccuuaagucccagcaauguucugguuaguccggugguguugggaccagccccucagccccucugccucagugucccucacuuguagaaugagucuagcaccagcuaccucauagaagguuauuaugaggucucguaagauaguacacauagaacguucaggucacagugccccgcacgucgcacgcagacacacagcugaccauggcaggugcaaugagcgccauccauagggggucgcuguccugccuuccuaaggacaugcuucugagacuugcacucuuauccaguaaguaccagccagggaaccuggguugaaugagggcugggagugagaacccugaggaggggcugaaggcagaaaggaaagggcuccucaaggcuuuuccucagaggugggcucugcugggcuggaggucuccaugguugguugguccagcccuuuugcaaucacuuucaaacugguaagccuagccuguuuucuugcuggucccagggagauuugcuuuccauccuauagagcucccugugggagugucucaggguccuuagggucagagaugaggagagaguggcugccaugacucaaaagggcccaugcuucuaagcugguccuucauuuggaguagggauguuccagggagcucgacuguuucagcaccgcccaagcaucugauuaucaauccacaauagcaaccacuuagccauccauucauccaccuacccauccauccauccauccauccauccauccauccauucauccaucuauccacccacucaucuauucaucugcccaucuauccauccacccauuuacucacccacucauccauccauccauccauccauccacccaucuguccauccauccacccauccacccauccauccaucuauccgucugccaauccauuuauccauccauuuucugucugccagcuaauacucaacauuugucugucuguccauccaucccacacucaucuauccacucacaagcuccccauccaucuguccauccaccccaccauccuauccacucacaagcucuccccauccacacacccaccguuccugcgugcaugcauccauccaccguccauuuguccacuauacccauccauucauuauucauccaccuguuucuguccaucuacccaucuaccuacucaacacagauuucuuuaauauuuuugagccagguccuaaucaguguuucuggggggcucuuuuuuuuuuuucuuggcaaggccucacuauuuagcccuguucuggaacucauuauauagaccaggcuaggcugggauuaaagucaugugcugccgcaccaggcuucuggaugugugugugucuugccgaggaacccgugagaccuuucaucucuguaauucuggcuucaucugccucucccuggcucuuucuuuugcuccguucuuuccaucagucuuuaucuggucucuuuggcaucucugccucucucgucccugugucuucccgugacgugccuccgguguugaucuccaugucuucuacuccuugccucuuucuucccaccaugcccugcaccugaccgggggggcuucugccugcuuccuugggccaucuucacucucccaucucccagucacuuaggcuaagagccucucuugcuucucuccucccucauucucaggacggccgcuuucuuuuaugagaugccaaugaggugaugucuggguuuuguuaaaugucauaaauaaauuauuaaucgccucuuguguggcugcacugcucuggaucugccgagggccugugccacagggggaggcccagagaugaaugagaucuuuaguuuaggcuucucaauauccagaaguccuaucccagaguucuuccaccccgugaccccuccuagauucuuucuguguuacugaaaugcacccagcccugggggggggggggcucacaguucugcccaggaagaaggcuacaguaugaagcccauuucaaagaugaaugaucagugggcaggccuuuagggcgccgggucaggaagggguggggguuaaaagcccuugugcgucuuuggccuucuuccucccugaccacuagguggcccuguucccugcuuggagauggguuguaggguccgaaacuggaaggagccccuauucccuggguucugggaagaacaggggacugagcuggcucuccaucaauggcucauuugcucaccucagacacaagugauggagaucuugucuuagcuccuucugccgacccccuaguccucccauucacagaaccagaugacauaacuucuaugagaguccuguuggaaaagcuuccuggaggcuuguucuuccucacaggaaguggggccuggagccaggacuucacccuggguguagacuucuagaucuguccugauuuggcccccccacacuuaucucucaggcucugggaacucucagauccagagccgacuuuagucacuucagugguccugggcuugacacacaaggcacacugcugaaauacugaguucugggcaguccaaggccuggaggguggagcaaggggaggccucacauacugguaugugccuuuggcccauguugccaagacuguccccucggauaucgguggagccgagauaugggcagaugaggagguccuuagaguaaaucuguaaaugggggcauugaaauaucuuauugagacaaugucuugcuacguagccuggguugucuucaaacuuugauauuacccucagacuguggagugcuaggauuagcgaccugugccaucacaccuggcucagugccacugcuauaaguuacuagcugggaagggucacucagcucacccaguggcagcuggaugaugcaggccugcgcugggggcugugcggccagcugacaaggggcagagagcagaaaacacuuuaccugacagauucugucacgacccuugagcugugucccaucccuggucucggaaguagccucccuugcuccucaagccaauucugacuggggccacguaaggaguuaccaagcuaaugguccuaauuauagcuaccuuggaucgauggaaccuccagcucuggggcggggcggggcggggcugguguuugaggguaccaccaggcaggccagaagggcacuggggcaagccuccagcggcugacuguuggcagggcaaacucccucacuccaggguagaggaguugcgucucccccaugggccacagacccuuuguuuuaaagccauccucugaccugcgccugacagauggggcuguggggaggaggaacaggguugacagacagcacaggucugaguccuggguguggcagcccaugggguugcuugagggugacucucuugagggugagcuugcuuuuagaaggcucaggaccuguugcugcagagggggauggcucaugugggaggaaggagcugaagcguccguccguccguccgugcagacugagugugugggugauggguggagccagggucacaggccacgccucaggugucuguccucagggcuaccagaagcuacaugaggacaggaaaugcuuguuagagauaggcauggucagagcugggucccccauccucaugugcgagcucugaaaaauucccagaggaaaaaaaauuuuuuuuucauuauuaagcaggcagccuugggcugugagguugucuuguggaggagcuguguguguguguguguguguguguguguguguguuugugugucuguguguguucuggaugaguugcagcuagcuugggggcuacuuccugcccucuucaguauccacgaguggaccccaggcuuccuuccagaacauuccuagcuaccugugcaccuccccccaccccccaucucuucugcuggucacuuggaggacaugugcugggcuggcuuccuaagccuggggauuccccugcuggguggagacagaggacugcccagagcaggcaggagggagaagggcccccucgggauugcaucagccuggagcugguuacauaaccguuguggauggcucccaggggcugggagcuucuggcuggcugggugucugugguguugggagaguacacagguauggauggguaucccacuggucaccauagccuggccugcuuccauucucagcgcagcugcccagacuccaccacaccuagaugacaccggacacugagggccucuggcacauuagagcucagaggagcccuggguuacuuccaauaucaccuggccucagcuuggaucccuggcccgugguagccuaagucaggaaccgcccacucccuugugcucuggaguccugccaagaccacaacagcuguacccacuacaugggcccuguguucucuguagcuggguacugugguacuaaguacuaugguacucacuugugauacuucucuguagcuggguacugugguacucaguacugugcuacuucucuguagcuggguacugugguacuaaguacugugguacuucucuguagcucgguacugugguagucuuccagggaugacuggcauuuggacuguacucaggcugccuuccugcagcggcuuccgguccuaccuggagcuugccuucuccucucuguauuggcuggcugcucuucuggauucccauccguacaguuggagggggcuggaacuuggcugcacacuaucccuggccuggagauucuggggagcuguguuggcaggcagggcugcuuguuccuuggauggggguccuggugccaagggguacuuugccccuguaggaggaucuaaaugugcagauugacuguguaggguucagaaaggggaucauagccacgcagugcccucugagggugggguaugugugauuggcuagccacccggucugcggagccaccaaaaccaguggggaccugucuuccucccucuggacucuggaguucaagagauucaaggcuggcagguagacuggugugggaccugagagaugggugaugccucucuaugcaugcaugcaugcggagcacaggcucuucucuacugucuggucaccccuagaugcucgcucacugugcacagaacaggaggucgggccagaggagccagguuaugggcuggagaaguccuugggccuuuggagcgacuucauuuuggaacucucuuuugccccucugcguggcucucccccuuccuccucccuaccccccaugacugccugucuccuuugccccucuggguggggcugcuucuuucucuccccccccccacugucuuucuacucugggugguuuggugaccugcagaugacccucacuaucuuuccucugaggucacgugagucugaugcauggaaauacuguuucaacuuggauuuccucaguggguaggggucaggcuucauuaaccaugugccccccccaggacaucaggagucccuuucuccucuugggguggcauggagcuacuuaaccacuuuuuaaaugacccuaggcccuaaguccaccuuaacuccucuuggaauuuaaugaaaaaauguguguguggugugugcaccugagugugggggugcauacagauauggaggucagaggaagacacagugccuucuuugucacccucuaccuuguuaccuuuagacaggauaucuaacuggaccuuaaaucccauuuggcuaggcuggguggcuggccagcaagcuguccuccaacaggcaugcucagccacgucuggcuuuggccuuuaauugaaaugagagacuuugggauucacaggcaacuucuggaaaaccgacgugugcaaugggcugggcccugugcaucuauguugggcguguguauugauuuccugcacagagcuaggcagggaagcaguguggucuugaauaccucaguaagagagaauccuguugucaggcagugguggcucaugccuuuagucucagcacucaggaggaagaagcaggcagaucuaucucugugagucucaggccagccuggucuacagagcaaguuccaggacagccagggauacagagaaaccccaucuuugaaaaaccaaaaaccaaagagggaacuuaucaagcccaugacugauuauugugccgauuccauuaaguguuuggcugaugggacccgugucucuuauugucuuauucucaagucacaucugagcuguacuugaaccucuggggggccaggacagguuuuccucagcuuggggucucuguugggucccagcccuccuuggccagcuagcuaugauacuggugugccacgaggccacuucucccccaggucaguaaggacaccagaguauugaguucaugacuaggugguuauuugaccuuugaaaggucagagagggcaggugaccugugccgucuaccagagcugacaugacuguugucccuugacuuaggaccgugaucccauggcuucgaugguggcauguggugguguagggggucucguggccugccuuuggcucugugucccauuuucuggcucagagaaacugaaggucaccccucucucucccuuccaacuccugcagaagaagaagacgguggccuugaaggcuuugaggacuucuucccugcagagcccgugagucuucccaagaagaagccgaagaagcugaaagagagcaaguccuccaaagguaaaaggaagaagaaagaggugaggcacacugggggcguggcgcggcgucggggagggcgugguguggcggggugggccgggacccugcauugcauagaauggaaaugucaugaagaaaugccccugggauggaaauagcauguucuguuccuuaagaaaguuggagggucagcuguccuguccugagcugggacaccgugacacuaucccuggcugucagcaucuucucacaggcauccugguggccgcagcgcagccuguccucucccaggcugcucuguaggagccucugucuccuuagugaaucgcaccgaaagcagagaaagucagagaaaccaacacggggaggaucuagugagaggaccggcuguguguaagggccaugccgggggaccuaaaugcuccuguguuuugcuuccugguucugguggcucugauaggagcaguugggacucaaggcugaagaggcgagguggcgugacaugacaugacccuuccaugugccucgugcugaugugcuucaucucugggaucgcccuuggacaugggugguguggggaaccgaggcaaggauguagcuuaaagucacagggaacugaggcaggcauguagcuuaaagccacaggucucaaccccugcaucucugggcagcccugcugggaugguggguuauguacuugguccaccaaagacagcgauggccuugugcuccugacucaggcuuuaagcugguuuuccuggguccccagaaugcaggcugaguguagaaagaagcaaggagagagaaugauggugcaggguaggugggagccccugcccacccgggggucucgacucuguccucuuccuuuguugggaacgugucagauguggacccggcaagugagggaugaccguggagaggaucagggacaucugagggaccugaagccuguguguuuucucuucuguuacagugucuugucuagggcugugagcagagccuaacccgaggguuccccuuagcaaugcauagcaccccccccuaggccaguuaguccuucagugucccuucuagcccaccccuacucuguccuugcuuugcaucuuggugugugugugcaugugcaugcgugcgugugugugugugugugugugugugugugugugugugugaagcccugggauucaggugccccgacuuucugguugaagcugugaagucccacucuggugccacuguucccugccccgggcuuugggauccucuggcagaggacagggcccucccccggcuugcucucaaaugccaggccauaggcugggacccugucagcuguaagcagccccaacagggcuucccaggguuccauucuaagcaaggcugucuuuuuucucacuccuucccgggccaggcaaggcaugggguugccauggcucugguaggaaggagguuggagauggggaggggcuguagggcuggggguaugguggccuccaagguaagacucgggaaaucuuugcccacugacuugggucucuaggccucuuuuucugaggacaugguuguguuuuuuucccuguaccgucuuccucugguucggucuucacacacuggcucuuccuccagcccgugcuugguuccucugccguauucaucucucucagucucucuccacuucauuuucccaguccccucccauuccucccuucucucuuucauucucuccucugccccgguggucgugguggucuuuccuuaagauguagcacugccucuuuaaaaaaguggggcauggagggagacaagguugcacuauaugguggugacccucugaccaggggugcuuuucccucuccuuuuccaucccauuccauccagcagcuuggcucucucucaccagcugcaggaucugggggugggggguggcagucuguagcaugcuauuuacaaagaggaagagccgucugcccgcccacgcacccacccggcagcccuggaucacgggugugggaaucuccuuccucccccgaccccaccgcugcaucccccaccaggugacucgugccaggcgccgaggagcuggagcaggugggcucuaaggcagugguuugggcggagugugugugugugugggggggggggguuggggggcgcacacaggcaagcagcaagcccugguuucugauuuacauaaaauaaccgggcugcagccggaaccugagcauauguagaugaagcucccugucagaccgggagcgcaggagggagaacugauuucaaccuguacugcagcgguugccauggcaaccaauuauucagugcuaaauuauaacuguuuauaacacuggugaaugggaggcucagauuucauucuuuuuuuuuuuuuuccuuuuucccucucagucuuggaggaccccaagucgagaaugaccaacuccccgaguucuuccuuuaagucuaaauacuguuuuguuuuguuuuuuuuucuucccuuuuucaggagacaagaugugggcugggcauagaaaggggguggggagagagcaagauaggagggccuggauucagaaauuguggaucagggagggagaagggguuguguuggacucacuguuuggggucuccaccagccauggcugugcucucaacaggaaaaggggggcugagcagagagaacccucuuugcuccaaccuggguguggcaucugaagugcuuugcaugugucucuugagguucccaagugcucuguuacacagucaugcccagggucggaccuuuacacccaugaaggacggugccaagguccaacugucauccugauuuuacagccucugugugcuuugguugcucucagaccucaggaugacugagauuggcuggggagcucugugagagguuuacaggucugucucuccuuccugaaugggguguggcccaccuccuuaucaccggacucuucuuuaaaaacaggaucucacuagguggccuggaauuuagcauacagaccagcugaccucaaacucagaggccgggcuggcuaccuuugguguggucccucucccugugguucugggucaauuuucccuucuucucuuucauaugacauugcucugugggggaugcuuuucgaauccacuugcaguguuuccuccucacugucuucucugagaggcgggauguuuuuaugaugugcagccagcagaggaggaggcccaguggaggaaguauggggacagcugguucagguucugccaggacucagacucaucuuguacuccacuguggugugccggcauggcugugggggugacccaggauaugcuggcuuuauugggaagaggcagggcaggggagaagagaggagggcuugggggucggggcugcagguuaggguccucucucccuguggguagacaucuugccuaugcuuugguagauggauggagaaaagggaccucuagccugagcuccacgcugccugcuggguuccagcucugcccacugcccuccuacccagcucuggagugugucuuggcugaguccuguccaggccaggcuuucggcuuuagcaagccccgccccuuauccgugcuuugcacaggcuguugcugcuucugcuagacaucucaguccgcuggaggcgccuucccaccucccucgugcccucuucucccucuggcucuaagcugcgcuggccacuucugccccccucuugcacuaccccggguauggcagugucuucuucccaguuagaggcucugagcagcuaccaggcaacaguugucuacccaugacccaguggaaaaacgucugcuuccccgucagcaucaucagcauuugaggguugcugcucuugccugggugugguccacuuguaucgggaguaaagggcaucugugguucugaaugcagacugaucuggucugaguucccugccaggacacacggugaucaacugguucucccuaguuaccccagucucugagcacgacuauccacaccagccucugugugcacaaucucccugguuucucucaccacugugcaguugagagaguuuaaguucaggugguuacaaugacuugaacauaucccagacuagcaaggauccaugggcaggccauucagguugcagcugcugucuguggugcugaaguguauggugugcucucucucucucucucucucucucucucucucucucucucucucucucucucucucucucucucuguaucucuuggacaugaucuugaagagcuggcuggucucuguuaccuugggggaagggacuguccccaucugaauuccacugggaacuguggcugugggguuccauguuaccgacaggugugggagcugggaguugccccuuggguccagggcagagucaguauucugagaaagcaaggagaccuugucagcgugcugacuuggugaucgauuagcaggugacaggugcagucuucuaugagggagacugagcugagcuuccgggagagccuaagagagccuaugggugggguugucccagccggacugcagggaagaccucagcgacaauaauugauuggugacauguccaaccucagcuaauugaugggauguugcuucauuggaaguucucuacugggacaggcaagaaaaugguucaggguccccccaagauuguugccccuucuuccccuucaucuccuuucuuucucuccugcuucccucuccugacugucuuucauagcuuagucuucaugucuccagcuuucucuaucucuucucacaccugucguugcuuaccugaaaaauaucucacagcaaucacaagggggacaagucccgaacugguaaucguagugacggcgccagccugccccugcagaccccagugggagaggacagggcucugcuguucucuugccuccaaacugggcaaaccauuuccuuccagggacgguaucuugcugguggguaugcuaugacuguaaacacccucaucuccauauaaaugggccauuuucugccuguacagacaggaaacacaauccagucaauuuuaagagcugccugauuuaccuuuuucuaugguugagguggaguggccagccuggagacaggcuuguaccguggcugcucuggagagcugguccuccgugcauucaccccauccacgggugcaguacagggugcaggguagacgggucggcuccugucuggaacuuuccuuggcuauuuggcuuuggucaucauggccucuaccaggaguucuugggguacaguggcauuauauuucccaaauccacucugacccaaacagaagcugacaccugccuggagaagucugguuccucuguggaucaucucaccaucugccacucaccucugcuugugcuccuucaccagugcacaaugggugaagaaaguugguggccgaguaacuuaaccaggccuugcugccccaggucuucggcauucugggguguccugcgcccucaccgcuccccuugucuuuuccaggggagcaaugacgagaugucagacaacgaggaggaccuggaagagaagucagagagcgaagguagcgacuacucccccaccaagaagaagaagaagaaacugaaggagaagaaggagaagaaggagaagaaggagaagcggaaaaagaggggugaggaugaagaugauaacgacgacggaggcuugaagguaaucgcuggggcggggccagacaggaggaugucggaggaggagcucggaguuuggagucagggagacucuguguacgugcacacacugggaugucggacacagaucacgaggggccuguggccagaagggcuugcgacagcaaccgugcggugucuugcugauagauuggggcugcucuuggcaauagcucgcccacccgagcgugcagcuguuucuggagaggacgauagauagugugcacucaaguuugguguugggaaccucuugcuuggagcaauuuggggaaaugaaacagcaaaugggaucuuugccacuuagcaucugccggacagcccugaguggccagcucugccugggugcuuggugcacucugcagucccgcccacguggguguuccuccagucucucaaugaacuuggaggugugugccuguggcuguaaagaugggucuggcuguccuuugggcaugaggaaagcaagucaaggcauugcaauugaacugaggccaaccccuggcuuguggguggaugacccugugucaccaggaaucauuugugagccacaacguggcaucguaaacauuaacacagucaccguugggcggcagagggcuacgugugauugaagacuggagugcuugugggaagaauugcuuucuuggggguguccugacacccaaugugaucccauuagucacuggugggugugcuaugaaucagcuaugacuguaauagccauggggacaguuuugagaaauuaacuuccaggagcuguuuggauuccuggugacaccaucgucugcuugcuucuguguuuccuccauguuucucaggaauggcugggugugucugagggggcagguuggcacugggagggugucccucgugaaacuaucucugagguguuguggaaccagguuccuaagcccucuugcuuugcaggccguuucugggacacagauacugggaacccaggaagaauuugcaccagcuggguggcuuuucacugcuggagcagaaagacagcuuccaagagggcuugagggaucagagcagauggggcucuguguggcauuuucuggugucacccaaggcuaagaacuuuucuuucucuuccuccauggaugggggucugugugcccuggcaggucaggaacugugcacuauaaagguguacagggggagaggaagcugucugggccgcacaacagucacuaaaguauucauccuacacaccuaugcuaguuuucugugaggcagaaugaagaaacugaggcagaaaggugaauuaauuuacccacgucucgcugauguuaucuggcagagagucaugguuggaacugacccauggggaggcuggagaguuggcucagugcauaagaggaccugaguccaacuuccagcaccuaaagaugguucauaauuauaacuguaguguugggggaucugaugcccuuuucuggacuccaccggguacacaugaguuagaaggcaaacaaguggacaaagcauucauacacauaagcauagcugggcgugguggcacaugccuuuaaucccaguacuagggaggcagaggcaggcggauuucugaguucgaggccagccuggucuacaaagugaguuccaggacagccagggcuauacagagaaacccugucucgaaaaaccaaagggcauaauagcaaacacccuuagucccagcaguugagaggcagaggcaggacgaucucuuugaguuugaggccagccugguguacauagcaaguuccaggauagucagggcuauguagagagaccaacaaacaaccacaacaauacaaacaaaacaacaaaaagagaccuuuccccacaaccagcacuuccugugauccuggcucaucaggggccaccagucccaugggccacuggcucucugaucccugugauggcuccguugagcuuuuugucacaguuuccuuagcagcacaucugggaaguggcugagggacucucucagcucugcuccuugcugggccaccacuucaguccugucugucugucugucuccagagcgucucucucuuagcugagcggccugucccacacccaucugcauuccugcaugaucuuuccccagucucagcuuuaaaacucacagugucguccugugagcuggaguccgagacaugccacuggugggggugucggugggguuguugggacaggaugggugugacuuucacugucccaggggagggugagagcuguuguuagcuugcagacugccccuuucuuacucucucagagcaaggaggugggucagaagggcccgugcgucugaccccaccucuggccaugucucugcaggagcccaaguccucgggacaacucauggcggagugggggcuggacgacguggacuaccuguuuucugaggaugacuaccacacacugaccaacuacaaagccuucagccaguuccucaggugggccaggggcugacugcugugucugggugaccaugaggguugugcuuaucugaguggggaggagggagaggcagcggggacuccugagacggggaggauuaucagaggaaccccugaccugggaagggcuuggggucaggacuccuucauuuuaacauagcagaugguugggucuaccucccgcacaggccccccguccuggguccuucuguggggaauggccugcuuaggccugucucuggucugcagccuaaaugaaaacacuccagaagucaggaguauguuggggugugcuauggccucacuuuguccuuccccagccccuacugggcuagccaggggcuacugggcuagccacaccucgcaggcgugagagaaagggguguccucccucacuuucccgucucucucccgcaggccccuuauugccaagaagaauccgaagauccccauguccaaaaugaugacuguccugggggccaaguggcgagaauucagcgccaacaacccguuuaaggguagcucggcagcagcagcugcggcggccguggccgcggccguggagacagugaccauugcuccucccuuggccaucaguccccagcaagugccccagacucugcccauacgaaaggccaagaccaaagagggcaaggguaaggcuaugggugacugggcaccggcccugucuggcaguucugcccucuagauccuacagggcuguuagggggcaucuguacugaggacucaguguuguaacuggcuucgggcugacuucuuugggaguuaacaucugacccacuaccccaacacugugggcauggagguagggaggggucauccacagcaugggguuguucuaguccaucccccacccaccccuacugugggcauagaggugggagcccacaggauggagcuguuccagcuuuggacuuagacaaguuuaaggcaguuuuggauccucuccuaugagcacuuccuguagccgggccucucugugucaagucccugcagagggaucucacaggagugugaccaggucuagaaggacagcgaagagaccuagguccagucugacucagugcagauggggcuggguggggagggcaagcagggccuucuguugaggaggaauagacugucugcgacagucuggguagaaguucuggcuucugagaggcuggggacuccaaucuccucccagugcgggcauuaacaacacuaugucuucuuagugcucugaugugggguuugaugggcugagaggagacugggaaccccugugucaucacacagaguuuuggugucugggacagugcucaguauugugccuggcagccccauuucaugucucagagugccuggugggugagugucauaggccaggucuuuucuugccccaucucuguguccacccaucuuucacaguccuuacuucccccugcccaggagcuccugcagagccguugacccccugagaugccuguucagagcuaaaaagauugaaauagcuuuucuguggcaugccccaagugcagcuggguccccaucgccauggggcauagccagaggaggacugaacagggcuaccuggccaggguguggagccuaccauuaggcaccauguuuggcucuaggcugcugggguggggacagggacaucauucccuagauggcacaucagucgccuugcagcccaggggcauaagaaagcugggagugguagccaugguuugggaggcugauggacuggcuuuuggauccagguggguuguguuguuuuagaagcuggcccugcugguuaggaagucaagguuggucagacuguguagaacuguucccaaggugguaggcauuuguaaguguccauggcuccccuggcuauaccaacauuuggccagcaugguggccaaaacaggcagacggauucagguuugucuuccuguguaacccaagcaagauuagaagcccucagccugccgggcgugguggcacacgccuuuaaucccagcacuugggaggcagagguaggcggauuucuaaguucgagaccagccuggucuacagagugaguuccaggacagccaaggcuauacagagaaacccugucucaaaaaacaaaacaaaacaaaacaaacaacaacaacaacaacaaaaagaagcccucagccuucucauccggagugggugacagugcauacggccaggucccggaggcucagugagguggcaggggagaagcgggccaucagaggcaguguuggucacggcaacccuugucacaauguccagggcccggagugaggaagaagaacaaaggcgccaaagauuccaagaaaaagggcaggggcaagagaguggcagggcucaaguuccgcuucggagggaucagcaagaggaagaaggguuccucggugagugugugugugugcaugcgcgugugcaugugugaauaugugugugugcaugugugugcagguguguguauaugugcaugugcaugcauauguguauguggagagaaagguuccuuagugugugccugugugugugagauggagcgagacggggagaaggguuuucucagugacugugcuuguguggguaaggggagcacuguuuugaccagagagugggccauguucaucccccucccccgugcccccucccccccccccagcuaacugagggaagcucuccacaccucucccagucucuguacauacaggccuucuggaccucaguuuccccauuuauaaguguacaccggacccuuccaaagacccaucuagccuagacucugaccagguagcucccucuggccaacugcugagcuuggcugcggugcugcucacaguggcucuauccagcagacagacaaucagccugcccuucaugggucuuuuacccagcugugcuccgaggguggagcccuggaggguggccuguuugaccaggcugauuggagccacgacuccuccucuagccccaggucucaugucaccucaguccaccugcgccgcugucacuuguccucccagcucugccaaggguggagaagagggccaaagcuuugcucugucauuuggugggggagagugucaggucucaaggguagcugcucucgaaggagcacagccccuccucuauacguagaaggagcauggcucugcccuagaugaaguaggccagcucagcucucacugguccuucuguugugucugagggguucuuuaggguggcccuugaaggccauguaggaguuuggggaagcaguguggagaagaacuguggaggugucagagguccugagagcaggcgaugggaggagauggggcauccaggcugugcgcuagcacacauuucuagcuggguugggggacagagugaagccacagggagacuucagagcuuccuuggcucugcuuuacccaaaucaccaggguaggcccugacucacaacccgaccuccuucccuucagagcgaggaggaugaacgggaggacucagacuuggacaaugccagcauccacagcucuucugugcguucugagugcucugcagcucugggcaagaagaacaagaggaggcgcaagaagaagaggaguagggccucucgggggcguggccuuuuccguggugggaggcggguccuuuuccaugaugggaggcguggccuuuuccguggugggaggcggguccuuuuccaugaugggggagggggcgguuuucagagaaugggggaagggcauccucaugucccagccucucccaaccuugugcucucucaaccacccuugucuacuguaugucuuagggaggaggaaauaagaaagccaggguuucuuaaugcuagacccuagcagagggggaguggaccaggcacuucagcucacccuccaguccccccaucaguuacccauggagcuagacccaccaaacacccacccuccuuccucuuucccucucugucuugauuuuucagacaggaucucacuacauaguucuagcuggucuagaacuugguauguagauagggcuggccuuuaacucauggagaugccccuccuguguucuggauuaaaggcgugccuucucuguuauucuuucuccaugcacacuggcuuucuguccucccucuccccuccccuccccuucccucucucugccccgcccuuccuucccccaucucuguccacccuucacacuccacagccaucccuaauauuucuuuacucuuuggucuaccuguccauccgcuugagauaauuuaaacgccuaucaugugccagucgagucgggguagugggaauggucaugugcggcagaccuccaccauuagccuucucccaucguaguugacgauggugacggcuaugagacagaccaccaggacuacugugaggugugccagcagggaggcgagaucauucucugugacaccugcccgagggcauaucaccuagucugccuggacccggagcuggagaaggcuccagagggcaaguggagcugcccacacuguguaagccguggcugagguccggacuaggguuggcaggccaucgccuggggacacggcucaaggugcauccaccuggacuccucccuacaggagaaggaggggauccagugggagccgaaggaugaugaugaagaggaggaggagggcggcugcgaggaagaggaggaugaccacauggaguucugccgcgugugcaaggacgguggcgagcuccugugcugugaugccugucccuccuccuaccacuugcacugccucaacccgccgcugccggagauaccgaacggugaauggcucugcccgcgcuguacagugaguguuauaccucccgccccugacgccccugacgccccugacgcuccuggcgccacgcccaccuugcugacccaggccacgcccccaacaaacucaaccacagaagaccacgcccacggccucacccugccugcucucuccugaauucccuuaggacuguuaauugagaauuuauucugcgcuaagaaccucaugcacaucgcauuccuacugggaacugaacccaggaggccucccauugagcucuaauuccauccuccaccucuuaauugacuuucaagaguuauuuugggguugcuugggaauggaacccagggccuauauaccaggcaagcucucaccagaauuccucuucagcuggaguauggggcucaggaggacacaguagcuugccugagaccaugccacagcagaccuuuccacuuggauuugggucccugagucacccugggcauggugucccuaggcuuugacagagugaugaccccacagucuggaguuucaguuuaugaaggcaggggacaacauucucuccucaucccuugacuacggacacuguaggcagcugaaggucccauguguggacuugcucugucucccagugcuggguauccuaucccauagguucugggcuguccugcagcuucccugacuuguguaugcaucugggcuccugccgugugugggcuucgcaugugugccaguguaucuauguccuuggugguguaggggauggacaggccccuuggaugggcguaggcuucauagcuuuccugagaaugggguauaguucccugauuuccugauuccuccuugcaggaggcgaggcugggugggcuaaggucuaggaaaugaguuccucuacaccccucaaguccaagagaaucgcccugccuucccaucucgccucuuccuccuugcgcuuugcccucagaggccagaguaugguugcuucugggagguguggugugcauugcauguuggaucacaccggugcucugaugccaacaguccucugaggcugaggagaagaggccagauuuacaggcaaggagacaggcugaagggguguguacucagacacacagaaguucggcagcugggcugagaccugcccuccgcuacagaacccucucccuaaaucuaccaucucuccucaguccagcuuggccuguuucagaacuguguuugugagggucaugaccaccccaggccaucucggcguggcccagagcacuggugccgugagaugugacgauugauugcucugagcugccagccaccacuuccgggagucccauggugugacucagggccugaguguguguggggggagaggggaaauggccuuccugccccagcaagcucggaugcacaggcugcauguagcccugcugggugaaggaaguggucaggacugcaguguccgugugggucaggcagggcuccuguccugugggugcucacgugucaggauaugagguuccugggaccaggcagggcgugaggccaugcauggcuguauggauggguuugucuccucgcucugcuguucaggcugaguggauguagggggcucaugcacccugguuuagcuugccagugcuaaggaaggucauugucacguugucaaauacaaagggcccacuuggacccgcaagcuccgucguugcuugucucuugauacacagcaauguguggguucccgaggaagcgacugguaucacagaguccccaugauacuguuguggcuugggacccgguguaacaagucuggugucauaggaguuucagcccugugacuuaacccugaacauggugaccauccucuguucacagugucccccgcugaagggcaaaguucagcggauccuacacuggagguggacagaacccccggcucccuuugugguggggcugccaggaccagagguggagccaggcaugcccccgcccaggccucuggagggcauuccugagagagaguucuuugucaagugggcuggucucuccuacuggcacugcuccugggugaaggagcuacaggugagaccuggggccgcaugguuauguuugucuuggugugagccugggguucccccaggcaugguugggagcugggacuagcagcugugaaggaggcuuguuccaccuaggagagggcuugggggcugaagggcugguccgggaacuggggugagcggccggucucccgugcucugugacuaguuggagcuguaccacaccgugauguaucgcaacuaccaaagaaagaaugacauggacgaaccgccacccuuugauuacggcucuggcgaugaggaugguaagagcgagaaacggaagaacaaggacccucucuacgccaagauggaggaacgcuucuaccgcuacggcaucaagcccgaguggaugaugguucaccgcauccugaaccacaggugaggguguuggguagcaccugccgggugagggcuguccaggcuugccuuucagagccaggaguaggcucaguggggcaggagccgaguaaggacaucucacugcaggggauguggcuguccaaccaggagugucacgccucugcacaggggaacugucaugcucaacauucucacucucaguaggacagugccacagacacacacagcagggcagugccacagacacacacagcaggacagugccacagacacacacagcaggacagugccacugacacacacagcaggacagugccacugacacacacagcaggacagucccacggacacacacaguaggacaguuccacggacacacacagcagaacagugccacugacacacacagcaggacaguccuacggacacacacagcaggacagugccccagacacacaguaggacgaucccacagauacacaguaggacgaugccacagacacacacaugaagggaaacacacugaguuguguguaagcuuacacaaagugggaucucggcugggucccgguuagggacugaggucagcaggaugauucugggagccaagcagguccaagaaaggauuaguguuagugagcugucacagucccaagagacacacacacaagaauauacucagcauggggugggcauggcggugcauaccucugaucccaguacuugggcugcagagacagacugaucucugugaguucaagagcagccugaucuacacagcaagcuccaggacaacccugggccacacagagagcucuugucucaaagcucucucucuuuccucucucucauuugagagcacuggcugcucuugcagagggccuggguuagguucucaguacccacaacacugcuuacugccuccuguaauucugguucucggugaucagauacccucuccuggcuucuguggguaccaggaacauauaugguacacauacaugcaugcaaacaugcauacaugcauacaugcaugcaaacacacauacauacauacauacauacaagcauacacauuuuguuuuugagacaaggucuugcuaugcagucuugacuggccuggaacuuccuguauagagcagggaugaccuuauacucagagaucugugucucugccuccugagugcuggauugaaggcuguaucagcaugcacagaccccccaaucuuaaaauaauaauaauaauaauaauaauaauaauuucagcaagacugagucaccugccugaagucacacagccgaggcuacaggacugggaacuagacccagugucuuuugguagcacuaguguuuucuugcccagaguccccaguccgugugucaccucaucccugaagucuggcauucccagguacuuagaccggccagggcaaggaggcccagcaggagggcaucggcaggaggagcucacucccaagccuugggcagggcaagccucugcugauuucugggugcaggugcuggacggcagguggcugcugccagccggccuuggggaaggccaugaguaccugucacggggggcagcuugcaacucugaacuuuuccagcuugggaugggcggccuacccacucugucccugacucuagguccugucagacauugcugggcgggcagagguuaagaaccuguguggccacggacuucugagcuuguccucauguaacaaggguuugcuaaagccuugcuggagugguuugugggggacaggaaacgugcuucuuauugaaacauccuucccaucuccagacuccagaugguaccugagcuguaccuuagacugacugccucccccgucucucuuuuauuaaaaugcaugcaaaagcaaaaaggacaauuuccucugcacccccaaagaggagcgggcgaaucucccagagugugcauaacaaccaauuauucagugaaaauaagccaccgguuuccauggugacugggaauuggccuugcuguucaugguucccaggccaccugcugucauagcucccccccccaauucauuugccgucacccuggccagucagggguuccccagcucucuggcuuugcggggcucuccuggcugguugcugaaucuacugauugagcaggaagccuugaggacccuuccaauagccacuguggggcuugugauccugggggucucuagaugaggcuggcccacccgcagggauugcuucuuucuuaguuuguagggaaggacccucaucucggauggauacugcaaaacgcuuugacuuuauguuagaacaugaagucucugagcagggaagagauucguggugucauuuccaucacguagcaggauggccucaccccugcaccagaggcuggaaaggacacuggcugccacuucuuagcgcuccguuagccacagacucacugucucugccuuggugucucuaucacucucucccugaaagcccaguggcacuggcgagcuaagccucucuagagcucuuaccguggugcccgugaacugguugggcccagaauacuaggagaccaugggugugaguggaugggcguuucauguggggcccugccugggaccuaaauuugugagccucucccaucccgugccuccuguguugcagcuuugacaagaagggggacauacauuaccugaucaaguggaaggaccugcccuacgaccagugcaccugggagauugaugagauugacauucccuacuacgacaaccugaagcaggccuacuggggccacaggugugcccagugcuggcagccagggugugggcggggcucccgcucguucgcucgcucgcuuggucugaguuuugcucaucuguaucugauguuucugcucagggagcugaugcugggggaagaugccaggcugcccaagcggcuggugaagaagggcaagaagcugaaggacgauaaacaagagaagccacccgauacgcccaucguggacgugaguggagacaggguggagguggcgguguggcauuagcgggcccgccacccuacguguggcaguagaggcagggucucuuuucucaaggacccuuccuugggcccucauggccggacacugugagagacagcgaggcuggaugggccagugggaagagcguacuggucuggaacucagagauuugccugauucugccacuugaguucugggauuaaagacaugcaccaccaugcaggacccccccugggcauauuuuaagaagcccaccuugggcugggagguguggcucaguuuguagauugccugcccagcaucuacaggcccuugguuucaauuguuaaucuugaccuugacucccauuccuuugaccccaguuggaggcugaagaaccaaacaaacauucaggguuaucuuuggcuacauaguugaguuugagaccacccugaucuacaggagacuuaaccucaaaaucaagcaaacaacuaagcaacaacaaccaaaaccuccaaagaccaggauccaugguggggacauccauugggaggauuuuauugggaaagugaucuggagauacgggacaaaagggggcacagugacauucgggugagggagccaggccuuugcaggcguuaagguguggaccuaggaaguguuucuuggagagacauucugggggacaccuugaguauggugaggagaggcuagcagagcaggaagggcuuuuagacagacugccugcgaaggccuggaggcuugacucugguggcccaggauucaggcugugucugauucuugaccuccuaccccagcccacagucaaguucgacaagcagccgugguacaucgacgccacaggaggcacgcugcacccuuaccagcuggagggccuuaacugguuacgcuucuccugggcccagggcaccgacacuauccuggcugacgagauggguuuggggaagacaguacagaccauuguguuucucuauucucuguacaaggaggugggcagacaggagggcaagcggggcugggcgggcgggguucugagagggcgggguucugagagggcgggguucugagagggcgggguucugagagggcgggguucugagagggcgggguucugagaggggggguucugagagggcgggguucugagaaggcggggccuguacagguggggucugggugggcggggucugggcagauggggucugagcaggcgaggucugggcgggcaggguucugagagggugggggcugggcagaugggggcuggauaggcaggggcuggguggacgggggcuggugccauccacuggcagccagcuucaccaccucagguucucucugcagggccacuccaaggggccuuaccuggucagcgcgccccuguccaccaucaucaacugggaacgggaguuugagaugugggcgccugacuuuuacguggucaccuacacgggggacaaggagagccgcucugugauccgugagaacgaguuuuccuuugaggacaacgccauucgcgguggcaagaaaguauuccgcaugaaggugagugcugucuucacccaggaggcucugggacuacugagccuugcaguguccauauuccuaggccaaugccacaauuguucuuuacugaugcgauggcacaucauuggccgaggcuaaaucuucacagaccugggggccagcucuucagccaggcucacugugaggccccaggaggcauccauccgccucuuccagcuuagcuucuggugucugaggauugcauggcuuaauacaauucucugcuccugccucuguuaccgggcauccuccuugggugugacuccucucauaaagacaccaccgcucacgguggagugagagcuaucacggcuuagccgaauaacucuuaccugccacgucuuauuucaaaaaccaaaccaaaacaaaaaccagccagauggauaugaaucuuggagaggugauauuuauccuagaagagccaggaguuaguuaacaguggguguggugucuugguguccucacugaucuuuggccccgcagagggucuugucauagggcaggcugugacccagcagcucuugggagaugacagucugcauuuguaaaauaccccaugcucugaggugacucagucgguagaagagcucgcugcgcccgccgugcaugccugagcauaugaguuucguccuuggccucauguaaaaaaagccagaugugggcugcgagucugcgaucccagcacucccaggacaagaugggagcaaaggcagagucgcugggcuuagaaccuugcaggcccccuucaaggcuuaggcucagggcuauguguagaauggaggggggggggaggggagggaggaggcaggaagacucuaagagccagaggugacuuuacgccaacagcauuuucuagauacaacagggcagauacauaaaugaacucccugagacuguggcagcacgcgucagaucuacacacgcucgagccacacgaaauuuuagcacagaggagaagugggcacaaaguuccaccccuagacaggaagcuguuggcugcugcgagagggaaggccaguuuucuccaauggagugacaccagguguacaauccaggcugcaggccggguuuccacaaacaacacagggcccacauuuguuuguuuuuauugagauugagagaaugugaaauuggguacacagggcaaguggaggagaaucugggguacagaggaauaugauucaaauguaucgugugagguuguccaagaauaaguaaagagaucauuuuaaaaagucaugggcuaccuagccuggugcacagggcacagcaggaacaggagagacucagguuucaacaaagcagagaaccgacuccugagguuaucaucugagcugcacauacacuguggcacacauacacacacacucauaccaugcacacaugcacgcacacgcaccugcacacacacacacacacacacacacacacacacacacaccucauacacacacacacacacacaccccauacacacacacacacacaaacacucacaccccauaagcccauacuacaccacauacacacacacacacacacacaccucauacacacacacacacacacacaccccauacacacacacacacaaacacucacaccccauaagcccauacuacacuacacacacacacacacacacacacacaccucucauacacacacacacacacacacacacaccccauacacacacacacacaaacacucacaccccauaagcccauacuacaccacacacacacacacacaaacacacacaccucauacacacacacacacacacaccccauacacacacacacacaaacacucacaccccauaagcccauacuacaccacacacacacacacacacaaacacacacacccauacacacacacacaccucauacacacacacacacacucacaccccauaagcccauacuacaccacacacacacacacacacacacacucacaccccauauacccacacuacacagacacacaccacacacacacacacacacuguuagagacagggucucaucacugcauauacuggcuagcuugccugcccgugggcuccugucucugccucccaucucacuagcauuacaggccggugcuucugugucuggcuuuaugugagcuauggcgaccagucucucaugcucacucaccaggacuccugguugcaaugauaaccuuaaacacuuuccaccccagacuguuauguguguggguguggagcccgcagggauagaggggugaugucacucaucuucugcaacaucaccuucucgagggcacugugcuuuagcccugaagugccugguacccguguuguccccccagggcuccccgggaugcuugugugggcuucccacucacuuucucagcucugccccuuucccuuugguuugucccugccaucuccuuccauguucuugccucuccccauagaaggaagugcagaucaaauuccacgugcugcucaccucuuaugagcucaucaccauugaccaagccauccugggcuccaucgagugggccugccucgugguggacgaggcccaccggcucaagaacaaccaguccaagguaggaggcaccggccguggggcuuaucccgcugggcauggccacggcucugugccuccucacaccccaucucuucuccccaaaguucuuuagggucuugaauagcuacaagaucgacuacaagcugcugcugacagggaccccccuccagaacaaccuggaggaacuguuccaucuccucaacuuccugacuccagagagguucaagugcgucccccgggccuggcaggagugagggguugcagcccugugaaggcauggcagccgccuauacuggcucugagaacugcuuggggaccuuaguuuccccauuagucaaaagggaacauggguaguauucuaggaugaucuugugugggaaggucucagcauuccuggggaauuuacaacugcccccaacaaaccaggguuugcuuuagcucugucucagaaggcccuggggcuucuccuggguuccuacccaugugccuccuugccuaccaucucuggcucauuucagcccacagugacagaacgugacccacgugagcuuaucaaugacagaggccagaucuggggugguguggagauggaagcaaagauggccccuuccuuccuaggccugcuccaaugggggagggggcucagggaggagugucauguuuccauggcgauucaagggcagguuguggcacgcuuggccaggucaccuugagugcucagccuuggucuucuuuuuuuguagucuggguugguucugagaacuucagaacagcggugauaggugggaugcaggcucagauggagccugaguggucacauggcacuggccgcuggccugugcuggccaugccuucuguccugucucauccacccugggcccgauuuccucugcagagaacaguagucuacucugacccucugcuucugacacuuaccccggcucuuuauugcagcaaucuggaaggcuucuuggaggaguuugcugacauauccaaggaagaucagaucaaaaagcugcaugaucuauuggggccgcacaugcuucggcggcucaaggccgacguguucaagaacaugccggcuaagacagagcugauuguccgaguggagcugagccagaugcagaagugagugcuggaggcucacccuguccugcagcaacuggcccuucuccuggucuuguguccucagccaccccuucccgcaggccccaacuggcuuuccugaccauuuccugggguugacaggaguccuugcucagugauuuccuucccccuccaucaauugcagugacuacggucaggcugccucaguuguaguaaugucucccauugacguuuuauccauaccuggugccuggggcaccaccaacccuucugaaaguagagccugccccuuaggaaucuggugggaccugaggaggcggaguccagcuaaccuugaccgcacccuguugcaggaaguacuacaaguucauccugacucggaacuuugaggcgcucaauuccaagggggguggcaaccaggugucucuacucaauaucaugauggaucugaagaagugcugcaaccauccguaccucuucccuguggcugcugugguggguucccugugaucaucuuggaggggucccugugguugcugugguggauucccuguggccaucuuggugggucccuauggcugccaugguggguucccugcuacagugguuucuuuauggccaucauauaggucucuacaggucuguaccggcucuuguuguugccuguggucacugugauggguuguccguggccaccauggugggucucuaauggcuucuguggucgugguagaucccuguggcugccaugguggcuucccugugaccaucauacaggucccuaguugggcgccaugguugaacuaccaugguugguucuucaugcuugacacucauguguucccuguggacaguaggugccucccugcuguggugguuucuugugaucucuaaggaaggugcccauggcuaggugccuuggccccaguccucuguuccuuucccaguaugacuuguagaggugaugugugucuccauccugucccuuuggaagcugccucuuuacacugcuuggcuccaggucauuucuucccaaccucucccaguagccccaaagccucccuagccucagcacugggccuccagggagcccugagggcugaccuggcuucccuuccagggaguuuauccugggucaucugaguggcagaagcuagccaggcgcugggcucuggaauuugucuagcgcagggcaguggucauggaaagcugacguuccuuguggaggucagagagaccaccccaucacugcccuuaggguucagacucauccucuacaggcccagcucucccaacugcugcagagacaggcauggcugugcuggggugaccucacuucgggccacuggagguccuucuuguguggcucaguaacuuugugggaucugccuguagauugaucugcuccucuggagccagaggccuggcaugguuuaaugcuuuccaggacagugaccaagccaguuuccauggacagguccuggggcuucauuucagagcuaggcagagagugaggcuggcaggcuugugccaugcuuaagcauggucuggagcgaggcucuguugacacuauugagcacgcuugggcuugagcucugugcucaguaguacaggugggcacguggcccauggcugggcacuuaucccucacuacagucucuuuggugccaagcaagaggaagggccaccaaggcucugcugugcuguguccacaggaagccccuguacugcccaauggcuccuacgauggcagcucccuggucaagucuucggggaagcucaugcuauugcagaagaugcucaagaaacugcgggaugaagggcacagagugcugaucuucucccaggugagccacagaacauccacagagucagccugccugugggcugaaggccucaagucggucccuggcacagcacagacucaugaagauggucugguugcuauagagaccagcguguuccccaucucaucccccuggcccugccccgccggcucgugugacuaggcuggugugagaagccccucuucuguccagccucuucuuacuacugugugccauggucgacuaagguccagauugauaggucaggcacuggacacggaacagggaaagacagcaccucaggcucaacucuugugggaggagggaugagcacacccucagacuuaccaaugagggcaggaggcagagcgcagaauccaaaucccugugcuuugaggugucgagugguaguuccauauaguugaacuacguaaagacaggaagggaccagucaggaucugggaucuguguguguguguguguguguguguguagccaggugguuggaaguaguuaaggggagaagaaagcauugugucuguagagcauugaaugccagcagaggggcugggggccacucuuuuggggaaaugggagugaaccggaggcuuaugucugaggcuagggauggaggcuccucugcagaaugguggugggugaugggugaggcuggggcugcguucuuuuuggggaggccuacuuuagacauauuaacccccacuccgggcgucucuguucuccuacccauggugguguguguccgcauuucuuguagaugaccaagauguuggaccucuuggaggacuuccuggaguacgagggcuacaaguaugagcggaucgacgguggcaucacugggggccuccggcaagaggccaucgacagauucaacgguacucaucucucucgggguaacccugugucuuggggugucuuagccucagcauccaaugaacagugcuuuccagccugcuuugcauauuggaagaaacacaccaguccuuacaccacaacuugucuaucaucaucaucauuauuauuuuuauuuuaagauaaggauugcuauaaagcucaggcucaccucuagcucaccauccuccugccucagucuccaggggcugggguuacaugugugccacuacaccagagacauuuuauggucuguugguuucugaggauacucaacaggugaugaauucucuaagcagcauuuuagaguuguaugagaagaaggcagacugggaaggaaugcugcaagcuacucaccccucuuugauugauacccacuuggcccuugaaggucagcuucccucuccuucugguucccuucaacucagcagggccuggccucagcggggcuuugcgagcccagcagauguggcugccucucuggaaucauagcuucugcccuugccucagucagggaccuuugcuccgguuccuggccuccuagcuccuuccaccgaccccugccuagcugugcuuguuaacucacacaugcccguuggccucuuucucagcuccuggggcccaacaguucugcuuccugcucucaacacgugccgguggccugggcaucaaccuggccacagcagacacggucaucaucuaugacucggacuggaacccucacaaugacauccaggucugugccucgucuccugcugcgcucucggcuccucuguccuuuccuguccuuauuccuauaccccuguuucugugccccaccccucacaauaugaaaacaucagccuaaaaggggacccugaggggugaagggagaggggcgcaaaauggcucagagagggcagagggcguguucaagacacacagcaaccugaaugccagcccggaucggucccauuaccuucgggucccuggucagggaaggaggcaggaugagggagucagucacaggauccacaggggugccaguuuuggaggggauaagggacuauagggagccugcugggcauaggggagagggagaaacagggauggauggaaagaguagggcguuguaggaauagaacccccgauguucuacugucuccucacucuggggcagaacaugauacacuuugauaaucuggagugcacacacacaugugugucauauauaaugucucacuagagccauauccuauagacacacuggagccucaggcacauacuccagggcaguuccuaggccuucucaagguagcuguaucuccagcucaggccucuucugucccauuaccacacaccgagguuuaggcugccuucccaugaugcagcacuggaguuccaggaaguucaauuuccaucaaacaugcaggacacuucuugacaaccccuugugugucugcagucacauccagauccauuuuucacucuaaaccaacuggccaccuggccaccaugcugccucacacugaaguccgcacagacgcacagugcaccucccccuaugaucagacugccccugcauggccacgggcuuacaaacaugguccucccuggugugccccacuguggcugggagccuggagucaagccccgggugcugagcugugcucugccuccccaccccccaggccuucagccgugcucaccgcaucgggcagaacaagaaggucaugaucuaucgcuucgugacacgggccuccguggaggagcgcaucacucagguggccaagcguaagaugaugcucacacaccugguggugcggccuggcuugggcuccaagucgggcuccaugaccaagcaggaacuggaugauauccuuaaguucgggacagaggagcuuuucaaggacgacguggaaggugggccucuuuucugugggaguguugugggggcuuggggugaaccuguuugaggcauaccuauucaggaccccaggguucuugccccuuucucuacucccagccugugacaccccuuagaguuggcuaggguggcgucucugcuugcuucccaucaacccuugcuguucuucagugcccugaaaccauguucauccuccucugccucucaggcaugaugucccagggccagaggccuaccacacccaucccugacauacaaucuaccaagggcggaucucugaccgccggcgcaaagaaaaagcacggcagcaccccgccagguaggggcccaccugagucaccccagccuuuugucuagucagguggcugcaccuggacaagaggagguccucugcugcccauggcugccccuuagguugcccucuguugguagguggugagggagcugccacacccggcuagguuagggcauagcuuccuugccgggugggucacugaccuuaccccagcgggaaggccguucuuagcagcuggccccgcggaugguccugaccaccuuacaacugugucuacacgauguguccugcccaccccgcaggcgauaacaaagauguagaagacagcagugugauccauuaugacgacgcagccauauccaagcugcuggaucggaaccaggacgccacggaugacaccgagcugcagaacaugaacgaguaccugagcuccuucaagguggcacaguaugugguccgcgaggaagauggcgugguaaggccuuuugagugcucuggggccccgccucauggccauacugccccuugcagccccacccccgguagcuuuuccccacccgccagccuacaccaugcuucugucuuggccugcucuagaaacuucuaccucaucucucuccuguguucugaaaagccugauugccccacggcuccuaaucucucccaugggccucuccacauccucugagccccugcggcucuccuugcagaugugggcacugucuauauuuuccuuuaaaaccaugaaccccaagaacagugucuggggcuguacaguagcccaccaagaccaggaugcacauguggaaugagcaggaaacuagcaugauuggagagggcuuccuggaauaggcaaccccccucgcuugucccaugggccugugaaggugggugagguguggcagaacaacugggugugcccggcuaucucccacaucuacauccccaggaggagguagagagggaggugaucaagcaggaggagaacguggacccugacuacugggagaagcugcugcgccaucacuaugaacagcagcaggaggacuuggcccgcaaccugggcaagggcaagcgcauccgcaagcaggucaacuacaaugaugccucccaggaggaccagggugcguguggugagcaggggcacgccggccggcauggggcuguggggccggguacguggacggggcaagagugggagcagacagcuaggccucugggaggaaagggguugcaggcagguuguggggaugagcuggccaucagccagguggcuccaggcacaccuugaccguggaguggaugagccuccgagagucagcuuccagcuguggaacgggcagaguagccaugcgcuuccugagugcgaaugccugggccgggauuaucaacugaguuccgggcaaaguaccuggcggccauugacuagucugggagguggggagggggcuaggcuuggccuuggcugccugaggcuggggcgggccccuuccaugccccucugcuuacagaguggcaggaugagcucucggacaaccagucggaguauuccaucgguucugaggaugaggacgaggacuuugaggagcgaccagaagggcagagugagugcuagugugugacccggguuguuccggugcugcaggggggggggggugacggccggguggggugggcuagggugcccaugggagcuuuaggaggaggagcugagggucuccucauccugaggggcugguggagccucugcaccccagccugagggucuguggcgggcuguuuguucccuagguggacgacgacaauccaggaggcagcuuaagagugacagggacaagccccugccuccccuucuggcucggguugggggcaacauugagguggguccugcacguuccccagacccuccaggcugacuccuuacagcccaggaugugaaagaggagcugaggguuuucucagacucagggaaccucuggguuuaaguguuccuugcucuucuuccccaucccauaauucuggccauauaaccugaggucacaaccuuucacuacucuggccagguucugggcuucaaugccagacagaggaaggcuuuuuugaacgccaucaugcgcuggggcaugccgccucaggaugccuucaacucccacuggcuggugcgggaccuucgagggaagagugagaaggaauuuagguaaagggucccagugaggugacggccgggaggguguggcccccgaugccuggguggagugggcccuccaguggacagugccuacacccgccuggcuaagggugccuggagaggucaugguugucagaucuaugggugugguguuuugggcggggcugauuuauagaaaauaccgcccagcaguccucuugcccauacucuuugggauagugcuguuggccauccagggccagcaucugaggaggguccccugccagugaggcucuucugccuuucugggagccugaccacagcaggccugcugugguggaagauuccacgucagaggucucuaggggucccgccugccuccccucacucccugagccccaguaccccaccucagccuccccccacucccugagccucaguaccccaucccagccuccccccacucccugagccccaguaacccuuaccccagccucccccccucccugagccccaguacccccaccccagggccuauguaucacucuucaugcgccaccugugugagccgggcgcagacggcgcggagaccuucgcagacggcgugccccgggagggccugucuaggcagcacgugcucacgcguauuggggucaugucgcugguuaggaagaaggugggugaguaagccucuacuagccuucuggcuggcauguggccuuggcacugccucugguggggggcagccgccaaaggauaaaugcccaguucaggucacacagcuaucuaugucugagacaguccaaagggacagacuggagguggguucuaaggaacgggaacaccggcagaaguuugggucagaagggcgucugaccuuaauaaccuugggcagggcagcaccccaaacccauggcauucucagucuugugggcugucucugagaggugaccacuguccccucugcuacccuccuacugucccaggugcaggaguuugagcaugucaacggcaaguacagcaccccagaccugguccccgagggggccgagggcaagaagccgggcgaggucaucuccucagaccccaacacaccugugccugccagcccugcacagcuuccaccggccccacugggccugacaggucugggcuuagggagcgcgugggagagcuuuugggucuugggagguggaccaaguauaacguguaacccacagugugaggggcuacccccccccccacgcccgcuccaaacaacuugucaggcuuguagccacagcuuugagauuguacucacacacgugccacccaauuugccuuucuaacauuccaacccugggccacgcccccucuucugcuuccugggcaacugggaugcugggcuuauagugucugacaagugcccacugcgaccucaccagcuaggccagggucuuacaaggaucugaguuggaagccuggcuuggagcccuguucaucucuccugaacuugucucccauugaggagcaccugcaaggccaggccucucucucaccugaaccccucuucuccacccugcucccguguccugucuacgccuaccugucucaccucuuucccuugugcugcagacaaaauggaagcccagcugggcuacacagaugagaaggagucaggcaugcagaagccaaagaagucccuggaaauccagguauggaagucacugguggcugggucugugggaaguauggguggagcuuagucagguccagcugggaacagcccaggccuuccugguucccacuucuggucacuggaugucuuagucaggguuucuauuccugcacaaacaucaugaccaugaagcaaguugggcaggaaaggguuuauucagcuuacacuuccacauugcugcucaucaccaaaggaagucaggacaggaacucaagcaggucagaaagcaggagcugaugcagaggccauggagggaaguuacuugcuggcuuguuuccccuggcuugcucagcuugcuuucuuauagauuccaggucuaccagcccagagaugguaccacccacagugggcccucccacccucgaucacuaagcuggaucucauggaggcauuuccccaagggaggcuccuuucucugugauaacuccagcuugugucaaguugacacacaaacuagccaguacauuaggccugggggaccaggcagagagcaaauggagacaucugggguugagggcuuccaggcuggugcauauccccugcccugaauuccugcugaggcccagguccuguagcucccuggcuuguccuuccagacccugccaacugcccuggacagaguagagggugaagacaaacaucagagcucagacagcaaggacagggcucgggaggagaggacagaagagguggagaaggcccaggggucuccagagcagccacugaaagguagggcucucuuggaacaguccacaaccucugcagcccucuggugcgagagucagggaacuacauuccagucugugcccugccugggugcuggcugucccaccaccugcuaguggaaggggcaaagggucucucucuauacacacucgaauccugaccuguagaguuugggguccuuggauuauguuuugaugacaagguucugguuugaaaacaggagucugcccgauacugucaaaguugccuucuggcuuggcucugccggaguuuguacauugccuuucgaguacuggaaaaagacaucugggugugagguucuuaauaucgcuccagaucauuagguagugcuuguuaauuauacgccuaagguuuuuaucuuaaucuacuugaugguauuugccaugaucagucaccucuugagaacauuuauguuacaauuucacugugauggcagcaccacaccagacccugugguuagcugaauauuuguuuuggcguuuaguguuggugauaauuaccgucccucuugauagauucggcuuucaaguuuacucgguugggagguugggagauggcucuguuuguaaagcaaagaaaacucaaccccaagccaacccuacccucacaaccagccaaccccagaauacagaauaugccgguaagcccagggcugaggacacuugggagacagggguccuggggcuugcuggccaaucuagccaaauccaggcucaacaggguugucucaaaaccacaaagagauaauuaaggauaauuaaggaugacauaagugcccccucuggccuucacacucaugugcacaccccuucccacgugcacacauuuauuuugaccgcuauguugguuacuuuguucuaacauguauuugguacaccuggauugaaggugugcucuagggagcuuguagcuuguagcuagcccuaccucccaggguaccuaccucugagcuguggcuguugaacccugaguaacaguucugauggauagggggccccccucugcccaugagccccccucccuugcuuuguuugcagaggaagugcugccggacaaggagccgaucccagacaagccggagcugagcuugggucacagcggggauuucaggccaggugggcgcuucuuccugugcccugccacaggccuccugggcagccaucugggugcuuucugggaguccuagaugaggccagaggacaggagccuggacuugcaaguuccuccuggucaggauggcuauuuucucaggagacacacucauccugucccucuccccaccccuccugucaccccggucauccaaggagggagaagaacuggucacagacaucugcggcucagcaucuuugcucuagagcagcuacccuccaaucagauuugaauucucccuucaugguguucugagcuucucgguggugcgggaggggugccagggccuggaacaggccucccuguucaggauggaagcaggccggguggcucucccuuuacaagggcucauauggugagcacacagcauccaguugcuggacagggcuuugaguaaugccuucuagauaguuggugaacauggccuguccccuccccccagaugaccccaagacugaggagaaggagcccggggagacucagcaaaacggcgacagagaggaagaugaggaaggcaagaaagaagacaaaaaugggaaauucaaauucauguucaacauugcagauggcgguuucacagguacagaggcagaacaguagacgggacccggcugucggucucacuuccucacuguggcucccaggagucugggcuggugguaauuuuauucugaggugugaauguuugaugaugguccaucguaugccccucuuagcaauacuggagcaaugggccucugauagccggugccgagcaagccgggacauaagccagggacgggggaaucuccauucugcuuaccuuggucucucucuucagagcugcacacucuguggcagaacgaggagcgggcggcuguguccucggggaaaaucuacgaaaucuggcaccgccgucacgacuacuggcugcuggcaggcauugugacguauccuugcucagucaggcuggggggcuccugucaguuucucugggccucaggggacccacaaucucuaggaggaccucuacccuccucucccagcuucuggugacugcccaaaaccuuggcaggccucugugucucucugucauguucucuugucaucuggccaucuggcugggaugugccccaaccccguuuccugacagucguuggauuuaggacccccccacccccuuuugaucaugcuuggauaaagccauguuauuaaguuuuagaggucaggacuuacacgugcccauguggggugcagcauugggugcagggauggggucaccacucggaggccucggugcccugucuggcaccugucacagccugcuaaugucacugaugucuucauugccggcaugcuuauccugaagcugaggcugugacuugccugggugugcacagacagcaaacugguacccgggagggggguucccacuucacccuuaccgucaagccccucauuuuuuuuuuuaaagauuuauuuauuuauuauauguaaguacacuguagcugucuucagacacuccagaagagggcgucagauauuguuacagaugguugugagccaccaugugguugcugggauuugaacuccggaccuucggaagagcagucaggugcucuuacccacggagccgucucaccagcccaagccccucauucuuguggccagcuucacccuuaacaguacccacaggcauggcuaugcccgcuggcaggacauucagaaugacccgagauacaugauccuaaaugaaccuuucaagucugagauccacaagggcaacuacuuggagaugaagaacaaguuuuuggcccguagguucaagguaggccuuuagggauguuagcucccugacccaucucuguaccuagacgugggccaggcucaccccugaggagagucagcccacacaggcaaggcuccaguguagagacuccuccccuuucagcccagagccucagcuucagugggugccagucggggaggggcacaguggcucugugggaggaggggucaggccagugcugucacacacacugccccgccaccccagcugcuggagcaggcgcuggugauugaggagcagcuccggagggcagcguaccucaacaugacccaggaucccaaccacccagccauggcgcucaaugcucgccuggcagagguggagugccuugccgagagccaccagcaccuauccaaggagucccucgccggaaacaagccugccaaugcuguccugcacaagggugagugagccugcuccucacuucucggggagcaccuucaaucuugcccagggagcacgcuuggccuagauuggaaguguugauagggcagaugugcagagggggaggccucugggaccuggagauacaguucugcucuagagccucgugagguuccccgcuuuuaagaccuucacagagauaccaacaaggaggggcaggcugcagugggcagcacagagaugugggagauugggggcuccccgaugcucacagugcugcccugcgcaggugcgcgugagcccugugccugcaguaaugacucuuuuaagagucgccaucuuggggcaagggcauuggaauuuaggaagggggacagugugcucagaguguacguugagucuuacuccagaucucugccuuucugaccugggggcuugcagccuccuuguggggcagggcccagccgagggugggaugucuaccacugugcucacauaugaaggucugacuauguuuuguggaccaagggucuggagcuuuuuuuuccugucaagaggggacccuggaggaguuuuucuuggaaaccuuguuucucugauuggcaagcccgggcuucccaggcucugagagccuggugaggaacgucccacaguguccacuuuugggugugugccgugccguccguacaaacaccuuccuggccacuaccuguacggcagcuguggagggcagacccaagcccuccauucuuaggcccucccacccugcaguccuaaaccagcuggaggagcugcugagugacaugaaagcagaugugacacgcuugcccuccauguugucacgcauccccccgguggccgcccgucugcagaugucugaacgcagcaucuugagucgccugaccaaccgagcuggugaccccaccauccagcaggucagguuuggccugcacacugcaccacgggccugaguccccuuguccugucacaugggugggugccccugggcgggggcugggcgauguucugguugucaccuguaaagcugguccuugccuccagggcgcuuucggcuccucucagauguacaacaacagcuuugggcccaacuuccggggcccuggaccgggagggauugucaacuacaaccagaugccccuggggcccuaugugacugguagguccccauccgauuccgggcagcaugcacacagcgcccccuuggggcccagccugcccgacgcuggggaugccaggcaagcccaugcucugaucucuucuuggcagacaucuagccgucgucgugacuucccccuguuucagcgcuccuuuccagcugaggugagggugcuugcuggccaccccacugucccauacgcuucaguuuguccuaucugugcguucauugauucaugccucugagccuuggagacuuaugugucugguaguuuuugagucacauucuagcuuagauuuggucauggcuguguguguauguacaucuguaugugcacauguguccuuggcuccauguggucauagcuuuguguguguguguguguguguguguauguguguggacaucuguaugugcacauguguccuuggccaugugucauuggccccauuggccccauguggucaugucuuugcauguguguguguaugugcacauguguccuuggccaugugucauuggccccauguggucauggcuuucuguguguguauguguguguguacaucuguaugugcacauguauucuuagcugugugucacuggccccauugaucacugcucccagccuaaagcccuguccugccuccacuguccugcaugaugguccaucccauggacaguugcugcuugucucauacccacagucucuguucaagcuggcggcaggggguagggugggggcagugucugagggccugagugugaggauggcuuugggagcggagaaaggggaauucagagaagucacuaguccugacggcucucgccaagacccgucuguuccuguaagguagaucccaagccagaggaccuggguaagcuuccaggcugagccuauuggaugcugggacuccagccagcaauuaggugcagcucacaucaaguccagaggccagggcaaggagaucuuaauucugggccucucugaucauaacugugaccagugugaacagccaggugccucuggccaccuggccacccacucuuacaaucaacugguuugccuuuuacagccaagccaccugcccaacccccgcgggagagaaaagcuacagcccuuuuaggaguuggugcgguguugggguacaaaagggaaaccaugaaauucuaucacacggaggacaggcccaggcuggcugcgcaagaguccagaagugccaccucaucguaguugaagccuucuuccacacggcaucccaucuacagcuacgccuggcaagguccuggcgccuuuuccagagugacugacuuagaggaaauuccauuuaccuguaaauuuuuuuuuuggcacuuuccuacugaagaugcaaacauguuugucuugauaaaaaguuggaugacguguggaagauucagauucacgacacuccugucugucaccggcuccagaccucaaggggaagcucuuuggaggcccuuggugcugcugcucuauggauucaacugcggccgaagagaaugcagcauccagugcucuggaaacccuuagucugccccccgcccccgucuguacccgugugacugcuccagaccccugccugcuugggacccuagugcuagccuagccagggaggggaucaggucuggagaguggcugccuacccugcugaugcccagcaugggagacggcccgguacaucccacuucugggcaggagcgcauaucucaaggucucuggcaucucucauuuccaguggacacgugguggugccagcaauguguggcagguugaagugaggguaccucgcucagaggguggagcagauuuagaccuuggacaaagcccccugcagggguuuuuggacauuuucugucugcaggagugugguauagauaggugugagcuggugucccagagaagggugguguuuguuggguggcccugcgagacuugucccacucaccuuggcaaagacaagcaucuuggaguguccugggccacacagaugccagcagccccucccagagcugaauugaucucuguugucuugguccuagagaagccuugacuagggugacuucugcaugaaguaggggccacaggggccuuugcuggaucuccgaggguauggagagagcugugcuuggaguggggccuggagcugauggugacuuuagauccuuccuacccggagccuucaaggcuucugaccucauuuccugcagggaagccuuaagagugccaggcccaucuucccaugucacuguugacacgccacuugucuugcucuaccccagccuguggcaccacguaacgcuccaugcugggguggggguggguggagccugccaggcuccaggccugugucugaacuucuuacuggcccuuggcucaaccuggagagauccugggguucaguuuacccugaagaugaggacggggcuuguggagagaagccagucggguccgagggagcuugguaggggucagauugucccuggaaaaggaguugggggguaugcagcaucucugggccugccaaaaaugggggcaggucuccauggcuuguuuugaggacacugggcagguggcuggccuuuacuuagcccagauauguacacaucuguaacauaguuccuccucugcuccuggagggcuggacccccacagcuucuuauacuuugccacuccuauacuugagugucuauccaagucuuaaggcuagcaacuggccgcacacuguggguaggcggggagggggaggggacucuggccauagacaggaccacugaaggcuugagugcauuaugguggcugaccccgcucuccaagaagggcuguccucugcacaggagugucuucccuaguucgcuccccaacccagaccucugugcuaaucccaagaugggcaagauggucagcccuguuggccucaguugccacacugacauccuaagacuuaggccugcaggcucacgugggacagaauagggucugugucucuugacuucagggguccaucccuucccugaagacuucccccaggagucuugcucuguccauccaucucugcuucuuccugggccauacccacccucuguggccuuccccucuccacagccaccuugaccugagaccccugcuggccugggagggccuuagcgccucaguucuccaggguagacugcccaggcagcugaggagaggacaaaguccuucagaguguucgcaucuuggcccuucagcugucgccugcuagagagugauaggauagagguggcaucuugagguggcucucauuuugcugcugauagaacuggguccucaugcccgagcugucagagcugcagugacagugauuucuagcugcuuuggcuugcuuaauucuauaggaucucuguggaaggugugggguggcucucggugacauagggguuugggucagagcuacaucaucugagggcacccccucaccccuguucugaauugcuuacuccccauaccccaggggccaccugugagccaggguucccucccccagccucugggugcucccuagcccaugugggcugcuggcucagugacaccggcaaccagucuaagucuugaguccugcagggggcacguggaggguaggcuagggggccagggcucuuuguagucucauagagugggcaaguguugaugcuuggagugucucgugugugccaaggaaggggguugggggccuaggcugacccucccuccaacuucgcugucuuggucuacccacaagggcuccugcgcagaccacagccaggaggaggaggaggccaaccugcccaauuuauauacccgaaaguuuacaggucguggcgcgucagcccaaagucuuuggugucccugcguuuauggauauuucccucuuaauuuucagauuuuuuuuuuuaaaaacaaaaguauuuuuuuagguaugauaaacccggaaagggccuguuggguauguguguauguccugaacucuccacaaagccacacggaccagagcccaggucagaggcagcucuuccaccuggccuggaggggagggaggguccccugcugccuaccagggucaagcuagacugcagggauucucuuccugcccaggccgggcuggcaucuguccuacccuugcccaaucgagcacacccugaugaagucagaguaggugcuuggggucagcugggagcaccucagcaggggucccaagggcacaucaggagccccucugaaggcugggcagaccagugguaucuccacuuguauucucuguguguauguuuugguuucuguguuuuaauaaacccuuugggaagggauggaaucgcugu

SEQ ID NO: 12340 - RNA, 1343 nt, Mus musculus
gagagucgauccagucucugacugugagagcaagcagccagaagcagacuccuuaauuccaggggaccuagagcuagagccugcagcaauggugaguccaauuugggacagaggcagauggguuucauuuuaguugacuuuacuccauuccuugauagggucuuccagagacagaauagucacaguaugagaacagaauauaauuguuuaaagcucacuccuggggggcggggggggggcagguucuuuugcucagauaccagcucuagaucccuuaaggcugggcccagaaggcuaucuuuaugggugaacugaaacaaugugaugguugugggacccuuuagaaccgaggccuccguaucauauaccuggaugguuccccuaauagaggagaggaugggguggggguggggggggacauggauggacgugggggcuggcccugugacuggugcuuugcauguaguaacucccagccaaaguugcuaagccggugguucucagccaaaggauucaggaaccuuuugggggccugaaugaccuucugacaggagucgcauaucagauauccugcauauagcaaaaccaguuaugaaguagugaugaaagcaguuuuaugguugggggucacuacaacuccaggagcuguauuaaagaauggaaacauuuuauuagagucauagcauuaggaggguugagaaccacuccuaaauccaugugaugcuugcaggccugggaccuaaaggugaagaugcugggggguaacgauuuccugguguccgugacuaacuccaugacggugucagaacugaagaagcagauugcccagaagauuggugugccggcuuuccagcagcgccuggcccaccaaacugcagugcuccaggacggucuuacccuuuccagucugggucugggucccagcagcacagugaugcuagugguacagaacugcagcgagccucugagcauccuggugaggaacgaaaggggccacagcaacaucuaugaggucuuucugacgcagacuguagacacgcuuaagaagaaggugucccagcgggaacaaguccacgaagaccaguucuggcugagcuucgagggaaggcccauggaggacaaggagcugcugggggaguauggccuaaagccccagugcacagugaucaagcauuugcgccugaggggugggggaggggaccagugugccuaaggcccccauccagagccaguguugguuauaaaagaugauggggggggggguauggaggacuuuugggauagcauuggaaauguaaacgaggaaaauaccuaauuagaaaaaauaucaaaaaaaaaaaaag

SEQ ID NO: 12341 - RNA, 177915 nt, Mus musculus
aggcagcgagugagcaccccgguuccacugugccgcacccgcagccugaagccagcauggagaaggacagccugagucgcgccgaucagcaguaugagugcguggcggagaucggcgaaggcgccuaugggaagguguucaaggcccgcgaccugaagaacggcggccgcuucguggcucugaagcgcgugcgagugcagaccagugaggagggcaugccgcucuccaccauccgcgagguggcggugcugaggcaccuggagaccuucgagcaccccaacguggucaggugagccgggagcccuggcuaugggguccgggaaggugcugggcaaggggcggcugguggcccaacuaaaguuaagaguugaguuuccccagauaaaaccggugacucuguuagacagggcagaaaaagagaccugcgguggcuuccgggcagccaagcuauucugaagagcuuucgcucugcgugccccaaggguuccgggggggcguugggugucuuuuagggacaaaaccagacaaucccuccagcccuuacuuaacuuuccccgucgguggggggauuuuugagagacagagugagauaguuauccagcuugcagauaauuagaaggaaacuuuaaggguggagcauaauguaaauaaaguuuaagaaauguguaagaauguguuugccaaucaaacccacaguggugacuuuuuuuuuauaguuguagaaugguuucugauggucuuagaaguucagaaguuuagacucugacaccuaguguuaaacauuguuugaaaaaugucuuucaaggcuggguacugggaacacugaaccaggaagauccagaguucaagacccuccugagcuacaaaagacccugucugagaaaagaaagggagggagagugggugguaggguggagggcgauugcuucucaaaggguuuucugauuguaucauuuaguaucuguggacugguaugaucugacuuagaaugccucucucauugguuagaugugagucugugcuuuagauuuuaaagccucuguuuucccuggaagaguugugcaggugggugggggaggcauuccuaacccagucuccugugacugaagauaaugguguuuucucgaagaugcugggauuuccccauugugccuuuucucauucucuuuuuuuaaacagaugcauagcuggaaguuaaaagggaaugcacagacuuuucuacaaauuaggugaugaguuaacauucucagcucuucuuuuuagagggaugaucuuggcgucuucauccugucuucucauuccuguagggauuccuuacaacaaauaugugccuacuguaugcccugggaugaaguuauguaaauaagaacagcuaaauauuuuuguaaaaggcaaacaauguaacauuagucaucaaaaaggagcgacccgagacugaccuuugaaauaccaagcccucuaggacucagagucuacagaaucuuccugggaggugguuguuaaagggcuuuuaacuccucuacuaggcuggguguucguuuuguuuuuuguuuuuuguuuuuuuuucuguuuauuuauuuguuuguuugucuuuuggugggguuggguuuuuuguuuuuguuuuguuuuuguuuuuguuuuuugcuagcacuuuguucccaauauaaucagacucacaagugaaucauacuacauaaauaaguaaaaagccaauguaaauaaagggccgccauuauaccuaugcuuuaguuggguggcagggguauguggggugcaacagcaaaagauaaugagacgagggagaaugagucuucuagaaagucagguuuuacuaaaaguggauuacugucugucugucugucugucugucugugucuugcacuucagagaggucugugauccugaaaguugccugcuggcucagagucauucacuacccuagaggaucacuauagcuguaggaaaggaugacuuucaacauuagaauuuaauaucaaauuucguuugucuguuaccugugggguguccagauaaaagguaauaaucauauauguaaauaaaaaguagcauuccuccaaacaaacacccuuguauaaccaaucauugagugcaguucaauacaagucccuguaacagaagaguuuuggcuagcucgcucacccuguucuccuguuuuauccuccugugacuggugugucucuagaugguuuuuaguugaucccacagugggauuuugaauugugaguucaggagcaucugcuuauaugcaaaaagaagaugcgcuuucuaaauuuauuuuaccucguuugacaccugccuacuuagaguugugaggauaaagcaagagcauaggugaaaauccucuaaauuuaaagccaccucaggcacuggauaugucagagauaaucagauccuuggccuagaacagguccccgggaaggcauaauucucugucugacauuauuacagaacaaaucagauuccuguuuagacacagcaagacuuguguaaguccagcuuggugaguuuuuuuuuuuuuauaugaauaugggagagggccuauguacagaggcagaagaccugugucaucgaagcccaccccagcaugggugacagcucacaaggcugagacccuagagcauacugcacacuugcaguuagcuuaccagauuggagauugagucuuccaggaaccuccauugguuucagucucuuccaggcagcuaggcugguuucugcguuucgucugcucugaguuauuugcagaugugacucugcucuuuugagagggacacucaucucuuauuugcuuauauggcaaggagaagccuagugaaucugcuuaguuucagggacuuccugaaacccuauucugaauuguuuacuuuccugcuuaaggagcuuccugucacaugggauguuuuaaucuuggaggagacuguuacacaccagggaccaagaagcuacuugggcacccauacccugaauuugucagcaaagaaaauugauugacuaugcgaugagauuagugaaaugacccuguguuuaacuaauaacaucauccucacaagccgccaccucugucaccuuugguuuucuuccuaguuuucuccacuacccauccaccacuccugcccccaacgacauauguggcuaaacuagaaauucuuacuguagagguuuguguuuuuagggacagucuuaggaagucaaagauaagcgacaguucuuuuccuuccaagggagaaugucaaaacugagccccugaaccuguaauuuguugucuuuccugggguaaguuuuauauucauaagcccggguuuuuaaagauugcuuaaaagggcagaugcuuuuuuaagugccuuccagccauaaguaauugaucauaauuacagucccuacccacguguaguuaagccucuaagcuugaaggagcacaauaaacauauuaguuuuuucaaagguuuaagacuuaauuuuuauggauuuaccagaaagacagacuuguuuuugugggugugaagccccccccccccaagcuugcaaagcaccacugacuucacauucuuucuuaccuggugugucccaggcuugaugagccaauaguguccugcacacagauucgcucuaguuuuacgguucguaaucuugaguucuggagccuuugucagaauaaguguauacagacggaguguuuccauuccacagauuuuguuugccauccugaaccaagacacagagauggaguaaaacuuguuuuaucagcaguuuguuugugcaccaaguauauauugagggguuaccaugugcuggacagcuucuagaaaaaagacacaggguagggaagugaaugagucagagggaauuccuaagcuucugaacugucucuuguuuguuuuuguguuuuguuuuguuuuguuuuuauuugagacaagguuagucugcguagcucuggcuguccugaacugucuucuguaggcaaggcucuaacucaaaucugccugccucugcugccaaaugccaagauuaaaggugugcacuacuucaccuggcuagcuuguuggcauuuuuuauuuuuaaaaaucuuuuaaaauguauuugucuaagcaaggcauggugaugcaugcucauaauacuagaacucgggaggcaggagaggcagaaggucagggucauuccagcugcuuggcaaguucgaauccagcaugagcuucaggagaccgucuccucuuuauuucaguuauuacuucccucaguuaaccugcccagcuuuacaaagccgugcuuaugcuugugacaguuuaguuacaggaauuugccaauuggguagaugagacacgcagaacacuagucagaguuacucgauauauacagguuaaauuuucccuugcguacacacaaguugaccucuauaaaaaggccuugacgugucacuaacaugugcgaacacuugagcuccauuuauuucagcgaguguugaggaaagaccucuuuucuaaaaacuaguuguaggaaagacaccugguucauugguuggcuacucagacaauucugcugucagugaaggaauaucaggaucaacagaaaacugauauguaguucuguucagugcacugagacauagguguuaccuaugucgccccagacuguaaguuuguuagaguagcaauaaaaaggcuucaaauucaaagauuagcucugaugccauggugauggucugucagaagauaagguuguaauccauaaauguuuugagcacauuaaguuauuauuagaguauuuagucacuguuuuaaagggaaagaaaaauaagauuuguaguguugcgauuauuuaaggaaaugguucucguuuucucuuuuuaaaguucaauguguaaguaauauaaaagaagagaagugugacuuuaagaacaucauauauuauauuuuauuguaaauuguaaagccaggauuucagaggucuugauucaugagagcccucauuaauaaacauguuauuuuguggaugaauaaucuauugggggggugcuugcuucagugaaaauagggucaggucagcauuuaaacuucaguguuuaaaguauguguguucuuuccuucucugaguucuugaaaaguugcaguccucagagcuguugagcaaacagacauuuuuacacaguuacauucugcucucucucucccuguaguugcaauuaguaacgaugagguuuuggcucugugguuguauuccuuuguguguaaguauaucaucauggaagucauggaaccucacuuggagucaaggaacagugaggucuguaaaaaggaagcauacacaucugaauaauucuugugguuuuccucuuguuuaagacucaggccaacgaguauccacggagguagauccuuguuuuaaaaaauaaugcuucucguauauuucagacccacuguuuagaucucugacagccuugagcaguuggcaguugccaguauuuaugucuagcaggagugugauuagggagucucauuugcaguacaccaaucuccaaagauuuccuuuugaaacauuuuuucucccuuccuuaauuuuuacauuccggucuuacuaguguuuaguggauaauuuugguguuucuguguuuugaggacaaaaaucuaucauuauaccauaauguuuguucucaauuuacauaucaaauaugccuuauuuuuucucauuuugauuuccguuaauaacaguugccguuuuaacauacuucacugaagauccauuuauuuauaaauagccuauugcacauuugaacaaauaaaccaauaggcaguguuuuccuauuguaaaggaguuuccuauuguaaucugaguuccagaugcugguuggcuuuaaggugggugcuggguaaucaaaccuggguccucuggaagaguagccagugcucggggugcuugaccuaaccuacuauauuucauuuauucagaaacauacucagcaaucaacaguaauaaaaagcacaaucauguuuuugcaaauauuuuggguuagcauugcuacugaaagacuugaguguaguaacucuauuacaggcaucuaugaacucuacugagaccugcagaugcauaacaacauuuuaaguguuucuucacuguccuuauuucuccucacuauugauaaugacuuuggugcuauuguugugugcaguuugugcucuuguuauuuguggacaaucaaaccuuuccaguuccuggagaugcccuucucacaucugcuucuuugacuuaacuuggaguuauccucagaaugugggcuuggggccccucccugcacacauccugcagugcucccuguguuucagggccaggguuucacagugcuuuguuggugcacucuuuaauaaucccucuuccuggauacaugccugccuugacaacuuuggaccucuggcauggcaguuagaauguauuuauucucuuacguuaacugcuacauaaaacacacgaauccuccucaaguaauccuagcugugggcuuccugaggcagaaagugucuuggugauccuguauauccuguggcaagaaaaugaaucuauagcaaaucagugaugucauaggaaagggguguuaaggacaggcccuuugaaagaggguuaaauaagagaguccaguugauauuuucucugccauagauggugauguugagaagaacguaggguuucuagcacugagcaaguguuuacugaguaucccuguugaaaugggauccacacaguguucacauguuaaaaugucucccaaaacugcuuucaaaaauguaggauggucagacaggugauggugaauaacauuuugaagggucauugugaccaguggcuuuugauuggaugugcuuagacuuuuuccugggaguaagaaguguagcccucacagacugggagugggagacuucgauucuuuucccgacacccucaacuuaacuagcuguguaaucuugaguaaauuaauaauguuucuugggugacauuccucaacaauaaagaaggaagcuauuccuacacuuuggauguuaguggguugacaugaucagaugaaacuacuaaaaggucaaacaguauaaaaaugggaauuauuagcaaaaccaacucuugcccucaagcaaaaacauauaauuucauggaggaaacugcaguguacacagaugaacugcuaguguguauuuucauggcucgcccaccccaugugacagcaugaauggauucaguguuaugguaaaauauaauuuuuaaucugcguuggaaauugauguugcauuuacucgccacugcaucugggugauccagucuguugguggaauuuuuucccauaugagggucuguagaacccuccugagaucucacaaacaggacuuugauuuccuuuguguucuguguuuuagaagaacucgagagauaaccuccacucuuugcuugcuagcucacguuuauuuuguuuucgcacguauucacuucuauuucccucgguguaugugauggacacccacacgugugcauggagaggauacaugugguucucuccuucuaccauguggguuccaggaacugaacacagaccaucggggcuggcagcagcuaccaucacagcccuccucucaccucuuucaaaugguaaaaucccagacggguuuauucauuuccagucacacacuugagccucucugcuuguuuucuuagucuguggaauagcugcuucgugacacucaguuguuuugcacugugcuuuaagucagugggaggagcaaggcgcucuacagggguuuccagcaagccuuuucuucuuucucccuugcuuuauugcuaagugaucucacaaccuuccugguggaaguuccuaaugguuaguauaaagcacuuuucccagcaugcucuugguuuuaaaaggcauggaaguauugaacaggaauguugccauuuauuuacaacagaacaagaagaacaaaagucuauuucaaggguaggucuuuaaacuuuggguacugagauuaagaaauggauuuuuauuuacuuauuguaauuuuuagguguauuuuauauccgugugucauuuacauguaugucagugcaccgugugcauccugcugcugccucuggaagccaugaguguauuagauccccuggaaccagaauucacagaugggugugggcugcagugugggugcugggaauuguacccaagucaucuacaggaaggguaaaugcucuucgcugcugagucaucuugcuggccucaagcaacauauuauucuuuaauaaauuaguggaaacuaugagacuuagcaaucucaacuuggaaguuuucaguguuuuuuuuuuguuuguuuguuuuguuuguuuuuuuuuuuuuaauucauccugacccuauaaaauuguuuuugaaaaauacuuaggaaagguaaaauuggauucuuuucuuguugagcuuuuaagaaccaagacauacauaguagaaagguugggugaagggucucguagagcuaauugugaauggagaauaugugacuuuucugagcuuugaaauaacauuuuuacacacuaguucacaaaaauuauaacauccugcuagucguucuaaauuauuuuaacuuugggaacuuaacuuaaugaacuucuggguuuuuuaacuaccacuggugccggcugggaucagagauauaccaacuggcuuugcagaggcugucuuuuuuuuuuuuuuuuaagaguuuuuugcucuucacuucucucuacucugacugccuuggacugaugaaggugauuucaucaagaucuguaugcacuugaauccauugguacaaaucccaggguuagacuccaucagggcagaguggcacauaccuauauaauccuaagagagguagaugcaagagacuggacguucaaagcaagucucugcuacauagcaaguucaagaccaccugggcugcaggagacccuguggaaagaaggcuggcuggcuggcuucuguuuuuugaaaugaaucaagagaagcacauuuauggaaaacaugguacauuuuuuacuuggguugauaaaauaaagagcugaauccaucauuagacaaguggagacuggucuaggauggaacuaugugucugaaaagacuguacacacacugaacggagggaagauagaggacucugguacauguuaaguugaggaaggaggaaagaaucugggcuagcaacuagaucucaaguucccagauguggcucccagauguggcgugggauccuaaaggacgggagaauucugcugugaugauggagcucugcagucagugcacauuugaggaauaaagucaagagugucuuucccagaguucuguaggaauaaaucacauggauuguuuuucuugaggaccuuauguuaacuguuguuaaaugguuacauguuaacauugcaucuuuauuugcuccuuacaaauuuuaguauaucauaguuuccuuucauucaauucagaauauuuaauuuuuauaacuuuuuuugaccuguagauuuuuaaauuacuaaacagaauuuuacaaauguuuuucauucuaauuaaauuacuuuguaauuaggaaauauucuguaugauuuuaauucaauaacaguuuguuuggucuucuggagaguuugacuugauaacuacucaucauuuuuugccuugacuuauuuguggucccuuuaaguuuuuugaauaugguuuuaauauauuuauaaucauauuauaauaaauuuauauaauaauauuguuagugucuuguucuuccauaaauggugucacuucugaaucuaccuuugaggacugauuuuccucuuaauuacagcccacauuuuccuauacaucuaccugacuuuuuuauguugaaggucaaacauuaugaauaguacauugauaaaaugcugaauuccgcuguguuacuuuaagaguguuggcguguguguguguguguguguguguguguguguguguauguguguguaucuaucuuguguguauugugcacccaagugggauauguguguucguauauguuugcacauaugugcucuauguuauauaugugugggggugcacacauuucuaguguagggguggauaagguugauuuggggcagcaucuucaguugcucgacccuguuaucuccugagacagacuuccucaaccaacccagagcuagucgauucuggcuagccuagcagaccaacucacucggggugcuaggaugacaggggauuguccugccuguccagcuuuacauggcugcugggcaucugaacucugguccucguacuuacacagcaagcuauugccuguugcugagccaccuccccaccacucuacauuaaauuuuaauaaagccucaguagcuaauauagguacuaaauggaacuuuucaucccugcuaguguuggcuucugaguccauuucugaggaacuuaucuagagucggaaaugaggggugagaauacgguuuggugaauuugcuuuugggucaaugagaaaaccaacuguuaagcugugcaggagaauucaaguucuguaguguggucuuuuccuucacagugcugaacacgaggguggcaguggggacccugaccagcucugugaucagaugucagcugacucugagccgcucuucuugcuccuuuuccccauugcaccuccuggcucuuacucuaccuccuucucccuccacagcuccgccacagcauguucuagaacacuggacuccuuccaguaaaaauaugagcauggcacugagauuuacugauuuacaagguauagauauagguacaaucuuacauauaauaagauaaauagauaagauuaaugauuuugaaaugaagggauuaaacguauucacaacuaaaauuauuuccucaauacucaauuuaucuaucuuucacguuggaggucauuaucuuuucgccgaucuagaaugugcaccgaacucuaguaugcagugagugugugagugugugcgcgcgcacaugugagugcauuccuguagcugggcuucuuucuuucauuugagcgcugucugagagagguuggaggcggacaguugcagugagucugccacuuugcaguuccguugccugcuuuaaugggugaagaauggucauagccugagaacugcuugguccucaaaggacauuucucuccguguagcacuuccuaaauuuguuauguuggaggaagggugaaccaaggaaggcguccaccaacuuuauuuaccaggagcagccucuaggacguagguggucccagagcucugugcuugcccuguguaccccaccuucuuauaacgugagagacuguauugucuucuggaacaagcaucgucucauucuguuaaugcccauugcaccuagcugucugaaguccuugucauucugguaggucucacacuaugaaugugcuguguccacgccaacagcugguaacuguaacacgugagagacagcaugacaucaucuuggggauguuggccaacugauuuuuuuuccuaagggaaacaaaacuagaaaacuuaagaggcauaauuaacuauacauuaauucacugcaggaauuucccaugucugaugauuuaaaagaauaaauucugcaugcaaacaaaucauuaccaacucaaccgcagcuugcggugaccccagguuuacucacugugcuguguuuuugguggagacgggaagugagaaagcuaggccuuucuuucucagugaagucucaaccagucuuucaaccaguuucucauuuaggcuuuaucgccagcguaaaugacucaagguaucuauugcugccuagcuguuuuuaaaggggaauucccccuccccacauucucaccucccuaaaauagcuaauucuauacuggaaauuucgguacuuuguugggaguuugugaagucagcacauuucuggaagcucccugggaauguacuucugagcagcagugaugccuuugucucccgucuccacagcccgcucagcucagcccuguaaagacagaauucuauugcuauuucccccuuacauuugaugugguaguuugcauacagcugcaggguagacaguuaccuuugaaaggaacauuuggccacucuaauuugauuaaagaaaaaccaccucaaucauuucuagacugagaccguuuucauuuuaacuuggcaggaagagucaggaauguccucggcgcgcuuagauaaguaggagaggcugggaggagcaggagcaacggcuugagugaaggaagccuugauacgauuugguuuuuagagacaagcaguguugcaggauugauucugucucucuuccucucccagcuugaugcauccuugauucucucaccuccuucuccuuugcacgauggcuuacuuggugauucugauaaaucaauggguucuggcaguuauaccuugccacucuaaagcaguuuaguacucggaguccuuauagauagacacccuguccauuuuuacauaguacugagaucccagaucucaauuuuuacugugaaacacauuggcuuucuuugccacuguugggggaagccuggaagaauuuugaauaacagaucuagguugagaguuugguuguagcuuaaacugaagacauuuacccucaccgcagccugcgcuagauaccucugucccagcugcagaccuguucucaagcuagauguugugauggaucauuaguauaguaguucagaaucuauccuguagauugccggucaacuucauauguauguaugcaugcaugaugggaaauaauugagugagucguucguaucuguaggcaagcugagggacuuguucuuauaaaagccaugcuccugugaagggcgucccaguuaauacaugugaguguggagagaacauaagaagcccuggcaauaacagauaauguuauuauuccaucacugacuacuauugauugccuaggaguggagaucagauguguggauucacauuuugauucuacaugacuauaauacauuaggagccuuuucucucucucugagcugcagauuacucgcucucgagaauacauguuagguuucuguagucauaugauagaacacauuagguuucuggaguaaggggcuuuauucuuagcaaguaaugaguugcaaggcuguugcuugcuccucuuagcacaguguucugguggcauccccccucccuuuuauggaauugcuuuuaugaagaauuacacuuuggcauagugcaguaguagugaaaucuuucucauuucagguuuucuucuguuguucauagccuaagugacaaacagggauucaaauccaccaaaauuagugaguguguuugaugaaacacacgggagcuaggcuaacguccagaauuuauuuuucaaaaauuauguaauagggccggagagacgauugugcaagugguugagaacacuggcuacucuuccagagaaccuaaguucaauuccaagucacaaccauuuuggcauucauaugcugcauaugcauauauguaggcuaaacucuugugugugcgugugcguguguguguguaugugugugugcaauaaaaauacuacuacuacuaacaacaacuauauaaugaacaccagguuuagugauguaagccuucaauuuuagcacuguugggggggggggcagaucuggaauucagaaguagccagggcuacauggugagaagcagagucagucagauauccuccauacacacaucuacuaaaugccuccuuucguuucugucuugacuacuguacuguucuuacagcaacaagaaagcacgcuagauuaggauuauuauucucauuuuacagguaaagucagaauuuacauuucuagaacacaaauugcaacucuaggguauuauuuccuaucgauuauucuaauguugcaagcauuuuaaucauuuaaggaucauuuggauuugacucuugaagguuuggccaauuaagugaauauaaacugcccacugauacagguauaccaaguuuuugaggcagaugucauuccauggucuguugcugaaaacuagagguaaaguaauuuaauuuugacaaauuauuuuugucaucuauuuuugacauacauuuuuggugcuggcaguugcacccagggucucuuaacacauaaacagucauagcuugcacggaagagaauggcuccuugucagagccuucagacugugucagacccugugccaaauggcuaucucccacgugaagaccuguuauaaagcuagaagaucugagaacucccuaguguauuuauucuguugauuauggacuggcaucgacuuccuguguguguguguguguguauggauuauggaaaauaauuggguaucuauguguacaaauggagacuauguauucuguauuuuauguauuuuguauucuguauucuguaggcaguuuguuuuacuagauguguauaggccaucucuggauggaacugguacuccaaaucugcugggccuguauucagcacucuguagugugcggugagcaagugggaagcagaagaguguggcaggguagaggaaggaggcucaccuuugagucuggcaucagaagugcugacaguugggugguauaugcucuugaugagucagcacuuccugguuucccuuuccagccacgcuggcuaauggcaucagaugacuuugguccaagcugaggcuuucucagaaucaaauuuaaauuuaaaaaagaaaaagaagaaggagaagaacaaaaugugccaucucuuuuucucuguuuuugauuacuugguacuaggauaaacuauucuauugagcacagcaccagauacuguguguucuuaaauucucagcuuaaggaaguagacuuggcccugaacucuaaguaaauauaucuuuaccucuugggacagcccugcuuuuaguucacuugguuuuuauuguuucugugcaaacuaauaacagacaaaagcggaaggaaacagaacucaaacaucuacaggguuugcuacgucagcuuuaucaaaggcucaguaaguagugacacagcaagcagaggaaaugguggaucugcuucaugaucccaugucauuuuccaacugguccagauuaggcccacuguugugagagaagucagcggcuuuuacuccuuagcuuuguacuucagacuaggcaaaaaaaaaaaaaaaaaaaagaaaagaaaagaaaagagagaagagaagagaagagaagagaagagaagagaagagaagagaagagaagagaagagaagagaagagaagagaagagaagaggaaagaaaaaccugcuagacccuguguuaaugguagcacagaugguuuuuaacagaaaacuucccaacucugguucccuugaguuuguuuuuccaaguuuguuauuucaucaguuucagaacauagcugacaguuucucuguguugauauuuguuuaaaauacacgaaaacuauuuuaagcgucuggauauuuuguuccuucggaaacauauuuuuauuaaagagagugcuuagugguuuacaaugaagaaauuagugauauuauagcaaaacuguggccaucucacuuucuuuuccuguggcugugauaaaauaccccgacaaaagcagcuuaaggaagggcagaucaguugguuugaacucgaaugcaguucaagauacaguccgucuuggagcugaagucaaggcgacaggaacuguagagguuguucacaccguauccauaaugagaaaacagaggagcaaaugcaagcuugcuagugcuccuccuacugucugugcguccuacuguccaggaucccaugcacugagaauagccaggccucuguuuagaugggacuuccccauaucaaccagugucaccaaggcauucucccaccggcauauccagaggcccaucucucaggugauucuaaauucugucaagcugacaaugaguaccagccauaagccaucacaauggccauauuuaaaaagccaggaguacuauuaaauguauuuauguuuucaucuuuccuaaguaggaagaaugucugacccuuuaacugcuugcuaauaagcaaaagcaaaaccccuacagaaaagcccucaucuuuuugcacacagaauucaaaugaaaagauagcauugagguagaaucacauuacauaaucauucugaaaauaugugguaaauauguaguccuuugaaugucuuucacucagaaacauacuuuuauuuauuguacuggucauacuggcuggaaauggauuauuauuauaacaggagguaaaggcagacgucuuauaacccuaguuuguucuaucagaauaccugcugauugcacagucaagcauguaagccaaguucuagaagguacugagaguuguaugguuuggacauacccaggacgcugccguacaucauuuggauaauuguaacuuacgaauagggcucucugaaacaucacaagugacauaaaggguauaagguuagugugcgacauauacaaaacaaaagucucaccgugugagcggucagagaggcugcuguagggaucugaaagucaggagugugugccuaaaacuacaagcuuucugaggcugggccacuccgaaaauggacguuuugauuaguuuucuuuggcaugcugauuuggugagccuucuguuuguugagcuguaguagaaaacaucuuaaucacagaaacaaagauacuguaagagguaaaagucaucaaagaacuagaauaagauaaaauaaaauuuaaggccaaaacuccuaacugauugguuuuuaccaugaagaggaugauacuuguagacuuauuuuuauuugaaucccaguaaaauggcaguuuuaaugaggugcccacugugaaucauaagacauaaaacucucaccuggcucucugcaggccuguucaugguagguggaagaaggcugcuaugccuauuugggcaaacaaagucaauuaugauuugauuauaauaucucacuguuugaauccaccuguggacagaaaaguuaagagguugggauagccauauuagagguucagugaacaucucuagagggguucugggugugucucagaacagaaucgagcacugucugugaauuuggaagagauaacuucaagggacagaguuuauuaguuugcucugccugcugaacagaagauucaggcuuuugucuugcagcuuggguucuucucuacucugcauuaguguggucucacauacagaugcacauguaugugcgucuaccccacuggagugcguguuaugguaguacgaaucgcucuagagcaccuucagacacugcagugccucuguucugcuccaggggaggacugccagccucugggugggaugugggggagucccugcagcccuccuuugggucagcugcuuauuuucaugugcuaauuguguaaggcuuuucucgaagucuucuaggccuuaaccguauucucuacucccaaaauaacaaaaaucaagccuaucagaaaguagauuuaaaaaagggaaacagacaaaaccaaaaauaugaaaaaauuagaacaaauuauucuuggaguuuuaaaauacaauuccauuguguuuggauguauaauggcuauagauggauucaaacaaaguuaauguggcaagaacuuguggacucagcaggaggaaugggaaccuaaaagcacaaggggacaauaacacagaaagaaaaugauauugggucccgaagucgcauaauuuagaacuucagugugguuuaucuuaagugguuaacuaaguguccaacacuugaacaagcaagcgcuccuggcccuugucuucuuucuuacgcguuucucuuggggaagcauaagggaaguucacucagcguuuagccuugggauggggaaaugcagcuugacagagccauuggacuuagcaugcugacaguuucugcucuguaccucauguuuaaguuucuguugguucuaucaccaacauuaucaaacacgguuuaccaugccccuuaucugguuccgcaaacacaauugucagcuauuaaaauauaaacugacuacuuuaaaugaagacauacuuggcagucagccuaagucuucgcuccuccuucauaccccccccccccaggucucucugcccccagguuuuccuaacgggauacucagggaugcuugugaccacaaaggguacuuuggggccugcaauuguucuacuguaauuuuagauaguucuaggugcaucuucaauauucuuugcugaauguuggaagcauuugguucaugguuuccacauacauucacuuucaguggaaggcucccagcuguugagauuugcuuuauuuugaaguuuagaagcuucuauagacacuguauuuuaauuuucuuuuaaaaagauagauugguuuuccuuuuucauucggcaacaucaaauaguucauuguaugugaaugucacucauuguauucugccuuuacacaaccccuagcccuccuucuccuccuaccugugcccucagaauuacccuuacccuuauccuuaccccuuaacuuacauuuacuccaaauuguauuuuuaccccuaaaccuaccauuucccuacccccacccagccuccagcccaacagccaacccuacuccuacccuuacacuuacucuugccuuuaccccaaacccaacacuaacccuuacccuuuacauugcuauucaucucuaauuuuccaucacccuagacuaaaacuugugcucaggaagcaguagccuuccacaucccucucuccaccaaaagagagguuuuaaauauguguguguguguguguguguguguguguguguguguguguguucacgccugagcacaugugcaauaaccacuuguagagguaagaaggcaugaggucauuguacuggccacaaauaccauuuacucacugagccaugugacagccccaaaggguagacauuuaagagaugcaucacagccaagaagagaaugguguacguuaggcucuggcagguggauuuaagacuagaaguaauaaagaccuacuauaacuuccaaaggagggaucacauggcaaagaaacgaguccucuugugagaacuuuuauccuucuagccuucugggacagagacuggggacucuaggaaucucuggagagugcaugcugucugguacugaggggucacccugagauuuccucucugugucugcccugccuccucuugaugcuuccugugagucuuccugucucaggcuccuuuauaaccucuguuucccuauggcuguuguggucuaggguacuacugcgcgguucccacacugaugcauucgccccuguuaguucuuacugcagacucggcgguaugugugcagaaaacacccccagcauaggaagcacugcucuuuagccuugcuuucacggggccaagagagccagccgacucgaugcuuguugccauggccuuagccuuuaacaaacaaaacauugcacacgucacgaggacaaagcuuuagaagucuuaagccauuuugacguuuacauuucagagccauuauguguuagucgacagguuuaaaauugcauuccaagacucaaagaaggguguguucuuugauuuuuguuucaaucauauaaagcccucuccaguauuaacuacagcaggugcuuagcacaggaaucacaagaauagguugcuuguggaugauuauuaccaauccuuggccaugaugcucuccugacuucacuugcuuugguggguagaaccauauacgaaaagguaagagcaucgugguagaaauggaucuuuauuuuaaacuuuugaacgugaaagcuuauuugucuggaaaacacauugcauauaauuaauucacuagcacauacuguaaauaagaaacuccaaagcaauaacuguuugauaguggguagcuugggccauagaaaguaagaacuugcuuggaauaguugaaugacuucagccuccuacuuggccugugccugccugugccacucuaguggguuuacuuuuagagacucguuaugugacuaguuaucuucuauugggacuuuagcccuuugaguuaaaagaaaggggcaauguguacuuaaaagugaagaagugauaaauuauaacuaauuguuuaucuaauucuucuguuuguuuagucuuuaauucugggauuguacaagcguggauuuaucucccaaguuuacauuacagcaguuguauugaaucaggagugacuuugccccaggggauauuugacagucuccaggcccauuuaaccugggaagagacacuuguacagcaaucuacaacaaacagaauuuaaaauuugacagucccaaguauuacaaagguacuguuuaauaucaguuucuagacgguaaaaaguauugaagggucuagacugugggaaauauacagcaguuaauacucugauauccaaacucccguguuaguguuugccauucacuagugacugagaagaagaaaaccacagagagggauugggaaguuugagguucccugagaauggaguuuggaacuagaacccuggaugugaagguuagaagucaagggaugacugcgcuuuuauuuugccagucauugaacuccagaguuucuuauguuuggacuguuaggaaaucagggguucugcuuguugcugcuguuguuguaacuguuguuguugcugcuguuguugcugcuguugcuguugcugcuuuuguugcugcugcuguugcuacugcugcuguugucacugcugcugcugcuguuaagguuaauccgguugacauugcucuuuaucacccucauggaucauaaggauugguuauucuauugugguuuuuaaugccuccauuuauaaaauggcauuaauccauaugagguaauaaaacaaucagugaaaaguggcucuugaaauuacauucagccauuugaaaaccucuggguguuuacaugguuaguguaguuugcgcuuucccuugaugucuagggauguguguuccuugugcacaugcgcccacaugcucauugaggauggaaguccucuucuucaggcaccuuccaccuguuggguaagacuccacccuguugggugagauggucucagcuagaucuagggcucaccaguccagcuacacuggcuauccgguggggcucuaggauucacccgucucuaucuccgcagccuggaauuacgucugcacacccaggucuuuacuguuugagcuggauccuagugaacucaggaccucaucuuauguggcaagaacauugccaagggagccaucuccuccagagagacagagacacacgcgcguguguguguggugugugugugcgugugcgcgcgcacgugugugugugugugugugugugugugugugugugugugugugugucgucugucugucugucucccuccguccauccacaucccaugugucuaucuauccuuuuugucaaguuacaaggacuugaaaccuggaagugaauaucucuucuacuuuccauguugugcaucaucuuagccaggucucccaggcagcccucuauagggccccuugccauucccccauuuauaguuuuuguuccuagucuacuguuuccucaacagagaaccagaugacucuuuucuucagguaauuuuuguguuuguuuugcuuuauuuuuucuugucuuuugcaguaacugucuuguaguucaugguacacuuuccuccuauguaacguaucuaccauuuugucaaauguauuauuuucucccuaaucuggaccuuuccuauauacucucgccugcugugcauuagccugccuccacccacuuggcuuucucacugggcccgauuguggcuuuccucuaagaauugccugcuuuucucuaucuuacaugauucauuuucacucaucuucagagguuaaacuuggcuccuuaagaguguugucuggggguuagggugggggcugcauggcucagagcuuuagagcacugacugcucuuccagagguccuaaguucaauuccuaguaaccacaggguggcucacaaccaucuguaaugggauccaaugcccucuucugcugucugaacacaccuacgauguacucauauacauaaauaaauguuuaaaagaguguuuucuuuaaccuuuggugcugacaguggucacuccugccuugagaauucccuauugccuuauuguguucugugucgcaacuuuguccucucuugcccaucauuacugccuguuucuuccuucuaucacugagcuucuugcagaaaggaugcaccuucuguuguguggggucacaugaguaugcgggagcaugugcaugccugcacauguggaagccauagucucuuucugcugcucuccacuuugcuguugagauaggaacuccacucaacucagagcucacugaucggcuacgcugacuagccugccuacccaguuacugggguugagguguuugcuaccauacucugguuuuauaggggcucuaggaauccagacucaggcccuccuguuugaacagcggauacuuuaccaacugaacgccuccucagccuuuuaccuucugucguucauuugugaugauuugcaugcugcuaaccaauaugcuucuagcgugguagguugugugagauagucuguuugcugaaaaguacacagagaugauaugcagauacaauaacaauuacgguauacaaggacacucgaguuacagcaguuaucuugguuuguaacacuguauggucccaguacacaagugaauguaaaauugcuccugaggcauuuggaaauaccugaagaguuuuuuguuaacugucagaaacagagggaugccacucuuaggacaguuaggacaguugcuaaacagacugcagugccagggauaguggagagcucucagcagaguuauccagccuucgguaugagucaugcuaccguugagaaacccugcuuuuauacccugugugggcaucccauuaccauacuuuaccaccuaaugaaacgaggacauucgaaaacauagugugcuuuccuaucacagaaaugaguacacaucauaaacucuuaaaugguggggaaugcagcuaugcccagauauauagucagaugguacacauagcugguuguguaauaaguaggcacucugugauuggaccagccuuugcuaaugcuagaggagaaacagcuuucuguucauuugaaaugaagcauagaaguaguagaucauacucuuuuuuuaagauuuauuuauuauuauaucuaaguacacuguagcugucuucagacacaccugaagagggcgucugaucucuuuacagaugguugugagccaccaugugguugcugggauuuaaacucaggaccuucagaagagcagucagugcucuuaaccucugagccaucucuccagccccuagaucauacuuuuaauaaacuauagaaugcuugcaaaaagauagcuauuuuuauuaaaauacuaaaccauacauccaaauacuuugcaauguuccuugaagaauauuuggcaacguuuaaaguaaagggauaauaugcuguccuuccuaacguuagacuuagaagacacucuugcuguauucaaugguagaauggacuaggagagcuagcaguucauggagagaucccugguaggccaugccaaccauaacugcuucguacuugguuugcaccuuuucaaaaagaaagauucaaggcuugccugaguugacuagcuuuuuguuuguuuauuugguugguugguuuauuuuuguuuuguuguuuugucaacuugccaaaaguugaucauuugagaagaucccuuaauugagauauugcauccaucagauuggccuacaggcaagucuacgggcuguugucaugauuaaagguuggugugggagcacucagcccauuggggaggggaggacagugccaucgcuagacuagugguccugggugguaugaaaaaagcaagcagaggaggccacaaggagcaagccaguaagcagcauuccucauuggccucugcuucaguuccugccucacguuccugcccugcauucccuuggugacuggaaccuucuucuccuggucagaguuuuuaagcacagcaauagaaaagggaacuggaacaaagcuauaaaguucuacauccuguuaauuucagguaauaaucaaaagaguuuauuuauacaaagcaaauuguaaaaggucuuugaggguaaucauaauuccaguucccucuuuauaaacuucagaaagcauccuuuucuaugaagggcuuuacucccaguguuuacaggaaagacuuccuguuacaagucaagacaaaaaaagaaaguuaauaaaauuuguaauguguuaaaaaugucauuguugacauauuuugaaacuauuguuuaucuucucucucucucucucucucucucucucucucucucucucucucucucucucucucucucucuuucucccuccuucuuucuuucuuucuuucuuuuuucugagauagggugucucuauguagcccuggcuguccuggaacucacucuguagaccuggcuggccucguacucagaaaucugccugccuuugccucccaagugcugggauuaaaggcucgcaccaccacugccugucuauuguuuauuuucuuguuuuauauuuauucuaaggaaaauguuucaacauuauucauacuaaacuucuucacacaauuuccuuuuaagauagcuauuugcagauccagaaaggaaacccauuuggaaguuucccggugaaacuuuuuaauuuacuuguauuaguauuuaagcaucaggcuuugggcaaaauaaaguguuccuuuuuucuccuuucacauccugucccugccccgcuccuguccaugcccccauccuccagaccccacccccaaguggaaguuugaguuuaugcagcagugggguuuagccuccaaauagaaagcggguuuuugaugucuuuuuguguauguggaaaaagcuaggaaguugguucuggaauuuucaugucccucagguccaugaaucaugagaugaauagaaaauucacagggaggauaaaugucuuugauuuucugaaagagaagccuuguggagaaagaaaacuuggaagcccuaagcaaggguuacaggaagugcagggaguggcgcuccuaagagggcccagacaguggaggaaucugacguagucagcagccgugguuccuuuaaauaucuucccuuacucguuaauaaaugaagacuccauggaguucuuaggucagcacgucucgggaagugucaugucuaacagauuauucuuuauauauauauauauacauauauauauauauauauauauacacacacacacacauacacacauacauauauuuuaugcuaguaagaauggguuaauucacugggaugccaauacuuguaaaauguugcguaacauuuuuugcaaaaacucaugcauuuuuacuucaaacauagaucuaaaaugaccagaauagaucuguauaauaaaacugggucaguucucugguauucucccugucucccccuuauaucuguuuccucaccucuucuuuuccauucuugcuuuuuccuuccuucucucugccucuauuuucuucuccuuucugcuuucuccuuuuccuuucucauuuuaaucgguauuuuacccuuucaggucuucuguuuaauguuucuugcuuucuguuuuuuuaaaacauaauuauuuccccuuuccucuucucaucugcacuuucuggcuggggguuggucuguugcuaugcauacaaaugcuaaagucugaaucccaagaucugguugccaucuagaugagugacuucucucauaccagucuuugcuauguaaaccuugcuccccaguuuaaaagcugauugguuaauaaaaggcaugugauugggcaguggaguaaggaaggugggacuugaggauugagugauggggaagagccagaaagaagaggacagagaggagguccccaugaggccugauggaucaugaguauguguccaggagaaaugcacccugagggcagacugauggagcagaagcagccagggagacucaaacagugagugacaaggagcauacaguagggauacaggugcgaacagcauagaaccuguccaaucuaggaucauauauuauaaauacaauaccagguuucugugucuuuuauaagggcuagcuagaauaaaucaccucacagucuccccuucaugucuucucuuccauauauccccuuucugucuuuuuaaaaauacuuuuauaaaaaaugauuguaguuaaugccccacgcuugcauucuuccugucuguaauccuuguguauugucauacacaugcauauagaaauaaauaugucaguacaaacugcuaaguccaacuaauguugcuuauguaauguauguuuuuagggcugaccacuucauauuggauaaccaguuuacuggucacccugagaaagaccauuuauccauuucuuagugguuguuaauugcuccucaucccagaccccccccccccccauccccagcuucccuuaagguuuccuucauccacauugaccugcuucuuaaugcugccauugcuuaggucuuguuaagcagcuguauuuugagauuuuguggguggggcuucccugucaaaucuagacaugcucacagcagcacacucccuggucgucuggcucuuccaguguuuccuccuccuuuuccuggauguucccugagccuugauuaacuuauuuuuaaaagagaaauuaagagcucuguggaaaaugugucuuuacuuaguaaaugauggacagaccuccccuuaaacaucaguuuauuaaguucccuuuucaccaaaauuuuaacuuagaguucaaauccaaaagagaagauuugauguuacauuuuggcauuagacacuucaaaauucuuacaucaucuagguaugaauuauugagaauuguucuauuuuuaguuacuuuuuuuuuuuuuuuuugcaacuugccucucccugcaguuaucuugagaaaggaagcaggcugguuagucaugaugucuuuccugggacagugguuugaaaauuuuuggaagaaaguuuugcucguuugguguuauaucuccaguucacacaggagguugucaagggacccuucgugccuauugguuugcaguggaaagagaguuacucuaucuguccuuaccuuacaucaguuccugucaugugauacaauucauuaccaggacaaaucagugaaaacuaguauacauacgauuagcuuuuccugggccuggagagaugguucagugauuaagaguauuggcuguucuuccagagguccuugguucgauucccagcaaccacaugguggcucacaaccgaucuguauguaauuaauggauacgaugccuucuucuggugugucugaagacagcuacaguguacucauauaaauaaauaaauaauucuuuaaaaaauauaaucugauguucucuucuggcgugacugaagagagcgacaguguaacucacauacaucaaauaaauaaaucuuuauuaaaaaauauuaacuuuuccuaaaaggugcccaucucugcuacccagagacagacguucuaauaguccugacaaauacauccagagguguugccuuuauucuuacagucuuaagaguuccuagaguuaaaagucagaaugcagacugucuguaacaguauggaggcagggugugccuggaagucagggaaccacucuuacccuucaggaggcugggggaauggcggcuggccaaugcuacacagauucuuugcugcccucgcuguguuccaggaucugccuggcauuuacaacuaacagcucaaauuuacuaguaucccuagagagauugagaggccagaaugacacauuccugccaaccucacaaaaaauggaggugugaaccaaaaccaugucugugaucuuuuccaguaaaugcugaacuucuuaaaugugcuugaaucuaccaaccaaggcauggucuucuucucauacuugacaauguggaagccauauugcagggagaccauugcuuugagaauuggguacccuugcagggguuacagauagguaacuuaaaugucuauuagccagccuccgcuccuacugcguccauugaguuagucauacagacuccuucaucugugauaagacguggcugcaguggcaagugugucuuucaagaacuugcuuuuauaaagaugaaauauuuaacuagcuuacgguucuccguugccuccucgcccuggcuuauacucuugcaguccccagcuccccagcgcuuccucaccucucacacacuccuuucccuuccucagcauucaaccuuguccuuuaguuugguucugcuucugggugcuuuuguaucuccguaugaagaugacuuccuguaaaucuaaaagguaaccucuaagagacagcuuuuuggcacauccuuugacaaugguauggauugaacuauugcaaauguauuauuuuguuuuccuauuuuauuuugauauuaaauagcuucaaaaauauaaauugcaucuaaaacuuaaacuuuuuuguauucucugugaguucaaagcuagccuggccuacauagagaauuccaagcuaaccaaggaugccuagugagauccugucucuaaguagaucaucuaaguagaucauuuuccuugaauaucuccagggggaaauacaaacacacacacacacacacacacacacacacacacacacacacacauuucgacauguguuuuccuguacucugucuacaaagagaggcaaaaugccaaagcaaauucagcuugcuuacaauuaauauuuaugcagcgauuacaguuuucucagauucuaugagaacgauuaguaagacagaaagagacaaaacugucugauuuaucaccauccucucaccgcagagcaugucagugaacacugguuucauagagcuacgucacuuaauucauuaaagugcggugacaaacaaccaaguuugcuuccucuccugauacgagucagguguuggcugcauacaggucuauaaccugagaaaaugcgcgaacacgcuuacugcuggucuuauuguuuugagagagagcauguagaguuuuugcauugguuuccucugcugcucaugcugacguucucaugggaagccuugcucucuguggguacaguucuccagcuuaggacaggguguguggagugaccauggaaccgugugacuccucuguggaagagcagagcaugguuuugguaggguggcauccuauuaacagcuaagaaacaaaagguuguuaaugagacauacaaaucuaaugcuugaaucuaauguuugcacacaccaguuccaugugcauaguauaaaaaucuguaaaacuuucacauuagaaaaaucaguucaguuaaaauaucugcaucuuugucauuagaccauaggguauccucuuggaaggacauuuaaagaaucagcaaaucaggaccuguagauugggaagaugcacuaugacugaagugugugugaugguacacaucaguucuccuuuauggcuuugauagaguucuaaaucaaagccaggacaggacgugugugagcugaggcauaggguuuggauuaaucccuuucuggaaguuuuuuugugguucccuggacaguuuucagaaaguucaaagaguaaaauacguuguugcucuaacacauuuucugacccagucugggguugaaguauacuugugucccagcaggacacacagcuaagugaacucaaauguaugcugaauguaaauugcucugaaggcccugggucacaaguuaauagauucuggaccuugcuucucccuuucaugagccagacauuccuuggauuuaaggguagguuuaaaauaaagacuagcaaauugcuuccuucuuuggaaagagaccagaaaaaaaaaaggaaaaaaugaagaaggaaaaaaaccccacuuuugauaauaaaaugcuucucuaacauguuaggacaguuauugagaaaaacagcaugagggggaaauucauucaaauuuuaccccuuagaaaaugaaauauguuuaauuaaaggacaauuggcuuauuuucauaugucuugggaauaaugaagcaaaugaauacugcucuaguagaacuuucaugaacauaaccaaauaaaucuugccacgugcgaggcaauccaguuacucuaucugcauuguaacugagcaaaacauuuucacucuuuuuagaauugucuucagaacucuuucaugagccaaccccugccccgaaucagcaucuuugcuuuauuaucacaccuggaagaauauuacucagccugaucccccacuuacuguaucagauggcucuagcuauuuccagaaaugcaggacgcucccuucugagacauccccauguauucacccagaagccguggcugaguaccuccagugcagggccgggcugugcuaacacagaggaguucgccccuggaaaaggcaggcugcagcaaagacaguuguagaucaccagacauggucaucuuuuaguggaugaaugacguagaagaaaacuaaccaugcagagucggacuuuaugcugacggcaaauguuucaagaugaguagugucuaguuaaaagacgaggacagagugaguggugggguugguagcuagauuacgaggugccccucccauaacauaaaagaaaggaugcgguggauaagcuuugaguuaugauugagaguuuacccacugaaaauauacacuuuggaguuugcaggguuuguucauaaaguugugcaaacauugucacaaucuaauuuagaaacuguccauuccccuaaaagaaaucuauccccuauuuaccccaugccuugggcaacuuaaaaacuacuuuuuguuucaauagauuugccuauucuggguauuucauuaaaaaugaacauguuuaguugugauaaaugcaguuuaucuucuuucuuuguuaccugugcuuuuacauguaugcagauuuguuuucccuucugugagccuaacauccagcuucauugguuugcaugugauauccaguuaucccguguguuuggcgaagacacccccaccccuaccccauccuugucauguggcgagcuguagaugaagugaaagcuccucuccaaaaccaaggugacccuugacuucugcucgcaugcacacacgagugcacacacucaaguguauacacaaacauggacucacacaccacuacaaauacauacauuuaaaaaaaaaaaaaagcuuuuacccuuagggauuuucaacuccacuuaguaggaauugauaagguaauagcgcaucaucauugaaagacuaggagaugcuuuagucaauuagauaaggaaauaagcgaaguucaacugaaagguuuguaggagcuguuggcacguuguucauuucuuacauaacaacauacuguguggcaugugauuuaauuguagcuucauagacugcaguagaaaguacuuaaguaggauggcguuuccuuggcccgguauacugcugaagacagagcugcugguuccccuggucucugggcugcuaguucuucuucccugucuccucacuccagcuccacuccacuguaacccagccuccacugcaccgacacauuggccuuuccuagcagcgcauccgcccguagcauuacccacuguaaaauccuugggccuuucccacugaccguaagguaauucaggucuucuuagccuagaugagcaaacuauaauuuucuuucuguguacuuuuccagcucuucucugaucauuuccaagaaaaucaccaguguacacuaagcuguccacuauaccccaaaaggagaguuuucuugccugaauaccuuuggacaugcuguuccuucuacugggagcuucccaagcuuccuuuauuucucuguccaauuccaggcuaaccuuuguaauucagcugccaagccaccuccccaccagauauagcugaaugccucaucuucagagcuuucagugacuuuugaacucuuuccccuacacccuuagcaguaauaggauaggagucugugugggugucggggaguuagaacacaugugaccuauuuaccuucaguucacgcuucuuucucucuuucuuucuuucuuucuuucuuucuuucuuucuuucuuucuuucuuucuuucucucuuucucucuuucuuucuuucuuucuuucuuucuuucuuucuuucuuucuuucuauuagauauuuucuuuauuuacauuucaaaugcuaucccgaaaguucccuauacccucccccugcccuguuccccuacccacccacucccacuacuuggcccuggcauuccccuguacuggggcauauaaaguuugcaauaccaaggggccucucuucccaaugauggccgacuaggccaucuucugcuacauaugcagcuagaaacaugagcucuggggguauugguucgugcucuuauugaugaacccagcucuguaucccagucucagggcucucugguguuggucugaggccugguaccaauuuucuaucaucugugaugcaguuagaaaaagggaaaguccugcuguguggugaauuguuuuuuaaaaaucaaaaucaguuaauauuggggugcuaaaguguguucauaaaaagguaccgaucguagcuuaugagguauguuuauguuucuaguugacaacuuuccaucagagugcuaaaguuguugaacguuuauaguucccugaaacccaaggucugggaacacugcuguaucucaugggguggcaccaaguccccaagucaagccugagagucaccccuagcuccuccucuuuccucccaccccccuccaccacccccaccccccaccccccacuccccacccccacauucagacacuuggcaaguccugccaagucaaccuccuaaauauuucuggaaucuauccucucccucuguccuugcugcugguuccucaggacagacuuucuuuauuuuccugaugcuacugcagcaagaguuccuuuuuggucuccuugccagucuucuugcacccauacugcaagagugagguauuaggaaaugaaaauagccgcuuucuagaggauaaauugguuguguugcacaagguuucguugguacgacuggcuuucuuguugaucgccuuucucucagguucgagcgcccuuucuagaucuaccccacuguuugcaaaccucuguguaaucuaagauagcucugugggucauuucuucugcgaacccuuuacuacauuucgaaauuggauguaccuuuugcuucucuuaaaaugccauuuuuuauaugucugcagcauuuuagaaaagacacacacaucaaagcauuuacagaauacuugguguuugucuuuuuaauguucugccuugucugcuggacuccaggccauuuaugaucauuuauuuuugucuuaugauguuucuaccagcacucuauacaauucauagaaagcgaguacuuaauaaacauguauugguuaauuuaugugacguuacauucgcaugucuagugcagaaggcuuacugacugcagugaggauaggcacagaagucuccccaaggcaauagaacaccaucaguauuuaacauuuaaaagguccaaagaaucuucagugcacauuaccaagaaaaucccacugacaacaaugucuaaaaauggugugagggggauuucagguauaagucaaucuuaaagugcuugcuuaaccugcacaaaauccuaaauugaagucucagacacacacacaccauacucacaaagugugggaauuugggagaggaacaaucccaauccaaaauaucaguaauguagacuauacaguugccuaauauguuuggaauaaagguguucagcguucguaaagaagucugacuuguauuuacgaugacaaauuucucacucuuaauuuuuuauugcugcgauugugaauauuuaccuugucuaaguaaguuugagucacaggaauauaacaaaugaugcuuuauuauuuacaaguuuuuauacccugcaaaaucacccaauucuguauacucaagcuaacuuauaccugaaagccccucacaccauuuuuagguauuauuguuaucagugagauauuuugguaguguauaugagauaguucuuucaauguuucugacuuguguugcuuucugaccuuuuaauacaguucuccguuaguguccuuacauaguugcagaauuuaucucaguugcuaacaguguaacuguuaggacuuguuaggacuuguuuuguuaggacagaccuaauuuuuaaguguaauuuuuauaaguacuguuuuaaaaucacaucuuagucauuuugauugccaguuucucacuauugguugaauguaucuagcuuuuccauucuacuaucuguuugccuguuuucucaucugucaaaauauucuauagaaccucauacucucuaaagcucccucuacuuagaaaagcccacuuugucuucgcuggauuuuuuucuuggcuugcauaaugaguauuagaguuauuuaaagauucccuaagccagcauugucucucuuuuguuuugugguaauucuguuaaagagagaggagagggggcugacucugugcuuuaaauacagauauguguuugugcaaauuugggggacucgaucacuguccaccuuuucuauuugucuuuggucuuauuuuucugauauuuuugugaaauagaguucucacugaccugaaccucauuaaguaagcuaagcuggcuuucuauaaggccccagcgauguaccucucucuaccucauuaucgguguauuuacaagcauacauuaccauacucagccuuucaaaaacauuuuuuuuaaauaacauuuauuuauuuuguggguggggagcugggaggccggcagggaccugugcugcgcucaggacaacuugugacagcuuggggaauaagugcucaccaggugggucccagggaccaugcucagguacucagagccaucuggcuuggcaagcacaucagcuuuucccuugagcacucacuccucauaguagcccacagagacuuuguaccuggguucuggguacccgagagacaacaucacaggucuauuggucucucccucccucccucccucccucccucccucccucuuucuuuccaguucugucagauauugaguuugucugcuuaucuguaucggguagaguauuaaauuguaugacaucauugauuaaggaauggcaagcauuuuuuccccuuugagaggaaaauugagaauuggcauuguuaaacuuacuaauuuuaaaauuauauuuuuaggauuaaugaucaggauuuuuaauaaauuguggagcagguugaagucaguggugucaaaaaacacuuuugauuuggguuguuuagaaaacuguuuuguuuuguuuugucuuuagagacagaguuucucugugcagucugggcuauccuggaacucaaccuguauaccaggcuagcuuugaacucacagaaguccauuugucucucucuugaacacugggauuaaaggugugcaccaccaugcccagaucaaaaaccaugaaaaauagaagaaaauuuuaauaagaaaaauuuuuugauuuuuuuuguaauuccuguuuuaaaacaaugcuuauuuuucuuaauaaaaaguuaguaaguuuuacagacauauuugcagaggacuugaguccccagcaccuacuuaguggcucacagcuaucucuaaguccaguuccagaauauccaauuccguuuuuugaccuccgaggauaccaggcaugcacauggugacauucacacacaaaggcaaaccaaacacuuaaaacuaaguaaaucuucaaaaauuguuuuaugaaguaagcucuccugguagacagcauggauaaggaauaucagaaaacaguauuucauaauuuuaucacccaaagauaagcacuaacagcaacauaacuuauccugugcuguucuguuuauauauauggaaucacaugggacaaacucuuccaagcuugcaggacauugugaaagccuucucugcccaguaaguguagaucuguaucauagagcuacguuguguguguguguguguguguguguguaugugugugugaacacacacagaaagauccuuaccaguuagcauuccugaguaauggggggcauuuucaaaacacucugcagaugcuguacuguuuuaucauuagagcaaaagaaaccaucuggucucacacuggugugagcccauguuggacaaccuggaauauugcgucacugauuguuucuguuaguguuacuagauuuuuuugcuuauuucuuuuauguuacaauuuaauagucauucguuguuccuuaaaaggagacgacuugcaggguuacuguauuggagagagccuaaucguagguaccugaguggacuagugcgggcugggauaacauggcucacggucuagggguggguauggcauagucagacuuguuuauccuccuaagacugugcagacagucuucaucacacguggcuuccuagcuuuggcugcucuaucguuuuuccucaagaaaggcccaggcuggaaaacggggcuuuuacaguucagaaauggaaugagaacugaauguugacaguuauccagaauguuccgcacuguaugugacucaagccaaagcuguucacuuuuaaaaauaccucuuaacucuucuauucuuggaaccagaauaucuuuuucaagcccuuuuuggugaauugcccugugucauuuuucuaaccagucaaagagcaagcacaagagggcaagagaccaguagucuuuagcuuuucaauuuucuauguguguguguauuuucugagcauuuuucucagucugcccuccuuaugugugugugauguguguuauguguauuuuguuuguaugguaugugguguauguaugauguaugugugguguguaugcauguaugugccugguguguacgugugguaugcagucuuuuguguguguugugucuggugcauguguugugucuaguguguauguuugguauguguaugauguaugugugguauguguguguguaaugucugauauguguggucugguguauguauguguguugugucugguguguguguggucuuuuguguguguugugucugguguguauguguaguauguguauaguguguguguguggucugcuguguguguugugucugguguguauguguguugagugugcauugugucuggaguguguguguguguguugucugguguauguguguagacaccaggggugauagcacgugagaucuacauugcugacucucaauuuuuuuguaacagagcagaaguuuaaaucugcucccaacacuguacaaagccuuucucugcuggucuuuuccucuuauuuguuuugacuuguauuuaagcaucuucauaaagauacagugugaacaccauaaaguucaccugugcaagugugucguuuagugaucaugccaguucguuuaccacgauuguguaacuauccccaugaccuaaauuuagaauguuuucaucccucucaaaagaaaccaaguggacauaagcguuuguucccuuuucucccagcaaccucugugcuccaauccuaucucagucuauuuuugacucuguguccagccuguuucucuacacuucauacgaauggaaucacgccacuuucacgacuggauucuuucauuuagcagaaucuuuucgagguuuauccagcauauuauguaucuauauuucuuuuuguuaccaaguaagauuccaugcacuggugugauacauuucuuucuccauuaguugauggauauuucucuugguuuugccuuuuggcuuuaugaaugguggcacaugucaaaaacaaggaccauccuguagggcugcugcugugugaacacuaagaugucagugagaaucuguacaaguuagguggcaaaccgggaacacacacguaagaguuucacaaugaaugcaggauggcggcucuggccuccuugcuucagccucaguuacagaggcuugcucgcuaggggcucggagcaccuucucuucugcuuugccccgaccuuguccggagcugucauuuugaaacuuccauccauucaguugccauuuccugaacacucacugcgugucagauucggcacugaaugcaguggagaugaugaaaggcaaauggacaggugcuuccaggucaaagcugcuuuuaaaguuagcuguucuguacucuucacuugcuugugaugccuuggacugggguccccuucuccccgggugcauggguuugggguucugaauuucgacccagaugcuuugugugguugaaguuaacugucauuuaaggagaucuguguaagcuaaaaaguuugccaugcuugauagagacuucaagcgauaaggcagugaugagcuguagcugugguuggugaauuauucuuuauucaaaucuugacccaaggagggugcagcuggcaggcaggcuucuucuuuuggcacaagcagcuuuauguuccuuuugaauuuucacaacgguuaagcauuaguucuggacucagccaaauuuaccaacuccucauugcuuaggugcugcccucucccacccccccaccccccccguccuggaauucuggaccuaaagauccauaggguaacucagagcuuauuucuguccuuguugcuauugucuuuuccuacaacgcaaaaacuagggguuuuaggaguuuucuuguuucuguuuuaaaauaucauuuuucuuucuucccccacaaaaauaacaugcaguuagccugagugagguugcaaccugauucuucucugccucuggugcaggccagauuugaagagcugcauucaguaauggggagacucagcuagugcuugcugcaggacaccgggaagcccuggauucuguuguucuacguucauuugaaggguucauugugaauaugagcaaagcaagaugaaggcaucccagaaucccaucuaccacggaaccauccucaguagcggauuugugaucuagcuguugcacccguucucacuggucauauucaggaauguuuccauacacagaaguuguacuguuugcuuuauucucagcauuuacuguagugcgaauuacaucuuguaaacuugcccaguuuaggggauucccaguucgucuugaaacacuuuuuggugggugugggggggggggaacguaaaaccuaacagaagcacaguugccaagggccuguaaguagaagcugaaaguagaccuugcagugcugagggcccugaaagaugaacuguggacuugcugguaggcacuacagcuggaggaguacccuggugagggacacaggaugcugacuuccugccucccccauuagauuugcauaagggcuuucccucaccugagguuucuguuaauuuguugugugguguauuuugacuuuccaccaauagcugaugggaagggguuuguuuaauuguggguuucagaggugcaucccccuaggcauuggauucagccuuuaauuaauugaacuagguaucuuuauauuacuuguuaaguccuucagucucucucauuuccucuccugucccagguuccagauuucugugagugauggcuugacugucucuucuuccuuuguauucuuuugcuccauaacaugucucuggucaggucagaaaccucagauagaaguuaguucccuaaaacugucccagguuggcccugaacucccuguguagcagcugguggugcccuuggccuucugaugagggcagguuggaccugcccucgcccugugagguguguguuguaugccaacauguucuguuuguagcaugcugaggcucacacacaaggcuucucacacgagaggcaagcacugccucccuugccccuccaauaggaguucuuuaagaacucacagucugucagcuaugcugcugggcauugcuguugccaggaugaugaacuaauggaggagccagucccagucaguaaauagucaauagucucccauagagucagagaaguccaguuacagagagcagugcgcccuaaaccuuuuccacuccugcacccuuucugcccaagaaauauucugcaaccccaaguauaugaguauauaaaauagauacauaagugagacaugugccaguaauaagcuggauaauuauacugugagaugguucucugaaauacauacaguuuuacaguuuacugaagacaaaacugugcuuuuagggagguggacgggcuuguuauuuuuuuuaaaaaaguaacucuuggcugagcaugugauauaaaagacaguauucuauguuuuucagaguuggucaacguuuugauuuucuaguugucaacgcugagaacaccauuuugaauaaauacauaacacaaaaugacaaagcauuuuuagauuagggccacuucagaaauauuuugagauucuguccuaaccccuaucuagaauuuauuugaugacuguuuacaaaacccauccacaacucaaaacggcugcuuuaaaaaugaaacauuguaacgcaguucagagaaccuaauuugauacuuaacaugcugaagagggacaauagggaaagcauugaguuuguguuccauaauuaaagcacuauauuucuacaaaaacagacagcuuuguguguguggugcauacccgugugggcugggcaguuccaagguggguugcuugguguuguggagucugacaacaugugcagugggaggggcaugugcugugugcagugaaaagggacaugggcaugugcugugugcagugggggacacacaugcugugugcaaugcaaggcacaugugcuggugcagugggaagggacugugcugugugcaguggcugugcugugugcaguugggggacacaugcugugugcagugcaaggagcaugugcuggugcagugggaaguaugcuugcugcaacacaaguuugucauggccagaaacuccuuggaauaauuaauguucuuaaauuuuaauugauuuuuggcccuuguguguucagaaaccuuuucuguuaauaaauauuuugccacccuaguauucagcuaccuaacuccaaauggagcuccagccauggguuaaggagcuguaacuuagaaggcacuagugcuacuagugugcaugaaguuaacucacuguuuuagcuguacaguauaacuaacuguauaggaugcauuugaggucacauauuggugucuguaauuucaaacuauuuguagacgucuuaugauuguuucuuuuagacauuacuggcauuacugcuuuuuauugugcauuauuuccaggugagucccuggaaauauguuuugccagggguuagagcugguuuuacuguaaauaaaaaaagucucaauucaaauucagagaugugacuuagcagcuuagguaacuuuucuaaauucagaauguagaucagacagaagaggcuucagguacuuaaacaagauccccgagguccuggcugcauucugugcucuguagacuaaagcgcuggccaccggcugcugcaggcauuuugccucuccaguccaauaaugcauaaagaguuuuagucuccauugcagugaaauuccugggaccaacucuagcuuccuucauccaugaugcauaguugucacugaacaacacuguccacgugccuuacuugcccugugucccucagaaacuuuaaacugaguauggcaccuguaugugguagguacugauacacauucugaagaugccgcaaaaucacaauguccuuuagcagcauagucauugcuguuggagcuaauacuucuggacuuugucauuuccagcugauggcaaaucauugcauacacagucuguauuucaugagcaaaaaagagccaccuagccuccguccggcaguguggggcuggcggaauugcugaagauugauuuggugcacaaacuguacccaccaaaagcgcuucaugaacuuucaagauuagauacaggggugugaggggaccuucucaauuucaaguucuggcucugguucaaauaagaauuuguuauggcccucaggcagcuguaccagacaacucuggaacuauuugguauccaaacaaugaagagugugcaggggucagggaaaccugacaggaaaagaguccucuuaaaacuuccugcuuagcuaauaauacagauuucccuuuuauuauagcuacaauagaaaggcagagguuguguuuacaaagcucguuguuugggagacuuuuguaaauuguaaacuuuggaaaucccaaaccuacuggguagaaugaauguaaucccauccauuaguugaagguaguuuccccgugcuauagcuucggagcagcaaguuaaauugagacugugaacaggaagcagccauuaagaauuacaauggguaggauacccauuauuccaguaauguuuuguuagaggacaucaggucagcagaaaagccgaggguucugugggcugugugcuuguucuccacacccccacccuagcagcaggagguccaaacaauacaaacagccagcaaaguagcucacuggguagagaacuuuuagggguuggucgguuucccuugaaaugauaaugaccuguauuuugguuuguguucacucuucuaagauggauguauagccucaauaaauaccgagagccacuucucauuuuuacuuuuuaaacaaaugauguucauuuaugugugcuuguguguucuguaugaguuuaugugcaccacaugugugcaagggcccuugcagcacaagagggugucagaucuccuggagcugggauuuuaggcaguuguaagcugccaggugaucuggcaaccaagccuggaucuucugguguagcaccaagcacacugaacggcuggcucaucucuccaaccccucccuccgucucaguauaugcuuacucagaucacauggugugacugugacaaauguugacugugauuuugcucugacagucggugcagugcgguuccguucuuccucugaaaauguagucaugcaaucaaugguauucugucauauuacugaauauuuuagaaagucauaaauguaggccaacauaagaaaucauacaguggaaguuauuucucaguguuuauguuaaaauggucagaucuaucuugcuuuuuuucuuuugaaaguccacggaauauagcaggguuuguuuguuuguuuaucuaucuaucuauucauuuauguaaaugcagguugucaacauucagccaaauacuuugguuuauuuuaacuggguuauauggaacuuacuauauugcaguauuuauuguguuuugucugccaaaaugacugcuguuugauuuggaguaauuuuagagggagccauagauaaaaaguaugaauauuggggucuaggauuuccaaaaucaguauucacaaacguuggcucaaaaugcauuugcuauccauugcaaucaaugcaucuauuaacuuuuagcauaaauguucuauacaaacuguauacauacauauauauguacauauauauauauauaucuucaacuauauacaguauauauaguuuauauaguauauauaguguaugcauauauauguauauauauauauauauauacauacauacauacauacauacacacacacauaacuaaaccauuaaagcgcuuuauauuacagugaagagcaguauuuccucagacgucuucuuugaaguagccucucuacaagcuccugacagcggacacugaaccucaaagcaggaagcagaugcuuauuuccuugauauggauuaugaauuucuaaggaaauuaugauagccuccucuuugcaaauuaacaguaacaccuaaaauuuaaaaguaguuucuucuugaaccugaacauagcaccugauuucuuguagcugacaauguauaaguccacgcaucagaacccacacuauagggacuggagggacggcucagcaguuaagagcauuuguugcucuuauggaggacauguccagcucuuagcacccagaugcuggcguauaaccaucuguaacuccaggucuaggugauccgaagcucugugccuccaaaggcaccaaguauauacgugauacacacaugcauacuuauguacaugaacuaaaauaacauuuggcuuuaugcacugccacacaccucuuuagauucauuccacuuuaaaaauuuuccccagguuuaucauuuaagacagucagcagugcuuugucaagcucaccucuaacuaacuucugcaccuuuaguaugaagccgaguuaccuuaggugacauuagaagguauuaauauuuugaagagcaaaauauugcauaaagagaagcagcuugggugguuaaauguuauucaugaauugugucguacaagaggcuugaaacgguuucauugagauguagcaacauugcauacugucagagcuguuagguaauuuuuacgacaacgguuuaggggacaguggccuuuuggcucaauuguuauuccccaucauaguuuuuucuuauucugaaaauuaguagcuccagacacauacacagacacacacacacacacacacacacacacacacacacacacccuccuuuaauaagaacgggagcuguucauuaacugauccguggugacugacacacacuuuucauuaagggauaucuuaguuauagugggaauguuuuuaauuguacuggacauguaauggucuacauagaguguuuuguauuuuauuuccccacaucccauuuuuggcucauuguaguucuucucuuuccuuugagaacuaguugaaagauaauaguaacaacguggcccaaagcagcuuaugugugaagggucaaaccagccaguucaaagcacccuucugauggucuccccaaacguuaaucuaugcauggucgcaagccuuucacagugggcuuuacacaguuuauuauagauuaaaauuguuuacaguguuuuguauaggcucuuaaacuuugguguggcguuagaaaggaguccuaguuugaagaccuuguaccucagaaauagaguagcagggcccuguaaaccaccuaggccuugaacguuugacagagguagcaucgagauugagccacggcagggaacccaggcuuuacgcacaauuuuuugaaagagguuuuuaaauuuuuaaaugaaaacauaauacaaauaguauuuuauacauuuccucuuauuauuuauaucacauucaucucaaagaaguuucuuuaugauuuauuuauggcgauuuguuuaauuuuucagacagccuggugaaacaaccaugcuaaacuaaaauacuuuuugucuuugguuugaagauucuauggaucccaaaaggcucguucuguaauacuugcuuuuauuaguuuuccagugaauuccccuuucgauuucagugaauuucauuguuugaaugauaaccaaguucuuuagcacacccaucucuucaucuucuuagucuguaagcauuugaaauccauguuuggagcaccuuuggagaguaucuacugcaucauguguuacagucacucacuguuuucugcaauacuuucccaauauuucaaaacucugcaugauauccuuuaaauacauggacuuauuuucugucuauuaaaacuuuuuaagacuuggaauguguuuuuacaggggugauucuacgugagauucugaaugcuaaaacuaagaacauacgccauugcuagggcaguacguuggcucacuaggaugagaagucugucuccaugcuucuccguggucugucauagugacuuccauagccguggucguucuaggaaacuguuuugccgagucuacuaucuccaaagacugcuccgcuggccucaaacaauccucagucuguaagcuaagaauuguuagaauuguuuugccuggauugcagguuuuuaaaagcuauauucaccaacaaauucugugcaaagacuaaauuaaugaagauacucugggcagaaauuuuugaacuccagucauguugcuuggugacugcuccuugaguggucuggcuuacaccacuccuuugcaggacuuugauacugauguggaaacagcagaucccauggacaugaucacaaggugugccaccagcuagggagugaaauggagggguacagggaagacgcaugcguuacuacuugacuuauuuccaccuacucauucuguuuuguuuuuguuuguuuguuuguuuucccuucuagguuguuugaugugugcacagugucacggacggacagagaaaccaagcuuacacuaguguuugagcauguugaucaagacuugaccacuuacuuggauaaaguuccagagcccggcguacccacagaaaccauaaagguacccuaaucaucagacuugcuacgcuuacggccuguugaacacuagcauuauuucauugugaaacugccagaguugauguuucugaaacuuaaaauauaguucaaaaugucaacuaaguaagauguucaaagaauggaaaauaaucuaguccucuguuaagugggaucuucaaagagugggguuguaguccaguuuaauuuuagggucaauuaaaaaugcacauuaaaauucuuuaauacuccuuauuucuauauuaucuggccccuggcccuaaucuuauaaaggaauauauauauauauuucagucuauccugaugguucuuugucucuuaaagauauaauuuucauugucacucaaaaacacauagguuauaauuauaugcugauucugagguacauacauauuacacagauaugcauggucaucuggcccuuucuguuuggcuguuuguuuuagucuaaauggcagguuguacuguugggauucaaagaugauuaggacacaccugcccuucguggucaggaagcuggaagucuauugacuacaaacaaaaugcuuuuguccuuuaaaucuaauggggaaagugccacaaaaaguuuagugcucuugccuguuguacugcuucacuucauuguccaguucaccugugaaguccgugcacaucuccacagaguaagaaaugucuucuugcauaauggccaggugcuguccccagauauuaauacauuuaaagugcaacguaauaaaugauuaucuauucagguuuaggcuaguaagacaucucauuucucccaucuugcucucauuaaagaauguuauauauacugggggcuugaacuaugcacauuucuuugugugcagugacauagaaacccuccaaguguagacuucugaucaucuggucuugguccucccuccauggacucucuuccuccggcaucaucuuccauucccgaacucuauuuuuuuuccucuacguacuuaaucccaaaacuccaccuugugccaacagagcaggguccauccuuuucgcgcacccuguucucugagcacaaugaucaugaggguuuuuuuuguuuuguuuuuugguuugguuugguuuuuggugggaguugguuuuuuucaaaacaggcucucugugaaugaccucagcuguccuagaacuugcucugugugcuaggccggacucgaacucuuagagaucugcugcuucugccucccaagagccagaucccaguucuugauguggucugacuccccaccucaguggccuucuucuuguggcguuucuguuagugaggcccauccagaugugcuugauccacacucaaguuggauacuggcucauucgcccuuuacucguuguuacucucuccaguuccuuguauccucugcccuggugguuauguauauaugcaucugucuauucaugaguaccaacugucauauguuucuuacagaauauuguagugcuuuaguaagguuguugugagaugaguguaaacuauaccuuacauucuccuguguuugaacacucauucccuagcugguaggaacacuuaguagcauggggccaguugaaagaagugcaucuuugaacugcaggccuuaugggugguagcucagccccacuucuugcccaaauuucuuacuuccugaucaggacagugugugcaagcugccugacacucaccacaaagcugcuugucuccuugccucuugcuuccacuacaaagucuuacccuuuauaauggacuguacccucugagaucaccaggcaaaauaaacccucccucccuuaauuuauucuauaaagucuuuugucaugauguggagaaaagugauggguauaaaaccauuuuuuaaaaucaugaauaauuguuuagcagcauauauaaccaucaguggguaguuuagguuacaggcauaacugauaacaaauauuuuuacuaggcaauuguaucuuugucuuaaugauugauuuaguuuuaggaauuauacuacaggcuacugcauuguggguugaaauuuucaagcaugaaacuguagaacaaauauuuugucauacagauguauuuaugccaagucuguccuugagcuagugaauguuacuauguugagcaacuuauugggaagauaaaaauggauuccuuucuauagaacgguugguggaaugagaguuuuuuaaacuauacugagacacuauuuguucaguguuucuguauuuaggacguuuccauggugaacacuuugcaaacacaaaaugagccuacucucagugacuucugugaaaugaaagaugaaaugcacagagagagggagacagacacagagggaacacucaggcacccgcaaugguggcacacaccuuuaaucccagcacugggaagcugaggcagguggaccucugaguucaaagccacccugcucuacagagcuaguucuaggauagccagggcuauagggccgcacagagaaaaccugucuugaaaaacaaaaugagagagagagguggugggcaggggaagaucucacaaaagcauacggcaaucguucucagugauuauuuaacaguuuggggacauuuucaaguaccaacaacuaagccuaacccaggucuuagucuuuuucuaugugauaccaaaguauucucuaaaguagucacagcaucuagaguguuaauagauaauguauugacauuauuuuacaugcauugaaacaugcuauguugauaauaauaaucuggacgauauuuuaacauaaaauagauacaaaauagcagcagcagcaacaacaaaaucaaaagaguacagucaugugagaugguguagguccaggacuuuaccaucuuccuauucugcuccacggcauuguuuaccuguuaguuugccaccuauaggaaggcagggcuuacauaaaacuuuaauguuuuauagugucuagaaggagauaaaaucuuuuuguuagaauuaucauuuaaucgacauauuuguuagaaaacagcccauggaggacuuuagaaauaccucucacaaaacaauucuucagauaucugaauaacauuuguuuugagaaaauuaaaaaucguggaaguuuaugugguugugcagguugguauugacaaggucaguuuguagaggacauccugucauuacugcguugucaucuuguuaggccuugauaaaauaagucacaggcuaugccucuacaucaucucuaaaaagcuguaaaaaaauaaaguuaauuaauaauaauaacaacaacaacaauaauaacaacauuaagaggcuguucuuuccagcgguuuuaaguaaaaaauuucuaggucaaauugacaauuugcugcaaugcucuguagguccaucuguccuugucucaugaugacauuugccuguggaccgcucuucugugaaaccagccaacaggcggguguggacuuguggacguggcuggcucgccucucuaguucagacuguuauccuggaaucuguuuugcuguggagcucaguucugccuuuacuuuccaucuucauguguccaucugccaccagaugacacggggucacggggaguguccaaaagcuuguucaccauauuccuuagucacugcaguaagagaagccaaauggcagagugcugaggauggacagacuccugugugagaccuucaagaugccugacuuccugcacuauccucugcuagggcacuuaccugcacaucggcuuuccucggagcuggccaacaucucagcugacuuauaaacucuuugaaaaccuaccugauguuauucucuggcuauugugccugugcagccuauuuaaugaaacgggcaguaucgucccgugagaacaaaguucagaagaagcacagaugagcagccuuuucucagcaggacaggcuuccuugagcucaaaaccaugugggcucauggaguccugggauaaaaauuauguucauguuuccuuauaauagaugaguucuauggagcugcgagaacccaaagcaaagcuugggguuuaugucugugucguaauuuucucacuggauuagauuucuuuuugucuucagucaauuguuucuuggagacuauguuaguuugacuauuuucaguaagagauaaaauguacuauuagguuuauuuuauaaaacccagacuucaaagaccagcacacacucucgauagcaccuguuuucugccucugggaaauaucugcuugcuguaaacauggcucugaugucaggauggaaugcccaggccugauucaucccucucugcuugacauaaugcaaagugacuggucuccuguguugcaaagagagucucccagaucuuccccuucugcucuuaaaggaaccaagcccaggccccucacagcuccugguggucuccgcuuugcccgacuuacagcaggugauguguccuaucuuugcaggacacagaacaaauuaacaugaaaauaucgcuccucagcaaacagggccggcuugaaagcccugucacugcuggccacugccaucugccaccaacacucacacccuguuuaucacauuggaaauucagagcacaugucgcauaauaaggugaucgcagagacaagaaacucagagaacaaggaguccguaauaaugauaaagauuuggacagaaaaaaaaauguuuuauucaauuugauaucaugguuagacuaauugccuagacuaugauuuuuuucacacgagugucuggacagugcugccccccguuuaugcgaauuauuuuuauaguuaaaaguuuuaagagaaaguaacuacguaugugaaagaugccuuacaggauggcacaguaaguggccucuaaugagcaaaaucacauuuuauuaauauucauucugguauaagggauuucauaggccagucuugucucugacacuuuaaggcagacucugacucacaauaacuucauuaaggauaaaucaguaauuacagcaguaauuaagccuggacaucccaagccacuguagcuuuccaguuuaacuuuuuugguugaugcucaauacucuauggacccuacauccuuuccucuuccucggcguccggcuuuagcuguguccuguguccuguguccuguguccuguguccuguguccuguguccuguguccuguguccugugugacuccgcaccagugccacugcuaaccuguguucucuuagcaucuguuggcucuggcucugcagagcccuacccagcuuccucagaggugccagucuuaggcuuucuuccagucuugcguuccaaggagcucacuuuaauucuacuguccuucuguauacacaaaaguggcauuugguggacuuagcuacuguugugcuguaucuaauuuauuaaugcacacucgacucuuauuaugccuuauaaaaaugacaugagucauaguguacuuauuagcugcuguguuucacaagcauucuguauuuuuuagagcagggaucaugggaugggaauaggucugaguggucaagagcuugccuagcaccgcagaaaagcuucccugacuuugaucaggacugggaccuauguuaagaaaaaaugguaugaguaucgcacugcuggcccugugccauugauuagacaggagugauaacgugcguuuggagugaaccuguacuaaguguucucugagaucaggaagaaaacaggguacgugagcuuuaacagcuacagucacuuauacccccaaacccguaagcauguaucuaauacacagagaaaugaacccauuaguaucuuuccuccuccuacuaggaaguucccuuugcugucccuuccaucagaaauauccauagcguauuuugucuuuaaccccaaaugaaaaugcauaagaaacuuuuucaaggugagcguuguuuuagguaaucuacauuuugaggauccucacagaaacaaacguucauacaaauuuucacgucuuuguaguagcuaaaaauacgugguuggaaagaagauagaauuauucaaauacguaguacucugauuagaaacuauaacaaagcuauuuggugguuuaauucccccuacaagcaugaagcacaaauuucauuuaaaaauaauagucccauucuaaagguauaauaagacacguugaaauaaaggcugacucauuaacaaauaacacuuagauuaaagaaacagcagguaaauuggacucuuucugagagaaugcuuccucguggcaggcaacaagucuguugauagagcccacuaaaaaguuacaggccguauguacccucugcguugucaccaugguaaccgcaaaaucugcacaaaggggagguauuccugucuacauuuacuuguucugaagugccuguugucgccuuuaaauguggggacacgugaggcuucaugauagccucagcucuuuucuuccguagccacacguuccuguguuuccaguggugccauggacuugggaauguucagguacuuacugucuagccugaccucucccaccaguucuggacacauagaacugacauuggcagaacccuagccagaggacuggaggacagauggauuagucugcaaagugacugcugcaccaacaugaggaaguggggugucauccuccuuaccccacuuuggguguguccacucaaaaaaagcaggugugguggcaaacacuugauauuccagugccguggaggcaaggauuucuggggaguuuguucgcuggacagccuacagcaauuggugaacagauucugaugagagagccugucucaaaauggaaaaagugaaugguuccucaagagugacacccagaguugcccuucauucgcaugugcgcaaagacacacacacacacacacacacauacacacacacacacacaccugcaccaccaacagccugucuuguacacacaagccuaccuggaguccucuccucaagcuaagccuugcuugaacccaagcaucagugacugcuuuccuucacagucuacacucgguccaucuaacaugaugcuggcucagcaucccacuucugccccugcacaggagccacagacauugucuuuaaagcauacauaaagcucugugacuccccuacugaaaccuuguccccaagugacuucccaugaucuacagaguaacaucaaaagcccuguuugaucuggggccucauuuaacuccucucuugcucuuguucacugucuuuccaucacauuagaugugucugucacaagacccagcugagaaugggaagugucuccauuuuguucugagacaacucuaacccauguaaugugugcuuggccuggaugcaggagcucccgauagacugcagagcucuucugguugcaugguggcuuaucuuugugauucuaaagcucugggguuggaggcaggaaugugaacucaagaccagcauaggguacuuuguaaggccugaucagaaagaaacaguaaaauggaaggauuuaaggugacguuugcauggcuucuaacugaaguugcccgugaccuggaagcuggauuagaagcccuaguuguucuguuagaaagcaauuaacuccuuaguaggagaucugaaucaaacgaugcuuagaaguaugaacuuccaaacaaaaagauuccuuucuuucucuauauuuuauuuuauuuauuuuugcauaguccaggcuguucugguacucacuguguagaccaggcuggccuugaacucccagagaauucaacuucugccacucaagugcuagaaguaaaggugcgugcugcuauucccaaccccuaaauaaagauucuuaaccaacuaaggagccuaccuuuucaaaaugggcauucaugauagaugauagauauacaucaugacuugaacuuugaaaaauacuuuuugucucaugcauacuaauguuuucacaguuccguagucuuggauuaggaaaccauuaccagacuugcagguauaacuggucagaauuuuucauccccgcccccauccccaucuccuauaguaaggaaccaaacccaugugaaauguuaagugagccuuugucgcaaguuuuaaugaugacaucaguaugaaccgcuacaaugagugcauuugaaccugguguccaaggaaccaugaguguucaggcucugguuggcuccguuuugauucaaggcuucuaacaaaugugacucgauaaccuuacugauuuuauauugaccguuauucacaucugacccuggugauauuaaauuuuuucccuuuuuuggacaaaaagagagguguuuuuguuuuugcuuugcuuuuuguuuucaaacauucuccuaaaggguagucacaaugauuucagaucagaaaguucaaauagaacauagcagguauggggauugauugcaggccuggagagguuuugcuaugaaucacguuugggaaugucaacauggaaguucaagucuguguguugugcaguguagauugguccggaaacaauuacccucaauguaaggcacucugcguaugguuagugugaaaugaacacucugaacacuucuugcugauauucccaucgcacuaauauaucacaggucaguauuaaagccuagcacuggaaaauucccugucacugaccucugguguuagcagaaugaaagccauagaagcuguagacucgggccuuguuuuucuuuuuguccuuaccguuuaccaaaaccauauuccuggucaggaagguaaagaacaaagagucaagagguguuuuggugaugcagaaggaaaugaguuggcuggaucccauuaacaaaggagauagauuugaagacuagcaguagcccuucucucaaaggugcuuuguaaaaaguaguccauuaugugggguuuuaaaugcaggaagcagaguuaucaauaacucuuaugcuucccauuaaaauuauuacauggaucacagcagauaucuucuaaaucccaagccuuuucauauguauuucagccagauacuaaaggcaggcugggcuaugugugcacugcaaagcuauaugaauccaaguaacuaacacacaaggacauaaguagcgguuuugucuuugauuguaucuguugugaauguugccacuguacuaacuaucuacgauaggcacuguucauccaugcugugagaucuuaauuaaacccuuaggaaccugaagggaaguaaauacaaauuacaucagcaugaauuaagacaugguuacauucugguguccuccuggggggugggggucacacccuaagagaagugcuucguccuuagcuuccgacacaaggguuucacagaacuucauguguaauuuaucaccgaguccgguaauuaacauaugguuuguguuauugauuucucggguuucaaagugaaauaaauugagcuuucuuccacauuuaggauauacagguuuuguuuuuuuuguuuuuuuuuuuuuaaaggaacucuaaacaaagacacacauuauuuguaaguuagggaacagcugccagaaaacagaaaauugggagugagugcuggguggaauaauggagacacuguucagagguagcccuguaaagcaggaagggcuccuuagaaaacagacagcugaguuugcuuguaaauuuugcuagaaacaggccuccuuuuccagcaucuagugcugcuuagggggcugaaggcuacacuuucagcuuuguuuuugaagcaaggaccuucguugaugauuuguagaaauccacuuauuuccaguuuggacagaugagugacuauuauuggguuacaguucauuuuuuuaauguauagaacauuuuagcaacugucagauuuugauguggggguugcugaguguaaagcauauaucacaaaagccagguacagggacucaggccuuuagucccagcacuugggaagcagagaaagguggaucucugugaauucaagccauccggaucuauagaguggguucuaggacagccagaguuacauagggagaaaacaaaacaucauauuugugugugugucauucagagauucaaaaaauauuaaauuuauaguauacauguaaacuuaaagggcaaacaauuauuuacacaaaguauaguaaaaguuuaauauccuuaauguaaaaaagacuuacaaacuaauuuuuaaaaacuaaccaauuuagauaugaacgaggaucauaaacauucaucaagacccacauguagacagaauagcagcaagguuugggguugcauggugaagccagaaugugcuauaagggaugguuauguaaauuacaaaacuucuaacaguggucauaucaccacagaaggauuucuccuagaaccccacuuuugaagaauaauuaucuaaagaaagaacaagauaaaaauuguguagguagcagauucucaauuugaaaacacauugcuaaugcuuaugauuuaaaaaccagaaagaaauauaucaaaaugcuaauacuguguaucucuguugauauaggcuaugcuguuuauauuuguggucuccugcuauaugagacuggaugaaaaauuccuaguaacagcccauuucuaucauccaaccaaaugaucuuuagcagugauguuuucuguuacagaguagauguucucaugccggacaagccuuauaaaacaauacacauuagaguauugggugcauagguguggaugaugugcucaauaaaauagcagaauugaaaaccucagugauacuaacccuuccaaaagaccuacauguaugguuaucuucuuuaaucaucauuguaccgcacauuaggaaaaucggucugugggggaaguuuccugaauuguaauuggaagcagucacuaggcguuaguaaauguaaaugcaugccugccuacagaaaaaaaagucauaagcuuacuuguuauuccaguucaggcucauguauaguuucuucaguggucucggucuuuacuugaagucagcuucaaguuugguuagcaugagcucuuagugauuauauuacauauuugagugaaggcuuuuuaaaaagagguauuuguaauucugcaccugcuuaaaaccguucagugcugcccacagucagaguacucccagacagugacauaucuguuacagugccaccaaguccaccauguacccaaaagcagccugcucuaauucucaguuauagguaaagucgugccagggacauaaauuugcauuauuuuuaaaguguugggggguggguguuuguuuugaaggaagagucuuauuugaaagucuauugucguuucuucuuaugguuucuugaacugagaacuucugggcaugugucacuuacagaacgaucaguaccaaagcuuuguagucucugaauugcauuuagaaaauugccauuacccagcacaguuaucccaaaccaagagugcauagccuuugaguuccucaaccaucaaggcggugugcuugggaugcacacagcccugauagucaauuaucugcugugggaaggcccauuccucgggcagaaaucagugagcaucauucccuucaucaguucccagcuuccgggaacuggcgagccuguugccaggggaaauggacuuguugccuuuguuugacuugcccugggaagaucuugacaaagaucucuauucuuguucuguugaggucugaugaagcauuaaguaaaacugucaagucugaaaagauacuguguccaguggcgcacgagucaccuuuacaaaugacgcucauggcucccuaugacacagguuguacuuuugaguaaucaccuugucuuugacaagccaugggacuucuugauuacugcaguguggcacugagcugagagaaagcuacuuuauauuaaguagacagauccuauuuuguugaaaagcaguaacacugcugaaaagugucugaaauuccacauacagaacuauuuuaguacuacuggcauuuuuaaauuagaugcuucuaauguggaaggguuuagauaaucaggaacauaaacugcaggcaaacucauaaaugcgaguaguauuuuuacuagagagacacaacucugggagcaucaauucgggaaggccuucacugggccacacaauggaaucugauccuucacaugguuccagggaacugaccucuggaaguguggcccucaugcucaccugcccucacagugggccuuguagcaacuggaacaaauuacagagccacuucggagacugcaggcguaucgcacugcaagucaagggggauauucaggacauugcuugcacgugucuuuauuaaagguuacagaguggauucagagaugcacacauucagaucaugggcuugugacugaaggggauggauggauggauggauggguggguggauggauggauggauggauggauggauggauggguggauggauggauggauggauggguggauggguggauggguggauggguggauggauggauggauggauggauggauggauggguggguggguggguggauggauggauggauggauggauggauggauggguggguggguggguggauggauggauggauggauggauggauggauggauggguggguggguggauggauggauguuuaugacgugaggggaugacugaaguugaauggguuuucuguuauuuucacguuuccauauugguguugagcaaaaagucugagcaugauuuggguuggauuguuuguauuuucaugaaagcguuacuuuguuaugggaaagcagggaguccuuaaagauucuauuggcagggaacauuuuaaaaggcuccacuugcauuauuuaguguauuuuaggaauguguuuguuucugagaguucuccuuuugcgguuuuuuccccucccuccaaccuuuugccuuucuaaguuaugaauguuuuaaguuuuccuaaacgcaguacauaucucacaaguuugacuuacaaacauaacagcccuucacugcaguuauuccuggugccuauauccagcagacuccauucugccacacacaaccucccauccccauccccauccccaucgccacucccacccucaccccuacccccuccccggucuuaugugucuuggcugggugacuuggagaacauuguuucccuucguuaguagaaagaugacuaccugucccugaaacgaacucuuuguggccaaagaaugaccaccccaaaggccaucauucaaacauuggcuuggaaaaccccccuuggaacucuagcuugcuacuugcucuggcuccuccucccuccagacaccuuuagcccgcgcacacaccugcucuuugggagauuccaggucgacgugggucccauaugcuccauaacacauccuugucaacuuuuacacuuuaaaaccuugaacaggagaaaaagugacuuaaacauauuacuuuggagcaccgaaauuccccaucaagucaugcugagucacuuuuaaaugccuuuagaguugcauaaaugugguaacgagguccugcuagaguggguuuuuuucccaucuuuucuucuuaggcuugacuuauagguuguacucagacucaucacuagguaacuuuccugccuagugccuuuucuguaaacacacuauauaacccaggcgggcuaggaagcugacguguccauuaggcugccuuggaacccacagagauucccccugccucugccaccuaaaugcuuagacuaaaggugugugccacccaaacugguuuuuaugccaacuuuuuaaaaaaugugcauuuacauaguccuaugugcucagaucagccagaccugauccauagcagagccaguguuguaagugaugacaagccaagguucauugcugauuaugugaagaagggaaaguauaccuugccaaaguugaggcauauuccucaacccugcaaacuuuguggcaggcaguuaaugagcuugaacuggggguucuuuuguguguaugugcuugcgugugcacuuguacgugggagaaagagugaaagagauauccaugcauagaauucuaaaccagcacugugguuguuagcuggaggaaagagauauggcaacucccaagcccuucuggaagcagccuacuaacaggaggcuuccuuggaaacuagucucacauagcuccaucuugcuggagugacgguuccuccaaacuuacaccuuaggaguccuuaugugagaugugcuuugugcauuugaauuacuuuggaaauuggagcccugcgauguaccacucaggaaaauaaauggucauauuaacuccuagcaaaugccaccucuuugguuugaauugguucagaaagcauuuucuuccugguuuguacgcaccacauuguucaggcccuucucaucacugaccagcuggcuuuucggugaauagagcugugggcccuucgccauguuucaugugaggucuuggcuggguggcaaacaggcagccuguagccagugucggcaauucaggaggaauuggcacagcaguguccccauuaauuucuguuugucacaugcugucaugccaguuacaccagaaaggaaaugaccguuaaaaaaaaaaaaaaagguacccuuguggcacuggguccccuccagacgucccugagguuaaacaaguggauacaauuaguucuacacagacagcugcagggaagggaaagccuagaccaggccccacagcaaugugucuguccuguuaguguggagugucagcugucaacaucugccauauuuuaacccuucaaagaaaccaguaaauuaaggggagcuauuaucccacgcucuguugaucauuauugaucauaaugccuuagaaaaucaccacagugcugcccccucagcggcagguuuugucuuugggggugguuuuuauguuauugcugggagcugagaaaagcgguaaagcacggggugagggaaacgggcucuuuaauuguugguaauuuacugccacauggaaagggcacccagcaguaaacucuucugcaguucaagcuggcauuguuaaaacuggugguagcuuccauuuccacaaagaucuguccugcuggcugucaguccgucuucaccaggacauguggugguucuuacaaaagcacagaagagagcuguggggaauaagaaccagguuuggaagagaaaagccauugacgaugagagacgaaacccgcuauaggauaaauagaagcuuccagaaacuguuacuguguuuucuaaagauugaagggauuaagcgucugugaccuggaugagcccuguccaaccucucuguaagcaucuaacugugcugggagaggaucagucugaggaagucugauuccuggcacacaugagugagauguguguuaaacuguugaaacacacucauuaacucuaaccacuaaaacuuucagaggagaaaggguaagaaugauuucuugccauauuuuaacuccaugaggacauggcuuuguaguugugaauuuagaacuucagaaaagauaccauuugcuugggaacgugcagaugggagaaauucuuuuaaaaaggaaaagaaaagaaagaaaggaaaaucaauaagaugcuuauuugaaaguuugccuuacaaggugaaacacugaggaggcaauacuugaauuucacuggguuucuaauguuuauuacagaugacuugacaccacuuaaaauaauuuuaagggaccugcaaaauggcuaaauguggguuaaagcaagccaauggccugaucaaaacuacuauuugaaaaugaacaaaaacaaaaacagauuucuaaucucagcacuccaaccccaagauggaguuggggguguuaggugaggacaagagaauuccccugggaggcuggcccaccugggguauacaagucagcagaagcaagacgcccuguguccacaaauuggagggagaaaguggacucccuaaagcuguccccugaccuccacaugcaccuccaugacaugcgugcacaguguaggcacaugcucacacacuggaaacaauuccauuggacugucuauaaaagaacugcuaugaucaccaaccaaugagguugggguguuaucagagaugagugucaaggcugguaucauccugugaccucaucuagucugagacucucauaggcuacaaagcaguaaccagggagguaagggacgcaaggcccuaugugcaucuccacagcuaagucuguauaucccagugauggccaauccaagcaaccacagacugacagcaggauauaaggcaacccccagaccuggagacaugcagccuuccucagucagucagcaguggcuucuccugugauaucaggauguguguuuauaguagggguucuacuugccucuguggaauaagagucacuaguuucagagacugauccuguccaauuuuaucuauaacacauaauuuugacauuaaauaucaggcuuaauguuaacaucaggguaugaauuuggagaaccuugguguguauuuaaaaucguuuaaacauuaggccacaaagaaaaaucauuaaacguguguauaucugagccuacguagauaugugcuccgucccuaaggggucuccuugucguguagauggauagacuauaugcaguuuuuguauuacucauguucuuaagcucugauuuugggaggauaagcaguaauuggcucugaagucucugagcuuacuuauuaaagccugacuuuuaauacaguaauaaaaaaaaaucacaacccgauuuucagaagugaauucauauaacaucaaauggguucuuauuuuaguuaaauaugaaaacagauggaaaauaaauuuguaaugcuuucuugcuguuuaaauagguugguuuucucagaauucuugcuuaggccugauguuaagaucuguccaaaacaggcuagcaguagaggaagcccuuaccugcaggcugugacuguagaggaagcccuuaccugcaggcugugacuguagaggaaccggauguuuggaaagggccacaggagagacgauccugacugaggaacaaggaugagccaaguagacuaagcacccugacguggacuucauagaaggcccccaaaucguuagcaacaacugugguauucagaaugauaacaucaaucacagugagcuacuccggucauccuguguccauaugcaacuccauaaagauucucccgguuugggccuuaauuaauagugacugcauuuuacagaaugacugauuucacugaaaacacuuguguucaaacaugucugcucaggacucccuccuagcauucauuaccuuuauaauugccgaauucucaugggaaauggugguuucucguuuuaaguccugaaguuucgacgggauuugauguagcguuucauuucgcuucaaguucuaaugacucacuacauucuuuccccuagaacuuacccucuguuuacccucagagcaugcucucguguagacacaagccuugggaaucaauaagcaugacuguauuuaugaacaguggaacgcuccagccucucuuaugccacugggagacauugucuugucugcaaaguugaaguaaaaugaauguuuccuguacaucuggacuuggcuuuuuaaguucugagggaaucuucucacucucgcaggcucagauauucuucugcaguugggguguaguacagugugacuuuacagauggaggcaucucauauuaaucacuaacugaugacuugcccaaguucacacaaguuaagagccaggagguaaacuuuacucuugcccaaucuauuaggcuguuuucaucucagccccuauaguagaauuaaauauaauucauauuuuugucaaugugcuuuaaugaguaagccccauuuacauaaaugcuuuagcauuuuuauacccucugggccauuagaguaauuuuauuuuuauuauuguaauuauuauguuucuaagugagaaaugaaaugaagagagacgcaguaaauuuuauuguuguuauugccuauguaucagugacaggauucuacaacaaaggcuguuccuuagcucuuggcuggcuguuucuuugugcauucucuuuucuuaccaucucugaaguuacagcuagaguuagggcaaacauuuucugacuucuguagaucuguguaacaacugcuuaggaauacacccaguccuuuacuugaauuuuuuuuuuuagaaaaggcuucuugucauaagaaaugucauuccuucccugugagaccugacagggauccaaaggaggccaaaggauacaaguacagauggccuccugcgagaauccugcgcgagaguuuuucuuugaauuuguauuuauucauuuacaucccaaacucugcuugucuccauucccagagacccucccuccauccccucuucucuucccugagaggauggcaucucccuggguauccuccuauccugguccuucaagucucugccagauuagugcauccucucccacugaggccagacaaggcagcccuuuuggggaauggguuccacaaucaggguacagcuuugaggagaaccugcacuccaguuguuggggagccuacauggggacugagcugaacaucugcuacauaugugccggggaugccuuguuccagccuguguguguucuuggguggcucagucucugagaguucccagagguccaggcugguugacucuguugguccuucuguggguucccaucccccucagggccuucaauccuuccccuagcucuucuguuaagaguugccaacuccaguguuuggcugucacacacacauuuuaaaacaaaaacaaguucucccuguguagcacaggucaccuccaagcucagggcccccuaccucugccucucaagcuccaaagagcugagcugccaggucuauuauaccaggccugguuccuugcuccugagagagagucuacaugcugcuguccuccuuuuaccaucucgggaauucccugaacacagcacugucccagcucaagcuguaaaaguugacaagguucaucuauugagaccaaaaaguuagaaagccaaacagaaccaaggcagucauugucaaccuccucuggaagcuguuuucuaaggcuugaaaacauacuugaaguacaagucagugaaaguauaaaauguucauaccggcguacaacuugggguuuguauauuucugacuccucgaguaacauuuauggaagugaauccugaaucgauugguaagcuacuagaaguccuacaguuauccaguuauccguaauguuaguucuaaacucggcgucugcucuagacaucagacauucuguagaccauaaaaggcaguuuuguucccguuuccguaggauuguuuucagcaguaaagaucuguacuuagugugauuuguuacuggauagaaggacccgcuacacuuaacuuacacaguccucugaaagcagcguuaauuuugaucuuacuuuugguaauguagaucagaaucgguaacuuuguggggacauggcagggugagugcgcacauggucuagagcuuuuaaauuuuuuuuaaucuauaugaguauauuuuggcuaucuuuagacacagcagaagagaacauaggauccuauuacaguugguugugagccaccaugugguugcugggaauugaacucaggaccucuggaagagcagccagugcucuuaaccgcugagccaucucuugggccccuggaguuucaugcuuaacauuguauucuguuccacggagccuuguucuccguguugcucuuugccuuccuucucauacuguacuuaucaccauguguaguccauauaauuauuucccuggcaguuuccagccaauccuuuguacauuuucagguaaagauauaccugaaaucagcacgugguuuuuauugaaccccacaaacauuugcuaagcaucuuccucaugugacacaccauuccagcauggcacuagagaggacugaagcccucugucuuuucauacaagucacagaacagagucuauaauacuucagcaagaaaagccacucauuuaaaacagaaaagaugccacggcaaguguugcaaagaaguagacauucccugugaaacacaugacaaucaccaagggccaaaaggacccaagugcagguggccccacggcagugagaaccucacuugcaaaccccgcagaauuuuagggcuggcuuuggacacuggcuuucagcuuacuuucuccauugaucuuaaguuacaaaauugccuuacaacguuugucucaggagaccugaauuccauagguccaggagaggaauggcuggugggguugucguaccuacacucaguagguacgacaaucccucaguaggauuucaggaagcaacuugucaaccagauuauaguaaaccauaauaucguuugauacucccauaauccaaagacccagaaggcagugucugcauauuucauuuaucuauugauguggugaaagccccuggcaacaugauacuugguuacucgucugagcaagucgcuuaagcuccuugagcuucaguuucuuuaucuggagagcagcuacaaaggugugcaagucagagacacuguuuugugcguaguccacugcccuggugacagaaggcauuguaucuuguaguuccucccaguguuucagaugagaagaccuuaagagucacagugcucucccagcaaucucucucaugaugccucuuaaguagauuuugcaaauaggccuuuauggcuugccaacaugacuuaaucuguuugguguccauaaaaccuguuuuccuccuggccuggcucucuguucuauuacuuucuugcugauaauauaugaguugucuaaguugcuauuaaaagucuucaggcccucugaaaggucaauucuauaaaauuuuauuauaaggugucuaaacauagaacacacaauaugacaucguaaguuaagggagcucauguuaagaauuuuccauugcacaccggaacacucagaaguaaaagccucgggaaugacauagucuacuuaacaucugugcacgucccucaaauuuuacucauuguguuuucuaagugacaucagaccaaauugaaaugcuacuuuuaaaguacucuaaaacuugauguuuuuuuuaaaugcagcagcuuugauuaugggauguuuuaaugggaaccauguaauucuguucuagauuuacaccuaguuuguucuguaagcccuucugcggaguguugguacugccuauguuggaccaugagcuuauguuucaaaguaagcccaccuuauauggagauaguaugaaauugagagggagaaaauagagcauacagagagaggagugggugccacaugagcccaaccgcacagacaccgcgugaugcugucaauggcaagugcagcagggacagcagacugagaaacagcaccaaccuugcgaaggaagcggcaguguugaaggacuuugaagacaguaaacggagacgugaguggcauaugucaguucaggcuaggacucagaagccauggucagguguugcuuguuuccucuggggaagaugccacgagccugggcacaucuagagagaugaagaagaugugugauuauggaggugcugagaggugacuggcaggcacuggaguugucagaguggaacuguaagccgauuagucagguagcaaugacuaauugcuuaagacuuaagauguuacaaucgauuugcuggagaaaccgguccauuugauuggaaaagggagaagguggguugauaugaaugugucuuuguugagcaguggagaaaugaaaauuauaaagaaggaguugaugggaccugguuaguuauucuuugucuggaggcaaggcaaauggagguaauuagagauaagaauugcuauuuuaagaaagagagcggugauuuggucuuguggaauuaagccuaaaauggaaaauuauguaugaggguacuuucuggcuuagcucugagaaccuuuugaggaauuggacucuaggaaagaacccacauccuggaaaagggaaauguuaugcuuuuauagaauaggccauaaauaaaucuauaaaaugcagucuaguaaaguuggucuuggcuauaaagaggucauaacuguggaagaauaauaaauugggcuggggagguuauagcucaggagcagaacuccuccuuagauccuaagagacccugguucaauuaccaguauugcauaacgcaaacaaagccauauuaauacauauacaauaauucccaaacucacuaccauaagagaaaugaaaagaaaguuuguaacgcaauaucucccaucaaacugccuucucccaaaaagaggguucaaaaauggcaggaaggaucauaugagccagaggagucaaggacaccaugaggucacaacccauaccauccacuaagcaggguucauaggggcucacagagaucaaagcaacaaaugcagaccacauaugagucugagguagguucucugcauauaccuuaugauuguguguguuguuuuugugggacuccuaagugggaguagggaggggugccucugacucuuuggcuugcucuugggacccuuuucuuccuacuaggucaccucaugcacccugauacgaggguuugugccuagacuaauuguaacuguugugccuuguucauugauacccuggcaggccugcucuuuucugaagagaaauguaggaggaagagaucuugggaagaagggagguggggggcuggaaugagagugggaggggaaacugugguggggauguaauauaaagaauuuuuguaaaauggaaagaaaagagaguuaaugauacaagcaguucaaagugccugugugugaguguguguguuuagagagaaaugcuacauuccucucaaguacagcguaaagcacaaaauaaagacaagcuauauucaagugucaacuauuuaagaaaugccauugagcaaacccggucaguaccugagacgaccccaaaccaugaacugaaaagcuugucugcuuuugaaaggccuaagacgccaaaugguuaaaaagcuucaggaaagacugugcgugcaggauccagcagccaggcaugcagaaguagucacaggagauaaaaugcuguuacuugccggaugugguggcgcacgccuuuaaucccagcacucgagagacagaggcaggccgauuucugaguucgaggccagccuggucuacaaagugaguuccaggacagccaggacuauacagagaaacccugucuugaaaaauaaaacaacaacaaaaaaacaaacaaacaaacaaaaugcuguuacuugcuucagcucaucugccuggguuauucauuuguuugugagugguuuguguguucauguaugcgggcauacaugugugcauguguguuuaauauuggggauuugugccugucagcuuuuaugcauuuuauucuuagcaaacagaaguucaaaguugcugugaaaaggcacuauugguuuggcuuucauuuugaaauauucuaaacaguuaaauuaagaaaguuuagggacaguggaggcucaugccuuuaaucucagcauucaggaggcagcaguaguuccagccuggucuacagagagaguuccaggguggccagguccacacagagaaaccaugacuugaagaaacaaggaaggggaggggaggggaggggaggggaggaagaagaaaguuuaggggcugaaaagaagguucaguggaucagaacucucccuucucaugcaaagaacaguguucaagcacccacaucacagcucacaaguucaguucuuuucuuuuuucuuuuuuuuaauuagauauuuucuuuauauacauuucaaaugcuauccugaaaguucccuauacccuccccccgcccugcuccccuacccacccacucccauuucuuggcccuggcauuccccuguacuggggcauauaaaguuugcaauaccaaggggccucauucccagugauggccgacuaggccaucuucugcuacauauacagguagagacacgaggucuggggguacugguuaguucauauuguuguuccaccuauagaguugcagaccccuucagcucuguguguaggauacuguguuuccagaguugugagaaauaccugacagaguauaaguagaacacagauaguuugacguucccauccaacaucuguugacuguugcuggggcauguaaguagacagcagagugugguggugcuagcugucuacaucugguaacauacaagaaagaguggaagagaggugcuggagagauggcucagugguccagagcacuuucugcucuaguagaggacaguuucauuucccaguacucccauggcaguucacaaccaucuaucaugucaguuucaggagauccaaugcccuggucugccuccuuggacucucugcaugaacacugugcacauaaccucacacaggcauacauacguaaaccaaaaugaguaacucuuaaagaaaaaggagaacaggguaucucacacauuuugagagcaugccccagugaccuaaacccucacagucccaccucuuaaagucuauaacacacuggcuguuaggacaugucagagugaaauuaauaaauguagaauuuauuuaccauugaugaauauuugggguuauuuucccaggauuuugcggguuuuuuuggggggguggggcuuuuaagucuuuuaagcaaaauagcaccaagccuuucuguuuugaccuauuacaaacuugagcuguugggucuguagggugaguuuccagaaauagaauuacugaaucacagcguauuuuuagaccugcguucaauucccaugcacauguauuaauggauggacagauugauugauauuuuuucccuagcauuggagucacaaggccaggugcacuugaggcacaaguucaggaggcacccaggcuucuagaggaguacaguccucaggguuaggcuccuugccuguccuuuugggucagcuuuccccuccacuacucaguucgacgcucaaugcucuuguucuccaggacaguuucuguccacauaacuaacacgccggugacacaaacuuagagcgaaugagugucuggaaaauaguaacauaggcagaguccauguggaauggcuugguguccccacccuacugcauccuuacuuuuuugucaaggaaggagguacuguaguaacaggacaggcacauaagcucugggccagugcuaccuaugcuuagagggcugugugcuuauaggguaagggagggagggcugcagucuguggguguggagagaauuguccccaagccuugcugaaggaagccaucaaacauaaggcagacaggacacauggauuggaagaugcgugcauguugggggauauagugauggagagagcacuccaagaaagagagaacagugccacaaaaggaccaaagaccaugucauccucugcgguuaguaaaagaaucaggagaacagcuggaaacaaagacaguggucauuagagaccagacgauaaaguacuugagguagcagcuuguuuaagggugaacugcuccaucccuagcugaagagcuauuggcaucugauaggugcuggaagaggagagccagucuucuuuaagaguguagccccucacucuguggaaggucaaucacaguucagcggaaggccauacaucuaagaauauuugggcaacacaaauuggacuugacggauuuuuaaaaaaauuagaggacacaagguuagguagauuggaaagagucggggguggggugaguauaaucaaaauacacuguauaaaauuaucaaagaagaauaaaaauguauuaaaauuuuaaaagcuaaaaccuaaaaacaaaugagcaguagaggacuucuguaugguucagaguaccuuuuagaaauaucuaucacucaacauagagcaaagaaaaaagaugauuaaaugaagugugggagcuagguaugucagaauacugucauguugaaaacaaaaauaccagcaacuugguuagcauuguauaaaagggagaaaggguaaauugacuuuauugaaaaguaauuuagaggcucucaugaccaggacucacuugggugauuuuucugaauccaucacugaguaaauuuuaggucaucauacugaaauagagacuggagaauaaguuuugaaagguacguuuacaaaauauucauuuugguacagauugggcuugcuguugcuguguaacagcuguguucuagaaaaugugucaggaagcacugaaauguguacauuugggaauggcccuaauagcuauuaggacuugagaugucuccaacuaugaccaguaucaaaguugaagccgugacugagauaagauggcagaggcagaaggaugugucuguguguugcuuauaaaaagcccaaagucucccaagucccagacaagaacucugccacucaguuacucccuggugcucgguuugcugagcuugggucucacauguauagcucaggcuggccuuaaaauuugcaguccuccuaccuuggucucccaagugcuggcaaaauggacaugagccuacauccuaagauagucuugagaagugcaguugcucaugacaguagacaagggauaccacagauguugaaaguggcagccaugguaggcgauagaaaaggaaauuuaccauagacgcagcaaaggcaguaccaaaagcucaggugaaucuaagaguuugccuguggggccuuugucucuguugauauuguaggaauaaggagagcaggugguucaugacuccuguaggaagaaauggaaaagaguuugugguacccauacaaccagaagcacaaaugcagacugggaguuuuaggugaguagcuagggagguugaaagagaaaggcauguuaaggaaaacgagagguccggaaccucauuuuagggagcagcauuccuaaggcuccuuugccuggacucuuccuauccugaagccaguuuucacauuagccugccagauccuugucauuacagcaccgcagauugucugcacuggccuuggaguuggcucaguaauuagcucuuccguucuguuugacucccaaauccccuccauucguguccucugugauuuuccugacuaugugugaccaccugcagccucuuccuguagauucaagaagcuucuagugagcagugugugguucuccucucuccuaagaggcuucagaccugcagcaacacggaaggaaggcuauugcacuacaggaguccccguaaacagcugcaggcagcucuaccccaaaaacagauagugugugcagauguguuaaugggaggaagaccgaguuuguucucugugcuguucuaagccucucaccacugugcaagggccuuucuuuuucaagugaagagguacacuguggucagcagucuuuuauaacccauaauaaaaacccuuguaaaggccauuuuugaucaaaugaagcuaaguguucuuuucagaauccauucccauuccuccccccaccacugaacccaaccuaccaccaccauugaaccccacccccaccucucugcacuggaaugugcacaggucaguaauggauaacauauguaaauaaugucacaauucuaguucuuauuuguuaagcugagaaagcaaccggaaauaauuacauaagaaagcuuaccaacccccuccucuauagcauguguguguaaccacuaaguaaaauuuaaaauuacauaacugaguuauauagguguugaugugcaagaacacucaaaagacaaugugaaggaaccuucaaucauuggaggaccccagagaaaaguuucucuaaguguagacuagaaaaaaaauugcauguaccuuagaagguuggauuauuuauuacucugcucacugaguaauaacauaacuucugaagauccuuccagaccuaaggcuagcaaacuguggaguuucaaauuaaguacaggccacaugacacuugauucaguuaaaaugcuaacuguuuaaagauucuguccuuugauguggguacaguuguguuucuugauccuaauaacaaguguuugggaagauggaaagccaaaguguaggauggccauguuugccagugcccuggccaauggugacuguggagccucugauuuaaugaugccacucuggagcccauuccucacucuaggagucuccucacaaccacucuaugagagaggguuguccauucuuugcacuaaggaaccugagacaagauguugguggaugagaugugaccaaccucucagaagacaucaguguaguuuaacccaugaaaaugaaagaucacaucgguccccucgauugcuauuuuucuuuacucucuuuuuauuauucuaguuugugcccuuaguagauuaacaaccuccuuuuucaccuucuguucauccuauaugcuaaacuuugaauaauaaccuccuagucuguauuccuuauccacacuaacuguaagauacaauacuuuuaaagacccagcaauaaagcucucuguagugugguacugcuuuagguguccucuccaggguccugucuggugaggaugcagcugggcuccucacucugaagccccaugcucucuuuaaacuucucucugcuaguguucucuuacaugccagaaacuuccccacaccagacagaccuagcccacagcucagguuggcucagaagcuccuucagccucagugcauauaagagcacaugugcccucugugguccuugucacaaaccagcuugaaguguguagguacaagcucacgucuuuuauccuuguuaaagagccccuugggccccagucucugggugcuguuuuguaacagugccuaaugugaugucuucuauguuguaggugcuucauaguucucuuaaauaaaugguagcugaucaguguguguaauuuaaaauauauuaaaugcuuuaaaauauaauauucuacauaauguguucuaagauguggauggaugaauagauagauagauagauagauagauagauagauagauagauagauagauaguauaacauaaguauacagauaguucagaaccugucuaaaucuccccuuuugagguuguuuccuuuuuguagacauaggacucacaaugaugagagggaccugccuuaguuuauaugacuaguaagcacaagcucuuagcucugaauccaguuaguucauuuucuuuucauggauagaggcugaugggagguggaaggagggugagagcccucugcugugcuccucuaaccgaggaggagagugcuuccuagacugauugcucgcccucacaggccuguacaccccugcccaccccuggaucaguugcuugugaguggaaauaguauuguccugguauccuuggaucaucccuucccagcuguccaccacagugucuaugcagaaggcaggcaggcaggcgacuguguccucuaccaagggauacuaacuucuguuacacauuaccucauugaggagggaagugugaaguaaaccggagagacucucaaaagaaggaaucgagaaggagaacagggaaaggcacgcugucaaaaagugugaggcuguuauuucauuuaggacaugcauggaaauggggaaauagucccauugggccacccaguuuuuaaagaaagcuucacagaaugaggugaauaaauccaggaucauuuggaucacuggccagcaacccaaguacuucagcuucauaccuucguguuucuacagugcugggguuuauauccugcucggaagaaguuauaauuaacauugcauguuuguaguuucguuuccugaugacuuucuacaguggguuaauaauagccguugugaugagguaaugauucuuccuccagccuguccauuuaugucauugcuuuguccccugaauaccacugccauuuugacuuuugcugaaagugaguuucuucucauuucuguguaguuaaggcagagucuuuaccugucucagcauuuucaccgccucuagagaauaauaauaauaauacagacuccuuaaacugccacuuggugaauuaaauuuauacacacaaaaauauuaaauauuuaaaaacagccacguaggccaugcuuuuauccauuugacugagguagaggacagcaggcacuucugaggucucgggccuuuguuucucugugaagugcugugauguggcuugccacccugcuaagcuguuccauuucccucacgcccagugacaggcacuaaguaaagaggaagccaauggggcauaggcuaaccagacucuucuuuggaacagaguucaugugugacucuuggagccugucuccaagcuuugauuaauuguccacuuuaaauucaccauucauagagcugaguguuuuaaagaaucuaccuuaucuggaggcuaucauccugagugagguaacccaaucacaaaagaagucacuugauaugcacucacugguaaguugauauuagcccagaaacuuagaauacccaagauacaauuugcaaaacacaagaaaaucaagaagaaggaagaccaacacguggauacuuccuccuuagaauagggaacaaaauacucuuggaaggaguuacagagacaaaguuuggagcugagacgaaaggauggaccauacagagacugccccacccggggaucuaucccauaaucagccaccaaacccagacacuauugcauaugccagcaagauuuugcugaaaggacccugauauagcugucucuuguaaggcuaugccagugccugacaaauacagaaguggaugcucgcagucaucuauaggauggaacacaggacccccaguggaggagcuagagaaagcacccaaggagcuaaaggggucugcaacccuauauagguggaacaacaauauaaacuaaccaguacccccuccccccuccccgaucucguguuucuagcugcauauguaacagaagauggccuagucggccaucauugggaagagaggcccauuggucuuauaaacuuuauaugccccaguacaggggaaugccagggccaagaaguggguggguaggggagcagggaagggggagagagaguauaggggacuuuugggauagcauuugaaauguaaaugaagaaaauaucuaauaaaaaauuuuuuaaaaaucuaccuuaagccggcccucacuucguaacagcuuauugcucuuuguggguuuugagggcaacauuuucuugugaaccgaugcaaaaagucagucuuauccaugcaggacuguguauagaagucccuaaagauugucauaaccauuagaaauugaccagagaaugcaauaggagcaagggccuuuggagcuuugagauaagucaaaaguguaagcuugaugugcugugcccauaguguagaaagcugugggcacaaucucccaaggggugggugaaccuaccugauucccugaacaggaccuuagcguggcugugcuacucucuguuuaguccuauauuuaaaaauauugcaccauuuuguggaagaacugagggguuuuuuuaaggugcuaggaguagaucaagcaaaccccuguguguaauguauccaaaggacuugacagaggagauaauugcacaccuauguuccaagcagccuauuuccacagaagccaacacccacgggcagucuguguucaucccuggauuacaggugggaauuaauguguuuaaauacuauacagccuugaaaaggaugagcugauacauagccucauagagacuuacucuaaguaaacgggcaauucccaaaugauacacgcugauuccacacgugagguuuccagaggaaagguaggaguugagaggagaggaaaguaggaguugugguggagucuccagaguuucaaguuuugugagaugaucggcucccagguaguaacauuggcucucaggcuuaguauugagcacuaaguuaaaaugguccaaaguaggaagucggcgcuuuccuguacuacaauuaacaauguguguaucaguauucuggaacuacuggcccucacugcuggucucccugugacuuaaccaucaucacuuccugugggcuggcucagauagccugcaccacaccuccuguacccauaauaccugccuucauucaaucugcugccaccagguuggcuggacaaguccugcuuuacauuugacauuuucaaccgcagacuccagacacucuuugggaacaagauauuaugcauguguaggguuggggcuuuauuggaagggccaguucuugcugugcaauccaagcuggccucaagcuccagguccugaguguccagauuacagguaggugccacagcacccagcucugaagaaacuguaaugacgucuuuggaaagaauguggcuugugcauuauaaggggaaaaaugagugguacugucuacguuguuuugugucuuauuuuuaauuuuugaaugaguaaacauuuguacauuuuuaggaauaaacuuugagaacaugagcaaauagcucaaauauauacauauacauacauauauuauaucauaauauuauauauauauauauauauauauauauauauauacacgcauacauucauucauuuuuacuagucauuuucauuuuaaaacugccacuucugagacuugucggauggucuauguuggcuauuucaguaucacuggaaaacuagccugugccucuguagaugggaaguaggacccuaucauaaaccuuuuaaccauuauaagccucggggucauuuuuaguuugcuuauuuuuuauuuaaagcaguaagcagauucaagcgcuagagccccugaaagcaacauuagcaagucuucgagauuccugggaugucuggagucugagggagcagcagagggcugacuucccuuaaagccacugucacccagagcaagccucucucugcccuagaauccugugacaaugugcuucuugucacauggcuuagccagagagaguuggccccccacgugacagcucagcacaggccauuuguaccaaaacuaugcuugauggguuuuagcggaaacaucugaagguguguuuaccuugaagggucaaguugggaguaccccgggguucauggaucucuggucucauugcacugccucaguugagcuacugcaggguauuugggacuuguauaggacagaauaauuuauauuaaaaucuugagcuguuugacgguaugguuuauaacacuguaaugugagauaaaggaugaagauaacccuuugaauucuucauuuaaaaaaaaaacacuucuuguaacugaagcagauucuugaaugauacuggaguucauucauuauuacuguucuguggaguuggaacugugucuuaauuuggggcccaaguuuggaguguccuccugcccuccagacgagguuucccugugugucccugacuguccuggaacucacucuguagaugaggcugaccuuaaacucagugaucugcaugccucugccucucgacugcugggauuaaaggcaugcaccaccaugcccagcuccgauugauacauucuuacuuagaacaacuauucgcgggugucauuagcauggacugacugagagaggguacguggauccacacuauuuaauccauguuaggugugguuuuggcaagucgcauuagccuuucagucagugguucucaaccuuccugaugcugagaccuuuggcugagggaaucuuccugugcacuggguaaagguugucuuuauuuuucacaucuugauuucugugccagcggagagcuaaacacugugcagacuuagguauuguuguuuuuuauuaagcaucaccugucucaguguuucacaaacguuccucuccaucuccuccuguuuggcuucauaaaggguugcaggccuauacauggggcaagagaggaaagguggggccuccaggcagagauagggacucugggaaggaaucagcugcuagagauuugccagcuagacauggaggaaggaacgggugucaggacugaaggagaggaugagccacaugacagaacauagauuagaaugaacuagcuaaugaaguuaugugagcuaguugggaacaagccuagcuauaagaccuaagcauucaucaauaaauauaagacucugugucauuuuugaaguuggugggucaaggcagucuagggauacaguuucuuauauuggggugacccccugccccagccauaaaguuauuuuccugccuacuucauaaccaaaauuuugcuacuguuauaaguuguaauguguuuucuauggucuauggccuuucuacccucaaagaggucacaacccccagguugagaaccacugcuuugaacaaacauuuuggcaccucuacucuaggugccaaaaugacaucaaagaaaacuaaguaauauauuuaugacacuccucaggagagaagacuacauagccacuaaaaauuccauuguaugaaagucguaaggaacuuacaacagcuuucuaauagcuuuauguuugcaucgaugcucugcacgcgccccugcgugagcaugugugcuugcaaagucuaggggcaaacuuccaauagcuuugugcuugcauggaugcucugcccgcgccccuacgugugcaugugugcuugggaagucacuuuucuccuuccacuguggguuccagagguugaacugaggucaucagacuuguacagcaagggcuucuacccaguagccuuucuuccaauccaauaaauuguaauuuaacacacaaaauaacauacauacauacuaagcauuaauuaaauacauuuucaugucuauaaauauaauguaugugucaaaaaggaaacagaaagauccacaaagauuauuugacagugacauuuucucuguucucagcaguuaaauuauauguagguuuccuuccucugcugcauacaguucuucuuuaaacuuacgguuguuuauaacuacuaauuuuguauaaugcucuauauugaaacacagaggcaaugcauacucuuuuacucuacaguucaggcguuuuauagguucacgugggcuuuauuaauuaauaaguuaguccaaguuuuuagcuuuuauacugcgaauugucuccuuaccuuugaacaguucagcaugaaccaagcagauuucucucccugugcuacuuuaagaaaugaugcuuaguggacaggaaguuagcaugaugagccaggaugacauuacuugaaguuagucaugcuuuuuaaaaauucaaugcuuacaagcugugugcauguguucccaauaaagauggauuugccuccacagaagacgacucaguuuggcacccugugcuucgcuuucgcauaguuguugacugauauuagaccccaaguauugcaaggccacuccucaccagagcagguccaauauacauuugaaagcuuaggaaguagcuccugccagcucagaaugcucauuaggagccucagaacucauguccacacucccguaucauugccuggccccucuuugcaccuguggacacugaccuuacaguguugguugccugcguguuccuuuaguuguuugugaaucuggcucucccgggaaacaggaggcaaacagccauucuccccuccccauuaauaauucccaucugcuaaaugcuuccugugugccuaaaacucuccucaaauguugcauuauguugguugauuugaaccucuuauuaggaaaaguaaaugcuguuuucuccaugugacagguggaagagcaaaggauuugauuuucagaagacagaauucuaaacucuagaaaaugacccccaaaccggauguuguucucagugaacugauuuaguguugcucuuaguuaggguucugcugaccuaaucaaauagugaacagaagcaacucaguuggagagagauuaguuugggcucacgguuuagaauagccugucauaggcaggcacaguggugacagcaggucauagcuauagcagccaagaaacagaggaccugugaggaguauuucacauccaaaccauagcacuccauuccugguccucauaggcucauaggcucaugaccacuucauaauuaauacaaacuuuauucaguuuagcuucaagaauccccagaguuaauaaguggaaccauuaaaaaauucagggcaaacucuuagcugugagccccuguaaagauggaaaacaagcuacauucuuacaauguauauaguaacauggaauaaacacucccauugauugcaaaagggaagaucaggaggauagcaaugaaagcacgacugaaacucauugcuaucaucuccaauaguguguagucuccauugacauauaggcuucuucccuuccacagcuguacacaucagcuucuuagaucuucuuaccaauuucucucucccuacuacacaguuucuuuucuucuggaaccuugaggugagcaucuauuaccauauaacugcuacauucugcuugccuggcaacagcaccauaagugauaaguucugaugccagcuugagauggcugcaguggcguccaagcaccugcaagcaaaccagggcaaaugccucccugugcagcccuuugaaauaggcgaucuauguggugcuauucuuuguucgggcuuauugcuuuuaaaucugggauucucuuuucagaugccagauguuaaaaugaacuuacaguuuuauacucugaccucuucuaugagugggaccccagaggcaccaaugucuuaauggagaguguggcuucucuuucuugucacucauuaaucuccuuuacagcugaaauugcuuuugccucauguccucagcccuguccacggcucuagggcacucugugcucucaaauugcagauuuuucuuuuuucuuuucacuaucuuguuccauuuuugguuuugaaauccuauuauaaaccugucuaaaugcagcgaacagugaccacaccagagccuggacacucugucaucuuaaaguauccucugccuaacaaucccauuagguuuaaauuuagccucacucagccauucaggguacagcagaacucagucacauuuacuuaucuugucaguuaucugcacuccgaucccugguugaauucuuguuuugucugaaaguucaugaugacagucugcuguccacauuuggcacucuggccuugcacacucucaaugaaauguuccuguaaguuuguucugcuuacagcauccuaggacuccuccugcaugcuuccugcagaccacuucuaaccauuugugagccauguggccagguuuaucacagcaacaaucugucuucccauaccaaguuuguauuaguaacuguuauguugcugugacgggcuaucugacuggaagcuacuugagagagaagagcuuuauuuuggcucacagcucaggcauuuaccaucuaucaagggaagcagucaucucaaguucaggguagagauggcaggagaaacagccauagugaaaacaccgagucggggacuuuaaauagcuugccuugcuuucuguauuucuuuccuguuuaaauaauaaagggcuguguuaagagauuuaaauuguuucguauuuucuuuugguuuuacacuguucacuaaaucaguacccugguguugugaccuugauccaauaucuagcuuacuuugauaugauaguuucuugaccuaugaaaauagggcgauuuaucucagaguugugguuuaggcuaaguaaguugcuaaacagaaaacuuuaagagaagugacacuuagguauaagcacuauaaaaauaaccguuuugaaaauacuuaaauuauauaauuuguuguauacugacaguugaaauuaaugaauaaaaaagucugugaaguaaaauucaacccccuaagcucgcucaguccuuauccuguguccccccacucccacccccgcccccaacacuaaccaccagugauuguuugagguuuagccuuuuggaacauuuccuacaccagggaaaacuauucuuaagcuguccuuuccuaaaaaauacucucagggaguuguguuugaugguguccugugggagcaugagaagugggggaagggagacuggcaucauuucaggcaacugcugggaauucuguggcucgcacacacugcuuugagcaccugcugacuguuguauguuuguuguuuccugcaggauaugauguuucagcuucuccgaggucuggacuuucuucauucucacagaguagugcaucgugaucugaaaccgcagaacauucuggugaccagcaguggacagauaaagcuggcugacuuuggccuugcccgcaucuauaguuuucagauggcccuuaccucggugguaagugagaucauuguccuggcguuaaauguagucuuccuguuuuaauugacaaacugcccccuucauucuccuccugcuguuucugcccacacuuagucugugaacggaaugucugugugcuuuuuucgcuagcuguggcuaagaggaaaacaagggcuuugcuuacuacaccucagacgcaucugacuggguuuguuauggaugggaaccgaucacagaaauagccuguuggcaccuuagccacuagggaggagucaguuagaaaucucuaaaugaguuuugcuauuaccuggauuuuuaaguugcauacauaauguggaaggcacagcuuggauaaggguaggacaagcaggaggagugccaccuguguucugugguguaacuugagaaacagccacagaguucugaaacugugauacuucagggacuagagaaaugaacuugacuguggaccugaacuacuucccagcccgauggaagcaucaugggccagaguagagaggaccugaggccguguuuuggcagagaacuuaaguccuccuguucuuugucucauucagauccauggccauaauaagccuuaguauuacuuaacuccaguuucucuuuauaguccaucugguggcagucuacagaaucuuaagaggagcacccugguagucaguaucaauaauucuuuucuuauaaccugcuuuguauguaguaaaugugugaguagcuagaagugaaggaaagcugcccacagacauagcgaguuaaaacuuaggagaaaaaaauccaucuucagccucaaagaggcucugaaaccagacccuggccuggaugggggcccuuguugggaaaugugaggugguacgguuggccauuguagugagggaaugagauggcugcuuccauucuuggcacaugugcugcaagaaggcugacauucuacacagaaaaaaacaacaaaaccugcuuccccaggguccugcagugucggccuggaaggugaaguccaggagaagagucacuuggucaggaaaaacguucaacuuacaaaacuuacuugugccuccuccucuuucccucuguaugccaagcucagaaaucccauagccuccaaacccuucauuccugucacuggauacuuaaccucuggagcauucucuaaaauacagugugcucuugaaagauaaaucuuacuuuguucaguguuugucagugccucagagaagacacggcccaaguagauauuuaaagaacaggccucagcuucggguggagugaggcaagcccucagacuuuuacauaacuacaccagaaagggcuugagucugugugcugccccaaugagaaggaugagguaggcuuugcgcuucccuaggaauuuacugugccuguuuugggaaaggggguccugggaagaagcuugaauaggcuuugugaucaucugggagcagaugaaggaacuaaucccugggcauauuaauuggggggaaagaggaugagucaucuucaucccccuaaguugaacacaauaacuauaaauaaaaacgggaaacccaguugaguuucguuuaauuuuuuuucucguuaaauuuagaggauaacccagcuuguggguuacaucaguugacaccccaugcuugcugaaaguuggcauguauaagcaggaaaacacagacuaaugauuucauaucccaagaaaaggacaagggcaaacauauaucuauuacuagauauauugaugucuaguuugcauugucuauuuuguauuuacuauagugacauaauaaaagggaaagacuuaauuccaaagaaagauguucggaauuugaugguaacauuaagagguauguuuucuuuaggguacugcauuuuaaacacuccccacuguuacuauauuuuccugcuuacaggaaaaaaaauccaccugauaaaauaaugcuuugauuuuuacauacaugcauaaaaacauaaucgcugucuuucagaguaaacugauaaauuauuuuuaguauucuuuuaauaggcugcacuccacuaccuagaaauacccauuuuacacuagguuaugucacacaaggaaauggaaagccacguaauuugcagacaggcaagagauuugcaaguuaacugaccugagaccaccaucuuaacugcugugaaaagcguguacauugcucauugccgaggcuugaucuauagagucuuuccugagaccccuucagaaacugacuguucuuuccuuggcguuauuuucuaucuuguugguaguuauuuggggcuuuuauuuauaaagcagcggugagucauuugaagugagauacucagucuugcuccaccuggauguucuccugggcauuaaagaaauacuuuuuaaugaauaaguuaagacaugccaacauguagacacaugcguuugagucauuagaaaaaucaggaaagaauugcuuauacauuuaaugguuucaguauuccacaucgcuccucacugguacuaaagccaaaccuucaaauucccaagcucauucugugucguuguguugacugagcccuuggcuggaaucucugagcaaaaaucaugacaguuauacgccauagcuuggucuuaugugagaaccgaaagauggcuugaacucaggucuugcauuuacgguaaucuucuuugcugaacuagucaccuggcugaaucaaacguuuuguccugaacagagaacugaaggacauauaggaauauuguaccucuccuuacuaaaggacauuauuucuaacucauuguauuuugauauuagcagcuuuagaagagguuuuauauucuucuaagauaauuaacaucuuccaaauaaaggaauaggagaauuauuagacagcuuuuccuauuuucuucaccugucucugugugacugguuuuguuuguuuguuuguuuguuuuguuuuguuuuguuuuaacaauagcuuguacucuuagagcuuuguaaaaagcuuuacacauuuucacaugugacuuuccuccaaagcucuuucucugaguccauccauaucuaauggucauacaauccugaaaacauuuucccauguaaaaaucaccagacaguugcaaaccuuguaaggcugcuguuagagacauaaaauaguacaggaaacaaugaaggggauuuuuaacggcgcuaauaagauucugaagguuuaguacugccagucugacacuucgaacugcuuacacugcccugagccagcugagccagugcaguaggggugggugggggugugcgcacaggugcgugcgugcauguaugugcauaugucccugucucuguguuguuagcacuugguaaacagugaagaaacucuucaauuucagacaacagcuuuuauaugcuuaggggagguaaggaaauggaguucuggcuuucagucaacaauucccagucaccuccucugugcugggcucuguccaccaccuuagaggagaugcugaacucaaguggacagggugucugcucucagagcuuaaagcagaauugggaaguagaucugagcacaacagucucaggaagcaaugugccuuuagaaacagcaaaauacaaccgaggaagaauuucccguucuguggagucacaugacccauggaucuacuagggcuggagcuagagaagcccacacuggucaccugugccaggauguaggaugucugcaaaggucacagcaucguccuuccagaaccugucugcauucagcuccacuggaugugugugcaucaagccaucugcacuuguuuucucuaugugugccuggaaugaaguccuugcaugacacccaguuggcacgcucaagugacaaagugaaguaggaccagaaguugaaaacaaugucaucuuuuacgcgagaaaauaaauucuuuauguuuguuuuccucucugugcauguuguauuuacuauggagaccuggcagggauugagccucagcccggcagcugagcagcucccacagaagccuacggaggcugccagugcauaccgaaugaaucaaauccagcauuaccugaguaucacaggaaaaccccaaaguccugucgccucagcaccucagcaaaaguucaggacacgccucugaagcaggaaaggcuccuggaacgcccuccggucucaacaucucgccaugacacaaacaggacuauuuuguuaauacucgcaguugccaguacauauuucauagcuaacaaugggguguuuguguggguuucguuuucacuuugaccugugagggaaguggaguacaauggaagcagugcagagcugggaagagaacacguuuucuuuaggauucccaaggcugcguacguggaaaaugccagggccaaaacaaacacgagaccuuguccagaucccucuguugcucauucucggugguaauaaaacacgguugagucgcugucugauaggcugacucugcucacagucacagcggccaccaauggccacuguaugaguuucucccauguacaaaagagaaugaguucugcgcuguacagaaaaccgcuguaggcggcugugccuguuacaccagcccugcugcugagguggauccaugacugucuccuuguccauagaagauaggcguucauuugcccaccuaaggccagauccuucaugaguggugacuguuaugaauuaguucagacaaaaauaggugagcugugaagcuucugccuggggaauauuuuacucacggggaaggauuggcuuccucucaaguccucuguacaaguuuggccagcauaccccaucuagggauggugugcauagagacugcuugucuccuggcuuuuuaugucuugucauaaacauugcauguggugucacuagaucucagaagccugagaucagacucaaauguaaagauagcacgugugaagguuguggagaccaggugcuuuagugaggccuugcaagccgugguuccccggggcuccagaagaugacagaauaucccugucucuuaccuuuagcauuccuaagggaauacauuucagugccauguuaggcacugagcaauccgaaacuuuaugucauagggcaacuuccucuuugcaaguuugccucacuggaaggugguguuuccauacucugacugugaggcgugguccuuagaauauaauguaaaacaauguuucuguaacuaggauuuuugugcucucuuuaauucuucagcuauaugaacuucuuguuugcagcugucacaacuacugugugaggcagggggagguagcuguaccuucauuuugucugcgcuuucguaaucucauaguauaagucaagauauguuaaugaaauuuuguagcauuuggcuuaacuguucugagucauucaguucucguuuuacacagagugaguaaauccaugaggccugauucaccaauaccuaaauagcgagucccagcucccagcuuguuuguacguuuguuuacagggcagccccuaccuacuucucucuccucaucgccagccauagacaucaguuuaugcgacuaauuaucuaauaccacaaaauguuucauuguccuuugagcuuguuucccaacuccagauuuucacaauaaguggauggguacauuuccagccccucuccccugcacagccugcugcaucacggccucaguugugagcaccuagaccuccccugcacagccugcugcaucacggccucaguugugagcaccuagacaaaaauuccgucaaaucaucucacucucuuugucccuucugaucauaacuugagccucuugagccccagcagaggaacauuucuauuaggaaugucugucuggguguccuuuaaccuucagauuuuguucaugaucacaaacccccuccccucuccccauccccccaccccccgcaacuuggacacuuacacuuccuggaugcugugacuuuauuuaaagaucaagauuucucgaggccucuggugaaaccaugauaucucaaggaaaguuugaugauaccuccuuuaucguaggucacgugacuugacccaugagggcacuugagaaggucagagguauuguuucuaucucuauaggucuugccaaaaauccagggccauuuucuaaaugaugaugcuaugauacgggguuuccagcugaccucugacccgaccacuauuuucucaaguccauuucucagugauguccuugacugaguccauccucuuauuuaccccagguucuagcucuccuuucucuaggguuuaacauggugagugagugguacuguagcugggccuggugucugccagggugcugaugguuuuuaaaucucacguaacuaugaagguuaguuagacuugacaguuggcuguggaggacuagccugccuucucaucuugggaaaauaaaagaaggggaaaguguaggcgaauuuacuuuaguacugcucauguguuuauucuaaagguuuggcagagucuaaaaauggggcuguaaauuuaacagcucaaccauaaaaaaucccaaaacaaggaauaagaaacucuacggcuucuagguuuggauagcagcauaauauuccagaauuaucuucugccguuugauucuuuuuuucauuuuuaaaacuccuuguuuuucuuuuuuucccaccucuguuuuugauuacuugcaucauaaagguuacccgugcucugcagugugaggacuugucuaauauuaccaugcucugcagugugaggccaugucuaagguuacccgugcucugcagugugaggccgugucuaagguuacccaugcucugcagugugaggccgcagugugaggccaugucuaagguuaccccugcucugcagugugaggccaugucuaagguuacccaugcucugcagugugaggccaugucuaagguuucccgugcucugcagugugaggccgugucuaagguuacccgugcucugcagugugaggccaugucuaagguuaccccugcucugcagugugaggccaugucuaagguuacccaugcucugcagugugaggccaugucuaagguuacccgugcucugcagugugaggccaugucuaagguuacccaugcucugcagugugaggccaugucuaagguuacccgugcucugcagugugaggccgugucuaagguuaccguggucugcaguaugaggccgcaguuugaggccaugucugagguuaccgugcucugcagugugaggccgugucuaagguuacccgugcucugcagugugaggccgugucuaagguuacccgugcucugcagugugaggccgugucuaagguuacccaugcucugcagugugaggccgcagugugaggccaugucuaagguuaccccugcucugcagugugaggccaugucuaagguuacccaugcucugcagugugaggccaugucuaagguuucccgugcucugcagugugaggccgugucuaagguuacccgugcucugcagugugaggccaugucuaagguuaccccugcucugcagugugaggccaugucuaagguuacccaugcucugcagugugaggccaugucuaagguuacccgugcucugcagugugaggccaugucuaagguuacccaugcucugcagugugaggccaugucuaagguuacccgugcucugcagugugaggccgugucuaagguuaccguggucugcaguaugaggccucaguuugaggccaugucugagguuaccgugcucugcagugugaggucgugucuaagguuacccgugcucugcagugugaggccgugucuaagguuacccgugcucugcagugugaggccgugucuaagguuacccaugcucugcagugugaggccgcagugugaggccaugucuaagguuaccccugcucugcagugugaggccaugucuaagguuacccaugcucugcagugugaggccaugucuaagguuacccgugcucugcagugugaggccgugucuaagguuacccaugcucugcagugugaggccaugucuaagguuaccccugcucugcagugugaggccaugucuaagguuacccaugcucugcagugugaggccaugucuaagguuaccugugcucugcagugugaggccgugucuaagguuacugugcucugcagugugaggucgugucuaagguuacccgugcucugcagugugaggccgugucuaagguuaccguggucugcagugugaggccaugucugagguuacugugcucugcagugugaggucgugucuaagguuacccgugcucugcagugugaggccaugucuaagguuaccccugcucugcagugugaggccaugucuaagguuacccaugcucugcagugugaggccaugucuaagguuacccgugcucugcagugugaggccgugucuaagguuacccaugcucugcaguguggggccaugucuaagguuacccgugcucugcagugugaggccgugucuaagguuacccaugcucugcagugugaggccgcagugugaggccaugucuaagguuacccgugcucugcagcgugaggccaugucuaagauuacugugcucugcagugugaggccgugucuaagguuacccgugcucugcagugugaggccgugucuaagguuacccaugcucugcaguguggggccaugucuaagguuacccgugcucugcagugugaggccgugucuaagguuacccaugcucugcagugugaggccgcagugugaggccaugucuaagguuacccgugcucugcagcgugaggccaugucuaagguuacugugcucugcagugugaggaccuuucuaagguuaccuaugcucugcagugugaggccaugucuaagguuacccaugcucugcagugugaggaccuuucuaagguuacccaugcucugcagugugaggccaugucuaagguuacccaugcucugcagugugaggaccuuucuaagguuaccuaugcucugcagugugaggccaugucuaagguuaccgugcucugcagugugaggucgugucuaagguuacccgugcucugcagugugaggccgugucuaagguuacccaugcucugcagugugaggccgugucuaagguuaccuaugcugugcagugugaggccgugucuaagguuacccaugcucugcagugugaggccaugucuaagguuacccaugcucugcagugugaggaccuuucuaagguuaccuaugcucugcagugugaggccaugucuaagguuacccaugcucugcagugugaggccaugucuaagguuacccaugcucugcagugugaggccaugucuaagguuacccgugcucugcagugugaggccgugucuaagguuacccaugcucugcaguguggggccacgucaaagguuacccugcucugcagugugaggccaugucuaagguuacuguccucugcaguguaaggccgugucuaaaguuacccgugcucuguagugugagaccgugucuuuuucaaguacuugguggauauacuugaguuggugcaacucauggugucauuaaauacuguccguaccuugugaaggcugggugguuucagggagguagggaccgcacaugggugucuguucuugugggaaaacaugcuucaguggcuuacuggcacugggucuggaauguggcauuuaaaaguaccuuuuugcagugggaaagaauccugucaagaauaaacagucugaccuuguuaaaugggccaaagucugucuguaaucuaguuccagaaaacuagcuuuuacuaguuuagagaaagcagaucagugggggaacgacacaacuggaaccuuuguaaaggaaagaaaacguugcuaucaagaauguaaaguggaauucuaaacugacaggccucacuugcacuccugaaaaugucuuuaccuggcuauaaacuccccaacuacugaagaguggguggaagaguggaccucgguuggccagaaaagcagguuuucuuuuuccgggaaauacaggacuugcuuacaggagggaaacugugggaguggacaugcaguguggaccauugugggaaaacagcaagcucaaauugccagugccuccgaaguacccacaaguccgugcucucugaguucucccuaaacacauucacacaccuugugaucugcccaucccaacacugugacauuuguguccccacgccauuagacacacacccccaucuccagcagauugcuuccccccuccucagccuaaugaacuccugaagacuguuccucaccugucugaagugggccugacucaggaccacugaguguggccucuccuaccugcuuuugauuuuccuguauguaugggucccaucuguuuggccuuuguccccugauuugcuagcauugugaaauauguuucagagcucagcacacugcacaagcccauggcaguugcucagugaacguuuguggaacgccuguguugaaauaagagguuuguguguagagcagauggaagaggcugagguuuggaaagaccuuccaguacgcccucgcuucccugaaaggcacuccuacgccucuuaccuguagcaucgggaucccagcauguugccuuaaugcuuguugcuaaaaucuaguauuuagauuucagcugugucacagaaaauuaaaauuuucuugguuacccagauacaugucuguuuggauugucacagaccauacuuagaucuuggugaacuacuucuaaucauaaucgcuucugucacaaaaugaaaaauuauucaguauuguuuuaaguugggagacuuuuuaauggaguuagaguaaagaucaaauccuaucuuauguucuaauguaaauauaaacuuuaaaaauugugaauccguguggaugcacgcacacgugugcaugcacaaacacacacaaacacucacaccauuucuaccagagguagaagucagauuucacacuugacaaguauucuacccagcacacacacccugaaacacuuaacuuuaaauuaaguauuuuaccaguagacuucuggagauuauuuuuuuaaauaucuuaaacuuaagggcugaacaaaugguucagcaguuugaggagcaauagcuccucuucuggaggaucagacaucugucugcaacgcggguuccagggaaucuaauacucucuucaggucucuacgggcaaugcaagcaaaacacccauacacauaaaaugaaaaauuaaggggaaaauacauuuaaaauauaauuuaacaaacggaaacacguuuucauaagccucugugauuauaaaugacauggcacuugugucgagucaggacagucugcauguugagggcucagacaggcccucaggauugguggcgagugccuuagaucacugaucagugguugggucagauccugcuuuaaaacucuuguguuucuuuaaucaggauuuuuaaccugcguucuuuuuuaauugguagaguucuuuugaggguucaguguuccagaugggucacugucagugugaugaauaaucuuccauuccuuuuucuguuugaacaaagcucaaauaggugggcuuggggcuaggagagaguuuaugauauacauacaggccacuuguuugcuccuuuagcauuucuuacuuagcuuuuuguauuagacuuagccauuuuuccacaccuggaauccagucuaugugcucuuugucuuaccuucacugugcaaauguuuguaaugcugcuaccuaguuucucgggaugagcauuugaagucgaauucucucucucucucucucucuaucucucucucucucucucucucucucucucucucagcaaacuccuuugaacuuguucucuuaccucacuaguuuggggaagccauaaaaauaguauuaucaagauuggaugaagcuggggcccauuugagaauucaguguucuccaagcggaucgagcuucgcgccccuccucucccuuaacugaaugccugugagcucucugcuucaucucuuccagguaucucugugcacccccuuugugucugcccacucauaaagcauccaaaauguucugacgaaagucagucuggcaucuccggccguggcugucaauugucugcagaggcaucugcaucuucugucuugccccaggauccccugugagccucccugagcuucagcccucauucccacuuacucccucagagcucugccaguugaugcuuggcaucagaagcaucaccugcucacuaccucaccagcucacuggguggccacucucaguggcuaauccccacgcgcucucccuucuuggacaccgucacuggugaucaccaagccugagaugcucagauuuuuaaagauauuguuugcaugagcauauguauaguuacagguacagaauaauaaauacaauguuuccuaauuagugggcauuaauuucucaacauagcaaagaagucuggagauagguaauucuacagcugguguaacugggucaguggugucaccuuggauauuauaaucaaauacugaagaaaacaaagccuucuuaauugcucaguguauugauuaugccuucccucauagccucacgauggcugcuguauuucaguuauggugucucugcacuacaacacucuaagcaggaucugaaacagugggagggggggcuaggugaauuucacuaucuuuguucaguaaagauagucuuccagaaacucacuucagacuuuaauuuggguuucaucacccagaaccaacauaccucugccuaguccagucacacuauagaaacucuuauggcuaccugaauaaaaucagauuauccuaggcaggaaauggggauggcugcugguacaugccaaugaggagcccuucacucccaaagccacagugccucugugugggcagaaacuuuuguuauugcuuccucuccacagcacauggaucauucagggauuauauauauauauauauauauauauauauauauauauauacauauauauauauauauauauguaucaucauuuacuuuauucuguaacuguuucacagauguugaaagcuuagaucgaagaugaaggcacucuacgccaaccagagccgauuuccucagauucuucaauagccuuagauaggcaaucagcaaacaucugcugagcuugaaaauccccacaaguguuuuacagguggugccgucacacggaaauucagccucguguagaaaugaaggcuggguuuuaaaaagguaggagauuuuuugauucugugaauuacuguuuaaaaauaaguaauuuuauuacuagucaugcaacuuauauugcuaacucaguuccuuaaauuggcauaaguugcauacaugauuagcaugcacauaucugucugcauagcuuacccaaccaaguaaauccaugugcaucaagaagcaaguacuguuucaucuuagaaagugcaggaaggcuucacaggggggcuaauuucugagcccaugcuucaagaaggaggaggagauuggauggcgaagcacggauaaggcuguguucuaaccacaaagcaugcacacaaaacauggauguccaaguugacgagcccagaagugcaugaccaaaaccacauguuuguguuguuguuuccaaacuccagggcacuguaaucaauggggugguagggagaguuuguguguaugaagaaacugcuggagaucugguggcagccugugaaauggaagcaaucugaucauaugguauaugugugugguguauggaauucucaaagaauagggguuuucuuuaauugcuggcagggagauuugcaugaacauugguuuuauuuguuuguuuuuucugcuauugcuuuuguucugagacaagguuucaucuaugacuguagccuuggccugccugaaacucaaguugcccugaaauucacagagaucugccugucccugccucccaagugcuggaguuaaaggcaugugcuacuauaccccgugugaaagcuguuauaagacacauuuguguuaaagggugggguggagagagagagagagagagagagagagagagagagagagagagagagagagagagacuggauauaaagaggggcucgagagggaaaaaugucucuuuaacucguaagaaucuuugguccuaacucucguuaagucaugcuguuucuggaaaccaaguagacaaaugugaucuuugcuguuuucacuagcaguaugcuaacuacacgucauaauuuccccugauaaaucagcauuccuguugaaagggaaaugcuauuuuauggucaagaaucuguauaacaucucucaguaguugcacacuucagaauuguucuacugguuuaguauuaaagguacuaccaaaaauuaguuuugcacuugcaaagaaauuuuaauauuuuuuuaaaauaauuauuuaguguuggggugggacuuccagaggucagaaggcaacuuaaagaagugccauuuuucuuuccacccugugcauccuagaagucaaagugaggucuucuggcuuaacagcagguguucuagcuacugugccaucucagggaaaggggcucagcccucuuuuucacaaucuaucccuccccugcuugaagaguuaaauaacuguuacuuuaauuuauugggccuaaaguaacaugauuauguugugcuuaauuagauaccuugcuguuucucucuuuuuuuaauccccauaauccagguuuugcuaaaguugacaaauuauauaccucaaauguggucauuauaggacuaaucccuaaugagugaguacaauauaaacagccacaaaagagcacaauuuauucgucaggagacaacaggcuccuugaggaaagagcugggacaucccauucuuuaggcucaccaaguagcaauugguagugagguuguacuucucagguauuuggagccauccuacagguaucguguacucacuaugggcauguuuauguggccuugguuuaccacaguccguguuuguugguucagcucauccauucaguucuuuuuuucugagauguguuuauuaaaauguauaugugaguacacuaucacugucauuacacacaucagaacaggacaucuggacccauuacagaugguugucagccagcauauggugguuaggaauugaacucaguaccucuggaagagcaguuagugcucuuaacuaccaucucuauagccccuuccauucaguuuuuuacuaguaaccuagauuugcuuuuaaugcucaaagucuggaguucaaaguaguaucugaaaggcugagcagguaaaaaaagggacugguucuuuuucagcauuuuauaagcaguaccuuugcuugaaguuaucuucugcuuuuaccugcuucccucacugaaccuuaaaggaacaaguuuaaaacuccccaucaggguuugggaacguggcuccggggcagagugcaugcccaucauagacuaggcuucgaguugugcugugguacaagggagggaagugggcauuguguacacacugcuuaugaaaguauguuuguuugaaguuuuuaagaaccagaagguucugugagacacccugccucaguaacgaaaauggaaagccaucuaggaagauacccaaagucaaaaaucagcccuaaacacacacacacacacacacacacacacacacacacacacacacacacaacacauaucagcaaacacacuggacguacauacacacauucaggauaaaggguuccuuucugcaauccaaaugagcacuuuagucuucugugugcaaucaaucgucuuguguucuggagaucacauucucuugggaauaagugguaguuaauacuggaaaaguguguuuccccaauagauuagagucuucucugguauguaaaugacucacuaaaccauggauuaggaguuuaaugucacaaauagcauagauuucuuaagaugugucgcauaagaacucucccagcuacuagaccuguaaagaauaucauugaaagaaauucccgaggcucucagcccagccuuuacauaaccugcacugucuuguugagcuuuacuaagucgcucaggaaugccccaucuacaaagacguugguaccuaaaccaacaccucccguuuggucugccguucuaaagcgguguguguggcauuucauacaguugcgugcucucauucagucuuugacagcauugucucgguguuacucuuaccuaccuaguacucaggucuguauuucuguuaaagcacaguaccaucuuuggaaacaaagccaugcucucucgcuuuucuuagaaucaggauggaggugugguuuggccacaugagcugugcuguauagaaauguaauucaggagcuuauacaauguaaccugacugggguccugcuuucuuuggacacuuccuacucugaacucccacuuaccucuuagggacccucauucagccuuaguucucaaauuucauguaacuuucuuuuuaauguugcccaaaguucuuugagauugggaaugcucuggccuguguugcuaagccugugaaacacuugugaaguaaagccugugaaacugcuaguuacuuguuguucacagcaucccuuacucuucucucuuagugcuacaggauaucauagaagaaacaucacugcuagucagaaggucuaaugacuguguuuguuauaugugaauauaacagaauauacucaugaaauaaugaaguuuucauauaaaaagaagccaagagaauuuauagccaagacuuuuuaauacugggaauauuucaaaaagaaagaaaacaauucuaaaaggaacaccugagaugcaagaaagaguuauggguacauaauuggaugaaugucuaaauaggucuuuaaucacaauaaauaaaaauggaaaauacaucacuuaaaaagcaaagaauaugagauuagacgugaaaaaccuuauugaaaaccagcucuguacauuuucuugaaacugauccucugcugauaggagauauaaaaucaugcuguucuuugugauuuuggcaauaacccaugcuguuuaacauauauguacuauggaaacccugccuuuccaugucugguuacaugcuucagaaaaguuacugcaggugugcacuaggauucauguuagaccaguaacagcagcacuauuugcaacagccaaaaaaaucacaaauagcccaaagguucaccuaucaaaugcugagguguacuuugguuaacaucguacggaguuaaauaaaagugagaauugaaaugaauaagcucuaacaauaagcaauaauaugcacaaaucuuagaaacaauagagugaaaaugauacaaaucauuuccuuauacuuaugaagugauacagacaaacauuguuuguauuuauuauaugacaaauguaauguuauuaaagcaaauaaaugaaacauaagaguuagaacaguggucauccaugaacgcuaagagguaagggaaucauauuacagguaaaaagaagaaaauaggguggauuugugugccuagguagcuacaccaccauuaauuccugacacuaauuccuucaaaaagagacuuuggacucuuuuugagacucaaacuuauuuuuucuacaauuuuugaagguuuuucuauaugguguuugcuagcgaggcaaagaugagagugaagauguuagugugauagauaaaaaucucuccuuguucuuaggaagaaaauacaugcuaagccaguaaacagguaccuguauuguguugcuaagauccgucggggcuggccagcuagucuguucuaucgccuaagcagguaacuuagggaggggacaucuugucaagaagagaagguucaggaaagagcagccuggcagggaaauguaggagucucaaagcaaggcugaguuuggccaauccaggaagagcaggagacuuggauuguggcuggggcagagcaaacaggagggaaugguuaugaccuagggcagagguguggaauguucagucugccgcaggagauugggaauaugaagguaguccuucccguggucuucacgauacaguguggcccggaaucgaagcagaaacuaggaaagaagcugaagaacacagauagcaaagaaaaacugaacugagagcagaauacaauaaucaaaaauuaggucauguuauugucagaguuagaagagggaaacauaauguuggaaagucaguuauauccaaaucuuggucuuaucagauaaaagggauguuagauauuacccaagucuccccuuucucccucucccuccacccccuuucuauaacauacuuuuaaugauguaucucugucaagaagugugacgucuuuauccauagaugagaaaauuugcucugugcauucauuacuugauauugaugaugguggugaugguggugaugaugauuugacaugguuuucacccauccugaauugugcaguguguguaaaaugaguuauagcauuguuguuauuauuauucagaguaaaaggaaucuuuucaguauuuccaaugcuuaugacuaaaugaaauccccaccccccauuaucaugcucagaguggauuuacugugcuugaugacuuuagcuuuagagccccuuacucauagcaccgcaguguacacugacgcuuugggagagguguuagcgagaugaucauuagaaguaagcuguugcaggugcagcugguaaaagucuagaccaccauaacucaugccuucucugggcugccacagagcugaccaguggcguuuaugagaucggccagaggaagauugaccagcuguggguucauauaaaccucaggaaggggguucauuauuacuuuaugguuuuacagauugaacuggucuggaaucauuuuuguugucacaguggguuuggggggauugggaucuaguggguggcagacuaugauacuguuaaguaucauaccgugcacagaacagaccuuagauugacagcugucuagcuguaaauacccaaagugcccagauugagaaaacccuuaaaaacaaguaugacuagucucugaccccuucauaggaauggcuuccaggaguuuccucccacuauccugugcuagaucaccuggggucagagaucgucucucacugugaguguggcccaugguaucuggcagcagaagucugugggugguagaggaggaacaagguuugaaacauaccgggucuccagccaguccaagggaaaaucugugaggcgguaacuguguauaugugaauacaggcaaaggagucucaccagauccgagccagaauggaagcgcuuucauaauuacuagaucauaguaacauacuuagccauuuuuaaagccuugcuuuuugucuauucgugagacacauccuugugaaaauaaucgaagagggucagugaguugguccaacccguaaagugcuuccugcacuugccugaccaucugaauuuugauccuaggcuccucagaaggagaagaagugauucccaaaaguugcccucugaccuccacagacaugcaguggaacacauauguccacaccagcaugcacacauacacaauuuuaaaaaauaauccaagaacuggaauguuaucuuaguaguacacuuagcguguuuaaagcccuggauucaacccucaaggaccacacacacacagcaaaccugaagcacaaaugcaaauucacaugugaaauggcauguuugugcaucacauuucucaaugcaaauacuugugaucauuuuaccuuuuugcacacucuauaaaaauacuucagaacuuguuauauagaaggucuauaagauauagcuccccccgccacugcccaaaaaacaacacauuauuucugcauuuugugguguuuguagaguuagauaauaugcuuaaaguauguaacuuuaagcuuaagaaaccaaguaccugcuccuggucaagguaguaccagcucauauuuauaccaaguccauaaaccuauaaagcuaccucaacuuauauuuacaugacacauacuuacaguuuagucuguuuaucugugcacaggcucaugccccucuguguccucagacacagggaucuucuaaucucccuaccuaggagccugaggcugacuguucugauuuccucuaaaucuugacuauaucaucucucugcugggucuccugucuuccacagagagcagguaggaaagaugaguuaacacucacugaggaggauugcucacucaggaugccguugacccugggauuccagcuuguggccuucaucuagcucggggucuucuaguuacugucuauucuuccuuugauuucuuacaaaugcccagcguggcuucuguggugcuguggugcccugcuuuuccucccuauugccugguucacuccuguuucguggauguucuuccugucuggccaggcgcuuugcuuugucuaugugugcucucucggcuagcacccuccuccaggaggugacccugcagcccugaagcuccacuuacuugcagcucagcccaaucucagcuauucuuccucuuaagcuacaggccugcuaaccuaacguuuccugcuaaccaucucauugcccagaccagaaacaugggauuuauccuagauauuuuuccccuucuuccugacugcuaaaucugcuauuccuccugccucccccuccucucuuuuacucacugccccccaauaguuucuuuagguugucuccauuuuucuggguaaguccaaccuuuugauugagcucccugccuucaagaccaucuucaguucuagccucuguauuugcuggaaucaaaugcagaauaaauauccuauaagauagcuguaauggcuuuccauuuugcagauguggacggaaacaaaggcauagagaaguuaauuuuguggaggugauugcagcccauuuagaaaagggagucggguuugaacccagguuccuaaauggugaaccuguacaugguacugagccuguugucagugguuugaugucugccuccauugcccagcugagcuuucgggagcagauauggcgucucuggucauccucacaacgcagaagcaaugcuuguccuacaaugacaaacccugguauacaaaugaaugguuggaguuaucaucaaaaauaguuacaugagcagcaauuacauguagaacaaacgugucuguaucuuguccuucuugugcauugugugugaagacacagaggcuauaaaagugucacugugcccugagaaaaacagagcuguuugagaaucauaucuauuugagagaauuuaagugcugggcuuaagugccauucuuaugccugaucuaaauggacagugcuaauuuuuauaaaaaucaauauaucauuuuaaucagcuuaucuuugaauugcauguuauaacaacuaaugacuucucgguccagucauugacuugaucggugcguggggucagacacacucccuugugcucugagaacugccaccugcuuuucaugucagccugcuuugcugacaugggcuccaaaggacagugaaaguucagugucucugagcgugagcuaguccagcauucagagagaagcagguuucccagccuugcugaagcuggcaugacagccauucaucucuggucuguaugcaaaagaaagauuccaguugcuauuuaaaugcaaaaauggaaugcuucaaaaauagguguaggcauccuguggucucuggagcucuugcagagcaucccugagacacagucucugauguccuuugcaauaggagcaugcuuaauuucauaaaccaaagcccaucuaggaaaaaagaaaaaaaauucucccgccccaugcaaaagcuuagaaaugaaugaagaaaaaaauuaauuaaugaugugaauauuaagagguuacuuaucuauuauaacacugggccacaaguugacuaauuaaaaugaauguaggcuggaaggcugccacgaaucuuucacuuagagggccauggcugaagccagugauugugugugacagacuucaggaacaaugguacugcgcagacugucagaugaagcaugcucuucgaaauuacaccgacgaugacgggguggcccacgggcaaacaaaaugguuaaacaauacauaaucaaguuuuuauuugguauuuccugcgaggcuauaccauuugccagggaaaguacuguauuuuuaacuuggcuguauuaauuguugaccauggcuggcagagccccaaacacagacagauaugagagaaaauggcaucugggcauuaaagcucugaguguacugggggguagggggcacaaaaauuacagcauauaucaggaauuuuccagcuaacgauaugcggaugugguagugugagggaaacggagccagacugagcuugcuuuguucgcugagagaggcccucuguaacauucuuuuuagcugugcauauuuugucuucauuuguacaguacuaacuuucuuacucuguagagaaacucaguuccagccgguugggccuaauaauucuauggcaauaauuaaagcucaugaacaacuguguuguuaacugcauagaaguggcuucgcaaacuaaccauaagcugaacuguuuuuuaaguggcacaccauuacuguaaagggugcccauaauuauuuucuucgauuucucgacaguuuuuuuaaggcaucauaaucauuuauacaagcaagagacagugucuuaaaaguuucauauacgacuggagaguccagccugagagcgauuauaaugcacauucuuagccuauaaauaaauguccuuaacuaguucuuacccugaccaucugugauagagaccaucccaccagcuagcuacuuugggacuugguuuuaaaagugcauaacuagccacuugcaaagaugugguguuugagccuggggaucguguuguuuaaaacaagaucucauuugugcaggucaagcugguaucagagucgucacugccuuuccaccucaaccucccaaguucugggauugugagcacaggcagcucugugauuuuguuuugauucaguagggcaggggaaagucccaggguaacacugauccuuucuucaaagguugguaagccuggagcccucucucuaacagcagugaugucauaugugucaaugugaaagacaacgccuggccuucccgggaacuuugguggcagcgguagagguccaucugagugccugguggccagcucgugggcugugaguucugacucugauauguagcuagcuuggauuuagcucugguuacuaacguguuuuaugcacgcuaggauaugggcaaaguauccagaccugucucagaagggccgauguuauauaaauggcaugaaauagguccagagcucuugugaagaagcucuggggaauucgugagcuccucagaucauuccagucugucugcauuaaaguugaauacgcuuaguuauucaucguugaaauuccaaagcagaaaacaagagaacgguuauguggucuguaaugauagccuagaacguuguuguuauugcuauaguaguaauuguuguuguuacuguuaaacuuuccuugaaacuacaauuuuaagauugauugauggauggauggauggauggauggauggauagauggauggauggauggauggauggauggauggauugaggggccaugaacaagcauaugcugagaggacaaccuuugggagucugcucucucauuccaccauguggaucuugacgagcucgggucaucaggcuuaguguccagcacuuuuacccgcugauccaucucuccaccccuaacaacucucucagaagaagcuguggaguggugccuuucaaguagcagugaacuggaguucuagcuauggaguauagcuacuuuuaggggcagaugccacagcgucaccccgucauggucucaucugugaucgggugaguuuccaggggacuccuuuaacagccucuacaugccaauaacauuuucuacuguguuccuuuuugguccucacuaaaggcguggcuguauuggugauaagugaguagguuccaaacaucuuuaaauucacaaaauuccuuauccaaaacaaaguacguggauuaauggaaaugagacucagauaccagaucaauuuuuuauuuucccaaaguaaaucuuaacuccuggaaacauuuuaagcccuuaaaugauauccguguuaucuuaucuucauguuaauaccuuuauaacaucuuuaaaauaauguauuagaggcuaagaauauguauguucucauaguaucuuagcuucuuagcauuaggaauaaaaauuaguacuuuuccauugaaauauuaacaauuauaauaagccagguguaguuagcuuugccuaacuggaaaacugccuuuccuuuucgacaauugauauuuucucuugggcugcuuuuuaagucgaggcuguuaaagauuuagccugucuuuaauuuuaagcacuguucuucuagucauauccccauaggaagcccaggugccuuagccuggcuucccauuggcuaacuggggaaagggcauuucugcauaaauuggaugcuuccuucuccccuggagaccaaauaugcuccuguuuuccaacccccugguuuguaagcuugaauccauugcuccaugcuggaaacugucacuuuguagacagcacacauggaaauccagaucuaggggucccugacaugcccauggguuugacggcagagugaaugaauacauguauuauccauucucccuagucugcugucucugugaugcuccagcugaaaucagaaaccaacguuccugcgagguguccuucaaaaguauuuccuuugugcagcuccagugcacacagaacccaagggguuaacaggagagcagcuuugaaagcaaccaaaggucacuggcggcaagagcaaagacuuuuuaagccugcuuccccacccaggggauuguaaacauuggcuccuggccacccgcugugucccacagcacagaacuucucugugcucaggguucaugguucugcucuuucaugaaagccagcaggcgcucugcugccaucccacucucaugucaggcaauccaaggcgaggaguucugcccugcagaagaugaagguguacccuguuaaugggugcuuccuaugcaagcaagguccugcugguagucugucuuucucaggucuaaggaauguguagagggcccauuauguuccacgauuccuauuaccagccauuugcuaguagcuaacaauaaugcucacaucucuuuguccuuuggcucaauccagggcucucaaauaaaaaagcuggcaacugggaagugccuacugcccugagcccugcuucuuaugcuuccuuucuuuauacaacaacaacaaaccagcagagauccuuagucgccaacaaaggaaugaggcucccguaugcauaauuuaaauaaaguuaccuucaucucaggaucauaguucuuuggugaaaaggaaccaaggaugcaccgacuuaugugugcaucagaagugugcgaucugcaguuuaaucauuagucugacugacuagaagagacuggaacucccagagagauguguggcuuguaucccccacuugaucuguuuagaauguuguaaagaguuuuauuugaguauuauuugaucucccugaagauuuuauggaauuacaguuauuucacuugauguuucucccuuacaugaauucugaaggcaggaacacaugaucacuuugauagaaccacauaucauagcaaguagagauauuaucccuuauguaaucucauuuugauacugucuuuugugugugugugugugugugugugucugucugucugucugucugucuauauuuuaggggcaaauauaggucuuaucuuuaugaaaugaccugugagcauguuuuauaauaaauuuggauguugaucuauaagaacucugucacuccacguacauuccugagugaacaauguuucuaucaguugugacaauagcagcauaagccaccacuccuaacuguauggcacaguuguacagcuauggcugcucucggcucuauagcugcaauuggugcaaugugugaguuugccuuuccccucagucuacaucacacucaaaggucuuucacagccguuucugggauuacaguuuuguuuuguuuuauggaaucacagauuuucuuggguaguuaacuaauguccuguugguucuuuuguuucaaugucaguuuccugagaacauugcuagggucauguauuggugcauacuacaguguccagguggugccagugagcauguaaaaaaaaaaaaauuagagacagagucuuucuauguaguucuggcuguccuggaacuugucuguagagcaaucaggccucagacucauagagauugcccugccucagacucccaggugcugggauagaagguguuuaccaucccccucccuccacuuguaauguucuucuuaacuauaggauucuguucuuugaaagcucuauagaaauaaagguuugugguuucaugauuguguaguuuagaaaacaguggcccaguggcaugaaaguaguuguugauaacacagacacugguguaucuagggaaaacaaacaaacaguucucuggccagaaaggugccucagcaggugucaguguugcuacacagccugguaaccuggucuaguucccugaaagagggccucuuuguguacauacacauacauacacacacacauacacacucacacacaacacacaauaaugauuuaaacagaagggaaauccuguucucagccuagaacuuccucccuuggugagcuauugcuguccccucacuuggcaugguguucccuagugcccaaagguaagguuacuaaauggcuggugaucauaccucagcagguaggcaucauacaaugagugugaacagaggccuacuccucaggcuguggugaccagcauugcaagcugucacuucagagucacugcaucuugcaacuucuccucucaugcccacuuaacaugucacuuuguauugcauuagugaagucuacucagagcuguaacaguaugaccaaagcuccucccagaggcuaauucauagcacuaacugccucuaugaccaaaugacagagacugaguauaaacauaaaagcccuuauauuuaaauuauauuauugaaaaguauguuaaguucaauuuaaaauacuuucauaaacuauuagacaugaaaaguuuuaaacauuuaucaaacaagaaaauaggccugagacauguucccucacaaagacuaacuaaaagaauccuuuggcaaaacugaccagagaaaagcagagucugggggcacaucaaagcacuucacuguuagguuggagagcuuuuagaacaaccuagggcuaaugagacagacucaggcaggguaggaagaaguucuagcuacacuaccccuagacucagccucccuccacccuuguuuccacuaagugggaaaacaaacaaacaaauaaacaaacaaacaaguaaauaaauaaaugugucugcuuuauauauguuguaguuucacuuguaaacaaaagaccagggaaaauauucccgauaaagacagaagauagcuuggaacuauacgaaauaaauauuuauuuauaauuuucaauucacuuuaagucacuguugccucacaagcuuuguccuagguuugagaacuaagugcuggaguguguuugaggagacaugcacugcgccugauugguuaauggcuugguaggugaaucaaauguggcaaaaauaaaaaaggaggagaaggaagaaagagaagaggaagaggaggaggaggaagaagaggagaaggccagcugagaagggcacaaguccagucaaaggguuggcaagguagcucagcagaucugaacgcaguacucuuuaagaggacugccauccacaucagguggcucauagcugcuccagcuccagggcaccuggaucaccuccagccuccacagcaccugcaucuguguacaguaaagaccaguggugacaacauauuacuaaccucccagaucaaaauacuuuucucucgugaggcuuuucucucgugagggaaaucacaaagcucuauuugaaagugauuuguuguggugguggugguggugguggugguggugguggugguggugauguuggagguggugguggugguaguggugguggugguggugguggugguggugguggugguggugguauuuuggaccagucauaagauuuggaauuccaagguuguggcauccacucaccaucuuagaaauauacuaugauuggaauguaugggcuuaucuuugacaagaaauaggcucuuggugguagcucuggcuaauuagcacuacugaaguuccucccaggacagaaguuacugaagcaucccuuagucugauuggugaucacaccuuaccguccugcaucuauguaaugaaucuuuuuagcaugaaccgcacggucauauuugaaguaugugucuguacacacacauguucuccuuccuccacauaggaaacccugcuuuccucuguaucuaccugaggcuugucuucgaagcaguuuacucccucugcuggcucuaacuuuacaaugagagcauaucaaacuggagcucugaugaggaauacuggggacugcuugcuuauguccuuuguguuaggguuucuccaagauauaaaguuaaacuccaagcccaaggaaucaagagaggcucuaaaauucuuugaaaacaauaauaucauucucacacuagugaugaguugcuaauuaagagagucuggcauguagauuuagaguaugcauaguaggugcucaguaaauucgagguucucaguugcaauccuacuuuguuaugcauagauuauagguaccugguuguaggagcuuuagcucagccaguccuuuguguuuccacuguacuuccugggugccugcuuacaacuccagccucacuccauucgcauuauccucugggcuaugaagucuuccuagacaagccuggucuaggauuugucuuuacagucucagucccuguugugacagguugguuacucagagaagaaugucguugaucuucaacauuacagguaucuuccagauguacaaggggcagaaagcuucagucauuacaguuuucuccagccuaccuuuaucaugaagacuugaauaacacuuaccuaaaaaugagugucucuguaagaacagaaauaguaguuaauaucgagcgaugugugguugccaucucucucucucucucucucucucucucucucucucugucucucucucuuucucucucucacacacacacacagagacaugccuuaauuuuuuuuaaggaaaaguguauuuggucuuauuugccuggacuacauuaguuugacugucgaauuguaugaguaggaacauucucacaagcccagcccugcacaugguccuggagcagggauuccuuaggcauuuucccaggaacgauuagcucugcacaguggaaaugaaugcuaugugagagagaaacaccauuuaguuuggcaaaugucugguccuaugccuucaguugucagugugaaguguagguguggagaagagagauucaguauccagauuugucaaauuaggacuuuuuucauagacucucuaggcuggcaguggcuaaacucuuaggaaacaggagccagauuguggggugggugugcugucuuagguccccgagaaucgggaggcugggcaugaggagagaagcuugagcagccuaccauuuggagauuagcugccacaguaugacgagacucacaaaaagagcgaggcaggagaagggaagugggaaaagagagagagagaacuuaaauugaaauuauagucucauuuuuagagcuuuauauucuuaacagauuguuaauacuaaaauuaauuuaacagauuguuaauaaauacaggcaguugcaguccacacuaacaugaaggguggaaaugguuggguggaguaaaaugaaagucacacauuacuggaggaaggggguuuacgaaggucugaauacuagcaaaauugguaauguuuacuaagcauuugucuacuuuuuauguguacuuacauaaaacaagggcucauguccagcaggggacacacauaaaaagacucaaaggauauucauguucauagugacacaguggaacaauacuacugauaugcauaacacgggcagguuuugcauuucaugcugagcaagcagaacuacauaguguuggugcauugcaugauccuuuagaugacagccaagcaaaacguauuccaagaggacaaggguaccuugaguaguucuguggugauguaaauuccagacaccuuguucuaagacuugguuucauagguuagaauuacauguaaauaucuuguccaugugaagaguuguguaugccuaaaaauaacucaagagauuaagaucuuagguggauauacauacagauauauacaugaacugaugcuaguaguggauaaaauguaauucuuuucuuuacacgaggcuuuuguuugguugauuugguuuaguuuucugagguagggucucaaaaccuggcuguguagaccagaccagguucagacuucuagcaauccuccugccucugccuccugagagcagagacuacaggcugcuucuaacagccuaucuacaagagauuuucuuuuaagaugagauaauaaaauugauuuagggggccauauuugugacucuagaacauuuucuauaccuucauaaauaccucaagacagacuauucuucacucucugguuugguguguugccgaucuuuuucggguuuuguuguuguuuuugcuguugcugcugcuagggcugcuguuguuugguuuuguuugucugauuuugaauuuguugggguuggggagcauuuucggagaaauguuuuucuugaucacauaucugacagcuuuuuagugacugcuauaugcuaaauauaguagcaaccucagagaccccuagagguagaguguuaaagacuggcucccaaggugggaagcuaugggaccuuuagaaggucgcggggagggggugucuauuggggcaugcccuugagagugaugguaggacaccuuccaccuucagguuccuuuugcuccuccguucucauugugagcagcuuucagcuucacauguuccugccaugacaccgccucaccaccagcccagacgagaagggccaaccuaucauggacuagaucccucaaugcugugcggcacaaauaaaccuuuuucucuuauaacccaauuauuuugguuacuguguuguaguaacagauaaucagccgcacagcaagauuggggaucugaaaguaagcagugucauuauagaauuaggcgcagugggaguaacacagagguagaaguagauucuuguggucacaccagguaucagagcaagaacugagggagguauagugugggaauacagagcaguggacuguuaguuguuucagaauguuccacaagacuuucagagagguuaucacuaggcccuacuuguacuuuggccacauaugagggucaucucuauauuaaguaucugcagugaucacuaaagggaccuuuucaucuccuggaugauaaacaaugcucucugcagucuucauguuuccuuggguaccacuguaauccugucuccacccaucagccuuaaggauaaggaaacuaccugccacacauuucuagaaagcagcaguauucucugaaauguuuguaaauggaaaggccuuuccuuugaauuagcucugaggucaaagccgagcuuagcauggccuugggcugguacuucuucuuuccagcaguguuugcaugcagcaaccacagugcccccaagcacgcugcagcuagccccggccuaggugagaaaccuucugcugccuuuuauugucacacaggucucucuccugauagcggauguacuuagaaacgcuuuguaaaguccuugguauucgugugguucuuccuagaaaccgagacgguuucaagagaaggguugcagccccugagcaguaagagaacucguacucugcagucaucuauuaagggauuccuuuacagugguccuuccuuccucucugcuuacaaaagauaccugagaauaauuuuaaauucuaaaaauauguuaauguuaaguguaggaucguguuuguuuaauuuuccuuucuguauuuccugaaagucuaaggauauacagauaacacaucaggcccuuuucuuguuuaagcaacuuucaaauuggacuuccaagcugugucuuccaucgccuguuucuccagcuccaguccucugugagcugccguguugucaagucuguaacugggugaggggugaguuugaggaagagccugacucgaggaacugguuagugauuucauuugcagagauagaagacuggaaaaggagaacaagguuggguggaaggguagugguacagaaaaggccaagagaagcgcgccuggcguagcaggcugccagccccgugcagagcauuuuggcuaagcaguucuuccuuccccucucuccaggacccuugcucauccauacaccauuuuagugaaaaccuuuuggauauaaguaucguaggaagaucccuuguucucaucagcuuucugauaaacauacagugcucuagaaauauugacuuuaaaaacaaaacaacaacaguaacaacaaaaacagaacaaacaaaaaccacauuguuuaaaagugauaauuaaacaaaaacccuaaaagggaacgacugaaccagcugugauggugcaugccagcaaucccagcacucuggaggcagggcagaaggaucgcugcaaguucuaguccagccuggucuacauagaaaguucuaggcuagcccgggcuacauacccaagauucuaucucaaaagggggggggaucaaaauaggucugauaacagaacuuagcacgugugcaggccugaguuuaguccccagcacccuucuccuuccccaaagggaaggaagaucugaagucagugacuugcauagugacagugaaccugagucacaggucccaguccugcuucuguuccuggcgcugccagccaccagcuccuugcucucagaugucucucucuguccaucugcccuucccuguugcuggaagcaggccauggugcuucaucaaacaucaaacuggagguuauauacagcacgagcugguuagcccaacauggaacuuuaaugucugccaugcuucacggauauuuccuuucccuuuucccuaccccuguccguacccugagauaaggcaagaagaaggagaagggagaagagagaagggagaggggaggaagaagaagaugaagaagaagaagaagaagaagaagaagaagaagaagaagaagaagaagaagaagaagaagcagcuucauagaaggucuaaaaucccacaaaagcccauccugauacuuagcaguucuugucagaaaauaguucaugucucagauuccuagugcuguaaucugaguccuucucagccugcaguuuuauaaucuugccaaacgagcagcaugggacacccuaaucuuaaagcauguuuuccuuuaucucuuuccuuugacauuggucagaaagcacucagaguccucugugcuuggguuugcuucugguagcccagacggguuggaauguuuaaggcugccuuucuuuugccccauauaccuguugcacauuguagaugagagaccauauggaagccggugcuauacaaggagcuacaccuuggugacuccuuuagucaaggaucuccagcccuuucccauuuaaggaaggcaguggcccuggaguugaacauuguucaggaguggggggaggggcgcuuaguuuaacagcuaugcuugcauuugccccuggccacaucaccaggcuggucugcacgcagccuuguguaaaaauggacacacggacaagggaguaagaaggcacaggcugcggaaccauuuuucucccuaacccaaacaaauccuguuuuaaaguuuucuuugaaaucugagucauuguguggccucccaacacaugcagguuaaagcaccauuucauaggaaacgaugagccccgcaaccucucacauccuguacucaggaugauuuucauuuccacuucucugugaagguucaauauuuguuuaguuucuguggugaaggcagagagcaaucuaguggcgauuguuuauugucaaaaccaaagcuacacuauuacuaaauuuuugcaaagagagauaaaccuauugccuggaacauaauagacacuuugcaaguugugacuguuugaaguuucacaaguucggcaugaaauuucaacagugcggcuugagggaaaccaugcgccugucugucauuuuaggacuuaauuuacaaggauaaaggugcccugaggccacuucauuaaaguugucugaugauuaaagauacugcuggugggcuaucagaaugcaugaccugggucuggggacacaacccugcuccauucuccaucuccuacccuggcuucuccuuccuaacccuggaaccuuccauucugcccucagcuaccuaccguuacauuuguuaggacaggcauguauuuaaugccugcuguguacaucacaucacaagagccaggauuguuuguguucgggauuggaugaggcaaggugagguucacaagaaucaagagugcaguugugagauggagccuccagagaaacgucuaagcauuaucuaaaggccacaagacaugacacagcaugcauguuugaaaaacuucaaaguuucuggguaagcagauuguggaguuaagcagaggacccaguuaguuaggguuacuguugcuuugaugaaacaccaugacuaaaagcaacuuggggagaaaagguuuuauuucacucacaguuccauuugauaguuaaucuucaaaagcaguaaggguaggaauucaaggagggcaggaaccuggacacaagaacggcgcagaagccaugaagggguguugcuuacuggcuugcuccucauagcuugcucagucuucuuuuuuauagacucccaaaccaccugcccagggacggcaccacccacagugggucggcuacccccaaucaccaacuaagagaugcccuaccugcuugcccagagccuggucuaauggagguauuuccuccauuaagguucuugacuuucacauaacucuaguagaugacauguugaccaaaaacuagccagcacacguggguaagggagaaguuugguugugaagacaaaggauauaagagcagcaagugccagaugaaaggcagugcaugcaacuugaauuugaaguuuuuuauggaagaacuacauggugauguccaggaaacagcuaacacugcaugugguccucugcagaguucuggguacuguaugaguuugaggcuauccaugugagauggaggauuuauauaucauccaagugaaaugacugucuggaagagcaggcucuuaaggaagagagugcagagggagcucugaaccuggcauucugcacuuaaaaccaugcaacaccuccagcccccaggggcccuucagccaagucauuugacugugugcuuucccaauuuguggccacaaaguccagcugacuuggagccuuuuacagagcgagcgcaugaugaacuccacugaaacucacuuggaucuaagguuugcauucuggagugaaacaauuuuugggcaaccaauacuaaacaugaauaauaaaccagggcuuggccagagggcagagggacccucguagaauugcaguuucaggucaagagggccccgcauaagcaaaggacauuuggugggaaguaaucauaucuaaugggaacuguggaacccaugggagccaggaagcugugggggcugaagaacacccugucaggggguaauggacauaucagaacagagaugagaagacgaugacagccgccacgugggcucccaccaugauccaagcauggaagaggaccccgggcacucagugcuccaagcacugagacucucuccugucauguuaaaacacuuccucuagacucugcuuacaaaggaaugaaugagugugagguggcccuuuuguauuugucccaaaauauugguuuguuguuguuuugguuugguuugguuugguuugguuugguuugguuuuuugcuaguauauaaugcuuuaaucguuuccauguggcauuauaaugagaagacugccugcaagaacccaaacuccaauucuuucuaauacgcacaguucgaauguguauguuaaagaauuggaguuuuuuuagacccuuuguaaaaaaacaauagaauuaucccuaguuuugauuuucauuucauaagccauaccagcuuucuguaggaaaacaugcauaucaggagauuucuauguuggcagaaagcauauaaacagaguuugggaagauucuguugucugucaaagaugauguccauguuccuccuaacguacugucuauguucagggcuaaggcauguuaaacugggcccagaaauagaguccggauaaucaaagugaaggacaagcaagggaagcguaggguuuguuuggucuuaauuacucuugucuggcuguugagucucucagaauauuaauggagcaccucacagaucacccuguccaaacgcccucuaugaacagacuagaggagggggaggaauucuauccacagugcuucguauacuaauguauacuugggguccugacagaaacaugaagacaaggucaaugagccauuuccagauagaucuguuuacugaagcaggauugacagaggugcagggcuugagucuugagccagucagacuguuaccaaucccggacucuaaaggaacagacacggggaggguauguaaauggaaugaucaugcuaucugagguagacuuuggcacugugagacaacuuggaguugagggccugaucucuguucucccucucucucaacuccugccaagacuuguggccaaacucaguaaggaccuggaggcacauggcagacugauagggcugccuccaaggcagagaucaucuggacaaaagggagauucccccagccugacauucaccagggccuuucaaacaucuguagccaacuagugugaagccacuggcaguggcaguguugaugcgauccaggugaaagugcucagaaauacaagaagccuaaguagaacauuaagugggaacaguugacucugguggauuuugagucagcacuggccuuggcuggauuuuaucuucuagugguauugaacugguuaaaaaaaaauguaacuggagaucaaagcccuuuaaacagauacauugacuucuguaaacauccuugaacugcccccuccuuggccuccccccuccuguugccagaucgguccagcaccucuagaggcuguuaauacauguaaugauuguaacaaauacgguauuugcuuugauuccagcuggcucuagccagacucuguccauaguuccuauuguuaucuuugcuuacuagacaacuguauuguuaccauugguagcaaccuuugucacagauucuucagcccugguucuuacacauugcgcucggugcuuccccuaacaguguuugcagauugagacuuuagaagacuuucauauuaguaauuaauaacauucugcuuugcacacgcuuaaacugguugugcauugaacaguuuuccaucagaaauuuccacagaaguauaauuucgaaggaaaacaaacuuauauuuuguugccagaaaaaaaaaaaauguuauacuuuguucucaagcacuuaaaacgagauuugauuguaacaaaauguugcaaauccugcagaguuucagguuuuaaaacuauagaaacuuaagagaauugaaggacucuggauuagacaauaggauagucauaagacacaaaugcuagaaaugcuuuucaauauauauucaauaauaauacauaacccagaggaugacuuuuuuagaaagcacuaaucuauaucugaaauaagagauuauuaccuaauguaggcccugggaacucuugggauuauucuacuugagaauucaacagaaauguaauugguuuuuuuucucccaucuuguacguuuuuauuaauuauuucacuccuguagaaagguaaucuuaacaucucaauuucuuuuucauaggaauuucaccaaaaucaaggugucuuuacagaaauguuguuaguucgaggagaguaugaacauagucuaauuccucuucauuuugcuuagcaaugacuuguauggagaccaagcagguccuucacagagacagacacgugauauuguaagcucuuaaccagauuguaagcucuuaacaucccugcaguggacauccguaauaggugguauaccgcacagagagcgcugucaugacccagcuggaaagcaacaacaagcaaccuuucucucaagccauuguucaaagaaguaaguugaaaccaaauggcaguugaauuucuacaacuugcugacucaccuaaaaagaccucaagauaguucaaaauacauuaaaaaucauguccacuaguggcaugacuucaguccgccuuuaccuguugcuuugugggugcuuggcccugugggauuuucaggagaguacagaucucagcccugcuaagccucaugcuuugggccaggcuacccaaccaucuggacuucccaguucucagcucgcuggcagcagcuggcuggcacuuaccacccugugucuccaggcuuugagagggacacccauugcaagcuucaugucugugucccuacagacacuuucccaggcacaccauggccaugauguucaaaccacgcauaacuuuuuuuaacaaaaaucagaacauacugcaacagaguucagaguugauuauucauuccguacuauuucauggacgucuuuucugugugaacaggauguucaagaugagaagucccauucuuguuugcaagauaaauaaugucccccuauuagucacuacuguggcauaaacauccuuaggaauaacuauuuguuuaguagcauaacuauuucugaggagacugcuggaucaggaacguguacuguuuuauaaaugcugucuuauuaucucuaaaagaguugugccaauuugcaguuuaaagcaauuuuacauaacagaggcaagucauugugcuaauuucaacucagccccuuccugcacaguuccauuacaaagaauggcaucccuuucuucucugguuuuucauagguguugcccauuuuuuucaguuauauuauuuucuuacugauucauaugaggucuuuaaucagucugauguuaaauccuaauugacccaccugaaaguagaucagauacuaaauaccucaaucucgcucugguguuuuuagucucugucacauucagguuuauuucucuguguugagagguuuuuuuucucucccaaaucauuggauauuuuuaauuuuugucuugcuauuaccuuuauuuuuucuaaagauuuauuuauuuuaugugaguacaguguugcuguuuucagacacaccagaagagagcaucagauccuguuacaguugguugugagccaccaugugguugcugggaauugaacucaggaccucuggaagagcagucagugcucuuaaccgcugagccaccucucuaucccgauguuaccuuuauaauacagccuuuucacaccauugucaugccauuuguguaggcuuucuuuuaugugcuucagcaguaguauuaccauuuucuugugcagauuuuacauuuuuaauuccugauuugagugaauguacucuuugcauuuuacuguggaauuaacuggggcaugucuguguguaccaucuaaguucuuguuaucuuacuaauauuguauuuucauaaauacuaugugccaaaagacaugaaccuugagaaauucuagggggagggacuggagggagcgauggacucagaauugaccaaguacagcaaaauacaaggccuuacaggacacacaaccuucuaaugcagacuguacaaaauggagaauguacuuccacacacuguagaacaacaacagcaaaugggagcugucaauaccgagcaagaacaaagcccaccaaguaggacagguuacacugagguggagagagagggaggaagggagggagacacacacacacacacacacacacagcaguuggaggagagcugugaucugggauguaacacaguggaagaacuccuguucauguguacagggcucuguguucaauccccaggagugagaaaaaaaaguaaguaguuuggucuuagggaaauguugguacacuuuucuagauuauuuacuccucugagcccugugcucuuugacuaaaggaaaaacgucaacuauguauuaucugggguugaacaaaauugaugaaaauucacauguaaauaauuauucuauuaauggaaucugaaguuuuucaacuaagaaaaguacaagggaaaacaaaagaugaugaaggaaacuguguagaauaaaaacgggaaaucgcuagauuauccaagaaaagaauaacauuuccaagauggaaauaaaacuccacgugaguguuuaaaauaaauaauaugacuaagugccugauagauguggagagagaaaaacuaaaggacaccuggaaagaaacagucaauacaacagagccggccacugaaacaaccgagcaagaugcugaaacaaccgagcaagccgcuagaaccaaaguaauagacauucugggagcugcuucagaccagugugguuuaaaauugaaauuuaagagucaauagagaaauccuuggucauaaucaaaacugacucgucaagagguucaaggauuuaaugaaccaauuaccaagaagauauucaaacaguuauaaacacgcccagcugagccgggcgugguggcacacgccuuuaaucccagcacucaggaggcagagguaggcagauuucugaguucgaggccagccuggucuauagaguuccaggacaaccagggcuauacagagaaacccugucccgaaaaaaaaacaaacaaacagaaacaaacaaaaaaaaaaaaacaugcccagcugacaaagaugugggucagagaauuuuagagcugucaaaggauuacuuauucuugucauuaaugcuucaaaaaugaagaaagugggcugaaugcuuugcuuauuccuaaugucaaaacgggaaauaacacacagaaaauccuauaggcuacucuuauuuauaaaaauauuaauauccugaguaaauguuugcaaacaggugauaaguguauguaauguauguaaugauuaguaaugguauaccccaaggaagcuggauuggugcaggguuaggaaaucuaacgucauguccaucguuagaaaacaaagaacaaucaugcagucacuguuaauagacauuuuaaaagcaucagauaaaaaucuauguguacauuugaguguuaaauaaauuuuaaaaugaguagaaaggaaauuccuaaaucugucagucaguauguucguauuuuuaauguugagacauuuuuaauuuuauuaauagauacugugcagcuaaaguaaugaacaugaagauaguaaugagaaguuuauuagggugagacaucagaaaucagcuuccuaggaacaucuuaaaauaacgaggcgaucagucugaaguuucgucuggucgaaugcuaggcuuuauuaugaacagagguuaaugaaugugcgccugcgcaucacucaaguggaacgugguagacaguuugcaccugacuuguguuuacagugugucagagauaaagcaaugucccugcuauggacgcugguagagcugaaguaagucuugccuaguuaucuucuuaggaccaauugccuuaaaaugccuacucugcuauuaaggccuaguuguuagcacgauaauagauaauaagcauguacagacaugcaguggaaaaagccuuguccaggcccucaggaaggaaucguaggaccucuuagggagcagugaguccaggaugcugguaccaugaaacugggucuugugggauaaauagaauuuccuuacauagaggaagaaaaggcuucccaagcuaagagaacagauugaacaaauuguggugguaggagcugaagcugugcuagguacaguagugcucagaccccgcgggacauucccucgagaacauuaaaauaaggaaguuaaggaaggggaaaacagacaguccaggacccccugauuuagugagguaccuuuaaaacaaggucucaaguauacagucuaggcugguuuuaaaacugaugauccuccugccucagccuccuaagugcuaagauuggauaugugccugcacaccugauacacucuccuccauuagcugucagucacgugucucuuaacgaaaacugaccccagggugaguugaagcaaaacggauuauaugagaugaagagacgagaacugucaggguugcuguauacucguccccaaaaguuaaaacacccacuguuuuauucuuucucauacucuuguacauugacuggacuccaucucauuugucuuuagacgccugggaacaagguagccuucauugucccauacugguggcuugcauagcuuucagcugagaauuuagcaggggcugucagagugucuucaugaacaccucacagcgucacuccuggguccccagaggaagcaucucaagagcaagcauucuaaagggcccaggucacaagacgucuuaugagcuagccuugauaaccucagacgucacugcuacguucuucaggucaggcaacuccugaucagcgaaagcugaguaaacuccguccugugaugaggacaggagggauguacauggagagaaggacaucgauggaagacauuuucagagaccugcuaccccaacugucaguguaccaaccaacacaggauugaaguacaugacaccaaauugaaggagcucuagauaguaacacagacaaaacaaugaggauaaagauaucuggaagaugcaaaaugugcguguaaaauaugugaaagguauugacugaguaucggacgacaaagaggccgcccuuacuucgaguguccguagaacuucugccuuuccucucuagaacagggaggcguucacuucccgacccucacaugagucugaagccuuggccuggucuuuuccucaaccuggaagaagucaucagaguugugcuucgaccgucugcucugugucgaauggguucucgucacugcggugcuccuccgugggaugacguccuuagacacagugcagauacuugcguuaggcauccugucuugcuuuuucucacuuucguuggcugggagcaccaggggaggggaguuuauuuugauuccccauaguuuuguaauaagagcaguuuugacuugucuugggaugcucuguacacuucagggucauccuccagcagccacuggaaucccccccuuuccaacagugaccugggaguugagccagcauuguuuccuguguguugucuugaagucucauaaguaggggagggcaguuuucugauaagaguuuugucuuugguuuuuuuuuuuuuuuuucuuugcucucugaagccuguguuauguguuaugugccauccuggucccacugggacagucugaaaugggagcccagggugugggaugaugcaauuuccuggccuguggaguccugugugcuucuugccucugucauguuguuaccacgagguauaggaguucuguaugaacuagaucuuguccucgggccacucgagauggguguguaauucaacagcuggcugccucaguaaugacuaggucccuuugcuguugcaggucgucacgcugugguaccgagccccagaaguccugcuccaguccagcuaugccaccccuguggaccucuggagugucgguugcaucuuugcagaaauguuucgcagaaaguaagaacuccauuuucucacggaaucguuggucuuuuacgugcccgccugccauuucuaucuugauugagggcuuggucagacccaccuguccuacaucuguguuccugguccuuacagcuucugauuugugguaacuucguuuggcgagugauucccccacuguccuaacugguaaacaugaagcaccucuuuagugaaggaagacccucgggguggacuuuauccccaggaggaucaggacuauggagaguuuuguuguugucguuuuggguuuuacuuuuuccucuauuaauuucuuuacuugugcauuguaaauccuggucacagcacuccccaacccgcggugggcuauggaguuuuuaacagaaauucugacgguggaaacaguuggugcaggguaucagguuaaaaaggagcaggccagggggaccugaguggugccuuagaguacuggcauagccccaccguacggggagggagccagcacaucugggcugcaggucguguggcgugcacacaagguaaaauaaacuauguccuugaaaagcagauuugcuuagaagggggaauaaaaugaucggaugaggcugccugcagucucccuuaguguccacgcgucucacacaucaaacauguuucugcaguuuucauggggcggugaucaggccauccugcuugucaaagugguaguucaccugauuuuuaggggacaaaaacaggcaaacagcauuaaucaaguuugguuuccuuucccuuauuuuuguuucccucagaagaggugagugagaagccaaguguaucccuauugagcauguucggagucuagcuccgcauagcuuuuuuucugaggaaagaaguggucagccauucuggcuugcugguuguucuaaccagaggaaguucauuccgugaauuuugugaacugcgucuacgacucagcaaaacuguagcucacaggaucauaggacuguggcagagacacgagaguacaaagacucuuuugugcugcccuacugugugugguguauauugccagagcuucugcaucguguuugcuucucuauuccuugaaguaggaggguacugugguugaaugguccccaagaacuagcaggaaucugaccugaaaggaagccucguaacuucuaauguaguacuguuugaaaaggggggaauaaaaauuagccaucaacugaacaucagagacaacgaaccaggcuaaaucaguaggaccuggaacaguugagggaguggaggggacuuguguggaugugugcaugugacgcccagaagucagccucaguguccuccacagucuuugacacaggguuucucacuggaaccuggggcuggcuguuuaagcucggccugccccagggaugccacuuguuuguaucuucccagcccugggacacaggaaugcgaccaugcccagcuuuguaugucagugcuagggauggaucuccagugccuauauuugaaaguguggucccugugcugcggcuucagccuuacuuggggccuucuuagaaaugugaauucuuaggacccauccuagaucggagguaguuccugagcuaggucugucucccuguguuuuggcaaggccuccacuugauccuaauaugguaagaacuacuggauuggaugaugguguuggcagaagugggcaguccuuaauggugcacauuucaggcacucccuugagguucagauucauuguugagucgagccaggaauuuuguuuuuuaaaagugccuuagguaauucuuucaucuaacaagaguggaagacauuagguugaagucuuacgaucagagaugagauuaagacccacaugaagagcaaggugagaguugggguaguuguuccaggcuauucggaauagcgccuauaauacuaagaguugauuagaaaacugcucauucagauuauauuuaugugucuguguuuugaguuuuccucuguguaaaaauggagucuguauuuuggggguagggaggucaguuauuuuucuacaguacaaauuagauuagcuaugauugauuuuuaaaaacuaguuuugaaaaaugcuaaaagaaagauaaaacuugagacauuagaauugagcauccucuaguuagauauuggcaguauuuuuaagucuaagugguacccaucuauggaacagcucaaccccaaguuuuauuuucaagccuuaaacuccuuuccaccuaguugaucaacugauugauaauuagguucucagccuagcuugaggguucucagaucauguggggaacguaugauauaccaguccaucaagcccauuuuccaaugggagaauuccauucuguauucuuaugacugagagaggaggcucaaggaaagacuuugguggcgauaguauggucuguugguuugccugcugggagagugggaacauagaagccuuuccuccugaaggcacugcauaaaggaguagaucaaggucugagugaaugaaggacaaagcaauaucagaaacuggauccuaaagcuaaagcagacuaagucucugccaaguacauauccuuccaggauauccuaucccuuccuagucccucgugcauacagucuuugauuguuucuacucaguucacauugauauuccugugauacuacccagauaucuggacauagcaugguucuuaauugaagcaaaagugucccaguauucuggcauuuccaggaucuagcuggacuccugauuccauggagagccuguugagaacugaaaggcccaggaccccgaaagcauguucuuucauuacuaaaggcuaauuauaauuccgggaauauuugacaccugucuauuuuucauuccuacuugcugcagaggcagugauuucugugucauacugucuguauugcugccauuguuuuugcucuuacagcagcuuuauauugguuacugacugauuuuuuucacuacccuaaaucagcuuacuuuauaauuuaaccucacccuacacaagaauacauaaaaccacagccuugguaaaccaguaauuuauuuagcugauagacauuagaaucuauauaaauaucaagauuauuagaaagcuccccauggccaggcguggugguacaugccuuuaaucccagcacucgggaggcagaggcagguggauuucugaguucgaggccagccuggccuacagagugaguuccaggacagccagggcuacacagagaaaccuuaucucggaaaaagaaagaaagaaaggaagaaagaaagaaaggaaggaaggaaggaaggaaggaaggaaggaaggaaggaaggaaggaaggaagaaagcugcccaugaccauccaccaaaauggccucauacaucaccagcugaguguaucuaaaauacaacuaaacccuaaaauacaacucccuguagaaugguugcuauaugagagggucacucccgagacaugaccauauaaauccuaguaaaaaagaaacucauugagugugugaugaguucguuaagcagaacuggcuggugagggaugggugcuguggguugguauaaaaacuguacggggggcugaagagauggcucagcgguuaagagcacugacugcucuuccagagguccugaguucaauucccagcaaccacaugguggcucacaaacaucuguaaugggauccgaugccucuucugaugugucugaagacagcuacaguguacucauauacauaaaauaaauaaaucuuuuaaaaagaagaaggagaagaagaagaauuucaaagaauucucagugaaagcccagaggucgcauccuacuuguuuguauaaaaucuuugaggaauaaucauuuuuguaugagcaauauuuggcauccuucccagaagcaaagaaggcaggugagugaaacacuucuggucuuccaagcccggggcugucuccuucaggaguuaccucaccaugccauauucagaggguagagacauggaaucuuccacaaguagggcaaauaacuuguucgggaacaccaacuauuacacagcagagccagguuugaauccaagucguccugauacuauagcugccaauugcucuacucuguuagguuuuugcucuugacaacaccaaacauacaagagcuuuuuuuucuauaguauuuuauguauugcuacaagagaacaacaaugacauuuuagaggcgaaagagcagaucacauagucaaugcccucgauuuccacuuuccccagcguucgaaaggcugauugauucucugucacauuaucaagaguuacaugcuuucuauucuaaaacugaugccuaggaaauacaaacucaauaaagagagucuuagggcagaugguugccaaauagccagaaaguuaaauaccaucugucaguauuaucugaguuuaauaauugccugcacugacccacagaagcauucuacagaguggauaacacggauuagagcuauauucuuuuuaaucucccuucucucuccuuuguaaguaaaccaucuugaugucacguugagauguguauugugcuaaaacagucagagaucuggucaguagccauguaguuaaagugaugggagggcuagggggagauguggggacaggaauagagugguauuuaacucugcggcaagaucaacuacucaucuccacucucuggguaccuaguaguugcuuugugguccuggccagaacuguuaguuucucguuugaaaguuaugggguuuuccagguuaaagcaaagguauaaaagagaguguacauugaaacagaauagaauaugcuacaaauucuuugaauauggagauuguggugagcagauaggaauucuuagaaauucuggguugccagcccugcugguccuuagcuacaaagugccaaaugccaccaagaaaaauauaacaaauacugucacuguucgcaggaaacaaacuucaugauaauauuacucguugucugguggcuucucuagacuugucgucauugauuucuaugaauuaaauacccacuagcagaagcuaacaguuuauaacuguccuuuguggcuugaaggccagugagcaaaugucuaaaauguuacugagcgccuugccaauuuuccccucccuugcuguguuggugggcauccauauuguacucuccuagugaccucaaggaaacgaagggcuugacuggcugucacagaugcccaggcaccaggaggugagaaaaccugccaccuccggcucggucagaacuugcgugcagagcuucaggcucuuacgcagcuaggcuuucugccuccugucuucuuggucuuuauuuaaagaacuuuaaaggagcauccuauuagauacggaacccagguaaaggggaccagucuugauagagcgauagacagauccaggauagcucagucugagaacaagcagauacuuucacacucuaaucaguguugaguuuucaacucuuuuuuuuuuaauuagguauuuuccucguuuacauuuccaaugcuaucccaaaagucccccauacccacccccccaauccccuacccacccacucccccuuuuuggcccuggcauuccccuguacuggggcauauaaaguuugcaaguccaaugggccucucuuuccacugauggccaacgagaccaucuuuugauacauaugcagcuagagacaagagcuccgggguacugguuaguucauauuguuguuccaccuauaggguugcaguucccuauagcuccuuggguacuuucucuagcuccuccauugggggcccugugacccauccaauagcugacugugagcauccacuucuguguuugcuaggucccggcauagucucacaagagacagcuauaucugggcaacucuuacugcguagcuuuacaugaauuugaaaaacaugcuuguccugagaagccguuggguguggacuuucagacggcuuugccacucugcaggcuccuaaggcucuccagccuggugcacuggcucugccuguccugugagcucggugcuuuuccuuucuuccuguguuuccaucucuguucucuguucucagcagccaacggcuccauucuggcucuuucuacaaaaccccaaguaugggaacucuauuucugcaacagaucacccucucuccugggcucauuuucauagugauccucaucacaccagguuuuccuguguaugugugcauaugucuauacugcccucucugagaaagaaauuguggcauuguuacccaucugccacugcagggagugauuuugcuggucucucugugccuucuuuuaaacaaucccagguucugaauugcaucaacuagagaaauuuggccuagagccacacaccaggguaagaagggaugucgccuguggugguggugguggugguuccacaaagugggagauagaacaauguaaaggucccaguugacucaacccagaaucacucaguuuauacauuuccuggccccaccagcuagcuguaaggauuccaugacucuugacaagaauuccaguuuuacacucauuucucagaaaaauaccccugaaguagcaucaucuaaaucagugguucucaaccuuccaaagacacacacacacacacacacacacacacacagacacacacacacacacccacacacacacacacacacacacacacagacacacacacacacacacacacacagacacacacacccacacccacacacacacacacacacacacagacacacacacacacacacacacacacacacacauacacacacacacacacacacacacauacacacacacauacacauacacacacauacacacacacacacacagacauacacacacacacacacacacacacacacacacacagacacacacacacacacacacacacacacacacacacccacacagacacacacacacacacacauacacacacacacacacacacacauacacacacacauacacauacacacacauacacacacacacagacauacacauacacacacacacacauacacacacacauacacauacacacacauacacacacacacacacacacacacauacacauacacacacauacacacacacacacacacauacacacacccacacacacacacacacacacccacacacacacagacacacacaccccaaucauaaaauuacuuuuuuugcuucuuugagacuguaguuuugcuacuguuaugaacuguaaugucaauauuuuuuggagauaaagguuugucagagggucuugaucgacauguugagaacugcacaugugcuugcucagugccugugccuggcucuucauaggccugcccauucuccuccagucccagcccuuggcagacucagucccgggcuaggauucccuucacuugagacuuguagcccuuuggacacaguugaucgccacacucccaguccugcauucugccuuaccuccgauuuguugaugggugaagccauccagugggcuccuccuuucagugcagaaauccuguuucucucuuccuucucuccguucccuccugucagggcaaaucucuagagcugugcucuucacacucugucugugaugcucuccugauugagcggugaaccaucugcucauucucucuccauccuacaaaugcucucucuucaacuuucuaauccccacccccaacccacccccacccuggcuuucuccuacucuuuguggccaccacuacuuuauuacuggcucaucucuugguccuuuccagugauaaaaaugauaggugcgauccagcuagauuuuuuuugccaccuaggcuuuccagguacaaaacugaggcccgcagagguugagucguauagagaacaccgcagccuaucucaucugugaccagaagaggcucuaaagccagacauacccacugcaaagucccucuggcaugcaagagguggacagagcacaccuuguguauccucugaaccugcgugcuccuucugugaacccugccuggcuggcucuuagugaugagcacaucucugggagccucugccucugccucuuagccucuuuucaucucccaaguucuaaagcugcauuccugaacauuuuauuuagacaagaugaaccagacccucagugggcuccagcaucaugaguucccugauggaccacaucuaccuaccacccucccaaagguccuuuccuucaaugaccucuugaaaccugguucuucuccccucuuccguuguucuaaugaaaugcacauccccguggcuacuggguccucaaagucuccuuagacacaucuucaucuuucuucacccauguccuauggauugucugcgcugguaucuccccaaccuugccccuuccuauaccaacuucugucacacugacggaggccauuuuucaacacuaacccugcuucucuccuacuugugucuuaugaugaauucacacaugaauuacacccuuucacaaaagcuuagcugaacuaguguaggguuauuaggccucgagaucuuuuuaaagaagcccuuacuucauaugggccucagcaagaagucguuauuugguccuacaaaguguuucgagguuuuccuucccaggaacucugacuuuagaguaggaaagaugguauaguggugaaaaacucuuggaaagaaccuagaugccguucuaaauacccacauggcucacagccguucauacucuagcaccaggguaucccaugcccucuucuggcgccaggcacacacaugacacauauacauacaugacauauacaugcaugacacauauacaugcaugcaaguaaaucaccauacaaauaaaaugcauaaaaaucuuuaaaaacuggacacccuuuccuuucuguuccucgugccuaccagccuucugcagugguaccaaaugacugaccccuucaggagaaauaugcugcugucugccucuugcugcacaaucccgacugcauccgucuuacugagcuugucucugccaugcucuuccugagcacauaggauguccaccauggcugcagcaaggaaauggguggguggcacagaauucuuuugcaggacccagguucccagugugugucccagcccuuccagcuuugugauugaggacaagccauugaccucuauauccuaaugucuuucuacagaguuuaccuugccucagacuccuccuauguucagucccagauguucaaaauccuuugcuuuccuucauuugacuggaucgggcuucugaagcuuuaaagaguagauagagugagacagaguagauaauguccacgauucacucgaacaccgccauacucugccucuguagaacuaugucuugggcaucugcucacaucuauacguuguucuuuaucaauaccagcagaucuuccccaguacgacuccccaaugcaaacauugauuauccuuggggagcugaguuucugagaucuuggucugugcaccaccguagggaacaagaaguguggagggaagggcugagauaggagcucuagauaccaguuuccagugucucuuaaagaacagccugguuguaaaaugcaaagugguacugaaguauaaaauaagaauauuuuauuucuugugcccauaucaaaaaaucccaggguaacccccugaacauacuucucuaucuuuucuuuauuauaaacucagauauauauauauauauauauacauauauauauauauauauauauauucuguaaacaaagaaaugguuacauacuaagccaucaaaauuauccauuuauuuuauaacuuagcuauaauuuaaaauuaaguuagcaauguguccuuuugauaaacauuuaaaguuuguuucuuuguuuugagcacuauuauaagcaaugcugcuguaauucauuaaccuuaguuuuauggaacauuuauccaaguauuucuguaugaugcauucuagaagcaaaauuaggucagauaacacacauauuuaaaaccucugcuaacuaaaccgaauuacccucaaaggacugaaacuuaagucugcugugaucuuugggguuagcauugagauuucuaaaaauuaacagaggucaucugggagcugggaguguggcucagugguagaggacaugucuuagcaugcaugaugucugugaggcucuugguucaguccgcaaauccccagaaggagauagguugugcggaaugaaacaagacaggaacucuguaaucuuugguuaccccaucuacccaaaacaccaccaacugaaaacaagcgaauacaauaaccauuuuuauaaagccguuuuaaagcuugcuguugcaugagggagcuaguucaacuguaaaacucacuguggcuuuccuuuuuuaaucagcuggguagugauagggaaggagccauccugucaguuaaaaaggaaaaagaaacuuguagauaaguucuaagcaguuucucagaugguuuucccccaguccauggagagucuggagacaauucugcaguguucauggugucugugcuuagagaauuguguggcggauucugauuacccuuccagggaaccugggaccccucuugaccuccccccauccuugguagucaccagaagauguauccuuacuuagagcuuuccuuuguagaucuguacugugggguaccucuauaggccucuccaucagacacuucuagacaggaaaauccugggacucagguucaaaucucaggucugcuuggucaugucuuucaaccacugaguuggaauaaaacaaucaacuugaaggaagaugacauccacuccuaauuauaaaaucuuugcagagagaggacacguuggguacgugaaagccacuuuugccaguugucuuaguuaggguuuuacugcugugaacagacaccaugaccaaggcaagucuuauaaaaaacaauauuuauuugggccuggcuugcagguucagaguuucaguccauucucaucaaggugggagcauggcagcauccaggcaggcauggcgcaggaggagcugagaguucuccaucuucauccaaaggcugcuaguggaagacugacuuccaggcaccuagggugagaguauuaagcccacacccacagugacacaccuacuccaaccaagucacaccuauuccaacaaggccacaccuccaaauggugccacucccucguccaagaauauacaaaccauaacaccagucuucccuuuaguucauggcaaacaucuucucacccacuuuacagguggacaaaagguucuuccuaaugauagaaaacaaaaacuuccaggccuggcccaaguaauguuagcugcacccugaaccuccaauccaaguugagucuggccauggaaacuccagcauaacguauuuguuguuuauaacauucauacauuuccuacacaagauaauaaugagugcugauggaguuauuauagaugaauauuaaggucaugccauuucacuguaucccuauagcuuccuuuacgcugugcuaaaguuacaacaggugguaaaguguggcaaaggauggcacacgggagauggguagugcugacagucugcacgccccauccgacaacuguuguauucugugccagguacuuaagcuaaggguucucugggugccaggccaagagacuuccuccacucuggcuuugcccuagaccuagggagcuggcacugaugacuccauuuaauggagagucaucaaagcugagcuuccuuuucucccacuucaccuuuucuccacucccacaucacucaucuuccucucugccacccugcugucccucauucuuucccaccagcuuuguaggcuuagauuucuuuuuaauaccuacuucauaaggguucucaaaugcuccaaccuccuucaagccugccauccaaaaauaggggagaaaagaugguaaguaggacaagaagauggggaucuguuuagaaguaguucuuuggaucaauuuugguuugguuugguuuuucgagacaggguuucucuguguagcccuggcuguccuggaacucacucuguagaccaggcuagccucgaacucagaaaucugccugccucugccuccaaagugcugggauuaaaggcgugcaccaccacugcccggcucuuuuggaucaauuuuaaucuccauuuuucaggauaccagcaauccaguucaguagagucaggauacgaagaguccaauuuaauaggguuaucagacacaaaucagcaacgacagcacaauccagcagaaacugccaggccucugucgaaucggcaugagucacuggagcaacaaggcuuagucggaauacuaggcguucucugccaugcuucucucaaugaagugaagaucaacagggaagaugcaagagcaccgaagcuugacaaggcuagcuaugcaagaagugcuccugucacgucaugguuuuauugaguccuacuuauacucccuccaaacaucacguguccuccucaugugauaucuugccucagcaaaacaucauguaagucugcgucacaugacacaaccagaaacuuccacuucacagcucucuugguuuuucucuccucucucaucucccauuuuaaccauucaaaaugcagagcauucaacaugacccugcccacccaccuucucuaauagugcacaacacugaagguuugugugugugugugugugugugugugugugugcgcgcgcgcgcgcgcgcgcgcguuugccaaaaucagacauacagauauuggaauuuacuaaugaguaggacuaagagucauucacuauugaugugugaacgaguacaacauacacacaaaggggaaaacuaacggugacguaaguuuguuauguuauguguuccugauccuauugggaguuccguaguuccuugaacuuaccucugccaccuaaaaaaaaaggaggccaggcuucucgaggaagugauggugucuguaggugaagacaggugugagagcaacauuaucucaaacaugucagauuuguaaaauagaauagcuacucagagagcagugaaugugaguuuagaguaauuauguccguggauaagucgcuucuuuuaaaaugagagggagaaaacuaaaagaaaaaaagcacaacuuuugagaagaauauaauacaacaaaguuaacuauccagagauucaaaagaaauaaaguucagaagauggugauugaucagaaacaaaaucaaaagaaacuugcuaagagaugaucaaguagcacagaguucccuugaaggcucccugugagguggaucgcacuuucuagaccuaugcagacagagcugauaaauaaaaauugcugacaagcaucaaguaaauucguuucaggguuuuacaagaagagaguuagaaaggccgagcuagccucuccuuugcuucucuuuaguccucuucuguuuaacaagcagccagugagaggaaagaaaacuguaucuuugugaagggaagagaggaaucuguggcugaagaauuuugcagcaggaagugucacauacucgaggauuccauaugguguguaaauuggguaagucucagcuggagggccaguaagauaaggccaguaaaaguacuuguugcuaagccuguugacuugaguucaguuccagggaccuacgugguggaaggagagagcugacugacaaaagcaguccucugacccccaaguguguacccucccccaacccacacagaguaaauaaaucaguguaaaaacuuccaaguguuaguugagcugaggggauagcugggcuagaacuugggaauaggauggcguugucugauggauacaagaugagacugccccugacccaaggcucaccucucuaccaaagcucuugggcggggagcgaggacugcagcagaccucaucuguuuguacuggucacacuaaugacccuguaggaaugugguugggugaggauauuuuuuaaaacaacaucuggaugaggcuuaaaagcaaauaauuucauuaugacuuauuaguccuuauuaugagaauaacccuguaauuggacuucagaaaucccccgcaggcaagagcguaccaucagauuuaaaggccuaauuaacuaugacuaaagucaugccucauuuuagcccaccagugacuuuaaaaaagcaacguucucucuaaagaccuuuuagacaggagaguagguccaagugaaacacuaaagacggcauagaaaggguggugagugaagugagaacauguuauaaagagaaaauggacagccagguuguaauucccaggaggccgugcuccuagguggguggaacucggacccacaaacacugacacuuagaacucaggaacucggaauccaaaaauacaucaaguucaauuuuuuggagaauuuccuccuuauggugguauuacuucuggaaucaccucauaaaauuucuuuaaagacaaugcacacuaauacacaaauguaauuaauaaauauuccaugugagugaaauucuuuaauaauagaaucucaguaaaguguuaugacguguugaacuauaaaagcauuuguaugcuggcguuuuuccucccaugggagugcugcuguagcaaucuuacuguagauguauagaugcaacuggguuugcgcucucccucauaauuaauuaauacccauuauugagggagugacuugguuccauguccauugaugaagagucccugcccaguggcgauaugagguuauaaaccuuagaaugagaugcugcacucacuauaacccugugggccuuuuauaagugggugggaauguagguagguagacgguagguagguagauagguagauagauagauagauagauagauagauagauagauagauagaugcagagagacauacauacacacacacggauacauagauagauacacagauagauacauggauaaaugaauggauagaaacuuucucagagucgaggcagaagggagcauaagcaagguugcaggcuaaauagagcaggcugcucagaugugugcaguggucacccuaggaacuaggcagaggcugauaggagugagaacagcccuggcucgcagccagcaagaaucaaucgguuauagaaccacacugaauuggcuuuagccaacaacuugaccacgaguggaagcauguuuacuccuauaacgucgugaaugagccgagccaugucagacccgggcuuugacccacacaggacugugagauggcacgugaguuguuuuaaucagcuaaauguagauaguuacagcagcaauaggaaagcauucaacuaacacaggaaguuacgucaacagcacacaucccagcggugggauaagcaguaaacauuucaaagauagcaaugcagaaaggcuugaugucuggcugagaauuguuuacacggagagcaacccaguucugaagccaggaaagcucccagggaacuuacguuccacaccgagccacggguguagaugaggagauugggggagggggcgggaauguauaugcauguguauaucauuuuguagggaauacuuuagaggguagccauauagacaaaggagccuugcagagagcuauaaucaagaaugugaguggagugucugcugccucccagcuguucacuuaaaguugggacuguauaugguaacaauuuggugagaggaagaaauuaugcaaaagggagauaguucugugggcacaugcuacgcgguuuguguuuuaucacuugggguacaaguguaaaacuugaguaguucuuuuguuuuguuuuguuuuaagauguguuagcacagggacaugaucucauguuucuugaguucuaaaggcuccuggcuuccauaagguuacaccacaacaugaaggugcagugaaucucugcacagugugaaugugcaacacagaagcuaaugugcacugugacacagaagcuaauaugcaccgugacuucaaagguagcuaaacacaggucgacaccacgaccagauugccuggguuuaaaucccagcccuuccacuuucuggucuuggagccacagaccagcaacuuaagguccccgugcucacuguucucccuuuggugaaaacugaugacugcuauucccuuuguuauugcaagagcucaacaaacuugaagcagaaauauucugcuugaaauaccuagcuuugaaauuaggguuagcuauaauuauagcuucuguucuucccugaaacaugcaaauauuacagaaacugggguucucaggcuuguuagacccaagaaaucccuaaagccgacauggucuaaacauucuauauaaaauagucaaaccaggauauccagacaccagacaacccucucucucccucccucaccccucccccacacuuuuaacuucaaauuagugagacucaauacauaguauuggcauuauggcaacacagcagacacuugggaaacucagagaaugauaaaaacauacuuuaaaaaccaauauucuagccuggcgauuuuacccaggaaauggucaugcauaacuuuaagcccagcacuugggaggcagaggcaggcagaucucugaguuucaggauagccagggcuacacagagaaacccugucuugcaaaauccuaguauacugaacuagaaaaccuaaaagaaaugaaccaauuucuagauauuuauggccuaccaaaauuauuucaacaugaaguagauaauaaaauagacugauugcauucaaugagauaaaagcaaucaaagucuuccaacuaaaacaaugcccagagagccagauggacccagcacagaauucaaagaaccaauacaguucuuccucaaauuauuuucuaagcuagaaaaggaaggaacauuuccaaacucuuuuuuaaaagccaguauuacacugauaccaaaaccagaccaagaaaagaaagaagaaagaaaggaaaggaaggaaggaaggaaggaagagagagagagagagagagagagagagagagagagagagagagagagagagagagagagagagagagagagagaagucaugggccaauauuucagauaaacaaagacacaacauuuuuaauaaaaugcuuuuaaacugaauccaagaacauaucgaaagcaguuuaaucgcuuuaaguuuacauucuuagaaagcauuuaauaaaugaugcaaaaaaauucuaaacuaaucuaaauaaucuaagcuuuaauucagucuuccuuauucuccuaauguucacauucacauauucugccaguguucaugaggaaaugaaacucuagccaagacugcuguugucccucagugacugugguuuccgguuccugggaaaucugacgagaugcuuauucuagacccugaggaagaagucaauaggagaaugacuaaggagugagaauacauaagcaagugcagcagaaugcacagguuagaccagcaaaguggucagguuagaccaugaguggucagguuagaccaaaaauuguuucccaaacuacacuagaacaggagagacuucaugaaguucguccuuggguagacuguggagauguuucguugacugauuagcaaagacuuuaugaugcaugccauagaaauaguguauucuuaagaaagcaaggcccaaagucgggcgugguggcacacgccuuuaaucccagcacuaaggaggcagaggcaggcggguuucugaguucuagaccagccuggucuacaaaaugagugccaggacagccagggcuacacagagaaacccugucucggaaaaaaaaaaaaagcaaggcccaaucccagcacuggggaggcagaggcaggcggauuucugaguucgaggcccugcugcuguaccccucacgcaccuucacacuggggcuauaaggguugcaaacggccuuggugaguccuucccauuggguuaagcagcaugcacuuccagacugauacagcuggagugagagaagccaaagccggaggccuggaaggagucuccguggaguaaauaagccaaagagaagacuugggaggucauccagcguccucauaaauccagcuagugccagagaugaaagggaaaugagaggcugagcggcaauaggagagagaguuccccagcacccuucccuuuggccucuggacuuccggggaggagcagccaagcugcccagauggcagccaacacagacagagggaagcucccggugcccuaaggccucuuuaggaaauccuguuugugacaguggcaucaccgugaggcuauugggaucccucccugaaccguggacgcacacuucgggacagaacucuggucucuaaugaggaguuugaaaucuuaguaucaugugcacucagcaagcuagaaacuacauguuggguaaagcucaggucagaccguauuuugcaagcacuuaacuuaucuuccuuuugccauugaaaugcuaguaacuuaauaacuugaaaacaacauaagucucaucuuuuuucuuuuucuuuuuuuccuggucgggaauacgggguggguuuugaccaccuuuaaaacacaggagagggcaaagccccgugaugcaugcauuuaccauucagagaguucacuucagagccugggaaugauaaaugcuguggcuuaaauggcugagugugugaaaacuuugcaggaucuaaacgaaggccaccagaagguuccuucccugagagaccuguuuuagauucacaguugagccuuuugcuauuugagugcuuggguguuaggggugaaccacuaguuuccacaccagagcuugugaaaugagauuugucaucgcuugcagacagguggucaggcuauuacacagagagagaucuggcuggcugcuggccucuggucccccacaucugaccugugacauuacaagcugagggccaacacugauagccucgaguggggcccgcuuuggcugguuggggugauguuccacaggcagaucugugggcagccgggcugaucagugauuugaggccagagacugggaaacaagaaaguagugcuccagugaugaguccagguucccugcuuucuuucuaagguggcccagguugaaaaaaaaaaugcuggccuuuccagguugcacauauuacaugugcauuuacuguccugcauuuaguacauggaucaagagcagauuucacaagguccauuccuagaauauuagguuagucauuaaagguuaauuauucaggaguuagaggaaauaccaugauguucggaaaccaaggaguagaggugucaauuuuuuccaugaagaggauccacaaccauucuccugaagucuuuuuaaaugggucauuuaaauugcgcacauucagaauaaucacaauuuaaauauucuauguauuaauggucuucucuccuaagcuguaaauggccacuggucccaaccucacguagcucggaagcgucuguccucagacauaaaaugcaaccaaguuguagcagcaaaggacucugguccuccacgcuguuccucucuucuguuuguaauguuguaaaucugcuguuuggaagaaaucugaagaccugggcuggccggugcuaaaugaacauuccuuuugaucuuagggugagugccacauccagccguuacucucagucacugauaggaagaacuggacgcacuccccuguugguuugguuuugugugugucuugguuuugcucaauagccugugaggaccauguuuggccucagcuucucuaggacccucugggcccaacuuaucuuucaucgucuuuccuaauuccgauaccguaauuccacagggaagaagccaguaucccacuuggaugaacucugcggcuagcacaaugccuuccuucuuaucccugauucugaacugguuuuucccccuguauuuaagagcaaugaaugggaaaguccaagccuuaaaaguaaagaaccucacuuauauuuaugauguuuucuacacagugaagggaagcacccuuuagcaagcacgugaagcccacgcuguccucguaggacaaaagggaagacaccuccuuuaauaacugacuuccuuuuuuucuuuuaaagauuuguuuacuuauuuuaugugaguacacuguugcucccuucagacacaccagaagagggccucagaucccauuacagacaguugugagccaccauguggcugcuggaaauggaacucagauccucuggaagaggcaucagugcucuuaaccacugagccaucucucuagcccacugaccgacuuucuuuuacccuaccuggucagccuggcagggcaggcaucauauuggucuucccguucuggguucccuuaagucagcaccgugaagaacaaggacauccugaccugccauguacugaaaaggcaaagaaaaagacuucugaguacuguguggccaacccaaucuacugcucgguggaccaggagacgcuggcuccucauuauccuguuacaaccagcgagugagaguuaccuggccuuuaaagcaugcuuauugaugguauuuggcucguugguuucuccuugagucaggcugagucuccauuauggaacaguccccugcagccccguguguuagaacauuugguucucaccuggucugccuguucugagagguggugggacugugaccuggcuaacagaagucauucauugaggcuggaggcuugcauccuaccgaacacucugccgaugugagaaguaacagacgcagccguuccuguccgccuuccucaccgugaugagcuagcugccuuccccgaaaccaggagccaacauaaaucucccuccagguuaccuuucugccucugaguuugccuauuguggugaugaaagucacuggcgcauguucaccagcagucaccuggcauuaucuggaggacacaggacagugaggcgguggugugagccagcuuugcagccuccaguccccucuuguaucacuuccuaccugggugacugugcccaaccaucccucgaccucagucucaaguauuaaagcgagagcacucaagcguaaaucccacacaguggugcaaaacggcacucaugcagcauuuggcuuucucuucuggauuuauauacucaguaucggugauuauguugucuguguugcuacaccaucaucuagagcaggauagcauuaucauugcuaacaucaggcaugagaagaauucgaagucaaaaagucuugggcccugcagcacugagauccuagacaguaccccaguccuaaguaucagacuuaaacuugggccacagcacacuaaacaguguggccgggugacucauuaaugaagucaugccuagucacucuggggcucuuccugguccugccccaucugccccaccacagcuucugcaaaggccagagccaagccuagaaucuggcaagacacugaguacacagaugagguccagaaaaccuaucuaauaagacucagaaaccaggugggacuguuuggggcagaggcccacagacugcugggcaagguguuaggggcuucuugccuugaaacccuguugccacagcacuucacagaguggcgagcauaauccccaaggccauuguagacucuuguucugagccacaggaagaaaugccucacauuuagcuuguaggggaacuccgaacagucagcaagaauuucuucugagaaggacagaaaugacuaucucccugccauucagugucuucagccuucugagacgggagcaagcacacguuugucuaugagaccaaggagcacagaaugugcuagaacugugucaugccuacagcugugucucuggcugacuggcuucagucaggaaaagaccaaugguugucuguggaccgucacuagacacugccuuccaaacugauugaugagacagcugugcccugucccgucucaaauggaacuccgugcagagaucccuuuuauucucauauuucugaagcauguugaaccagaaagcugcauuugaaaaaauaauaacaauauaaguugggugugguaacacaugcccguaaucuuagcacuuggagggaggaagcaggagcaguagaagcacaacuucaaugccaucuuuggcuaacuggcuuguuugagagcagcaugggauacuugacaucuagccucaggaacagccuuuaaaaguaccucauaauguguauauuauauauguuauuuuauguaagguuguuuuugauuauguguguaggguguaugcaccugaaugcugauaccuacaggagaaagaggcaucuggcccccucagaaccggaguuauagucuucugugagcuucuguggguacugugagcaugacacacucuuaaggacugagccaucucuccaaccugagguugacuuuaauuacaugcauugcauacucucauuugacagcgacaaugugguuauuauagaacauuuuaaaaauacaggccuagaguguucuuuuuuguaccagaaaguaaagacaaaauuuugcaaaugucacagguuuuaacuugaaggaguggguacauaccucugagguauuuuggauaucaaacuacauaauuauauuaaacaauuauaagccaucaaauaagaucaaguuuauacugauguaaagaaauggaagauaagucacuguguuaggguagaagagaugaugguguuggacauuugauaauuauuauuuuaaguugaagcugaauauagauuuacuauauucgaucacugaaaugugaugcagaucaagaggcaaacauagucucaaaacaugucucuuaugagaguucuuuuauaauaagaaaaaagaaaaagauaaacauaaacuguugaccaagagacggucguugguguuuuucaauuguuucccauaacacuuuagcucaugaaauaccuguaaucuguuucucuuuuauaaaaacaaaucaugaugugauugguauuuaaauauuccugacuauuuguuacacauauagguagaacguuugucaaagugacauuugcaagaacucuuuuagggaggccuagaugcucggucugauaaccagggucuucugccuucuugcgauucccuugggucugauuccugggguuagugaguaaacaugcgaccuuaaggcuuugugcaugugagugugcauggaggucagagccaaggaccaucagugaaccugggggucacugauuucaacagacucgcuggccagugagcucuggggaucuuccugccggcgccuuaccagcgcuagaauuucaggugcucaacacagcucucuuggcaccuuugcaguggcccugggaccugaacucgggucuuuuuggcuugugcagcaggcacuuuauaaacccagccucaaaagcauaagccuuugcacaucugaaaccuacugccaucugggaaauuuuucacuguauucuuccuucggggacagcaucacauuuccaagguauauauacuuauauuucacacacaucgacucaguaguaaucaaucagagaaauaauagcaggggccaugguagugaguucccugagcuccgcauucucucuaggcagcaguggggaagacugaagugagagaaaugcuggagcccagaggagccugggaaaucagagaagcccucacacaggcaggggagggaaagggaaagaaagguggacgggguggggguggggugggauuaaguucuucucuguaaugguuguauucugguaggacccagagacaaagauaauaguuucccaaagccacucuccugggggggggggggggcagggaguuagauuccauuuuuguaaaaagcucuagugugauagaaccugaauucgguuaagccagccuauaucaucuuuguaacuauuuuuuuuuaagucuugucaccuguucugggccuuuagacuauaauguuagacuagauccugaaauggaaaacaugguuuuguuugcugcaggcaagacuuugccuccccugccccucaguuaagccccaagcuuccaagagcaccuucuccccuuuggacacaucucggaucagcacugacgugguaggcagggcuuggugcaggauauacacguguuucuuggacaguggagcugugugcccuuuugaugccagccggugcccauggcaacccugaccagcugcaucaagccuccagccaggugagaaagggggacagacauaauuuccugauccauuuguuuuaccuguuauuaaggagaacaagcagcaagcuauugggaaaggcaccuuuugagggaggagaggagcaguugguaaaguuaugccaugcuuuuucuuacauugcccaucuugagcuggcuugaauguucucaagugaugacaguuggacugauuaagagccguuagucaaauccaguaacaguauuaaucugugguuggaaaugacuguuaaacuaagugccaggcuauucaguugugguuuuauuuccagcuucccaucaugccaggcuuccagcgggaggaauagucugugguaaaggaaaccguugauaaaagagagaacccacuaacugucacuacccauaagagcaaaggaacaacaacaacaaauuacaggaaaggggaagacaggaaacugaauaaggggccuaagccuagacaguuugaugugcacaugaggcaucaggcuaacgugacgggggugccuggggcagugacuccaguuuuccaguaagaaaagaaagcuuguaagcaccaaaccacgccguccacuauacucugagcaaggaaguugcucuugggggaaagcaauaacuggccuuugagaauauugucaguuuccuaacauuccccugaaaccacugaaacgugggcauuaucugagggggaagucagguguaccuauacaucagccuucaugcugaguccuccagagacagcacucgaucauacuucugccucuuagacaucgcgaagagacgccuguuguaauguuugugcuuuucuuuagaggguuucaggcuggcaucucuccauuaggguguaccaaaagaaugaggaguuucaggaacgugaggaggcaguccucuuggugaucccaauucagaguacugagaaguuggcugggugaguaagguccagaggaccuuacaaaacccugaggacuguuugaaaaguacucccgaagcauuccaucugccacagcagggaagcgguguuuucaaccagcccuucugcugugucucagugucucuaagaugaugaaaauguuugcauccucauuacuucuaaaaucgggccuugaauuccaaucaguuaguagcauccugacuucagcgagauacuguagauuucuuuagaaaccaaaguguaugguuuacucguaccgucggcaccaguggcugguuaacucaacagcaaaagacauuucaagugcuaguaagaaaaacacauuuaauuuguggacacgucuguuacaggguaguguaucggccagguuacuuuggggcagucacagaacccuugagcugauuaaagagaguuggcauucagaguuagcauggugcuugcagauugcaaccacucgugggcagagcagaacgggguaccugaccagccuggguguuuuccuccugguggucagagcagacucagugaggcuggcaccacaucugcucugagacacccacccuucuaucuggauguuguaaccagaagguucaccucaaauaagggaucuguaagcaggagccugggaagcauuuggcugugggacagggccauuggugguaagcugucauuuauaacagagcucagugucagccugcggcucccucccugaaagaggucuugccgcucucuggcaccagggucaccuuucacaauaaaucauuuacacaaaaaaauacuauugaugcccugugaccaaagaugccuggaagugagcuuccuuuugguacauucuggcaaauuaauaaagaagagugucuaauggcacucaacacaaacagaaaaguaagauaucuuuugaaacguucaacauauaaaagugauauaaucucaaggccuauucaugugcagugcauucagugccuauuggcauaugacuaaaagcaguaguuauagcccacgaaacacuuuuuaagggguucuaguuaauuagcugagaugaagagacacaauacaaacuucuaaguuuuuaaauuucucuucaggcaagauggacaucaugucacauccuguacccucagcacugaggcagaggcaggagaucagaugggcauucguggucaccuucagcuaguagcaaguuugaagccagccuaggauaugugaaacccaaucucaaaaaagaaagcuucucuggagucuuaauuuuuauguauucucucaaaauacauaaccaacuuguauauaugccacuggacaaugcacuggcuguuuauuacauacaguuuuacagucugcuauuugauuuuuuuuaacugaaaguauuaauuccugucacuaaacuaggaaucauguuuacccagcaggguaugcuagagaguuaguugauauaauacauguaaaguagcccuuuccugcaauaaguucuugguaauugacacuuggugguguucucuaugucuuuuuagguaacaacacuuuuuuuaaauagauuuuaauggaaauagaauuaugucacucccccauuuucccuccaaucccucccauacacccccuacucuccagcuauuauuauauucacauacaauauauaugugugcuuauaucuauuuguauguauauguauauauauuauaaauacacccuacugaaucugggguggugguggugguugugguggugguggugguggucguuguuguuguuauuuacaugcauaugguuccaaggcugaccacuccacauuggacugccgauaagggguccuucccugggagaggcuaacaauucuccuucucccagcaaccauuaguugccaguguuuuuuuguuuggugaguaggauccugugaaacuuucuccuuuccagauuaauaugacuauggauacuucugguuuucuggucuucuuuaugcauccauucccaggagaaacuguuucagugcuggcuucuugguauucugacucuuaaaacauuuccauccuucuuccuccauguuccugagccacugauucgggagcugugguguagcuguggcacuuggcuccccaugcuccauugaucuuugccuugcgcccaguuguuuucugugauacucuucaucugcugugaagagagaccucuuugagggguggcaguuacauuuaucuguggguauaggauaagauucagauuguaguaagaaaucauuccggucuagcgaaguggagguaauagacucuuuucuaagguccaugaucucacuagcucuguggcuucucugccuccacccuccaaggcugccucacccacccuacauuuaaguagguuuugaacaucucaacuccgauucuugugcuuauucggcaagcauucuaacugcugagccaccuccccuacccuacccuacccuccccccuaaaaucauaauucaugauuuucaucucauuucucuaagcuagauuaucugggcucagugucagcgcugcagauugagaaagaaauucauggaaacacuaccacugguaaacaaacauaaacaaaaaauguucacaucugcuaacaaaacucuguuaauauauucagaaaugacuauguuuuguugauaguuguauugucaggauccaaacaaaauucaguaaugaguuuugaacauuagguaaauguucucugaagagauuuuuuuaaauggccauaaugucagaccuucgguuagcuauguaaucucucagagucucagugugucuccaucaauauaaggagagugugcaagaggaguugguggcaggggcgguggcagcugguugguggcaggggcgguggcagcugguaagccuuauuucuuuaggcagaugacagggaauauaccuguuccugugcaugucauuuuccagauuguagcggcucuaaaguuaucuggugaccuuuguaaacagcauagcagagcaccaugggugaauuaaaccuagagagauuugguccagggaaaggagcaaaacaccaguauuaaaucuuccuugcaaaauuagucauaaugaaaccaaggaaguugggggaagggaaagggugcugugagauuaacagagaaugagagguuuuggagcgagugggaaugucuugcauuugccaccuuccuggcaggguugcuuccgccaggcagacuuuucugcccuuccacggugcuaacugcuuuguucgugugguuuauuaauuuuauaguacucuggucugugccacagcauggucagaagcugagacaacggguuuuuacagaugagcagagguuaaguacccacuugcucuccuugcuguguuaaucaguuacagagccaguguuaggagcccgggucaucuagucucuuggcuucuguggcuuucccguuacaugauucaguauccuagagccucagcaguggacacaguccugucccccucgagagacagcacuuccgccuggcaaagcuagauucaauccccagggggugggugggggagcaauaaaucaugcaccaaaaauaacaccuucacugcuaaauuccacuuaguaggugauuucccaaggaugagccagugcagugaaucaucgcccugagagcugauucgaacaguaguucuguuuuauuuacuaccucgugguuuuuaaccuuuagagccuuccugggagggucagagucuccucaccaugaauauaaaacagacucugcuuauaagccuucaagggucccuuuuccuuuuguuuuguuuuuuguuuuuuuuuuccuccuuuccacuuaaaacaucccaugaucaggaggacccaggcagaacaacagcuaacuuucugagguguugauugugcaggagcaaaccuggcacccugcagaugcuauaaacuggcauccauggccucccugggcuuccugggcacagacucacgugcacaaacacucucacacucaaaaugacacuuuuuuaaaaauuuaaaacguugggguugggagcucccccagucaagaagguuaggcaagcaugagaauuguuaggcaagcaugagaauuuaaucuuggcucccuagcacccacacagaaacuggaucugguaccuuacuccugaaauccugguacuggagacgugggucccagaggauucccugagcuuuuuagaugaguuuuauaagugagggacccagucucaaaagacaaagccgagagccauuaaguguaagggagccucagcgcaguucuguucagauggcacgaaagaguggaagaaauucagauccccuuuccauucacauauuaccugguuugaaggcaguuuaagaaaaugacacacuccgcuauaaauaccucaggacaguuuguccacauugacacuuccauuuccuaaaaugaaaaccucacuggcccacagggaugaggggaaguguggggggaagggggaggcuggcuuuguucaccaggguuauuucaacaagcacauccgaacgcuaggaacuuccucugaugacucaagacaguugucaaacaccagcguuccucuguuugaccccugcugaaguaagaucuggggaagcaugguacagagucugaaucauguagcugguguuuugucuguaucugaauuuacaucugucacauacccaguguguccacccaugaaaaacuacauucuucagcuaucacugaaggggaggggggaaagcauucaaaugggccuguuucaucuagacagucugaaaguucuaaggaaugccaugggcuuugcuuccugaacggaauuguugaguuaucacccaguguugggccuccauccagacugagugagauacagggaauacuguguucacgcaggauaccagcuggcuucacacuggcagaggagaaggggaacacguucgucaccauacaguacagauccuacggggugccagagagugugggccugauaaucgcugggaacauggccuugacuccugucuucacagaggcugccgcagcacuuggccacuccuuuguuaugacuguaaccaccuucuugucacuauucuucaagccaaacauaucuccaggguugaagucucacucgggcuacaguacaguuugagaaggacagucaccauauccacccaucauuaaagauacaaaucuagucugcaaguuuccugaagacguaagcugggucagagagguggcucagugggaagagcacuguuuguucuuacagaggacccaacaccuauguggcagcuucuaauugucugugacugcaguuccaggggauccaacaccgucacacagacuuacuuuguaugcaaaacaccaaggcacaugaaauuuuuaaaaacugaaaagaaagaaaagaaaacuuaagcuggcucuugggucaguucauuuugaccuguuaggacucacgcuguguuuuauugguugggcacaguacuaauuuugcaguucucagaaacaaauaaacaacaucccugacucucaagggcuugcaggaauuuuuauacuaaguauacauuuuuauacuaagcagauucaaaguuuaagagagaaaaugaaaaaaaaaucagucugacgcuguauagacuauuuauagcaaaugcuuuagcuguguuugcuccgacuuucacaucacuuguaggacucuggcugacgccggugcuuccuugcugaggaaagcuuuuuaaaguuaauucauuggguuuauuuucuguggguaugaacgugugcgugggcuugcauguguguggcaaucagcagaccauaucucuccuccuaccauaugggucucgaucaucaggcuuaguggcacgugccuuuaucauugaaccaucucuccuguuucauaaaguauacuuaaaaauaauuaauaauaauacuaagccacuccgacuaucaaacuccuucacuucagaaaugucuagugauuauuuucacaaugguuaaggcuuccauucugagaaagugucacuugccacuacuuggucacaaugcaguuuuugcacaaggaugacuugugucuugaguaagugguggucaugcccacagcugaauuccugaggcaugcuguggcaaaaacaaaaacaaacaaauggaaaagugcuauguuagagaaugagcccccugaauucaaagaucaugaaaaagaagugacuugugacuuuuauuuaguuguaugugugcaugugcacgucuccauggcauguuuacaugggucagaggacaacuuugggggcuugacucucuccuuccagcacguaggaccuaggggucaaacuuggguugucagacucagcagcaagccacuaagccaucucuccagaccaagaggugguuuccaaagcucuuaucuccauccccauaaugucacuuucacuuacuggcuuagcaugucuucaucgaggggaugaauacacuuguguauuccucugaagucaggugcaaggagaaaaugucuuuugcaugccuaggugcagccagugguccuugcucaguuagacucaguucuaggcgucugugcacagagaguccuugagaaucacuuccaugacguuuucucucaauggucacuuagucugucuaucuauguauauggauaguugucuccguagauagacucauuugaggguuuaacacugcacaaaaaaagaccaugugauuuagucaucucugguuuaauuuugauucucaacuuugggauuaaaacuaacgggguacuccgcuuccuugagagugcccuuguucauuccgcauucccccaucagcaucuuaacgcauacucuaguaaauccgagcccuuuccagaacaacaaguuacccacaucugguaccaagaaaaagguucauucagccaguuguuuuuauggcaaucaccaaacucucaguguuccuaauaacagagaugccagcacgcggcgccucccugcgagaggcgccucccucccccgaggagcauuugcccaucucugccugcuccuuuuuuuauuaggaguuuuccuuccuuucuggauggcucugccucagacgccccucuguucuccacgcccucucucauccuuuggucuucauugcaccuuuacuguaccguuuucaacuucaagcuucucucccuuugucuucuggacacccuauccugccuggaggccugugugagcucagcacuaaggcacagucuguccugcaugccuuccugcuacaucucuuaguuagcauagcaauugugaaugagccccgguuuuuaaauacucauucuuuccaggccucuaguucucuagugccucaugcagguaaaaauggauuuuaaguuucucuauguaauuuccauugauauauaaauguuuaugcaaguacacguguucacacaugaaugugugaacuugaaaaaaaaaacaagauagcagaguuugaaacaaggaagugcaguugauaggagagaaagggaagucucuaagggaugagcagccgccauucuguguaaguucaucuguggagagagggaacuguauuaaaugauguagacacaggcaccuguaaaggcuagcucuaaggccuguggaugguauaaaaaccagagucaacaaguaauacaaagaugggcaggcacaggagcagggagugcaguguuuaacagggagcagaaaugucuuuucugagacagggauuuauuuuauuauuuaaucuugaaugaaugguauuuccgaugguagagauucacuguauuauuacuuuauucgggacuugcgucagcgggugagugcuuugauugugguaaaauauguaugucuuacuaguucacuaccauguccuuacauuuuucuuguaucuaggccaaagguaguuuucuguccugaaucuguaauauuuguuuagaaguauaguuucuuaacuauuuauuuuaacucguugguguuacacauuaaacaguccacuaguauaaacugucucacuucaauaguguauagugggucugcugggguguucuaccauccccacacuaaauuucagaacauuuccaucacccagagagaaacucaauacccauucauagucugucuccaucagcuaaaguaaggaauuggguuacaaacaacagaauucauuuccuauaguugguggguugaggaaguacaagaugggguccaaaagaucccaugucuggugagggcugauuucuucuggaccaccuucucagcaucuuucccaagacaacauggugaggguccuuaaaggacuucucuaaggacacuagcuagcaccauucauaguucagcucacgaccaaaagccuuauuuucugacaucacuuugaagguaagauuuaagcauaugaacuuuucagagacauagcuauugcaccuaccagugagccccuguuuuagacaaccacaacucuagcuuaugguucuauagaucuuguguauauguaaauagacccauaacuauaucuguucuuuaguggcuggaugcuuuugccuaacauaauagcuucauaaauuaccuaccuguguguacuugauucuuucuauggcuaaaugguacaccauuguucuuuuuguagucaucaaauagugagcauuuacauuguugcuacuucugcucaggaaugauguguucuggccacucaugcacacgucuuuauacagacauguguuuucaguccuauaaggguauggaccuaacuaugccuacuucugcuuuuucacaauacucuuucuucaaucuuaguaaacuauucuguacauuuuaauuauauaagauacaucuaaaguuaauucuccuaaugacuagagagaugguuuggugguuaagaacauggacugcucugacacaggaccugaguucaguucccagcacacccaccugguggccuacaaccaaguguaacucaacuacagaggauucuaugcccuguucugaacacacacacacacacacacacacacacaguguagaacccugcugcuucuccccagucggguucagucuuucuucagaucaucuuacaccaagugucucuagucucuucacauugccucacuccaucgacuuaggcccuacucaucucucucgaccuaacaguccuaccccuuggccuagucuuaaccccuuuggcaaaccguagccuguugaaccucuuuaagccacucuuuguuuaagccacacacuguuuguugaagucauggagagcauccuacccacucccuaagcugcuuccucggguacguuaauuuccaucgggaagagagggcuaaucaggccacuuccacguauuuaguagauauuaaaugauugcaccaaguguggggcuucaucaguaacaggaaagagacaucucugaauaaccacaaauuucuuuaucuucuucccaauggaagcaaaaauccuugugguaaauaugaguguucguaugugugcguuucuaugugcacuuggugugugcaggaaaccauagaugucuaauaaggacaucagauucccuggaacuggacuuuacagcuaauugugagcaccuaauauauguauugggaaccaaacucaaguccucugcaagagcagcauguaccacugaaccauaucuucaguccucuacaagcuuuagauauaaagaacauacauggugcucuauaacuuuaaauauuguggguuuucauagcaaggggguuuuuuguuuguuuguuuguuuuguuuuguuuuguuuuuuuguuuuguuuuguuuuguuuugauuuuuuguuuuguuuuguuuugauuuuuuuuuuuuugguuuuuuuuuuuuuuuuuuugguuuuucgagacaggguuucucuguguagcccuggcuguccuggaacucacuuuguagaccaggcuggccucaaacucagaaaucugccugccucugccucccgagugcuggaauuaaaggcgugcgccacuacgcccggcacagcaaggguuuuuauaucuaccugccaguuagugccuuaugugcuaagugggugaucauucaauuaauguuuaguaaauaaaucaauuaauugacuuuucugugggcucugauuugaacagcuguuaauuauaaagugauaaguuuguuuccuuagauaauaacucuagaagggaguguagaguaaguauauaauaguaagauaguauuuuucgagcagucacuauauggacauggaaaauccuacccaccaagggaaggcaacagcugaaguaugccacaguucaaaugcagguuacagagguguucuauagggugacccccuggcuuccuugccuuguugguauucaauaaaaguauuuauaaaugaaaucuuucaucucgcucuaugcaugaaucacuuccuuucuguagcaggcaugucgguguacacucuugugcugggaaacacccugccguucacugagguuccguaucuguauguucuuuuuaguuguuuguuuuaaaagacauuaaucugaaaguugcccccuuuguaauuugacccugaagaaauugcugauagcagccuuaauaugcaaaguuuggagguuuuuguaaaacugugugcaggagaaaugacuuuuucccaguucagaauaaugaguucccuuuagaaaaaucagcaucccucccugauaaaauucccucuuucgcugauuaguuauaagaucuuuaauauguaauaaauacauaguaacuuagauaaaggaccuauaugugauaugcaagcucacuauguagguaugugucaguguuuucuuccuugguugauuuuuuuuuuuuuuuuuuuagcucuugaaacaaggucuaacuuacaugaccuggccuuggccuuggccuggccuggccuggaacuuacuauggagaccaggcuggccucagacuuaagugcuggaguuacaggaguguccugccacacccagccucuuccccugcauauccaccaucugaagcacuucauuauccaauauaauauuaaccaggagcacgaggagugcuugucugugggggacuuuauuuauagaugucuuaaaucucucucucucucucucucucucucucucucacucucucucucucucgugugugugugugugugugugugucugugugugugugucugugugugugugugugucugugugugucugugugugugugugucugugugugucugugugugucugugugugugugugugucugugugugucugugugugucugugugucuguguguguuuguguuccacuucuagauccguuuugaagcugggcauuguaguauacgauaaaguaucacuuaguggauccuaugaaguagauguuauuaucuccauucacagaugagucaacuaagaauaaaacaagucaagggacuuuccuaaagucauguggagagaaaugguuggguuggguguuucccuaacaguccauaccaguguuugcuccagucagcaaacacccuuuaaacauuagucugggaacacagcauggugguagcuugcuuaccuagcacuugugaggccuugaguuuaauucucagauauauguauguauguguguguguguguguguguguguguauacacacacauauacacacacacgaagaaagacauguagagaagauuucaagagaggcuugaagaaaagccuugccaauaaacaccaaaaagauguacuuguuuugccuggcagugccauagauggcauugaacacaauuuugccacuggauuuuguaaugcccuccuguaguaggaaaaaaaugcuugcuuagcuauauuagugaaaugaauuucuuucauaaaggauuucaaggcuaucaaagauggcucagugaauaaagaugcuuguugccaagccugagaacuugaguuuagucuccugcacccaaacaauggaaggacagggccauggccuaagagcugaccucugaucuuuacacaugcacugugacgcucauguauacacauccuaaauaaauaaguaaguaaauaauagguuaguacaguuuuaucuucacauuaacuauuguaagguauaaaaauggaauaucuaacauaaaaacuuggaaauaagcuaaaauuauuauucauaauagucauuaaaaugaauaauacuccauuuccaggcauuacacacacacauacaaauauugacaaauaaguugguuucaaaguaugacaugacaaagcccuagcucaugugagaguucaaaauaugaaaagauucaugucuauaaguugugcaaauaaaugaucaugggagaggugaguaccugugggggucagagggcaucucaaguauuggcccuugccuuucagcccuguacgacuuggucuuugugcucucugcagcugccacacgggcuagcuagcccacagauuuugggggucucuccuucucugccucccagugcaacacuggugcucuggaacaaaugaaauacauuugcacaccacuggcccuccugcccucgugcaugugcaaaccuuuucuuuaccaaagcaacccugucagccauucacaacacagagagugcucuguuuucuguagucacgucuacauuugucauacauuucaauuuaucaucacaugucauuuauuguuuuaaauauguauuucuucuuucuguguuuacugaguacauauugauugccaagucuagaucuaacaauuuucacaucuggaucuuauuaugaagaaaguaauaaguacguguauaucuguauguguaugcacacauauuugcaaauaaaaacuuaaaaaagaaugugcagucaucucaagaaaugaauauaagguaaauuauacacacauaaccacauaugccagagcugaggaguacccagagccgaugaaugacaguucugggcuagcggaauuacuuauguuauuuuaguuuuaguuaugcuagcauucaugaaacagcuguucucucuucucuugagagacggcgagggugcuuccagccgcuuaugugugggauugaaaagaauaaaguuugaccuuguucuaugcgcgugagcugagcaguaaguaaggagucuacucauaucaagccaaggacuugggaagggccaugcuggggucuagggagagcuggugcguccccauuaaguuggcaguggggagagauguauuguuauuagggcaguuguaacaagcugaaagaauacauccacuauaacaaccaagggaguuuuaggacaugauuauucuucugagcuuugcaaaugcacaguaauuugcaggaagcccuucucuugcccuguggaggaaagcgagcccaguaaugaaaaugaaguggggccaccugucagcugacuacagucuaaucaaaacuccagcuugaggcucaucugguugguucaguuuaaguguuuagugauuuaucuuagaguacagguuacaauaggagaauaagcauaaaccauaaaacagacuuaugcuuccaaaacccuugaggguagcuugcugcgggcucacuuguaaaaaucacuuggaaguuuuauuugcaggcugaucuaguuuuuaaaaccagcuuuuaaaaugagggggagggaaggaggagagggagagagagagagagagagagagagagagagagagagagagagagagagagagagagggagggagagggagagagagagagagagagagagagguggugaguacaguugagucuuauaaaacaaaagaagcaccuucagcugggucauaggaaaggcagagugaggauuaaacauggacccgugaagagccaccugcugucuuuggcagaaggugcugcuauauaagguuuaagcuuaagcgaacagaaagucaucuaaaguaaucguaguucgugaugauaauaauauaaugugugaaacucacggucuuugguaauguccuauguaauaaaaaacgauuuuccuuauauguuaauuuuaggaaguagcuauuuuuguauuguauuacugagccaggaaaaaaaaaugcguguacagaaguaucuuugaaauuuuaaaaaguauccuucagauuugcuucuuucaauagaguaucucuauugcugaauuuuaaauaauuuauuuaaaagaauuaauaggucugugauccagaggguggacggaaaaaagagguaaaaugguaucaaaaaaaaauuacacuaguuuuuucucuugugugccuuugucccacuggguaccaucaagcaucccucccucucuguccucauucguccuguaggaccucucuaaggucccuuuggaauucugggacacacaggcuuucucagaccaugcugugaaauagauuugaggcuauaugggccucaucugguuugucucugccucgcccccuuuacuucuuucugucauucuauuuauuuguuccuucagcccucugcuuccuuccucccagucauaaagaucccgccaagucagcucauuucucccuccucccacccucacccccauccccaucucugucagucagcugagucaguuuccauaauuacaaaaugucaccuagggggcgacauuaaaccaaaaaccaugcuccuuuccuugaggcugggcacagagauaacacaggugguuguggagggccugguagcggguuuauaucuguacuucuguuugaacauguuuaaccuaaucuuaagcaggucauuugaggaugucuaacauggcaaaggagaauaauuauucauuggcuucagucagccuacaugccuucuugucuccucagaauacacagacuggccucugagaucuuuuuaaacccgagagcaucagagagagacuauuuccugggguccuguagcugccuugccuccucucuccaugucccucugcugcacaucaagcuuugagcaggaugcaagcauguauucuuguuaccaccacucacuuuccuccuaugcacagauggccuccuguagacuuaaaccagcucauguggacuaaucagaauucuccucuagaaacuagauuguuugaacauuuccaucacguucauaauuagcuccuuagcccuuucccuccaacaucuuccugucuauugacuacguaucugcauccaauaaaccauuuuacuggcagcugacauuucacugcagucaccucucagcaggucuauguaacugcaggcaaaccauaucugcugcaaagcuaaaugacaagaguucagggucacguuguacaccagauuucuccaaaggaauggcacucauucauucugguacccggaguugcugcaucagagagauuucagucuccacaaaggacaucaucaucauccugaauguucacagaacauucuaaugucacugaggcccugcuugucacacuugucacuaaaggaagcaauggcuaauucaaaguuggcagagcacaguucauccuauagaucaaauccagccaauaaguagagauaacacaauaguagaauauugguccuguugcucucugcuggaacacccaacaguaaaaugaacauuuuuuuuucuaggaugucauugaaaacuuugucaggauagaagagagucaaaaacugagggggccggguuuccaugaccggugcugauccguccuccccaaaaccugcgcauugaaaaccucuuaaccuucaggauaggccauuagauuaggaaguggaucccucacacauauucgagcucagccaagacaggcccauuuuuccuccccuuggagcaccaguccccuucccuccaccucgucccaggguugccugacacccacauucaaaccauagcagcuacgagugagugcacagugagugguggguugcuucguuucauguugaaguagagcaagaauuuaaaggcucauggaccuucagaaagcagucugauuacaggaccccacagcccuagcuugugaaugccaggacucuaaaguacccccuuccagaaacccaugcugcuuuucccaaguggcuuagcugcagagagcugagcuaagagaacauuugugaugaaaaucaggguuuugacguaaccgcaagaugcucagcucaggcuucggagcacaucuucacuuucuacuuugcuuacuuuuugagacccacuuaaaggcuaguaagguagcagccucaguaauggaguaacgcuucuuaccugugggguuggaugccaucaacacacauacacuuuauauaaugcaauaugugauauaauaaggaauauaauucuugaugauaaucaucaauauuuuaaguagguuaauauuaauagagccaguuguagugguuuggcaguagagacucugaggcaggaggauggugcauuugaagcuacuuugaguccacauaauaaucuacuccaggcaagagccagcuuuggggagaggcucucacucaaaaauauucaaaaauuaaacggagacaaaaaaagcuauuuauguucaccaagcaaagagcuaaaaaagauuuacuuguguacuacagauguacaauaauaauaaauaaauaauaguaauaagugugugucaauuagaggaaaguauuaggacaagacuuauggggaaacuuacagauguccccacccucaaaggacuauuuggucuacuugggaaaacaccagaaaugucacaaagggaguuuauuucauugccagugaaaugguugcuguagauaagaaaggcuuugaguucagaagagggcacaguugccucugaacaugugacgguuagcaaguauaguacuaaggaagcagcaagcugcacgcucccagauccaggacagauaagagagaggcccgcaaggaaggacccugggugugaacagcaugcugaggguagccucgggacucccacauaccuuuagugggaggcucggacugagaugggcuccacccuauugcuaaauuacacugaacuguaaaacccaggccuguaggcagagugucguagcuuugucaccgccacagcugcaaacaggacacucguucugaacaugagcuagcacagcaaccagaagaggcccugcugggaggaaagugcacagaaagccacccuugaccagagaggggugaucacacuccuugcuucugucaguaaaagagcgucuugcuugcugcugagcagugcuaaugacagauaauuggaacguacuuucaggaaaugccugauuugaagauguucucuuuauucuugcaggccucuuuuucguggaaguucagacguggaucaacuaggaaaaaucuuggaguaaguaauacuuuuauaguuguccaucacaugaagcauuugcaguggcuuuccucugacuuucucuuaucuuccuugcuccaagcugcuacugcaggcagucugacuaguugugugaugaguccccacaagguagaguagagcugugucacacggggcccggucaugacgcguagccuugaugcugugcccugaaugcuuucguguugccugggugggucuuugcugcuucuccuugcuugagcucugagcucccacuccaugguacagauguguuggcugcuugaggucacaucaaauuuacuucucguaagagaugggacacuuggugguggcguagaaccccagccuguccaaaucgacauccuguucccauugaggauaaccuggaguggguuuacugcaccgugcccagcucccaauugcuaacuuaacccuuuucuucguuaacuuuccccccugagcgauggaagggacuccaguuucuccgugccgccugucuccagcucaugcauugcuccaucgcucuccggugauuugcaaauuucauucauaccugcauguuugugcacgcuuuucgugucacuagaauguaacugggccuucucacaaggcgugcuguguggcauccuuuugcugagucccaccccaagaaagggaaaauggaaagagauaggguccuggcuaaaaaucaccacuguuaacacuuuuaugaaucucaagcacaaguacuuuuuauggaauuuuaaaucuauaagaccccuucccucuacccguguccaaauagugccccuacagaauuuuccuauuuaaaugugauugccucaaaccuggaaucaccccaaagcugagguucuuucaggaacugaucugguauggucuggugacuucccagguccuaggcagucaccagcaccucaucuccuggugauacuguaaaguggacacuuuguccaccuagccuuuuguuaggcugccuaugcauggaaaguuccugucgcuaaccacuggacucugagacuguggaacguguccuguaugcaugugaucuucaagaaggacccaggaacauaaacuuucuaguauuacccuguugcgugaaaaggugaucuugguagugugugccugcugggcccuggaggccaucaucugcucuccauuucuuaugccuggugggauuccuagccaccuccagcacccagucucuggaccuguggcauuacguguacugccacaaagccaaugcaguaggacagaagggacuuuuugcuuguuccgugggaaagccugcuugacuuuuggccaaggccuggcacucccacauagcuaacagaagagcagcuggaaagccuuguauguuuggugccuuuagauuauacuggcuuuguuucauuucucugaacagugcucucaacgggaaaaggacaaugcugcacccuagugucacugcuaacccacuucauuauuuccaccacagccauuuuacagucugugcccuguaguucuuccccguguaaacagugaacgguuacagauucuauccaaccguccaaauagagaauuaugaugcaggccuuaucgaaugaaccugucaugauuucauuaugcucauuaagggccaugacaguccuuauuggacaggaagcugauuuuuuuuuuccuaaggaaagucauagucucagacucuuaacaagguaagcuguagacacauuucuacuuucagagagcauugagugcuucagaaggaaagcaguuaggccaugacauuuagagcguuuucuaagaccaguaucauaguuaaguggagguauaaaaaaaaagaugcugaacauggagugaggagaaccgaggcuguccgcacagugugugaccugggcaggcauucuccuuccucauuuugucuuccaucccuacagugagguggcacaccugaccuaugugucucucacagcuuuuuacaggagauggagaagacaacaggcucuaaguuuuauucguauguauuuguguauguguguaugugugugauauguauccaugcauuaggugugguuaauauguauuuacauaucagacuggcagacagacuguuucccugaaagcgucuggcuucugacugcuguauucauaagguuucaaaucagcaaguauguucaaagcuacuaauaacacucaggaggcugagacaggaggauuuucaguuggagaccagccugggauaccuagugaaacacuaucucaaaagaaaagaugcugucugucaauaaagugauuuaaagucuaagcaugauuacaauccguuccuaaggggcugauaaugaggauguacuaaaguccuuguacaaaagggcacacauuucaaacuguuugucagccauaucccauacuacccaaacccauccccauguuacuuuucgugauuaugacaacauuuuuaccccuucauuacccacuauagaccuggcuauugagcacacuuauaugaugcccaagucaugauuuugcucaaugauuccaggaagucuauccaugagucuuuguaugccugaguaauguaacucucugcagaugcccaguggggacagaguuagugucuugccucggcacccaggggcaugugcgugggugauggcgaagcugcucuuuccagggaggucugugaccugggcucuguaaagggaagggaacagugauaaagcccugugacauuuaccugucacauuauauuauccugugacauuuaccaccuccuuuccuaaaagaugcuugugaccacgcuuucuaggccugcgcgucaggaagucagaacagaaccuuaauucaggccagcgccauuucuaguuaggguuaaaauaguuuggaucauuaucuaggucaccauauauccuguccgcucaacugugauuuugucuucuuuuaguucagaguuacugagucuguaccguccaaauacacuuagcaccuauacauaaacuauaaauaauacuacaccuggauaaaucauauagggccaccugcuuaccauuaauaaguaacaaaugguacuguaaugugcaguuucaguaaauuaccgccaacccucauuguaaccauaaauuauuguugucacguacauaaagacaccagggcucauaguugucauguaauuuguccuuaccugucaauuaagggcaggugcugaauuugaagccacguccgccuauuuccaaagcucuuuuaugacucgcuguuuccuccacauuucugaucccagaaugguagucaggggggaaucuaaaugauacccuuucuaauuuucuguuucucacucuggaauaccauuacacagcgcuuccauaagacaggcccaucguaguuuuuaaccuuaucuuugagucuaauuuauguaaugguuuagaauauugcucuuuaauuuacgaaccucagccaaagugaugcgugucacaagccgugccggacgagcugccugaaaacacauuuucacagaacuguuguaucacaccacaaagcgaagcuucggguguaggugaagacuugguauaucugaugaguguccuucagaauggcagacccugccuugucacuacaccaagacuuacaccaggggggcgcccugcccugucacuaagccgggacuucucccuggcugcaccagugccauucacauacacaccuuccaucgggggucugcugccagggacagacacuuccucuugucagugaaguuugcaguaggguaaaugagaaguccuuucugccaugaggugggguucucccugugccgcucuaagauuugguaaggaaggucauguuuaaaccgcaggcauuuacauucccgucugguucuuccguagcaucauuggacucccaggagaggaagacuggccuagggacguggcccuuccccggcaggcuuuucauuccaaaucugcucaacccaucgagaaguuugugacagauauugacgaacuaggcaaagaccuacuucugguaaguuccugggaugccgucaccuugugccccaaccauguggcaacgacguggcgugggaggcuguauuuguuuuuguggauuccguuuccagcuggugaguuuugauucugcaaugucuuccuaacccagcucucaacacuugaaugugaauuuggacgaagcuuuaugagacgcuagguuccuugggcaaaggcuucuugacaagaaauugcuuuucuucgcuugaaguuucaugccacuugaagcaacgugcuagucgcaucuuugcaaaauauuuccccccaaaggaaccaaguaaccauacuuguaguuauugauuuacugaauaaguaccuugugugcuauucacauauaagauaucccauuaaaaacaagauccuagggcuggagaggugucuccguucucaagaauauguaucauuuuugcagagggcccaaguucaguucucagcaccuguacccagcagcuuacagcagccuggaacucuagcuccagagacacucuuggccccacaggcgcuuggguucaaacgcacauucccacacacagagacgcgaauacuuauucuuaaaaugaaguuuuuuuuuuuuuaauaagcacuuuuguauuuugaaacucaaacuccucguuguugguguuguguauaauguccuuccugcagacacagaaggcccucuuccuucuguucucagagucagagcccuaugaagaauaagucuguuauugauccugaauuaggagcccguacucuugauucagaccgugggucuaucaaaccugcaugugucugugugucucacccugccugguggcauguuuuucucauggaggcaaguagaaccaugaccaaaggccuaggucaguuauguggucagggcagcuugaagaaaggugagaauguucaacccuugaguaaguugugauacuagaagguaauuuuaagucaggugucugguaaucacauuaauuguuuuuacggaagcagcacuucuugugucgggguguuuuacuuuaguucaugucgugcuggugacuuuucuccccaaauagaacuguggaaaaauuuuagccaccuuuuccaagacuucccccaagguccaggguuggccgugcuauguuucacaccagauguucucuguauugcagaaaugccugacguuuaauccagcuaaaaggauauccgccuacggcgcccugaaucacccguacuuccaagaucuggagagauacaaggacaaccugaacucucaccugccauccaaccagagcaccucggagcugaacacagccugagguuccacggggaugcccaugagcucgucaucugaacacauuggcggcugcgaguccccuaagcaagccucucagagcaguugaagauugcuggcugccaaccuucuggcugccagcuucugggugggcucugccuuaccaaggaaaccaccuaguuuacuguucagagaucaaugcaagggugauugcagcuuuauguucguuuguacacuuguuuguuuugucuguuuguuucaagaaccuggaaaacuuccagaagaagagaagcugcugaccaauugugcugccauuucguuuucuaaccuugaaugcugccaguguagggugggaauccaggcccagcugaguuaugauguaauccgccugcagcugcugggccugcuuugguacuugugagugugugugcaugcguauguguguguaagagagaagaggaggggagagaaagaccccugaucucgucaaguguuacuuuuuuuuuguagaaaacaagaauaauugaguuuuaaagaguagaggugacugauaguaagaagggcuuguucagugaaaggugauucacaauggagucuuguuaggaagguuggaccuaaguccucagaguugccuuccuguccaaaagcuuuugcuagcaguaaacaauaaagguuuagaugccacaaaaaauggggggaaccacaauauuuuuuaagagacuuuuuaaggcauacaucuucuauuuacucuuuggaaagcugaacuuaaugugucccaggcccuauauauaguacaguauguacuuaauuguuucuuuggggaaagaugcuauaaguaucuuauuacuugcaauacauuuaaggagugaguguaccucagauagguuuuaaagauagagagcaccuguuuucuggugugagauguuaucauuuucuucacgucucuugauaccuugauaccuugucaccuuagggaaucacuuccugcucugacuagaggcgggaauaccaucuagcugucuccaccacccaccauggcgcaucugccuugugcugccuuguguagugcgaagcucucaaccaccagcacuucuaauucauuuuccugccacugccuggcuaacgacagauggcccagcugccccaaucccacacccgcuugcacgcuuaccgucuuucaccgaaugcuuugggcguaggcucccauuccgaaacccuaacaguauccccuugugccuuuguaauacagucuucccccugccgcagcugaggucaccuaggcagugaagagugcuuguucuguguguguauagacuacuaccgacugucacuugguguuuccuaucuuuaaguguauguugucaguguaaugucugaggaaaugucuuuuccucucuucuagagauaacuacuuacucucuaaagugaucucucugucuguccgcaggauguguuucug

SEQ ID NO: 12342 - RNA, 32627 nt, Mus musculus
uggaaggacauaagaauagaauauuaagaacaaccauagcuuaaccaccaucucauaaaacuauugugcuuuggucuuggguuuuuguuuuguuuuggucuuuuugugguggugaaacagauaagaucucacuauguugcccagaagagucuugaacccucagugauccuuauccuccugccucagccuucaguugcugggguuauaggugucuuccaccuauuauauaaacacugaauucccaaaauggauacaggaaccucaacuaugagcaugcacccaugaguuucuacagucuauugcgacauucagcuuuugacaacagcuccccuugauucggacauggcggucaggaagggcuacccucugcucucauucugucuucagaugucuccauuccuauuugcaauacacuuacucugcuucucacagcugaguuuucauucuuugcuuucuuaggaacgggaggauggaggauggucaccgauuuaguguuaucauaacucaagacaagaaacuauucugccaaguuuucuuuuguccagguucauuaauucagaacuuuaucagagaacuucaauccaacucuugacuuuguuuuuuuguuuguuuguuuguuuguguuuguuuuucgagacaggguuucucuguguggcccuggcuguccuggaacucacuuuguagaccaggcuggccucgaacucagaaauccgacugccucugccucccaagugcugggauuaaaggcaacucuugucuuucuuaaacaacacuuuccucaaagaugcauuauuuuccaguguuaggccaauuuguucucaaauuaagcagaauuucaacgucuuguugagccaguuuguaaaccccaacuucauuuaaggcugcuguggcaggaaugugcucggacacugacugcaggacaucuuucagcaguaaugcagaaccgauguucaaauucagaaugaugcaggcuucuuuuacacuguuuaggaaaacaagaaagaagagaugcucuuuuggaccaccuuuggagagucuacacagccauuuaacuaucuauggacuacuugguucuacaugugcugggacuacacaagcuguacaggguuaauagaucauucaggcuugucuugguacgucauuaggauuugucucaggacacuguuugaugcuaacagauuauuaaauguaacuacgaguucagcuagaauuaggacuuaggggaaaagcaaaggaauaaaaaugaaggcagcaaaaaggcaaaacagcaaggccaaccaagcuauaaagaggcuggggacgaugaugcgaguguaauccccacacucuggaagccaaagcaugaccucugugagcuccaggccagccuggucuacacuaugagcuccaggccagccaaggcugcauagcgagacugucucagaaaaccuaaaccaaacagaauaggaaggcugguguggcggccgaggauaaagcugcugcugccggcaggcucaguccuuggcaucugcguggcaggagagaacuguucccacaaguucucaccuggccuccaccccacacauggaaaccaaauuagaauauuuaaauaauaauaaaaguaaaagggggcugagacuucauguacgagguaggguacuugccuaacaugaaugaagcaugggaggggcuuuggcggguggggugagcaccuguaaacacgguacucagaagacagaggcaggaggagcaaaagcccagggucacccucugcuacugaguacuggguucaaggccaggcugggauacauggaaccuaucucaaaaacagaaaagcaaaucagaaacaaccauaguucccaggaagcauaaccuuuuauguuucaaaggaagguuuccaaauugcacagacucuuuacuuaauguaaauuuuaaaucaauaaauuuuuuacuagauuccuaguaacuguucucauguuuacagcuauaguaagagcuaaaauuaauauuaaauuuguaagaaaacugacuuucaucuggucuaggcuauuguuaggcacuaaaccuaauuuucugcauuuuccuaauuuccuuauuuucuacagguggcagaauuauaccuguaucauuuucuauuuacucucccaguuauaagcaaauagcauugaaccagaugcuauguagcaaguucaacauguaauuuauaguucugaucaacuuucuguugauguauauaccaugugcauuauuuugguuucccuauugugucuugaaaauauuaacagacauacaaugaauguuuuaagguuuuuuuuuuuuuuuugagacaggguuucucuguguagcucuggcuguucugaacucacuuuguagaccaggcuggccuccaacucagaaaucugccugccucugccucccgagugcugggauuaaaggcgugcgccaccacgccuggcuugcuuuaagguuuuaauuauguugggucccauuuuggcucugguuugagccuugaggacaaacccgagccuggcucgaguuuugagaccagucucagucacuucccuacugggaugaccuguuaagcccugccucugccccacuguugcugauguagagcuuugccauuggcccugucagucacuccauacccucugucacccuuccuuacccccuauauacaucaucuuaccccaccaaaaaucccucucccuguguucugaacuuauauaagcaagaggcugaugccauaaaguugaguuccugcuucgacaagacucuaggcucaguguguuucuuuugggccaucgauacuugccaucccacuuagcccccagagagaccccaacagggcaggaccgggaccuuucuccucucuccuggaccugcuggcaaggagccagcaauuuguugcuuuuuagauuuuuaaauuucauguguauguuuugcgugcaugcaugucuaugcacugugugugugccugaugccuguggagaccagaguguaagaugcccuggaacuggaguuaaggaugguugaguuaccauguaggugcugagaacaaaccccuguccuuugcaagagcaucaagugcucuugacuguugagcaucucuagcuccagauuuuaauugaugcuauuacaaaagauaucagcaaaacucugaaacuguuaaaaagaagccagcuccuccagcguuugcauacaccaccaauacuuauggcuggacauuggacuuacuguuuaaaauaguuuucuggucucuugcaauagugagaaaacaaaggaaagagguuccuugucauaucaaacugcagcugggcugcuccuccuucguugaagugguuagcaaggauuaucugcaacaaagagcgauccauguaauggcugccaucccaggcaaggguuaucugcagcaaagagcaguucaugcagcggccgcccucucggccccggccccgucucccgacucacuuccugguagauguacagguccagcuucucugccagcauuugccagaagauucugaauagcgagaaacacagcugcugcuccagcuggagcagacggucccguaaggucagcaggagcgggcaggcugagcuggacagcgacaucacugccuguuccgacugagacggcagggacaaccaucuggaaaaacaaguaaccuucacaagagugacccuuaccacucuguauccuuaaaguuucaaaacgcaauuuuaaaugugagggggaaauauaccguccuggggaaaaucuggaguuuaaaaaaucaugaugucuaauacucaaagcucuaccagaaauaaaugucucuauauuuauauuuuaacuuuuaauuaauauuuccugaaaaaugcccuaaaguuaauuacuuuaucuuuagaauuccaaagauaccaguuaaucuuaugcucugguuuuuuuuuuuuuuuuuuuuuagauuuauuuauuuauuauauguaaguacacuguagcugucuucagacgcaccagaagagggcaucagaucucauuuacgggugguugugagccaccaugugguugcugggauuugaacuucggaccuucggaagagcagucgggugcucuuacccacugagccaucucaccagcccccuaugcucugguuuuagcauacaaacuaacaguauuuccaaacugacuggaguacuguguggaggugccaugccaggguacagaggcaggagaguugugacaggcaagcaugacagggcauagaccacggggcacuuuccuuuguaaagugagugacacucggacaacugaaccucucuaagagguccacaccaucacucauuuauucuaaguaaauucuucaaaagaauagauucuagaacgaucccaucaaaaccagugcuuagagcuaccauacacgaaagccccaaguuccaucuccaagacuuggagugaggauuuuacagaagcuaaaacagggaguagaaaugguaucuugacucagacuagcguguguaaaggguaacugacacaggacacaccuuucuuucuuauacaacuuugcagagucuuucacuucucugaaaacauggucuacuuggcgggucaacauaucaagcuucaaacgcucuaagagguugaucaugucaucgaagaccgagcucuccauggaggccagcugucccagcugcaguuuacugaggacguuauucucugcaaagaccuccagugcugccuguugcagcugcagaaagaacugcaaacaaacaucuguuauuacauuuauuggcacaauucuggacauggcaaaauagaacgucuauaucacacaauuuccuuauuuagugugugcagcucagggccagugggauggcuaaauggguaguuacuugcugcuaagccugaagaccugaguucaaucuccaggauccacacagugugagcaaacaacccuauccucuacaugugugccauggcacaugcauaggcacauacucaagugcaugugcacaccacacacacacacacacacacacacacacacacacacacacacacacacacacacacacacacaccacacugcuuggcauggugaaagauaucugcauucccacacucaggagcugacacuggaagauuaccaugaguucaaagccaguacgggcuacaggagacccugacucaaaguaaacauaaaagcuuucaucucccucaaaaucaaacaugcagcucaggaccacugugauggcucagugcacagaagcacugucacuaagggccagugugauggcucagugcacagaagcgcugucacuaagggccagugugacggcucagugcacagaagcacuguaagggccacugugacggcucagugcacagaagcacugucacuaaaggccagugugauggcucagugcacagaagcacugucacuaagggccagugugauggcucagugcacagaagcgcugucacuaagccugacgcccugaagcuuuaguccugaaccccacaugguggaaagacagagccaagcucugcaaguuguccucugaucucaacaugugugccgugacacacacauacgcaugcacaguauaaaucauuuuuacaacuaaguggcuguaguaacucagagcugugcauccaccauuucucuagagcacugccauuacuuccucccuacaaaauccucauucaugucuaucuccauuuugugcccacuccuccaacuccaggcagucacuaaucuacuguuuauggauucaaugaucauggacgucucaagaaaauggaaccauaugaaguucuauucuucaugaccagcuccucucuuagugccauagcauguucuaaguauguacuucaugcuuuuauugccccccaguacaucacaggaccauacauuuuauacauucgcuagcugauacacguuuggacuguuuccauuuuguaucuauugugcauaauguugcuuagacuaauaugugcauuuuucuguaaaaaguguguuccuuugucuuugucuguccugaggaauggaacuguuggacuuguaacuccacccaccgucuuaagagcugccaggcugccucgcccagaagcugcagcaguuaagucaccaccagccauagccagaggucugaagcucugccugcacagagcagguuuguugcuucagucuggguuggguuuugaugugugaggguuuuguuuugguuggagacugaaucuugcuguguaguugaggcugacaaaugaguaguucaguguagcuuuguacucauggccagccuacaucagccucccaagugcuuggugugcacucuuuucugugguacuauguagucucggcuggccuggggcucugcagauagagcuggucuugaagguguggcaccccuuuugccugugccaccacugcucagaagccaggggugugccuccccugccaguuucuuuuucucacugcaguauuuuuuauuuuugauacuguauuuuucugcuagugagcauguuccuuuaaguauucaguuuuucuaaacacagacugaaggcugucagaaaccuggaguucugacagucagagaacuaaaaugucauuuuuguaguagucagcccagaguuaccgauggccacauguccaggaagugccugagaaugcaaccagagaugaccuguggagugggcaugcccagucuauucauuacacacacccugccugcacuuaucaccgacaguaaaacuggaguucugucacagacaacugaaaagaaaauucugagagguuggacaauuugggaguggcauggcccaacaacaaaugguuaucaacagccaaucagaaacaaaggaagguaagcugccguucucuucucugcaucuggacuugugugggaacagaccuuugaugaagcacuguaaggguggcuggaggacuugcugugaagacaaaucagcaccaucaaggccagaacucaguuaguacagucacagucacagccacagucacagccacagucacacaggcacagucacacagucacagccacacagucacaaucacagccagucacauaguuacagccacacagucacagucacagccacagccacagucacacagucauagccacacagucacagccacagccacagucacagucacacagucacagccacagccauagucacacagucacagccacagucacauagucacagucacagccacagucacagcuacagccacacagccacagucacacagucacagccagucacacagucacagccacauagucacagccacagccacacagucacagccagucacacagucacagugucacagccacacagccauagucacacagacagccacacagucacacagucacagccacacagccauagucacacagucacagccacagucacacagccacagccacacagccacagucucagcuacagucacagccagagacacagcuacagucacaguuacagccagagacacagacagaaacacagccacagucacagccacauggacacagacacagucacagccacacagucacagccacagucacacagccacagucacacagucacaguuucagccaccaucacagccacaaucacacagucacaguuauagccagagacacagacacagucagagaaacagcuacagucacagccacauagacacagacacagucacagccacacagucacagucuuagccacagccacacagccacagccacacagccacagccacagucacacagucucagccaccaucacagccacaaucacacagucacaguuacagccagagacacagacacagucagagacacagacacaguuacagccacacagacacagucacagucacacagucacagccagagacacagccaaagucacagccagagccacaaagucacagccacagucacagccagagacacaaccagauacagacacuaucagucacaaucauagccacagucacacagucacagccauaaccagucacagucacacagucacagccacacagucauagccacagucacagccgcacagucacagacauagccacagucacagccagucagucacagccacacagucacagccaccaucauagccacacaaucauagucacagccauagugacagucacauccagagacacagucacagucacagcuauagucacagccacagucacacagucauagcaacagccacacagucacauccacauccauauccacagucacacagucacaguuacacagucaaagucacagccagucacaguuagagccacagccacacagucacagccagucacagagacacagucuaacauguaauuuuuuggcuugcagcaaagucaacauuugaaaggcuaaaggagauaaagguacuaauaaauuauuuccuauaaaagcacauuaacucacaacauugucagcccagucugccagcacugcugagauauaguucacggcauugagaaucgcacaguaccgaaagcccagggccgcucucgucuccuccuucaucaccugcguuaaccggauccugaaaucaucuaccagguccuucuguagcuccaggaacugcaguuuccgggaggcuguggggagauuuuuauaccugucugcggagagagugaacaauacaugaaugaaccugguacucuccaugacagcugguuuucccuaaagcccggcuuuacugccuuuaugaucaaacucuuaagaaauuacacauguauaacaucucaggacuuccagagugcugggauuaaaggugaguguuaccacaccuggcucaaucaaaagugaggcuacugccacagauuucuacuaguguagaaacaacauuaaguuacuauaccaguguuuguuaacuacuaaaaaaaauagguacaugugaaacauacuauuguuuaagguuuauuuugauguacaugcaugccaggugccugaggaggccaagagaucacuggauacccagggcuggagucacaacagguuauaaaugggagcugacuaggucuucuguaagagcaacaagugcccguaccugcugagcaaucucuccuguuccaugcacugcauuacuuuuguuguuuguucguuuguuuugguuuucugagacagggucucauauaucccaggcugacuucaaacuugcuuuagagcugagacuggccuugaguucaauucuccugcuucugccucacaagcuaggauuacaaguguguacccccaugcccagcuuuaaaaauuaauucuaaauuagcauuguauguuaaaaggccagggcuuaccaguuauaaccaaaagcagggucauaaagacuuccgcacagucuggaaccuucauuucauccacaucagagaugucuuuauacugggauacccaggcagccucugacgaaagcauugaguccauuuuuugaagagcaacuaacacgaaggaagaaggaucaguuauuucauccuucaguuaucaacucacacuuuuuuuuaaggaacuauguuuuucauacaaaauaaauuuuuaaucucccacuaacuaaucacacuauacuuaaaaugucuacuucagaguuaaauaagauaccugauucucccucaauaguuaugcugacuagaaguggcacaucugaaaauacccaaccaagaguugaaacuguguauggcagaaaucuacagaacaucacuaccuucuacugguuugcuaucccaacauguagacuguaauuaaaacaaacaaacaaaaagaacccaaaacaaacagaagucuuguggaaagaagacugucuuugaagguaguucaguagauccugcccaggaaagauuuaggcgccuauaguucuuacucagagcuguaagaaaaucaaaacuccgaaacuuuauacaccaaaaccagccauugccaggcaguggugguccauccccuuaauccuagcauuugagagcaaaggcaaguggaucuuaaugaguuugaggccaacuuggucuauacagagcguuccacgucagcuaaggcuacacagugagacucuguguaaaaacaaaaacaaaagcaagcaaaaaaaacaacaacagaaacaaacuaaaaccauccagagagcccucccgcucgacagccauacgggcgcuuacacuuucucuccacagucagccaucucuggaaacaggucuccuccgacaggaugugcaugcagcuggcgaaugugcugggauagccgugaacggugugcagcucccuuucaaacagcagcaccucauccaccaggugacagaagaggcugucaucguagagcaggcaggggauaucagaagccagcuucucaagaaugagcaucacaaggccacgggaaaacucaagcugaaagaaaggcacaggcauggggguugugcccaacuccaaggaagcugaaaggcacaggcucagccucuuacccuugcauuuacugcagagcccacuuuguccaauauuggcugaaucuucucauccagaaacuguguaugguuuccaauccacauaaguaccugagccaaguaccauucaggcuaaggggaagggaaaaugguaucaauucuuuauguauucuauggugaugggaaauucuaauuaaaugcacuuaguuaaaaacagacacaaaaauuaauugaaaauuccugaauguaagaaaauaauucuuaucccgcacuucaauuucacaaaagacuucauaaucaaauguuuaccaauauacuuccacaacaaauuccaauaaugcggcuuaagucaguaaacucauaauuuaaaauaccacauugggauuagguguggcuugcugguauaacaucugccuagcuacaaagccuguuuuaaccccagcaucacuaaaagaggaagagagggcauaagaacaaucaugaagaaaagucucucucacacuuaagaacaagcaucugcccagcacacacaaagcccugauuccagagcaaaacuaaacaagcagacaaaagccacggcacagggugggccgauggguaaaggcaccugccagcaagccugacaacccgagcuugauccccagaauccacaugggagggagaaagccaacucccacagacuguuccuggccuacacagaaaacaaaaaccaaacuuuuuaaagcccuccaaaccuagcaugaugaggcauuacaaacaaccaaaacuuuuacguuguuuuuugaaauagcacuccaaaacagaaggcucugagauaggaucucagguagcccacgccagccucaacgucucuaugugccugaggguaaugaacgcugggucuucuucucuacuucccuagugcgaggguuucgagcaugcaccgucaccugugacuuauguggugcugaggaccaaccugggcuccaugugagcggagcaagcacucugccuacacugagcugcgaauaauuuuaaacaugauuucuuuucugcuuccucuuuuuaaaagguaaaguaaggaaaaagagucaacugcucuaauuacaaauauaccuaagccuuaacauagguguaacuuccuaaaggaaauaggcacaaagcauucacauuucuuccacuuugcucugugugcacgcauguuugaauguuugugucuguguacaaugccacuguguacgggcacaaucagaugacacccugugggagucacuuuucccuugccacuaccaugugaguccuggggaucaaacucaagcuggcagguuuggagguauguggcuucaccuacugggccaugccaccugucccacauacagcauuuuaaguugucuuuagagaggauucugcaagcauuucaaaaguuuuucuagacgacaacuugaaaccauauaguaggcuggggcuauaauucagggauagagcauuugccucccacaugcaaggccucaguucaauccccagcacugacuggcaaauccccauguguccuaaauguuggggauauaaacaagggcugcaucuaaucucaugacugucuccaugacaguguacuaaauucauuaggaucacacuuucaaaaugagccaacacaacgcagaauuuucuuucuuucauuuuuuuuuuuuuuuuuuuuugguuuuucgagacaggguuucucuguguaguccuggcucucgcucuguagaccaggcuggccucaaacucagaaauccgccugucucugccucccaagugcugggauuaaaggcgugugccaccaccgcccggccagaauuuucuuaugcuaagucauguuacugccuuucuaaaugcuaaguuuaugcuuugccucauugacuacugaguacuaaaggauucugcucuuccaauaacacucuaugcaaaacagaagaccccuaaagcacaaacaggaaucuacugccacaaacgucauuuguaugaccugugcaauaccugcugugaucuugcucuuaauucagaauacuuagugaacccagcuccauacacugcauuggcuacagcuaacauuaagaauaaagauuguacccacauccuaguagauuauaauuacagaaaaacccuggcaggcuaugcugaucgggucccucaguucaaguguugguaaugaguuccuuuaaaauccuuauuccaccccuccugccaugauguucucuguagcucugaucacuguggcacugcaccuguacucaaccguccaugcucucuccuguggaacucacuucucuucuuucuaguucucucucugcaggaguggucgcuacagugaagccugugcaucgaucagcuauaaagccugcacacacaaaugcaaaugugauggugucccaaagacagugcagagccugacagccuguuggccuaagccccagucacaucuacaaagagcagccauuaggcaggaacucaaaagggaaaacagaaacgugaauagagacggucuuuaagcuaaacauguaaaaguccaggcuuagguaacguucacuauuaaugaaaacucaggguaaaauggacacuguagccuaaucccagcacuugggaggcagaugcagagggagcguaugucugaggccagcaggaguucuccuuggacccugacucaaaaacagaaacacagaagugaagagaaagugaagcguacgcgcucugggaacacacaccuugcucaugacguuggucugccggcugccucugaagugguaccugaaucucuucugcaggggagccagcaugaccuguaugggcagggucacgggaggggaggcaggaagacaguauuuuucugggaguuguuuuggcucaguuaauaacucaucucugacacaggcaagucaaggaaaaagaaucaaaaucauauuuauaugcacaagaacacacacaauaaauuuuuucaacaaauguaauaauacuuagcaaaagguguaauacaaauaauggaaaaucuaacuuuauacugaaucugaauuuccaaaaaacgcguucagggcuggagaggugacaaguuaagaauauuuguugccgccagggccaaaaagggggagugggcggguaggggaguggggguggguggguaugggggacuuuugguauagcauuggaaauguaaaugagcuaaauaccuaauaaaaaaugaaaaaaaaaaagaaauuaauagaucucaaaaaaaaaaaaaagaauauuuguugcucuugcagaggauucugguucaauucccaacacccacauguugacucaccaucauccuuacuaaaguaucaggggaucugaugcccacuucugaccuccacaagcacaaggcaugguggugcacagacacacaaacagacaaaacacacacucaugaaacaaacaacuaaugacaacacaaaaugccuucgagucagucagcauucaggaaaucauguuacguaagcacuucuccaacacugugucaaccagguucuucccacugcugauuggucuuccugcccuaaugaccugugggcaaugccaguaugggucagcugcugggcugcuuuggauggaauggcgcccauaggcuugcccauagggaguggcacuguuagggacugugaccugguuggagaaagucugucacugggaguaggcuuugggguuucaaaugcucaagccaggcccagugucucucucuuccuucuggcugccaauccagauguucaacucucagguaccucuccaguaccacaucggccuguaugccaccaugcuucccaccaggacaauagugacugaaccucuaaaacuaagccaaucucaaugaaauguuuuccuuuauaagaguugccauggucauggugucucuucacagcaauagaacacaggcuaagacagugauuuaucuuagaacucuuuuuacagcucugccacuuccagacaauucauuuuuuaaagcuaauauauaauuuccaauaggcaguuaaguuacaugucaagucuaacccaggacccucacuuuggcuacauggccacuuggaaaccuuucuccccugacuguggaggcugauccgugccucaagcccucugccacucugcacaagcccagcaugugcuacucacuaaccacaggucuacugucaggggacguguuagugaguuuccacuccaacaaagauacgaggccuguaguuucaacagcugacaaaacaguguguccaggcuacuguacagcuccgggguaccggcaggccggcucccgccaacgguuugcgacuggguaugugaggugaauggccaaugcagcugugccaagacuuccucaaaaucacuguaacagaaaagaaacaaugcuuccuacaauccaucccauuaccaaauacucaucagaaagcagucaacaggagacauuuccugccugguaagcuuguccuugagaauuuuaugccagaauuuaacuguggcucucaugaaacuaagaagaugaguacaggaugacuccugaagcuggauguccaguucugucauggucaccaggagagaggcugccucuggcacacuguuggucaucagguacugcugaauguuaucacugcgggacaaagcagaacacguuaaugagaguuucuguggaguaagugcgugcguguguguguguguguguguguguguguguguguguguguguguguauaugguguguguguguguauguauguguggcguguaugcguguguguacaugugugugaauucauguauaugaguaugugugugcaugauguguaugguguguguguguauaugcaugauguugugugugugcaugcaugugugcauguguguguguacccugaggacaauggcagguaucuuuucaaucacucucuaccuuauuuuugagacaaggucucuuuauugaaccuggagcucaguaauucaccuggagucuacauucuagauucuccaucuggccacugaacuccaggaauccuccugucugcaucuccaacuuagcuuuuuaauucaggugcuaggggcugaacucagauguuuaugcuugcauagagagcacuguguugucgggcgugguggcgcaugccuuuaaucccagcacucaggaggcagaggcagguggauuucugaguuugaggccagccugaucuacagagugaguuccaggacagccagggcuauacagagaaacccugucucgaaaaaccaaaaaaaaaaaaaaaaaaaaagaaagaaaagaaaagaaaagcaagcaagcacugugcugacuaaaccaucacucaaaucccucucuggaauaauuuugagcucagaaaaacuuucuccuucauuguugacauaaaauuacaucuaaaccgggcgugguggcgcaugccuuuaaucccagcacucgggaggcaaaggcaggcagauuucugaguuugaggccagccuggucuacaaagugaguuccaggacagccagggcuacacgaagaaacccugucuugaaaaaccaaaaaaaaaaaaaaaaaaaaaaaaauuacaucuaagguagaaugaagaacuaccauggguuggcuacucauuucauccgacacucacaucugcaggaacauggaguccccuacuuuaacacccuacgagccuguguuccacauguuuuccuccaccugucccuccccauccucuugaggacagaugugucacauuccugcaggcaacacucauggcuacaggcaggacuucuuucauagaagucauagucucugggauaauguaacuagcagcugggacagugaaggacagaaaccuucaguuuuuaucuacuuugcauuauuguuaccauuucuccauuaaaaaaauguaucccaaauuaaauguuucauuaaauuaaauaaagaccauuaugcuuuuuaaaaauguacaacuauaaccagacauagugacacaagcauguaauccuugcacuguacacuggagaaacagaggcagaaggaucaggaauucacagggucaugagaccagccuagacccuucaauuaaaaaagaaaugagauggggcugaagagacggcucagugguuagagcacuggcugcucuaccagagguccagaguucaauucccaguacccacauggcaguucacagccaucuauacugguaucugaugcccucuucugguaugcagguauacaugagauagagcacucauauacacaaaauaaacaaaucuuuagaaaaaaaagagaaagaaaugagacaggugcaagaguacaugccuuuaaacucagcacucaggagguggagacaggcagaucucugugaguucaaggccagccuggucuacagaauaaguuccagguaagccaaggcuacacugagacccuaucucaaaauccaaaauguuauuucacagaagaagaggaaauguacaaguaaccacacaauauaaaauuuccagaauuauaaauaauacuaaaguaugaaggacacucaaagcacagacaagaacagaaagacaauggccaugugacacugauucuauaauguccauacaaaacacucugccaggaugcuaguucaagcgaggaggcagggcuuggggaugggggagggggagggagagggaaacagagagacugacagauagaaggaaagagagagcacagaaaaaaaaaaaccuaguuauuaacgagaaauuuggagaugaagccucauaaguuccaaaaaaauggaaauagaaauguuuuugcaaaggccuaagggagugaaauaacucucuguauggugcucauuauuaauuuguuucuuauucaguauguuucuuggguuaaaauucucuuuuaaauaauucagguaccaaaaaaguuucugaaaacuaaagucuuguuuuggucaaucucuuuggcuacuaugaaagggaaacuuucaagcaacuuagaaacaacuuacucugcuuauaaagguuacuaauauuacuuuuuuuuuuuuuuaaagauuuauuuauuuauuauauguaaguacacuguagcugucuucagacacuccagaagagggagucagaucuuguuacggaugguugugagccaccaugugguugcugggauuugaacucuggaccuucggaagagcagucgggugcucuaacccacugagccaucucaccagcccacuaauauuacuuuugcuauguucuuccagaggggcaaagaaaaacgaagugacaugaagcagggcuuacaguccuuuaggaaagguccuggggagaugucucaguacguaaagcacuccugggcaagccugaagccuggggucuggaccuguaccaccauccaagaagugaggcauggucaugcaccugcagucccagcacaggaaggggacacagagggacccuggcgagucacucgccagcccaccuaggcaaucagagagcucugggauuaaugagagacugucucagaaaauaaaggaagacagccaauguucaauuuggaggagacaggggaccauaccaugaaauagaauaaucuccccacugaggcaaaaauguuucucugacuuaauaggcaagaccagauauaaucaaccugucguguucgcaaauaugugaacuuuauuuuuguuuuuacucaaaagaauuuucuuauuuuuccugacucaaaaauagaucaauucuguuauucaccuaggagcaauguauaguuuauuuguuuucaguuuggcuauguagccauaagcuggucuugaacucgcuauccuccugccucagccucccaauaauugggacuacagcuuugcaccaucacacuggucuaacugugcucuucuuuuuguuguuguuguuuuagagaccaggucucaauauggagccuggguuuuccuggaacuuaauauguagacaaagcuggccuaaagcaacccuccugcuucaguccucaaagugucaggauuacaaguguguuccaucacagccagcucacaguucuuuuucaaacauucauucauuuacuugcuugcuugcuuacuuccuuacuuauuuuuugagacuggguuucucuguguagcucuggcuguccugauacucacucuguagaccagacuggccucuaacuuacagagauccaccugccucuuccuccaagugcugggauuaaagguauauggcacuacuuauuuauuuuauguguacagggccuuggccugcauguacauguaccacaugugugcaaugccaauggagacgagaagacagcaucagagcacccugaacugaaguuacagaugugugaauuccagaaccgaauccagguccucuauagaauagcaagugcuucuaacugcuaagccaccucucagcuucuuacauugcaguucuuauuagaugauacccauauuuuaaaaauucaaauucaggcuggagagauggcucagcaguuaagaguaccaauugcucuuccagagauccuguguccaauucccagcaaccacaugauggcucacaaccaucugugaugggaucagaugcccucuucuggugugucugaagacagcaaugguguacucauauacauaaaauuaauuaauaaaucuuaauuuuaaaaauucaaauucuaguggcaaaauacaauucaauauuugacaauucguaauauuaguaggaauacugacaaucauacucagggaaaucuagcauuagaaagaguagguuuuaccauguguucaaaaugcaacugcuuagccuuaaaaauuuaacuuacagagggcagccuggucuacagagugaguuccagagggcuauacagggaaacccugucucaaaaaacaaaaacaaaacaacaauaacaaaauuuuaaccuacuuauauuacuuucuuucaaguacaaauuaggcuccaugaaaaguuuauguucauuuacaauagggcaaaauaaguauaauaauaauguuauuuuccuaacaacagguaaaauuauaaucucuaauuaacucaauuaucuaaucgcauagauacacugucugagacugagccucaaaggaaacuauaguccuggagcaaugccacccaccucagcuccucagucugcgacacccacuuaagguaugcgagaugccgcucaaucucuuccaucugggugaucauggcuccaaggucauccauccagggcugagccaucagcagauggcugcuaauggagcugaagagaggcgcuuccugcuccagaaacucaucaagaaguuguuuggauuccucugcaucuuuuaaagcacuuugaauucuuuuagggauuucugaugaaauuguaaguaccuaacaacacacaaaaauauuagcaaugagauaaaacaucaguuaagacuuuuccaaaaacacguuccaacagaacucaaaguuuuccauuaaaaauuucagguuagcuggacaugguggugcacaucuuuaaucccagcacuugucaggguacucugguggagucagcuugugaggcaaaaaugccaaaaagcugcucacgagaaaugaauuucuaagacucuccuccuggauauucuggcgaaagccaacucuccaguuuggaucgguuugucaggcgaaaagccugaaagcuguuucacgaggauaagaguccagggaaauuuuccucccagaguuauggcaucucuuucccuaacccauuauauucaaauuuccaccacauuaaucuaguguauagauucacgugcacucuauuaagcaucaccuuauaguaaaugccuuuuaauauuguauucuaacauagcuaaagccuuuucccaguguucuuagauuccagauagcagcaaggagcuuaacccauucaguaaacaauuaagcacuugccauuuuacucagcuguuuacagauagagacuaaaauucucacugagauagaaauucuuauuacagauuucaugccaagagcaaauuaguauacuauacugaaaauggacagucucuagauauacauaagaauuaacgaggccuagagaauuuuggggucagugacacuacauuauucuugaggugugucaagaguuaacuacccuggggcuauuaacucuaaguguaaaacucuugccuggcagaaagugcuaaucucuaauguaaacauuuaucuggucccuacaaauucccuuuguagucacuccccuugcaucugugcuaaucucuaguguuauacauuuaucugguuccuuuugaagucacuccuuuugcaccuggaaaaauucaaugugccuuguucugcaauuuauucuguauuauaaaagucugaugcucgacuagaacauuacauucagauucaacaccucucuuguguguuugacugauugucauuuucauccuaaucucugcucaucuacucuagagacucuuuccuacgcaggcacaggggaccagaaggccugcgacaagcacucagaggguagaugcaggaaaaucuuuguaaauucgagauuacaucugaguuccgggcuaguuauaguuacauacugagacccugucuuaaaaacaaaauauagggcaggagagauggcucaggggcacugacugcucuuccagagguccugcgguucacuucccagaaaccacaugguggcucacaaccaucuguaaugggaucugaugcccucuucuggugugccugaagacagagacaguauacucauauacauaaaauaaauaacucuuuuaaaauaaaaaauaaaaccccuccaaaaaaaaaagguuuggcuaaucuggcaguugggaggcagaaacauaagaaccaggccuuccaggucagccuuggcuauuuauugaguucuaggccagccuaggcuacauaagacagucucaaaaagaaccaaacgagggauggaaggugguuuuguagguaaacuacuuaucacacaagcaugagagccuauauuuggauccccagcacccacauaaaaagccaggcauagcaaugugucuguagcccucaggcuaggacagaggcaggugaauccugcucaguggccagccagccuagcuaaaccagugagcugcagguucaguaagagacccugccucaaauaaauagguggacagugauagauaccggacauugaccucauugacuucugaccuauuugucuggaugcucaugcacacauauaccaucacacacacacacuuaaaagguucaauuucuucauccuguagcaaucaacccaaacauauaaugcuauacaagguauauaaauacuauauauacauauauacauacauacauacauacauacauacauacauacauacauacauacauagagagaccucccaacacauggcucccuagcaaguauuuguaacacuuuaaaagcauacagccagagaucucuugcuucaccuacuaaguuauuuuccuucaaaaaacaaaugcaucugugauucaagcuguacugauaaaaagcugugcugugucucaacaguagaccaccagccuagugugcguaagacuccauccaauucucagcaccacaggaaaagaccuuuuaaaguaggcaggguggcacacaccugcgaucucagcacuugggagguggaggcagaaggaccaggaguuccgugccauccucagcuacagagucugaggcuagccugggcuacacgaagcccugccucauauuccagaaauacaucugguccccuguauuuugcugaagccuagggugagcccuacagaauuggauaugcaggcaaugucuuuaaacaugucauuuauuaaaggauuauuuuuacgggggcuggagagauucuauucccagaaaccagaauggacugaagcuuguggccuauggugacagcuguacucaugaguauauccuaguaguuauauaaaugucugcaaguguuuguuaucauauaugguaaacauagaucaauauuagacaucagaauaaaugacuaauauuuuauuuuuauuuugagauaaucucauauauccugagcuggccuuggacuuccaagcauucuguuuccaucuuaugagugcugggauuacagguuaaugacaccacacccagaacuacacauuacuguacagaauuucagcucagccaacucugauuagacacucugagcccagcacuaugcuagguauauaagggcaacauuugcccuuaaguauggaagagacacauauaagcaugcauucucacaagcgacacgcuagccuggacacggcggcacacaccuuuauucccagcacucgggaggcaggggcagguggggcucugcgaguuccaggucagccugguguacagaaugacuuucaagccagucagagcuagagugaucgaucccucaucaccaacaaaaccgccugaccuaggagcugggagaaagugugcuaugguagcgcuccugacuccugaccaugcacaggaauccccugaagaucuucuccugauacacagaauccaauucaagggaagaagagagagcaggugagcccgggcaguggggauagcagaucucaguagucacagaagaacauuguacaagagauaacagggacacuuacgguuuaggagggaggaaggaagacagggagcacagaugacugggguuuaggaccaaccccacuagggaggcaagauucagacuccuaggauacagggcuggcucgaacuugucaaaccaacacaagcuagagucaucugaaaagaugccuccaucagacaguccuuuaggcaagugugugggcauuuucuuguuuaacguggaaguguccaagccacuauguguaguaccaccccugggaagggggaaggugguccucaguuauauaaaaaccaaacauuguaaaccaaaaccaccuuuauuccccaaguuacuuuugaucacagcauuuuaucacagcauuagaaagcgaggccagccuggucuacagagugaguuccaggacagccagggcugcacagagaaacccugucuggaaaaaccaaaaaaaaaaaaaaaaaagaaagcaagacuugaguguuggacagaugcaaaugcuacuagccacugaggaaaccuguuaagagacaaaugagaauaauauuggacaauuucagauuuguggugguuugaauauguacaguccccauagaugugagugaaugcuuggccuauggggaguggcccuauuaggaagugugguuuuuuuggaguaggcaugcguuuguugaaaggagugugucacuguggggggucuccuauauucaguguagcacagucuccuccuuacucccugcagaucaagauguagaacccucagcuccuucuccaacaccaugucugccuggacacugccaugcuucccaccaugaugaugauggaccaaaccuggaagccagccccaguuacaugcuuuccuuuaugagagcugccuuggucauggcgucucuccacagcaaugaaagaaacccuaggacaaguuucacuuacggacuuuagcaagucucuguggauucaagagguaaaagagcaguggcaagcuagaaaauggagaaugauaauaaacgcuuuuuaaaaauaccugaacaaccaaaugaaugaacagacaccuacuaaaaaaugaagggaaggauuuugguuuguuuucuggggaagaccuaagugugcucgucuacugagaagacaggacuguuggugaagcaaaggauaaagcaaacuaaggccacuggcugccaaggugcugggaaggaaggagcuaggguguagggcugccuuagcacuggcuccuacuagaagacuuaugugggguagaaguguuuccucugucugacaggaacagagagaucagggguuggcagcaugugcaaacuccaaugguacauauguaugaaaaugucauaaugaaaccuacuuaugcacuaaaaacauuaaagauauauuucuaaagccuggggcagcagguggucauucagcagguaaaacauuugcaaaaucagccugaucagccaagucugcacucuggaaccccugagaaggcuccaugcucucugcgucaguucccgacuccagguuccugccuugaguuccugguuggcagugugcaggccuugcaugcauaaggcccugaguuugauccuugggcacacaauuuguugguacauguugaaaauccuagcaucccagagguggaaggaagaagaccagaaguucaaggcccuucucugcuacacaauuaaagucucaucugggacccuguuuaaaacaaaagaacuaguuuaccucugaaaagguaaacagauuauaaauaaguuggaaauaugggauagacuguuaagucaauacauccaugcgagaugcuucgcuuuuugguuagagaagagguaacagcauuucagccacacaggaagaggggaaacuucuggaugacugaggacaauauaagacugcacggcgaggcugaagacaccuauggugucaggccacagauuaggcuagccuugacuaacucaggagugcgacauccuccaccagagccuugcaaaagcagaaaagcugagccaucaggcuacacagagaccaucaguagguaugacaggaaagcagagauguggaggccuaacucaaccuaacucagcacauggggaugggagagcauaaagacacaccaugcccacauauccagaguuggcucgcccuaauuaauuucuuacuuauaugauaaaauauuuucccuuugacagaguacugcaacuauaagaccuucuuaucuuuagcauaaauuauuuucauuggauuucuaaaaauaaaagcauuauauucguaguaaaaugaaccccuaaaaauguuuaaaagcagaagaaaauaacuuuucagccagcacccagaaacaaucauucuuacaguucucucaguuuuuuauuauuuuuuaugacaggguuccauggaacccaggauggucugaaaucauccuguagcugaggcuagccuugaccucuugaugcauuugccuccuaccuccacgcacugaaguuaucagugugugccaccacuccgagcaaccacuauacaauacucauguuucuuucuaucuggguaauuacacacacuuggaaugguuauguguaaccauuucugcacauucugaaauuacucauagaguuguucuagaaguuacugaaugaaagagauauacaaugcuagcuaucauaaagaaauuauuauaucaaaacaacauaaaauguuagcuaucacagcaagucaguaggaacucuuacuuacaaacuacauagcaggggucuuuaaagccugucucucaguuugaggcuugcccucauggccugcaucgacagugcaugaugugcaauacucauaauacugcuuauguuccauguccaugaacacaguugacagaacugcacugaggcuaacacuuaccuguucuucuaacuucacuuugcuuucugucauuuguucuaugaguuuaccaagugucuucaaagacuuaaggucacuucccacuuccuucucuaugaaugcagacacauaggaaaggagcgcgucgucacugccaccuuggcugagcugcucgcuuccagcaggagcugcaguguucacgucaccuacagaaaggaaaagcagcuacucagcagcaccucgaggcugccggagagauacgcaggccaggacaccagagcaccugagggcuggaggcagcgcugugguacagcacuggccuaucaaguacagucuacagguucaauucucagcaucuccugaucauuuaaggagacauauccacacucuaucucucgauccauaccuaugcaucuaaguguacauagauaguaccugaaugauaauagcaaagcaauuaaucaaccaauuaccagagaugcuugugggcugagaaggcuuagagcaaaggaaaaauuccccaaaucucagaauuuacaagagucauauguaugauaacacauaacuuuucaaaguugauaagcaaucaaacaaugauccagaaucaauggguugcucuagcuuuaauaaauaugacaaacaauauugaaauauguuauuggaacauauuggaaaaaaaacaagaugguaucccauacauaaaaaccuguacagacuuuuaaaaacauauugacuuauugcaagagaagaagggcaauggaggacaacauuuacuaaacauuaaaacaaguaaugcagggacuggagagaugggucagggguuaaaacacagacugcucuucaagggcacccggguucaauucccaguauccacaugccagcucacaacugucuguaacuccaguuccaggggauccaacacccucccucgacauaccugcaggcagaacacuaaagcacacaaaauaauaauaauaauaauaauaauaauaauaauaauaauaauaacaacaacaacaacaacaauaauaauagaaaaccaagcaaugcagagggaaggcagagauggucaugagcuuuccucuucucucagauuaggaauccugcuaguuccucuggacuucaaagcugaucuuccuucccugugaccuggccugcacacugcagguucugccuucuaccaggagcagaggagcuuuaccaguuguuaccacgaauacuuuguggagcaagggucaaauacacacaaaauuuuuuaaacauuuugaacaaauuaaaaaaaaacauuuuuuacucaauaaaaauccacugcaaaagcaacuaaauagucaggggugguggugcgcaccucaucacagcgcuaaggagcagaggcagggggaccagagugcuaagccaaccugggcgacacaguaaaaacaauaaaacucuuuuuuaaagagauuuaaaagcaguuagaugguuuccuacuguccuagaaucuguuguucaauggcaucaccuauuuguugggcagcugugccacagacucagccauccuguaccucagaagcgccucaugagagcuacuuggcagagcugagggguaugugacucacaucuggcuacauaagcuuucuucucccacucuacuauuaauggccuguggcaaaugguuucuuuucagaguggcugcuucuauucauaagcuacacacacacacacauacacacacacacacacugguuuaguuuuuguuuuugaaauggaaucuuucuauauagcuggcaaugauccugacuuucugacccuccuaacucauaguaccagugcuugcuuagacuacacgaguuccaccacacuggcuuaugcuuggugcuggaccuggggcacggagcaugcugggaaagcacuccaucagagucuaaaugaaaagaugccuaaaugaaaaccuaaguaugagaugcuggcuaaauauuuauguacaguguacuagaacauaccagugcgugcaugguggcucauaccuaucugaggccagcacucaggggcugaaggaggacugauacaaacucaagccagcuuuaacuacccagugagacugugucucaaaucccuacaaaaacacuaguuacagggccaaagagauggcucagcaggcaaagugcauuucaaauaguacaaccugauuucauccagaacccauauaaaggguuaaauaaaaauaaauauaaaucagaauugacuucacaaaguugucuuuucaucuccacaaucacgccauggcaggcacacacccccacacacaauacauacauacauacauacauacauacauacauacauacauacauacauacauucauacauacauacauacaaaccaaacaacagaaacacuacaaggccagcaggauggcucauuugguacaggaguugcugaaaagccugaugcccugaauucaaccccuggaacucgcaguguagaaacaacuucugcaaacuguguguccugagaugugcacacacacacacauguguacacacacagacacaaaguguaaaacaaaugcauaccaucugucugcugcuggguauuccuucucucucuucuccuugcuccagaaaacauucuuuucccuuuguucuauuuaauuuacaugaauuaaaauauuuuggugcugaggguguagcucagugauagugugcuuacccacccuaagcaaaaacccacauuuaauucucaguucuacaaaaauaaugaaucaauaaagacacacuggccagcaacauggcucagcagguaaaggcacuuuccaucacggcugauguccuaagucugagcucaagacacacaugguggaagaccagagcuaacucacaaguccucugaucuccacacauacacuauggcaugcaaacacacacacacauacacaaaaauaaaaugaaauaaaaaacuuuauuuagaaagaagaauuagaagauuguuugcagacaugaagagcaagaggccacugguaggagaaauaaaacaaggcuaagucucaacuuccaaacuacuaaauaaauaauaaugccugccucagccuauaaagauuaaaaaaugaaacuaaaguucaugcuuucagaccaaaacucuauugucuacuuuauauauuaacagaauugguuuuucuguaucuaaauuuuaauaauaucugacauagaugggaaguucagggucaucuucagcuacauagaaaguuuaaaaccagccugggguacacaagacacagugucucaaaacacagaauaauccaacugcacucacguccugauaagaagauaaucuuuagaaucauccauaaagccaguaaguugugguguguauccacagacuugagcucuguaucugaggcggcuaaugcuaccuucacuugaaacaaaacccacacgcaccacauguaacuauuuaaaggugcguacuacauucugaagcaugugagauccuucaaaacuauacagagauuuuuuauuaccuauuucugucuguucauuugcuuuugagaaagaucucauguaucccaagcuggucucaaacuugccaugugguagucaaggaugacuuuaaugucaauuucuaauccuccugccuccaccucuugggugcugggauuacagucaugcaccaucauacuuaauuuuaucuguuguuucuuuuuuuuuuuaaagauugaucgauugacugauugauuauauauaaguacccuguagcugucuuuagacauaccagaagagggcaucagaugguugugagggcaucagaugguugugagccaccaugugguugcugggauuugaacucaugaccccuggaagagcagucagugcucuuaaccgcugagccaccucuccagcccuuaucuguuguuucuuaagacaggcuggagaaauaacagcucuugucgauuuuguagaggaccaggguuggauucccagagcucauaugugaguagccuagaaccgucuguaguuccaguuccaaguaggcugaagcugaagcccucuucuggccuuccguggcaccagacaugcauagucacagacaucuaaauuuuaaaagcacaagucuaggcuucacuauucuugcccauaacuuuaaaaaaaaagagcuaaaaaccaaauacacuaauauuuguguacaauauuuuagauacacuauaauucugugaccuaaccugaucuccauaucaugguaauccuccugccucagccuccuaagggcugggauuucagaagugagccacaccuggcuuggcagauuuuuaugucucuucccuuucauuuuuuauaaagagccugcacacugucgcacagcaguuaacugagccacugaagacacggacaaaguccuuaacgaaguaguuugcaccugacgcucuaaaaugacaauucggcugaugucaagagucaaggcaucugggcagacaaaaguagagaaaguuuguuugcauuuuuugguuuguuuccuuguuuguuuguuuguuguuuuguuuuguucugcuuuuccccuuuugguuuacaaaugggcuggcagguauuuccuaaacuuuugagauuuuauguguguagguguuauauguaugucuguuuaccacauuagucaacguacauagaggccagaagagagcauugaaucuccuagaacuauaguuacaagcaguuguuagccacacuguaggugaagucagcuccucugaagaauaucaaauucucuuaacugcuaagcccauucugucugcugcuuuguuuguuuggugguguagggcucaaguucaaacccagggcucccaaaguucuaggcaagaaagagcucuggcacuuuaacuucccaggccacuucaggcuuuggguuuuguuuuguuuuauuuuuuuuaauuauuauuuauuuguuuaaggauuuguucauuugauuuaugugcacagguguuugcuuccgugaguuuauguguaccaugugugagcaagagcccugggauggcaggacuguacauuuagacuucuaagacugaaguacugagcugucacguggguuccaggaacugaacccagguccccuguaacagcagcaagcacucuuaagcaccaagccaucuuucaagcuuaucagaagccaacaguaagagcaaacuuccuccugggagccacauggaaaugugggcacccuuucucuuacugucaaggucacugagcuuaacuguuaacauaagggcuuuuuaaaaaauacuucaggcuggagagauggcucagagguuaagagcacugacugcucuuccaaagguccugaguucaggucccaucgaccacaugcuggcucaccaucacccaugaugagauuugacgcccucuuguggugugucugaagacagcuacaguguacauagauauaauaauaaauaaaucuuuaaaaaauacuucaaaagcuccuaaagagguugggcaugugacaucugugaaauagaagacuguggaucuggaguccaaggucauccuuagucacacaaaagucuggggcgaaccuggguuacgcuccaccuugguuaaagagagagagagagagagagagauugagagagagagagagagagagagaaacaaaaacagccccuucagggugcuggauuccuaauaaccugcuacgcuuaucucaagugaaauaacaaauauccaggagucugacauaguuuccuguccuagguacugggucuuuuccaugucaccuacccagaccaagcccugggaccuaaggugugggcuaccugcagcaaacuguaauuacuuacucacugaaggcaaaaguacaauuaaccuauuaucaaaccucuuccuagaacccaguaacagugaccagcauaaccccucuaaauaccugauaacgagcugacaguucauuaaaauggcaggucccagugaagccaaaccagucacuguccuaggaaggagcgucaaugugcucuuucuauauuucacagucuuagagagacaaaaguccacgugcaaagauaacuaauauuuauuacuguuuaaacauuguacagaaagaauacuccauugaaaagauagcagacuaagaaacucuuuugcagacucugaaaaggcgagcuucgaagggcagcuagacaaaaagaacuaaggguuuaaagccugcuuacuuuucacgucuguguucuucguuucgucaccacucucggggcagcacuggcagaaaaacagguguggcaaacaaguuagacugaaguaaguggaauucauacagcgcuccgaaaggucccauacugacgggcggagagguccuaggcgccucucccaggggcaugccugacacuacugccaccuucccagaggucuggaccaccuccccaggguccgaguuacucugcccgggcaccgaggccacuuucccgccaacucucaaaacugucaucuucugggacaucggacauugcacugugacuaccuccccagggacucccuugccugcuuccggccgugggaaccaccgccaaaccacuuccaagguaaccuguccccggggcggagguggggucugugccaccucgcagggucaccagcgucccuuccccggguuuccagggacgccucaccggggcugccggcacuucgccgauaucgucagccgcaagcauccugccuccgcacgaauucuggauuccaugcaccgccagcccggccugcagaguccggcuagggaacacacagacugggcgaccagaccagccuucug

SEQ ID NO: 12343 - RNA, 12118 nt, Mus musculus
augacuuuuuccaaaaauaauuuauuuuuaugugugugugugugugugugugugugucaugauggaggaguugguucucuccuuacaccauguguguccccgguaucaaacuuaaauugcaagugacuuuacccacugacccaucucucuggauccucaaaugucuuuuuaaacaaaacaaccaaaacaaacaccugaaacaaaccaacagcuguucugaagcaaagccagaugcugcguacccggcagcuguggugggcccuguuugccaccuucacaaggagaaaaggugaaagcgugugcauggugaaagauacuuaaaagucugggucaaaagucaggcguggguggcacaugccuuuaaucccagcacucgggaggcagaggcaggcagauuucugaguucaaggccagccuggucuacaaagugaguuccaggacagccagggcuacacagagaaacccugccucgaaaaaaaaaaaagucugggucagcacaagagcauauggaaaguaaaaaugacgaggcuggcuggaauaaucuagaaaagaaagaacucuggggacagcugcauaaggguaacagcuguccccacggcucucacuuuguaagaggccugaguagcaugaauaguuugaacucugacugauggacuuaaguuuagcuguuacugucugucuugcuacuggguucccaaugacgacacaaaauagacgaaugaauugcugacgucuauuauagacgucauauauugcauauauuuacaugaauauaugcaagcuuugaaauuuaagcaaagcaccucagugucccaccucugcaaggagcaucaaaguggcaugacuccucucaagcgugccagagacacggcugagaggagcugagauaaaaccagccgggacaguacuuuggucugauuaccaggucaguaucacaacucagcugcgaacgguggcuuaguuguuuuaaagaaguacagaaacgacgcaaagugaacuguuacuagguuaggaacugucucugacauuagcaaaggucuacacuuaagaauacagucuaauuacuacucaugggcuuccugcuggcgcucugcaguuaaaucuuccucauccucuuccugcagcgcugauugaacacaggggaggaccccaugaggcugucaguggagugggaaccauagcugcugucugagucgucagggcucugagggaguccagccucacucaugccugacauuggcuccucaaagacaucacugcccagcaccccaugcgcagacacauugccuucuucacuuucuugagguuccauuuucacgugagccagguuccagagaggagaagcauugaccucugcaccuagaaaugaagggaaggagagauuaugagcccacggggaggcagacacagaaccugcacaucucgcccucacacaacuagcgaccuccgagcugcuuucauuacagcaccccacaugggaugagggugucacuguuagucugggguucaaauguuacccccaaauuaccacuuccuuuccacuuucaugguuuuucccuuccccuuauucaccccuacuucuccuauaccaaaaaaaaaaaaaaaaaagaaaacuggguagaaagauuauguucaaaggcagacacaauuccaguuuacccccauaagaagcucuauuuuccuguauucaugcuugcacauggaagccacagaaggaugugagguauggaagcaucuucuuucguugcucucuuauugccguaaccuggaaacucaguuuucacuaagcuggcuggccaguguugggguugugggcacacagccauccacaccuuuuacaugggugcugggauuugaacucauguccucaugcuugcacagcaccucccgagcucccuggccuucuuuucuuuuuucuuuuuuugcuuuuucgaaacaggguuucucuguauagcccuggcuguccucuggccuucuuuucauuuggcuuuuucccuuuuauuugagaaucucucuaggccucuuuugcauuuugaagacuauguucacacgugaugcugacaucagcucucuacuugucucuccugacaggagacaugguuguugguguccucugucuuucuguauuuugguaaugcagcucugcuguuaacuauuaugucuuccucagagaaaaaccucucagcgcuucuaaggcugaccuaauuuuguuugggucacauaugaggaugugauauuuaaauuucuuacguguuuacauuuguaaacaacuaaguguucaaacuaauuugcaacugagcugagucgggauagcgagugaagcacagcaacugcagcccgugggagcucgugggaggcuaaagcaggaggccuucaauuccagaccuaccuagauggcaagauggcaaggugugggguguaaaaucaugucaggauguuuaggauguuugcuaagguagagcagggcgagaccuggggacuugguggucacacaccugaggcuuaggugacucccagcucccugccagacuccugacucggaacacacaugccacguuucucacauaaaagagacacggccaagaggucucucugcuaaugagguaccuagaggcccggagcauagccaauaagcuuuccuucccagacgcuccucccuguaaaagguguuuaccucaggcccaccagagaaguggggaugguuuuauacacccacuucccgccauacaauaaaugccuuagaaccauggacugccucuuuucauugaucuguuguggggagccaugggaaaggccuuugccuauagagcacagccuaaucuguagacggccucucugaacucccagccacaaccgccagcaagccugcugccccaucaagccaaggacucuuucggugggaccagcuggagcucuccuccccccacccaccuuagguuaaacccagcccaaaggcccacacuuuucugugacucccaacagugccuggauauccaagagccugugagaaccccacagcccaagcauuguugcaggcccaggguugggacugcuccccucaacccccauaagcacagucaaaacuccccacaucccaccuccccugugguggagcagaugagggacccacaacccuacagcaagacccugucucaagaacuaaaccaaaauauaauugcuuaaaaauaaaaaguagggcuggugagauggcucaacugguaagagcacugacugcucuucugaagguccagaguucaaaucccagcaaccacaugguggcucacaaccacccguaaugagaucugacgcccucuucuggggugucugaagacagcuacaguguacuuacauauaauaaauaaauaaaucuuaaaaaaauaaaaaauaaaaaaauaaaaaguaacaagccaguucugcaggcuccuaaaguccucauggcuauaaccuacaacagaacaacuccauccaacacacaacaauuucauucccuuuggucugcaauuuucuugaaguuccuaucaaggaaacagcuccuuaaaccagagaguacuguaaaggauucaccacagcucuguuugcuccagcaacuucuguucugcccaugucugccuuucucccacuuggaguugauuccaaagugucaggaagugcuaagaugggcagagccagaugcaaaaugaauacaacuuucuuucuuacuuggagccuguggcgaagccuccaccuccagguuggaugggaagcgcucacucugagccccgaggaccccaauggguaaggacugaucuccagaagcaagguccgcuucuagcuccucacugacaggaaaugugaugucgcucacaggcucuuccuugaucuucacagguuuagugucuucuguggccuucucgggauucacaauccuuucauauucuucagagagcugcuuacuaaucuguugguaagcaagaauuaguuuuccagagcuauuuuagaauuagauuggagagugagcuuacaguaacccaaggaaaacugggcagagcaggaguuagcaaaugaguuguucuuucuuucuggugugugugcacgugugugcaugugcaugaauaugugcacaagcauguguuuguguguguacagaggucaaagagucaccucaguggucauuccucagguacuuccacuucucaguugagaaagugagcuucaggaacccgccugucugccucccaucucaccaucgauggauggccuuacaaguguaugccaccacaccuggcuuuuuacaugggcccuggagaucugaacucagggucccgggcuuucaagauaagcacuuuacuaauagccagccuggaaagugagauuuaaaaccucuccugccagggcuggggugcagugcgagaaugcaugcccagccugugcaaggccaugaguucaaucccagcaccaucaaacaacaaggacagaugccacugccaaugguaggaagucauuuaaggguuugggucugcauuuaugauagacacauaaagaaaauaugucagaaauugucaucauuaauuaaaaguuacacaaggcaaaaaagccagagcuaaggcaaaauacugcauuucugucuauaaaaacuaacaauuaucuagacauaguguauggaauuccaucucuuaggaggcugaaaagaaaggaggggaguaaggccagccuggcugcucagggaagccgugucucacacgucagaaaccucccaaguaucuggcagacagacccuagaggcaaaccuucagugaagcaagcaaucuggacccuuuugucagaugcuaaagguuacuggucacuacaugccuaagccucaagaacuggagagacggugcucuacuugagccuccuggcaugccacuggcuuguuuaguuuucaacacauuuaaugcuaucugaaauuguugugcuuaguauuuguuugccuguuuuugcuucccaugaacacuucaaacucaagaguugauuccucuuauaaacuacuaucucccacaaugccugacucauaguaaguccucaauaaauacuuguugaauagccaaccacggggcgagggagaugguucagugguuaagagcacuggcuucucuuucagaggucaugaguucaauucccagcaaucacaugguggcucacaaccaucuguaaugagaucugaugcccucucuucugguaugucugaagacagcuacaguguacucacauacauuaaauaaauaaauaaauaaauaaauaaauaaauaagagagagagagagagagagagagagaaagaaagaaagagagagagagagaaugcuagccauaguacuugagaccccagguacccauguacuucauccagaggaagcaaugaggaaugggcuacccacugggccagugguaugucagauucacucugcuccaagucccugugcgcuguaccccagaacauguguuguagacucugcccagccagggcaguuugcccaugucucccagggucuccucaccuguagcauguaagugugauaguccuugaugcggugcugccagaacuucugcagggagagcacacugccaaugcccacuucauggaacaccuguuccauuacaucagggaaaggagucugucccagcagggccucucggucgacagcaaagcgcagcagcuuggugaacuugaggcaguauucaugugccacaucaguuagggucuccaggacacuuucauuagcacacucaaagccugugugggccaggauuguggcgacugcuugauagaggagcugccggcaggagugccagcucagcucugucacaggcucuccuuucccgcugagagaggagacaaggggugaccagccugucucauugggguuuuacaagccauuuaagagaauucuagagaaacagccaccuucguccugcucuucucagagcauaggucagcaacccaauaucauauuccugagccccccaauuacagaguuugaaaaggcaaugcgugucuaaaauaaacuguacagaguaauaguggaggaacuagaauuagacaacugagugaccaguuccucuagaagaacaagcguucuuacccacuugucaucccuccaaccucucugaauacguacugguguuaugccuccaucugcaaaggaaacuguuuuauaaaucucuguucuuugguuuaugucaccacuuccuguaguagguggugucugaagaggccucacucauuuacuauuaucugcucaauaacaaccacggcaaguuauagauagccaaaaaaggagacgacaacuaacuuuucauuuaauauguccguggccagucuaucugggccaaagguuaaaagcacuggaaauaccaaauaaagagcuaauuacuaucacuuaauuugagcacuuuauggacuuauucccuugcaguguugggauuugaacccagagccugugaaaucagcagggguuaaccugaacuacaucuauagccuagauauaggcuucuuuaauggaaagugauguuuugguaccucauagcugcuguguauuauuuuuucuuauacaguuucuuaaaauauguauagaacaaacuagguucaagucaugugugugugcaugugugugugugcauauaggggccugaugcauguacauguaugcacaauacauacugacgccuacagugucauuucugaggaaaugacaaaaaccucccugauuuuuucagaaagggucucuucuugggaccuuucuuaggagcuuauugauuaggcuaggcuggccagccagugagucccaggcauccuccugccucugccuuuccugcccucggauuauuaucauggacuacccugcccagcuuuuucacuggguucucauggcaagcauuuuccugacugagcaaucuuccccagccacucucuuuuauuuugaggcagggucucuuuuuguuauuuugucuuuuuuuucuuuuccagagcugaggacugaacccaggaccuugcgcuugcuaggcaagcgcucuaccacugagcuaaauccucugaugcaggcucucuuauaagaccuggagcucaccaaguagguacacugucugacuagagagccucaggcauguuugucucugacucccuagugcugagauuauaaacgaaagccaccaugacuggguuucuuuuacguugguucuggggacagaacacaggguuuauuaaccaacuuacuaacuaagccauuucccuagccccgagguucuucuuaaaaauuaaacuugcugggcggugguggcgcgcaccuuuaaucccagcacucaggaggcagaggcagguggauuucugaguucgaggccagccuggucuauaaagugaguuccaggacagccagggcuacacagagaaacccugucuugaaaaaacaaaacaaaacaaaaaaauuaaacuugacaaaaaaacuacaguuggaguaauaacacaaauuuaaugcgaugaacguuauuuuauugaaugaaacuacauuacccucaaaauaugacuaugcugcugacuguuacaagcuggggguuuuuguuuuguuuugauuuccuuuaugcugggccacuacuuuaccagcccauuuuucacuagucauguaccaguuuauuguuucacuuuuaguaaacugucuggcauuaauaaguacucaguaaaugccuauugugcuagaaaauuaaaaaauacagauagugguagcacaugucuuuaaucccagcacuaaggaggcagaggcagguggaucucuaugaguuugaagccagccucgucuauagaacuaguuccaggacagccaaggcuauacagaaaaacucugucucauaaaauaaaaacagaaacaacaacaacaaaaacaacaacaaaauuauagacuagcuucuggcaauuuggacuaauaacuccacuaaugacuuaagcaacauuagucuagccaaucacucuccucuccaguguucucauguagaaguggaaaugccacuauaaucguaacaggaucauggggggaggggagaucacuuaauaaaaacaccacagcaaugcuuugucuuaccgguaaaagucacucucugggucacugugccggaucuggaauggagcauugggauuuuuacagucuaaaggcuggaggucaucagggagaggaggugagccagggcaggagggaagagguucacucucuucagccuucacacccucugucugcugcugacucugggucugagcuguggcaauaaggcugcgcaggcgucgguuguguuggaucaacugaaugguauggauggugaggcuacacgguucugagggaauguccagcaucguggggggcuucggcuuguuggcugagggcuggugcaggggcgggucauggacuuccaccagacggaacucccgugggagcagaucaaaggaacuucuguuggucuguccugacgguauugguaucucuccccaguaccucagcauuuuagagcaagcagagaagggcucuccagcuuaauguaaacgaucuccuaaaggugugugcuuccgucucuggcaacuguagaucagaagcuucugcagugaaaaguaggaagucuaggcaguucccacauaagaagcaagcuaagaucacuuuaaaaaggugcuagcaaaacucuaggacagacaauacucucccugaagaaacgaagagaaaaauaacuguuagaugccaaucacacagcgacaacuccucuuugaauuacaaaaggaaaaucaaaguaacuaauaggugaagaguaguaauugguguguggggcucuuaacauauacacugccuauuucacgucacaaauucaucaccagaauacccaucaugccucauucuaaauaugugacaaggcauaaaacuaaaguaggaggucuggacuacuuccagaguauuucuacacaauugugcuagacuaauaggaaaaagagagcagcauuaaaacuacuaacaggcagccagauaugguggugcacuccuuucuuccagcacucaggaggcaguggcaggcagaucugaguucaagguuagccugaucuacagaguaauuuccaggacagccagggcuacacagagaaaccauaucucaaaaaauaaaacgaaacaagacaaaaaauacuaguagguguuuuuuaaccugugccguguaugguagaaacauucaugaaccuuuaaucuagccuuaugcuuccaaauucugacauacacaugaacaaauagagggucucggugggcgugugcauggaggccaggaaucagccucaggcaacauuccaccuugcuuuuugagauaggaucucucgcuggaguguaggauuugcugauuauucuaagccaguguauugccuguacuucuauucuaccgacuuugcucugggaaaagccgagcuccuagcuccccacccagcuucccuugaaucuguggauaaaagacacacacacacacacacacacacacgcacacacacgcgcacacacacgcacgcgugcacacacauaguuuauucuuuuauaacuugccuucuuggcacaaucgcuggguguuacugucucuugccuagaaaagcaugaccuuauuaauauuuuuagcuguuucuccaccugccccaaacuucaguggcuagugccaccuauguccugccaaaaauccacagccacccaguucccagccacaggccucagcucccccaagaccucacaugguugcugcauucuucuuccuccaaagcauggcagaaagaccucucuccuuccuuguggcuaccuuuuccuccuggaaccuggaagucccacauguaccuuccucccagcaauuggcccccagcuuucuuuacugacaaauaaagaaccaauuggggaauaagaccuuaacauaagaaccacgcccuucaccagugagucccagggaucugacuguuucugcuuuccuccccacaagcugaguuuauaagcacaugcacccauaccuggauuuuuacauauggguuuggggauugaacucagguccucaugcgugcaauggacugagcugucuccccagaaugaaucugagagacuucuguugccuucuaacaaguauuccuuccucuaguccagugguucucaaccuguaggucauaaccccuuuggggaucaaaugacucuuucauagguuaaggaauaucagguauccuguauauaagguauuuacaauaggauucauaacugcaacaaaauuacaguuaugaaguagcaaugaaaauaauuuugugguugcauggggucaccacaacaugaggaacuacauuaaagggucagaccuuuaggaagguugagaacugcuauuccagucuuuuucagaaucugaucuacacuuggcccugcugcuagacuuucuuccuuucucugucugucucucuuugugugucucugucucucauucucucaaugcugaagauuuaacacauccuacaaaaguauuuuuauuacugagcuacacuuccaagcuuuuuuguuuguuucuuuugcuuggaaaaagucagaauucuguggcuuagcauucaauaaaagcuuacuaagcgucuuuaauucacgucuccagguuuacugccuauaugucuccucagguccaacaaacaucaaaugaauacauugugugacgguguaagaucuuuguccugagggaauaacagaagcaaaauacugcaguauagcagcagcuggcacugcuacuuuaaaggcgugaguucaguguccugcaggcaagugaggggcuuccuggacaaaaugaaugcccucagcucuaacaauauacuacucaguuccuuucuuucucuuucuuucuuuucuuuuuuuuuuuuuuuuacauuuacuuauuuuggguaugugugcaugaaaaaaucacaagacaacuugugagaggcaguucucuccuuucaccauguggguuccauggauugaacucgggcauucggacuuggcagcaagugccuuuuaccuacuaagccaucuaacuggccccucagcuuauuuccuuugcuaagauuguauuuuuaaauuauuaauuucgagacaggguuucccuuugaggccuuggcuauccuggaacuugcucuguagaccaggcaggcuaugcauucacagacauucguuuuuguugucuguuggggguugaguauaugcuuguguguuccauguguaugcaggugccaaggauaucugaagagggcaucagauccuucuggagcucaaauuagaggugguugugaacuccccugauguggguacuggaaauggagcucagauccaccgaagagcagcacacagaaccaucucuccagcuccaccacucagcuucucaagaacaugagauauuuuuauaauugacccuuugaguugugaccucugccaggaacccucuacaucuuuaucagacuugaauuuguucuuuaggaucccugaaaucaccauuccccccaacagaucuccuuucuuuguauauuuacaugaauuugcuuuuaucccugaaccuuaacuuuaguugacuuauucaucuguauucucccacuuguuauggcugccaucuugguauaguuucaggccucugucaaagaguuauaauauuaacuauggcuuaguucaauuuuccauaaauuuuaugacaaauuaacacuacuauuuccaauuuuucagauguggaagcuguuguccagggucaugccaacaucauaaauacaaagaguaaaaaagaaaagagguuucgaugcucagguuuguuaagccacuaaacaugcuaucucaauauuuuguuccgaguaauaaaagaaugaacaauaauaaauugcuucuuuacuaacuucauaaaaggaauaaauucgagagcugcagauagggacuccuugcuccggaucuggaggcuuaggcuuaggcgccgaccacaggauccugggaagucugauuuacaaggcagcaggaaaauggguggcucuggaccggaaccagaaaauaaaguucaaauacucaccgcccugccccaggagugguauacgcggcugccugacucugacaggucggagucgaggacuaggucaagcc

SEQ ID NO: 12344 - RNA, 12118 nt, Mus musculus
ggcuugaccuaguccucgacuccgaccugucagagucaggcagccgcguauaccacuccuggggcagggcggugaguauuugaacuuuauuuucugguuccgguccagagccacccauuuuccugcugccuuguaaaucagacuucccaggauccuguggucggcgccuaagccuaagccuccagauccggagcaaggagucccuaucugcagcucucgaauuuauuccuuuuaugaaguuaguaaagaagcaauuuauuauuguucauucuuuuauuacucggaacaaaauauugagauagcauguuuaguggcuuaacaaaccugagcaucgaaaccucuuuucuuuuuuacucuuuguauuuaugauguuggcaugacccuggacaacagcuuccacaucugaaaaauuggaaauaguaguguuaauuugucauaaaauuuauggaaaauugaacuaagccauaguuaauauuauaacucuuugacagaggccugaaacuauaccaagauggcagccauaacaagugggagaauacagaugaauaagucaacuaaaguuaagguucagggauaaaagcaaauucauguaaauauacaaagaaaggagaucuguuggggggaauggugauuucagggauccuaaagaacaaauucaagucugauaaagauguagaggguuccuggcagaggucacaacucaaagggucaauuauaaaaauaucucauguucuugagaagcugagugguggagcuggagagaugguucugugugcugcucuucgguggaucugagcuccauuuccaguacccacaucaggggaguucacaaccaccucuaauuugagcuccagaaggaucugaugcccucuucagauauccuuggcaccugcauacacauggaacacacaagcauauacucaacccccaacagacaacaaaaacgaaugucugugaaugcauagccugccuggucuacagagcaaguuccaggauagccaaggccucaaagggaaacccugucucgaaauuaauaauuuaaaaauacaaucuuagcaaaggaaauaagcugaggggccaguuagauggcuuaguagguaaaaggcacuugcugccaaguccgaaugcccgaguucaauccauggaacccacauggugaaaggagagaacugccucucacaaguugucuugugauuuuuucaugcacacauacccaaaauaaguaaauguaaaaaaaaaaaaaaaagaaaagaaagaaagagaaagaaaggaacugaguaguauauuguuagagcugagggcauucauuuuguccaggaagccccucacuugccugcaggacacugaacucacgccuuuaaaguagcagugccagcugcugcuauacugcaguauuuugcuucuguuauucccucaggacaaagaucuuacaccgucacacaauguauucauuugauguuuguuggaccugaggagacauauaggcaguaaaccuggagacgugaauuaaagacgcuuaguaagcuuuuauugaaugcuaagccacagaauucugacuuuuuccaagcaaaagaaacaaacaaaaaagcuuggaaguguagcucaguaauaaaaauacuuuuguaggauguguuaaaucuucagcauugagagaaugagagacagagacacacaaagagagacagacagagaaaggaagaaagucuagcagcagggccaaguguagaucagauucugaaaaagacuggaauagcaguucucaaccuuccuaaaggucugacccuuuaauguaguuccucauguuguggugaccccaugcaaccacaaaauuauuuucauugcuacuucauaacuguaauuuuguugcaguuaugaauccuauuguaaauaccuuauauacaggauaccugauauuccuuaaccuaugaaagagucauuugauccccaaagggguuaugaccuacagguugagaaccacuggacuagaggaaggaauacuuguuagaaggcaacagaagucucucagauucauucuggggagacagcucaguccauugcacgcaugaggaccugaguucaauccccaaacccauauguaaaaauccagguaugggugcaugugcuuauaaacucagcuuguggggaggaaagcagaaacagucagaucccugggacucacuggugaagggcgugguucuuauguuaaggucuuauuccccaauugguucuuuauuugucaguaaagaaagcugggggccaauugcugggaggaagguacaugugggacuuccagguuccaggaggaaaagguagccacaaggaaggagagaggucuuucugccaugcuuuggaggaagaagaaugcagcaaccaugugaggucuugggggagcugaggccuguggcugggaacuggguggcuguggauuuuuggcaggacauagguggcacuagccacugaaguuuggggcagguggagaaacagcuaaaaauauuaauaaggucaugcuuuucuaggcaagagacaguaacacccagcgauugugccaagaaggcaaguuauaaaagaauaaacuaugugugugcacgcgugcgugugugugcgcgugugugugcgugugugugugugugugugugugugucuuuuauccacagauucaagggaagcuggguggggagcuaggagcucggcuuuucccagagcaaagucgguagaauagaaguacaggcaauacacuggcuuagaauaaucagcaaauccuacacuccagcgagagauccuaucucaaaaagcaagguggaauguugccugaggcugauuccuggccuccaugcacacgcccaccgagacccucuauuuguucauguguaugucagaauuuggaagcauaaggcuagauuaaagguucaugaauguuucuaccauacacggcacagguuaaaaaacaccuacuaguauuuuuugucuuguuucguuuuauuuuuugagauaugguuucucuguguagcccuggcuguccuggaaauuacucuguagaucaggcuaaccuugaacucagaucugccugccacugccuccugagugcuggaagaaaggagugcaccaccauaucuggcugccuguuaguaguuuuaaugcugcucucuuuuuccuauuagucuagcacaauuguguagaaauacucuggaaguaguccagaccuccuacuuuaguuuuaugccuugucacauauuuagaaugaggcaugauggguauucuggugaugaauuugugacgugaaauaggcaguguauauguuaagagccccacacaccaauuacuacucuucaccuauuaguuacuuugauuuuccuuuuguaauucaaagaggaguugucgcugugugauuggcaucuaacaguuauuuuucucuucguuucuucagggagaguauugucuguccuagaguuuugcuagcaccuuuuuaaagugaucuuagcuugcuucuuaugugggaacugccuagacuuccuacuuuucacugcagaagcuucugaucuacaguugccagagacggaagcacacaccuuuaggagaucguuuacauuaagcuggagagcccuucucugcuugcucuaaaaugcugagguacuggggagagauaccaauaccgucaggacagaccaacagaaguuccuuugaucugcucccacgggaguuccgucugguggaaguccaugacccgccccugcaccagcccucagccaacaagccgaagccccccacgaugcuggacauucccucagaaccguguagccucaccauccauaccauucaguugauccaacacaaccgacgccugcgcagccuuauugccacagcucagacccagagucagcagcagacagagggugugaaggcugaagagagugaaccucuucccuccugcccuggcucaccuccucucccugaugaccuccagccuuuagacuguaaaaaucccaaugcuccauuccagauccggcacagugacccagagagugacuuuuaccgguaagacaaagcauugcugugguguuuuuauuaagugaucuccccuccccccaugauccuguuacgauuauaguggcauuuccacuucuacaugagaacacuggagaggagagugauuggcuagacuaauguugcuuaagucauuaguggaguuauuaguccaaauugccagaagcuagucuauaauuuuguuguuguuuuuguuguuguuguuucuguuuuuauuuuaugagacagaguuuuucuguauagccuuggcuguccuggaacuaguucuauagacgaggcuggcuucaaacucauagagauccaccugccucugccuccuuagugcugggauuaaagacaugugcuaccacuaucuguauuuuuuaauuuucuagcacaauaggcauuuacugaguacuuauuaaugccagacaguuuacuaaaagugaaacaauaaacugguacaugacuagugaaaaaugggcugguaaaguaguggcccagcauaaaggaaaucaaaacaaaacaaaaacccccagcuuguaacagucagcagcauagucauauuuugaggguaauguaguuucauucaauaaaauaacguucaucgcauuaaauuuguguuauuacuccaacuguaguuuuuuugucaaguuuaauuuuuuuguuuuguuuuguuuuuucaagacaggguuucucuguguagcccuggcuguccuggaacucacuuuauagaccaggcuggccucgaacucagaaauccaccugccucugccuccugagugcugggauuaaaggugcgcgccaccaccgcccagcaaguuuaauuuuuaagaagaaccucggggcuagggaaauggcuuaguuaguaaguugguuaauaaacccuguguucuguccccagaaccaacguaaaagaaacccagucaugguggcuuucguuuauaaucucagcacuagggagucagagacaaacaugccugaggcucucuagucagacaguguaccuacuuggugagcuccaggucuuauaagagagccugcaucagaggauuuagcucagugguagagcgcuugccuagcaagcgcaagguccuggguucaguccucagcucuggaaaagaaaaaaaagacaaaauaacaaaaagagacccugccucaaaauaaaagagaguggcuggggaagauugcucagucaggaaaaugcuugccaugagaacccagugaaaaagcugggcaggguaguccaugauaauaauccgagggcaggaaaggcagaggcaggaggaugccugggacucacuggcuggccagccuagccuaaucaauaagcuccuaagaaaggucccaagaagagacccuuucugaaaaaaucagggagguuuuugucauuuccucagaaaugacacuguaggcgucaguauguauugugcauacauguacaugcaucaggccccuauaugcacacacacacaugcacacacacaugacuugaaccuaguuuguucuauacauauuuuaagaaacuguauaagaaaaaauaauacacagcagcuaugagguaccaaaacaucacuuuccauuaaagaagccuauaucuaggcuauagauguaguucagguuaaccccugcugauuucacaggcucuggguucaaaucccaacacugcaagggaauaaguccauaaagugcucaaauuaagugauaguaauuagcucuuuauuugguauuuccagugcuuuuaaccuuuggcccagauagacuggccacggacauauuaaaugaaaaguuaguugucgucuccuuuuuuggcuaucuauaacuugccgugguuguuauugagcagauaauaguaaaugagugaggccucuucagacaccaccuacuacaggaaguggugacauaaaccaaagaacagagauuuauaaaacaguuuccuuugcagauggaggcauaacaccaguacguauucagagagguuggagggaugacaaguggguaagaacgcuuguucuucuagaggaacuggucacucaguugucuaauucuaguuccuccacuauuacucuguacaguuuauuuuagacacgcauugccuuuucaaacucuguaauuggggggcucaggaauaugauauuggguugcugaccuaugcucugagaagagcaggacgaagguggcuguuucucuagaauucucuuaaauggcuuguaaaaccccaaugagacaggcuggucaccccuugucuccucucucagcgggaaaggagagccugugacagagcugagcuggcacuccugccggcagcuccucuaucaagcagucgccacaauccuggcccacacaggcuuugagugugcuaaugaaaguguccuggagacccuaacugauguggcacaugaauacugccucaaguucaccaagcugcugcgcuuugcugucgaccgagaggcccugcugggacagacuccuuucccugauguaauggaacagguguuccaugaagugggcauuggcagugugcucucccugcagaaguucuggcagcaccgcaucaaggacuaucacacuuacaugcuacaggugaggagacccugggagacaugggcaaacugcccuggcugggcagagucuacaacacauguucugggguacagcgcacagggacuuggagcagagugaaucugacauaccacuggcccaguggguagcccauuccucauugcuuccucuggaugaaguacauggguaccuggggucucaaguacuauggcuagcauucucucucucucucuuucuuucuuucucucucucucucucucucucucucuuauuuauuuauuuauuuauuuauuuauuuauuuaauguaugugaguacacuguagcugucuucagacauaccagaagagagggcaucagaucucauuacagaugguugugagccaccaugugauugcugggaauugaacucaugaccucugaaagagaagccagugcucuuaaccacugaaccaucucccucgccccgugguuggcuauucaacaaguauuuauugaggacuuacuaugagucaggcauugugggagauaguaguuuauaagaggaaucaacucuugaguuugaaguguucaugggaagcaaaaacaggcaaacaaauacuaagcacaacaauuucagauagcauuaaauguguugaaaacuaaacaagccaguggcaugccaggaggcucaaguagagcaccgucucuccaguucuugaggcuuaggcauguagugaccaguaaccuuuagcaucugacaaaaggguccagauugcuugcuucacugaagguuugccucuagggucugucugccagauacuugggagguuucugacgugugagacacggcuucccugagcagccaggcuggccuuacuccccuccuuucuuuucagccuccuaagagauggaauuccauacacuaugucuagauaauuguuaguuuuuauagacagaaaugcaguauuuugccuuagcucuggcuuuuuugccuuguguaacuuuuaauuaaugaugacaauuucugacauauuuucuuuaugugucuaucauaaaugcagacccaaacccuuaaaugacuuccuaccauuggcaguggcaucuguccuuguuguuugauggugcugggauugaacucauggccuugcacaggcugggcaugcauucucgcacugcaccccagcccuggcaggagagguuuuaaaucucacuuuccaggcuggcuauuaguaaagugcuuaucuugaaagcccgggacccugaguucagaucuccagggcccauguaaaaagccaggugugguggcauacacuuguaaggccauccaucgauggugagaugggaggcagacaggcggguuccugaagcucacuuucucaacugagaaguggaaguaccugaggaaugaccacugaggugacucuuugaccucuguacacacacaaacacaugcuugugcacauauucaugcacaugcacacacgugcacacacaccagaaagaaagaacaacucauuugcuaacuccugcucugcccaguuuuccuuggguuacuguaagcucacucuccaaucuaauucuaaaauagcucuggaaaacuaauucuugcuuaccaacagauuaguaagcagcucucugaagaauaugaaaggauugugaaucccgagaaggccacagaagacacuaaaccugugaagaucaaggaagagccugugagcgacaucacauuuccugucagugaggagcuagaagcggaccuugcuucuggagaucaguccuuacccauugggguccucggggcucagagugagcgcuucccauccaaccuggagguggaggcuucgccacaggcuccaaguaagaaagaaaguuguauucauuuugcaucuggcucugcccaucuuagcacuuccugacacuuuggaaucaacuccaagugggagaaaggcagacaugggcagaacagaaguugcuggagcaaacagagcuguggugaauccuuuacaguacucucugguuuaaggagcuguuuccuugauaggaacuucaagaaaauugcagaccaaagggaaugaaauuguuguguguuggauggaguuguucuguuguagguuauagccaugaggacuuuaggagccugcagaacuggcuuguuacuuuuuauuuuuuuauuuuuuauuuuuuuaagauuuauuuauuuauuauauguaaguacacuguagcugucuucagacaccccagaagagggcgucagaucucauuacgggugguugugagccaccaugugguugcugggauuugaacucuggaccuucagaagagcagucagugcucuuaccaguugagccaucucaccagcccuacuuuuuauuuuuaagcaauuauauuuugguuuaguucuugagacagggucuugcuguaggguugugggucccucaucugcuccaccacaggggaggugggauguggggaguuuugacugugcuuauggggguugaggggagcagucccaacccugggccugcaacaaugcuugggcugugggguucucacaggcucuuggauauccaggcacuguugggagucacagaaaagugugggccuuugggcuggguuuaaccuaagguggguggggggaggagagcuccagcuggucccaccgaaagaguccuuggcuugauggggcagcaggcuugcuggcgguuguggcugggaguucagagaggccgucuacagauuaggcugugcucuauaggcaaaggccuuucccauggcuccccacaacagaucaaugaaaagaggcaguccaugguucuaaggcauuuauuguauggcgggaaguggguguauaaaaccauccccacuucucuggugggccugagguaaacaccuuuuacagggaggagcgucugggaaggaaagcuuauuggcuaugcuccgggccucuagguaccucauuagcagagagaccucuuggccgugucucuuuuaugugagaaacguggcauguguguuccgagucaggagucuggcagggagcugggagucaccuaagccucaggugugugaccaccaaguccccaggucucgcccugcucuaccuuagcaaacauccuaaacauccugacaugauuuuacaccccacaccuugccaucuugccaucuagguaggucuggaauugaaggccuccugcuuuagccucccacgagcucccacgggcugcaguugcugugcuucacucgcuaucccgacucagcucaguugcaaauuaguuugaacacuuaguuguuuacaaauguaaacacguaagaaauuuaaauaucacauccucauaugugacccaaacaaaauuaggucagccuuagaagcgcugagagguuuuucucugaggaagacauaauaguuaacagcagagcugcauuaccaaaauacagaaagacagaggacaccaacaaccaugucuccugucaggagagacaaguagagagcugaugucagcaucacgugugaacauagucuucaaaaugcaaaagaggccuagagagauucucaaauaaaagggaaaaagccaaaugaaaagaaggccagaggacagccagggcuauacagagaaacccuguuucgaaaaagcaaaaaaagaaaaaagaaaagaaggccagggagcucgggaggugcugugcaagcaugaggacaugaguucaaaucccagcacccauguaaaagguguggauggcugugugcccacaaccccaacacuggccagccagcuuagugaaaacugaguuuccagguuacggcaauaagagagcaacgaaagaagaugcuuccauaccucacauccuucuguggcuuccaugugcaagcaugaauacaggaaaauagagcuucuuauggggguaaacuggaauugugucugccuuugaacauaaucuuucuacccaguuuucuuuuuuuuuuuuuuuuuugguauaggagaaguaggggugaauaaggggaagggaaaaaccaugaaaguggaaaggaagugguaauuuggggguaacauuugaaccccagacuaacagugacacccucaucccauguggggugcuguaaugaaagcagcucggaggucgcuaguugugugagggcgagaugugcagguucugugucugccuccccgugggcucauaaucucuccuucccuucauuucuaggugcagaggucaaugcuucuccucucuggaaccuggcucacgugaaaauggaaccucaagaaagugaagaaggcaaugugucugcgcauggggugcugggcagugaugucuuugaggagccaaugucaggcaugagugaggcuggacucccucagagcccugacgacucagacagcagcuaugguucccacuccacugacagccucaugggguccuccccuguguucaaucagcgcugcaggaagaggaugaggaagauuuaacugcagagcgccagcaggaagcccaugaguaguaauuagacuguauucuuaaguguagaccuuugcuaaugucagagacaguuccuaaccuaguaacaguucacuuugcgucguuucuguacuucuuuaaaacaacuaagccaccguucgcagcugaguugugauacugaccugguaaucagaccaaaguacugucccggcugguuuuaucucagcuccucucagccgugucucuggcacgcuugagaggagucaugccacuuugaugcuccuugcagaggugggacacugaggugcuuugcuuaaauuucaaagcuugcauauauucauguaaauauaugcaauauaugacgucuauaauagacgucagcaauucauucgucuauuuugugucgucauugggaacccaguagcaagacagacaguaacagcuaaacuuaaguccaucagucagaguucaaacuauucaugcuacucaggccucuuacaaagugagagccguggggacagcuguuacccuuaugcagcuguccccagaguucuuucuuuucuagauuauuccagccagccucgucauuuuuacuuuccauaugcucuugugcugacccagacuuuuuuuuuuuucgaggcaggguuucucuguguagcccuggcuguccuggaacucacuuuguagaccaggcuggccuugaacucagaaaucugccugccucugccucccgagugcugggauuaaaggcaugugccacccacgccugacuuuugacccagacuuuuaaguaucuuucaccaugcacacgcuuucaccuuuucuccuugugaagguggcaaacagggcccaccacagcugccggguacgcagcaucuggcuuugcuucagaacagcuguugguuuguuucagguguuuguuuugguuguuuuguuuaaaaagacauuugaggauccagagagaugggucaguggguaaagucacuugcaauuuaaguuugauaccggggacacacaugguguaaggagagaaccaacuccuccaucaugacacacacacacacacacacacacacauaaaaauaaauuauuuuuggaaaaagucau

SEQ ID NO: 12345 - RNA, 31591 nt, Mus musculus
agggacauagauaaaugcugcagacaucaguaguuuauuguuuuaguccaaacacauucaaaauggaaacucaaaagaauacuuucuaccugaaacaauuaaacuagauucuaccagcauauaaugcuuauuuaacacauuacaaaauaaagaugguaauccacuuucuucuauaccuacuaaagccaagaugguaaagccaauuugguugcaauagugucauaaggauagaauauuaccaucaaaauaaaauaaaaucagcaaauaacaguaauggcagaugacuacuuuuuaguuuuucacuggaaaggggacaaaauguucaaaguccacaguacugcaggugaacagucaccauguaaacuucuccaugggaugguuaaugucucguguguggucuggaaaggcugaagcugaauggcucguagcuccaauuaucuguuacacuuaacaucugucuuuugucgccagaacaguagauauggguuacagggcaagaucuuggauuugaaauauauaugcuuguacagauguuguugugugaaauauuuacacacauauacacaccuauacacaauaggaggaggaauaauaacaaaagaaaaauuacaccuggggggcaaaccacugacaagaaagccaccuauuucaaaguaguuuggauaaaagcuucaaaacuacaaaggaauucucuaguacgaacuucaaguacuguacauuagaaaguguaaaacuguuucaaacaaacaaaacacuuuagccuuccaaaauggaaacuacaaaaaucuguguccacaaaauauaugcaauagugcaagacauuuccucaaacauggaagaccucauucuuagggaaaaaaggaaauuuuacccauauugcccaguugacaaaaaaccaauaguugcgucacuagcaaacagucacaaaguucagaaccaguuugcucccaugucaaguguguauuuguucucacuaagggagaguggagaagucuuccauguuaacaagcagcuuuaaguggucacacgcguuuacuccgcccgcuucuugcuugaaacaccagaaaucugauauauacugauugauccaacuguaaccagauaacccucgccauucuugugguucacugggaccugcuauaaagacagacaacaauccagcagcuagaaacucugcucacagaauuguuuaaagauucauguaaaaauaaaaagauguccucccagacuuaaauucaggagccauuugggugcugacaucaguucaagaguugugcaaaaugagugacaguucccgucccccacccauaagagcugccauucuucccucugaaaauugcaguauccgcacucagguucacgugccguuugggggaaucugacugcuucuaaaaugugacaaaauguccaccacguuguuugacuuuuccaagaacugagugauuaugguuuuauaguucacacuggagcugaaagaaaagucaauuagagacucaauggacuucucccuucaaacacacaugacucccucccucccccacagaacacagauguuaacugaagaacaagauaaauaauaagcauccauuuuacugauuugaaagauacugcaauuuuuauacaucaaugauuuucuucaacguuuugcagcuguguggcuuugcagugcagcaauucauagaccacaccguacaggaucaccagcaagacuggaaugauguaauagaaggcaccaucaugcuuauuacauuaccagagaacagaauacaggaaggacagcuuucacuggacacagcuuaaaggagagaggggaggaguguguugagcagccauccauccaucccuguacucaagagggcaaauagaaaacugacaaaacagagcuacuaaaccuggucuaguauuuaagaccacagcuuuugaaguucucacuuuucuuauuucguucauaacuaaaugacuuccuucuggaguauuugcagucuuguuaagguuugugugcacacgcuggucacagcaagcagauagaaugcccuuaucauuucacaaacuauucucuacuggaaaagaagaucaaacuuuuuuuuccccuguugccuccuggugcagauuucaauguuaaugacuucagaguacccgauagugcauucuaaugaauacguacaagcuucuguuuguuuguguuggggggugggagggagacaagaaaaaaggcaagauucuccaauugcacaaauugcacuauuuguguuuccaacauuaauagcagaaacaguuaacacuuaaacaaaaugugcagcagaggauuuuuuuuuuuguuuuaacucaaaugaccugaacucagugggcauguccuuuuuuuuuuuuuuaaaguucauuuuguuguagacaguuuaagauauggucauuucucaguccuuaauucuccaagucuagcuuuauaaauuaacaauaugaauccuguugugaaauuggggaaauaauguccaccucaauuuaacugauaaccaaaagaugcuuuucacaucaaagaaaugaucaaaaaggcugugucacauuccaaagccaaaaaaacuuaacaagaaugcaaacacgaugaguuagguaccacugccaaaacugccaacagugggacuucaacgacgcuguccugugaagcgaccuuccauuugcccgguuccucuuccagaaccaaguuucugugucaugccaccucguggagguggcccucuuccgucacgaucacgcaucauuccaccacccacaauuccacguggaccaccaggaccccgaucauugcgccugauaucccugcggucaucgccaccaccucugguuucucgcucucuggcagcucuuguuuuuuucucuuccacauuuaaacguacuucuccucgaaacauaauuggcuuuaaaacagaaaaaugacaugaguggguuacacaaaaauagacagauauuaauuuacauacauaagaaaaucuuuuaggaaauaaugaaacuuuaacacaagucuguauuaagauuuguguuucuauuaaagcuucagcccuucucaguugaacaaaugauccauacagcagacugugacacuauagcuucuuacucuuugcauaaauaccauuucacaauuaacuauuuuuagcuuuaccauaaaaaggauuuucuaugguuuuaaauguuucaauucauccuauagacaacaaaaagaaaaauuuuaugccccuuaaaucacuuacuuuugcaauuaagauucucugaacugguucagagucaucaaaaaccacaaaaccaaaauuuggaaguuuucccccaacacccuugguauugaugcgaaguuccacaacguuuccaaaaccugugaaaauauacauuacaaccaaggguuaaauauuuuaacaaaacauccuagugacuuuaauuguucagaaugagcaacugucauguuucugauccgucugaaaauaaacacagcaaagcugcuaugcaggaugguugcuauaggacaucugcugcucagagggccaccaccucuguaccccuaacaaccuuagcagacgcuugucuccacaggagaaaaaaaaauugucaaguguuggaagacaaacauuuuccccaccccauuuuaccaguagaguccucggaguuuuaaaucuaagacuguugauuccaaccuucuuccucaucuccugaaccugaccaaacaacacucaacagucccugacaauugugauagcuuuaucauuucuucccuucuaaccaauuaaagugagacuggaagcagguuaagauacaauaaaguaauucaaaauccuggcuuuuauuaugacaaaaaggauguuucuuccuuuagggcuuuuuacuaaauucaagaauauuuucuuuaaagggaagccuucauguugucagaugguagaguuguuguacugaaaaccguggaguccuguuguccacuuggacaggacacccccaaccaguccagauucucuugcucauggagggcaggcaggucaggaccacaagaggaagacugagcccuaaugagcagcuauguugaucuaauguaggguaaccauuaaacuucaacuuaaaaguagaacauaaaugcaaacuaaaccacuuacucauaaagaauucuuucaguucauuuucaucaauaucaugaggcaaguuaccaacgaaaagcugaugacuguccggauagcgaauuauucuccgguugucagagucauucuguuccauaucuccucugccugaaagacaggaagaaaggaaacacuaaagccuauaacaacauauaaaaacaguacaaagaaaugaacuagacucaagaggaaaaaaaaagaaaugaacuagaaagaaaaaucaguauuagugccagccaggcagagugguacauacccuaaaucaguauuacugccaggcagagugguacauacccuaaaucaguaucagugccaggcagagugguacauacccuaaaucaguauuagugccaggcaggcagagugguacauacccuauaaaucccaacagucgggaagagcuccgaguuccagaucagccuggagcuacacaacgagaccuugucucaaauaaacaaaaacauacaagaaagggaacaaagaaaaaacaaaaaacccaauagugaaaguccugguuuggcuuacuaaagcagacgugcccugggagacgcuucuguguuaucagcagguggagagagagcagugaggggccaagcuagacugcuagacuguggacuaugggcaagaccaugaaugacuagcuaguacucaaaggacagggauuucucuauaacccaggagcaaagcaguacggaauaguccucgaaaauaucgccuuaguguuuugaaguagagcacauuuuaucucugaacggcacagccaaucaauguuaacuuacuagcauuuacuuuuuaggccucuuaccucccaaaguauugucacauagaaauaauuuuacuuaauccucucauaacauagcaguagucacagaagacagacaucacacaaggaaacaucauuaacaccuaacuggcuuaagaacaagcagcucagacuuaaugucauccuagauggugacagucaauaccacugccugcaacuucagaauucauuauuuuuauuuauaaaauuauacuucuaaauuugagguacaguaguauaccucacuugcauccaaaacacucucucuuuugagaagauuaaucugccuuauacauguauggguauuuugcauguaugucucugcaccacacacauaccuucugcuagcagggcagaagauggcauugcauccccagaacugacaacucugaccaccaugcaggugcugggaaccugaaccuggguccucuggaagagcaagcagugcucuuaacugcugcuccaccucucuaacccugaaaagcucuuuuaaaucuuacagaauucaaauaauggucuucacuccaccuuagcuaacaaugcaguuaugaaaaguuaguucaacucaggaggagucagugugaagaguuuuuccugaaaagacaagagugcacagugagcuggauacgaacagcucagcuucgaugucuuaagagcagcuacaaucaguaaaugguaaaagggcacauuuuaucaaaccgcaugucuccaaagagaucagcaaacccucucuucaaaguuguuagcccaggcuaucuaucucagcagcauaucccuaucuaaguaaucugaucuucacacucggacccauguaugaacccuaaaguuuagucucucccaacuguccaguaaaagcuguuagucaacugagcuuaccuggccuugguccucgaggagggaaaccaggccgcucucgaggucgcuguucccguacacgcgguggcugagacugaacuucuggcuuagcaucaacccucggcuaaaauacaaugggaaaauuauuaaaauuuuuauauuauaaagaaguaauuucuacaggagaaaaaccaaucaaagcaacuauuagcaagucacuagcaaggauaaugauauuaaguuuaugauguuuuuauauaauuuccuauaugugugaaaauacuuuuuaaaggauauucuguaccaagcuaggacuguaggguagaucuuaauuuucuuacucaauacuguaauaauucacacuaagcugcuuuuacacaauagcacucuuuaaaauuaaaauuauacucacaauaaaacagguaaguuauugcuacaaucacaaaaugcaagaugagcaacuccauauacauacaaaagacaaaguuaaaaggcuuucuuaucuuauaaagacaagaauagacacacaauuccucaguaaaugccuaguuugcugcuuucagacaucaacagugcucaguagaaaucuccuagcccaucccaccaucuugaaaccaauacuuuaauaguucgaacaauaacccuuugcaugguggcaaaugcacuccgaaggcugaggcaggaggaucuuuguuugaagccagcuugaaacaguaagaccacaucucaaaauuaagcgacaagaguuuccauauaaaaucucaaguaguccaagaagcccugucgaaaggauugaacaacagucuuccuuaacugagugggaauggcaggacaggucugucaacugcucaaauacacucaaggauuuuguaaacaauaaugcugucuguccacacuucugucauuuccccucauacaacagccauuuccaguauuuucaaccuccaagggcuuucuaauugcucaagcauuuauggcccaaggaaaagacaaaacuaaaugaaucaucaaaagacacugcaagcauucaacggacuacgggcaucccaaacuaaaagcuagcacuuuauaaucuuuaaggaccuuggucuaagcaauacuuucauuaauuacauaacugggauguuauaauuuguaaagauaaaucuaaaucuaaaaaacagugcagccacuguaacccuaaggcauauguuaacauuacguuauuuaaaagauuuaccuacuucuuucuuacaaccugguuuuucucccuguguagacugauuuucccaagaugaaaucuuuucacauguccuggaaucuaccuagcccaggcuaucuaucucaguuacaauguuaauuuugcugggugugguagugcauaucuuugaucucaguacuuaagaggcaggcagaggcaaguguauuucugugagugaguucaaaggccagccuggucaguuuuuguuauaaagccuaucuagcuaucuugcuuuguguguaugggagguggcaauccuugagagaacuguuucguuuuaaaaauuuuuauaugcauuagcauuuagcuugcauguaugucuuacauguaucugugugagggcgccaguuccacuggaacuggaguuacagacaguugugcacucccaugggagugcuggguccucuggaugagcagccagugcuuuuaacuacugacugagccaucucuucagccucagccaagggaaucguaagcuuguucaaccguuacuguuugccacugcugggacugcaaaaacuacugaaaggacaaauguucccaauuuacuaguucagaguaucauaagccugacaaugaggacugcugucugugcauauacaguuuaauaguauauuaacaaucuaagaugugguauauacugauagcuguauuuauaaaaaggcauauauuuauaacuauaugcuuacuuccacuaaaggaaguaucaaaagcagaacuugguacaguuuauauuaccaaucagaauugaaaaauagauguauuuuacucaaauuuuaguuagugucauauuggaacucaauaaaaauggcaacugcauguagugaguggugguccagccuuugaucccaccauccaggagacuagagagccaggugcaauuuugugaguuaggccauccugguccacacaggcagaauucuaggcuaagcuuagguacauaguaagaccuugucucaacagaggcagaagagauggguaggcaaagagcacuugcugcuuuugcagagacaguucccagcagucacaagcccucuguauuccagucccaggguaucugaggcccuauuccagccccuacaguacaugcuacacagaugugcuauauauaugugcgggcaaaaccacccauacucauuucaauuuuuuugaaaaaaauaauuaaauauaccuuacauuuagaauuuucaggaaaaaaauagaacagucuaaauauuaucaaagaacuugaggcucugucugaccuuaacacauuucaaaacuuauuacaaaaauaaagucucaaaacaauuuaucuuauaaaucaucuguacaccgauuugguaacuuugacuuuggaauagacaagaaugccagugcauaaggacaaaaagcaaagaaacguuccuuuuacuaagaaacaauugucagcuaaggcagcuaugccuucucccucuucucacccaccaauuaaaaccaggcauuccuaacagaugaaguggcuacauagccuaccauuaaggcuuucaacuuaacuucacguaaccaaaaguaugaucuuacagcaaacccuacgaaugaaugucaaacaaaauauaaaauaaaaagucaaagcaagucaaaaaggcaucacuacaaccauacacaugcccuucaguggaguguaagcgaucaagagaacugcucaguuccagcaaggacuucacuuacccaccucuuuagcucagugccuaccaauaccuuaagguaaacuuaagguucuuuuaccaaauaaucuauuuaaaacaaaaggaaaaaaaagccguucaaaaguaacaaaauaaguugaaggauacuaaaccaggugaagauaucacaaauuuauuauucuacacauagcacaaagaccugaggguagucuuaaagcuuacauuuuauuauuuguaauuauguguguguguguguguguguguguguguguguguguguguacaccuaagugugggcccgugcacaugagagccaaugccuacaaaggccagaggcaucagguccccuggaaguggaguuacaggcaguucuaagucaccugauacagguaaaggccagaggcaucagguccccuggaaguggaguuacaggcaguucuaagucaccugauacaggugcuggggaccuuaacucagguccucccugugugcucugaacugccuagcaaucaaucgcuccagccccuuaagguuuaauuuuaaaacauuuuuaauggagugggaaauuauaaaauaacuucaaaauugacucaaauguaagauaccuaagaguuuagaaucuaguaagucaagacauaccuuaaaaaaaaaaaccuuaaauacuaaauaucuuaaauucuguuaugaauacagaccuaauauucucuguaagacauuaaagaaaaauguaugcauuuagaccacauguagugugauaugcaacuacauaaauucaaaagccaagcuauauucacuugucuaaacaugggugaguuaugcuagaaucuaauuuuccucucuauaaaauggaauguuaauacuugucaugcagggugguuuuaaggacucaguaacaagaaaaucugugugcuuucuaucucaguacuagggaggcagaggcagauggaucucugauuucaaggcuugcuacagcuauacaaugagacccuguuuccacccauaccgcccaaaaaagaaaugugaaaauaacacacugaccacaauggcuaggcaaacaaaucuuaaaguaggcauugaacuguagccaugacuuagcaguuggcgaagagcaccagcagcucuuccagcagaccaagggaguuccagccucagcaccuacauggcagcucacaaccaucugcaucuccauucccaaggaaaccaacacacucuucuggacucugagggcacugcaugcacaaggugcacaugaacgaacacagguaaacacaaaacucuaaguuaaaauuuuacagugucaccaaaucucugaaauaacaacuaaaaaggcuccacaugugaaucugacagaaauaaagauuucaaagucccaagucacucguacagauugguuugaaaagcacaaaucauuagggaugagcuuugacugggaucaaauacaaccgcauuuaaauacuuaaccagaaaaaaacaccaccaccaucaacaacacacagguauuauggcaccauguacguguguaguagagacaucggggaaaaguuuuaacuaguuacuuuaaaaucguaugucuucccccccccccccaccaccaagacaggguuucucuguguagcccuggcuguccuggaacucacucuguagaccaggcuggccucgaacucagaaauucgccugccucugccucccgagugcugggauuaaaggcgugcgccaccacgccuggcaaaaccgcaaugucuuaauguuagagcaucuaaaaaaaauguguacaauaaccaaguguaaauuuuguaggaaaaugaagcucuacucaaaauguaggggaaacuggguacuuauauaugccaauaaacucaaauuuaaucuacucugucuaucaagcaucauaaauagugucauauuuucacaguuuuggaaagcucugaaauggauaagaugacaaacagacaaaaagcagaauacuaaaaugaucuguuaaggugaacacuacagucauaaguugguacaggcuucaaucaaacugugucaaacacucacagacugaauuuaggcaauguaaauauauauaacauauauuauaacauauauauuauauauauacacacacauauaucaagguuucuauuucuuuagaacagugauuuaaaaaaaaaaugucauucuauuuugugccuuuccaaauuucuugccuaaaauacucuugcuaagugguaaaauuuucaaggaguauuuuucuuaaagaagccuuuaaaaugacaacauuauauuaguaaaaccaacuuaaucuguacugcacacacccaaaucccaccucuguauauuaauagagauuuggcauuuaaagugggugcgcugacauuuuauuaauacauuuuuaauguuuaauccauaauucugguugacucgcuuaaaaauguuuaaaaguaagcaauuggcaaauguaacaaggauacaauccaauguguucacagauugguuaccugugagacuggugcuuuaacaugggguggaauuccagaggaagaaacaguaccacuaggaggcagguuuuuacuggucacugaagcccaggagaaagccugcaggaaaugcaacaaaccuagacuacuaaucauggaaaaccaccaacauuccuauagggaaacuuccaaauauuuaaucuguuuucauuucuagucuguuccuuuauauugaaggacugacuuccuaauagaaaggcacacacacacaugccagucugugugccaacuuucagaaucuuauuaugcaagguacgacugcuguuuugucucaacugcugaaaccucaccaaguuccuacauaagcaaguggcaaaccacugucaacuaaacaugcuauaaaaucugaagcagagacugacugcucuccccauggggagacaggaugugagugaugguguuagggagaagcacaggaagaccagagugcgguuggagacucagcagacguuaccaaagugagcaaggacuccugcacuacucgcuucuccugcccagaucuacuaaccgucuacuugacagagagagaguucacaugcuauacuaugggugccacacaucuguucaagagaauuaguagaguaaggaaacugaucccauuuauaucgcaaacaggugucucucacagaucaacuucaguagggacacugcaugacuccuagagcaucagaagagaugagcaacugaaaaccucacacauggacuuucauguaagucauucaacacugcauacagacaagaggaaucuagguuauaaauuucacucuuaggaauauuuuggggguagagagaaaccauaaaaucuccucagaacaagaacucaaguuucuuucauauacauauaaguauagcuuacuauuucaaauaacagaaccaaaaccaugcuuuauuaauggcaccaagcaugaaaaugugaggucccagaucugaaaaguuccuuugaucucaccuuuggcgguuccugaggcagagaagcaggcucagcaggaggaggaguggccgacuucuccuccagcucuuccaaguguuucuccuccacuugugguuucagcucuucagucuuuguuucagauucuggcucaggcucagguucaugagaggauucuucuaaaggcuccucuaugccauuacuacaacgaaacaccuaggucacuagguauucagaugaaauaaaacgguuucuccaaacuaacaguugaaacuaguuacauuccuguggguaaacuguucugcguuugugagcaaguauucucuggucauacacaugugguguuggguaugggugaaacccuaguccugacugccaggcacauaccagugaaauugcucuaccagagacucaccuccagucuauacccaucuuucugguuuuuguuguugagacaggauuuuacuauguauccuuggcuggccuggaacucaacucuguagaccacacagaccucagagucagugagcuucuccuuuugccuccuucgagugccaggauuagagugcaccaucacauuuuaaaaaauggguuuuaguaucuugcacauaauggugcuucgcuuacguguaugucggugcaccaugcauguacacugcccuuggaggccauaggagggggucagauucccaugucuaggguuccaaccagucacguggguacuggaucagcuggugcucuuaacuguaaugccaucacuacaaccaaaccccaccauuuaacucuaaauggugacaagguuuaccccagcguuaaguauaaacccuguguuuguuuucuaagcaguguguguugggacagauaggucaggcuuccacuuuacgccaggaggaaaacuuagaacaccaggcuugcagggugagcaccuucacaggcccucacccucugccauauuaaaguuuuacagaaauaaguucaguguacuguccuaaaaagccugcauuaucacagucaaccacagcuuugauacaaaacaugcauuuuuuuucuuuuuugagccaggguuucucuguguagcccaggcuggucucaaacuuagaaauccgccugccucugucuccccaagugcugagauuaaaggcaugugccaccacugccuggcaugcgaauuuuuuuaauuaaguaguaauuuucaguaucuugguacaugucauaaauaaccaaauacugucuuaaauaggcgguuuuaacaaaaaaagaaaaaaguauucgcagaggcugagggucuggucugguggcaaugugcauaacucaacaugcaugagauaccuagcacaaaaaaaaaaaaaaaaaaaaaaaccuaacuucuaaccuagaaagaacuaccuuacaguuaguucacuacaggucaacgcaaaugcaaccuugcaacugcuagcuagccuuacgucacggggugugcgucauaguaagcgcuguuagcauucucuugcacagguucaggagacggcugccugucuucuugcuccucuuccacuucaucuucugacucugacaacacaggacacaucuuuuuaagagaagcuuacauagacucuaacauacacacuguaguauauuuaaggguuugcuaguuuaaaaugucaguagacuuacaaaggcagucauucacugaaauauucccuguuccccacaaacuaaagagaacaagcaggaaaaaaguugauuauuauacucucuuuuaacaagauguaauaguaaagaaaggaaaagcaaggaagcuagaaaccauuauuuugguucuguugucauaucuacucuagaguggcacugagaaaacugguauucuaucaguggacgacgaauaccuacaguauagccauaacaggaagacaaagugagcucuaugccacucuuuucauuuugacaaaaaaguguuugcauccccaagacaauuccagaauauguacgaaacucuaguauagucuauacagacaagucaccuauacagucuuccuagguuugacuuuuacauaauuucauguacacacauaguuauacuuccccuaacaaaaacuaaagaagggaaagaguuucaauucaaauaaacagccaauuucccaaaguuucguccuuacagacaguacaaaguaagacuacugagcagcucccuucaacuuaaacucaccuucaucaaguucugguucagaaucaccaaacacuucaucuucauaacgaaacauaucauugugaacauaaaauuuauuuggaacagaucccuauagaaaaacaacauacaaguaaguacuccaugaauagucauaaauagaaguacccacauuauccucaaacaacuguaaacacccaugguauuguauuaaaagaacaaauuaaauguuacaaucuuacaugcaaucuauauuuuaguaccacagaaauaaucuagacuaaauauaauuauccacagcugauuauguuauaauguuaacaaagagaaacaucgccauugacuauuauaaaaugugugguggccaacaccuguaaucccacuucuucagagacagagaaggaaggccacagauugagcuauagggagacuggguuaaaaaaauccacaaugcacacacaugaaaaugucaaaauaaagcccuacaucaugaaugaguagaugcuaauuauuaaaaauaaaaaaauuacaauuuaaaaacucuucuaagccgggcgugguggugcacaccuuuaaucccagcacuugggaggcagaggcaggcagauuucugaggccagccuggucuacaaagugaauuccaggacagccagggcuacacagagaaacccugucucgacaaaccaaaaauaaacaaaaacaaaaaacucuucuaaaauugaguucauaaaguuuuuccauuuucaaaaccuuuugaaaacacagcuuaguauuucacagaucauguggguuuacuuugucuuaugauccugggaaucaaacucagagccuuccacaaaaagcuaaguguuuguucuaccacugagcuacaucacgccaauccuguucuguauuuaucauccacuuacacauuuauuccaauaucuaacuuuaaagcacacacauguauauacaauguccaaauaagauguaucaacacaccuaauaaagucucucaaaaacagcugcuaagcugggcguggugguguacuccuuuaaucccagcacucgggagguaggggcagguggauuucugaguucgaggccagccuggucuacacagagaaacccugucuuaaaaaaaaaaaaaaaaccacagcugcaagcaggaaggagaaauggcuuagugguuaaaaaaaaaaaaaaaaaaacagguugcuuuugaagacccaggguuuaauucccagcaaggcagcucacaacuguaacuccaguuccagaggaucugauacccuucccacuucuauggguaucagacacauauccauacaagcaaauaaaacauucaaacauggggcuggcgagauggcucaggguuuaagagcacugacugcucugaguucaauucccagcaaccacaugguggcucacaaccaucuguaacgagaucuggcgcacucuucuggagugucugaagacagcuacaguguacuuacauauaauaaauaaaucuuuaaaaaaaaaagcauucaaacacauaagacaagaaacaaaguuaaaggggcuggagcugaagagaugguuuaccaguuaagggugagcuguucuccuacaggaccaggguuugauucugaacacccauggagcaacugucuauaauaucaguuacaggacagucagagauaccagguaugcaaauagugcacagacauaaaggcaaaacacccauaaaaguaaguaaaauucaaauaucaguuagauaauuaaaaaaagagcaacaagcaaauccaagccuguaggaagaaacucuagcauuuucaauaagcuauuaacaacaaaucauagaaauacaaaguaaaugaagugaaaacuuacuucuggagccagaacaaagguuugcauaaacuuccucucaggcuguccacuguuagacagcaagcccaugaccuguaccacuacaccaucacucaagguugcaugagcauccacaugacgaauuuugguaugacauucacugaaguucagagauaacacuuugugguguauauccuuuacagaagaaaagggugaagaaaauaaacuucuugugcuaccacauuaacuacccaucacuguguguacauuuuccucacaacccaaaaaggucaaccauuugcuuuucugcauuaauuugaauucaguccagaaacuacguauuacaacagaccacccauaaacuacuaucaccucuauacaagaaguccuaaugcgucuugauacuguguuuagucuggugguguacagcucuucccccccuucauuucucuggcuggcucaguugguagagcuugagacuuaaaucucaggguugcagguuugaguucuguugggggucagauguaaaaguaacuuuuauacgcuugauaccuuccucugucugcuaacguaggccuuguccuggaagcgucucgucuccauacaaccuaaccuaggccuaaauugguuucagccucugagacuugcugcugaauaaguucaccccuuccuaguucuuccugaacucuggcuggcuaauucgacucagaaacgucucuccaagcgacugacucaaacugacuucucucucagccucucucgaauugcucugcuuggucucauucuaacucuggcaaucuguucuaaucugguuccuucucacucucuggcucaugcugucuucuccuguguuuagcuuguucucucuucagccugucucuguagaacucuccugguaaaccugcuccucucugcacugccccuuaaguagcuuccuuuuccuuucuuuucacaagagcugggcagauccuguucugucaaaucuuucucuaauuugucacuuugucugccacucaauuugacuucacuuucaaacaugggugcuuuuuucuacaaccuaacucuaccuucaucguuugggauuaaagguguguacuaagggcaugucuguauuccugccaaagggauuaaaaguggcugagccaugcuguacuggcuaguuuugugucaacuugacacagcuguaguuaucacagagaaaggagcuucaggugaggaaaugccuccaugagacccaacuguaaggcauuuucucaauuagugaucaagggggaaaggccccuuguggguggugcuaucucugggcugguagucucgauucuauaagagagcaggcugagcaagccaggggaagcaagccaguaaagaacaucccuccaugaccucugcaucagcuccugcucccugaccugcuugaguuccaguccugacuuccuuuagugaugaacagcaguauggaaguguaagcugaauaaacccuuuccuccccaacugcuucuuggccaugauguuugugcaggaauagaaacccugacuaagacacacgccauaauuaaaaacagguuuuguuuuuuuguuuuucuuuuuuuuuacuaacacaaucuuggggcucacaguguaaucgaauauccugugaucaaauauccugcaacaguaccagaccaccauucucaaacuguuaccaacuuccuuuugaucuuuuuuuacuuuacuaucuaauuuuacuuuauuaugauguuugcugaugcuauuuuucuauguccaguuucuuccuguuugcuaaggaccaagccuggaguccaacugaagccccaaacccucuaccguccucucuucccaucaagaucaguuauuucauacauuccuguaacauguaaaauaugcuuucucaacuauauguauaaagcaguccaugcucuccuuuugaaaacaucucaauauacaguucuacuaaaacuauagcaaaagaucuaaaaacaccuaaugaaaggcuacauuuuuaaagccaucuuaauucuaagacauuuugaaaauacguuaauuugugacuuacauuuuggccauaaacugcuuccuggggcuuuccacuggcauccacuccaccaugaacauaggaggaauuccugccauagaaccugcaaagucaucaacaauuaaaaauacugccacugaagggucaagaaagcuuaagacccacugauaaucaacagauaaagggguccuuagucacgaacaggacagugacuacuacccagaguugauguacagacuaaauaagucacugcccauagaccccucaggacagccauguaacaaggaacaugcucaaggagcuagccucccucucuguugucaaucuucuuauuaaaauugaaagaaggaguucaggugcauccuaaauauuuaguaaucuaguaacuuauugaucaaauuuuuuuucuucagauaaaaaaacuugggcuggggagauggcucaguggguuaagagcacugacugcucuucugaagguccugaguucaaaucccaucaaccacaugguggcugacaaccaucuguaaugagaucugacgcccucuucuggugugucugaagacagcuacaguguacuucuuuguaauaauaaucaugucgaaagaaagaaagaaagaaagaaagaaagaaagaaagaaagaaagaaaggaaagaaagacagacagaccucaaguugucuagauuuacugaaaaucaaaugucccauuuaauacucucuucaggaucuccaagugguuacuaacuccacaggcuuacagcuuacaaauuucaaauaaucaaaaagaauccaagcugggcagugguugcacacgccuuuaaucccagcacuugggaggcaaaggcaggaggauuucugaguuugaggccagccuggucuacagagugagcucuaggacagacagggcgacacagagaaacccugucucgaaaaaccaaaaaagaauucaaagaccaaguaaaagucuacaaccaucucaacauugacuuuccuuauucaaguuauuaaguacauaauuuauguucuccagagcuagucaaacaugucagaacuuccccugugccaaacaguauuuucagugacauauaccgauccuuuugauccuaacaacuucauaaauagugcuacuauuugaauguauacagaaguuaagaaauccacauaaccagcucccaccacuugacaugucacuccggcuccagccggaaucugacccuucagcaugcacacaugugcaugccuacacaaaacacacacacuuaaaaccuaagaaagaggugacaacucuucagggaaguuacucuaagaauauaauuaacuaaagcauauuaaaagugcugaggagaaaaauauuaaaaacuuuauucaggcuuuuuagauuuguaugaauguuuugccugaauguauguuguacaccauguaugccuaauaccggcagagaucagaagaaaacacaauauccugugacacuagaguuacagauggucuugagucaaaauguggguguuggacucaaacccaagcuucuccaagaccaacaaugcuucuuacugcugacucaucuuccaaccccucggugaaaaacuuaaaagcaucaacauuuuuauuagaggaaaaaguguuuaaauuaagcuagauauaauauggaagcuguaccaucuuaagacuuuuaaaaauuauuuugugacuauucauguacagauguguuuguguggagaccagaggaaucucuuccaccuuuaugagugcuccauccaggucguaagucuuuccuggaaaaucccuuacccacugugucauguugcugaccucaaaguuauacuguuaacaauauagcuacacuacuaguugagacuuuguuagccaggugguaguggugaaucccagcacucaggagacaguucaagaacucugauucugaggucagccuggucuagagugaguuacagccaggguuacacagagaaacaccgauggcugucagcugucaaauaugagaaauagaugguuaaagugccuacauuauaaccagcauaaaguuuacauggggagaaaaaucauccccagaaagggaacccagaaaacaguaaauacaaaccucuccuauaauacagaagagacaggagaaacacauguccaacaguacaccuaaaaaaaucuaauuccagagagcuuaccuaagauguacacugagucaguacuagccuuucugaggggaguaacaaaggauggacagcaaccugaagaacucagcuuucaaaagucucacccucccuccacuugcucaaggacuccuuccacccagaauaggacuauacguaugcuacacauacuucauuccaacuucuggaaacauuaagcuuauggauguucaacucuugccaaaauagugauagcaucuuccaaguaauacugcuuuucacaugagaacacagagccuucacaggucagguguguggcagcauuucucaacaauaugagaacuucaaaagauaaagucauugauuucuaaucacucauuggaaccuuguaaugagucaagcuccacauuaguauaaugacacaugaaauacugaggaguuuugugugugugugugugugugugugugugugugugagagagagagagagagagagagagagagagagagagagagagagagagagaaagagagagacagagagagacagagaccaaauguguuauggcacuaagauaugacauguuguuccuguuugcaaagauacuaucaacauauaaagagacagaacugacaauaaaauguggccauauccaaagaauucaaagaaaugucuaaauuuuaccugugcaaauacucgggagcuuuauucagcaaaguauaauauugccucacaaacucccgccccacaagcagcggacugggcuucuccauaaccauuucuuugcugcacaaugucaaaugcuggaggagaaaacacaagacaaauagcuacuaagucauccuugcaaaauaccacaaaauaaaucuucuuagauauauaacugagaauaaagcaaauuaacaccauuuauuaaaaaugaaucacagaaaaauuaauuucuggccuagugggaugguacagcagcuaggagccuguucuaacagaggacccagguucaacucccagcauauuaaggcacacgacccaagccgggcaugguggcacaugccuuuaaucccagcacuagggaggcagaggcaggcgaauuucugaguucaaggccagccuggucuacagagugaguuccaggacagccagggcuacacagagaaacccugucucgaaccaccccacccccaccccgcaaaaggcacacgcaacuggaguuacaaggaucugcuugccucuucugacaucuccuugggcaccagacauagacauaaugcagacacauaugcagagaaaacacccauacaaauggaaaaacuagcuuggcuaaauacaacucauuaauuacuugauacacauagcccuccaaguagucuaauuauagccaacacaaagaauaaggagcagcaggcuauauaaagggcucauaaaugccuauaacuccaguuccaggggaacugaaccucuaaccccaaaguacucauguacauauccacacauggauacccaauuacagaugauuaaaaacuuaucuuggagugagacgacagcagcuaaaaagcacuucuuauuguucucacagaggaccaagauucaguuucccagaaccuccaagguaguuuacaacuguguucuaagaaaccagacaccaagcaaacaaguggugcagcauauaccuacaagcaggcauacacuaaacacacacacauauauacacacacacacacacacgcacgcacgcacgcacgcacgcacgcucagaaaaaggaggaaggugggaagggccagugggauggcuuaagagauaaaggcauuagccgggcgugguggcgcgcgccuuuaaucccaggcgcucuggaggcagaggcagguggacuucugaguucaaggccagcauguucuacaaacugaguucuacgacagccagagcuauacagagaaacccugucucaaaaaaacaaaacaaaacaaaacaaaaagagagagagagagagagagagagauauaaaggcguuugcccgacccaaccuuaauuccucaggaccacauaguagagaaaacagacuuccauaguuugucuucugaccuccacuucuguccaaaacucuuuuuuuaguaagauggcuuuacuaucuaaucaguacaguaacuccaagaaauaguccuagguucaguucuaaguaccaaaaacuguguauagaucaacagacacacacaagcacauuuugucuuaaaaggaugugugauggggcuggcgagauggcucagcagguaagagcacugacugcucuucugaagguucugaguucaaaucccagcaaccacauggugggucacaaccacccauaaugaaaccugacgaccucuucuggugcaucugaagacagcuacaguguacuuaauuauaauaauaaauaaauguaaaaaagaaaaaaaaggaugugugacuuuauuuuuauucacaugcauguuuguguccaaagcaaccagaagagggugucacauucaagcccuggaccauggaucacaggcacagugaaucauucuaugugaguagcaagggaaugaacuuggggcccaacccaaaaguacuuuaaaguacuuggggguggggacacaaaacaaaaaccaaacacacaucuuagcguggaucagacaaaucaaaauacuaccagaacagcuauuuuaacacauuucaaugaagguuuucuuuaagcaacuaaauaauuucacagccaaagacauccauagccaucuaauacaaugugguauuuuuccuaacugucagguagguacuaaggugaagcacaaagguugagugcuguccuagggaccagaguguuaccugguguucgcuuaguuguuucuuccuuuggaauuguccuucuagacuuucuaaugacucaaaucuacuucaauuuuuauauggcguaucacuugcuuucaaaaacaacucaugaagcagaugugaacagugcauuacagaugccacuaucuuccuccaauacaacuuuucagaggcugacaaccccuaagcagaaagacucauugcuuaagcuacgacaaugggcuggcaaacaagugaaaugaaagacuggcuccacacaccagccacaagacacuagugcacaugugaguaagugcacgcccgcagacaaacucagggccucuccaggcacugcccauuuaaaaaaaaaaaaaaaaaagacagugucucucacuguccuggaacuuaaccaauguuaggcugucugucuuguuacuacugagugguaaauaugaaaaauagaaaaauuaccaguguggacaagaauauccauccaccuuaccaaaaauuacaauugugagcaaugcuauauaaaaaucuuagcuucaaagccgggcaugguggcgcacgccuuuaaucccagcacucgggaggcagaggcugguggauuucugaguuugaggccagccuggucuacaaagugaguuccaggacagccaaggcuauacagauaaacccugucucgaaaaaccaaaccaaaaaaaaaaaaagaaucuuagcuucaaaaaugaguaugugagccaaguuuaguggcucaggucucaaaaugaggcacuugggaguuugaggcagaaaaaucauugaguucaagccagcuuggaacacaaagugaagcucuguauuuuuuuuaaaguuuauuuuauauaaauacacacacacacacacacacacacacacacacacacacacacagaguguuuuguuugaauguauaucugugcaccacgugcaugucugguacccauggaggucagaagaagaauaggauccaauggaacuagggguaugggcaguugugagccaccauguggaugcugggaauugaacccagaaagugcucuuaacuucugagccaucccuccaaaggccugaacuccccagccccggcccccaccccaaauuuuauugauuuaauguaugaauaauuugcuguauauacaucugccagccagaagagggcaucagaucccccuacagaugauugugagccaccaugagguugcugggaauugaacucaggaccucuggaagagcagccagugcucuuaaauuaagcacugagccaucagcccccagcccugaacuuuuuuguuaucaaaauuauguuauaaaaucuaacagaagaguagaaaaugacuggcacaggaaggcagcagaaacuccaagccacaggcacacaguuggguggcuucuuccagcgccaucgcugccaccauggaccaaucuuuucucugugcucuacucucaaaagauagggaaaucuccagccaauagcuuugccaugcacaggaaaaaagguacuaugucacagagugcacagcaacuuuaaaauuuuagaacuauuuuucgauuuucaucccuuucugguaaccaucuagcaggcaugcuacuagauagaaaauaagguucugggggcugcuuuuccagcauaccuggguuuugauucccagcacacacucaccuggcagcuccaguuucaggggauccaaggccuccuugagcacuaggcauccacaugaguacagagaugaaagcaaaacacccaccaugcaugcauuuucacaaagcuagacuggcaagauugauggcaccccuuuaacaccagccccgugaguuugaggccgccucaucuauauaguaucuuaaagggaaaaaagaaaaaaaaaggcuaaagagaaauaugguuuuagaauaaagaucaaaaguaugaaaagugaccagggauuuuagcuaguuugccuagucugagguccuggacuccaaccagauuacuuaacauuacuguuuuuugcaaguccacucuagucaagucuggccuugaauucauagcaaucuuucuguccagggcuccugaacacugggauuagauaaauguaccaugccugacgacauaucacuaagcuaaaaacuacccacuuucaaaaugcccacaucaguaagaacaauacaguucugacacaguaauaucuaauugcugaagucugguuauacuaaaaauauuacuaaguaaagauagacuacagaaguuagaugaagaacaaaagcaaggaaaucuagaaaaaguaauaagccgggcaugguggugcacgccuuuaaucccagcacucgggaggcagaggcaggcggauuucugaguucgaggccagccuggucuacaaagugaguuccaggacagccagggccacacagagaaacccugucucgaaaaaccaaaaagaaaaaaaagaaaaaagaaaaagaaaaaguaauaaggaacagagucuggagaaauagcuuggugauuaagaacuucacugguuucucuucccagcaccuacauggcagcucauaaccauguaacuccaguuccuacacagcugaagccaucuguugcccucugcaggcaccaggaaugcgugugguacagacacacaugcaagugaaaacuccuuauacguaaaaaggagagagcagggagcugauguagaucagcaagaaagcuuccacagcugacccaagguucuggugucagucccaaugucaguucuaaggaccgaccaacgccaaacuugaacuugguucagacuuaagcccuuaauacugccaaaggcuacagagccauuaaacaagacacugaaaggaccaaacgaaacuuuuaaauuauggcuuccuuuuguuuguuuguuuuguuuuucgagacaguguuucucuguguaguccuggcuguccuggaacucauuuuguagaccaggcuggccuugaaauccaccugccucugccucccaagugcugggauuaaaggcgugcgccaccaugcccggcuaaauuauggcuuccuuaacagaaaggaaauguauaugaugagcaaaagaaugaaauuaauuuuaaaaagccaaauaguaaacuuauuagagaauauuacaauagaaaagguagggcuauccaaagcaaaauaauucucauuaauuucaucuuaaauggucucuccccauguucuuacuaaguaaggacauugcucuauugcuagugauaaaaauggcucuucagaaaaaucaaaucuagaagcaggcgaauuucugaguucgaggccagccuggucuucagagugaguuccaggacagccagggcuacacagagaaacccugucucgaaaaaccaaaaaaaaaaaaaaaaaaaaaaaaaaaaaaaaaaaaaaaaaaagaagaagaagaagaagaagaaaagaaaaagaaaaagaaaaaucaaaucuaacugcaaauaucuggucauaauuaccaaugcaacuaacugccucaagguuucaaauuucagaacauuccagcuuuucagacuggagauguucagucuaugcauacuucaaaaaucuaaaaauccugcaacuuccuucaacacuuguggucucaagcauuuucaaacaaaucaagggaccuuugauucucauucucucucugacacaggugucauguagugcagaacuaccuuggguuccugcucuuccugccuucagugccucagaagcaaacuacagugugacaucacugaauguaguuuaauggagcaauggggaucaacccagggcuugcauugcauguuuuaagaacucuaccaacaaagcuauauccucagcacccuucaaucuuugugagcauuaauacacacacacacacacacacacacacacacacaccacgcacuacaauuaauugcaugaaauuucauguuauucccuccugguuauuucaaugcuuggcgagaacaagcaaaaugaguacuugcggagaagaaaccauacuuucauacugaaaaaggucaagaaaacaaaacaauaccuagauaaggaggggaaaugcagaaaaauaaacucccaaccuuggaaggguaacauuaccauuguucccagggaaagaaugucuccaacagcauacuguagccucuuuaccagaaugugcuaucaaaggcugcccaagcucagccccagcuuaucuccgggacaggaagcuuauccuacucccucugcagggcucacucuuaggccaaggcccauucucacugacccaaagacuagaucccacuuuagaaugccagcuccauuuuaacacuguaacuauauccaaagcucucaaaugucuuuguuuaaagugacuuuagugaccacaauacuaucuauccacucauuuuuaggacaaggaacagauuugcuguggcaaccuuggaucccagaacugcagugauagaccuaaggcaacccuaaugauaaggggugagugcugaagcacaaaagcuaaacaugaccaccauuaagaaaugaugugccgggcuggagagauggcucagggcuggagagauggcucagagguuaagagcacugacugcucuuccagaaauccugaguucaauucccagcaaccacaugguagcucacaaccacuuguaaugggauccaaugcccucuucugauguaucuggagacaguaacaauguacucacauacauuaaauaaauaaauaaaucuuuaaaaaaaaaaagaaagaaagaaagaaagaaaugaugugccgagccaggaaugguggcgcacgccuuuaaucccagcacuugggaggcagaggcaagcggauuucugaguucaaggccagccuggucuacagagugaguuccaggauauccagggaaaaaaaccgaaaaaaaaaaaaaaaaaaaaaaaaaggaaagaaagaaagaaagaaaaauuaauuaugugcugccccuucugaaacaaggucucucuguguagcccuggcuguucuggaauucccucuauaggaccagccugcccuccacugccucugagauuacaggcauaugcaaccaugcccacccuaacauuacauuuuaaaguuuaaugaguauccucuguuucuuuuaccuccuugaauaaggaagauguuaacuucauuuacagaaaaaugaaacugauacuuagaauuccaaagagaucaagguuccuuggaauuagaucaagcacaggaauccuguucaucagcaugcuguuuucauuauuuacacuuguuugcuccaggccaggugugguggcacacagguuaaucccagcacuugcaagguagaggcagguggaucucucagaguucaaggcuagccagauguauauagagagugaguuccaggacaguuggggcuauaaagacccuaucucaaagacgggaggggaggguggugaugcagcagcauaauaugauaauaagauuucuguggacaggagacucugaaaguucaaggcuagcuugguaggauaccacaaauuccagaccagccuagacacacagcaaaugccaggcuagcucaagcuauacaaagauccuguccccaagaaaccaaauaaacacaauuaaaaaaaaaaaaaaaagacaagccugcuuugggggugggagggagaaaauaacaggacagcaacaugcaauccagcaagaaauauccccaauguuagcacaguaacaauuuuuggauagauaauccagagaugauuaaaauaaaccaaggcacaaaaaaacccaauuuuuugcuaagaguuuggggaaaacacacagguuuacuuuaucagcuaucaaacacacaucugccaguguaguaaccagguccaaacucucaacucuguuccacccucuuucuguucacaagcaauccaacuugugcuucaguguaaaacguucaaagaugucauucaucauccucauguccacucaacagaaaagcaggacaaauuaaggcaguuuagaaaauaacuucuaauauucauaauguguaaugacaauucugcaacaaaggaaaaacugcugucaagaaucuaagggcacucuaugaguaucuguaaauuuccaguagcugauacugaaaauuuugguauuuuaaucucuaauacaagcuagagcugcccacacugcccugcuacaaacaaugccaacaauuucuucaaaaccagaacucaccuacuaauccggcuacucaggucauugaguuaacauuuagucuagauaguaaacuugcccuagguucacaggccaaggcugaacaagaaacugccuucaucaucagcuaauggugguugggucuggguacuagcaaggcaaauuggugccuugaacaugucauucagacucuuagccaaaguuaaucuucuaaauuaucgaaugaauucuuuaccuacagacagccacccacucugcaaacauuccgguacuccaucugaggcuugcuucccccaucgcuaauucuaguuuugugugcuuuguuugagucuaggucuucuguguagcccuggcugucccagaacucucuguagucuacagaucugccugccucugccuccugagugcugacauuaaaucgugcauccaugcccgccaauauuuugauucugaauucucaauaaccuaaaccaucacaauaaaccaagccacugggaaacacacuuugaagccguucucacaaucaauuugucagaacaaaacaauuuucauacacugagauuagauagugcauauguccgaaaacgguaacgaagggacaauauauaauucagucguccuaagguccaaacugaccgaacucccccucccccauuuuuuugagucaguaucucacugaguagcccuggcuguccuguggaaguauguagaccaggcuggccucgaacucaaaagaccaccugccucuaacuccagaguggugggacacuggguccaaaccuaaagaccauaaagggaucacugaauuucgcuaaaucaaguguuuacucaaaguuugguucacaugccuagggcuacaauaacugccaaauauggaauugggacaagaaauuacuauccucacuuagaauuagugcauccuuuuaaacugcagcuaaugguuccccugccuagguacuuggaacaagcgagguauagugucuagaaucuaaaaaccagaaaccuuaagcuaaucaacugcacaacaaucacacccggagagaagggggcaauuuuccuugauucagauuugcugcacguguuuuguuuuuaagaagcaaaaggcaucuccucaauguuuuuugugcuuugguuuaaaacuaguuauaucuugggaguagaaauugugaacacgacccuacagcccccccccccccccaaagcaccacagggguaccuaaauaaaucugcccuuagagacgcaggaaaaccucaaucagacuccacuaacgaaauccacaccauuuagggaaacuuacguucuucuccccuuguccuaccccaaagaauagcagggggagaaaagcccauucccaaagcacugaaacguccuuuuuauuccuggguaacaggagagauugucugcagaaaaaggacguaggagacgcacguuacagucccaguauccgaacacguucgggauaauccggggagggcggggggaaacgccgagcacccggcaaguggagcggcggccaccuucaaccccggauucaguuuccgggcacagaaauggugcccggaggccgcuacuuucgcaucugcguugcuucugccuccgccgacacggccuccuuccccucccccacgggcggggcgacgaccgggaacuagggccgccggcgagcggaggaaccaggcgggugggcuuccuacccugaaaccgccucugcaggagcccacugccccgcuucgcggcuuggcgcccguuggcgcgcucugggagcuggcggcggacaggguacccccgggcugcuucauccuagcaauccccagccccaccugugcccuccucugcaccacgcgcgcaggucauccuccuccccacgcagccuuccgcucaccuugcaggaaaggcucggcucugcacgcacgcacgcacucuugcuggcguaggcagccggcgagaacaauguuuccgccgcaccaaccccgacaccaagcgcacacaccggacgguugccgcgagccgcggagcggagggaaauguccccugccgaccaccacaccgaccgccccucucggcccccguacacaccuccaaccaacagcggcggcgggcacgucgcgcggaggucaguagugucgcgggaucggccgcagcagauucuccucccucgaagcaacccgaggcuucggaauccggagagccgcgagcucggggccccucacagccaccucuucccgagagccuagagcugcaacgagcuccaagaacacggacgucccgcccccuuugccgccg

SEQ ID NO: 12346 - RNA, 36134 nt, Mus musculus
cucgccucccguggaucagcugggguacccgagaugucuguugacagcgguggcggcgacuguaaggccgguuccgggauccgcgcagggcgugggguaagcuggccggcgggugggguccuggcuggggaggcaggcggcggccaggcuauagcagcggugcugagcguuuuuuaaguagucccugagccggcguuucugggucucuguagaugugaguccuauggagcuacacggggaagagcagccgccgccgccgcaggaacccugggggaggcuucuucgucuaggcgcagaggaggacgaaccccagauccuucuuuggaaacgcgaguggaccaucggaaggaggagaggugcgguggccagaguggagugaggacgaggauaaaggcuaaagggguagacagggaugaagcauagggaccuaaaguggguacccaacugagaggagaccgagggccuagaacaggaucgaagaccuagucagaguggguuuagauggggaaaccgacaggggguuugaagugggaaaaguacccggcuggcgauacagaagcuacuggaauucggggggugugugugugugcacuguuuuucaacccccccccccccccauaaaaugggcuuauuuauuugugcaguugcucuucuggaugcuugaugauggauaucagucaguucucaguacaacuuugugaaauagaucuguaaauauauccuucgaaauacgaucuuguccucauuacuguacacuucucuuucucaaugaaaugcaauuagaaauuauuaacaaaaggaaaacugaaaaaagguauguagaaauuugacaccacuguuaaaagguugacgggugaaaaaaaauaaaccacagggacuuuagaaaaaauguuuugugacaaaugagaacaaagaauaugcuggaagacuaggacacuguuaaaccagugcucugagggcaacuuauaauggcaggguuucuauuugaaaagaucucaaagucccaggaaauagaauaauuuauuuaaugaacuuaggaaacugagaauuugaacaaaguuauacacagaucccaacaucgauugcuuugggucaaggacauacauuucuuuuuuucguuuguuuuuguuuuuguuuuuuuugggggggcgguuaugaggcaggguuucuauguauagccuuggcuguccuggaacucacucuguagaccaggcuggccucaagcucagaaauccaccugccugugccucccgagugcugggauuaggacauagauuucuauaacuuguguccaccuuauuuugcuaggaggauugauaaaaucuuacaugaacugcuuguguguaaccuagcuuuggacucggagagagcuuagaugguaaagugcuugaggaccugaguucaaauccccagagccuauguaaaaaacuaaguguggugguacaugacuaguccuaguugugaggaggcagagacagaaggagccacguuugcuugcugggacuacuuuugcagacuucuugagcucuaggcucucauugagagacccugucugccucugcaaacaugaucaugugcacaugcauacacauacauuagagagccucucaccauaauacacauaucaagacacugcauugcauguuaaaacaaaaaacaaaaaccugcuuucuaauagaaaugcuuuuaauaauuacuuucacuaacaauguaaaggucacugcacuaguuugcugauacuauguggaaggcuaaaacuaaccccuggagguuguucucugaucuucacacuaaaaguuuuacgggauuuuaaauggaauugacuuugaaugccagaggagaagaaaaguagugucuuuuuuuuuuuuuuuuucuuacuuuuuuucuuuuuugguuuuuugaggcaagguuuuccuguauaacagcccuggcugucuuggaacuuccuuuguagaccaugcuggccucaaagucauagagaucugccugcuucugccucucaagugcugggauuaaaggcgugcgccaccacagcacagaaucuucuaacuccugcuuuuuucugucuccucaagccagugucacuggcagauacccucaccaugacuuucuacagcuuccacuaguugucaguuacuuccucuuucaggggccuggguagaaccugugaacccagcauccauggggccuucccuagcugggccaugucugugucuuaccuuuucauguacucaucuucuucuuuggugccuaaguugugucugcguguuggcugggucuguugagcuauuggcagggaaugcaaagaucacuauguagaaacucagugacugucagaccagagugagcagaaggcuaauaauaguagcaggggcuugaggccuucugugacccaucaaccacuacugcaagaccauggagggcuuuagaacaagauucuugcugccuuuauuggcagcucuagauuugagcacagauggguaauacccaucuagcugcuggugaugucugaaucgguguuugauguaucagaacagacccugugucuaagucugaaaaccaguaucacuuaacugaccgugaacaaccuggagauguagguuauaaaccuugaagaaaagccgaugugccugcagaaucacaaagcaucugcacagacuggcagggacgugacguguauuucgccuugggcauugaccuauacgugaucuuaaaaaagacaagacaguaugagauuguggcagagaagaacuggugaguagcugacacugaaucaaacugaggagcuggacucucagguggucaccacauggaguaacuuaacucuacacaagcaagucuuagguuauggaccuacaacauauccuuuacaguccugaaauacagcuuccauuguagcuugacaugcaagcauuccuggaaggcaugcuaacagaggaguccacuuuagagaccaguuauagagcccaguuggcacaaaccuaggcaaugaucagcugcaucuaagccuaucuggguaccauguaugcuggagugccagcaacucguggacaucagcuaguggcugggggaggauagccaacuaugcagccugguuacuguccaaacacucauccccagguucucugagcuauuagauaucuagacuuuuuuucuuacagagagcuucaucugguaaaugaagggagggauccuggccuuggcucauucccuuuccugccaauaaaguuggugguucaaggagggggaaaugcugugucuucugauccaccaacauauauacaguggcaauuuuggaauuuuugauucuuuagaaaacaggaauauuguaagaauauaguauggagauguggagcugcuucagacuguccacagcagcugaccaugauuugcuucaugcucuggcaggagucugauuuugccaguggcaaauaguuucuacaauugugugacauuugguuugaauucuggggaauuuucaaaggguauaugagugguaggguccuaagaggcaggguggguuguugguuguugguugguuguuguuguucguaguuuguuaagugguuguguccaaagaagaaacaagaagagaaaauuagauauccugauggcaaagaucaaauuugccucaaggaacuggaugccccuaaugagcaggaaauaguuuaaagauaaugccagucccucucuucuguaucuuuuuuuuccucucuuaucuaucauuaggggguugaaaggguggaacaaagaagagcccacaaaguagccaaacacagcuacauccauaggucagugaugaagucaaacauagguccaaacagaauaaggcugugaucgcauguggaacguaguguccccuuacccuuauuuugagacagucuuaugauauauagcccaggcuagccucaagcuaccuuagccugggguaccucaguaugagauucuugccuagcuguuauuuucauuaaaagacaggagcucuaguggugcagucugucagcacauauacuuccauaauuuaaagaaagcacuaauuucuuuuuaguauuuuccacuuugcauuuaauaaagauucuuuucuguuuuauauuuucucauauaugcccuaugguacuuuacuuagccauauuuucuguguuuguccuuacuucaguuuuaugauuuauguaacccaaaucuccauagaggaaaaacuuaagaauuauuuuaaaauauuaaaaaaauuaauuaagcccuuuuaguuuaguuuuuuuguuuguuuguuuuacaauuuagauacuguuaucuguugagccguuugugagauaaacuaucgugacaaagcugcugauacgaugagaucucccaggugacuggggugaagaagguuggggcaaacuucuaucccuuuacuucaggcuaacacuucaguauucaaauguugcucguguccacgggcacaguuggucaccgacuggaaaagcaauaaugaacccacaguaauguccagugucuucuugccaucuguuuuaggcugugaccucucuuuccccagcaauaaacuggucucuggagaucacuguaaacuuacaguggaugaaauaucuggugaggugacacuggaagacaccaggugagcgcuuugucuucucguuagggagguagggagcuggcagugcguuauaugucucaaaaacaagguuuaaaauauaucgcuuguuuuuuucuuuuuucuccugcuuaugguuuucucagccuguacuucucccgguuccucuuuaccucccucccaucugaagccacaucuaaucugucucauuagaaaacaaacagucauaggcaaaacagauaaaggaagagagcccgagaaaaaacacaggacaaagauacagacagagcgacauagucauucacacacucaggagucccauaaaagcacagaaucagaaaccaugauauauauguaaaaggcauguaggguaaaaguaaauaaauuaaaaaugaaaaguaaaaauugaauuuuuaaaaaaggccugacacaacauuuugaggcaaggaaccuucaaaaaugacaacaaaaacacugaguucauuuucuguggcuuccacugaugggcaugugcccuacccuggagaguggcuuguuucccagugaagccuccuuggagaaaacuaauuuuuucauuugcaagugguuaucaguuggagcuagcuguuagggauggggacauguguccacuuucuuguucaggucuguuccugcuccuucaguuucugugaguuugugugaaggccuuguuuucuuggugucuuccauccccucuggcucuuacacacuuuuuaacuccucuucugcaggguucucugauccucgagaaggauuugauggaggcaucccaucuaauucaugaaagcuuaugauuucccuccugauuuuuuuucucacuauaagugacacuguuguagaucuccuaacuguauuuacaucugauuaucuuuuuuuuuaaagauuuauuuauuuauuauauguaaaguacacuguagcugucuucagacacuccagaagagggugucagaucucguuacagaugguugugagccaccaugugguugcugggauuugaacucuggaccuucggaagagcagucggguacucuuaccaacugagccaucucaccagccccccugauuaucuuuugaagggacacauugcuucagaaugugcuuguuuuaaauuuggcacaagcaauagguagccuggcaguacacugaguuguacaccaacuggauaagucuuagggacuugguuuuguuuguuuguuuguuuucagacaauagcacuguucuguggaacucggggccacccagaagucaugauccuccugccacaagccuuccugaguccucagauuucagauguguauacuugcagggacuaggcgccaugauggcaaggcauagaagcugggaagaaguuuuucuaagaagaacuaauggucuuuuucuguuuuaguugauaguagauugaauuuuuuuuaacuccuuuuuuuuuuuuuuucugagacaggguuucucugugcagcucuggcuguccuggaacucacuuuguagaccaggcuggccucgaacucagaaaucugccugccucugccucccaagugcugggauuaaaggcgugcgccaccacugcccagcuuuuuuaacucuuaacacuguaaaauggugcuaguucuaaagccaucuucuguggcaacaaacugccacagacuuaguagcuuaugagaauggugacuuacuuuugacagcuguagagguucagaauccaauguggaucuuggugggcugauuccuuguggaugcucaugggauaaucucuuuccugucagagguguugccuucugggguagagguggucuagaggagaagcagguagucaaggcagaggcaaaacaaccuguggggucaggucaggagauaagcagaaaucauagcagggcauuugggcuucagccuaagagcugggguucauuugucugaguaugaagaugacaguuggaggguaccuggcugcuggaagccagucaagauugugucaagauugaagucugcaugcuguuuugucaguuacuaggacaugggcgugccugcauauuuaaguccugcccuuggcugcugucaugcugcaguggcaaagcugaguaguugcagugagacuuggugaccacagaauuugaacuagugccaugugcuuuauggaaaauuuuugcuauuccuugacccgagagaauuauugugcaagcuugaaauacaaauuccuuucagugcuggaccuuucaggaaugaggcugcagcaccaagcuugguccagcugaaauuuauuuuauguucaguguacugaauucuuuggccaucaugugcuuaucaucugauuuuccaaucgguugccaccaaaaaguucuuucgggagaaucuuuccuguccccacacucuggaccuagagcauguacugcgguuccccaucuagcagugugauuauaauuggguuauaaagcacagcuuuugagcacaggagccacaccacugucaguggaaaacccacaauuuguuuuacuuuuguccugaaugcaucuuuugggagcgaucaguacucaguaaggaaugaacugacagaggagacugagaggggaagagaaugaacuggauuuuggagagaaggggcagcuguaucaacagcgcaggaaggaaggaaaugacagcacugugcugccucaggguccaccuugaggcaugccagaaagaccugcauuggaauugcaggugacccgcaugaccauucaaaaccauauguaauuccaguuccaagaguuccagugcccucuucuggccuacacacaugcaugcacgcgcacgugcaaaauaaucauacacuuaaaaaaauagagcaggaguaacaaguaaaaaguaauuuuuacagaaaaagaaaaagagaaaaccacucuuagaaaauuggguugcugauuuguuauaaguggguagugacaggcaaccuuuuugucuagaucauacuugcauguauaaaugguuaguuuuuuuucccucugaguauguucagaauaguaaugcugggcaaauuucuuaauaugguagaaaaauguuuauccuauuuaguuauuuugagugggguaacuuacacuuuuguucugucuuguuuguuuguuuguuuuaacagcaccaauggaacagugaucaauaagcugcaaguuguuaagaagcagacuuacccuuuacagagcggggauaucaucuauuugguguacaggaagaaugagccagaacacaguaagagggacaguuaacugggguagauacuuuccccagguguugcaccaagaagccaucuagcugaggcuggacacacccucagaaagaguauguguagaaggagacaucuccauacaaagugacagucguggggguucuugguguaaggacuuggguggagugcugacccuucagcugggccuuucuaaaggcaagaaagccaucaggagcugcacaccucacaguggcagccauggggaggaaaugggcugggcugggcuggacaguagaauuggagugugggagcaaaacccagauaggggcccagaagccacuggcagugcugcuuuuggauacuuugcaagagacuguaaagguuagacuggaucuagcuccaugaggguacccugaaauacuugaagaccaccauaaaguuauucuuggcaaggaguacaaagaggacacuaguauuccuuaaguccugccacaaagaaggaccguguaucuuuucuuccuagugguuauuacacaguuauuagugaagugugucuuuuuugcccuugacuccccuaugagaccauuuuccccuuugguugcuuccguauacuuagguugguaacugugguucacuuuuuuuuuuuuuuuuuuuccccgagacacaguuacucuguguagcccuggcuguccuggaacucacucuguagaccaggcuggccucgaacucagaaauccugccucugccuacagagugcugggauuaaaggugugcgccaccacugcccagcgugguucacuuuuauuagaaucacuuacacugguaaaaguuguuaccagaugguaaaugaagauaaucaaaagacagguugugaugugaucacaggauggggagaguugacuucgcacuucccauggggccacggcucccugacuuguuuaauuuccuuuuagauguggcauaccucuaugaaucuuuaaguggcaaacagagcuuaacucaagacucccuugguaaguggaaggauggcagaggccuggaugcuguacagggcuuuguguucuaggauggcccuucagcuccuuggugucuuucugaguugugaguguacccccuuuguuuuugugccuauagaagccaauaaggaaaauauguuccaugugaccaaagauugcucagguccagggcagggugaugauccccagguuccacuauugucacccauggcucagacaugcuuagaggaaccacagccaucaacaucgacaucagaccuccuccccacggccucuaccucuucuacggagccagagcugaccucugcagggcaaaagcauucuucuagcucuggugagacgggaucacaaugacagucacaguuuuuguuuuuugagauacaguaaauccauucaucagugaguguucuguagcccuguaugcugacuuauucccaagaaaaagacuaagcauuaaggaccaugguaacauaauauuuuuauaauuuuaucuaaauacaauucauacacuauaaauauuauucacucauuugaaguguauucauaagguuauauggccgucacuauuaauuacagaacacugucagcuaaaaggaaacucacguaucucugcauuugcauguucugaacauuuguguucauagucauacaguaugugguguuaugacugacuccuucauguaucauaauguuuucaaggcugcguguugcuuagaaccaguuuuacaggccuuguuccccauggcuuguccuuccuucuuacuuugucauuguauuugucuucuguuccaucuauccauaugcacagcauggagucugacaaggcuuuauuaaccuucugauaaucagauugccugaaauggguaaacgcauucauaccuugcguaauuuuuuuaaaugaaaaaugucuccaucuguaugucauccuaacacaguuauagguaguacuuagcacaguuauagguaguacuuauugucugccagaugcgaggcgguguaauaagugccuguguauacucagucccugugggcacccuccauagcagugcuagcacauaaccuuuauucucaaaagacucugaagaucagaggacgaguaguuccaggaccaggagguagccugggaagcuuguucuguuuuuaguauaugaguucuaugugguauaugaguauuauuuguuccuaaaauaacuuuauugcuucuccuugcuccccuuugucaauuuagauaguauaaaccaguuuuuucuuuuucaaguacuaguacuuaucauuugaauauuauaaagcauauauguauuauacuauaacauuaugaauaaaauagaggguaaugaaaacuuuccugacuuuuuagccagguucauuccauuugcaugugaugcuugagcuucugucuguuuaggucagagcucuaccacuuaguuccuugacaguacuccucacuccugucagacgugucugcuucguaccuuuuguggguauuuacuauguaacgugcauuuugugauugcaggacuguuggguuguacaucagaaucaccccuaaauacuguugacgcaguauuuaggggugauucuguuguggaccucccugcuugucuucacaugugaacgcaccgcuugccucuagcuuccuuagcacagugaugggcucuagugcacuuacagcaugacucauggaugaguagauaagacgugcaucauucuuaagcugagauuucugaucacaaacugcacuugauuuaaauaauuaacucucuccugacuuuauucuaaagcagauaaaucagcaucuuucuuauuugucccaaaggaccugggaacacaagcaucuccccaaaaggacgcaguucacuuguugcaaauggcgaacucucuagccuuucuccaguuuuccaagacaaagaagcauccuuuucuuugcuggaaaguaaagaccaugaggaauuggagccugccaaaaaaaagaugaaaggagguuagacucuacuguucuguguauccuuuggccucuugugcucugugcugugcuggcuguugccugcacuagguucccacuuuuugcagaagaacguggaucugccucaggguuaguaacaacuugcauuuuguguaugaaugucuagaauuuuuucuguuugcauaauuuaaauagaaguguucauuacuaggucaugcuauuguucugaaaacugcaguuuucaacuacaaaugggugucaaaguccucuaucuuuaauaggauaguaauuucucuaaaaagaaaguugucuuaagcaggauaguauguguugguucuugggagacauaggcaggagggucagaguuuaaggccagcuuacugaccagaauagggugggaacagagagauagaagagcucuaagaaugguguccugggggaaaacuagauuaccugaacauuugugguaaauuaauuaauuggcuuguggcagguaugaugugaaucacaacaguuccauagggaagaguaagcauagggcugugacauggcucagccagugaaggcauuuguugugcaagcccggcaaccugaguucucucgguggcacccgcauaaaggugaaagcagagaacuacuaggucuacagagguaaccucugaccucugcacguguaccaaggcacacucgagugcgugcgcgcgcgcacacacacacacacacacacaaacacacucacuaauaauaguaauuuccuuaagagaaaacaguaucaagccaggcauagccacacauucaacuucagccuugggagauagucagguggauuucucgagucugaggccagccuugucuacagcgugaguucuaggacagcaugggcaacacagagaaacccugucuugggggaaaaaaaguauugauaagaggugacuuuuuuuuaaagauuuauuuauuuauuauaugugaguacacuguagcugucuucagacacuccagaagagggcauccgaucucuuuacggauauuugugagucaccgugugguugcugggauuugaacucaggaccuuuggaagagcagugagugcucuuaccaacugagccaccucuccagccuccaagaggugauuuuuuuuuuuuuuugguuuuucgagacaggguuucucuguacagcccuggcuguccuggaacucacuuuguagaccaggcuggccucguacucagaaaucugccugccucugccucccgagugcugggauuaaaggcgugugccaccacgcccagcaagaggugacuuuuaacuuaaacaaaaauggagaauuagaggcuauaagaaauggcuuggugguucagagccuuuacucuugcacaggaccugaguuuguaucccagcacccaccugauggcuuacaaucaccuaaaauuccaguuucaggggaccuagugaccaauuccuguaaucuugggcuuuuccucucggccacuuaguucccagaaauaaugacuuugagacuaaauuauuaugaacaacugcuuaggccaaaagcuagagcccguucuccaaguagcucauuacuuaucuguccuguuucauucuaugaguaccacauggcugguucucucuccucagguuaugccacgccugagcuccuccucagaguuccaggcgaaucuccuaugcuccugacucccacaauucucucucucccugcuggaugucccaccuuccaguccuguucauuguccauuggcuuuuuuauugacuggugaugcuuaagagauucucucuggggcuggcucagcgguuaagaccacuggcuguucuuccagagguccugaguucaauucccagcagccacaugguggcucacgaccauuuguaaugugaucccauguccucuucuggugugucugaagagaacgacaguguauucacacauauauaaaauaaauaaaacuuaaaaaaaauauauuguacaaaauucucaaaggacuaauuaaaaaaauauaaaaaauguuuuaaaaaaaguucaguuucuuaauaaaaacauaugcuuuuaaaaaaagaaagaaagaaagaaaagagaaaaaaugagauucucucuguaaagucaggcuuuggcaggcaccaggcauguucaugguacacauacauacauacaggcauucacagauacauaaaaaauguuuuuagcuggguggugguggcagcagcgcacgccuuuaaucccagcacuugggaggcagaggcaggcagauuucugaguucgaggccagccuggucuacagagugaguuccaggacagccaggacugcacagagaaacccucgaacccccccuccccaaaaauguuuuuaaaaauagaaaauuauguaagauagaaaauuuaaauuugcuaggcuauuuggcuuagcagugaauucuuaauauauuuauaaugauggccauaaaauauaguuuaagcaagcaauauuugcucaguaauuuuaagaacaucuucaaaauugauaaaucaguugaggguaacucagugguugagccaaauguacaaggcccuagauuuuauucuaauacgguaaacaaaguaaguugacugaaguauuauaauacagacacauagcaaaaaaacugacuaauuuccuuagaugagggaacuagguaaggaaaggccaagguggagaaugacugcguuuauuucccucugugugacuuuuaaaguuguaugcuuuucaugccugccuuucuuccuuucucucuuuucuuuuccuuccuuucuuccuuccuuccuucuuucuuucuuucuuucuuucuuucuuucuuucuuucuuucuuccuuccuuucuuccuuucuuccuuucuuccuuucuuccuuucuuccuuucuuccuuucuuccuuucuucuuucuuucuuucuuucuuucuuucuuucuuucuuucuuucuuuucccucccucccucccucccucccucccucccucccuuccucccuucuuucuuuucagacaugcuuuugguauguagaacuuguuauauguguaguccaggcuguuagcaaagucacagagaucugccugcuucagcccccaaugcugugauuaagcauuugggaagaaaggugugcaccaucauguuuggcuucuuucuuucuuucuuucuuucuuucuuuuuuuguuuuuuguuuuuuuuuuuuuuuguuuuuugagacaggguuucucuguguagcccuggauguccuggaacucacucuguagaccaggcuggccucgaacucagaaaucugccugccucugccucccaagugcugggauuaaaggcaugugccaccaugcccggcugcuuuucuuucuuucuucuucuucuucuucuuuuuuuaauggguaacugcauaugaagaacagagaggauaccagcucucuggagauaguguuagaggugguuaugagcugagcacugaaagagcaacaaguucuccagcccuaagcaucucuuuaauuaaaaauaaaaauggaggacuauugagauguuucugugaguaaaggagcugcugcuaagccugaagaccugaguucaguucaccaggaccugcaggguggaggggaaggacuagguaaguccugcaaguugucuucucaccuccaaguacaucccugugcccucccugcaaaucaacaagcaaaauguaacaaauccaacguuuuguuugagaucuaucugucugucucagaauucacucuguagucuaggcuggccuuagagaucucucugccucugacucccuagugugucaucaugcccagccuuuuaaaaauaaauuaaaacugaacaagcuaugauauugcaugccuauaaucccagucuuggggaaacggaagcagguggagcagaucuuuaagguaacucucagcuacauaaugaguuugagauuaaucagggcagaaugaggaaaucccccaaaauuguaauaauuauaauaauagcaggaguaguuuauguauguauauaaauguaucagaagaaaggguuuuuuuuuguuuguuugguugguugguuuuuugguuuuucaagacaggguuucugggggcugaagaaauggcucagcgguuaagagcacugacuguucuuuugaagguccugaguucaaaucccagcaaccacaugguggcuuacaaccauccauaauaacaucugacacccucuacuggugugucugaagacagcuacaguguacuuacauauaaauaauaaauaaaucaaaaaagaaaaagaaaaaaagacgguuucuguguagcccugacuguccuagaacucacuuuguagucuaggcugaccucaaacucagagauucaccugccucugcuuucugagugcuaggauuaaagacaugugcaacuaccaccuggcaaaaggacauuuucaaaagcuuccagugcaccuuagaguuuuuuuuuuuucaagcaguuccuuuuguucauaggguuauauuuauuuguuuaaacaaagugacauuuauaacaauacuauacagcugaucucuccuucuacuugucauccuuaugucuuaugggucaacaccucuucuuuuaaaccagaauugaggcacauaggaacaugugacuuauuugggaccuuuaaaaauagucuuuauauccaggcaugguggcacaugccuugaaauccagcacucaggaagcugaggcaggcagaucucuugaguucuagggcagucuggucuacacagugaguuccuggacagccagggcuauguagugagauccugucugaagaauaagaaaagucuuuuaaguggcuuuguuuccucugcuauugguagacaagagaaaugugaggucgucggugucuucagguuaaguggcugugacuacugggacuugucuuuugucuuauagauggggaacuugacacgaaccuccaguuauuaguuucaggccagcguggaaaugcccaaaccucaagugaagaugucaaagaugccucugugaagccagacaagauggaggagacacuaaccuguaucaucugccaggaccuucugcacgauugugugaggugugcugcuuccuauccuaggguggcuucagcaguacuggcucccuugacaagugugaagaagaccauaaauaaaacagacuuugaucuucuuugccuuggcgucugcucagguucccagagagcagggccacagauucuaugagaugagaucucuugguuuugacugacacaggccauggguaacccaacagaccuggucuuugccuuguaggugaaucgugugaaguauacuggguuuuaaacacuuccugccuaaagacauaauacuuacaguagaacgaaguucccaggauucccuuugggauaaacuuaucuuuguuuuuguuuggaaacuugggagguagaucccacccaacuuucaguacccaaacacuuggugcuugaucuaugauuuguucucccugaaaacaggcauauaccucugauuuuuuuuauuacuauuuuuuuauuuugugucuucuaacacugagcuuuaaguauuuuuagguuaggugauacaauucuccacaguuggcccaugguuggggauccagcuugcauuccuguuugggucagcccgcaacggauuuuguuugagugucacaguggcagaucuuuggacgauuuugucaagaaauguguucuuuauuccuucguauucugccaguuugcagccuuguaugcacacauuuugugcggcuugcuacucugguuggauggagcguucaucucugugcccuaccugccgauguccaguggagcggauuugcaaaaaccacauccugaacaaccuaguggaagcauaccuuauccagcacccaggucggcuccgcuaacuuuucugucguagggaccuggggcugaagcuaugcccugagccaucaucucucuaguccuguccuguaguaaaaaguauuaaagucccagugcacggcuucuuccccaccuucgaccauucauguuccuggauguaaggcacacacagccuuagguagcacaacagcgaggcagcugccuacccuucgugcuguuagaauuuacguuuuccauugauaaccccgaguuaucacuuauuauuuacuauguuccguuugggcuguuguuaacucuaauuggccagcccucugggccacguucucuuggcacguagcccauggcagcucucuuauaucccuccuguauguucuucauccaugguggcuucuugccuuucuuccucuccaaguccgugaaacuucaacccugccuaugucucuucugccguuguucagcuauuggccguuggcaucuuuauucaccaaucagaauuaacuugggggcagggucccaggugcuaagugcagacucugaaaucuuaggggccagcacauagcauuacaauagacaguaaaaggcaaaaccucaacacuguccuuugccagugacugcugcuaugcccuuuaugucuagauaaaagucgcagugaagaagaugugagaaguauggaugcaaggaauaaaaucacucaagauaugcugcaacccaaagucaggaggucuuucucugaugaagaggggaguucagaggaccugcuagagcugucugaugucgacagugaauccucagauaucagguuagaccugugccuggcugaaaauggggaucuggggauaagaaguacguuagugcugugcuucacugugcuauggggugugcagcuauaggacuucaguaagucagauuccuuagagccuuucguuuauuuccucaaaccagaguauggccagaacucaauggacccagagcagcagugaacaccguuaagaaccacagacagccuugaaggacucuuacuucaauuuuaauuaauuaauuuugagacaaggucucuuuauguacucuuggcuaucuuggaacucaccaucuaggccgggcuggucuugaucacucagugauccuuccacagucuccugagugcugggauuaaaggccugugccaccaccucuagcuuaguugucgcucucuguauguagcccuggcugccccggacuuacuaucuagaccaagcuguccuugaacucgcagagaugugccuauuucugccuacugagcagcgaaauuaaaggcaugcaccaccauuccaaggcucuucaguggguuuugaacuucccccaaaauacccuccauuuucuuaggccccucaucauucacuggcuauagcagaaaauuccuauguauugguuuacccacauaagcacauguaauuccuauacuuagacacugcgaguccuuggcuguaaaugaguguuauaauuucuuaagaguaguaucacaggagaggcauaauacccaggcugagaggagauggcccuuugagaccuaauuuuacuuggugacacguugguuuuaggucuccauuuugggccaaggccaugcaugauauuuuuuaaaaaauaaauaguaaauuaccuccucuggcuuacagagugaguucaaagcuagccugagaagcauaggcacuugucucaaaacaaaacuauuuuaaaaggucuagaacuguaguugaaugguggagugauugccuagcaugugagaaguucgggucaaucuggcacacuaaauuggguguggcugcugaccccuuucauccuagcucacuaggguccucgugccucagucuugacagugcugggauugcaacugugcuguucuaacaaggcaagaacauacauguauugagagaacuagcaggacuggcaguguaguuuucucucaugaaccugaauuuucuuggccuuggagccuaugaguuuauguccacugaguagguacuaagugguccaagguagaguguccuagagcauggggugugagggauugagcaggaaaguagcugaguacagaacagcuauuuugugguagaugugauccucacuuucagacuccuguuccagggaguuauggguagugucaucccuguaguaggagcugggcagaaaagugggguucauugccuucuucacaguugcugaaguggugcugcaggugagcagagguagagcagaggucuugaaggguagaagcccaacaccuggagcuagggguuggugaugauguaacgaugauaucugcaugucugccuggagccuguuccuuuguaacuauagcucugcuucuuuuccucgcagucagccauacauugucugcagacaguguccugaauacagaaggcaagcggugcagucucuuccuugcccagucccagagagugagcugggagcuacacuggcccuugguggggaggcaccuucaacaucugccagcuugccaacagguaagacagugauaucuaaccaugaucucuuccauccacuaugucacauccuugugauuguuguucuauuuuccuauggugugauuccucuaugaugucuuucuuguccucuauuccuuugcuucagcuauccuuuugccucucguagccucuugcuuggcauagccauuaauggaaagaaauuaggggagccagguagagauaggaggaucucugugaguucgaggcuucccuggucuuuauauugaguucugucucagaaaaaaaagacacagagagaggagagagaauuaauuaauuaggugaacauuguuuauuugagggucuccccuuuuggacauaccuaauaauugacaguucugguuuuaacuuuggucuuucucuagccuacugcuucagggaguuugcuuagugggguuuuccaaagccaaaaugaucguucuguaucuguuacccaaauuuaagagacuggcuugcuugcuugcuuccuuccuuacucucucucucucucucucuuuucccuucucuuaauuauuauuuucuuuauuuacauuuuaaauguuauacccuuucuugguuuccccuccaaaaacccccuauccccuacccccuccuccugcucaccaacccacucacucccacuuccuggcccuggcauucuccuacacuggggaauccagccuucacaggaccaagggccucuccucccauugaugaccaaaaggccauccucugcuacauauguggcuggagccaugggucccuccaugugugcucuuugguuggugguuuagucccugggagcucuggggguacugguugguucauauuguuguuccuccuauagggcugcaaaccccuucagcuccuuggguccuuucucuagcuccuauauugggagggaguaaucauccaucuguuggaugcauccaucugauggaguaucagucuacugguuggcugagagcauccaccucuguauuugucaggcagacacugguagagccucucaggagacagcuauaucaggcuccuaucagugagcacuucuuggcauccacaauagugucuagguuuggugacuguauaugggauagauccccagguggggcagucucuggauggccuuucuuuccuucagucucugcuccacacuuugucucuguauuuccucccauggauauuuuguucccccuucuucuucuuuuuuguuuuguuuugggacaggauuucucuguguagcccugacuguccuggaacucacucuguagaccaggcuggccucaaacucagaaaucugcuugccucugccucccaagugcugggauuaaaggcacguaccauuauugcccggcuuguucccccuucuaagaaggaccgaaguauccacacuuuggucuucuuucuucuugagcuucauguggucugugaauuguaucuuggguauuccgagcaucugggcuaauuucgacuuaucagugagugcauaccauguguauuauuuugugauugcauuaccuugcucaggaugauauuuaguuccauccauuugccuaagaacuucauaaauucauuaauagcugaguaguacucuauuguguaaauguaccacauuuucuguauccauuccucuguugagggacaucuggguucuuuccagcuucuagcuguuauaaguaugguuguuaugaacauaguagagcgugugucuuuauuacauguuggagcaucuucuggguauaugcccagaaaugguauaucugggcccucagguaauacuauguccaauuuucugagguaacaccaaacugauuucuggagugguuauacuagcuugcaauaccaccaacaauggaggaguguucuuucucuacaucuucacuagcaucugcugucaccugaguuuuugaucuuagccauucugacuggugugagguggaaucucaggguuauuuugauuugcauuucccugaugacuaaggauguugaacauuucuuuaggugcuucucagccauucgguauuccucagucgagaaacuuuguuuagcuuguaccccauuuuuuaauaggguuauuugguucucuggaaucuaacuucuugaguucuuuguauauauuguauauauauuauauauuggauauuagcccucuaucagauguaggauugguaaagaucuuuucccaaucuguugguugccuuuuuguccuauugacaguguccuuugccuuauaggagcuuugcaauuuuaugaggucccauuugucaauucuugaucuuagagcauaagcuacugguguucuguucaggaaauuuucccuugugcccaugugcucgaggcuuuucuuucuucgcuguuaguuucagugucucugguuuuauguggagguccuugaucuacuuggacuugagcuuuguacaaggagauaagaauggcucgauuugcauucuucuacaugcuaaccgccaguugaaccagcaccauuuguugaaaugcugucuuuucucuacuggaugguuuuagcuucuuugucaaagaucaagugaccacagguguguggguucauuucugggucuucaguucuauuccauuauucuaccugccugucacuguaccaguaccaugcaguuuucaucacaauuggucuguagugcagcuugaagucagggauugugauuccaccagaaguucuuuuauuguugagaauaguuuuugcuauccuagguuuuuuguuauuccagaugaauuugcaaauugcucuuucuaacucuguaaagaauugaguuggaaguuugauggggauugcauugaaugacuggcuucuuucuacaguaugcugaauucccauuggcugucuugcaugcccauagaguauuuccaguagauaggcaucuagaugcacugggaaaugcaaaagacagacugagauguagcucaccaauagagggcaugcugagcauuuauuuguaaggcauuggguucuacuccaacuuaaaaggaaaacagaaaagaugaagggaagggaaaagagagcugacuacuugcuuguagcaugcuguucuuagcucuaaggguugaacuggcuacagguagcauuccagugcuuccugccugaggcuggccacucuaguucuagcucuuccuguucuuaguacugucaacacuguaaucauuaucaaacugaagauagccuuaggagcccugccccuuagcuguuauuuagccugaguguguuagaaggccgcuaaccuaggauuguaguuaggaggcacauucuuggcuaaccuacucucuuuugguucucugggucacuuguagaacccauaguuggaaaagcaaagcagugcucagcaacuggagguagauacuugaccacagcccaggacagccuuuuugcucuuuugaaacagggucuuaauuuauaacucaggcuagccuugaacuugaucuucugccucaagcuagcauuauagguguauccacccaggccugacuugaacuaccuuaguccauuuacuuuuuuucuucaauuuuauuuguauauauguuaauguaugcaugcaugcauuguguauuuuuggugcuguggauucucaaaugcuagacaaauauacucacugagcuauagcuggccugaauucuuguguuucaaauagcagaauaucauuuggccacuuaggaaguaguuugaauuccuccuggguucugacgcucuucccauguacuucauaguugccucucucauuguaaauuuuugucugcugucuuucaccugauaucuagacauacucugaccuccauaugucuguacuucagcagccccggauuacaugugcccucuucaaggaagccaugccauaugcaccugcugcuuccagccuaugccugaccggagagcugaacgggagcaggauccccgcgucgccccucagcagugugaguaauguguuauuuauaaauccaauaggugaaauaucuuguuuuaacuuauauuucuuaccauuaaaagaggucuuuggauagagacguagcugagugguacaagaguuguuuggauguauaagcuccuggguuucauuccuagugcugcaaaacaucagcaacacacauggagcucuucuuuacuuaauggcuguuugaauuuacuuuugcuugaaaugcuuguuuguaucuauugccuuuuaaaaaucuuucucaacuugagaguuccuugaauauuacugcuguuaaaugaagaaaggcauaaacucauguggccauaucaacaagucgcuacaguaccugagccccucuacuggauaucaagggcacagugucugauacaguacaagcucuccacuugagugauguagauguaguguguucugugugcucaagagacugcuucuggggagaucgcucuccuaucuugcacuuagugcagcacagaagaaacaguagcucagcaggggugugcauccugggauaggcagcuaacaagucccaggcauaccagggugacuucuaggcauguugaaaagaauccauggaagaguccuggaaauaccuuauaucugagaaauacagaucagcaaguggcagcugagguuauguucuuaaauuuuugcuaagagggcagucuuuacuuuuggcuaauucuguagagauugcuuuuauagauacaagcuuuuacaaaaugaucacucccuuuaaaagauuuauuuacucaguccuguaagaauuucagcuaggguuuaguuaguaccauaaucaaugaaacugcauuguagagaauauuaaacauuaaaaaccuuuucuacaaaggcaagcacaguaacaauguaaaaacaguauuuaugggucgguggaaaaguucucugcagacaugaaugugcaguuacuucaaguguaucacauauccagauuggggagacaaugaacuagggcuguuugggugcuggggucagagagcaagcuguuuuuaagaucacaauuuuaagauaacucugaauuuucauaauaauuuuauuucagauguuacuugacauguugucucugcucccuaguuccacgaaaacaccucagaaauacuguuuucaaagagaguugcgcucuugagucuggugcuaaauguccucagguaugagaacagccagaguucuaggucucaguugaccaacuguccucuacccacaggugcggugugccugcagcccuucugccaccuguacuggggcugcacgaggacuggcugcuuuggcugcuuggccccauucugugguaaugucaacucuucagcccuuaguugcuuugacauuuguguguucucuuaguaaauuuggggccggugguguuggauuguguuaagagaaaagaggcuucuaugagccaucaagugauuaccuaccccuuuucugcuacauugcagagguuucucaccuugaaauucucaaacccacauugcuuuaaaagcaagcaguaacaaaauaagaaaaauccugguuuuccuauacuggagaaauacuuauucacauaaaccacuucugcuauaaucccagcccuccagaggcuuaggcaggaggauaacaggugugugguauugcauaauuuaaucccuacacucagggagggaggcagagacagguggaucucuggaaguucuaggccacccuagucuagaaagaguuccaggccagucaggucuauauagugagauccugccucaaagaaaaaaaguucaaguuuagucuacagucgaugcagaccccguuucauucaguagugcgauggagaucaauuuuaccuguucucuauuuaagauugcauuuuaguuugaguaugauggugcucuguguguguguguguguguguguguauguauguauguguagcauagauguauauuugaguuuuucugugugugugaacaugugugcagauagaggacaaaagucaacauuaaguguucucuacugauuucugccuuacuuuuaaagaauuacucacuuauuuuguaugcgcacacacgugccaugacacauacauagucagaggaguuugugggagucaauucucucuucucaccacaugcaucucagauugucagauuuagaggcaaaugcuuuuacaucgccauggcucuccacuuuaaaauuuuuauuuuuuuuuuuauuugcuuguuuuugucagugauacuguuuuuuaaauuuucuugauuuuaaaauuuuuuucauguaauguagguugaucuuauucuuuccccucuuccaacucccagaucucccacuaccaaccccauuucauauuaauccucucugugugucaagaaacaaaacaaaaagacaaaaacaacccauggaauccguucugaauuagccaucuacucuugaguaagaaaucugccccucuaguguggcugauagacccacuauccuuccauugaagagaagugauucccuuucccggcagcugucacuugcaaauagcuucuugauuagaaaugagacuuugugccuucuuagugcugggaauuuguguggcuugaacuuguucaggucuuaugcaugcugucacagucuuugugaguucacaugugcaucagcucuguugugucugaaaagucuuccaucuuagaggcuuccacugcguuugugcucuuacaaucucugugccuccuugaugcuccuagccuugagggagagugugacaaugacaucccauuuagagcugaguacucaaaaguccaguugagggucugucucuauguuaauuuagcagcuacuguagcaagaagcuucucugaagaggguugagcagugcacugagcgaugggaacaauaaugugucgugagcaagcauuuuauugcuaugcuccuguaguagaauauuuucuugugcagguucuugaccuccuuaacaguucggguaugugcuccaucucauggagagagccugaaagcuaauuucuaaaaguguuugguuacuuucauuacauuuguaccacuacugcaccaguggguauaucuugcagacaggucacuauuacagcacacaggguucugagcuggguggggcuggugauuacuuucugccucuggaagcauuuaagcacuuggaaugcugcuuaguacgggugaagugucugcuugaauaccaacuugauuuuuccacguuuggugacauaaguaugugaugauuucagccguagugucuuaucucagauuguggacgguaaccaguaauauuggcaauaaccuguacugucugggaguggucuaugggacuccuucagcuaaugacuaaaaaagauguaacuuuuuccugguacuguagcuuuugguaguuuaugaugucuaguugggacauugacuccauuuauuauauuucauccuuauuuugagucuucccguugaacccuaaugcuuacuuaccacuuggcuaggacuaguugggucagcagucuccagggauccacuugucuccucuuuccccgaccagugcuaguguugcagacaugcccugcuacacuuggcuuggcucuucuuuucuuuucuauauugaugcaggggcugaaacuugggucugcuugcuugcauggcaggcauuuuacagaacgaggcauuuccucaccuuguuugcuuuuuauaaucuaugauggaaagagauuugauuauccugucaggcaaacaaguuugauaagaugcuacgucauccuuauaaaacagauaauguucuuccuuccucuggcagagcucaaccugggggacaagugcuuggauggagugcugaacaauaacaauuaugaaucggacauccugaagguaucaccuccauacuuguccuggggauccgaggaaacugugaagcuuuccuauaacuugugugguuucuguuaggacacacguuuucucuagcauuugccugcaaauguauacugucaaaaccacacacuguauuuucugaccaauacaaucaguuccaugauucuaauauaucagguuuuccauauguuccaaaaugaggagauuccuguuuguucaucaugcugucagauuguagaaaccggugaauacaucuuacagagaugguuucuaaauucuggcuugcuguggcuccuuuuucugaauauuuuuucccgugcuugaggaagcuagcucagaauuguaauauguucaguucugcacccucugcacuccuguugaguacuuugcuucccuuugagaccauucauuuacuugaacacaucaccagacguacuuagcuacgcaccacuacacccuacuuuuauguacauuaaaagaccuuucaguaacagccuugaacugugucaggaaaaaugaaggccuagcauucagcuauacuugucacccuugguggggagguuggagggcaaauguagaagggagaaacuuaauaauacuuagagauagaaaggagaaauucucuuuggugugugcuacugaaaccucuagcuucuauucagggagauuuagcuucuaccagaagucuuccguagcuuauauaggccaggcagggucuaagcagacacuggagauuguaccuucucaagagcauaugucugcagucugccuuuucagaaaauaaaagaagggggauccugucuacaaaaagcagauguuggcaaugcaaugauuugauuugaaguauguuagaagcaacacugugacuaacagucuguuuuuuuauuucucugucccuuuuaauaguauuuaauguuaaagcuugcuauuuuccuucuccccuucagugucuuaucuguccuugugcugugaaggccuuuguggaauuuuuugagagaaucgugacucuucuucagguccagaagcaaaagagccucuuggcaaagagcuugugaaacauaugagggaacugacuguaguuuauccacuggcucugugcaaaagccacucaaggacagcuguguucuggcugugucugcucucggagccuuguaugaaguaucccugacuaguugagugguucaucuaaacuggaauuucuuuucacccuuuuucucaucacagaauuaccuggcaaccaggggucugacauggaaaaguguguugacagagagucuccuggcucugcagcgagguguauuuaugcugucugguaagcaguguuucgcuagcccugcccugcagauugggcaucaauuuuuaagggugucuuaguuuccuaugaagugguaagaacguggcaggccacacuuggcaguauaccuaucuguuuuacuauagaucuaugucuuugacucugacccuuccuaagaagauagaggaaggucuagauuuguuuuggcagaguccuacaguguagccuaggcugucccugaacuccugauccaucuaucuuccucacuagugcuaggaugacagguaugagcugccauaccugucgaaucacuuuaaaaaaagguauuuauuuuauguauaugaguacacugucacuguccucagacacacuggaagagggcaucagaucucauuacagaugguugugaaccaccaugugguugcuggaagagcagucagugcucuuaacuacuaagccaucucuccagcccaugccuaaucacuuuugauguuuuaaaauuuuguuuuuuuaaaaacuuggugcacuugaaaccuguaugucauguuccagcaccuucucucccuauuagggaaggaugggagcauggcuaagggagccuccacaacuuugucacuuaacuuguuggcacucaguuggcagauaaagucagguauugugcuuucucccacaggagugcauggugugggaggcuacagaaaucguaacaguuuuuuuuuuuuuuucccccuaagacuuaaauguuuauuaagagaaaugugagcaauuugcuuaaaaccccuugaguuauuucuuucuggugauuauguucuggugugucuugucuguaguugcagcccauccaacuucuaugaacacccuggauuucuuuuuuuuuuuuuuuuuuuuuuuuaauuuuauguaaguacacuguagcugccuucagacaauccagaagagggagucagaucucguuacggaugguugugagccaccaugugguugcugggauuugaacugcggaccuucggaagaguagucgggugcucuuacccacugagccaucuuaccagcccccacccuggauuucuugauuuuguacuguaauaggaguagcucauacagaaaguaugagugacuuccuguucucccaguacacucagacaaaucccagcacccacuuacuggugcauagccaccugucaguccagcugcagagaauuuggcauccucuacuggccuccauggguuacacucuagcacaacuauaaguaaaauaaagaagaaaggaaggaaggaaagaaagaaagaaaaagagagaaagauaagacugggugcugaagagauggcacauuuguuaagagcaauaacugcgcuuacagagguucugaggucaacucccagcaagcacaugguggcucacaaccaucuauacagggaucugaugcccucuucuggugugucuaaagacagcuacaguguacucacaugaaagaaagggguugggggaugggggaaagaaaagaaaaggcugggcaugguaguguacaccuauaaucucagcacuccagaguuagagacaggaagaucucugugaguuugaggccagauggccagccuagucuacauugcgaggccuuugcagagagacccugucucauaauaaauuaauuaauuaauuaauuaaaaaaagggaaauagaaguaauauauaggaugaaguaagacucacuugaaaucccacagcuaaaccacuggcugagugcccuggggcagugcuuauauacacacugaguggcaugggguagugcacugcuuacugagcauuugugaugcccuggguuuuguccccaauauuggaaaucauaagcaaagaauaaaacaaauguggaaauaguguuuucaugugcauccaagcucuuccaaaaggucccuacuugcagguuacauugaagauggugcccuauuauugaagguccuguuugugcucagcaucuaucacacacucccuucugccaacaaauuccaggcauuguuugugagguaguggaaccuggucagagcucuuguguauacucuacugcugaacuaaauucccagucuugccuugguuucuuauuauuacauagagaguuuugggaggggacaggcuuagagaaaaugaucaugacccugaguaggcucagacuugcuguauauccagggcugaccuugaacuccuaauuuucccucccagaugcuggcagaagccagccuauacuacuguucccaguuuuauauaguguuaagggucaaacccagggcuucaagcaggcauucuauaaacuaagcuacauugccagcucuccauuaaguuuccaucucauaacuuauuuagcuacuucauuaaaugacauaucuuucuuguuuuccacuacauuaacaccacagcuguugagcgugcaaugcuguacaccuacaaguuuucauuuuagaauaaguaguggggauuuuguuuaaugacugugguaugcacagcugagucugccuugugaacacacaaccuucccgagguugugcaggucccacuucaugucugagccaucaccugccucuuggcuuugcauuuggcauugaauuuugugacuaugugagaagcugacagggacuuauucuuugaaugccucugugugaguguuaacaaaauugaaggccuuuuugcaucuauccaugcuuauuuaugauccuggacuuuacauaugguuuuuuugguggugguggugguggugguggugugggguccuuuagcagcauugauauauuaucuuuguuaaaguauguaguauugcccuuuguguuguagauauguucuuacuguagcauuacuauuucacaguuuauguuuuuuguauuuccauuucaaaguuuaaauuguagguagucaaauguacaagucauuucuuguaugugauuucuauucugaacacauguagguuuagcaucccaaauuugaaaaugccuucagcacuguaacugauagagugccaaagacaggacaccacaagaaaacucguaucuaugccagaccuguagugagggucacuguauuaaaucaccuucaggcaauaugugugagauguguagaaaaugugaaugauucuguggugagaauuucauccuccaguucucauuacauacaaaucaccagggauggcgccacacauccuuaauuucaguacuggggaaacaggcagguagaucuaucugaguucaauaucagccugguccuaucucaaaaacgauguagggaagcuggagagaugacccagcaauuaagaguacuggcuguucuuacaaaggauccaaguuugguuccucaaacccacauaaugguuuacagcuauccauaauuccauuucaauggaauucaaugccuucugacuucugcaaguacugacuacacaugugguacauacaggcaaaacacuuauacacacaauuuauuuuaauccuugggaacauaaacgcaaauauguucaaaucugaaaaaucaaucuaagccagaauaccagugaccuacauguucuagauaaggaauaauuaaccauauuaaauaccucugacccauguauuucagauaaggaauuacuaauuuaauuuacuuuagcacaagagaauacucucuccaaucuuaaaacuuuuggggggauuuuuaaauauuuaaaauuuuaauccacgggugauuauuuuaguagcugugagcaugcguugcucuuggagaggaccaggguucccagcgccuacaugguggcucaugacuaucuguaacucuggugccagaggauccaucuuugcaccuacugcacacauaugaugcccagacauuaaugcacauaaacacugauaaaauaaaaauaaauaaaaauccagcuaaauugguauuuagauugguuuugggauuauuuuccaaaugucuaaccuauugaguugauguguuaguuuccuacuaguuugaagugugucuauuuugguguuagaaaaugacauugcuugauaaauggcuguguccagauauggcuguguucccccagauuacagaaucacuggaaauacugugcuguguuacugcuguggucugcguagcuuccgagagcugaccuaccaguaucgucagaacauuccugcuucugaguugccagguaaggagcccgcgaaccauuucugucuguauuggugucaccacucaguucuaacaggcacuugggauggcaugaugcuccacacuuagcagaagucagacacacagcaugguugagcucgaacuugcuucucagaguuggucaagacaaauaaagacauuauagauaccacuggagcagcaucauuuccuucacuugguuuucagauagauuuguuuuucuugucugacaaucuuggcaugggcuaugaaaacugaucauaagaagagauaagauggaaguuagcaugagagcuuaguaaagggcuugcuguacugguaugaagaccugaguucaguccucauguuuuauuuguaaaaaaaggguuaugugggucuuacagaggucccagguucaguuccaagaaccuacguggcaacuuaucugacaccuuuucaaacacauacacaguauacguauguauaugcaggcaaagcauuaguacacauaaaauaaguaaaccuauuuuaaaaacaaagaaggcuggcuggugguaacacacaccuuuaaucccaguacuugggagguauaggcaggugggucucugaguucaaggcuagcaugaacuauagggcagaaacugcagcaacugccagaagccagguguagcaucucguguuuguaauucuagaacuagggacaaaaccaagcagaucccuagguuugccuagguggcaagucccaggcgagugaaagaccuugucucaaaaaaaucaagggagaugacgcccaacauugaccucuacacauacauuucuacccacacauuugcaccuguaugaacauacaugaacacacacacacagauuccuuuagcuacaugaaaggaauaugaugccaucugauguagacaugcauuucucuuuuccagugacuguaacaucccguccugacugcuacuggggccguaacugucgcacucaggugaaggcucaccaugcaaugugagugaggcuggggaaugugugggucaacugcaagucuuucaggcuuagggcuugugaagacaagaguaauauaaguuauaugcuuaaaagaugcacugauuugggaacuuuagguauacuucaguaguagaaaugcaaaguucuggcuucaguucucagaauccuacuccaucccccaaauacacauacguaugcuaauuuaauccuuauacuucuauaaaaucaugcaguauguaaaauaguguuuucaaguagaaauugugcuucuguuacgguguuucuuaaaccgcuucucugcaaguguccuccucugucuuucaucugugucuuuguggaugagucacauuaugccucgacugacagccuccagagcccacaggcagauucuagugccagcucucucugggccagcagcugugggcuaagcacaugucucccaauuacuggcccaauuugugugauagaguaauaccuggguuuuucuucaucuugugugaguggagguuguguuguaacuuaaccacaccugucuuagguuuuuacugcugugaagagaugcuauguccaaggcagcauuuaauuggggcuggcuuacagguucagagguucaguccauuaucaugaaggcaguaacaaggcagcauccaagcagacauggugcaggaggaacugagaguucuacaucuucaucugaaggcacucagguggcagagguggaucucugugaauucagaccagccuggucuacagagugaauuccaggacagccagggcugcacagagaaacucuguccugaaaacacaaaaauacaagcaagcaaacaaacaaaagagugcaugcugcucuugcagaggaucugaguucaguucccagcacccacacugggcauuaguaaccaccuauuccucucuugucagaggauuagacauugguagccuccucaagaacccacaugcaggugugcauaccuccaaacagacauauaccuaccacuaaaaauaauaaaaauaaauuuagaaaaagggugggggaacauuugaucaccuguucuccuuuguucauugcuguauggaugugaguagcaaagacagaugccacuuucugcaucaucuccaauguugcuccuggucuguggagaggggagaguggccuccguuaccucaggaccugucuccaccuugcuggcuaaagugcaggcaaaggaacacacuaagggggcacagcucuuguucuaugauaaauuaucauaguguuuuuauuuuuauuuuaaaauuuaaaaagagaaaaagaagaaauacuuaguggagcuggagagauggcacagugguuaaaagcacuugcaguucuuccagacaacuuaguuuggcucccagcacccaugucaaauagcacacaaccaucuguaauuuuagcuccgggggauuugauucccucuucuggccacccuggucaccucugcacacauggcauauacucauacagguacauauaaauacacauaaauuuaaauuuuuaaagaacacaaucuuuuuuuaagcauaaacauuauugagugagcucacaugauucacacauucucauggggcaauuacagugugcaguuucacaguuugaauagucuuugauguuuucucucucugcaggaaauucaaucacaucugugagcaaacaagguucaagaacugaauauuggaagagacacgugaaacaguuacagagcacaggaggcaauguuuuuuaaaaggccccauacaaacacuugaagggcauuuuuacaguuuucccuacgcagcacuggggguucuggucaggcacugggguguggauuuucccuuuguggagcgucaucgucagugacacacacaccacgugccccaguaaccugggaggccuccuggccacaccagccuucuagucgguguaagaggaucaguagacugaguucucccucccucccacuggaccgcucucccuccugugugcugaggcagugacagugcagguuuguacuuuuguaucuuuucuaccuuguaccuugacuaugguuaaaaugggaagcucauaggaaaaguugucagcugugucagacgcauucuccggaaggaaaggaagcauacguuuacagccuccagggguacauaggauagucuccugucuggaaagacacagccuuuuguauauuuuuuauuuuaauaaguuuggugcuuaucuucuaauaagauuuaaauauuaaaaacuguagcacaaauacuauaauuuauaauuuacaaauugacuaaaauuaggaauagccucauauuuggaagaaugagcauauguuucuguuuauuuaaaaaaaauuaucaacuguccgaaacugcuaauccugggaaggaagucuugaguguccagguccucgacccagggcuggcugagcccuuagcccuccagucccugagagcaacucccugcugaaacuccagauggcuccagacugacagggccuuugcuuuccaagcccucaucugguacauuagguuugccaugucaucuggaauaauacuugaaauuuuguuuuuagguuuuuuaaaacuuuuuuaucuuuuauugaaaucaccuguuauauuuguuugaaaacugguaacuuuuugcuucucaggaaaaaaauuuucaacuguugucuugcucuugauacagacugagaggcaguacucuguguuugugggagaugguucuuuuuuugauucuaauaaaugagcuguguuuguuucucuu

SEQ ID NO: 12347 - RNA, 34118 nt, Mus musculus
ugcaguguuugcggcuccugguggucucacgcggugagucauaagugggaaacuuuaaguguuugaggagucgaauaccguucucaugcuucuugugcaaaugggcccucugcagcuuccgcuuugucugcuuucuugugcgagcgagggggcgcugugcauagucaauucuuccuuuuuaucugcccuuggggcgcgcgggggggaagcgggggggaaguucacuuuccuuguuccuugugagcugaaacaggucugggcacauaggaaggcacaacgccgggcuguucguugccagagcgaaguaguuuucauaacgaacauuauaaauguucaugccagccccuagauggcuuuccccaaauaccuacugagaacccgaucuucgcugcuaggcucugcaggaacugaagaggguacgucugcauacucagcauacgugagggguaggauggcaaggaauggauaggagacaaccaagccauucucagcuucuguacaugaaggaagaugguguaaugcuuuguaaguggccucuggaauucuauucauaauccugggauuuugcuauggucacuuuuuuuucuccccacucaugaaugggccugucuuucauuuugagguggucauaaugugcccguuccuuuaaauuucuuuauguauuuuuuuuaaucacgugucuaagucugugcagugcgcacgggggccaauagagggcauuguaucaccaagagcuggaauuacagguguuugugaucuuuuggaugugggugcugggaacuguacucuugacuccuuaacugucuucauuuuguauguuugacaauacugggagugggauccaguacuuugcuucuguuggagaagugaugaaccaucuaccauugaguuauagcagccacaugacuaauuuuggguagagauuuacuuuacuuuuaauuauguuaucugugugggaaagugcaagugugagcucuggugauugcagaggccaagauccacuacagagccacugacuuuggaguuauaggaaaccucgagcugccagauuuggugcugagaacguagggaaacuuggguucugcaagaauaguaugugcacuuuccugccgaguccucuccugcucccuccccuucuccacucucgaauccagagccuuguuccuuauuguuggacucuuguuuucgaggucggauaugaagagucaucaucagucccacagcagcaccuccucgaaggcucaugacagugcuuccuguucacagucccaggguggcuucagccagccccaaggcacuccuucucaguugcacgagcucucacaguaucaggguucguccagcuccucuaccggcacagugccguccuccagccaguccucgcacuccaguucugggacucugagcucgcuggagacagugucuacccaggaacucuguucuauuccugaggaccaagaaccugaagaaccugguccugccccuugggcucggcuaugggcucuucaggauggauucuccaaucuagguaaggcacuuuguuauaugauauaguguguguucagagaaacaguuaaagaaggugguuaggaaaaaaaaaaagaaggugguuagguuguugcagcagaagucucagggccccugugguagaguuuaucuccuccugguggcccuguucauacugaagaucagauuuaggccuuacacauaguagagagcucuuacauugaacuacauccaagguccuaucccuggcuaccuuauuuuuauuuuuaaauagaaucuugcuaaauuucauaggcuagccucaaauuuuucuuuuuucuucagaaaaaagauucuauuguagccugaguuagccuugaacucacuauguagcucagccuggcugugaacuuuugaucuuccugccucuacuuccuaagugcuggguuuauaggcacacauuuuuaucaggcucuacuaguuuguuugugagacaaggaauucugcagcccaggugggcuuggaacucacaguguaguuccuuggggccuugaacuugcauugaucuugucucaguugggauuacacauaucgaccauaugugguucaaauuuauucauuugaauguggagaccuagcucauucugagacaguuuugaaagauacuuguauuagucaggguucucuagaggaacagaacugauagaaugaguauguauguauguauauauagggacuaauuagaguggcuuacaugcuaugguccagcuaauucaacaauggcuacccaggggagguguaagaauccaguaagaauccaggcaggaugucuuaguuggucuuuaguauacauuacuaucuuguagaaguaugcucuaggggguuggagagauggcucagugguuaagagcacugacugcucuuccaaagguccugaguucaaaucccagcaaccaugguggcuugcaaccaucuguaaugagaucugacacccucuuuugggguaucugaagacaacuaccauguauuuacauauaauaaauuaaaaaaaaaguaugcucacuagugcucagugaaggaaugaacuugccaguaagagcgagaucaaacuggcaaagcuuccuuuuuucaugcccauuauauaggcugccagcagaaggugugguccagcuuaaagguggaucuucccaccucaagagaucuggauuagcccagaugugguaguaaaaggaagcagaggcaaagugagcucugaguuugaggguagccugggaguuccaggauugcuagggcuacacagagggacucugucucagaaaaacaaaacaaaacaaaacaaaaaaacccccaaacuaggggacaggaucuauuaaauugguuacaugauauggccugaaucauccauucguaguucucuucaugauggagagaguuaagacuuaggagcuacucaguccacaagacuagaugucucagccaggagugccaguuuggcacugacagccuggaggauuccuagagagcgagcugaucuucacuuuguauuggaaagaagcagcgaagggcaguagcagaaaucauggcauagaagcacuugccagcaagaagcgaaggcaagcaagcaacacuuuuucccuuggaccucccugucuuggcuuguaggaggugacacacacucuguuguaaagucucuucccuucaguucauacuucacagguccacccagagggcugucucuuaguuguuuucagauucagucugguugacagucaagguuaaccaucaguuauuuuuccauguccccaggcuggcucaccauguucucaucucaucuccugaaugcaaagguuauagaugagguaguguacccuguuguauauaguuucuacuacccugcuuuaagcgccggguggaccuugcuaccagucaccauccuggauccacagaugaaagucagacagauccccugaccccccacauguacacacaaacacacaccagcuuauuuuuaauaugcuuuuuagcucaauggcuucuuuuuuuuaauuagauauuuucuuuauuuacauuucaaauguuauccccuuuccuaguuucccuuccaaaaacccccauccucuccccccuucgacuguuccccagcccucccacacccacuuccuggccuaggcauucuccuauacuggggcauagaaccuucacaagacuaagggccucucuucccaucgaugaccagcuaggccauccucagcuacauauguagcuagagccuugagucucucuguguguuuucuuuuuuuuuuuuuuuuuuuuuuuuuugguuuuuagaaauccgccugccucugccucccaagugcugggauucaaggugugcgccaccacgccuagcccguguauuuucuuugauuggugguuuagucccagggagcucuggagguacugguuaguuuauauuguugucccuccuagagggcugcaaaccccuucagcuccuuggguccuuucucuagcuccuucauuggggacccuuugcuccaucuaauggaugacugugaguauccucuucuguauuugccaggcacuggcagagccucucaggagacagcuauaucagucuccugucagcaagcucuuguugcuuauuuuauuuuaguuuuguuuuguauuaugauacuuaucuaccugcuguguugauaaggcugucugcgagccccugaaccuccugccucuaccccuuuaauaguacagcugacuguuuauuuagagcacagagccuuaguuuuuagccuggcacaguuuagaacucacuaaguagacuguucuagccuugaacucagagcgguucugucuugggcuccugaaugcuggguuauagguguggacugcuuuuuaaucacgucugaaucuccauuuauaggaguuguugguuuguaucuuucuuguguugucuuugucuuuguuacuaagguuuaacugccaucagaaugaauugaaaagguuccuuuuuuucuucuuugccuuuucuccucuuuccuucuuucuuugauuucuguucuuaaagccaguucucuugucuucauuucuuuuuguuuucuugaguguuucauggagccuauccugaccucaaacuguguauguagccaaggaugaccuugaacuucuaguccuucugcuaguaccuucaugcugagguuacuggcgugcaccaccaugccuggcuguggaucacaccacauacccccaccuccgcccuuuuuuuuuuuuuuuuuuuggagaccgucuaucuguacaaccgugguuguccuggaacucacuguacacaccaggcuggccuugaauucacagagauccacaugccucugccucccagugcugggauuaaagguuuaugccaccacuaaccugccuggagcuacacuguugaguaagauagucacagcgguccucguggacuucauguucugaggggggaagucaggaagaagguuuacagagaaguguaauaaggguucaucuuuguagaguaacugagugggaugaccuuaaugugauaaccaaugugguagugagauguaagugaaagauggaagcccaaauuuaucuuuggcuaauacuugacccuaaacacaaagggagagaggagaugagccauucaugucguuugaaguauugucugaccuuguuccuggggagaagugaacagagguguccucucaucccagguagggagcugugaugguuuguauaugcuuagccuagggaguggcacuaauagaagauguggccuuguuggaauaggugugucacugugugcaugggcuuugagacccuccuccuagcuuccuggaggccagucuccuccuaguagcuuucaggugaagauauaaaacucucagcucugcugggcgugguggugcacgucuuuaaucccaacacuugggaggcagaggcaggcggauuucugaguucgaguccagccuggucuacaaagugaauuccaggauagccagggcuacagagaaacccuguccccaaaaaacaaaaaacucucagcucuuccugcaccaugccugccuggauguugccaugcucccaccuugaugguaauggacugaaccucugaacuuguaggccagcuccaauuaaauguuguccuuaggagaguugccugggucacggugucugcucacagcagugagacccuaagacaggaguugaugacagagcagauacauagcacugaaguccaccuuggugaacugaugagcucuguugggguuacuaaaaggaguaggaaugacucaaagacaguagcaucaccaaagcccaccccggcaugagugacagcucacaaagcugggaccuggagcacacugcauagucuguaggcagcucaccaggugcucuauccccauggcucaguuggucagagccucauccaagcaacuccuagacagcugaucuaggcuggucucugcuucuugcggauggcguggcuggucugagugucuucuuugccucuuguccuguugucugaauuacuugcagcagucuucacugcuuauguacuuacuccuggggagggaggacuuaguggucaaaagcuaucuuuaguucuuuaguuuuugucuuaaggacccugccugcaggauggagucauugcaucuccccuuuagaacaacuuauuauuucacacaaccucccccccaaauauccuuccuucaccccccuuuucucuucguaucuuaaagugcuuuccuccaagacagaagguuuuaagcuuugaggaaacugcugcuacacaauagaaauaugcugugccucacuuguuugggcugugaaguugaaaccaguggagcuggggguaguuaacaagggggagaggcauuguggaggcaagugccuagaccugaguaccuggucggacaugaggaagauuguagauuuuauaccgaguguaauaggaaaccucaggaagguaauacgcagcuaacuaaauauuuuucaaaaucaaacgauuugagaaguguuuugagaaguucuuugguuuuuuuucuguguagcccugacugucuuggaauucacuucacucuguagaccaggcuggcugcccgauucugcuuccugagcgcugggauuaaaggggugugccacugcagccugguuuauucaagaagucuuaacggcugcuuaucauuucaugguuauguauaaaccaucaauuauuuaacccauaauuguacccagccugguguaguggcacaugccugcaaucuuggcacuugggaggcugaggcgggaauaucuggaauuuguggccagcaaguucgaguccagcuggguuacacgagacucucucaaagaacaaguaaauagagcuggaauguagcucaguugguagaaagcauuugccuagugugcacaaaguucuggguuuuauuccuagcaccccuauaaauugggaauggucggcacaugauugcaaacucagcaucaggaaacuugaggcagaaggauuagaaguuuaccaucacacagggcccccaauggaggagcuagagaaagcacccaagagcugaaggggucugcaacccuauagguagaacaacaauaugaacuaaccaguaccccuagagcucgugucucuagcugcauauguagcagaagauggccuagccgaccaucguugggaagagaggccccuuggucuugcgaacgccaaggccaagaaguaggagugaguggguaggggagugggcggguaggggagaaggggggccguauaggggacuuuugggauggcauuugaaauguaaaugaagaaaauagcuaauuaaaauaauuugaaaaaagaaguuucccgccauuuuuggcuacauagagaauuagaagccagccuggaggguuugagcuccugccugccucaaauaccagggucaaauaaucaccuaccaaaacaaccuaaaacaaaacaaagguaagccauuguugugucuuuguuucccuccccuccuccccgccuugagccccaaggccuugaauuugcuaaacuugcagugugcacuguuuguuuuuguuucucuuuuuguuuuuuuuuuucgagacaggguuucucuguguagcccuggcuguccuggaacucacucuguagaccaggcuggccuggaacucagaaauccaccugccucugccucccaaguauugggauuaaaggugugugccacugcugcccggcgucccucagucuuuaauacaaaacuuugauauugaaucuauacuuuugauugucuuuuucuuuuaaaagucacauuucuuucuuucuuucuuuuuuuaauuaacuugagucucuaccuuuuauuuuuuaagauuuauuuauuuauuauuauauguagguacacuguagcugucuucagacaccccagaagagggcaucagaucucauuauggaugguugugagccaccaugugguugccgggauuugaacucgggacuucuggaagagcagucagugcucuuaacuguugagccaucucuccagccccuauuuauuucuuuaaagauuuauuuuauguauaugaguacacuguagcugucuucagacacaccagaagagggcaucagagcucauuacagaugccugugagucaccaugugguugcugggaauugaacucaggacuucuggaagagcagucagugcucuuaacugcugagccaucucuccagcccuugauugucuucuuacugcuguuuugacagugucuuucuuguaggcaagucucuuaagcuuguccugcuggacucacaugugcaccacuccacagacuugguuccuucuucuaguuaacacuuugauacauucuuuucuguguguuuuuguaucaacagacuguguuaacgacaacuacugguuugggagagauaaaagcugugaauauugcuucgauggaccacuguugagaaggacggacaaguaccggacuuacagcaagaagcauuuucguauuuucaggguagguaacgguugcuucucuccucggagacccggugaucuagucguugcucuggggcgucuuuugcuauuaauucuuggugucaaaauuuggacauaaaauauucucuguuuuaggaaaugggcccuaaaaauuguuacaucguauacauagaggaucacaguggaaauggaaccuucguaaauaccgagcuuauugggaaaggcaaacgcuguccucugaguaacaacucugaaaucgcacuuucacuauguagaaauaaagguaauguuauuacgguuaaugagcuuuucuuaacuuccucuguaaagggaaauuuuugugucucugucaguuaugcuuuaauaaugcuuuucagucaaauuaaguaagucaguguucaguagcauccaagaguuacaccauugccugaguugugggguuuuuguuuguuuuuauuuuuguuuuuagacgaggucuuacuauauggcuguccuagcauucccuauguagaccaggguggcuuugaacccugccugccucugucuucugagugcugagaacuuacuuugagugugugugugguuuauguauuugugcauuuguguagguguggaggccagcaggggauguaaggugucuuacucucaucuccaccuuaauuauuuacauuuauugugugugugugugugugagagagagagagauugauuuaugugagcauguguaggcuuacauguuacaguaugcauguaagcuuacauguuacacuaugcauguguaggcuuacauguuacauguuacacuaugcauguguaggcuuacauguuccaguaugcauauaggggucagagaacaacuguugugaguucauuuucucccuccacuguggguucugaggaccaaagucgagucauuaggcguacauagcaagugauuuuugccuaccgaacuaucugguuggccccuggauuaaaaauaauucacuuuguauuacaugacaaauguaauucuguaccuuauuauauuauguguguaguuaaacuugagaaccagucuuuuaaucgugauuuaacaagcccauuucuguccuuuccccuuaguuuuuguauuuuuugaucugacuguagaugaucagucaguuuauccuaaggaauuaagagacgaauacaucaugucaaaaacucuuggaagguaaaguuuauuuucuuuauauaauaaacuaaaacucauuuuuuucuguguauucucauggguuaguuuuuuauaacugauuuuauaacauuauuauuauauagcugucaaacuuuugugauacauguacuacugauuuauuugauaaugaucaguuuaaauaaacguuuuucccuuauaaauuuuaguguugggauaagcgcugccaccaggcuugguuucucugauaacuauucauguguguguguguguguguguguguguguguguguguguguguguguaugaugugugugugcgcaugcggugugcaugcauguguggucucuaugcuugccugugugaggaugcuugugugcagagucccgaggucaguaucggugccuucuucaguggcucugcacuuugucuuuuguagcucacugaaccuggagcuuucugacucagcuucccuuucuagauugcgagcccuagaaugucccaguguucaccacagcagcacugggauuagagacaagcuuuuaaggccggugcuguguauccaaacucaggcucuuguguggcagacuucuuuuucuuuuuaaagauuuauuuauuuuuauuuauauucauacacuguagcugucuucaggcacacuccagaagaguacauuggauucccuuacacgagagccaccaugugguugcugagaauuuaacucaggaccuuuggaagagcaguccugcucuuaacugcugagccaucucucuagcccguagcagacgucuuauaggccgagcuaucuucccagcucuauuuuauuuuaauaaacuuaguaauuuucaacauaggguuuuauuuuguugcccugacuggccuagaacucacagagauucuccugcuucugccucccaagugccuggcugcuuuguucucauguagcuuacacuggacucagccucacugugcaauugagggcgauccugaacuccugauugauacucuugccucuacuuccccagacgggauuccaagccugccucacccugccuaacuagugaugacuuuuuuauuuccucgcgccuuagugaugacuuuugaaaagcagcuuuuaaugacccuaugaaucaccaugugucuguaugugugugggcgcacucgagccucagugaguauguggaggccagaggacaacgugcagggucaggccucuccuauguggauugaauucagucgucaugcuugaugguagaagcuguugcgugcugaguaagcauaagugcuugccuugcuuucuuugucuagugccgagucaugcuuaguguuugucuuugucaggauuucuauuccugcacaaacaucaugaccaagaagcaguuggggaggaaaggguuuauucaacuuacaauuccacauugcuguuuaucaccaaaggaaaucaggacuggaacucaagcaggucaggaagcaggagcugaugcagaggccauggagggaugugugugagauuguaugugcugugugugugauguguauaccguggugugcacuuggaggucagagcaaaggcuucaaaagucuucuccuucucccacauugcagaaauugacuucagcucaucagcaguguuuauguccuaacuugcuuucuguugcugugauaagcaucacaguccaaaccagccuggagaggaaaggguuuauccggcuugcacauccuuaucucaaucuuucccuagugaaucuuucccuaggaacuccagcagggcaggaaccuagauacaggaacugaagcugcuuucuagucugcuccacaauggcuugcucaggcugcuucugucuauaacccaggaccaccugcaucaaucacuaaucaagagaaugccccacaagcuucuguaaaagucaaccugauggagacgcuguuuuuucuauugugguucugucuuccagaugauucuagcuugagucaaguugacaaaaacaaaacaaaacaaaaaacaaacaaacaaacaaaaaaccgaaccaguacaauugauuccucaucagugacauaaaaauauaucauuaucauaacuuuuccuuccuuguuuguccccaagaugucauguucauacuguugucauggacuggggguggugcagcaugccuuuaaucccaguacucaggaggcagaggcaaguggcucuuuguggauucuaggccagccuggacuacacagugaguuccaggacaccuaggacuauguguagagauccugucucaaaagaaaaaccaaaccaaccaaacaaaaccccaaaauaacauaacaacaaaaaccaaaaauuaguaucacaaugugaaacaguccauuuuuuuucaagucccacagucuuuuaaaaagagaauuugaaacuggagagugacuuagcaaguaagaacacugguugcucuuuuagaggacccaaguuugauaaccaguaucugcaugauggcucauaacugccuauaacucuaucagguuaucugguaccuucuucuagucucugggauacuacacacauuguugcacagacauaggcagggaaaagcagccauacacauaaaaugaaauaagaaaaaaaaaaaucucagcaauuuaaaaguucaaguucucaaaaaaaaaaauccaagugucucaacuguggguuccuauuuuuaaagaaaaguuuuauuacuuuaagaaagaaccaggguuacaaucagaucauagcaaaaacaaauuuccacaguguccaaguguucagugcccaaggucugguaccacuccugaucuuuuggacugagaagcugagagcagcuccccaccaguaccacccccgcccuccauagcacacacagcucgucuuggagucgcaggcuggcucccuuucaccccugaugcuguccacugugcucaucccacagucuggacaucggcauuauggagucuccaccugcagcuaagucugcaucuuuuuuagugacauccuggcuucuucucuucagggauacggcaacccugccacacggugccaagcgugaccccuucgugcuuucaaaacucauaucuugugggagacucuugauaauuuauaaaguuccagcuugaaaugcagcauuggacucucucuggcccacggcuuuugugugcuggcccagaagaucucauguugaugauguuggacucuuauuaauuagagcagauuuuuaaggcccagccaacuagcauugauuaucucagugcacaaaagguuucauuucagacucuuuuuguuuacccugcuuauuuguuuuuguuuuuugagacauggcuucucuguuuaucccuuguuguccuauaacucacucuguagagcaggauggcuuugaacucacagagaucugccugccucagucucccaaguccuggaauuaaaggccuuaaucacuuuaccuaaccucucuuucacagauuuuuuuuuuaagauuuauuuauuuauuaugcauaaagcauucugucugcauguaugccugcaggccagaagagggcaccagaucccauuacagaugguugugagccaccgugugguugcugggaauugaacucaggaaguuuggaagaacugucagugcucuuaaccucugagccaucucucuaggccuuacagaaucuuaauugaaaacaucacacaaugacucugauagagucuuaaagggacucugcaauuuccuucugaaacuccacaggccaggccuguuguuugcauuccucucagcauuguuuacagaacaacucaccaaucucugaguacccaguagcuuuuccagcccaaagcuccaaaguccuaaaaucuuccccuaaaacaacauggcugcauccaucgaggcagccacuggaggacuacuuccuguugcugugauaaacaccgaccaaaagcaacuuggagagugaaguguauauuuggcuuauauguuaugaucgcuaccccugagggaagccgauucaggagcucaagccgaguaaccauggaggaacgccgcuuacugucucaguucccauggcucgcacagacugggcugggccgucccaaauucaucaagaaagugccccacagacuuaucuaccagacgcuauaauggaggcaauuuuuuaaaagugagauuccccucuggcagaugaucuucgcuuuugagccaaguugaccaaaaccuacccagaauaugggacaaucauuucuacaugcugggauauaucuugucagccccugcccuucugagguaggcaugcaauuuaguguaaaauauuuaguucaaucccuaacagaaaaaagagagcugggcaagguggaggcauacuuggaauucaacaacuugaaaaauguagcaguaagaucagggguuuaauauuauccuuggcauaauaguuguuuaaggacagccugagcuuccuaaggcuuuugucucaaaagcgaggggugaggggauaguuagggagagguuguaaugggauguuccagcuccuagagaaguuaagugcaaacaaacacaucaagauccagucucagauaaguaauaaagacauacugguaguugcuauaccauggaugagcuuugaaagcauuaagcuaagcgaaagaagugugauuucauggauaugaaacaucagauaauuuuuaagaaagccauuuagugaucgcuaggggcaaagguauagugguguuucccuaauuggaaccagaugguagcaguugcagagcguuggauauauacugacuauggcucaauccuacacuugaaaaucauuaucauggcucauuuaauguuacauauacgcaacacaauaagagagaugugaagccuuuucuauacucacucaaaacuggucauuaucauagcucacuacagacagguuguaugcugcaguggucguugcuaggcuggaccuuaauuuugcugaacaggcuuacuguggcuaagaauggugugcauaacauccucugccaucggugguccccagugagucagaaaucuuugaaagaaaugcuccuacaggaugaguaauuguguagcgcuuucugacgugguauaaggugaaauucaugcuuccaacuauguaugcaaauuguuuguuggucauuguuuugguuuuuaucuuuuguuuguuuguuuuuguuucucuguguagcccuggcuguccuggaacucacucuguagaccaggcuggccuugaacucagccuccugucucugccucuggaggcugggauuaaaggcuugugccaccaccuccuggcuguguuuuacuucuuuuaauucaggccuggauggccuuggcuuugguuugaugcucuccuucugucucagccuucucagcucuugaaugacgguuaugugcuacucccggcauggguacucauuuuucgaucaggaagauucuucuauugauauuucucugccccccccuagagaaaguaaauuuucuuuuuuucuuaguguuuuucugggaauuucacaaucaagggcucugauuagacugaagucacuccaagcucagugcugcuggaugcucuucaucuccgugugcucuuggcaguguacucuggugagguuucaguuugagcauagagacaaugaaaaaaaaaauguuacauggacaauauuuaauuuccugucugugugugugugugugugugugugugugagagagagagagagagagagagagagagagagagagagagagagagagugcauaacauaacuucauggccacagaauuuguguggaggucagaggacagccuuggguguuggucuugccuuucugccuugagacugggucucugucuguuucugcugugcauguguggcaggcuguccuacaagcuucuggaagagguuuuuuuuuuugcuugguuuacgugggugcuggguguuugaagucagauucugcauuugcaugacgaguaccugaacagccuccucagcuccuucuuuucuuccuaucaaggccgaguuugacaugguauguuucaugaugaaagucaucgggaaaagucacugucuguguguuuccccuuaguggugcguguggggagguaaagauggcuuuugagaggaagacaugucagaaaguggccauaaagaucauuagcaagcggagguuugcucuuggcucaucgagagaagccguaaguaccugugucgggagcugcccggcucucacacuuccuuaaggaacccuggagcacgucucagccuccggaagcuuggguggcuuagauggagcaauuuuugacugucaaacagcacugaacacuuuuuaagugucuuuuauuuaaucuagaaacuuauuuguaauuuaguucuagaaauaauugguuguauguaacccugugcauaguaacaggcuuuuucuuauuuuaaagucgcuaugaagggauaggggagaaagggggucuaauggccagugcagccucacagcugccuucagccucucucaucuugguggagacccugugguguuuagagacaggugaauucagcucguauggacagcucaccuuuccauuaacaaugugcccaccucgcagaaacugcuucuagucgcccaucggcuuuaucuaagcaccgggugaaguaaugcuugggacauuguagcagaaaugaaacuuuuugagaguuaaggggucuagugagaaggaaaaaauaaucucaggaaagcuagguuuaauccugaccuaagugcuaugcucaauauuucuuuugaaagcguuuguuacaacguguaaagugcucaguaucuacaguguagcauuuucacucauucuacaaauuauggcggauacuuuuuacuucaaagcauuuuuuuuuuucuuuuugagauuaugacucacauagcucagacuauccuggaaggcguccccugggaugcuaggauugcaggcaugcgcuaccacuccugacggagauggccccauuuuuuuacucucaguuugauggcacaguuccccugacugcaaaucugaauuugaaaauaguaaauaaggagaaauaguagucucuuucucuacgccccgcagaccccauuugcucuauaaggucuuggguguucuccagacagucaguugcauuugagggacuuugccugauaugauccgguucugaggugaccacuacaaauguucuggauaauaucagacagacuuaaacugauucucaaagacaucacugggaaggaaugccccaaacuuccucauaauuuaugcagauaauucuuugcuugguuguugagguaacuucaaauucuuugcucuuuuggguguuguggcgguggcuaggaguuaguuaguuauagaaacacauuuuuauaaaacucuggaauuaaggaauaccagaccaguacucuuccauggagaugacauuuuuaauucucaguugcagguuuuuagaauguaaaguguuuuuaugcagcaacuauuuagucacuuuuucuguaauccacacugaccgaaugagugaaguggccaacuguauuuuuuuccccacauauaacccgacaaaguaaaguaaaagcagcgcccaggcacgucuuccucuccagccagcuguuucuggcuuuaacauucuucaaauuguuuuucccaagauaauucuauucuuacauggcaggaggaauuuccggucuguguucaauuuguuacagaucuuugaccucacaauucuggauuugcuucccauuuaggggagaaaaggauaucuccuagguuguugaaaacuuagaaccaauuuuuuuaaauguguuuuuauuuuuuacuguuuuuuuuuuaagauuuauuauuauauguaacuacauuauagcuaucuucagacacaccagaggaaggugucagaucucauuacagaugguugugagccaccaugugguugcugagauuugaacucaggaccuucagaagagcagucaguguucaaaaccacugagccauuucuccagccccagaaccaauauuuuuuuucuuaauuguucucuuccagucauuggacccuguaugaccucucuauuaacagaaccuccucaccccugccccugcaauguaguaaugagugugagaguggaaagaaaaggucuggacuuaaacauuuuuaaucugggguugagggauagagagaugcuucagugguuaagaacacuuguugguccucgagaugauccauguucaauucuuaggcugccaugguggcuuacagcaguguguagcccuaauuuccugguacuggacauccucacacaggcacacaugcaggugaaucaccaaucaauguacauaaaauaaagugaaaaaaaaauuuauaaaagauuuuagggcuggagagauggcucagcaguuaagagcagugacugcucuuccagagguccugaguuuaauucccagcaaccacaugguggcucacagccaucugucaugggaauccaaugcccucuucugcugugucugaggauaacgacaguguacacacaauaaauaaauaaauaaaucuuaaaaaauaaaaauaaaaaauaaaagauuuaaaaucuggguuucuuagcugaagucuauuuuacauaaauauguagucuagcgucugcugucugagcagagccugguuuguaacucagccauucuaaaugaaguuuaacuguauuuuuauuauuacuguuguacucuaaugcuauccuuguuuauuuaaggacacagcucccaguguggaaacugaaauagaaauuuugaagaaacuaaaucauguaaguaucauugucacucgucguaacuugucucaaaauauaggaaguauacgaaguguugcuauaggaggcuaauuugggcuccuuuguauguuugugagaagacacguggaccuggcucuuauucaccucugacgaguuuuacuucaaaguuuuaagaauucaauccuguguaaaaggcuucaugacuucaugaucuauuacucgguauuuuuauugagaucuugagaaaaaccuuauaaagguuaguuauauuugcaaaagaaaugaaagucuugugaaguuaguuauauuugaaaucuggguccuuuuaaauaccuuuucuuuggaguaagugguaucugacagauaagaagcccauuguugcaucugauucguaggcguggggagccuuguuggagauaagugguccucaccuacuuuguaaggaagacucgauaucuguggcagucacagggcuguagcacaagggucugacaccggcuucucuuuccugguucucucagucucuucauuaguuuaugagaacccauaaugcacgcuuaguaggugcuggaguuacuucuugccagaguaacuaagaauccucuucucuuuuagccuccaguuagaagauuuucuuuucucucuuccaccuccucacuuuccucuaagagcuagaaaguuuauuuauucuagauuucuguguuugauacaaugucuccacagccuguuuacagcucgguggacccucucgcuaacucuccgcacuccagcggccauccuuccugcuugccuguucccgaccucacacguagcagcuucuucucuucccccuccuuuccuucccucucucuuugcuuccguuucccuucugccuuuucacccccuccucaaucccccuucuuccuuuucuuucuuuuuuguuguuaggagacagccccugucuuguuacccuggcaagucugggaauacuggacucacgugacccuucugucuccgccucuugaguggaguuuguuuuucuucuuuucgacaggaacuggcugaauuggccaggcuaggccccgauuccuggcucaagcaaucuuccugcugcagcccgcuauggccaguuuuuuuuuguuuuuuguucuuuacaaaaaccacauuacuguuggcagaaugacucggagggugaaggagcuugcugagaagccuggccaucugaguuugauugcuaagacucacauggaagaaggagagauccaguucccacaaguucuuugaccuccacacauacuccauggcaugcacagauacaggcaggcaggcagguagacagacagacagacauaauuagacaaagaacaccgcauacauugcacuuacguaccaucccccuaaauguuuuauuggucauuucgagccuuauuaagguggaagucucucaccagcacucggcaguguuuccaaguccaugccgggaagcugugggugcucgcugaugcaggaagauggauguacaaagcgaaaguuacagggacccaugaagaacacggcaauggagucucaccucuuacaaucucaaaccugaaagaauuauagguucuuucuuugagucuccugugaucaguccuccaugcuggcuucuguauuccugcuagauucucugaggucuguuucuuaccugccacugagcuuggcugucagcuuuaaacacaaguaugcuaaguagaaaaucguaaugcuaagucuagagaaucuaacccuguuuuaaccuacccacagcacugggugcccugcacagauaguaaacauaucauccaugcuucaaagucuuauacugugagaggaucuuaucauacagguuccauucuccauggcccuagugcuggagccgcaggaaucagguaucuggaaguauaauuaggcuuccuuccucgccuucuuuguuauugagacagggucucuuguugcccaggcuagccuugaacuugcuuuauagcugaggcuggccuugaauucuugcuuuuccuuccuugccuucccaagugcuggaauuacaaaacagcuuuuugggucucucaucuuguguccuguugagaaaaagggcuuugcuccuaugcugggauugaacuucagauugcaggucugcugagaaaauaucccaccugccacccgccacccgccacccgagcacccagcuccugcugcuuuuccucuugucagguuccuguuuugacaaaugaggaggaagucugggaaaaccugcugucaugccuaggcggggcuccuaugcagacacgaauuauuccuuacugacucuguaugaugguguguuucuugugugaguucucugugaggagucagccaccuuccauucugccagucuccugugcuugacucaacagcauccccagacaauagguuuccugucuggaguuuucucacuucuccuuucuucucucccauagccaugcaucaucaagauuaaagauguuuuugaugcggaagauuauuacauuguucuggaacuguaaguaguaacguuuaaacucauguuuccguguaagacuuauaaaccaguaaagaauugaaugcagauuagccaggaggugguggcuuacuuuaaucccagcgcucaggaggcagaggcaggcgaaugucugugaguuuguggucagccuggucuacagacugagucccaggacugucucaagaaaacaaagacaaauauuuuaaauuuaacuuuguuauuguuguuuagcgcagagggauuaaguaguuuacccaaagaccuauagcuuaugaagaauucaacugggguucaggccccaguugucugguccugcuugggagucauauuuccaccccaucagcauguaggaaccaugugggaauguagaucuaugggccucucuccagauucuggaagcaguuuuuuuuuuaaaagauuuauuugccggguggcagugguggugcacgccuuuaaucccaacacuugggaggcagaggcaggcagauuucugaguucgaggccagccuggucuacaaagugaguuucaggacagccagagcuacauagagaaacccugucuuggaaaaaaaauuuuauuuauuuacuuuauguauaugagcaugcuguccuugacacaccagaagagggcaucagauccaauuccagaugguugugagccaccaugugguugcuaggaauugaacucaggaccucuggaagagggauuagugcucuuaaccgccgggccaucucuccagcccuggaaucagauuuuuauuuuuuuauuuuuuuuuaucuuugcguuuucaagacagaguuuuucuguuuagcccucacaguccuagaacucucucuguagaccaggcuggccuggaacucagagaccugcuuccaggugcugggaucaaaggugugcgccaccacuauccugcuagaguuagauuuuuaaaaguucccaaagaagucuccguugcuuaccauauauuccaucucucacucuuuuccuacuggggcauuugauuauggaugaggcguaugagagaucauuacuuuguuacgagauuuauguuugauuauuuuuagcuaugugucugugugagugugcacaugccuguagaggucaggcgugggcuuuggucuccugagauggaguuacagguacucgugaguuggaccugggugcugaagucuggucuuccgugagaggaaugagagaaaucaggaugcaguccuccgaggugggguugaggaguggguuucuguugugcauuucagggagagcagaggcagaggcagcuagaagauuccagaguagggacaggaaguagcagaugaaacauggccaagggacugaaccuggccaugagagaagagagcagagagggagaugggagaggggaggaagacggggagaggagagggggcuaagagagcucauagcugaaauggcagaguuagaugggaaugagagguggggggaggagggagcucaugagcuggagaaguuuaggguagggguggggugaaaagagcugugaggagccaagguccuuugagagugaguagagugagccugaggccagccggugcucuggcaugcugauagccucuccuugugaguuuuucuuuggacuaccuauuucuccagcccucaagaaaaugacuuaugggcuggagagauggcucagcaguugagagcacugacugcucuucccgggauccugaguucaauuuccagcaaccacaugguggcucacaaccaucuguaaugggaucugacgcccucuucuggugugucugaagauggcuguaacuguacacauauacauaaauaaauaaaucuuuuuaaaauagcaaaaaagaugacuuauguauucauuaugaauuuauuuauuuuaguuuuuuggagacaaggcuucucuuuguagccugacugagcugguacucauguguagacuaggcuggaccaccuuaacauagagaucagccugccucugccucccaagugcugagaugaaagaccugccucaucaucgccuggcauauuuauuuauuuugagaagaccucugguaccucuggcuggccuggggguuuucagcucugccugagugcugguguuaaaggugugcuccacucuacccagcuaaacucauuaauuuuaaaagugauaucaagacugagaaaaacaggagccauguuuuaguguuggaggugcaggccggggcuucugacgugagacaagugcucaucugcucaccccccccauccuuauuuuucuggacaagaugaguuuauuucauuggugcugugcaucagggucacgugaagguccgcucuguucguguuucaggauggaaggaggagaacuauuugaccgggugguggggaacaagcgccugaaagaagccaccuguaagcucuacuucuaccagaugcuuguagcuguacagguaagagaagcccuccuguggccagcaagggccaagagacugagguucuggguguuugcugcucuguucuaggccaaaaaaaagacaaaauuccuucuugucuggggucuuucuggaggggcauugauuuugcaccuaccugauccuuguggcaaugacuuaguuugcagaauguaaaggugagcgagaaagcaaggcugaccaguuggggugguugagggguguuaacguuuguucuuucacaguucaguaauguguuccacaagaacggggaggacucaauacuuucccgcgauccuagauuccugucacaaucccuccccaccuuucuuuucuuuucacaguccuggggaugaaacccauagcccaaaauauguagauguguacacacacacacacacacacacagagcacucauacacccugccaacaccacauacacucuugcacacaugcucacacucacauacacucacagcacucacacacauccacagacucagaacacacucucacacacagauacacacaccacgaaacaccacaaacauuauauucauacacacucauaacacaaccacacacacacuacauucacaauacacuaucacacacauauacacucucacaccacacucauauguucacacacacaccacacacuucucucucucuuucucucuuucucucuuucucucucucucucucucucucucucucucucucucucucucucaaacauucacacacucauaccacauugccuguaucccuggugauuacccauagcucuuuguaagcugcuuuuuuuugagcuuugguuuuccugauuucaccucccaagugcuuagaggacaggcagacaggcaugcaccaccucgcuuggcuucauaguucacuuaaaaaaaaaaaaaaaaaagauuuuacuuauuuacuuuauuuauaugagcacacuguagcugucuucagcuacaccagaagagggcaucuaucuuauuauagaugguugugagccaccacguaguugcugcgaauugaauucagaagcucuggaagggcagccagugcccuuaaccucaggcccaucucuccagccaucacagcucacuuuuaaugauggcugucaggugcacaggauuuugauuacuuaucaauguuuaauuuccuuguauacugaccaacaacuaugaauugcacacaaaucuauagauauaggacauuuuuuauuccuaaagaauugauauuuugucuguuuucauuuuucauucuauuuccaacaagagaauuuuaaaguacuaaagcuagucuuuguaccucaaggauagauuaguaguuuaguuucugguuauuuuugguguuuauagcauuggggguugaaaauaguucaugcuaggcaaguccuauagcuucagcuuucagaguuucucugcuuugugugugacugugugugagaguguaugugagagugaguguguguaugaaagagugugagugugugugugaaagugagaguguguguguguguaugagaguguaugagaguguguguauaugugaguguugugagaguguguguguguaugugugagagagugugugugugugaguguguaagaguauaugagaguguauaugugagaguugugagagugugugugugugagagagagagagaaugugugugugugugugugugugugugagagagagagagagagcuuguuauaggacaaccuggagaagucuguucucuuccauggugggcucuuugugacuggagguuuucagguuuggugucaaguaccuuuaaaauacucuuagggauugaauaacaaaauguguaauuuugauggaauuccuaagauauguuaucauucauuuaaauguuuauugaaacagacaccaugccugucugugaggggauuuuuguuuucugucuuuguaaaacacaagcuuuaccauucuaagacgcucuuuucauuuuuaugcauuuuaaagcuuuuuguaacauaaauuucuaagugcucaggccugguccagcucugacuuuuaggaugcugcugcaccauauagcuuaauauuacccaggcuaagaguuagcuguugguaacugugucuccuuacauguguacauauaaaccaacaguugccuguuuuuguacaguaccuucacgaaaaugggaucauacaucgggacuuaaagccggagaauguucuuuuaucaucucaggaagaggauugucuaaucaaggugacaaugcuuaaccucucuguggccacuuuuaauuucuuauauuaaaaacaaauaagaguauuaaaagguugagaaucucacuucccaaucuuaccaguuauuguugagacggcccaguguuccaccuaucuaaugggcaguuacugaacuccagagcauacaagccacuucuguguucggagggagggaagagggucucaauggaccauugagucauggaguccgccuuuccuccugagccuagcuucauuuuagaaucuccuguuacagucccaagacaaaaaacaacaagaugaccccaaaacguaaaacuuuaggcugacaacaggugcuuucuuucuccccgagcucuccagaugucccauagugucgugagacuuaagcguuuugggugcaucaauauuaguguccuaauguguuuguggcaggggucauaaaguuuuugucagauuauaaugaucauagguaaauuauuucucagguuccagggauuuuccuuuaagcaaaauuuaauacauuacaaagacgugaaauuguguauuuaggguuaaugucaggugucuguaugacagauaauccaguuuuugugucucuugggaugaugggcuaugauaauguuuggauuucauuuguuuuguuuaugauuuuuagaucacugacuuugggcaguccaagaucuugggggagaccuccuugaugagaaccuuaugugguacgcccacuuaucuggcuccugagguucuugucuccaacgggacugcuggguacagccgcgcuguggacugcuggaguuuaggaguuauucuuuucaucugguaggagacauuuucauggcuucacagucugguuggaugaggugggacaaaaaugucccugugucuggguagagggcuucuguuugacucaggucauuucuuuuugaagguugacuuaagaaaagcugauuuuuuuuuuuuuuuuuuugccgggcggugguggcucacgccuuuaaucccagcacuugggaggcagaggcaggcggauuucugaguucgaggccagccuggucuacaaagugaguuccaggacagccagggcuauacagagaaacccugucucaaaaaacccaaaaauaaauaaauaaauaaauaaauaaauaaauaaauaaagaaagaaagaaagaaagaaagaaagaaagaaagaaagaaaaaaagaaaaaaagaaaaaaagaaaaaaagaaagaaagaaaaaagcugauuuuucucacugccgagaagaagccuguguauccaaugccacugagaaugccgcuugacuuuuucccuuucuuucucuaccaacauuaagccuaaguggguauccaccuuucucugagcauaagacccaagugucccugaaggaucagaucaccaguggaaaguacaacuuuauuccugaagucuggacagaugucucagaggaggguauggauacggaagggucacagaggugugguugacugccauguggguguccuguuggugggaguuucuccucagacugcuguuuuucucccaucugaucacuccgcugcuuugcaccauuugacaggaagaggacaugauuaauaagagccuggguuucagagccugaguguuagguucuaggucugcuacuugucuguuuugugcccuugagcgaguugcucaguguuuuugagucucucuuuuuuuuauuuguaaauaagugguuaauagcccagacaugaaagguuuugugugagguuuuguauaacagagucaagggucugcucccuguucaagugugcagaagcuucucaggaccaacauucuucgaguagauagaauguuagagcucagugucaaagguuaucucugaguuauaaguuaaaagugcaaccuugcaccucccaggagaaaagugucuagucauauaaccuaggugauugcauuaaauaucagggguuuaaggaagaauaucgcugcgucauggggcauacaagccagccuuuggcuguugcuugcuugugagguaggacuuuauuuuaacuuacuuauaaagagccccucucuggucucucaccaucaagcaaugggacucaagcguuucuggcccaucgugagagucucugaacuggguagaaguucaguuuagauuugccugaacucgagcacgacaaggaacaggaaggguuaugaugucugagcagagagagauggguacauccucauucuucaggucccgcucuccuguguucagagagggaggggcuuagagggcuuucuccauccaaucagcuugucccaugcugcucucuucucuggcuggcggucuguaguucuggcauaguuuaauaaugcagguggcauguauuuauucuauuuauuaugauuuccccaauucucuugcugcuguagcucuggaccuugucaagaaacuguuaguuguagacccaaaggcucggcuuaccacagaggaggccuuaaaucauccguggcuucagguggguacgaggcaguuccuuuucgccuaaaauucagggaaagucccacacugcuuaggugaggugaggcugagggucucugugucuuuggguucauuauguaaguguuuucaaucaggguguagguaaaguguaugugcaauuguuuuuaaucaguacacacucgcguguggcagagggagagaggggagggagagauggggggcgggaaaugggagaagagaggguaaaugaauauguguguguguugggugucagcucuuuccaugcaacuguuggcguacuucaugcuggguucugguuccauuugcccugagauugcaguguggcugaaauuccucugagagcuuugucuuccucaacugccagcugucucccuuuucuaccccuccucugccugguggaucagacugugcuaugguccagacauuuuuuuuuuuuuuuuuacuuuuaaucaaaaaacuggggcagguccaggaaggcagugucccugagggaacccagccacuuccugagccauguuuuaaaggaugccagucuuguucccggugaacaagcaugucaccugcacccuuugagugugcaugacaucucuguucacaugucccuguugcuuugagaguuuugugccaggcucacucaaagccugcugccaguguaagagcgucuguaacucugggagauuaaucguuggcuuggaauuaaucagcgagagcauccugcagcuucucuuguagaugucugauuguauucuucaucuuggcuacacuuuccugugaacauccuuaggccucuguuuccuguggggcugggugacaucacuagguggcuggagcuucccccccccaacuccccaucccccaucugugguucucaguucugggaacaccuugaaaaaucccugcuguccuuaugggacucuggaagauuguccccuuucugucuugcaaccauccacaccuaaguuuuggucugacuaguuuagguagagaacgagaaauccuuaaaagaaggagggcagcuggaccugagggggaugucuccucaccagguccagcacaagaucugauggcccaaguuucauccccagacuccacaaacuccugaaaguuauccucugauucuacacacacacacauaagauaagugaaaaaugcaauaaaauauuuuuuaaaaggcggagggugaggagugguggggggaaagggacagaucuauguguuuggguuguugcccuggaaacacgauucuccucgcagaagaaaucugucaggugacuuaauguuuacucgaccacacagaucugaaagcagcaagggccuuagagacaaggagccuggaaacaaaggugucuuugcggguggggguuuaacucugaugaaaagagaagcccucccuuuggcucuuuucacaugccuuaauagggcagcuucuggaauccaaacggaggcagacacacugcguuggcuuucuguguuagcuuuggaaaaaaaaaagcacgggcuggccaguuaggccuagcaacaggguuuguguuugccuaagaugcaugagucagugcagcccauuuugcuugaacuucuuuuuuuuuuuuuuuuuuuuuuccaagacaggguuucucuguguagcccuggcuguccuggaacucacucuguagaccaggcuggccucgaacucaaauccgccugccucugccucccaagugcugggauuaaaugagugcgccaccaccgcccggcuugcuugaacuucuugucucggaaaaaaaaaaaaaaaaaauucuguuauucacaaguaauuaaagcugaagcucagcucuccuucgcuuuugauaaaauagaagaauccuuccugcuugcuuuugagggacguuguaacuuaauaguuuugggugugaugucuccuagguuuacagaaaccuugcugcuugcucucauguugagaugcuuuucucauguuccuguugaccuguugcuucugaaagcgugcagauggaugcuugugaaugcgaugcagauggauacucgugaauacgaugcagauaggugcucgugaauaugaugcagagauagaugccacaggccaugaauggcccuaccagauaguguccagaagaaggacguuugugcuuauuagcuuucuguuagcuguuacacaccuagagaaaucaacuuagaaagagaaaaggguuguuuuguuuacuuuuaugggggaggucaguccaggauugaugugagaaaacagaggaagaggcuccggggagucagcucaauggauaaaguauuugucucacaaauaugaggagcugagagauugggggcgcagacuccccugcagcucacaagccaguuagcuugacuguacacgguggugagcaacaagagacucaaacgagauggaagucgaggaccaauacccaagguugaucucugaccucuacaugcaugcuacagcaugcuggggagaccugagaggauuuguuuuauuuuuaauuguguguguguuguguguguguucuugugugcaugcguacauauaucagugcgcacccacuuuguuuuauucacacauucaucucuucagagcaccguucagguuugaaacgcugcuaggcccaugauauacagagcagagcaauacacaugaguguaguauaugagcuuggugccauccagacaggcguucugugagccacucaagaguaaccaguaagacaaggaaguaggugcuggcucccacaaaaucucucguguuggaagccuuuuaucuuugaugccaugagagagguagaaaaauagagagagaaagugcauggggugcuaaguugacaaaguguaaaugggaacgguuucagacacacaaaaacucaccucccucugccuccuggcuacuaugauugaggugugugcagucuuuuuuuuuuaaagauuucuuuuucuggccauaguugugcuuuccuuaaacccagcauucaggaagagacagagacaggcaggucucugugauucaaggacugccugguuugcauagugguucaucccaggcuagccugggcuacagagugagaccauguguaugugugaguucaaugccugaacaguccagaagaggacuuagauccccugcuccugagggauuacaaacgcuuguaaggugcuugaugugggugcuauaaaccagaugcagguccucugcaagagcgguucccacucuugccucugagcaucucucucuagucucuaccuagauguuuuaugcuucugagaacuuggaacagugccaggcugccucccagagcuucugcgugcuugugcuugaacccugugggacuuuaccaugagggaagcgggagcuaguuacguguguuggagaagauuucuccuuguuuauggcuccccugcuccaccucuccuuccuauagcacagaauaccuacaguauuugguccuguuuauugccaucccuuccaugagauguggguccgagguuuuuuuuaggcucuggcucaucugucaacuugcuucucacuugcuggauuagcuguucagaugaccugcaaaauuagcucuguuugugucagggagggaggggucugguucugugaggacuagggguggcacagugucaaccuuguguucuggccuccugacuaguguuccccacagcaugcugcugguucugcaccauagcuggggucugguucucugguugguuaagagcccaggacccuugaguuugauguagcgagugcugauugagcacagacuguuccaagaaggcagaggcgaacagccaagucccuucauuaggaaacuucugcaaagguaugagguuugcugucaggaagguagccuugggcauuucccugucacucugggagcuugcuuugccuuauaugcagccuaucucuauauaccuuuugauuucuucacaggaugaguacaugaagaagaaauuucaggaucuccuggugcaggaaaagaacucggugacccucccuguggcucccgcccagguauucugaugacuucacuguggucuaggauuaaguugccgaugagcaagucugaugacugaacuuuccguggggaggcaggugcucagcuuuuaagaaaaggauuaauggcaggcuuagugacacauacauauacucuuagaaggcugagauagggcauugacucucaacagaggcaggaggaaugggacccacaggccagcuugcuugcauaauaucauguaguaauaucgucucuacuugcuggccguacuugggauugaaccugcggccuaaugcugcuuagguaagcccuccagcccgagccaguguuucugcguuuuguuuugauaugcuccugcagcccuggaagacuuaauaacgcaggauauguugaaugaauuggaacauuagauagggcuugccaaucuaacggaagacggaagauccuguuagaggcacgaauuuaaguuuucagaaaguguaagacuuggguaaguagucuaugaugguuucuguuuuaaacuuucuguuguuagaaaguaaaaguuuugcuuuaccaugguuuuauugaggcaauuucuuguuugguuugguuugguuugguuugguuugcuuuuuuuuuuuuccgagacaggguuucucuguguagcccuggcuguccuggaacucacucuguagaccaggcuggccucgaucccagaaauccgccugccucugccucccaagugcugggagaggaaguuucuugauugcaguuuuaucauuuucaaguucuuuguaaguuauaccugaucagugguauauuuggucagugaucucgauccuuuuuccuuacuguucuuucuugaauuuaugaauaggaaaagucuaaguagcuauaaguagacagugucaggagacagcaaccaagcaaagcuguuggugcugccugcuguccacauucggauauacuucagccuacggugggaucauauucugaggaacucaucucaaauggaggcauuuuaaauagaaagugcauuuaacgauaauagcugguguggcacaguagcgugugugagcucccugguaacccugugggagccgggagcucuggcugcuuuacaaucauaccucacccagaauuuugcuaggaaagauccaauuugaacuugcuuuugugucacuugaaagguuuuuuuuuuuuuuuuaaguggcuguacauuuauuagugguuagaaaucgccagggagcauggauaagcaucuugauuccagaggugugugaggaggauucgguugucaugacaacuagucauuuccaugaaaugccccuaguuuacugaacuaugaggagcuuugauagaagcugugcuuucucuuaaacacuucuccuuuugcuuuauuuccagacuuccagucaaaagcggccccuggaacuggagguggaggguaugccgagcacaaaacgccugucuguguguggggcuguguugugagcuuugaaugugaaagaaaugugcuuccuuccacgcuccaauugucuucuccaucuugacaucuuuuuuuuauauguauauauuuuuuaaaaaauauagccaggcaguuguggcccacuccuuuaaucccagcacuugggaggcagaggcaggcagauuucugaguucaaggccagccuggucuacagagugaguuccaggauagccaggacuacacagagaaacccugucuuggaaaaaaaaacaaacaagaaacaaaacaaaauagccuauaugauggaacaauugcuuuuccaucacagauacacgauuaaaaaacguggaaaucugggcugauuguuugaugaccugcacuuuagauuucuuucuuucuuucuuucauuuuaagaaaaauguuagggggugguguugagagauuaacaccacuccuguugagggcugcaguucaguucccagcacccauguaacuacauuucuggaucggaugcccucaccuggccucucuggucaccuacuacacauguguucauguacacagaaacacauaaucauuaaaaagaauauucu

SEQ ID NO: 12348 - RNA, 14550 nt, Mus musculus
gcgggaggaaguuuguccaucgccgugcuccguugucccgcgggcugcccggcaaccggcgaggaaacggcuggcgucugugcagugggcgccuggggacccucggagcgagcgggcgcgugaucgagcuaaggccggcgacccuucuccgcgaacuucggacacggagugcaugagucagagguuaggcugggccgaggggcggggacguggcauccuuguagccgcgggaccuguaaaaaguuguaugccuagcgcuuggcacauacccgucaucuucacaucauugucgcagguuauuucugcuugcuuuuugagacagggggcuuucugguuugcucagguuggcuuugaacuccuggacucaagugaucucuucacgccucggcuuccaaaguacgcgggaccgcuggggcaugccccugggaccugcuugucacuguaguuuuuaugcagaauguaaaaaaccucuauuuccuaucccaggcaugucaggacauuuucuaugucugcaaucucccugauaauggcuggccacuacuggacacagugcacguuuauuuaaauugauaauuugcagccuugguggcaaaucuuuuaaaacuuucuggcaugggccuccuucacaaaauuugaucauucgguuguccuagggugggaacgugggccuuaaagcugugagaaaggugcagccaaggggcgagugacaucaauagagagaggaggcauccgagugggaguggggcuuuaaaacugugagaaaggugcagccaaggggcgagugacaucaauagagagaggaggcauccgagugggaggggggcggucccuggcuuuacaacuggcuuacuuucugcccacugcuguuuccuucagauggcucuccccacguugcccucuuauugguccagccggaaacacauggaucuucgccagcgccagcaucagcaggaggaccaguuucgccagcagugggaacagaacagucgcuauuucaggaccugggacauccacaacucgaaacagaucgaauggagcuccaagaucuccuaccagcggaggcaagugucuguguguuguccugcccacugguuccuaccacgguucggggaauguagccuaggggcuuagggacuguggcuugaauuaucuccugaugaugcuggaaacugugcugugcuggggagaaguacuguacauuuuguuuuuuguuuuuuguuuuuguuuuuguuuguuuuuuugauuuuucgagacaggguuucucuguguagcccuggcuguccuggaacucacucuguagaccaggcuggccucgaacucagaaauccaccuggcucugccucccaagugcugggauuaaaggcguacgccaccaugcccggcaguacuguacauuuuaaaagauaaaccagaaggcagcgcuagugucuucucgguagguguuuagcccccccccccaagaauuacauagaaauguacaucaaacugugaccuggugugacugauguccagggaacuccuuaaccuagcaugcacgccuaccauugugagaagaugaaggaggagaagaggaagauucuggagcuccggcgggagaggcucagagagcuucuccuggaggaacaggacuugcuggcugcggagcuggaugagcucaggcugagcaugggccugcgggagcaaaggcuccgcgagcagcaccaggaccugaagucagcccgagaagaacagaggaagcugguaacuacccuaguccggaagcagguugcagggcgguagcauccccgccggaacggacgagugcgccuacgggguuguucucgggugccuguuccgacgagauggucaggugacuagagcccauggggaaaaccgccuccaaccccccacccccaccccccagagaggaaaggcuuauuuuuagcucgugguuucugagggucuccagcgauuguaaugaggaaggcauggagccugugaccaauggagcucaaguugcgcuggcucaggaaacaggauguuaggaagaggguucagagacccaccacaguggacuguugccgccagcuaguaccucauccccuuaaacgcccccugccuccccugaacagugcuggaagcuagggagcaguuguuuucaauguugcuuuugcuguuuugaaacggucucacuguguaguccugguuugccuggaacuuuguuuauagacuagccuggccucagagucccagagaucugccugccucugccucccacgugcugggauuaaagguggaucaccggccuggaccagagcaagccuuugaaaugugagccguguugaguugagauucagcacguaacaaugaucugaaccucauuugguaaccuguuagugccagcugggguguauaaccacguuuuguuggcccuuugaggauguaguccagguuggccagcaguggcugucccacagcagacagaccagaaaucccgcaguuguugagcccaugaggcucagauaucucugcgcuuccugccuggugcuggagucugggaggguuucugcagaacaucuggcuuucagucuguguuaggacccugaagaaguuggaggucauuguaaccucacgcuuucccaccuggccucuuuguucccugaaauaacaauucugagauuuuuuuuaucuaugaauaaacgccuacgccaauagcuuuggcuuguucccacgagcuuauaacucagucauccuguuuaaacuagccuaagccgugccacgcuguuaguuaccucugcucagguucaugugucugucucugccggcguuggggugaaucuccugcaucugacuauuucccagaauccucuuucuccccccccccuccccaugccucaccuucuaauccugccucagcucauuggccagaggcuuuuuugagaccugaugcuuccacacaguacacugcagaagagucucucugcagguaacacuggccacggucauaggagagaugagcuugccagcacgaguaaggggaagcagacaggaagccagcauccacucuuauguaccuuuauagggaguguuugguaugcggcuuauaagucacugugugggauucaccuucacuuuuuucaguucucuggucccaccaauaccugggaacgcuauauuuuauguuuuggguggcuaugguaacuaguugcagucuguguguuuuagcuuaguauguauuuggaaacuucugccccuagaagggacccagccauagcaucagaucuuagcugacucuugguccacugagacaggcauuuguccaugcccuuccgauuggcucugaugccccaucuccagagcuggugugcaaaggcagcaggauuuaacggcagacgggggugucaucacugaagagagaagcugacuucuguuguaucuugucuaaguguggaugaaugugaauagugaccucacgucuccuguguuuucuugauagauugcugaacgacuuuuauaugaacacuggaagaagaacaaccccaaacuucgagaggugagaacgaagccucccauugcuucgccugcguaggcaccaccgcgguuucagauuuuguuccuuguuucugggucuggauguguguugggcugauacagagggcagaagaccuggccagacagggcugagcagcgaacucugacaggcaaccugccuuuggggguauguucuguggcuuaggagcucucugcccagugggcugcagagaccugggcagugggcucaggaugcugcuuucaguuggauaauauggugugaggaaagggccuucuggauggagaugauuggaaaugcugcccugugccucgaggacagaaccgaggaagcuauaaagggccaggugagaccaagaugccccauggcuagggaguccugaagagauaaagcuggugaggagaugggagacagaccuggaccagcacugccuggccuuccuccagaggcucuggaccacuuuagcaaugugcaagaucacugcuguauguugggaugcuccucuuggcagcauggucagcgugagccaggcaggcuggugcuguguguuggguuccuaaggugaagccuggugcuccuggguggaggagacaggggccauaucugcauccugucuugguuggcaccugucacugcacagagguuggcuggagggcauuaugccaguuacugcuacugucuacucacuucagcaacguuaggacaagucugacauggucacuuuccguagcucguugugucuagaaauugccaguagugauuccaggugagauggcuccgcagguaaagguguuugcugccaagccugguggccugaauuucaucccagcaccaacacggcaaaggacagaaccaacucccacagguugucuucuggccuacacauauacaacacacacacacacacacacacacacacacaauguaaaagauauuuaaaaaaggaaacaagaaaguuagauggaguaguucacuuuuuucuuucuuguuguuguuucuuugacuguuuuuuaugaaacagggucucauuacguaguccuggcuguccuggaacucccuauguagacugggcuggcuuugaacucacagaaauccaccugccucugccucucugccucucugccuccucugccuccucugccuccucugucuccgccccugccccugccccugccccugccccugccccuaccccugccccugcccaucucagcacuggggaggcggaggcagcugggucucugaguucaggccggaaguuuuggcaagccaagcucagggcuggcucugcuuacccagcgucucccaggcucuccuuucaauuugcaguuuuguuugagaaaugcucgcugcccuccccugggcuccgagagagagcauuggcccuuugugaccagggguagacagggcuuagaagcacgugauccuuugguuuccuauuugcugaucauucagauuggauuuuguuguugauuuuuuuuuguuuuguuuuguuuuuuuuuuuguuuuuguuuuucgagucaggguuucucuguguagcccuggcuguccuggaacucacucucuggaccaggcuagccucgaacucagaaauccgccugccucuaccucccaagugacgggauuaaaggcgugugccaccaccgcccagcucguugauuuuuauugacgauugugugugugaggggugcagauguguuguagccccuguguggaagucagugaucaaccguugggcgucacuucuccucccgucccccagccucccuuagaggcagagucuguccuuuucugcugcuaaguugaacucugggcuagcugacccuuaaauuucugggcuuguagagaguccucuagucucugccucccaccucaccacagaggugcaaggagcccacacacacgccaucccguccugcucuuuacaugggcagugccagggauggaccucagguaugcagaccacggcuuuacacuugaccccucucgguggcccucaucaggcuguuuuuguugggguaucgagucauggucagguggcacugaccacagcaagucaccucaaucagucucacacaagcccucgggcaaaguaacauuuucuuucucacccucagcuugaguuggaccuucacaagaagcacgugauaaauucuugggcaacacagaaagaagaaaaaaaacagguauggaaugugugacccucacacacugucggcacuugugacucuguccugucuccaugcucuuggcuaaaugagcagcaggugccugccuggcugcuugcugcaugugcaggcugagguuugcuuugagcaugcucauaugcauguucuugugugugugcacacacauucacauguacgugugugcacguguguguggguucacauguguagguguguaugcgggugugugcaugugugggggugauguuucucaggagccagcugucguuuuuugagagagggucuuucagaagucuguagcuuucccaaguagacuuccaaggacccguagggacccccucacuuuccacuucccugggacuaaggcuacaaggguggacucuuuugccagcuuuuuuaaauuaaaaaaaaaguuuuuaaaauguauuuuucuguguaugggugcuuucccugcauggaugugugugugccucaagcaugccugguaccuuuggaggccagaagaggguguugaauccucuggagcugaaguuauggacggcuucgagcugccauguagguccugggaauugaaccuggguccucuggaagagcagccacagucagugcucuuaaccauggaagugucucucagccagccgcagguuuuuauuuuuuauuuuauuuaugugugugaguguguguguagcacauguguguagcgugugugugugugugugugugugugugagugugugugugcugcaugugcugguaucugagagguuaggugagagcaucagagcacuuggaggaggaauuggaaaguucgugagcuguccaaucuggauacaggggucuggacucagcucauccucuggaagagcagcgugagcccuuaacugccaagccaccuccggccccaacaucauaaaccuacaucacaaacacucgacccuggcuuaucuagugcagcaccucugugguccacaagacacaugugccauuucgagucuagguucauuguguuaucuuguaagccgggcaggaggaaggaaccuggcguugcugagccccagggcuucugugcugagcuugccugggcucugccacccacugaagggcugcauguugacccguuguccucuuauagcaagaagccacagagaagcaggagaacaagcgguuggagaaccaguacgcagcagcccgccgggaagccgaggcgaggaugagagucgaggaggagaggaggcagcuagaggggcgccugcaggccgaggcgcugcgccagcagauggaggagcugaagcagaaggagauggaggugagcgggagccgcuuuacacacugcucuaacguaccugggaaugggggcauuucaaaggccauucugaaaagaucacagcggggguggggguggggggggggucugugaacccgauccagccuguguucucucuucucgcaugugcaccccauucaugguucuacugagaugcuccacagugugccucggacuuuggaacauuauggucuaagacauaccuguccgcucagaugacacaccucgccagggccuuuucgggguuuucccagugggacauggucuagcacccaacacacagcauuccacuaguaacagcuuugggucucgguauguaagucaugagggaguuugauacacuguggucuccugagagagcugaguccucuguucagauggagggaggccucucuuuggucuccuguguuucccucucccuggccccguuguuuuaauaacugggaauguggugcccaagcaaggacuugcucaucucuggccucacccguggcugcugugcuggccaaggaaacugaagcuaaguuagcuaaguguggcccagcacuggaagucucucgggcugggccagccuugcaggaauggcuuaguugaggugggacucaagagucacaugagguggccaugacauucggggccagccugggcucacauaguaccugccagaccuggggaugugcagaagggcagucugaucgccccaucucacccggguuuacuguuguaaccacaggcaaccaaacugaagaaggaacaggagaaccugcugaggcagcgcugggagcuggaaaggcuggaggaggaaaggaggcagauggccgcccuccggcgcaagacagagcuggggugagucggggaugcccagggcucuccccagagggugggucucuugccuucucaggcguccuuggaaucuccugagaaccaaaggccacgguguggucuguagggugcugcugguagcugguaaucggcccuauggggacugaagcugccugauucuuccugucuuuaggcgcuucuugaaacaucaguacaacgcgcagcucaacaggcgcacccaggagauccaggaggagcuggugagugagcuggcaggcuuuuccccauccucugggaacagcaucaccagugugcaggcaggaccugaugugggcagagcagugcugguggacggugcagagaggaggggagcuugcagcacggucccuuucacaacacuacccaugugccugagcugcugggcgcugugcgaccaugguggacuguguugcuuuagguuuuuguuuguuugguuguuuugcuguuguuuuauuuauaugaguacacuaucacugucuuuggacacaccagaagagggcauccgaucccauuacagaugguugagaagccaccgugugguugcugggaauugaacucaggaccucuggaagagcaguuagcgcucuuaaccccugagccaucucuccagccccuguuuguguguguuuuugaggcagggucucacagugugcccuuggcuggguaggaucaugcuauguagaccagccuggucucaaacacacagaaauccaccugccuuugccucccaagugcugggauuaaaggugugcgccaccauaccuggcucguaggcauucauuuaaaaauaaguaaauggauagaguaauguuagggaacggagagacagcucagugguuaaggucacuugcugcucuuguagaagaccugggugugguucccaucugcagccaugccugcucccacgcaggugcagauucucuuggucuuguuuaccacacacccaacagcggcggauccuucugugcuuguuucucagggcccuuucaguugcuuugcacacgacgguuuuuauagggaagaguguauguugggugggcuuuguagcaguggcugcuugguguuccugucacgagcuguaguaggcugugggugagcacacccauauuuccugaccaucugccuccucuggucagacuuggguaugcugucacuguucugccccaccccagaaucucccccugcuuuuguuguguagacaugguaacaucucacccccugcccgugcgcauucgugcgcauucggugaugucuggguuucccuguuuacuggaaaguugcggcgagcaguuugugcaugugucuguuugaguucugcuguaacuuaaauggguucuugcuauguaguguuaagugugcugucguaaauguccaggggcauaugccugugguggcacagauggcaggagggggucacuccuuuuuuuggggggggguguuucgagacaggguuucucuauauagcccuggggcuguccuggaacucacuuuguagaccaggcuggccucgaacucagaaauccaccugccucugccuccugaguggggggucacuccuuuuacuggcaagcaucugugccugaagcagacgacgugguuaucagaagcagcacuccagccccuucccuucuguccugaggaugugugucaggcccuacauggcuggguagcagggacuaugugggaaagugggcucaccucgacgcugccccagggcucagagcagcccacccacaggcccugccccuucacccaggagguagaugggcggauccugcaggcccuccuggagaaggaaggcgaguugcagcagguggaacuggccaggcgggagcaagcccgggccgaugcggccuggaugaagcaggucaucgaggagcaacugcagcuggagaaagcacgggaggcagagcugcagcagcugcugaggugagcaacccugcuggacaggaggcuccgugaggugcccuuaggucccugggugggucacuuuuguucugcgacaucuguccucgugacuccauccccggggaauaugucuuuguuaguggcuuaggguagugaccuaauguuguucaagguggaaaucauuacgguucagaguagcugacguguucaugucaagucucaaacagcgugaggaggguguuugcagggugcagauguuuaaugcugcuuagcucuguaacaagauccuggggucuggauccuaacgcccugaagauggugcugccguggugccucagcuggucuccuccucagugucuccuuagcgcccaggaacugggacggcugggacugcuagccugugugcccagcuuuggguccuaaaagcccaacccauagauggaaauagccaaauagcagguacuagauacugauguccagacaccauuauuggguccugacauucagccaagccguaagugcguggcacauggagaccugaggggguugcuagcugucuagaggcuuuaagccacuagucaucuugggaauguggugaccgggcucgggugcaggccauagccuccuccugucucuggcuuccggucucaucagcacuaaaugaugaccuaaaauacuagagacgugucccuaaguaucauuguaggaaagcugguguggacacucuugccugaagcuugguggcugcgugugcccucccauccaucuugucccuuuuguguuuguccagggaggaggccaaggagaugugggagaagagagaggccgagugggcccgagagcaggucgcgcgggacagacugaugagugagguaauuccaaaaagcaugcugguguuuuuuucuccccacugugcauuugauugggagcauucucaccagcucgucaucagugacaacacucacagccauagugugcuccuccaccgucgagcaggcucccuagggucagccgcuagcaguggggcagcgucugugagggcugcagggaacauagcugccaaguccuugccaccugugcgcugaaagcugugccagccagaguggccuggaacgaucaugucugcguguggcaaucgguccacgguuggugguguucacucuuguauaacgcauccuguggcuuucuaccuuccucacuucaguguccucccugccuguucguggccacguuauuguccccuccuuacagaacacaugccagcaugucugaugguuucuuggauccagggcugggacuggaauauccgacugcucuggaucgaggucuaagccgcaaacaacagcaggcaucugccucuuggagcaguggaggggacgccuggcuccaucucccuaccuguguggcugaccccuggugggccaagucuuaaguguuucucugaagcuccuuccucccuguggagagggcuccgugacguuuugcuguccucccccgagcacugcucuguccuauggguuggugucguucaggguuccuuuuggcucacagcucucaggucacagucugucacugagggaagggaggaaggcugcucgcugacucacuugcuccucaugacuggcuuagggcuccacgcccaaggguaguaccagccaccgugggcugggcccuuuccugucaaucauuaaccaagaauauucccugcugaccugccuguaggccagccugguggaggcauucucucacugggauuccccuucccagaugacuuuaauguguggagaguuagaaaaacaaacuaaacugaccagggcaguuggcauggaugcgaaagagcaguggucugcacugggccugcggcucaggccugcucuccauguauuaggguggacuaggcuggguugguaaggaugcggcuguagcugggcugaggcuugggucaggagguuuagacugaaaugcaaaccuucucuucccccucggccagguucugaccgggaggcagcagcagauccuggagaagauugaacagaaccggcgggcacaggaggagacccucaaacacagggagaaacucaucaggagucucgaggaggggaagcaguuagcucagcgagccaaggaggagagugaagagcugaaguuggccaggaagcaggagcuggaagcccagguggggcccaagggcaagggcggccucgcaggacacuacagaacagagcucggccgagguccuugaguccaguccauugcuugcuuacauccaaaucucucucugcugcaggcuccauccugguuuccuagucuguggaaaccaggcuaaugucacuguccccuuuucuucuuucuauccuguucuccaaacacauggcugcauucagagcucucacaugguucacagcaccaucuguauggccguucccaguccucagguucuuguccugguuucuggcacuugccaucuguguccuugcuugaaggagggcugugcccucugggccuuguuucuggugacucuguucucgguguccagguugcagagcgccagggccaggaaugggaagcagcccggcaggaggaggaggaagaggaggaggccaggcaggcggaagagcacuccaaugcuuugcugcagcaggaggcgaagaccauggcagagaagggcuaucagcccaagguggguaccugccaggugucgagcccccauggugccauccucagcucuucuugucuccucccugugucugucugucccgacugguuauagccucuguucaaaggcugucauuccuugacuugacuucagauaguccaaggguucuucucugauccccuuggcuucagccuuugcaaagacccagaggcugacugcugguuggggggcagagugcaaucuagaagagcccuggccauaacuggugagaggugacagccggaucaggucccagcugccagugaagccaggugaccaagagaucuacaccugucucccccuuuuccucuguucuuugucucuuucugagcauccuuaugugugagcccugagcagggcaccauggagcauguaggagcaaaggcugucaugucuguugugagggaccugcugacuaggcucucuggaacuagggccgccuggccccuggcauucugaggggugugugcugcagagagcauucauuguuucccugucagagaacccggggccuggguggcguaaggcuagagugggucuuccauuugcuguagagccucaaagcccuauagacagagggcucuaagcacagggaacagcauuuccaaagucacccgagcaugcaucagugugucaggaugcgcuucacagagcacacgcaagugucucagggcaggucauaaagagccuuauuuauggcccagagucaaggcuuucucagcgguacaugaaaacccacuugugugcuccuaaagaaaagggagucgguucccaguguuccagacugcugaccugagggaauguuaugugcuuucucuccucagcuucacggacaccucagaauugcuugggacugacguugagcacagagaagcaaaccgacucacuaccgcuccagacaguuguacgguguuggugcuggccagugcucagggugcugcuagcuaguugagccauaccugucaggcacaucaugggccauagaugucaggaugccaugggugugcagcguccccugagagcccuucucaccccgacaggccuuggcuucagugccaccagagaucaggaaugcuuuauaaguacauguuagaguuagucuaagaagaagucauguucccugacagacaggaguaccaugacaggaauacguagguuccucucaucucaccuguagcugucagcucagggaggaccagccacagagaggagggagcuguuuagguuuucaaauugcuguucagaaguuauucuauugagggcucauaggucuuggugcaguuauugccaguuaugagcuguguagccccaaggcccauguguguacuguggaagagcuggcagucuggagagccggugacaaaggcgcccuuguuuggaaguguugugagggcuaccccuagggguuggggguucucagcguggaguacuuaaccuuccacuugugugguccucugcccagcuccacaccaccaagaagaaaagaauccuacagagcacuugagcccaacaugugccaccccgaaagaguccucaaggucacuugguuggcuagccgacaaaggcagaggcuugacuagggaccuccugugucuguggaagcccagugugcagccccaugggaauuaagugcccagagagacaugugacccuggagaaauggcaugagacucggaaucacagaugagcuuguccccacuguuagaucccaauacaaguggccauggguccucauggcgacagucggguuguuauggcuuguaucuuuccguagccuuccucgaguuggcuuucaccccuauauuccagauucugcccacucuagcugaauauacgguguuguuccugguuaugggaaccgagaguuugccugggcucugagggcuguaucacuucccuuccaucacggaaccgguucucagccuguuucauuuccugcugagguccuuggauguggcccccagcucuguuuccacuacacauuugugagcacucgcccucgucaaaugcucacuaacugaaguaaagcucuaucucaguauca

SEQ ID NO: 12349 - RNA, 4915 nt, Mus musculus
gucugaaugcaaugccuuuuuauuuguacuugacaaggaggaucaacacacucggcagcucaggugacuuuugccuaccccacugagaagcaaggggcuuaagagggucucucuccacagcagcacuguucuuuagacacuugauaccuacgcagccaccugaucuggacagucagggcucagcuaagaugggagucuugaguugucucaguugggggacagggcccuuaaagaccccacugugcccgguucuggacaguuuccuuguucaaccacucacagacaccaccagcuccagcucuccucuagaccugauccuggcggagugcuuccuuuuucagaguugcuuuuuuuauaucaacaacagaaugacuccaucagaacauuagaccccuccccagacggaaccuaaacucaaucaaacagaaccugggaugggacuauccagaaucgugacggcuggcagcaagagggaagacacccuaaaccucuauccuagcacagcuaagaacucccaaugagaggguagcaagggggcggggggaagagcaugcuuuacacaacuuaacaaggcugugggggccccugugcagcaccccuacuucccugacagcugcucguacagcuugggcacauagucaucccacucggcuugguagcacgugcccgccaccggggcucccagguuauacuucuugcggaaggucuccaccuugaacuugccgcgauugucuccagacuuguugcugagaaugggcucgucgcagcucagcggcuguuccugcucguacaccagccagacauagcgguggagaccugcaggggaggcaaguaccagccagccagucagucagggugggggugcaggugggggugggaauaggggugcgcuccgcuugggaccgcucuugccuaacauucacaaaucuucagccugguuuucccucacagcacagcauaaaucaguguaguggugcacaccuguaaccccacuucuuggaucaagaguucaggaucacucucaacuacccugaaaguucaaggacagccuaggcuaugugaaauaugucaaaaucguaugguucuuaauggcuuuuuaagaaguuaaauacgugccaggcauaguggcgcaugccuuuaaucccagcacuugggaggcagaggcagguggauuucugaguucgaggccugccuggucuacagaguuccaggacagucagggcuauacagagaaacucugucuugaaaaaccaaaauaaaaaccaaaaacaaacaaacaaaaaaagcuauuuacaaguaugaaaacauaaugagagagaaacggccaccauccaucagagugcuccacaaagaagugcagucccacacccgugucgcuaagcugccaggcugcacagacucacagcaaccuuacccgggcuaucagaguacaacacagccauuucagcggacuccagagcaauuccuagaccuagggcaucuaugcaagcacaaagaaguacaauggaaaccccugccuaggaauacagaaagcacacagugccucuauucauaacacccacauccuggcuacagcccaaggacccagcgagaggaaggcuggaccgugcaguccacagucacagggaauacuaauugaugaaagggaacgaacucguaacccaagccagcaucaagauaagucacacugugaacgcucaccagauaccacaccccgcccauccugcccauaggcacaugggauccaaagcgacccauggagacccauaucagaaaaugcugagcuccaagagggcaacagggaccaggccaccucuaagauauucaggguggcaagaagagccuccaucuuccugggguguccagauguguguaccucaaauccucugccugaaaccuucugagccaccaguuuaucaagcaagcuaaaucuuccaaacaccugagagcugcuaggguuuuauucuucaaaacagagcacagcuccgacuccagagaacugcucuacuccccagugccuccugccuguaauuaaaucaccugcuuuuguaggugcccuggagaaccuuaaagaguccccaggaaacuuaucuuucuauucucugaugaacacugagaggccuggaaagcaucuggaagccucugggccgacagacacaaggugagccgugagcaauggcccuuuuguccuuaguggacacuaguuaucccagucaguucucugcagggcaaugcacggaaguuggcauccugccaagcgucacccaccaccacgguggccuuguuccagugaaaggaaaacguguauaacaagcaaccggcaguaacugugucucccaccagcuuuggggugcuuaugagacuuugggagcacuguggggcuggacucucauguuccaugucaauacaaaacacagaaagacagaguaugugugaaugugacugugagugagugugagugugaauguguguguguguucaaugugucucacuacagucuuccaagucuuuucaaaguacccagacacauuuuggggagaaagggagaguuauaaagagauaugaaaggcaaucuuuggcacuaguaugaaaaguguuugcuucuuguucacaggaucagaaacuuccaugaucacccauagcagagauuacauagagauuagaggaggcucagagagcccacagagcccccagcagcccacugcaagccuccugcagcccuuccugcccucugugcccaggacacuugccagccuggcgacagagaccuugucuaguaugaggcccuggcuuugauauuucaaauccaccacaaaucauuuacagaccuagcucucuccgagucccagaagugguucuacagagggccuacccaaucagaaccaaaguucuggcacccacauccuacaggcugacugucccagaaaagacuugccugaggggaaaaacaagcaggauucugccguccuuacaguaaggcuuggaaagaacccagugguagccacccccgcccugccucauucucccccccaucccccccccccacacacacacacacagccuuuacuuaccugugccacugggaggcccggagcccacauaaucugagaggacagugccacugcuaaugucauuacccuucauguugaccaccaggaaguggugccacucccugcggagacagaacacgaggggcugugagcaccagacaccuaggacauucucaagcugggcaauaacaggcagaugauacacugggaagccacaagcaagcaugagggccucacaccaagagacccuguuccggggggaggggggcugagguuguggcucagggggucucagccugugcugcacgaggcccaggacuuucuccccaccacuacaaaaugacuguaaccccaggagguccacgcaucccuguccagcagggacuuccguguccggaugauagauagccucuccccaucuuuuccccaacuggccugaauuugggauccuuccugcugggagcaucggggucugugaggaccaggguguagaguuucccaggaucaaggccgucccaugaaaugcugcugggccuguucauaaccuguaggaaggaaccaguguggggguaaaaaucuagaaaugcucucaaaacucaacacucugccaccuuauauucccaaaagguaaaacaugaggguuauuauuuuuauuccuuucuuuuacuaccgagacaaaaaaaaaaauaguuuauagcaguuucacccaugcagauuagugguaauuccuaaguauggccgcuacuaaaagccugaagcuuggagcuggagagaaugcuggguuccaagaacucuugcaaaggguagacauuuccuggcacuccuguggggggggggugggggggugcaacuccagcuccaggggaccugaugccucuucugaccuccacagcucccugcucucucacacacacagccacacacucgcacauaauuaaaaacacaaaaccaaucuuaaagagccaggagucuaaaaaaaaauuuuaauuaaacaaaacaaaaccagauguggugcacgccuuuaaucccagcacuggagaggcagaagcaggcagaucucugugaguucaaggcccgccagggccacaacugagugagacccuacauguaacacacacaccaagccagccucgacaaacacuugcccacguuauuaacagaaaguggugagacaaggaaguccgacgguggcaacggguccuccuccacaaccucacugagggucccgagcuaccuaacgccuuuaaauaugguggccaacgguccgcuuggggccagcugaggaguaauccgcccucggaaaacgagagcggccaaggacacguacaaaguuugggacaagggagaccggccagggcuccgaauggaaaccuuccaagucaccaucucaaacccugcgcucuaaauauauaaagagaacgguuagacccaguuucucugagcuuggaaccgcucuugagcgucagcaucccacccccaccgccacccccaggagcaacacagguuaaugagaaagcgcuggccccggaaucauuaauaaagugcgggcugcucccugaggaggugauugcaagcucgggacauuagaagguuacagaagaggcuuucggcugucgggugacgcucccguccgguauacaaaggcugagcucgaggccugcuccgccccgcugucccccggucuccccggcggcgggcccacaccguaccugggugggcguuagcacuuugcccagcucguccaccgucaccccggcguagucgacccgcagggcgugcuggggcggcucguccaccuccugcaagcacaagggcccggcccacuggcugaugucggcggccauggcgauggagaguuggaaggc

SEQ ID NO: 12350 - RNA, 4915 nt, Mus musculus
gccuuccaacucuccaucgccauggccgccgacaucagccagugggccgggcccuugugcuugcaggagguggacgagccgccccagcacgcccugcgggucgacuacgccggggugacgguggacgagcugggcaaagugcuaacgcccacccagguacggugugggcccgccgccggggagaccgggggacagcggggcggagcaggccucgagcucagccuuuguauaccggacgggagcgucacccgacagccgaaagccucuucuguaaccuucuaaugucccgagcuugcaaucaccuccucagggagcagcccgcacuuuauuaaugauuccggggccagcgcuuucucauuaaccuguguugcuccuggggguggcggugggggugggaugcugacgcucaagagcgguuccaagcucagagaaacugggucuaaccguucucuuuauauauuuagagcgcaggguuugagauggugacuuggaagguuuccauucggagcccuggccggucucccuugucccaaacuuuguacguguccuuggccgcucucguuuuccgagggcggauuacuccucagcuggccccaagcggaccguuggccaccauauuuaaaggcguuagguagcucgggacccucagugagguuguggaggaggacccguugccaccgucggacuuccuugucucaccacuuucuguuaauaacgugggcaaguguuugucgaggcuggcuugguguguguguuacauguagggucucacucaguuguggcccuggcgggccuugaacucacagagaucugccugcuucugccucuccagugcugggauuaaaggcgugcaccacaucugguuuuguuuuguuuaauuaaaauuuuuuuuuagacuccuggcucuuuaagauugguuuuguguuuuuaauuaugugcgaguguguggcugugugugugagagagcagggagcuguggaggucagaagaggcaucagguccccuggagcuggaguugcacccccccaccccccccccacaggagugccaggaaaugucuacccuuugcaagaguucuuggaacccagcauucucuccagcuccaagcuucaggcuuuuaguagcggccauacuuaggaauuaccacuaaucugcaugggugaaacugcuauaaacuauuuuuuuuuuugucucgguaguaaaagaaaggaauaaaaauaauaacccucauguuuuaccuuuugggaauauaagguggcagaguguugaguuuugagagcauuucuagauuuuuacccccacacugguuccuuccuacagguuaugaacaggcccagcagcauuucaugggacggccuugauccugggaaacucuacacccugguccucacagaccccgaugcucccagcaggaaggaucccaaauucaggccaguuggggaaaagauggggagaggcuaucuaucauccggacacggaagucccugcuggacagggaugcguggaccuccugggguuacagucauuuuguagugguggggagaaaguccugggccucgugcagcacaggcugagacccccugagccacaaccucagccccccuccccccggaacagggucucuuggugugaggcccucaugcuugcuuguggcuucccaguguaucaucugccuguuauugcccagcuugagaauguccuaggugucuggugcucacagccccucguguucugucuccgcagggaguggcaccacuuccugguggucaacaugaaggguaaugacauuagcaguggcacuguccucucagauuaugugggcuccgggccucccaguggcacagguaaguaaaggcugugugugugugugugggggggggggaugggggggagaaugaggcagggcggggguggcuaccacuggguucuuuccaagccuuacuguaaggacggcagaauccugcuuguuuuuccccucaggcaagucuuuucugggacagucagccuguaggaugugggugccagaacuuugguucugauuggguaggcccucuguagaaccacuucugggacucggagagagcuaggucuguaaaugauuugugguggauuugaaauaucaaagccagggccucauacuagacaaggucucugucgccaggcuggcaaguguccugggcacagagggcaggaagggcugcaggaggcuugcagugggcugcugggggcucugugggcucucugagccuccucuaaucucuauguaaucucugcuaugggugaucauggaaguuucugauccugugaacaagaagcaaacacuuuucauacuagugccaaagauugccuuucauaucucuuuauaacucucccuuucuccccaaaaugugucuggguacuuugaaaagacuuggaagacuguagugagacacauugaacacacacacacauucacacucacacucacucacagucacauucacacauacucugucuuucuguguuuuguauugacauggaacaugagaguccagccccacagugcucccaaagucucauaagcaccccaaagcuggugggagacacaguuacugccgguugcuuguuauacacguuuuccuuucacuggaacaaggccaccgugguggugggugacgcuuggcaggaugccaacuuccgugcauugcccugcagagaacugacugggauaacuaguguccacuaaggacaaaagggccauugcucacggcucaccuugugucugucggcccagaggcuuccagaugcuuuccaggccucucaguguucaucagagaauagaaagauaaguuuccuggggacucuuuaagguucuccagggcaccuacaaaagcaggugauuuaauuacaggcaggaggcacuggggaguagagcaguucucuggagucggagcugugcucuguuuugaagaauaaaacccuagcagcucucagguguuuggaagauuuagcuugcuugauaaacugguggcucagaagguuucaggcagaggauuugagguacacacaucuggacaccccaggaagauggaggcucuucuugccacccugaauaucuuagagguggccuggucccuguugcccucuuggagcucagcauuuucugauaugggucuccaugggucgcuuuggaucccaugugccuaugggcaggaugggcggggugugguaucuggugagcguucacagugugacuuaucuugaugcuggcuuggguuacgaguucguucccuuucaucaauuaguauucccugugacuguggacugcacgguccagccuuccucucgcuggguccuugggcuguagccaggauguggguguuaugaauagaggcacugugugcuuucuguauuccuaggcagggguuuccauuguacuucuuugugcuugcauagaugcccuaggucuaggaauugcucuggaguccgcugaaauggcuguguuguacucugauagcccggguaagguugcugugagucugugcagccuggcagcuuagcgacacgggugugggacugcacuucuuuguggagcacucugauggaugguggccguuucucucucauuauguuuucauacuuguaaauagcuuuuuuuguuuguuuguuuuugguuuuuauuuugguuuuucaagacagaguuucucuguauagcccugacuguccuggaacucuguagaccaggcaggccucgaacucagaaauccaccugccucugccucccaagugcugggauuaaaggcaugcgccacuaugccuggcacguauuuaacuucuuaaaaagccauuaagaaccauacgauuuugacauauuucacauagccuaggcuguccuugaacuuucaggguaguugagagugauccugaacucuugauccaagaagugggguuacaggugugcaccacuacacugauuuaugcugugcugugagggaaaaccaggcugaagauuugugaauguuaggcaagagcggucccaagcggagcgcaccccuauucccacccccaccugcacccccacccugacugacuggcuggcugguacuugccuccccugcaggucuccaccgcuaugucuggcugguguacgagcaggaacagccgcugagcugcgacgagcccauucucagcaacaagucuggagacaaucgcggcaaguucaagguggagaccuuccgcaagaaguauaaccugggagccccgguggcgggcacgugcuaccaagccgagugggaugacuaugugcccaagcuguacgagcagcugucagggaaguaggggugcugcacaggggcccccacagccuuguuaaguuguguaaagcaugcucuuccccccgcccccuugcuacccucucauugggaguucuuagcugugcuaggauagagguuuagggugucuucccucuugcugccagccgucacgauucuggauagucccaucccagguucuguuugauugaguuuagguuccgucuggggaggggucuaauguucugauggagucauucuguuguugauauaaaaaaagcaacucugaaaaaggaagcacuccgccaggaucaggucuagaggagagcuggagcugguggugucugugagugguugaacaaggaaacuguccagaaccgggcacaguggggucuuuaagggcccugucccccaacugagacaacucaagacucccaucuuagcugagcccugacuguccagaucagguggcugcguagguaucaagugucuaaagaacagugcugcuguggagagagacccucuuaagccccuugcuucucagugggguaggcaaaagucaccugagcugccgaguguguugauccuccuugucaaguacaaauaaaaaggcauugcauucagac

SEQ ID NO: 12351 - RNA, 24334 nt, Mus musculus
gcucgguucccacuuugguuuccaccuuccuugaccgcgaccggcgcacuaaccccggcggcgcgacauccaccaaccacuccagggagcgagagagaccgcgagcaaucggcccaccccagccagccagggcgggacccccgaagccccgaagggaccccuaacucucagccacgucccgaucuccgcccgcccagcgacggccacugccaggacguccccccucaaggcuggccuccccgcgcgcgcgcgcugcggcggggacgugggggccgcaccugagcgcgggugccuggcgcgcccgcaugggccaucguugagaggcccucgacggaaagucccagcagcagagucggugugcacccgcccaggggagggucagaccugggggggccagggccccccaaacucggaucgcauucagccaaagugaggcggcgccauggagcuccgagcgcugcugugcugggcuucccucgccacugcuuuagaaggugaguuuucuuggggugcccccuguucuuggggucccccaaaguugugccucagagugcaaaagcuggucucucccuaucccaacuccgguaccccuuaaacacuucggaccaauagcacuagaacgggagggggcggggaggaggcggccuggcggggagugggguuuuucuuuuguuugggaaagagauggagucgagagcucagacccgggaccuucccuuacccagccuucuaaauucucaguccugaugccaaaggcccaugacagccuuccuuuuccuguccacccuaauguucaaaacuaucccccaaaguuuuuauccucucuccaccucuggcuaaacuccaggggaaaguuccugaaggggcacuugcaggcgaggcagaccccagcuaggccguaaagcgacccccaccucugguucccuagcguucauucacaccuggacuccacaccccagucaggauggccccaucugcagccccacucuccaacucccaaauggcuggccaggcuacugaccucgugcagacucuuuucuuguuuuucucaaggcuguaccccaaccuuuuacaugccauuuagaccucaacuuuucccaaggcugaggcuuucuuccagccaugcaagcccgcagaaacugccuaacaccggccugugucgcccuaauucaccccagcuggccgccuccuagcccgccucagauuucugguuuuuuuuuuuuuuuuccuucuguauuccucuccaaaugccucuucagaucugugagccccuaacuccacagucccucuuggggcugcacaggacucauaacccccuuuccugccucccuaaucucuuuucaaugaauuuggcucccccacaaccucccuugcugcuuagaaucaaaggagaaucuggggagugggacacaagagugggggagaucucucccugaagcgauggaaucaaaggagcucccucuaggcugggcagugcuguucugggcugaucaaagugugggaauggggugaggacagacuuugggcuccuggagaggaggaagucaaaugggcagagcacccaugaagugugucuggagggaaagacgggccaauaggaaaugccccuucucgccugcgcuaccugaaugauucucaagccccugccuucaccugugccaacugcgauuauuuuacuguuauuuugcccagcaaaaaaggagaguucuuguuuccuuaacaggugacaaacuaaagcuuuagaaauguuaauuaguuuauccaaggccucaggcccuaaaggagguguaaacugggagaugugguggugggggggggaggggacgacgaccuagaaauggagcccuggagggaaggaggugagaggugggucugggaacugggggacugaagugagcuggaggcaaacuggcguguuguggaugcagggaaagugagucugggcucagcucaacaggcugaagagcagccuguugcacagacaguguguaaauuggagacaggaaaacgcuauccaggcuggaacaauggaggguggggacggcggccucuauccacccccuucccagaaccgugggcauccuguccccaacguguucugcugucuccugccacccauuagaggggccgguaggcuuugccucuggcugcucagguuccugccugcccccuacacccugagacagcaccgcaacuuugaggugaugccucccucauccacccuaacuccaggcacuccucucucucaaagccaaaggggagggcgggaccuggucccagguguuccgcugacuccccuggaggcccacucucaacgcaugugguucccagacuccugcccccucccagguugccuacccucaccaggggauuccccaacccucccuuccucccucccgguuguguugccagugaagucugcacaucuccuaaucccuuccugggucagcaucaugucugcuccccucaaaugaucccagagccccuccagguguguucacacacaacuccccaccccuaaacucuccuccuuucuuucuccuaaccaaguccagaugugguggggccucugcuggagcugagcgaggcagggaacccaagaguccaggcuuccagaacuuauuucucuggugguagcaaaugggggaggugcacugccucaggcgagggcaucaccuugaaggacugggugucuggugugaaaagggggcggggaccgggauggaagccaauuuuggcacuuaggaaagggagggaguguggagccuaagacaggccucuaggaaaccuuagccuggaccagcaguucucagccccaggaggcaaggccaggacuggguuuuguccuguuuuuuguuuguuuguuuguuuguuuccagacaagaucucaugcaauucagacugggcacaaacucacuagcuggucuugaacucuugaucuuucugucucuaccucccaagugcuggcauuacaggaaugugcuaccaggcccagaacuuucuuuucuuuucuuuucuuuucuuuucuuuucuuuucuuuucuuuucuuuucucuucucuucucuucucuucucuucucuucucuucucuucucuucucuucuuuucuuuucuuuucucuucuuucuuuucuuuucuuuuuuuuuuuucuuuugcaauucugggggugaagccuggagccugacuacacgaagcaagcacuccagcugugccauaccugccuucccugagagcaaaugcugagaaucagcccaagagcgccugcugcugcugcuucuucuccuucuucuucuucuucuccuucuccuucuccuucuccuucuccuucuucuucuucuucuucuccuuccuuccuuccuuccuuccuuccuuccuuccuuccuuccuuccuuccuuccuuccuuccugaguugugugcacauuuaacuuccagcaugaguuucccucauuuuucuggguacagccccuccggggaaaucuagaagcuauccagugcccaccagcugcugaugggagaguuggcacugggaacagggguuacaaaucuaagggcauugggcuggugagggcguucaucagggaaugcuaccugcgagccugccgaccugcuuuaaauuaucaacaugcgcuuuaugugagguuggggacaaagaggaagacaaagacuucucuugugccuaguacuugugucacacucagaggacaacuugugaggcucucuccuuccaccaugugggucccaaggaugaaacucaggucugcaggguugguggcuagggucuuauuuccuucguccaagagaauaaauuuugcuaccuccuggaacuagaaagacaacccacucgcccucauucccguuuguucccagcaagcuguuggcccuaccucucacacauaccuccccaguggggcugacuuugucucucugucuuagagacccuguugaacacaaaacuggaaacggcggaucugaaaugggugacuuacccucaggcagagggccagguaagagcuggaggggaacugaagcaggagguugcacagaaacacuccgagauacuuguuuccuguagccacucugacccuagcuagacguccugacugacagcuuucgucucugcacagugggaggagcuaagcggccuggaugaggaacagcacagcguccgcaccuaugaggugugcgacaugaagcguccagggggccaggcucacuggcugcgcacuggcugggucccaaggcgaggugcuguccacguguaugccacgauacgcuucaccaugauggaaugccugucccugccgagggccagucgcuccugcaaggagacauucacugucuucuauuacgagagcgaagcugauacggccacggcccauacgcccgccuggauggagaaccccuacaucaagguaccaacagucugggggaucgaugccacuacaagcaguuaaguccagggagggaagagguggagguguguguguguguguguguguguguguguguguggauaaaagggaagaacgaguacugccucuccuguguggggagguccaacuugaagcugcuuucacgacaucucugcagaccuaccugcugaccugcuugcucacugcugggcccuacuguacucuuugcgucucugucaauaucggguccucucacaucccuaccugguuccucuacaccaagcucucaccuguccuuuuauuuguuugcuuucuugagacagggucuuguguagcccaggcuaaccucaaacucacuacacagcuaaggcuggccuugaacuccugauccuuuuguuuccuccuccugagugcugggcuuauaagggggugccauuguaauccuggcuguguuuuuaauuuauuucuuuguugcauuuugagacaacgucuaccuauguaacccuggcuguccugaaacucacucuguagaucaggcuggcuuugaacuuagagagauucaccagccucuaacucucaagcacugggauuaaaggugugcacuaucgugucuuucuuauuuauuuuauguguaugaguguuuuguuccaguguauauuuguguagcauagucacccuggaauuggaauuacugguaguuguaagaacugccacauaguuucugggaaucgaacccauguccucuguaacaucaagugcucuuaacuacugagccaucgcucuagcccugucucuuaaauucuaguuaccagcaccagccacaccuugccucccuauuuuugagcuauugcugugcugcccagaccagcuuugaaacuacuggacucaaaguuauccuugaguucagcuccuccacuuuguuagcccagaaaaggcuaaccaaagcccaggcuagcuugaaacaccugauccucuugccuccacguguguguguguguguguguguguguguguguguguguguguguguguguguauuguguagcaggaguugguucucuccucucacuuggguuccagggauagaacucagauccuuacucccaguggcaaccuuuaccucccccgccaucuuaccagcccugguuuuguuguuguugcaguuuuuaaaaaaaauuuuauuaggcuuauuaauuauuuuauauguguggauguuuugucugcaaugcguuuuaugugcgccccaugugcaggcuuggugccuaaggacgacagaagaggguguuggguugccuggaacuggaguuaaagaugguugugagccacauuguggguccucuguaagaggaacaugugcucuugacugcugaacuaugucuccaaccuucucgguuuuucuuucucuuucuuucuuucauuccuuguuuccuuccuuucuuccgguagucucucuacuaugcagaucaagcuagcuuugaccucagggaucucucugcaugccucuugagugcuggguuuacaggcaugugccacaaugcccagguuuuauuucugguuuuguucauauguacaucuuaaaacuuauuugcuuuuauuuucugugucugaauguuugccugcaugugugugucugugugccaugugcaugccuggcacccacagaggccagaagaggacaucagagcuccuggaacuggaguuacaguugugaacuaccaugugggugcugggaauugaacccugggccucuugcaagagcagcaauugccuuaaacugcugagccaucucucuaggccauguuugguuuuugagacaagaucucacauauagcucaggcugacuucagauuuucuuauggagccaagggugaccauaaacuccuacuccuccugcccccacauccccagugcugggauuacagguguguauuagagauugagcccagagccuccugcaugagcuaacuuaucuauguccccgcaccuaaaagguguauuuuuacaaaucuucacccaaaacuaguuauugauuucccauggcaugucagcaucugggguaagaaucuuagucucuagagcagguggcuacccucgccuuggcuccugcccuacagggccaucugucugucuaugauucuccauccuuucuccuuggcucugaggucauggcgcagguaucuaugaauauuccuagaacaaaugacucauugggaaaccaaggcaggacaaaguuagacgaagugcagcucagcaagcauuagaggacggcaggcgagucccucaguugugagugcuggcuuagcagucacaaagccccggacuggauggagcaagcauggccgugccugccuguccucccagcacuugagagguggaggcaggaggaucucuccaaguucaaggcuagccuggacuauagaguguguuccaggacagccaagacuacagagagaaacccuguuuuggaaaaaccuuggcuacauagcaaguuugagaccagcuuggacuacaggagaccuuauauuuauguguguguguuuaacuauauguacacacacgugcgcacacacacacacacacacacacacacacacacauuacauaugaauauuauauuuguguguauguauauguguauguguguaacuauauacauacauguguauauauauauacauauacauuuauguaugugaaauacauaugaauauauguuguauguuuauacauaauguguauauauacacacauauguaaguguauguauauuuuauauauucuauauauacauuuucuuucuauauucucucucuacacacauaccccauacacacauauaaaacacguaucauggaaaguagauagaagguucuccacagaagcuaaaaugguuggagguaucugugaagaagguagcccaccagagaucccagaggaccugggacagugguggugaaccuggguucuccugcagguggacacaguggccgcagaacaucugacucggaagcgcccuggagcugaagccacagggaaaguuaauaucaagacgcugcgccuggguccucucagcaaagcuggcuucuaccuggcuuuccaggaccaaggagccugcauggcucugcucucccugcaucucuuuuacaagaagugcuccuggcugaucacgaacuugaccuacuuccccgagacggugccucgggagcucguggugccgguggcagguagcugcguggccaacgcggucccuaccgccaaccccagccccagccucuacugccgggaagauggucaaugggcugagcagcaggucacgggcugcagcugcgcgccaggguacgaggcugcggaaagcaacaaaguaugcagaggugagaacgcgaguacccgggaaagguggggccagcuuuuccuccugcucucaucccuuaggauucggggcuucuuuccccucggauuuuauucuuagaauaguagaaaauaguauucagaauucuguuaauuccgcugauugguaguagaucccagcgacgagacucaugggcaccucuguccagccuuuaagcuucccuacguuaagugauugucacugaacagcucggauaccuuguugggugguggaaaaggacuuuacgaucgaucuccauuauuuucuguuauuuguucugaauucccucccauuugcugauaugacuuugcuucucugacccuggaauucagcuugcuuuugcuuuccuuuuccuuuuucuuuucuuuguugucagcacugaggauuugagccaaacucuguacgagcugcguuauauccuccacccuuuaguuguuucuuuuagccgggugguuugguuuggguuuuguuguucuauauucauuauuaucuuuuaaaugcaggugccagcgauucaaacucaggucuucggauuuguauuuucauuuguuuguuuuguuuagagauuugcuuaguuugugugugcuugcuaggggccguggccugugcugucgaggcccccuuguggucagaggucagaggucagcuugcaggcaccagucaagucauuagacuugguggugagcacuuuugccucuugaaccagcuugccguccuguaaaugacuccauuuccacaaauguccaccuaaaauuagccaguccuuacuuuuggaauguuggcaaccucggugccuuuggauugggaucugaggguuuacauaccauccuaaacacagggcuucacaaagcccacucugggugccgcaucaagcuaaaacaacaucuuugcucaugacuucgguguucuggagguccuaaggccaucugcggcaucucuggguauuuuguuugggguuuuuguuuuuguacugggauuaggucuugauuuauagugcacgcugcucuccagcucaugaacugucccaccuuagccuccuggguguauugcugugacuggcuugucucuucuuuggguuuuuguuguuauuggcuucuuccuucccuccuuccuuccucccuccuucucccucccucccucccucccucucucucucucuuucuuacuuucuuucaacaagauuauuuaucuuauguauguaauaaguacacagucucuguccucagagacgccagaagaaggcaucagaucccaucacagauggcugugagccaccaugugguugcugggaauugaacucaggaccucuggaagaauagucagucagugcucuuaacugaugagccaucucuccagcccagcuuguuucuguuuuuauaauuuuaaaauguucauauuucaaauuaguuguacaugugagguuauguguacauaaggcauuguaucuccccaggggcuggaauuacaggugcugcugugagccacccacuauaggugcugggaacugaguucugauccucacacgagcagugugugcucuuaaccuccgagccaucucuccagcccuuauuuuuguuucugagaaauggagucucacuauauagcucagguuguccuugaacuugccucuggcuuccaagugcugucuguuauuacaggcugggaaaaaaaaugccugauuucuaccguucauccgugcuuucuuaaugcuucacgcaucacauguuagcuaucuugcauuuuuuuuaauaguucuauauuuuuggcaguguguguucacaauuauucugauggcugggaacaugguagagggcuugcuggugugcacagaacccugaacuccguccucuccaccuugcaaacuggauguggugcugcacaccuguaaccuccauacuucagagguggagauagcgaaaucaguucaagguuaucccuagcuauauauggaguuugaggucaggauauauaagaugcugucuauaagucaauuaauuaguaaaauaucaugagaugguuucaccagacugccacaguuaggguuaggcagagugagggaugacacccccccccuuuuccucuaacuggccagucucucauuuauuccuaagcucugucugcaugcagguuuuguuuuuguuuuggagucagaagauuccuuuuaaagauuuuuuuuaacuuauguguguguguaugugugcaguugccugcauguguguauauaugucugugugcuguguuugugccugaggucauaaaggggcacuggauccccuggaaugaugcuuguaaggcacccuguggguccugggaacugaacccagguccucuggaagagcagccagugcucguaaccucucuggucuucaguuuuguuuucuugauagacaucuuuguucucucccucagccuguggccagggaaccuucaagccccaaauaggagacgaguccugccugccaugcccagccaacagccacucgaauaacauugggucuccugucugccugugucgaauuggguauuaccgggcccgcucagacccccggaguucaccuugcacuaguaaguuuccaggagugaaaaacaucugaugucccaugugugguucauugggggagaguguguggacuccccauaugguuccugauacaguuuucuguugcugucguaaaauaccaugauaaggaaccauuaagagaggaaggaauuuauuuuagcuuaacuccagguuguaguccauuggcaugggaaagucaaggcaggaacagccagucauaccacauccagagucaagaccagagagaaaugaauguacccauauuugcucgacugcuugcuugcuugcuugugcucagcuugauuucucuguucucacauaacucaggacccacuucauagggaguggugccacccacaguaggcugaguccuccuguaucacuuaacuuaauccagaaaauccuguacauacacauccauaggccagcauaacagucucaucaagacuuuuuccaagugauuuuagguuauaucaaguugcugaagauagcccaccacagcccacaugcuucccagcuuuggccucaccucuaauacuugagaagauuagugugacugacugucuguccuuuaggcuaguccauuccuacccucuaccugauucucuuuucccacagccccacccucugcuccaagaagcgugguucaccauuugaaugguuccacccugcgccuggaauggagugcuccccuugaguccggaggccgagaggaccucacuuaugcuguacgcugccgagagugccguccuggggguuccugcuugcccugugggggcgacaugaccuucgaccccgguccucgagaccugguugagcccuggguggcaauccgagggcugcguccugaugucaccuauaccuuugagguugcugcuuugaauggugugucuaccuuagccacuggaccaccuccuuuugagccugucaaugucaccacugaccgugaggguaagacaaggggacagaaaauaaugauuuuuaaaaguaauagaggggaugaugugaccaaagaauauuauguguucauaugggaaugucauaauaaagccuucugugaagguacuaugcucugguaaauuuuaaaagaaggagaaaaggaaagaaagaaaaaaaagcaacauuuaucaucauaaucucaguauuugggagucagagacagaaagaucagaaguucaaggccagccugagacucugccucacaaagagaaaguagaucuuaguuaccgacucugccuccugcgcucugggauuacaagugacugagaugucugugcagcuucuaccugggugcugggcauccaaauucuugugccccaggcaguuugcuuacugggccaucaucccagacccagauuaguccucccccccccuuuuuuuuugagauagcugcuuguauguagcugaggcuagcuucaaacucagcauucucuugucucugcuuccagagugcucaaaggaaaaaaauuuuuuuucaaaaauguauuaauuuauacaugugugccugcauucauuuguguaaaccauauguguggaggugcccaaggaggccaacagaggguauuggaugcccuggacuugcaguuacaggcagcggugagcuacuggaugugggagcugggaaccagacauggguccccugcaagagcaucaugcagguauuagaagagguugcuagguauaaccuccggaggaaaaauuaggaagcaaaaccccuaggguuugugguccggcucagagguagagcauuugucuagugcauguagggcccugaccgcauccccagcacugugggggugcgggucgggcaagaauuggaaacugcuaauugcuagacuuugcagcagggcgcauuggguuucuuucuccugcagugccuccugcagugucugacauccgagugacucggucgucacccagcagcuugauccugucaugggcuauccccagagcacccaguggggccgugcuggacuacgaggucaaguaucaugagaagguaaggcuaggcucugucccagguaaggggacuggugggcauugaaccagagcugggagcauugcaauucagguugacuguuuauuaacucuacgacuacaggcuagcccuugggccucucuacgcuucaguuauuguuaucuguaaaauaguuauaauauaaauauaauauaaauaaauaauguaguaaauauauaaauaaauaauacaaauaaauaaaugaaauagaaaauaaauaaauaaauaaauguauaaauauaaaauuuuauuuuaaauaaagaaaaaaauauauauauaaauuaauagucaguuaguuauauaccaggacaaccacuguaaaggguugucaggauggcucagugguagagccccugccuagaaucccccagggaggggcugggggcguggcucagugguagagcccugccuagaaugcuucugugaggggcuaggcggauggcucuaguggagugcuugcuuggccugugagauguuuagguuugaguuccagcaucccaaagagaaaaaacuaaagcugcaaggauaaaugaugcuauacgauagaacaaagugggagugacgggggaaggaaagcagcagagacgggggaaucuuacggcccauuccuuucuccuccugcacagggcgcagagggccccagcaguguucguuuccugaagacaucagaaaaccgagcugagcuccgggggcugaagcggggagccagcuaucugguccagguacgcgcacgguccgaggcuggcuacggucccuucggccaggagcaucacagucagacucaacuggauggugagucugggguuuccgguggaggcugggaagguugccccaccaggcacggcgggcuucaguaucggcagucaucugccuuguucuuauccuucaaugauaagcccuggccaaaaccuagaauagagaaacuaaauccgugcugugacgccugcuggcucuucacucuagcugcauguugacccacaagcuccuccuguuuccuccuccaguaagaugagcaaagccuuccacccugaugagaguccugagguaaagugagguagcacgugcuuuuuuguuuuuguuugauuuuuugguuuuucgagacaggguuucucuguguagcccuggcuguccuggaacucacucuguagaccaggcuggccucgaacucagaaauccgccugccucugccucccaagugcugggauuaaaggcguggaccaccucgccuggcuuuguuugguuuuuugagaaagaguuucgcuguguagcccucgcuguucuggaacuugcucuguagaucaggcuggcccggaaaucacagagaucuacggaccuucugccucucaagugcugggauuaaaggcgugcccaacuuaacuccguacauuuuugaacagcuccauguuuuuugagacagggccuugcuauguagccacggagauguuuuugaacuugcaaggcuggacuuaaaguugcagcaauccuucugccucugucucccaagauuacaggagucccccacuuggggggacuuggcuccuuccuuccuuccuuccuuccuuccuuccuuccuuccuuccuuccuuccucucucucuccccucucuuucuuucuuucuuucucuuucuuucuuucuuucuuucuuucuuucuuucuuucuuucuuucuuucaucuucucuuccaucacuuuucuuuuucucauuuuuaugcuuuuuaaggauuuuauuuuauuuuauuuuaugcauaugaguguuuuuccugcauguaugucugugcacuguguagauggaggccagaagucgauccuggaacgggaguauuugagcuucccccauguggacacuggggagugaacccaggucuccuggaagagcugcuaguguucuuagcugaugagcuagagauagagucucauugugugacacaggagggacuuuaacuugacaauccuccugccucagucucuuaaaugcugggguuacagacauagaccaucacuuuugucuuacuuuucucaguacugagggaccuugagcauacuagcccagcacucuaccacugagcuguauccuggccuuuauuuuuauuuugagaugggguuuuacgaaguugucuaugcugaagcagaaccuacuauuguagcccaggcuagugucaaacccucuauccuccugccucagccuccugaaugggauuacaggugugugcuaucaccuucggacucucacccaaagaagauuuucuuuguuaaacuuggacacuuaauccauuguccucaguaugagcucagcaguugcuuagcucguacugggcugagaugggagucagcuuaggagaucucagaucauugcuugaugguggaguuacggggaaucaggaacucucaucuuuaccugaccucuucucccccccagagagcgagagcuggcgggagcagcuggcccugauugcaggcacugcgguugugggugugguccugguccugguggucgucaucauugcaguucucugccucagguaaagacuggccaccugcucacacaccccagggcagugguaucaaccugccgaaugaugcaaucccuuaauacaguucuuccuguugugaugacacccccccccccaaccauuaaauuauuuacauugcuucugcauaacuguaguuuugcuagguaugaaucaugguguaaauaucugauaugcagaguaucugauguguggccccugugaaagggucguuugaccccguuucagguuucaacccacagguugaaaaccgccaucguagagcaagccuuccugucuuucccacccaucaguucucaguggagauuuuucuagaccccaacuccuucacucucugugggcccagagauguaugacucaguuugccuuuugcuucuuuucucacugcuacaggaagcagagcaaugggagggaaguugaguacucggauaagcaugggcaguaucucaucgggcacgguaugugggucacagacaaggggaagaaagcagcuuugaguuaaugggacaucuuggcccagaggaauuuacuuccugguuaaugggcuccugugugacuccuuagguaccaaggucuacauugauccuuuuacuuacgaagacccuaaugaggcagugagggaauuugccaaagagaucgaugucuccuaugucaagauugaagagguaauuggugcagguaagaggaacaagucgggaugcuucagagucguacaaacgugaggaccugaguuugauccccagaccugugugaaaaagcugagcauagcagcacaugccugaaaucccagcacuagagugagggauugggggagggguggggaucggaagggacaugcagagggucuguggugcucacuggccagcccaucauccaucagccuaaccaaacuggguucagugagagacccucucucaagaaaucagguggcuugcuguuguggcaguacgcaucuuuaauucuaguacucaggagaagaggcaggguacucucuugguuugagguuaaccuggucuacauagcaaguuccaggcuggccagggcuacaggauggcucagaggauaaagaggacugcagccaaggcugaugaccugugagggacccacaugcugggaggagagaacuaauuacugaaaauugcccucugaaugucacguguuuguucucucacauguguacaugcacauguguaaccaugaauauaauuacaaaaaguaagaaaaaagguaaaagagguagaagaaaacaccguauguugauauauggcugcuaucacaugcauauacacacaccaacaggaaaauguacauccaauguacauguucacauguucaaugugcguacaugcucgcucucacucucucucucucucucucucucacacacacacacacacacacaccacaaaaguaaaagccugggcuuguuuacaaaugggucagaacaggagaaaaacugaccaucugcauugugacugaaggugaguucggcgaggugugccggggucggcugaaggcaccagggaaaaaggagagcuguguggccaucaagacucugaaggguggcuacaccgagcgccagaggcgugaguuccugagcgaggccuccaucaugggccaguucgagcaucccaacaucauccgccucgagggcguggucaccaacagugugccgguuaugauccucacggaauucauggagaacggagcccuggacuccuuccugcggguaagccuccuccccaccuucacaaccgcugcaucuuccugggagauggggugggaacugaggaagcagggaaagccggacguagaaaauagaauaaagcagaagucaugccugccguccuagcauugcagaggcaggaaguuugugaguguacgucauccuagggauacaaagccaguucuaggcccgcuuaguauuacauugcaagacuuucaguauuguauuacauagcaagacuaccuccagaaaggaaaaaaaaaaaaaaaaaaaaaaagcugaauaguuucagacauggaagaaaaaaaaaaucaaaccagaucuugaauagugacugaauuauuucauugauuuauuuuuguacauuacuggagauucaaaccagggucucauauauaggcucuacaaucucucuauuguagaaccacagacccagccccucccuggggauucuagucaugagcucuaccacugagccauacccucagcuccucacugggggauucuaggcaggggcucuaccacugagccacacccccagcuccucauuggaggauucuaggcaggugcucuaccacugagcaacacccccagcccuucacugggggauucuaggcaggcucuaccacugagccacacccccagcuccucauugggggauuccaggcaggggcucuaccacugagccacgcccccagccccucacugggggauucuaggcagccuucuacuaccugaacuauauucccagccugccucucuguauacucaucauucugaauuucugucuacauuggcucucuacucuaggccccaaacacauuuucccucacuucccgauuaacucucucuuuugcaaucuuuucccacacucaucucccuuacucugcaacaggucccuggucacauagacuccugugucaaugaugagggggucacacugcguuauggaucugcuucagcauccauaggagccugggugggucugggacaguauguacaguguguagcacagcuccccugugugauccagccacagaugccuaauuuccaauucaucaggacaugggaaagagaucugguuacaggaaauacaggaagacaaguuaaaugacucuacauggaagaagccaugaauucagaaggggcgggugacauucuaagggacaauuguuacagcacuucagcaugucagucucauaucaaggacucucugggauuuagggagauacaugcaaauagccaguaugcugcccgacguccuagccacgugggagaaugaggcacaagauuacaaguucaagcccagccugggcaagguaaagagagucugucucaaaauaauaagggggaagaaagggcugugaaguauuuucaugguagauugccuauguagaaaaccccagugaggaccuaggggggugacucagugguagggcaccugccuagaaccccccagggaggagcugggggcguggcucugugguagagccccugccuggaaucccucagggaggagcugggggcguggcucagugguagagcaucuaccuagaaucccccagugaagggcuggugacauggcucaguauagaguguuuaugagguuuuagguucaauugucaucauuggaaaaaaaaaaagcaugguuguggagauggcucagcaguuaacagcaccgucugccuuucuaaaagucaugaguucaaucuugggccaucugcaaaauuuguuuuuaauuuucagccaggcagugguggugcaugccucuaaucccagcacuugggaggcagaggcagguagaguucugaguuugaggccaggccaggaaaggaacucacuacagagugacagccagggcuacacagagaaagugugucucaaaaaaaccaaaaaagaaaaagaaaacaaaagaaauucagauuuuggaugcagccuccuuguucuucccuccagagguguaggggguauagcuccugcauccugccuucaacccagaugggcuccauuuaguuuuguuauucugcuugguauagcuaugagggcaaaaugaaaacaucucaaggucgggcccagaccucaccuuugucaccaugucccuccguuucauccuguucucuucuguucacacgcaguugauuugggaccuugucuccacugccgggcagcucagaguacacuccuaacuggcccagcucugccuaucaaaucuaaggacuucguuaggauaaaaauguuagcugaagccauuagugauggcuugcaugucuaaucccagaguuugggaagcugagccaggaagauugggcugccacaacucuggggcuggcaugggcugcacauugagacccugucucagaaaaacaucucaaaguaaauaauaauuagauguucugauuagaagcagaacgcggugguucaugccuguaagcugaggcagaagggacauuucaaggccagccugggccgcguaguaauuuccaagcuaaccagcuagagauauauaaggugauccuguccaaaagagcacagauugagaugugggggagggccuuagaaacaucucuucacaauaugggaguggugaacauacaacuuuaaaaugaaagaaaacugggcggugugauugguucaugcccguauccccauugguuugaagauggauauaggggaaugggccauauaaacaagacaagacuuugucucaaaagcaaaagccaaacuaugaggcaugaugagaaacggugccaagguguggcuauagcaggggaauuuaggaagaccgggggcugccugagagaacugcaugcuguguagaccccaagauggguaggcgagugauggcugugcugaaggcaggggcgaggaggauaaaccaugggcgauccauccugagcaagccuuucucccgucucuuuccucuccagcugaacgacgggcaguucacagucauccagcuggugggcaugcugaggggcaucgccucgggcaugcgguaccuggcugaaaugagcuauguccaccgagaccuggcugcucggaacaucuuggucaacaguaaccuggucugcaagguguccgacuuuggccucuccagauucuuggaggagaacuccucugaucccaccuacacaaguucccuggugagccuggguccagagaucccagcuaagcauucacacagggaagaaguggguugguuggagaaaccauggguagaaguacuggcagcucugcugggggggggggggggggggcagccgggaguuagggcaguugggaugacaccuguuauuccagcagagaggagguuaagagagggaagcucugugaugguagcuagccugggcuaucuagguggauccuagauagaaagaaaaagaaauccuguaaucccacaacagaggcaguggaggguggaggucagagaaguccaucuuuggcuaccuaccggaacuagggagcuggaggccugcaugggcgacacgugacucuguuucuagaaaacaucacaaaacaggagacagggauggggguagguggggcguggcuuaguuucuuuuccuauggcugugauagaauacucugacaaagguaacuuaagacagguuuauuuugagcucagaguacuagggacagccugucacagugacaaagccgaggcagcagguggucacaucgcaccacaggcaagaaauagaacaauuaaugaaugcauguggcccgcucacuuuguccuuuugauugagugcaggggcccaagcccagggaaccucguuuaacccaguuaaagugucuuucagccacauccacaggcccguccuuuaagagucuagauuaugucaaguugaccacacuaucccuuauggaugauguccuggguccugcugcugccuagguucaccuuugcuggcuuccuccacagggaggcaagauucccauccgauggaccgccccugaagccauugccuucaggaaguucaccucugccagugaugccuggagcuaugggaucgucaugugggaggucaugucuuuuggggaacggccauacugggacaugagcaaccaggauguaaguguucuguggucauaccacgauuuccuggauauucuaucaggauagucuauuaugaauccuggauacgggagugggggauagaguucccagacucuuuccccaucugugugugugggcacagaggggugauguuugcauccaggaguuggcugcagggacuggagggcagaugacgaaaugaguacauuccuugccaugcaaggccgaggcucuccacagccucaccgcuggggugucgggggcagacagguccgggacuuaauuggcgcaccagcauagccagucagucaacuccaacuucugugagaccuugucucacaaaacaagguggaggggcuggggagauggcccuguaggugaagugcugggaauguaagcacgaggccuggaauucagaucccgagcccuuguguaaaccacagggaggugugggagcaugucuguaauuucagauuuggacgguagagacauagaaucauagagcuugauccuggaucaguaagcucuggguucaagagagagacccugacucaauguagaaggugaagggugacugaugaagacaccacacacacacacacacacacacacacacacacacacacacacacacacacacacagagagccacccaugcacauuacacauguaaucaaaggaaagugaugagcuggaagguaccgcagugguccugcugguaagucugaugauuugaguucaauccccggaaccagcacaguggaaggaaagaacugauugcuucaaacaguccucugaccuccauacaugcgccguugugcaugcacacacacaccagcgucugcaaauaaauagauacaugcaauuuaaaaauaagguggagagugagguaggaagguacccuucauugaucuccacauguuacauccacauaggaacacaggcacagaguuguauguaguagcagcguuggauucggggauggguggaggguaggguugggagguugcucucuagacugaagcuugagagcugcagggcugggugaguguugccaaccaaggcaguuuucguccuccugggacucagggggucugugcuuuuggggugccugugguuccuucggcgaacgauucucucaagccagcuucacccagucuuccuccuugucucuguaggugaucaaugccauugaacaggacuaccggcugccuccuccuccagacugccccaccucccuccaccagcucaugcuggauuguuggcagaaggaccggaaugcccggccccgcuuuccccagguggucagcgcucuggacaagaugauccggaaucccgcuagccucaaaaucguggccagggagaauggcgggugaggaucccaaaggacagcuccgacccacaacccaagaguccuuccaaguggcccuggaguacccaugccuuuguguauagacuggucucuguugguguucccagagccuucugaugaggacugacuuagcauuucucuccaucuuuauccucuccaccuuccagggccucacauccacucuuggaccaacggcagccucacuauucugcuuucgguucugugggcgaguggcuucgagccaucaagaugggaagauacgaggaaaguuuugcagcggcuggauucggcuccuuugagguggucagucagaucucugccgaguaaguagaagggaccgcaguggggcacagagcaucgguauaggaggcugagucagacccacccccuccccgguucaguagggaccucugaguucagcuucaagggcuguuuuauaugguggcucagcgcugugaugcccgaggccgagccccgggauccucccacaacagcagggccuggcuaguguucauucuggagccuccucacgccagggucaucuaucucccuucccauuuccagccuguaucugucuuugugccucuaucuacauuccaaacguggcucucacaguaaugugucaacucuggcucccucuucccacccauaaaaggagaggacgggccugagauuuggaaaucccuucccagcuuugaugauacacgguuuuaugauucuaucaacucccaaauaacuguucuccugccugucuauccuuggagcgccuccucccucccaucucugguucucucccaaggccucugcuuaccccagcuuuggaugggugguggugggggggaucacagacuuaugucgggaggagguagcuguggugguauaucacugugcucccagcuccuggaaacuuuuucaauugaggcuagcgugggcuacauaccaauacuuuaaucucaaauaaccaguuaaauaauauguaaaaugaaaaaaaaaagucuccagaugaugucuggccaggcaggucuccuggucccuccucaguaucuucacugagccaaagugcucccuaauuuaaggccuaguucuuuaccuguguggucccugucuguauuucuuucuccuccaaggcaaccucugcagcuucuucccccuaaaaucucucugaggacucucucuuuccuucuucuacggaggccgcucaguaaauguuuggugauuacucuugccuuucuccuccuguggccucccugcuuggcuggucccgggacuccuccaaccuucuguuuuuccacagggaccuucuccgaauuggagucacucuggcaggacaccagaagaaaaucuuggccagugugcagcauaugaagucccaagcuaagccaggagccccuggugggacagggggaccagcccagcaguucugaccuccaaggacucaccaccguggcagauucuucuuuccggggggcagaguuggguggggacucacaagaugagccccucccccucgucacagccuucccauuggauugcacuuugaacagagggggucagagacccaggauuuggggaaccgugccauaugggaucauacaugugcccuccaggcggggaaccccaaacucagagugagucuuucccucaagacugggcaaagaaacaucccuacgucucuaaccucccaucuucccagagggcucucuccccaagcgccuuccaccucaacgggcaugucccugcagaccaaagagaaagggugaccagccugccaacuugggaguggaaaaugccgucccaggaggcaggaaggggcugucaggacccggugauguaaucauuggguuuugauguccugacuugcugucaccaccaaaggcaaucauuuuucccuuguaaaugccccuccccucaucugccuucauauugaagguucugaaguuuuacuguuuuuuauuuuguuaauuuuuuccuccuuccccccucccuccccuucuuguccagauuuuguguguuaaagggcaccugguuccacuaucuccuguugggaacaaggacccaucgauauguucuagaacagugccuuggaaaugccacagccuuagacaguuccuucuuccuuuccuccccccaagugcccccaagcuguguuguguggagggaaggggggugauguuguaaaagggacaggagguuggugguggucaacagaggcagacaacggugcuuggaaggggguucuuaaauuauauuuaaaaagaaacuuuuuuuuuuu

SEQ ID NO: 12352 - RNA, 8556 nt, Mus musculus
cuuccugcaggucuggugugucgaggcuaccuucccucccgcagccuuugcguucgcuaagcuggaguugccgagccugcagggccgaggccggagcuuccggggcggcagcgaacagacucggcugugcgggcuagggaggccuagcgagagcucggcgcggaggcugacaggggcagcggagacgccugcucggugaggcccgagggcgcagagcgaucggggcugcgggagggaugcugggcacagauggugcccagucaguucacccgggcaccccgcuguccccagcuugcggcgccugggagggucgagguggucgggcugacagcgggacagcugcaucgcuuugggcugcacggucagucccgaggacagagugcaggcacugaagaacucaagggcuccagauucccacggugucacucagcguccaucagcucucuugcucugucuguggucccccccccccccgagucugcccuugaggcaucguaauggucuagugcucaaaaucugcuuuuacuucuuucugcucgugaaggaagacugagucugcgacaggugugagacuuaaucaagguuguguugaaaugagugccauuguuuucuaguuucuucccuuagucccuuuuuaagauaugcagcaguaaccaaguuuaguuggauaguuugaaaacaaaccacgcuuuaucccuguuugucggacgucuauccaucuggaccauuuuuccuuuuuguguuuuaguuuuuuugaggcguggauuccuuguggcacauauuguucugguagugggugauccucccgucuccgccuccagagaguugggauugcauguaugucaccucauggaacauggaucccagauauauauauauauagugcccagaauccucauucacugugacauauuuugcaacaguuugaauaggaaauaaaauaaguacccuuguuucccccaccuuuacaccaaaugcccguggauaaaaagaaggcagcguaguguucaucauagaacuguacccgcccccccucgccucccaccccccauuccaccuguuggaguuagguuugugauuuccuuccuaucaccucugcaguguguauaagcugcgauuucacuuggugguucccaggcgagagacaugucccuguguagaccaguuaaucuccgauuucagcgagcuuuuccuccagcaggucagucagcagugucuacaguucccccaagaggagcagaacaugagcagaucaaagguaaguuuuucccguuuguaauuuuuuuuuuucugacuccuuuguaauguauuuuggaagacuuacucaaaggucuguucuugaaugguaguggaguggucucuaaagggaucugacgcccucuucuggcaugcagguguacaugcagcagagcauccauacauagaauaauuaauaaguaaguaggauggucguggagaaaggagugaauaaaggugauuguaauauaaaauacacccgaguggcaggcugucaugaccuguuguguaggcagucugauaacuuuaggcuaauggaguuacuuggcagaguuagaaaaaggaaaaucguauccaucccaucaccugcagcugcucgugggaggugccguuuuuuguaccuuauaggaggcaaagacuugcuaggauuuggacaucuuccuuuagucagguugggaugauuuuugcauuuugaaaauuuaccuugacaagagcagcuugagggagaaagggcuuauucugcucacaguggcagaguacaguccaccacggugggaagggcacagaagcuuacuuugaggaagcugaaaauguauauauuuucugaagucaggaagggaagaggaaagcaugcccaccaugauggacaguacucuggaacauagagucauagaaaaguuacagagaaacaaaagaauuauacaaagaaaucuuucauuccguuugcuccaaaguugcauuuuuuaaacaguuuuuaaaaaauuuguuuuguaugugccuacaugugugcaugugugugguccaguaugcacgugaaggucagagcacaacuugugggaguccguucucucccuccauacagguccauagaacuauggagucauacauagaauuauaaagucucauacauagaaucauagaguuucauaugcagacucauagucuuguacacagacucauagagucucauacauagaaucauagucuuaugcauaaauaaaucacaugguuucauacagugagugcucagcccaccuugucuuuguaugguccaagaucuaagccaagggaaugaagccgcacacagugggcaggcuuuccugccccaguuuaccucaucaagagaaucccccacaagaaugacugacuagcccuuggucuauuucuccagcaauucagagucucaucacauugaccacugagaugaaccaucaguagagguggugaguucacagaggggaguacuuugcucaacuuagggaaacaaaaagccuguccaguguggauagcguugaauggauguccugguuugucugaugcagucuugaauuggaucuauauuccuaauaauuccauguagauggucuuuuauuucauacagagguuuucuuuuaaacagugcaucugugaucuuaucacacagcuguccaagaaauccuguacuuuaaccaugagccccaugagauagcucugcaaggacucugcuggagagucugcuguuuguuuuggcugcagaccaguauccccuagauaaaguuauaugacucaaggcugugguuucucuucuccauaacucuucucuguaccuaaaagguagcacugagaaauuccugugacuggaaucugccuuccacugcucuuagaagaauggaaugugguuuucuguuucuuuuuuuaaauauguauuuauuauuuuuguguugauaauuugugugccuuuuugaguuucugugucccgugugcauguaggagcuaacaggccagaagagggcgccagagcucuauaacuggaguuaccaggcaguuguaagcugccaaacaugggugcugggaaccgaacucagguccucugcaagagcaacaagcacucuaacaugggugagccaucaugcuaaccccaggacuuugguuuuugaauugggaagauaaucauaugugguuaguaacuccuaauuuaaaguuggcccucccugucacugucagaagcugccugcaggaaagugccaccuuggugucuuuccaccucccuuucugccccaccucuacguccuggugcuugucagucugucccuuuucugaggccccaccuuuccuuguaugucuuacucuaguaacaccuuugggcuucgauucuauucucuuuuuuuaauguuacauguuauuacauguuugcguugaaagcugaaauaaacucuacaaaugcuuguugacuuucagacgaaauaugcagagcucaaggaggugaaaucugggccagcagaugacucagcgaguaaaggcccaccaccaccacaccugacaacuugaguuuaauccccuaaacccacacgguggaaugagagaaccgaaccgcugugauaaaauacccugagaggcaaccugagggagaaggguuugcuuagcgcacaguuccagguuaugacccccaacucuggaugucaaggcagcgacguuaagcagcugcucauguuacagccacagugaagagcaaagggcacugaacuaaugcgugcuugguagcgcucagcuugcuuucucuacucuuacagaaugcaggaucucuguccaggggaugaugccacccacagugggugggucuucccaccucaguuaacauaagaaacacucugccacaggcuaaccugguuagacagucccuauugcaccccguucccagaugacucuagguuaugucaaguugacaguuaccugucacaucagagcuuugcuuuugcuuuuguuugccaagacaacguguuuacaauacgaugcugagauuuacugcaacaauacgguuuguuucccuuccgggcuuuguagcauaaaguaagguaugcaguguuaaugguuaacuggaccagugagcucgggugcccgcucugugugaucuaucugauucugaucaugucguugcagggcccacugucauucaaggauguggcuguggccuucucccaggaggaguggcagcagcuggacccugaggagaggaccacauacagggaugugaugcuggagaccuacagcaaccucgucuccgugggugaggaccacuugcuuccuaaacacugugaauuuaaaaugauuugucuuugaguuugaaggaacaagugcugacacuucguccuuucggguagauaucagguaucuuuacugcuccacugaaagauccuacaucuuucccccuugugguacuggaaauugaacccagagccuccugcaugugagcgguguuagcuacagcccaauacacaaaaggcucugguuuuacuuggcaaacacaggcaaaguguuauguaacuugugguggagcucccuauaccacagcgguucugcagccagugaguccaaacacuucuccuuuuccuguuaacaggguaugacguuaccaagccaaacaugauuauuaaguuggagcagggagaagagcccuggacaguggaaggugaccgccaugcucagaggcauuuggguaagugaauagagugaaauuuuagaaaguguuccuuuuuaaauuaauuuuguaggggaagcuucugaaaccuagugcuuuacagcaaaggaaauccagaaacgugcagguuuauuuguauuuggaauuaagagacaauuaaggaaaaaacuaugagggaagaagacaguagguuagggaaugugagucuccccagcagaaagaguggacagaaaggagauucaagacugaccggagugagcguucgcuuuauaucacaaaugucugagccacgguggaggggcaugaaacuuucauaauguuuuuacuaauguguggggucaaaaggcaaagauuucacugaaugugguggcucaggucuguaguuccaaaacuccagguaaggcaggcagauugcugacaguuuaaggccaaccugggcuaaauagaaacacacuguuucaaacaaaagcaaagauuucagaagugacuaagguguaaucucccaugagacguagacccauggacguaaaugcagaagugucuaagguauaaucucccaagugauggguuacuauuugauagaaauagcaaucugggucucccaaacacaggccauauuaaaacauuucuuuuucauauguccaauaauuauuuccccugcuucccuuugcugcgaguccucccacugugcguccucugugucugucugugucuggugcccuuucaguaacugugcuuccugcucaucauuucuuaggucaaaguuguaaagguaauauuuguaacguaaggugcuugcuuccauuguaaauugauucucuucccauuucuuacccacccugcauauacacacucagauuacagauuauaaaugaaaggagaaggagaccugugcauucauaauugcuuuuacucacagauugucagaaaauccgacauuuagguagcuuguauacucaugcugacagcauuuguuccaucucacuccuuuucagaaaucaguaaaguuuaugaccccagagaaggaauugaggaaauuggcgagaaacaucugcagugcgaugaugaucccuacugcuggagagcugagaagggggcugcuuuugaugaagccuacacccucgaaacagcccucauuucccccagcucaggugcucacagcugugucuccuguggggagacccuggagucuguuucagaacugauuagcagugacggaagcuaugcacuggagaagcccagcauguguuuugagugugggaaagcauacggagaaagccuugaagacuucaaccaagaugaggguaacuccucucaacacgaugaaaauauuuugcagaaagucaccauuuuggagaaacccuuugcuuaugagugcauggaagccuuagacagugaaaguguuuucauggcucgugagagagcuuacaugggggagaagcccuaugacuggggagacucuggaccagacuucauccagaugucggacuucaguacauauccgagaucacaaauggaacugaagcccuucgaauguacacagugugggaaguccuucuguaagaaguccaaauucaucauccaccagagagcucacacaggagagaagccguacgcuuguaguguguguggaaaguccuucagucaaaagggaacccucacuguacaucggagaucgcacuuagaggagaagcccuauaaguguaaugagugugggaagaccuuuugucagaaguuacaccucacacagcaccagaggacucacucaggagagaagcccuaugaauguagcgagugcgggaaguccuucugccagaagacacaccucacucuccaccagaggaaucacucaggcgagaggcccuacccguguaaugaaugugggaaauccuucucccggaagucugcccucaaugaccaucagaggacacacacaggagagaagcucuauaaguguaaugagugugggaaauccuacuaccggaaguccacccucauuacacaccagaggacacacacaggggagaagcccuaucaguguagugagugugggaaauucuucucucgggugucguaccucaccauacacuaucggagccauuuagaagagaaaccuuacgaguguacagaaugugggaaaaccuucaaucuaaacucugcuuucauuaggcacuggaagguccaugcagaagagagaguccaggaguguggcgagugugggaagccauccccgcugcagugugccccugaucacacaggcgaccuaggagagaagcgcuaugaguguaaugaguguggaaagaccuuccuugacagcucggccuuccauaggcaccaguccgucccugaaggggagaaaacuuacgaguguaauauaugcggaaaguccuucucggauucgucaugcuacacugugcacuacagaggucauuccgaagagaagcccuucgggugcagugaaugugggaagaccuucucucauaacucaucccucuucagacaucaaaggguccacaccggcgagaagccguacgaguguuacgaaugugggaaguucuucucucagaagucguaucucacuauccaucaccggauccauucgggagagaagcccuacgagugcagcaagugugggaaaguguucucgcggaugucgaaccucaccguacacuaccgaagccauucaggagagaagccguaugagugcaacgagugugggaaagucuuuucucagaagucguaccucaccgugcauuaccggacucauucaggagagaaaccuuaugaauguaacgaaugugggaaaaaauuccaccacagaucagccuucaauagccaucagagaauucauaaaagaggcacuguaaauguacucacuguagaaaagcucugacaugccaagguuuuuaaauuuuuuuuugguuuugguuuugguuuuuuugaaacaggguuucucuguguagcccuggcuguccuggaacucauucuguagaccaggcuggccucgaacucagaaauccgccugccucugccucccgagugcugggauuaaaggugugugcaccaccacugcccagugacaucucaguucuuaagaaaagcauuugguuauagugaacauuggaaguccaacagguagucaaggguggaccccccucaacccccccccccaauuuucaauauauguggugcugggauucugggccuuuugcaugcuauagacauucugcaagauucacgagcugagcauccacgcucuugaguguggaguccuaaaacaaaguccauuuuaacuugagcuuucagagaggaaucugugaagcaacccaugaccguaugacuuaugggacacuaggucaucuuuacaggagugaaccuuugaaaguauuuaauauuuauuuuuauuuaaaucguauuuacauaucagggaguucugcugugagcugucagcuccugaguauaacucgccuuggaaacgcacacuaaaagccauauuucugaccgacguuaccacggguguucauggaaaagaugcaagaagcuaugaguuccgaauaaacuuauaaaaugaagucaugaagccagcaguugagcaugagggugacugaaacacggcacuucugcuguucuagacacgcaauugaacagucucuaugcaauguuucgcaaucucggcuuugaaucauuugugagaacaugucagcaaggauuaaaaugacuguuacaguggguacaugggugggaugugcuagcugauagggaaguacauagcuuucuaugucggugcuuacccguagagugguuuuuguaaaaauauuuucaacuggaauugagcaaaaaaauuuuuuaaauacuauuuugauaaa

SEQ ID NO: 12353 - RNA, 12235 nt, Mus musculus
agacgcaccggcagggucgcugcagacgguggccagucuuaguucuccgaggcggugcgagaaggccggagaucggacgcuccucucuuagcuuucucuccgccaggucgacuccgagcagcaacacagacucugagcuucgcgccucaggggaagauuagagggcguagcggccuucgaaggcucggccaagaaccuuccgcccccucgccgccucggugagaacaaccgcgggucaucgcgcuggagguggggucggggggagggggcguuggguacacggggcgggggaagggucauuuggugagucucacuacuacuuccgggagacgccucggagaggaggacgugcuagggggcgggguuccgaggggagagacacuuaccucuuauccgauuggcuuauugcuugcugguugagcuuugcuaguugcugauuggccggccccaaagccaaauccaggucgcaggggaagcguuacuugaggcuagauugaggugagauuggucggguuccugaguccaguucguuuacuggaguagggacuucaucuuaacccuagucgggggccucgauuaacaggauaaggaaaagaaccaguagcgggauggugggggcgguugacaacgaagugaaggcuuagaacuaaacuaacuuccucaccuaacccuagcuacacccagaugggaacgugauacgguacgaaggccuuugagaaaggaggaggcgcaauccucggagcggugacaguguaggaggagagaccuucugggagguuuuuuuuuuuuuuuuguuaucuaauuguaugagucucuaauuaccuagaugaugguauaacagaaccuucuggagaauuuagcucuggcuuugcagaggagucgggagacuacuggguguuccgggacuucaaagaggcaguuugcugaauaauacaacuuuuguuuuuauucagaugagcagcucucaaaagaggcacaaacaucagaagcauggauacagucucaucuguuagaagaauguucaaaggaaaauaagguauucauuuugccuuacuuaugcuuaguuaauccaagaauauugccuuggaggagaagaucucugguuuuuuaauauuuuaaagaacuugacuuuuuuugucauuagauuuccacuuauuaaacaucuguuucaaaaaucaaguuucuaagcugggcgugguggugcacgccuuuaaucccagcacuugggaggcagaagcaggcggauuucugaguucgaggccagccuggucuacagaguguguuccaggacagccagggauauacagagaaacccugucucgaaacaccccccccacccaaaaaaaaaaaaccaaguuucugcugugaccaccaaaaaugcacuuugcuaauaguuacugauugcagugcaaauggaaauccuuuacuuuuugauauuauuaauuaaauuaacaucugagugaaucuugcuccccccaaggggucucauaugugugugugugugugugugugugugcgcgcacacacacacacauucuugaauguucuagaauucacucuguagaccaggcugcucuggagcacacagagauuagucugccucucuccugagugcuaggaaugaagacauguguuacuacaccuaguuuagugguugguuuuguguguuaacuugacacaagccagagucaucacagagaaaagagccucaguugaggaaaugccuccaugagauccagcuguaaggcauuuucucaguuaguggcccagccacuaucuguaaguggugcuucccugggcagguagccuugaguucuauaagaaaacaggcagagcaagccaguaaucagcaccccuccauggccucuguaucagcuccucccuccaaguucuugcccuguuugaguuccuguccugacuucuuccagugaugggaguguaaauaaacccuuuccuccccaacuugguuuuugguugugguguuucaucggaggaauagaaacccuaagacaacuaacuagcauugcauuuuaaaauuaggaggguuguuuguuuuuguuuguuugcauuuuuuauuugguuuuugguuuugcagacaagguuucacuguagaccagacuggucuuggacucaggauucuccugcgucugcuuccugaaugcuggaauuaaaggugugcgcuaccacccgccugccuaguuuauuuauuuauuuuauuuuauucauuuauuuauuuauuuuuggcuuuucaggacaggguuucucuguguaucccuggcuguccuggaacucacucuguagacuaggcuggccucgaacucagaaaucugccucucaaguacugggauuaaagacgugugccaccuccgccuggcuuuauuuauuuauuuauuuuaaaugcauccacuagucaaaugcaugugucaagucuuacaauaaagaacucaacauauaaacaacaacaaaacaacuuuuaggagcuaguaggucuaggccuuugcuuuaaaaguuaucaccaagucagacacaauucaacacauauaucucauaucugaguauuaaauugaucaucuucuuaaaauuuaucuuugucucucgaaauugugucuaaaagcauucaucauguuaaaauuuuaggcuugaauaauacauguucuugauguacagagggcucccucgugcauccugggacaguuaggaguacagcccacugucuuugugauguacagagggcuccauugugcaucccaggauaguuaggaguacagucuaccgucuuuguagaugaugauguccuguacuccuuccagaaaagauggugaauagaaaaugaccaccacugucucacugcaauuuauugagaugaaaauaauuuuugccuacugugucuacugaagacucaaaguugaugucucugagacugaaaaccaacaggaaacaacacacugugcauggcucugaggauugagaaaacacacaagagcucuggcugucuguaucaggccauccuucaguguggaaugguuagccucgggaguuucugguugugggggcuacauuugagugcuauccucgaagcagacuuucugccuuggugaggagacgaggagagggaacacugcuucuuagaaucuuagaauaucaguucaguaagucucuaaaggcaguggugaaucacagaugaagagauuguuaguggccuacaucgugaguucugggccagccaggauuacauaguaagagcuuaccucaauaaaccaacagccaaaucaaaacaaaaaaaguaggaagcauguuagcucaugacugaugcauugacuuugugcauguucuuuaaacaggaaacuagaagucucaggauggauccgucuagaucuagaucaggugggaguggagaagagagcucauuucaagaaaaugagagaagauggcagcaagaacgucuccacagagaagaagccuauuaucaguuuauuaaugagcucagugaugaagauuaucggcuaaugagagaccauaaucuuuuaggcaccccugguaagaaaugggcaaagggggaaauuuuucuaucauugaaaggagggauuuaaaguaaagagagugccucccuuugaguacuguuuugugagucugagaauuaugcaguauaacaaaaucacugcccucuguguuugauaaauacaugagaauacugaauauauagacacacacacacaggccaaacuuauaaagccaguguacauaagcauuaaguguuacacgcauaauucucacccuccacugccaacccucacuuggauugaaaccuaggguuuugugcauguuagggaaguguucugccacuaaacuagacucuagcucucuauuucucuuacauaauauuuguacaaagaaacuguuauuugaaacuuaauucuuaacuuauuugaaguguuaacauucagcuagauugugaccaaccaaaaguccaauguagucuauacauuuccuuucagauuuacuuuauaggaaacgagcugaaauaugccugucuguguguuuguauauuuguauguugguggcucacauaauaaaauauugugguagaauucaagcaccaagauuugaacauuucccuaaaauuacucccuaauuuucuuuuaaacuuaaacucgaugugaguacaucucauccuuuuguuguuguuuucaaauuaguuuuauuuuuugcuguuugucucugguggggggggggggguuguguccaugagguuaagguccaaggaggccagcagaggcuguagggucccaggcccucaggucuccuggagcugacauugagccccucagucugggugcuggaaacugcugagccaucacuccagcccuaacuuacagguucuuacuuagagguucugguaaccaaaauuauucaaguuuagaucucaauuuuaaugaaauauuaauaaaugacaugugacuaaauugauguguauuuguaucaaauauuuuauuuaauuuuuuuaguuuuuuaaauuuauuuauuuuauguaugugaguacaccauugcucucuucagacacaccagaagagggcaucagaucccauuacagaugguugugagccaccaugugguugcugggaauugaacucaggaccucuggaagagcaguuggugcuccuaaccgcugagccaucucuccagcccuguaucaaauauuauuaacuucaauuuuuuccaaagauuuauuuauuuauuauaugugaguacacuguagcugucuucagacacuccagaagagggagucagaucucauuacggaugguugugagccaccaugggguugcuguuaacuuagauuuauaaaccaugaaaauaauaaagaucauccucuguaaguuaagauuuuuuaaauuacauuuuauuuaguguguguguaugugugugugagagagugugugugugugugagagagagagagugugagggugugugugagugugugugugaguguguguguguuugugugugagugugugugugugacugacaaugaguacuuagaugcuacagaacaaccauagguaucuuuucucuccuacuaugugguucuuggaauucagguugucaggcuuaguaguaagugccuuuaccugcugagccaucucacugaccccaguugcuaaaguuuuuauuucacagguucucauaaagcuugguaauuuauuuauuuauuuuuuaaaugagugcucuuuuguuguuucaggagaaauaacaucagaggagcugcagcagcgcuuagagagagcaaaggaacagcuggcaucucagccuggcucugacagcgcggcaagugauggagguaguguggccugcacugcugcaggaggccuguucacuguuuccauguguucuucauuagauaacaagugugcuaagaacagucugcuuagggguuagagagcagagaaaaaguugagaaguguuucuuauacauaguuucucuucaucaaguuuauguguacagaauaguagaagcccaacuuugggacgccucuuucuguucuaccuccucucccagagacauucaucuuuaauuagguuguuaccagucugcugacugaagggucuuuugcucuaccugcauagaaacugugagugguucccagcuucucggggagacaacuaaugugauuuuaacauuaaauucagaaagugagauuucuuaagagaucaccuuccugaagccuuucugccccuaguauucaccgucucugcauacauuuuaccugugugcuaucguacacccucuuguuggcucucucccuucacccacccaucagcucuuuccagucucuugcucuuggguccuucaagguaaacacacacaacuaaagagaggaggacccguuucucugguucaauggauuguucccuuuaaguuuaugacaaaggcuuacauuccguguuuacaacccagccguacucaaguaaagccugagugagaccccuggguuauaaaauaaaagcaggacagaguaagagaaauaaugggagacuuggauuaucccucaguuauggacacuugcugccuguuacuuuagaugugaagacaagucauuagacuugccaucccuuugauugcccuaggguagaacauaaccauuuucaguuuguguuuuaguucuuccugucugucuucauaagagaguuugggugucucaauucccuuucuguccauggagcacuuugaauuuagcauugguguucuccuuccaaggucugcuagaauucuguaccgagucccucuaguccugggauggggcgggggagguugguugguuguuuuguuuauaaauuuuuuuuuuaauuuuuaguugagagauuuuuuguuuguuuguuuuuuguuuuuugagacaggguuucucuguauagccccggcuguccuggaacucacucuguagaccaggcuggccuggaacucagaaauccaagugcugggauuaaauuacuucuagcucacugcuaguuacauaucaguguaaauuauuuauuuuaucuuauguuuuuuucaugcccauuaauuguuaauauuauguuuagccucuacgagguuuguauuuucccagcuuuauuuuguaauacauaacaugggauguuguuucaaucuucuguauucacuaaggcuugcuguguguccuacuaugugcucuauuuuguacagaguacagugagcuacuaaggaauauguauucuuuuaagguuugguggaauuucccauagauaucuguuagguccguuugauuuaugauguuauuuaauaccagugucuguuuauauuuugucuggaugaccugcuuguacauaggagcacauuauuaaagccucccauuauugcuguguuggguuaaucuguagcuuuacauuuuuuaaaagguuuauuuacuuauuuauuuuauguauaugaguacaccaugcucucuuaagacacaccagaagagggcaucagaucccauuacagauggcugugagccaccaugugguugcuaggaauuaaacucaggaccucuggaagagcagucggugcuuuuaaccacugagccaucucuuucuuuuauaugcuuggccacaucucuguuugauguauguguuuagaauuguaauaccugcuugguagauuaaagaggguggugugaccuucuuuuuuuuuuuuuuuuuuuuuuuuuugagacaggguuucucuguguagccccagcuguccuggaacucacucuacugggcuggccucgacuucagaaauccaccugccucugcuucccaaguguugggauuaaaagugugcaccuccacuacccagcaauuuugucaaaugcuaaaauaguuacauaucugcuuguuucuaucuuguaugugcccagaguacuuuuccaucuuuuuacccuauggagaugucuauucucaugguuaggcauguuucucagaggcagcaaaaagguggauccuguuuucuaaucuucauagagugaacugagauccauuuguugaaagauaaauauuaauuuuuguccuuacggugaauuuuuagugguaaauaccuuuugauauccugguaucauuuaucgccuguggaauguguuuauccuucucuucagucugaaauauucuuucuacuauccucucuagagcuggcuugguggucacaaauuauuuuaaucuguuuuuaucaugggacauuuuuauuuuucguuuauugaacaguuuugcuggguauaauauucuggcuguaugacuuuucagaacuuggguaaugucuuucugagacuuaauccagggacuugacuacugugauaggccugccugugacuugggccuucucucuucacagcuucaacacccuuuccucagccuucucuuuuccugcuuuaacuggaauguguugugucacuccuuuuuuugcccuuguuguuuaagggugucucucaagauuuggggaauacugcugggcuuggugguacacgccuuuaaucccagcacuugggaggcagaggcagguggaucucugaguuugaggccagccuggucuacagagugaauuccaggauagccaaggcuacacagagaaacccugucucgaaagaaaaaaaauugggaauuuuucuccugugauuuuauuggaaagguuuucuaugcuuuugacuuggaauucauuucuucucccccacccccacccucacugucuguaauuuauaguuucaauuucuaugaugguuuccaaagauccuacaagucugcucaugcuuuuuuuuuuuauuuuucguuucuaguuuucuuugagugggugguccaauuccucuacccugccuucaaguccugauauuaccguagucuuguccaaaugaucuacucugauugugaggcuucccaccgagcuuuuauuuaacuaccucuucauugccagcuucauuucagauuagauuuuguuuacucuucugucucuuuuuuagauucuauucuccuuuguuucauuuagcugugugauugugucuucuggggcuucuguuuauuccugcugcuaccaguucauucaaguauuuaucauuguccucuugaaauucuuuuuguuuuguuuuguuuuuuuucaagacauuaucucuuuaaaaucuuugaacucuuugauuguguuuaauucuuuagacauuugugccugaaaaugguucuccuuggaaccauugcacugaugggcuucccaggaguuuugugugguuuuggguuuuguugugguuguuuuguuuuguuuuuguuuuuuuuagcagacauugucuauauauauaucgcuuauuuuugcaaugaccccugagcaucuggaauuagguuguuagaugugucuuguuguguguuuucaguacccaaggccagaaucacaaguuggucugagugcccaagggaguucugaggggguagagcagaagggaagagguuccucacuacauccccuguggaccagccacagggauggagauagcugguggggguucugaaaguaggggagggguggagccagguugacaaagguugccuuaccaaguuggggcugcagagugagacagauggccacagggagaauugcuuuauggggccccacaagucugggcugcaccuuguggagggaguccugauaaaguuccugucuagaaaguagauugugugugugugugugugugugugugugugugugugugaagacaauuuguguacaaggcaguucuuccaccacagaagaacuggguccugggaauccaacucaugaugguuaggcuuggcaguguguguccugucauaggcccagcaauuuaauuuuuguugugugcuuuuaauaaacuuuuagaaaguuugauuuuuuuuuauucauuaaaauaaugcagagccugaguuuaacucagcacaacugucuuccuugaauguuuuaauaaagaucugaagucuugcuauagaacuugaccuuaaauuguuuugauucacguuccagacucagaaagccuuagagcacauucagaugaggacucucugcugcgauggcugaauaccuuucggcgcacugggaaugugacucgaagcggacagaaugggaaccaaagcuggagggccgugagucgaacaaacccgaacaguggcgaguucggguuuagccuggaaauccacauaaacccugacaacagagguucugaaaugcauggagaggacucgacggacaucccucugucagguguuaacagagagcauaggcagcaaagaccaucgaguccuguggcuaggcgaaccagaagccagaccuccaugagcuccagugguccuaggggcaggcguggugcgaggaggcaggguucugugcaagggucauuugcaacucugggaagguuaaggaauggaauuggaguagcccuugguguucccagaguuagugccccucgcacuaauguuauuaauucccacaccaaccagucagaugguaguacucucaggcaagguggacggcagcgguuuggagcagcacauauuugggaaaacggggcuagaaguaauguuacagugaggaacacaaaccaaagauuagagccaauaagauuacguccugcuuucaguagucgaagccggucccccauucagagacagaaugguacuguucaucauaauucccaaaggcaggguagaccaguacagcaaacggguagaaacaggucuguuaggcacagagguguaacgcgggucuuuuuagaacaagguagagaacacagaggcacugauuacaccccgcuguccaacucaagacuugugucaagaauaacaguagaagagggagagucuagcagguccucagcugccacccagcgucauccagcaaucacacuggaccugcaagucaggaggauucggccuggagaaacuagagauagggauagcauugcaaauagaacccgaucuagggcggggcuggcagaaaguacgguugagagcaccagugggggcuuccacagaacuaucucucacuuagagcgcucagguguccgaaccuacgugagcaccaucacaguuccucuucgcaggauuucugagaaugacguggucgagccauccuccguggcucuucggucaauuuuaaggcagaucaugacuggguuuggagagcugaguucucuaauggagguggagccugcgucagagaaucaaagcaauggccaacguuuaccagagguguaccuagaacugaguaauggagaugcagccgaugacaguggucagcauggaagagcguccucacaggccagucaggcccaggacggugcugaaaugcuagcugugagggagcccgccccgccccaggcucgccccaguggcaguagaaguagaaggcaguuaggaagggcggacagcguaguugaggcuggaacauuacccauucugcgccuugcucacuucuucuuacugaaugaaggcgaugaugauccaauucgugguuuaaccaaagagcagauugacaaucuuucuaccaggaguuaugaacaagacgggguugacagugaguuagguaagguguguagcgugugcaucagugacuacguggcugggaacaagcuccggcagcugccuugucugcacgaguuucacauucacuguauugaucgcuggcugucggagaacugcaccugccccgucugucggcggccugucuuagaauucggagccacaagcagugggugagagguggggucugcucagcgcuguguugcuggagcuucauagucaaacgcuuuucuugaguuacuugugaucagguaaccaaggcaaaaaaaaaacaaaaaacaaaaaaaccuaucagauuauaguuugcacuauuuuuugugugcuuuuuuuuaaaacuuguuacagaguuuguuuauauaaaaaaauuuaaaaugcagauguuaaauuauccaaaaguaaagaauaguuaauauugcuagaaccaaauaaccuuuaaaauguuuuuauuuugguaauuuugucaugcuaagcacuuuuguauguuagggaucuugagucuuucuccuaauacugcaguagggauggcugggauuuuccaguuugagcucagugcuuuguuuagacacuacugucuggucuuuguagacuguuagggugaaugucugcuagauagacuuaaguuacuugaaaugauaauuuaacuuguggcacacucuauguguguaugcagguauguaacugugggaacauauccaggcuaaaaacucuaagcuugagacuuaagcuucggggcuuagacugcauaugguacaguguaaacagugacaagaucaucuccacgaggaagugaauuaagauacaguuuuaagauagagauuguuuacugaagcgugucugacaaucugacuuaauagagagcgagcgacauacaauaaugaaccuaguauuucuuuauucauggaauguggaaauuuuaugacagguaguuuuaaguucgucuuuuuugugauuuuuuuuuuuuagaaguacaaauacuucuugggguuagguaggguuuacagcaugcuugauuuuucaaaguuaguuuuaaaaucuaaaauacuuuaaagucuauaaaguagugaaaugcauagaaaauauguaaauuuggaugcccaaaagcuccaaauaaaagccuuuaaaagaacauagaguuuauauaaacacaaaguaugcauuaaagucuauuucuaccagu

SEQ ID NO: 12354 - RNA, 2657 nt, Mus musculus
aggaggcgccagaggcagccaccgcgcucccggagcucuuuaaaauccaagagccugggcagcaccgcuggccgcgccacaucccggcgcuguuguguccgcgcguauccaggcggcucucgugcaacgcggucucgggacgcgcccaugcggccgcucaccaugucugggcacuuucugcuggcccccaucccggaguccuccucugacuaccuccugcccaaggacaucaagcuggccgugcugggagcggguugugugggcaagagcgguaagugggacaaaggcgcgcaaagccgcccagggacagcggagggucuucacccgcagggaugccgggaugccgggaugccgggaugcaggaagaccccugccuguugcuucagagguccauuucugagcucuggacgggguuggugccuguugagugucgcucuaguccgguccaucacauuccgcggggaaaggcacuccgcgguggcggggcuuugucccgggaaccuggggggacgcgugcuguuccuuugagggcccaguuuggaacagcuugacccacuucuucagcugauuuuccuacuuuauuuuuucagcaaugauugugcgcuucuugaccaagagauucaucggcgacuacgaacccaacacaggcaagaauguuuccgugcuuccuggcucuuguacuuguaucucuuugcccuccccaccccucucucuuuauuuugcucauggggccgugggaacuuagaugcaaauuccucuucguuguacaggcaaacuguauucgagacucgucuauguggagggggaccagcuaucccuacagauccaggacacuccgggaggcauucagguaaggacugucaggaggguauguggugcaggcugagguguuuggcuccaggaucucagugagaugucucagcaugcccaauauguaggugugggcacacaaggugugcugaggguugggauguuggaugcccuccuagguggcaagaaaugguugauuagaacuaguuuccucuuaaaugcuaauuauaauuaguuaauuauuuuaaagauugcuguguagcccuggcugguuuguaguucagguuugcuuggacuccuuauaaucuuugaugccucagccucccaaguguugggauuacaggcugagccacccccucccagcaguagcccugacugaccacuggugcccgagcugccuaggcgggcgggcauugacacuuucagagcacauccugggacaaucuaaaaaccacagccuuggaacuaaggguccaguucaguaguaaggauuccuggguuccagcaccacacugaaaaaagcauggaguaggugggauucuggagggagugggguuugcguccuggcuagggcugucccccucucccccccccaaaaaaagcuagggaauguuuucucaagccaguaauugcaaucagauaaccuuuuggcuaucacuguggaaugcaacuuaacuaauugcucagcccuucuagggaggaaaagguugaguggagagcccagagaauggaauuuguuucugcaacauucucaagaaguugacugcuaaaaauauuuuuuuaugggcuugggaauagauauuuauguugggcuguuuccaggguuuuguuuguuaugaauuaguucccugaaaacgaagccguucuggucuguaauuauucuuaagugguuagaguucacuggagacugccuguggaaaaaguagguuaccagucuacauccaggccagcucagaaaauaauccagguugagcacuugucugaggcuuucugcagaaagccucuuguagaagcuagggagagccagacagcaauacucagugaucucucuguccaguguuccuacaggggcuacuccggugucauguuugagcuucuuugaccagauuccauuuuguuuuuucccaggcccaagacagccucagucaaaugguggauucucugaccaaaagugugcacugggcagagggcuuucugcugguuuauuccauaacagacuaugagagcuaccaauccauccggccccuuuaccagcacauccggaagguccacccugauggaaaagcccccaucuucaucgugggaaacaaaggagaccuuuugcaugcccggcaggugcagacacacgaaggccuucagcuagcuaaugagcugggcagucucuuccuugaaauuucuacuagugagaacuacgaagacgucugugauguguuccaacaucucugcaaagaagugaucaaggugcacagacucgguggggaacggaggagggcauccgucauuccccggccucgaucccccaacaugcaggaccugaagaggcgcuucaggcaggcccuguccuccaaagcgaaagcguccuccgcccuggggugauccagcucagauagacuggcggguugcuauuauuacuacuagacauuugugcagccacaaagacuggcccuuucccccuuuaaaacauauucagaguuuauuuuuauaaugacuuuauuggcuuucaaguguauguauauuucugaaaauucaaacaauggauuuuuuuuaaauguguuuuuuuuuuuuuguuuuuuuguuuuuacuguaacuguuagccacucuuccauuaaaggcaaaauggcaauacu

SEQ ID NO: 12355 - RNA, 69750 nt, Mus musculus
auuucuacaguagaaaguuuauuuccauccauaaaauauaucacuaaauagaugaaaaaguuacauaguauuuuaaaacauagauuuuuaaaaaucauauuuagcuuucccuuagcaaaaaacggguuugguuuguuucacguauuuacaagaauauacuauauuucagauacauggcuuuccccucaagccuggggggccuggaaaggccccccaggguaggcgggcucaccaacaagucucauuauuggcucucccaccugugcgaggagagguuugauuuuauagaagucacuuuggaguaauggcagacagcaucuagagaaaaguccagcgaagcaacggccuguagggcgcuuccucagaggcgaggcuaaucuuggcucuguggucuacagccugcuaggguggcgggguccaaggccuccucgcuaacuucuuucuccgugaaucuucaccugggccuguggcgauggcggcucugagccugccucucugcugaggggccgccuguuuugguagauggauggauguucugggacguugccacccauguucugauacaucuggaaagggggagaagcagcaagaaugaccagcugagcaggacucgcccgugugccuagaaagcacaguacuuaaauacaccuuacuuuuauacagaucaugaaauaugaguuuaggggcuggagagauggcucagugguuagaacaccugcugcucuugaagaggaccugaguuugguucuaagagcccaugugagguggcucacgauugcuuguaacuccagccccaggggauucaacacccucuucugauuucugagggucccuguauacacuacuacauguaauugaaaaguaaaauaaucuuaaaaauauaaaacuaugaauuuggguaguuuccaggcuuguuuugaaguuuuauuuacuuuaugugcgcaagugugcaccugucaguauuugaaugcagugccugcaguggccagaagagggcgcuggagcuccuggaauaggagguauaggugacugugagcuacccuguuuacugggaagugaacccugauccucugcaagagcagccaguggucuaacuacugagccaucuguccaguccccuccauggguuuuguuuuauucugaaacagcagccacucauuuuuuuuaagacuaaaucuauuuauuuauuuauuuuuauuuauuuauuuguuuauuuauuuauuaauuauauguaaguacacuguagcugucuucagacacuccagaagagggagucagaucucguuacggaugguugugagccaccaugugguugcugggauuugaacuccggaccuucggaagagcaguuggguguucuuacccacugagccaucucaccagcccgccacucauuuuuaauaaaaaguaggaaaagggcagauggcaggugauuuguccuuuacagaacuaucaucccacaagauguccacauuaaagucuaaaguugcaaaugcuacgugagacauuagugacauuaaagucacuaaugugagacauuaugugagucacuaugugagacacuagugacggaggcaggaucugaaccugggcucugaguguucaaggcuccacccuuaucuggagcagaccucuccugugcuaagagugcuaagaaggaggggcuaauaccaagauccugcugcuugaggaucaguuaccuuugcaacccauuuuacagaugggaacaccgaggccaaagaagaaacuugccaucguucagaucaguggggaaugagcagcagagacugaauggguccucagggcuuugggcuaaagcccuucccauccauacccacccucacaccauguugacuuagaaaaggccaguggcuccuggaggaguuaagguuuauuuaguugucuagcccuuugcacuggacccuuaagagcuuuuaaccuauuaaucacuuggaugaaaucacaggaaagccccgcccccaagcccacaccagauaguacgccuucugcacaggacuguggaagaguaaucuaggcaaagugaggugagaaagaugaucggccuaaaccagauaugaggccauuagugccggugugacacccacacaucucccuggggaccguuaugauuaagccaagccuccacauaccgcuucuucugccucugccagcugacauccuaaaaaugaagucagguuggggaaggauggccgcuuccuugagucaaaagcccagcaggauugcauuacaaaguaucugugagagagcaaaucagagcagagcugagggggugugaaugaacuuggcagggcuccacccacaguucacacccagggcagcauggggguggggguggggggugggggcugugcacugugcgcugcuggcuuugugggaagcacggacuagaauugguaccacaccagagagugaggugaagucaaauccucagguaccacaagcagaagaaugaagccuuggaggcugcccaagagggcgcaagcuaccugaagcuugcuugcuuucucucucucucucucucucucucccucccucccucccucccucccucccuuccuuccuucuuuccuuccuuccuuucuugucuugcuauuagcacagauuauccuacagccucauaccucuggaguacugggauuauaggcaagugucuccuugcccuuccugcccccccccccaauuuauugauugauuggcgauuguuuuuuucaagacaggaucucacuacacagcuuuggcugucgaccaggcuggccucaaaucacagagaucugacugccucucugcuuccucgcugugggaauuaaagguggaugccacuguaccaagaugucucugcuuuuaaacagcaaacaagggccggagagauggcucagcgguuaagugguuaagacugcucuuccagagguccugaguucaauucccagcaaccacauggugguucacaaccaucuguagugggauccaaugcccuuuuuugguaucucugaagauagugacaguauacucacauacauuagauagauagauagauagauagauagauagauagauagauagauagauagauagauagauagauagaugaauaaauaaauauaaauaaauaagaucucagcaaugucguaggaaaguguguuuuaaccaggugugguggcagugcacauuuuuuaaaauguauuuauuuauuauauguaaguacacuguagcuguccucagauacuccagaagagggcaucaguuuucauuacguuugguugugagccaccauguaguugcugggauuugaacuaggggcuuucagaagagcagucugcgcucuuaaccacugagccaucucaccagcccagcggugcccauuuuuaauaacagcucucaggaggcagagacagcuggaucucugaguuugaggccagccugguuuacagagucaauuccaggacagccagggcuacacaggggaaccuuggcucaaaaagaaaacaaaacagaaagaagaaacaaacaaaccaacaaacccagcaagcuuuuguuuuugcaaugcauuuggaggacuuagagcauaugguaaauguuugauacccaaccccggucuggcuguacucacaucccuucuguggcauagaauggcugcuccauuuuaaauccacucugaaucaguuuauagaaguuagcgucgacaggaaugccaggguaaggguucacaccugagaaaaacaugcgcucaguggggccucacaaacacuguucuuccuauuugucuauuugguauacauucugucugaaaacaagcaaagagaauuccccagugccagacccacccuguacugagggcugcaaguggauccagagggccccaagccucuuaaucaauuacagagugugggaaagaaagaucucagaugucagcaaauaacucuggcaacagaggcaagacuagaagcuagggucuugagugguguguuaaccgcccuuggcuugcaggguaaaggaaggguacagaggggugggggacacaaagccagagcccaaggaggccugcagagugccacacauacccagugaaaauaucucccagagaaggaugccguaggaccagacgucacucuugauuguguagaucccuucaaauaagcucucaggugccauccacuucaccggcagccgugccuguguacgaugcaagagaggcuggugaaguucccccacaugcagacuuggagauuuuuuuaaaguuuuuuuuuuuuguuuuguuuuguuuuuaauuuuaugugcauggguguuuugccugcauguauguaagugcaccuuaugcauacagugccagaggcugccaggagugggugucggaucccuugaaacugacauucuagauggaugugagccacuauaugggugcugagaacugaaccugggucuucagcaagagcagccagugcucuaaccacugagccaucucuccagccccucuuuguuguuguuagaugauaaaauuuaaaacuugaggccacuuaaaaaaaaaaaagauuuauuugguguuuugccuucaugucugucuguaaaagugcuguguuuccuggaacuagaguuacaaacaagugugagcugacaugaaggugcugggaauugaacccggaucggcuggaagaacagccagugcucuuaaccacugagcugucucuccagccuuuccaaguuuuaguuuuuguuuuccauuggaugacaauaucuacuuauuuauuuauuuacucaacuuauuuuuguuuuucaagggaggguuucuucauacacccguggcuguccaggaauuggcucuguagaccaggcuggccucaaacucacagagauccaccugccucugccuccugagugcugggauuaaagguguaugccaccauugcccagcauuagaugauaaaauuuaaaccuaagaacacuuuuaaugcuugauauggaaaaggaggauaugaucagguggaggaggagagcaacaccuguuccaccaccagaaguaacugggaccagcaggagggacccaggcacccaggaacaccccaggaucucagaaucccagaaccacaggaucccagagacagcugaacuccgagaagcucugauacaacuaggaucacaggaaggacaggcuccagucagacauagccagggcagguagcgcuagagauaaucagauggcaggagguaaguguaagaacacacgcaacagaaaccgagguuacuuggcaucaucagaacccaauucuuccaccauagcaaguccuggauacacaucacaccggauugggcucuaaaaugacuucuccugaugaugaugaugauagaggacuuuaagaaggacauaaauaucucccuuaaagaauuacaggaaaacacaaucaaacaggcgaaggaaaugaacaaaacuauccaagaucuaaaauggaaauagaaacaauaaagaaaucacaaagggagacaaacccggagauagaaaaccuagggaagagaucaggagucauagaugcaagcaucaccaacagaauacaagagagaaucuuagguauagaaaauaccauagaaaacauuggcacugcaguuaaagaaaacgcaaaaagcaaaaaagcuccuaacccaaaacauccaggaaauccaggacacaaugagaagaccaaaccuaaggauaguaguuauagaagagagugaagauucccaacuuaaagggccaguaaauaucuuuaacaaaauuauagaagaaaacuucccuaaccuaaagaaagagaugcccaugaacauacaagaagccuacagaacuccaaauagacucgaccagagaagaaauuccucccaucacauaauaaucaaaacaccaaaugcacuaaacaaaggaauaauauuaaaagcaguaagggaaaaaggucaaguaacauauaaagacagaccuaucagaauuacaccagacuucucaccagagacuaugaaagccagaagauccugggcagaugucauacagacccuaagagaacacaaaugccagcccagacuauuauacccagcaaaacucuaaauugccauagacagagaaaccaagauauuccaugacaaaaccaaauuuacacaguaucuuuccauaaauccagcccuacaaaggauaauagauggaaaacacuucacaagaagagaaacuacauccuagaaaaaacaagaaaguaaucuuucaacaaacccagaagaagauagccacacaaacauaauuccaccucuaacaacaaaaauaacaggaaguaacaaucacuuuuccuuaauaucuauuaacaucaauggacucaauuccccaauaaaaagacauagacuaacagacuggauacauaaacaggacccagcauuuugcugcacacaggaaaugcaccucagugacaaagacugacacgaccucagaguaaaaggcuggaaaacaauuuuccaagcaaauuguuucaggaaacaagcuggaguauccauucuaauaucgaauaaaaucaacuuucaaccaaaaguuaucaaaaaagauaaggaaggacacuuuauacuggucaaaggaaaaaucuaagaagaugaauucucuguucugaacaucuaugcuccaaaugcaagggcauccacagucauaaaagagacuuuacuaaagcucaaagcacacauugcaccccacacaauaauagcgggagacuucaacaccccacucucagcaauggacagaucauggaaacagaaacuaaaucgagacacagugaaacuaacagaaauuaugaaccaaauggaucuaacagguauuuauagaacauuucauccuaaagcaaaagaauauaccuucuucucagcaccucacaguaccuucuucaaaacugaccauauaauuggucacaaaacaggccucaacagauacaagaagacugaaauaaucccauauacccuaucagaucaccacagacuaaggcuggucuuaaauaccaacaaaaacaacagaaagcacacauacacacagaagcugaacaaugcucugcucaaugauaacuuggucaaggaagaaauaaaaaaagaaaguaaagucuaucuuuuuagaauuuaaugaaaaugaaggcacaucauaucaaagcuuaugggacacaaugaaagcagugcuaagaggaaaacucauagcucugagugcuuccaaaaagaaacuggagagagcacacacuagcagcuugacagcacacaugaaagcucuagaacaaaacaaagcaaauacacccaagaggaguagacggcaggaaauagucaaacucagggcugaaaucagccaaauagaaacaaaaagaacucuauaaagaaucaacaaaaccaggagcugguucuuugagaaaaaacaagauagauagacccuuagccugacuaaccagagggcacagagacaguauucaaauuaauaacaucagaaaugaaaaggagacauaacaacaaaauauaucuuaaaauaauuauucugucuguugaauauuaaguugaaaauauuaaaaucauguucuagaaaaaaagaaaaaguagaagcuuuuuagaaauacguuucuuaucuaucuauccaucuauccacccauuaucaucuauuaucuauauuuaacaucuaucuaaguaucuguuuaucuaucuaccugucuauaccuaccuaucuaccuaccuaccuauagcuaucucucucucucucucuaucucuaucuaucuaucuaucuaucuaucuaucuaucuaucuaucuaucuaucuaucauuuguuuuccuuuuuuuuuucuuuucuuuuuugagacaggguuucucuguguagcccuggcuguccuggaacucacucuguagaccaggcuggccucgaacucagaaauccaccugccucugccucccaagugcugggauuaaagacgugcgccaccaccguccagcucaucuguuuuucuauuuugagacaaggucucacuauguagcucuggugacauaagcagaauagggccucaaacacacaaaucaaccugccuuugccuccugagagcuggguuuaaaggcguagggcaccacuccuggcaaaauacacuucuuuaaaagucaucuuggacacaggcuugugcuugggauuggcaagugccguagcgaugccguucguucguuaaggaagagcucuguauuugcucagaggucgacaaguucaaggccgcggggagaaucauuuacgggagcuuuccucagaacugagaagcaucgcccucaaggacuuacgugaucaugccuagaguaaccauagcugcccuccggggcuugaauaacuuccagaggcgggacaggggguuggccucuguuugcacaggcuuugauuugcaucaggacacaguggcugguuagcuccuggggcacggaguuuuguucugauuugguuccaguaggaaccucauguguuuaauuggccaggcuaaagaagagccccagaaggaaauccucuuuuaaauccuaugcaaauggagucacuggcccaaucugugguccaggcuggguuaccugauucauuaacagaagguucugaacggaauucaccuucccacaggagagcccacugguggggugaaaaccccauaagcacacagagaggucaguguacuguaaccacagccagcgaccaucccugggaaccggcucuaagccaccugagaugagcauucauuggaguucucauuuuggguuaaagggcuaugucauugauuguauugguugguuucugagaaccuaggaaguaaaaucagaauccuguaggaaguuagucaggaggacaccaccgugaacgacagggaugcaggcucugcacgcucacauccacacggggcaaguuagcaaccgcgggcaaguugcuuuucuuugucucaauuuccucuucacagaguggguauuuucagaccgaagugaguacugagagugucgagcagagaggaggaacuggggcagccugggcugcugucauuucauaagcagggaugaugguacugagacuccccucccccuccccccugccccccucccccagcacuggcugaacacacagcaccagggggacuugcaccaagguguccuaauuccuucuuuuucuuccucauucugaggcuugaaccaaagccucgcgaaggccaggccagagcucuacgccugagcucuucagcccuuacuguucauuucauucuuucuuucuuuaaaaauuugaugccagggggacaugguggcagcgcacauccuuagccccagugcuccagaggcagaggcagaggcagaggcaggcagaucucugucugaguuccgaggccagccuggucuacagagugaguuccaggacagccagggcuacacagagaaacccugucuugaaaaaugaaaagaagaauaauuauguuuuuauuccugugcaugugugugggcgcugggggagggugcaugcucggcacacaggugaaggucagaggucaacuuauaccauuccaguuuuuccaccauguguuuuuggggggcaacuccagcccucaggcuugguagcaacuaccuuuaccugcugagacaucucacugucuaucugucugucuaucauugucuauaugucuucugucuguuuaucuaucaaucauuugucuguuuaucuaucuaucauuuucugucuaucuuucuuucucucucucuuucuucccuucuuaaacauucauuuuuugccucaucauacuuugaauugauuuucacuuauguguaaguaugugcacaugagcacacauguccaaagaggccagaggcacuagauuccuuggagcuggaguuauagaugcuugcgagcauccugccgugggugcuggguaucaaacuuggguccccuggaaaagcacucuaugcucuuaaccacugagccaucucucuggcccccucacauucucuuugaacgaacacaugucaguuauguuguauuuggagucuuccugaacucuucauauaguaacaggguaacaaacgcuaccaguuaacuacagcaccuuuaaacuuuauagugaauaccugugugcugccuguucagaaaaaaaaaaaacaaaaagcuuuuuauacaugcuagcuugucucaugaucggaaacauaaaacacauauaaagccacuuuauagcuaaggaaaccgaaacaggucugaguaagggcauuuuuuuuuucaggugaagaucucaugccaaccccuaauggaucuguucugaguggccagccccccagagaugcguggcuauuuugcuuagcucuuagugagcacaaaacaaucuuuucagccuaaagaagugaagcacugggaguuuuuuuuuucuccccuuggugucaccauaaaucaaaaacgcaucacagagagugcagguguuuccuguacucgugacaaaaagcaaacggcucacguugccccugacgacguagcuggagucgcucaggaugucucgggccaguccaaagucacagaucuucaccaccuucccgugggugaccaacacauuccuggcugccaggucucuguggacacacuggaagagagaggcuugaaugacauggucugugacuuacaccuucagagagagacucacaacaguuacagaggacagagacccaugacugucauacaucccgagaacacuggcugaguccuaaguuaacucagcugcagucaucugaggcaucccuggagcuaugagccaaagaagugccaaagggggccuucgccuagcuccagagacgcuucuaacagccggcuuccugugcgugcgugugugcgugcgagaacagaaucccuuuuggauaaagaacuggcuuucagaauaaaagugcaucauaucugacaggccuaguggugcagauccauaaucgcagcacuggagaggcugaggcaggaggauuucuaaguuugaggccagccuggacuacacauagaggucgugucucuaaaugaauaaauagauuaagauugaagaaagcauucagaagaagugaguuuggggggaccaaagagaugauagcucagugagaaaacgcauuaaccauguaacccugauguccugaguucgauuccugggucccacaguggaagaauuaacucccacaguuuguccucugacuucugcacacacacuacgguacaugggccccacauucucauacacacacacacacacacacacacacacacacacacacacacacacacuugcuuucacaugcacauacaggguacagggggcagacagacagacagaagauaacgaugaguuucgaggaguacaugagaguagagcccagagucucugaagggaaugaacucuguaagagagcacaugguguccauggggguccacuacgcucuccucagccuuuaaaagaacaaagccuauaaaaacaggaaugucugugccgugacuccugcccuccuucuccaagucuggcuuucuucauguggcaucuccuagaugucuguccccauccccaucauguccuccugacuaccugcccugcccguauucuucccagcugcucugggaaggcuccuucugaccagcaagaaggcugcccagccuggacuggcuuugacuagucccucucccucuggauuccauccgagggaggcucucuugcucucuugccuguuccucaccccuuuuuccuugggguagccaugcuaacuuuagugacaguaucaaucacaagacacugaucugauguauaggucugcuugucuuucuccuagaaacauaaaaccugugggcccugaagucacauccucauugguuuucugccccagcacagugucgcauggagccacacaaaugugugacacagucacagaguggggaagagcacagugcuuggcaugauuggagcagaaggcugcagugaagacaaaccgucuaaaaacuggaugcccggggcuggagagaugguucagugguuaagagcacugacugcucuuccaaagauccugaguucaaaucccaacaaccacaugguggcucacaucucauccaugagaucugaugcccucuucuggugcgucugaagacaguuacaguguacuuagauauaauaauaaauaaaucuuaaaaaaaaaaaacuggaugcucuucaaaaguccaugucauaacacaccuaagaguaaaaauaaaaaggccugcuguaauuagagaacaugaacaaacugugcuggauuaucuaaacuggucauugcggcucggcagcacgggggacagagaauuucuggauucugaggucagaagaccugccuaacaccugggccacgccuucugguggcagccauagaggguaugaaggaggaagcguuugcauuuugccugcuugccuucacucuuacuggcaaguccaucugcucugcugcugugguugcuuucucacugacuucuucaggaucccaauguagacccaggaccaccugcuuucuaagacuuccccgggacuccagauggggauuucugagacauccagucucgugcaccuuguuggauuacaugaacugcugccuguaagccgcucuaacaaaucccccauauaugcguguguguauguguguaugucugugcauaaaauauuuuuacauagagaguaaaacaauauauaauuuuauauguauauauacuuauauauauaacuuuuuaaauuuuuacuuauuuauuuauuuuauaugaguacucuguugcucucuugaaacagcagaaguggucaucagaucccauuacagaugguugugacccaccgugugguugcugagaauugaacucaggaccucuggaagagcagucagugcucuuaacuacugagccaucucuccagcccuauauauaacuuuauaauuaaaaauaauacauauauauguauuauuuuuaauucuaucaguucuguuucuuuagggagcccuaauuaacauacuaccccucugaaacacagacaucuuuuccuauggagaaacuuaguaagauacaccaaccuagcccuuccuuguguuucaauaguuuguguaggugcguacacagcuaaagauguugucucccccccccccccccccgcuaaucuguuuacuaccauguuacuucagcagacauaaagauuugaggcuuugguggcuuauaguguggaaugacaggggacagcggguggagaagcagcauugccuagcgcagcacgaggaggucaugguuuggggugggucccgcagucuuccugcugcagcacuugugaauacagggccagccacugagaagagacagguuccacagcgcuguggcuagccuaggcugaaucuguucaggcuggcuggcugggguggcagagcuggugaacuuugggccucugcucaugcccccgacugcagggaacaacccgaaugaaucccuguauuggcagggaugacgauacugugauacugugcuucuuucaguauggcuuuucugggacuucccuagacaucccacgggacguuggcucuaaccagcgacucugggccuucgugcugcagguaugaaaagaauuaggggaagcagggcagacagcaagggaggcauguuaaaaugaccauggaacaaacguagacacacggcucauucaaagcugcacgcaugcauuccuuucugcggcucuguguuugcgccuucugucgguuuucucuuuaaaagguacuuaccgacuugaacuccaggaauuccaugccuuuggccacuugguacgcaaagcaaaggaggucuucaaacgucagcacguucaaaucuuccuccucuucuucugccagccucuucugguuuucauauucaaucucaucuguaaaaagacguccacuugucacuuuccccagacacuaggcaguacccuaucagaccucugugagaggcagcuaaggcgaccucaguguggagauauuuauaagaggcguuugaucugaucuccugcucuagacucaauagaccaaaucgaauggcgucacccagacaaaagguccgccauacaaagagaaaggauuauuugaccuucggagaaauccgaagcaaccaucaaaccuucugcgcaggccagguuccugggcaugaagauggaauggccucugcuucaaaccuuacagaagagcuucuccuggggagccuggugcuaagcuacuagccaccuuguccauuuccugacuccaaacccggggaaaugauuggaaugaucagccuguccucaugagcaacauguggcccuggcugucccgaaauguacuauguagacuuagcugaccuugaacucacagacuaacacucugccgccuggaugcuuggguuaaaguugugcacagucauuccuguccugaucucugccucccuuuuuuuccugcccuuagucauuuuuuugucucuauaaaccugucuccucuuagucuacuugaacacucauucuguuuucuggaaugaagcccuguucaaauccccaggggcuggagagacggcuccauagcuaagaacacuggaugaucuuacagagaacccaggcuugguucccagcacccauaugauggcucacaacugucuguaacaaugcuagcuccagagaaugugacucuaucuuuuggccuccaaagguaccaggcacauacagugcacauacauauguacauacaugcauguauacacauauacauacauacaugcaugcaugcaugcauacauauaugcgugcguacauacauacauacauacauacauacauacauacauacauacauacguguauacauacaugcauacacacauacaggcaaacgaacucucaagcaaugguaucaggaguaggguguuugugaaguggccagguuauaaaaaugggaccaugaacucuauaaaauaggaagaggagaaugggcaagauggcuugucagguaaagguguuucuacagaggcgaaagaccugaguuuaaucccuggaacccacaugguggaaggagagaauggauuccuguaaguugcucccccacaagacacacacuaaauacuuuuuuuuuaaaguuuuuuaaagagaagaaagcguguacucuugccucugugugaggccugaggacccagaaagaucaccaugugcaugugagaagcaagugucuccgcaccucaguuuugaaagcaguagccucugaaacugugagaaauacuguagcuuaugauacccagucuuuaauaaucuguuaaagccaucugagcuaagacaaggaauacuaauuaugaauccuucuugggauucagugauucaagagcacuggcugcucucccagaggaccuggguucuguucccugaacucauaugguggcucacaauuccagucucagagcaucgagugcccucuucugggucuccaagggcacugcacccagguggugcacagacagagaggguaagcaaaacucccaaacauuaucccuccuucccuucaugcuagguaaaucugucaguagaaaaaagcaaagacugaccaacugucuaccacauuucauggacuguacuuuauacuucacaaccuucuguguaugccuccuaacaguccuaugaggaaaguagaauuggaccaauuuuauaagugagaaguggggacucucgucuggagccaacuguuucgaaaggaaaagaguuggaacauaaccaaacucugauucuagagcucacagucuuaccagguacaagcuggcuccaauuagcuuaugacuuuauaaagaauauucugaacaaacaaaacaguucaggugccuguuguugaccauggacacagaguucacaacuaucagcuuuugacuuuccgagaaagugugcacugacagagucugccuuugaccagagcaaagacacacugcuuccacucugcugccauggcucacuggagaaaagcuaccaucaggcugacacccugguacugagcccugguacuagcucuuacuaguugaccuccaugggugccacggcacgaucaugcccacacacaagcacacacacauauacacauacaaacacacacacacacacacacacacacacacacacacacauauauacacacacauauaccauacauauacaaauacacacauguacauauauauacuucauacacauacaaacacauacacacauauauacuuauaccccacacacauacaaacacacacacacacacacacacacauauauauauacacacauacauauauauaccacacacauucauacauauguacacauaucacacacauacaaacacacacauauacauauaaauaaauauauauauauagacaccacacacacagacacacacguauacauauauacauauauaucuuuaaacaucacaauauacaaacacacacauacauacacauaucacaaacauauauacauauauauauacaccacacacauacaaauacacacacaucauauacauaucacacacauauacacacauacaaacacacacauacauacacauaucacacauacauauauacaccuacaaacauacacauauacauauauacauaccacacacauacacauaaacauacauacauacauacccuacacacaaacacacacauacauacacauauuccacacauauauacacacauacacauaaacacacacauacacacauacaacacacgcauacacauaaacacauacucuauacacaaacacacacacauacuuacauacacauauccuccacacauauacacacauacaaacauauacacacauacauacauauaaacacacacccuacacaaaaacacauauacacauaaacacaaaccuuacauacacauucaucauauauauauacacacacucgacacacauacacacacauaccacacacacauguacacaaauacaaacauucacagcacacauacaugcauacaauacauauauauacauauauauacauguauguauauguauauauagcaugcacacauacacacacagcacacauaaacauauacacauaaaacacacacauacacacagcacacacauauacacaccaugcaugcacacguguaugcacauacacacauacacucauaauuuuuuaaaaaaguuuaaaaauagcuggcaugggacucuuggauucauuucagugaguguaaaauaccaaugaaaaguaaaacauuaccuucagaaugaauuaaauucccauugaacccugagagcugauccaagggcggguguaacugaacuucucgugaaccaggcaugcuauuaaaaauaaauuuguuccuuuguuauuuacauuguuccucugagcagacacuuuauuacaaaaaggacaauucaucagaggaacagauuucaguuacaaaugggcuuuuaaacagaaagcacgaugcuggcuugucaacgguaccccguguacauuaaaaacaucuguguguugggauuugccgagccaaccuggauaagagcugccauucagucacugucacgcuguaagcuggguacauaaaacagaaacuggggcaguaaaugauuacuauguccucaaguuuauaaagagaggaaccaauuuacagggcauccugcugcuccagacacaggccauuucaccuuucagaguucaugcaacacagagcuuacaaauuuagaguuuugauauucuuuucaucaauguguuugauguguagguuucugccucgugggaagguguacacuuccagcgccaucuuuucaagccagcaucugugaaccacguuccccuccucugagggauaagcaaauagcugcaacagauucugucuuuccuuuugcuuguuguuucuuucuuucuuucuuucuuucuuucguuuguuuguuuuuguuuuguuuuggucugguuuuuagagacaggguuucucugucuaucccuggcugcucuggaacucucaguagaccaggcuggccuugaacucacagagaucugucucugccucccaagugcuaggacuaaaggcgugcgccaugccaccaccaccacugucuggccagauuaccuuuucaagcgcaucaaagagaggccagcaccacuacaaauaggucaggacucaguauuucccaccauaagaguuuaucccaguuuucaacuccccuucccuuugaaaaaaggcuuaaugcuuuuaguuuauuuaauagcccagugaccaaaaaugaaccaaaggaucuaauuauuggcuacgcacgucuguguuaggauaguuccucuagagcaugcauggcagacuagggauguagcucagagagggaggaugcgucaagcauucauaaagcccuggguuugcccccuagcacuacaaacucacacaauaauaaauaauaaaugaaauauaauaguaaguaaaguacaaauaaauugggcauaguaacacacgaacaauaauaaccaaugauaagauaguauaauguuaauuaauaagcuguuuguaaagguacuuaaaacuuaaggauuguuuauuucuggacuuuucuauuuaggaucuuugaaccaugucuucugguggguaauugaaacuuuauuaaguaaaauaagaaauaaugggacagaaauucccagcauaaacaaauagcugccuuaggucucaggccacacacagcaacuccgaauguugcccgggugggguugcagguaggugugugcaguggucauucugucugucccgggguuuacagccauaaaccucugauggagcucuuaccuggaauuugaaugugccuggaaaguaggguaaaaacugaaauuauguuccuuaaaaaucucuguccauguccugugaaacuucucucuuuuacuucuuagguaguugaggaggucaccauagcaacaauauucaaaaaucaaguacacuggcccugaaacaguuacaauuguaguuacaagguuagacagacugcagacacuggcccugaaacaguuacaauuguaguuacagguuuagacacaggucaggucuuuccuccaaaaucacacuguagcgcaacaggaccugggccuuuccugcucuccuugcccucagaaggugcuuuaaaugagcucguacauuagacuacacucgaucucagcacuguauacaagaaucugucuucuagccuuucucuccaguucuaaacgucugaccucaccaucaucaacauaucaguaugugugugcugaguucugaagcugaugucacuacugcauuuaggccagcuucacagucuagggaggagcucagaccccacaacaugaaugugcaggguggccgcuuucucucaggcgguuaggacucugugacagauagaguaggggaaagacggggucaugugcucugcagaggggacaccgucuaauuccacuugaacuggugugaagagaauagcuuaugcccauauaagucugauggccuaugguuuaggaaugaaauaagagguaggacaucugggagacagaaaggauucugggauagagccaggcuugggagauucacccaggaagacgugacaaaacgagacgagacaggcucauggcacccgagcacagguggcagaauguagauuagaauaaauggguuauauuaaguuuuuaucuagucaaaggagagccuagcucuauggucaagguauuuguaaauauauuuugagucugagucuuauuucugggagcauggggcuggaaggaagaaacagacccaucgucuacaaacuggggcugaggaaagagcacaggccucgcucccuugggcugcaguaguguggaacagggcuucgauaugcagauguguagacauuaccugacagugugcaugcccccagcagauucacgauguugucauggugucccaggugggucaucauuuugagcuccgacaugagagcuucuuuuucacagcugucagcuuucucuguugguggaggagcagaaacaggauugaccucagggaacuguaugcuguuuuagaaaccaaggcucuccuugguucagaucacaacuuacacacauucaaaacuggaagagaaaaacugacacaaaaauaacacauaaauuuagacaauaauguucuguguuuuaagacagcguuuuaaaacgugaguuauagauauuaacuauaugaauguauaaucucuuccuuccucgagacggggucucacuauauagcgcuggcuggccuggaacucacccugcagauuaggcuggccucgaauucacugaguccugccuacgucuacuuccugagagcugggaucaaauuaugcaccaccaugcccagcaagaauauacauuucuacuugacuuucccugagaaaaauaaaaguccuuccacccagcucucaaagcagguagacaacacgauaaacagaacgugauuuuccuaguuaaaaaaaaaucagauuauccagcugauaggaagaccagaaggaggagguucagcaagcacagaugucuccaacaugaaguugcuccucaggucuagaaacuuccauugguaagugugcucaaugggggaaaguuaaagaagacaacacaugaaccaaugcaaucucuccaguggagcaaacuguguccacgaucuugcuaggaugcaagcauggguuguuacucccagggcucuggucacugaggcuagcauagcugccuggggcacccuugcauccguggguuuuggggccucggggacaaggguaacaccuuucuuugggaucucuguuccagggacuccugguucuaugcacauacuguuguguuauagaagggaccugaucgucugggacccuggcgucugcaaaggggacugugcaaccaacuuccugcagaaacugagggaugaccacacaagaugagagagagacagucaaaguccugugggggaacucuaggggggacaccagacagcccgaaaaagcaggacccuguaguucucccucaguggggaaccgaaaggagucacacaagaccaccgcaggcggaggcagcagaauacacaguauuaaguaacaacagcacgggaaaagccacaugccgcuuucagagggcuuagaaccuaacugaaucccuaaacgcaacuguguuagagucuccgauucugggagaagucuacauaguguucuuaggacguacuauauuuuuaauguuagaauuugucucagggccucaagcaugcugaguaugucuuguaccacuuagaacacccacgguccccagggacuugaucuuguccauggcgugaaaggaggugucccugaggaagugaucucaaagcugacauuugagagguaaguggcuuccuacagcaaaaggggaagagcagguggaaggauucaccugcgcaaagccugugggcagggaaacgaggcacucuggggaaccgaaagaagguuaagaaugaggcggaaaggcugagccacggcugcacugcucaaaguugugggaaccauuuucuuuucuuucuuuuuucuuucuucuuuuaagauuuauuuauuuauuauaugugaguacacuguagcugucuucagacgcaccaggagagggauucagaucucauuauagaugguugugagccaccaugugguugcugggauuugaacucaggaccuucagaagagcagucagugcucuuaaccacugacugagccaucucuccagccccugugggaaccauuuucagagcaguagaaagccauugucaaugcuuagggcagugccaagcaagaagguguucugcaucguggccaugccccaccucagcacauagccccuagcagaaucggugggaugcuuuuuaaaagcuaccauuaagagucucuaggagagacagaacuggaccaccacagagaccacggagagaugaggaugggcccagcagacacugugcaggaaaccuguuggggaaggcugagagagagccagcuauggaacccgcuuccuuguuucuaugguuguguggaauguguagucucacugaaacguuccaguaauuaccaggcuggaguagagauggaggccaggguuggaggacuucagccuggaugaacagugcugagauacaaguauuugggcacacaaagccaaggcuuagggaaccaguuaugagagcuauugguacaggagaugaagcuggguuauagagggggguccuuggugagugcguggagcgaguggaggcauaaggaacuccacacaggaagucgauguuggcacuauuacaaucaacaugcuaucuaaccagccuaggggccugccacagauggauggauggauguuggaaauacgauccauaggaagugguguauuuggcugcgaagaacgggaugggccaucugcaggaagauggauggaaccagacacugggauguuaaguaaaaaagccaaacucaggaagacaagcagugcaucaucucucauauguaggaucgagauuaaaaggaaaaggcacggaaguagaggggggagcuauuugagaagaagaaauggaccgacaggaagagaauugacgaggggagggggaacggugcuagugaacuggaccaaaguauacauaugggaauaccacagcgacgacacuccuuauucuguggaacuaggauguacgggugaagaaaaacaguguaaaaagaaaccuucauaucuguuccccggauguaacaagugaucguguucugacauugcuucaagguuuuguaccuugcagauaucagaggggaaagucuaucccuuuucacauccugaauuugaucuacagaaaauguauguauccuguuuuguuuuguuuuguuuuuuugagacaggguuucucaguauagcccuggcuguccugaaacucacucuguagaccaggcuggccucgaacucagaaauccaccugccucugccucccaagugcugggauuaaaggugugcaccaccaccgcccggcaaauguauguauccuaaagcuauccucuaacaguuccagcuuccguuucuuucuguaacccaggauguauagcaucaucagucaccuggcuaggaggugacugugagauuucuguccaugauguccugugugccauuucuccuuuuggucugcguacugcaaugcacuucagugacucucugucucugucucucucugccucucucucugucucugucucucucucucugucucugucacucucucuguaguguguguguguguguguguguguguguguguguguguuuggagagaggggcucccuuuauccuuacagggaacaccucagcaaaagaaugggccaucagucccgaggggaugauacaucucagcauucuugaaguugugaguucaaggccugccugaccuauauagcaagacaucguguuauagaaugacaggcuggggauguauuucugagguagaggacuugccuagcauucacaaaauccuggauucaauccucugcgcuggguuaagaaucggcugaggguggcccugcucgaggguggaugccagaugggagaggaugggacagagugggaagugagaaguccccgguguguuuucuacccagaaucugugucaaacuguaacacagaagcugauaccaacugaacgaugagaaagaggaaggggugggggcuugccuucccugcuugcagucuuugcucacgacugccccugccugcuucucguuaacccucagugcuuagcagacagaauaaugcagagggcagaagaaggggaggggaggcagcuggacucguucucugagggacuuugcugagauaaccccaccuuuugguaccuuuuagcaucuucaccgccaccugaauugagacucccguuuuacuaaugccauaggccguggcguucaucacccucccgaaagcgccagaccccaggaccuucccuguaaagauggaguaagugcggguuaaaaaaauguuugcaaggcagaggcaaugccaccgaagcucugaacagucaauccuuaccaaacucuaaguucucucucgggaacucccacuuaaggucauauucauagucccugaagucaacguagaaguacucguuauccagggggccagucaccuggaucaucugcagcugacucucguaccuaaauugcuugagagaugaacagcgggucagcagcgcugcagagucacgacagggaugagccuucgccaaccgguuuuuaccuuuuuguauuuguggcagaucaacacaaugagaacaacaaugaaggggagacagagcccaauggucgcauagaaggagauguugucuuggaugaaagggaaggggccugcaagagaagcaaucacuaggcgggggcgagauaaaacaggcaggccuguuuaagucucuuguuagagucucucacauccuguucaaguaaccaccaucuucaggccuuaugagcaaucuguguguucugucugggugccccacagaaaguugguuuguuucuguaaacaaugaguccccagaaaaaucagaaacgauucugaacccaucuuaaaaacuggaccaugaugucacgugaauaaagcccauauaaaccuuuuacagagcccgugucagguaaaaagaagucuguguauuuguuaucaagguucgucacacacauguagagaaguuauguguaugacugcuagccugcauguguguuuguguaccauguacaugccuggagcccucagaggccagaagagggcguuaaggucccccccaccccccagagcuggagcuaaagcuacagauggcuaugagccaccauguggguacugggaauuaaacccagguccucugcaagagcagccuguguucuuaacuacugagaccaaagccacaauuuugacuuacgugcuugcuuuguuuggcauuuuucugagacagcgucuuacuauggagcccaggcugaacgugaacuuaggagccucuugcuuuugucccuggaguuaaucaauacuaucuggugacccuaaacuguuagugucauuuuagaaagacucuaaacacaacuccaaaaucuagacuagccggcucaaaguaaauaagggaacugacagaauggaaaaggacagaaauuccagaucacuaagucugcuuuccugcaccucuggaggcuaaucuucacaccauggauuucccagacuccacagcuccgugaccugugagucacacagccuaaggauaacuggguccugaaacgucaaauuacagucugcuggggauucuugcuugacucaaaaagaccuuaugcucacucagaacugggcaaucucauaagaauuccccagcaaaggccagccacaaugcccaacuucaggugggggaauuucuggggacaggguguguuuaucacaacagcaaauggcugcacaccuggugaguuuaaaaagaugguuucgcaagacgugcccauagaauuguacgcacagcauuugaccagaagcccuuucccggccucacucauauuuagaguacugcucgacacccacuggccaaacacuuuucuguuagccuuuuuauuccaaacuccuucugggauuuccuccgugcaacugaaaagaaaaaaaaaaugguggaaagggauuguuagaugggcggggucaugguaggacaggaaguuagauggguggggucaugguaggacaggaaggcaggguuucuacagaugguucccaaagaaaacaagcuguggcuguaggguaagcauuuucaaugucauucuuaagcuguauccauggcaacaggugauagaaucuuaugccuuauucucacuuuucuucuuccuuucuuuuucuuucuccuuucccuugccccucuugcccucccucccucccuccuuccuucccuucuuuccuuuuuuuccuucuuguuuuuugagaaagggccucacuguguuccccaaggcuggccucaaacucuaagauccuccugccucagccucccgagugcugggaucacaggcaugcgccaccacugcccggcuuggcucauccacuucaagagacgucaggguucucauuacuugggagauuuguccgaacacuucuuccagguccaagaggguagcggguagccaucagaggaacaggacgccuggcuggcugaggcauuugcuagcacuugagguuucucuguagaaaguagcgcgcaguaagcucauggaagauagauuuuuuuuuuuuuuucuagaaucaguucagagcuagcuucaacuuaggcugcuucuuuagcccaggugcuauguaccccuggaacaaccccuuauuuaggaugccucaaaguuuguuuggucccuuccuccucugucacaaaacuuucuugacugguggaggcaacaccucucuaugacucaccuccuagagggagcugaaguguagaaccuccaucuaucugcaaaccucaauguaacacuuagcuuuaaaaauaccacccagaggaccuggguucaauucccagcaucgacauggcagcuuauagcugucuguaacuccaauaucuggcaccuucacacagacauacaugcaaguaaaaaaaaaaaaugcagguaaaaaaaaucugcaaaaaccuuaaugaaauauagugucuuuuucuuauuuugcauagaccaagacgaaaaucauuaaaagaaauaaguagcaggugacuguauagccuuuccuuaguguuccuuucauagcgccaaggcaguaaagucacagcacaucggagauggaacauguacuagcucagagaacaaguauagaaagggacauauauaacuacagccaacacacaagaagcauggcgcuuacaagagcaguuucagaggcuggagagauggcucagagguuaggaucacugguugugauugcagaggaacuggguucccaacacccacaucauggcucacaaccaucuguaacucaaguuccaaggggaucagacgcccucuuguggccuuugugggcacugcaugcaugugggccagagacauacauaccacuuacaaaacacucauauacaugcaaauaauccuuuuuuuuuuuuuuuuaaauuaguuugauaucgucccuccuaagcuguguuuggcucuucuuaauuaaaaauuaauggaggaauaaaauagacaagaugagauucaacuuacuucuuauauucagcgugaacauuuuggugaacugggcgucaucauuuucugcauagaauauguacucuccuggcuuguucuuaugaucgcaaaauuuagauaugcuguuugagaaagaauuaaagaagaacucagcuuggugcuuccaggagaggcuacugugaagaacaggauauaaaaauuuaaaaaaaguacaaauuaggacucagagguuaagagcacugacugcucuuccagagguccugaguucaauucccaacaaccacaugguggcucacgaccaucuguaaugggauugacaaccucuucuggugugucugaagacagcaacaguguauucacauauaugaaauaaauaaaucuuauuuuuaaaaguacaaauuaaugggcuuaguuacagcauuuucauacaucaucauuaucuuuguucuaauuugucccccuccccugaugccuucugucaccauaacagagggcugaaauaagucaacucagagagagagaaaucugauuggagcacacaacuucaacccacuguugguugucccuguugcucuggggcuggugaggggguacgacauggccagacuacaagauguagcagggaagcgaaagacaggaaguggggcaucccagaauccccuggcacauucauccauccacugacuucccacaaggccuugccagacaggcuugcagucacuccuggcuccacgcagcaacgaggugucagugugugagggccuagcuauucuccucggcuucaaaaagaccacagcccaagugagcuguggaaccccacaaaagaagcaguuaaagcuucaagucgaaggcguucagcugccaaagagaggcagaggcggcguagaaaguucuguggauuucucagaggcaaggcgggagucccauuugcuacgagugcaaaaaggagagcgcuaaggagaugccaccagaauccugaggacgggaaggucacagggcauggaagagaaauugggccuccugacugaaacaggaggaggcgcuggggugucugggcaaagagggcuaagagguaggaugggguccauugguuaggacccuugaaaaauggccuagaauauucagaggugaaaacgacauuuucacuggacguuugaaaacaaaauccauagcauguacaacauuuagaucgaccugauccuagugggagacguuauuggccggaagucuagagaugguagugacagucuaggagcccaugaguucauucagccaccggagaccugaccgcgggaagaaucaaaucuccugcagcagaucugaagacagaguguuuucuugauccuaaaauucacagcgugauguuagaagcagacacaguuaugggaagugggcauggugauguacgccugcgucucagcgcuugcgagguugaggcgggaagaucauagguucgaggcugggcugggguacacgaguagcuaccgucucuaaagcacguaaagggacgggaaacagagcagauaugcuagggugugggaagugccaucccuaaagaauuaaaguuggaauuugagguuucagagaauguuccuacagagggaaaggcaggaaaggacacacagaagaggcccugagcuaaacagacuugcaggugcuggugugcauaugcaauaaggcagcugcaggcucccuguuggccccaagauacaccuggacagauggagcucugagccaggggugccugggcaccagcgcucuaagcggcccaucucuuagucagaugcuccuggucggcuaaugagaaggaagucacucuuugagccucccaggagggagcccuccagccauuggucugcaggugaagcgugcacuagaaugcuugccugccauguccacugcccugaauucaauccccaggaacacccaaaggaaaauaaagugcuuucggcaauuaaaggcugagaauugcauacauuuuuuuuuccaguucuuaccccuuuucuuuucuuucuuuuucugcagggggugcggcuaggggaggagacagggucucuuguagcccugaguggccuagaauuaggagaaggaagaguuuuucgagacagaguuucucaauguagcucuggcuguccugaaacucacucuguaaaccaggcuggacucaaugugccacuaugcccaguaucuuuuguaaaagagagagucucuggcaucucagacuggccuugaacuugcuacaagauggcuuugaacuccugcuucugccuucugagugaucugguuuuguggaagcagggugaaccagggcucuguaggagugaggcaagcaccuuaccaucugaccuacaucacuacuccccauuuucuuucuuucuuuuuuuuuuuguuuuuguuuucgagacaggguuucucuguauagcccuggcuguccuggaacucacuuuguagaccaggcuggucucgaacucagaaauccgccugccucugccucccaagugcugggauuaaagacaugcgccaccaugcccggcucaauaucauaaauuauucuuuuuuaaagauauauauauauauauauauauauauauauauauauauauauauauauacauacauauauauacacacacacauauaugaauacauugucgcugucuucagacacaccagaagagggcaucagaucccauuacagaugguugugagccaucaugugguugcugggaauugaacucaggaccuuugaaagaacagucagugcucuuaaccacugagccauuucuccagcccuauuccccauuuucuauccuggccuucuagacaaggaagaaauguggcggggguuggggggcagggaugaaaugguggaaagauugugggagaaccccaaaggccaaccagggacugggggggcuugguaggcagcugagggcacaggcacaugccuaugccucuaaccucagugcucugcaggcagaaaugggaggguuaagagagaguucaaggucaagaucagcaguuaagagugcuagcugcucuucuagaggauccagguucaguucccagcacccacaugguggguggcucgcaccuacuccgucagggcauccaaugcccucuucuggccuccaugggcaccgggugugcacauggacacagaacccauacauucaggcaaacacuaauacacagcaaauaaaaauagauaaauccuuuaaaaagagagugcaaggccaauguggcucaccuaaugagccucgccuaugucaaacagagggagagaaggagucagagacagugauggagaccgggaggggagagggacugggugacugacauaguuggccaaggaccaugcucagaguuccacucaacuugggagagaaacuaaugaccacacaauagguguguguguguguguguguguguguguguguguguguguguguguguguguuguguggaacaaagcccaggacugcaugaugauuugucuuuucuguccauggcgcugucgucuccacagggugugccucgccucagacagacagagccccugaggucaggauaucgaucacauaacuuggcgggacacagaaccaaauguccagacagauuuaccacuuucuuuugucugucugaccuuggcaggccucagaccugcauuugcccugccuucagccuccaguguucuagagugacaggucugugccaccacaccucgcuuucucccaugaauaugaccccagcagcaaggagagggaccgucagguaccaggcagcucagagccuccuuucuuucagguucccccaccuccccuuucccacuuggcaucaggaaauuugaguugccagugacauaucuuuggagaccgagacaaugcagugucauuacaauuaggaagagggccucucuaccaucaggucacuuucuccuuccuuguauuuagcucccagggggaggaguuaaaaaaggccaaccuuggcuaagggcucuggaaucagcuuaugauucauaaagagugucagauggagggccagguagguggucauuucugugaguuugaggccagucugaucuaugucuccaguuccaggcuacccagugcuuguacagugagacccuguuucaacuuuuaaaaccuuuaacacuauauagcuaccaaaauuauaacuaaggggcuggagagauggcucagugguuaagagcauggacugggggcuggugagauggcucaguggguaagagcacccgacugcucuuccgaagguccagaguucaaaucccagcaaccacaugguggcucacaaccaucuguaacaagaucugacgcccucuucuggagugucugaagacagcuacaguguacuuacauauaauaaauaaauaaaucuaaaaaaaaaaaaaaaaaaagaguggcagauguuaaaaaaaaaaaaaaaaaaaaaaagagcauggacugcucuuccagagguccugaguucaauucccagcaaccccaugguggcucacaaccaucugcagugggcucugaaacccucugaugauagcuacaguguacucauauaaauaaaauacauaaaucuuuaaaaaaugguaacuaagauauaacaauauaaccauacaguaaauacacuuuacuacauauguuuaagacagggucucgcuguguggccccagaaaggaagggccggggccaccguuacaggcagcacgguuacaggcagcacgguuacaggcagcacgguuacaggcagcaugaauaaagggaaaacagauuuaguuggguucuugguguugcucuagagacaaacaucuuccccuuccuuuuuguauauacucaggcucacagcucuccuacccucaagccccauuccauuaaaaacaaaaaugucagcucugccacagguccuguucaggagcuucuauguggccacucuuguccugagcaggccccuagcagguccuccagacugcgaacacaggaaagagccccuguuucacuuuggaaacacccagugggagcucagaggggacagaauggacugagauacguggaagacaggaugaaauagcuccagggaaaaguuaugccaugcucauacuuuuucuaccacgacacuaaugcggauucaguauuuaucggugagucuacagaauucgcccccaaaguaaggggugaaucuccuucagucucuuuuucagaaguaaaagggcuccaggcagcuggaaaccagacacaaacacggaaaggcaagccccagggagccucagggugugauuugaggaaguaaauugcagaaaugaagcuuugauggucgggaagccgagagacuucuggcgugugccacgaccgcaucggggcuucugcaguaguucagcuacuacacagauuaaaaaaaaacaaaaaaccaacaaaccagcaacucucccgccacucaggucagcucucaaaacaugaucucgauccucuaccaucccaacucagggcaacagaacugcagaaucuaguggggagcuaaggaugccagcuccugggcuggagagguggcuccgcgguuaagagcacugauggcucuuccgaaaguccugaguucaaaucccagcaaccacauggugguucaaaaccaucccuaaugagaucugaugcccucuucuggugugucugaagacagguauaguguacuuacauauaguaauaaguaaaucuuuggacuggagugagagugaguggaugccaguuccuuugguguauuagcaaauuugaaacuuuccaccauuaaaguugaauagagcuugaguuaccucucaccucaaccagagccuacacagcagagagaaggaucauagaacacggaaaaacauuguucagcgcugacugcuuuaccucaggcuuccuugcugccauguuuuuuauucucugggaaccuucagagaaucucacgccaagcacugggcgccaugugugcuguacgcaagacaacacaggcacagcuuucuccaagaagucauguccaggaguggcagugaguccguuuccugguucacacacacauuuccuguaugaggcacgggacggagcuagagagaugacagccuggccaucuuuauggagguucuaaacucagagcugagaugucacaucugggaagcugcucucaggugacuggaaaugaaagggacacaggacggcucuagcugggaugggacgugucuggaguucaggcuuguagguuggagccucaggaugaaaugcggcuaccuagcccagcuccugaugcaugcauggcagacacagcuccgugauaccccaagagggucugcugugugucaccagguuacacagugacaauaugcauccucugggagagaaggaaaauggcagcuucuuacccauucacauggcccuuugcuguauaguccaggcuggccuagaacucacuguguagccuaggcuggccuagaacucaaagaugagccaccucugccccuggacugcuaggauuaaauguguugcugcaucgcgaccuuaccauugguuaaaccagguuuauccccuccuucaccugagucagguucacaaccauccuggaaugcagcaggagucccuaaggcuguguuagcucucacacgaccacagaggggccagcaagccagcuauccugaaaacaggcuccauggucauccguuccucccugucuucuccuucuggaauucaaguucuggauaagagcuuaugcgagccugguguggugguggugcauagcuugaugcacucaggaagcagaggcaggaagaucucagugaguguaagguccagucgggucuacauaauaaguuccaggacagccagggauacagagagaaagaaacccuuucucaaacuguccccuucuccccaccaauaaauaaauaaauaaauaaauaaauaaauaaauaaauaaauaaauaauacaaauaggaagcagagaggguggcucuguauauaaagcuuguaguauagccggagaaucugaauucagauccccaccauguaaaaguugagugcaguagccuuagugcgugcucuguagccuuagugcugggguauggaggucagccagucuagccaaaaugguaagauccaaguucaaugagagagucugucucaaaaaaaaaaaaaauaguugagaggguuagagagaugagucagagguuaaaagcaugauucguaggauccacaugguggcuuacaaccacccauaacuccauuuccaagugaccugaugccccagcagacacacgugcauagauagacaugcaggcaaaacacucauaagcauuacaugaaguauuguuuuaaaaaacaguggagcacaacagaggauguugaucuggccucugcacaugggugcgcgcgcgcgcgcacacacacacacacacacacacacacacacacacacacacacauauacaccccacaagacaccccuaccccccuaggcaaauuuagagguagagagagaacucagggguuuaaagcaagcauugcucuuccagaagaccugaguucgauuccuagcaccuacaugaggugguucacaacugccuauaaguccaguuccauccagggaauccauccuacacacacacacacacacacacacacacacacacacacacacacagagagagagagagagagagagagagagagagagagagagagagagagaauaaacacagacauacagagagagagauacagauagaugugcacacacacacacacacacacuuucucaaagaccaauuauaaaucacuuaugggaauuuuuuaaaaaaaagcauacuaucaugaaagaaacacuaggagcagcguagaggguagaaagaggucagcucuugucacagugaccagagcaacagacagcugccucguuuuccuuuuaaguccccugcagauauguauaugaaguaaagagaggggaaagcugagugcauucguugaucucuguaacucucauaccucaaacaaucauugaagcauagccucagugugaaaauuauuaaugagauguucuacauuccuguuuuguguguuugguuuuuugucugucuguuguuguuguuguugagacaguguuucuccaugagcugugcugcagauuuggugcagcgaauaagagcaaacccacagugccguugcagaggacuugagcuggguucccaguacccacgugggacagcucacagccacugugacuccaacuccaggggaaucccaagccucuggccuccagggacaccgcagucacacacacacagacugucacccacauacacauggcuaaaacuaaaaucuguaaaggagagaaagacagaagaggcaccauaguuaacagaagaaaccggggaaagcaggcuuuugcuuuucaaagaaggaaugagacguucgccuccagaacacucuagaccagaguugaacaaacccccaggagaaggagauccucuuuugugacuuaugcucgggcuauuucugcauuuguguuugagaacauaaaucaguacaccuagggcagauguuuucaguuggcaaggagguccgacucccccaucacucacaaccgcacuuagccgcccgguacugucagagcgcagcacuuagacaggaaaccacagucucuugacagaaaacugccaggauucuguuuucaugcagcaggcuuuagucccggaagagaaggaaaaguggcucuccucacaggugcgguuugcuuucagucuucaguuuucugacucaacaauaaaucaacucacagacugagggggcuaagucuauagcucggggacagaggugcucgauaccggggaugggggccggggaauugggggguagguggugguagugguggugcaggggauggggggugggugggagguuggggggaaggggaagguguguguguccuucucgagggaggagggcugugcugugugucucaccuguacccauccuccaggccucucuguucacaaggaaaugaggcuugagagaagauccacgugcaucggauucguggguacgcuuuaaaccugacugagaagcagaacuuuucguacgggucaauuucauacucuucuugcgagcugguagcguuuauaaacccuuuuucuguaaaaaggaaauuuacaaauuagauauugauauuuguauaaggauuauauauaucauauauacacacauauaucauauauacauauaucacauauaucauguuaugauauauaugugauacauacauauauacauacacacacacacacacacacacacacauauauauacauauauauaugguucuagccccaucuaacuuagaaccuccuuuguagaccaggcugaucaacauagagaccuaccauacaugauuuuuuuaaaaauuugucaguuuaaugaaagaaagcauagacaaaguugagcugugguuugggcuaguccaaaaaagaaacagaagaagaacucagacagagcccaucaucuuuuguagacaggauuugcauuagggaugagaucuuagagcuagagagaugacucagaaacugagaggacauacuccucuugcugaggacccagggacaggcucucuguaagauaaucuccuccagguacaaguaaaagagccauguggugagugauauacaugagcaaggccuccccgugagccucuauacugcucugcuuccucggcuugcucacgugacgaaagccugcacacuauguggcaucaccuauguguggcuguuacgcugaagcccucacgggcaucccaaucccuaggcacccagcaugaguacagugcccacugucaugacucacuaaggacauucccagaacaaggauucauuaggcacgugucuaguaccagguucugggacuccaaggauagacgucaggacugccccauccauaggcagcuacaguccaugaagaacgaagucagauacacagauggguucccuugcaauguggucugagaaaagccggugacaucugaguauaugugacugagcaggaaagcuguuggagaaccucgcuaugaugguagcaguccaccaagaccagauagagcaaaauggggucucccuuucuuaguggggcuucccugucucugucuggagagugucccugaacacagguggcuggccuugucuggaaaaugaccuuguacagagcucugugcgaggcugcauaacucaacacacacaucucccuccggcuucccacccgaauaauuaaauacugcuuuauaaccaaucagcucuucccgcucaaaugauguuaugaccaguuagcccuuuuaacgcguaccccuaaaaaauguccucauauauccuaucccugaaacaauaaaguagacuggcuuugcugcaguggucuccagagguuauuccgccauacucagggccaucuggaccuggcucucugccucugcucccuuuguccucucaggcugguggccaaaggccuccaagaaggagggguggggcagggcacagagagcaaagcagagggaagcuuauccuguccaugcuauucuaacucagcuucuuuuacaauuuguagcuggacagaugacucaaugguuagaaccuuggcugcucuuccagagaacuucaguuaguucccagcacccuuacggcggcucacagccaccuguuaacucccaucccaaaggaccugaaggucuuuuuucuggccucugcaggcaccguacacacacacuggugcacaggcgugggugcagaagaacacccaugcacguaaaauaaacguaaaagugaacuuuuaaaaauuacacucauguaugguguuuugggugggacaguugguaaaggccacauguagaggucagaggacaacccacagcagucaauccucuccuaccagggucccagggaugggugucgggccaccaggcuuggcagcuauggucuuucuugacagagcuaccucaccagccuuucuguuuaguuucuugauggaaaauuauacugaaaucugaaucuagauugccuaguccacauuccacagggaaagccacuaaagacacaagcagagucaagcuugguggccugugccuuuaaucccagcacuggggaggcagaugcugguagauuucugugaguucaaggccaaccaaucuacacagcgaguuccaggacagcauuaaaaacaaacaaaccaaccaaccccaaauuucgugagcccguuaccuaggauggucaccaacgcugacuggcuggggugcuuugaggaagagcagguguaauauccggugucguuccuucccacggaagacacaaaggccaagagaauccgaaucaugguccuguuuguggaguagguacucaucucaaaguagcugcccugaguauuaaugaaaggggagucuguauuccggguuuccagcccacgcugagagcuuacgguaaacaccacgggugggcgcuguuaccuccuccagggcuuugucuuccagcucccaggugagcccgaauccaugguucacauggauggccuuacaccugauccacaaggguucccccacuuucaggaauaacuggggcagugugcucugaggagccugguuuagaucuagaagauaaaaauaucccaaagaagacaaaaaaaaaaaaaaaaaagcacaucuuuuuuuuaaaaacuuuugccucagcucagaagugucgcaaacguuuugaaaagcaauggugucagcaucccugccaucacuaaucaagccaaacaaugcagagcugagaagaucaggguaaaagaggcuggccuggagaagaccuggagucacagagcagcacaaaacuaaaaaaaaaaaagcgacagaguaaaaccacccacucgagauggaauacccuuuguugcagaaauccucccuuacagaaucuacaguguuacauuguaaaugguaugaacggggcaucaagauggcucaguggguggaggugccugccgcugccagacugaccugaauuugauccaggggccccauaugacaagaagagaaccugacauccacauuacaugcuguagcguguguguguguguguguguguguguguguguguguguguguguguguguauguguguguauuuaauguguguauacacacacacaauaaauaaauaaauaaaguggugcaaaagaucuggaguggaacucaguggcaaagcagaugcucugagucccuggguuugagcccagcaccuaagucaaaucaaaucaaaucaaauugaaucaaaucaaaguccuaugaaagaaggauuaaaagcccgggccaccaagcuuggccauaccuguguguucaauugcuuuuaugucagaauguggacuauucgaucuagauucggauuucaguauaacuuuccaucaucuuucugaaguggaaugauuacccacacagaagcuaucaccggucccuuaggaaccgucacuaaggacacauagccgacagucccccauuaccuauggugaacagcuuggugcauucgcggcccagugcauuucuagcacagcaucugaugucuguuccgaacaacucaugaaguaccuuuuccuccuuucugacaacagcagggccuucuucuuuacagcugcaaugauaagguaaguuuccuucaggaaaugcuucaaaaugacagcuaacaggcugucagcacugcucagggcagacccuguguucaaggucaccagcacugggggauugggguggggggacccaguauguuuaggggaugaaguuacaaaguauauuuuuagggauggaagaaaagagcagaugaaaaauuaacucaacuguauccagccuggaaucugcagggaccagcuagcuacucuguaucuaauuaggauaauguuacaguauuacuuuauuauuuaauauuuuagauuuuauuuuauuuggugauuuuuuuuccccauagacaagcuaucuccauacaguucagguuggcuuugaccacacuauguggcccaggcuggcuucagacucacagcaauccuccugccucaguuuccugagugcugggauuucuucuucuucuucuucuucuucuucuucuucuucuucuucuucuucuucuucuucuucuucuucuucuucuucuucuucuucuucuccuucuccucuuccuccuccuccuccuccuccuccuccuccuccaccuucuucuuucuucuccuucuucuuccuccuccgucuccuuccuccuccuccuccucuucugguucucauuugaagacaggccaaaaagaaaacauggaugaacucagaaagaaaaugaggcaagaagcacagcuggucugcaauguagcucgacaugaccgguguguuuucuuccaaguacagaggaggaguggagagugaagcaccagguugaguucccaaagcaaacuggagaggaaagccgagguaugauucccagggaagaccagcagaccacgguagugugcacagagugacacuccucuucugccuugccugggcaggaaaugcccccacgaggcuuuccuggggcauucugggcuuucuggguggucaucauuacugucuuucuccagcaagucauggguacuuuccuuucaaaucugaagucaccaacuuccugucaccccauacaagacaacugcugucacacucacguacccuuccaacuuucucagucuauaugccuaucacauacaucuauagauacauacaugugcacacacaugcguggcacacacucacaguugaggucacuggucuuuucucacgaaauucaaggucgcauuaacaucauuaaagaagcagaucugguuuggacuuucccucucucuugcuuuaucccacuuggucuucagcaauuaucuaguguagcugauuuggcuaguucggauggcagggcuucucacaccucgggaacucagcuguagcucaggcagaggcagaaggagccuuguauucuaugcccagcgcccugcccggcuggcucuguggccucacaucucagcucacuccaggcaaccccauucuucuucuuuuaaaaaccugacuauuuuuguuugcauuuuuuccauccucacucuugagaugaacagagagcuuaauuaacuuaucugaggacacacagcuuauuacacaaacaaggguccaaaggucucaggcucuggauuccagcuccuuaacaauucuauaaauggccucuugagaggaaacauaaugaucacaaaugaaacauuuacucauaagaaacuuccuaucauaaggagaucacaguuccccccaaccccaaggcucuggaaucaauccaacaaccccacaguucaguuuuuuuguuuuuuggguuuuuuuuuuuuuuuuuuuuuuuuuuuuuuuuuugguaaugcaaugguugugagucccuuagcuacuucaggggcuuucaaagucccucuugccaaaaaccacccauucccccccucccccaaacaccaugaaauccacagcagugauucuguugaaaugaagaaggaaacaaaagucaaauuucacauucaguuaugaagucaaugacaguagaaaacagccaccauucugccaggaacgguggucacggucacuaggaggcaugucuuaccuuucccugugggagcugcagagcacccacuccacagugggcucuggaacacccucggagaugcagagcagugcguccugguuuuccaucuuccuaaaguaaggucuucuuagcacguacagcuguguaucuaaggcaccacgaaacaugaccguuuuaacacuucggauggucccagcagccccucaaagauccccacggcauuucuaaacagcuaaucuaucccaccacagcaaagucuggcuccuccccagccucaggugaugucagguuuuuguuuuguuuuguuuuguuuuguuuugagaccgagucucacucugcagccuugccuggccuggaauuugcucuguagaccaggcugauguuaaacucacagagaccagccugccucuaccucccaagcgaugcugggauuaaaggcaugcaucagcaugccaugugugaugcugguuucacacaguuguuaguuucuuaggguucacaaguccauagauaaaucaguaaggugaaaucaggagaugggguauaaaaggagaggaaaagagcaagaacacagaggucagcucuuacaaaaauuuaaaauuuacuuucuucucaucauuucaucuacaacuaggugcaaguuaauaagauggagaaaggcagaaacauuaggaugcaguuaaaacuagagcagaauuuagcggcugagcuuagccugccauuuagacuagaacuuacacacacacaugcacauacacacacacacacacacacacacacacucauacauacauaugcacauacauuaaauacacacacaaaaauaaugacgguuuuauucaauuacugaaaaggagauauuuugcuuuagcuuugcuucuuguuuauuuauagaugcucuuuauauauuguuacuaucuaucuguaguuaauaguagagauaguuuuguagacuacaaguaucuuuucucauucugcgguaguuuucaucuuuuaucccuguaauuucuaaacuugguucccauucuacacuuugguagggacaucagaguuugucgaaccugucaguacccuuaagugucauguucccagaacuguucugaauggggacaagacauuugcagaccacaauagcaauguugugguguucaaagguuggacagccuccuuacuucaagggcuugccccucucuuaaauagagcacugaagccagggguggugaugugugucuguaagccccagugcaggaagugggaagaucaggaguucaaagccagucugggcugcacacugagaccuuaucuuaaggaaagaaaaaccuugcuguuggcuuuaagcaucuucaauuaggagcugaggccacugggagcuaauuacuaugcuaauuacuauuugugugaguuagcucagggguccuggggcaaacuuucccuguaucacuccaucugauccacccgcaucgcagcuccccacaccacaccacccccacucccuaagcugccuuaacugaaggaaucccaaguguucugccaucaugguugcucuguauuuuuucaucugaaaaauaauguaaaauuaaaagcagcauagaggcaggagugguggcacacacuuuugugccauacauggguggcagagacagacauacaugucuguguauucaagggcaaccuggacuacagagggccagccaggucuauauaguaaaacucugucucagaaaaaaaaaaaucuguuaaucuucuagaacacaacugcuuguacaguguugcaaaagagagagaaagaaggagcccguggagccuguaucuucacuggacaaagagcccacacuuaaaugucccaccagaggccugaggagguaggaauggggcagggguggaggcccaggcaaagagcagcacaagacagcuccugaguuguguacuucuggguuuguguuccuguuucagucacuucucugagaaaaugggugagaccacucuguucuugacuuugccaugcaggcugacugugugauccaggaugaugacccucggggaaccuagagugucccccaguacuaggagcuaugacgauaggaccacaaaugccaccaaggcuccaaguggggugacaagcaagugcagaaauggcucucgugggcccccaguuuugccagucacaaacacaucaggugucuguguucauaucaacacacaggccaaccucugugagcaccugagguggggcaugcggagguccauagggaagggccuccguggucacuccugaccauggucacuccugacaggccccucuguggcugcacacugccucagcuucgugaauccgagucauccacagggaaaagggcagccuagcaaugugcagcaggcagcuuagugggugccaacccugagccuguggcacugccugagcccccaaagacacaaggcucuacaugcagccaccucugcagucacaggaaggaaaacagggugcacgguacauguagcaccaugucugcgccaguuaaggcaccggucugacaguuuacaucugcaaaaaccaaugucauccucagcagccacccuggcuguaugcgauuaucuauuuucagauuuuaauucauucacaugagauaaaaaauuuuuuaaaaauguccccugcuuacacuagccaguguucuuaacugccgagccaccgccccagcucggagguaugggcuuucauuccccuucaaaagcucauaguauuagaaccagaaauaaaacccaggacauuuagucagcaaggugccaagugcuugcaaucaaaagauuuaggaggaugaggcaggaggauugugaguucaaagcuacauacugaguuugagguuagccugggaaaaauuuggagacacaggauuuuuuaaaaaauuauuauuauuauucccaagucaaaauacucuuugcaguucuuccaggucuguguuaaaaaguccugaguagcuaccuuuggugaccccagagaugaguggaagcacacuaggucccgaagcacgcacugccucgggacgcaggaagugcccaggaggcggccacacuuaccucuuacauucacugugaacaguacuguguaguuggcggcuucgcucugaauauggaguagguauucuccugccugggucucugucacguucaagauggccauggaaacgauuccucugcggaaugagaaagaggacuggauucucuggaaaacacucaggacuaacagccucagcuucuccaugagucagagggugagcgcugucuucgaagcuauggcuaagggcugcucugugcagaacccggcucugguccagcacccaggcucaucuugggcacaaucagcucggcugugacuuguaccuaacacccacccucagaagugagauuuggcucaguaguagaagagggcuauagcagugggaaaagccgcaauuuuacaagguuaugggguacuauuaguuguuauaaacauuuuguacagauguaucucauacccaauaacaaaauacuuauuuugucagggcauaucaagguuacaaauuacauauguacaucaaccuuuaaaguuaaauuauuuuaaauauuuauauuuauuuauguauauaaauauucauuuauucuucuuguauguguaugaguguuuugccugcacgaaucuaugugcaucacuugcacucaguguccauggaggccaucagaucuccugggacugaagucacagacaguuacaaguggcagugugggugcugggaaacccaaccugaauccacuggaagagcagcucaugugcuuaaccauugagccaucucuccggugccuuggguuuuauuucucggagcagcauuggaucugcccacuucaccacacacccuugguguuaucacuaucgugugcaggucugguuugugcuaacagaagaagagagauggguuacccuaacccucaucaccaccagcuggcgucuacagaugccauuaaugucucuuuuugggcagcaccuccuacacaugacagauacacagcgucaugugcccauauccuaauccuacgugcguucauuauuucagcagagagaagucaaaacacacacacggauggauucucagucaggcccagugguguaugccuguaaacaacuucagcaucccuuacacagaagcuggagaaucuugaauuuagggaaaagcaaaaacaaaaucaaacaagggcagggguccaaaugaacuccauuuuaugugggcaauuuggcucugagaccaguuuggucugugcccacccucaccuguuuuguaaaucaaagugcggcuggcagcccagggagcugugcuuaaagacccagaggcaggaaagguccccugggguggcgagcugcacuugcagggugauggacccagacucggccaccuccacgguggccgcuucauauaccgucccuucacucuggcgccucggggcacacuggaggucuucuggggauccucgcaccugugagguagagggaacaacguggagucaucuuuuuuagcauugaaccuguuugcauaucuguugauauucugccucuauggugguuugaaugaaagggacccucaaaggcucauagggaauggcacuauuaggagguguggccuuguuggaguagguguggccuuguggugugucacuagggaugggcuuugagguuucagaagccccaagcuagguccagucucucucucucucugcugccugcugaucccgacauagaacucucagcuccuucuccaguaccauguguaccugugugccaccaugcuucccaccaggcugauaauggacugagcuucuaaaacuguaagccagcccaauuaaauguuguccuuuuuaagaguugccguggucauggugucucuuuacaguaaugaaacccuaacuaggauagcuauccaacucugcugguaccuacuaggaagguaccacugagcuggagagauggcucagugguuaaaagcacuggaugcucucccagaagagccuguucaacucccagaaauuguagcuaacaacugucuguaccucuuguuccaagaugcccuccucuggccucugaggaaacuguacacauauguugcacauaaaugcacauaggcaaaacacucacauauauaaaauaaaauaaauacuucuaaaaauugaggacacagugaagaaaaguggaaaaugacugaauagccaauuccuauaagcaaaagauguauggcgguggccccauccaguuucagaccacaugagucagcuugcuugucuuugagaccccagaaugaagcacuucuuugaacccuguagaugcccaccauaggagcgcacuugauuucaguguuaucacgguggaugcuguuuugaccaccacgaggagaagauaagaacaaaggcucaugaaugugcagugacuggucugcaggcuccauaguccugucccacugagaacaugagaccaugcaaauggaaaagcuauagguacugagcacuguaguucacugggcagggugguagaauacuguguggcugagcaaggacccccgguuccaaacccaguacuggaacaaaggaggcaugaacagaaaaaccaaagggcugguggucaaccacauggcacauguugggcaaacauggaaccaaagggcucaaggguaagcucaaccacauggcacaugcugggcacacauggaaccaaagggcugguggagaagcucaaccacacagcacacacccaguacacauagaccccugaagaaaugcaaaacacgggaggguugacaggcacagaacagggaagggcaguccaaaugaaagugaucaagcagaagcaaaagggaaggcuagaaagugggaggucccucugguguggguaggaguccaugcccagggagggcuguaagcguucagugggaaggcaggggguguggaagagccugaaucccaugccuucucugcuggaagaacagcuaaauacagaaacccaucaguccaaggggcuucugucgcaggauauuugaucacacuguaaaccccaagauuguguuguuuacuggaaaaaccuguuucuaguugugaugcggcucagccuuagcacacaacuuuaauccuuuuggcuggaauauagacacaccuuuaguaugcaccuuuaaucccaaacagugaagcuaaaguuaguuuguagaaggaagcacccauguuugaaagugaugucuaggggcuggugagauggcucagugguuaagagcacugacugcucuuccaaagguccugaguucaaaucccagcaaccacaugguggcucacaaccauccguaaugagaucugacacccuuuucugggugcaucugaagacagcuacaguguacuuagauauaauaauaaauuaaaucuuugggccaaagugagccacaaccauauguacucauauacauaaaauaaauaaauaagucuguaaaagaggagaaagugaugucuaauugaguugucagacaaagugaugaaucagagaaagaucugacagaauagcauacaccuaacucucaugagaagagagaggaagagaggaagagagggagagagggagaagaggagagaaggcaauuuuaccaggacaguuguauaaaauagacagguuucagagagaacaaacuagacacaggugaagacagaaugauccagguaaugagaaggagccagaagauuagaccauauuuccaaaguuagaaugaggccaagcagagcugaaagaagcuaguuugaaucagucuccuaggagaggaguuugagccagaauagcugaguugaccacacuggcugcaacacuaagagaucugccugccucugccuuugcugggauuaaagucaggcaccacuacacccagcuuccauuuguuuugagacaagacuucucuauguaaccacagcgaagguauaugauccuuguugagguuuggucuguugcuaaugcugaauucuguaggucuagacacaagaguaaauucuuagguuuaacagccuuuguuaugcaaaacuugcuccuuaauuuaaaacuguugagguuuggucuguugcuauguauuguaaaguuacauacuggguuuggucgguugcuauguauuauaaugcuacauacuggguuuggucuguugcuauguauuggaaugcuacauacuggcucugguuaccucaggaacuaggagauccuccuguagaucaagugacacuauguaaccuugccccaagauaccuacagcugggcagcagagagaugggcggaguuucaaaugccaggcuugggaacugaggcaggagaccacaagggaaagaagaagcuggagagggaagacaucauagaguagaugaaucaugaaaacauggccaggagggcgggucaacuggaguaagaguggccaggcaggacaugacaaauuauaacuugggguuauuguuggggaaauagauucuaacagcuuagagggaagcuaucugcccagcucuaaugcuuuagaaguuuaucauaaauauaaagguuuuguuccuuuaucuaggaacugaaugaucaaaggugggguagaaagcccugauugaugaguaaauauuaucuacaacagaucuuuuucuuuuuucucuuuuuguaauguuggggaucaaggguggccuuguccauguuaccugggaggcacuuugucaucaaaccuccccuugugcaagacuucuggauaugaccaaauagcccaacauaucugcagccaucauaagggccaaaagucguuaaaaaaaauaaaacaaagggcuggagagauggcucagugguuaagagcacugacgggccuagcaaacacauaaguggaugcucacagucagcuauuagauggagcacagggcccccaauggaggagcuagagaaaguauccaaggagcuaaagagaucugcaacccuguaggugcaacaacauuaugaacuaaccaguaccccggagcucuugacucuagcugcauauguaucaaaagauggccuagccggccaucacuggaaagagaggcccauuggacacgcaaacuuuauaugccccaguacaggggaaugccagggccaaaaaaugggaauggguggguagggaaguggugggggguaggguaugggggacuauugggauagcauucuaaauguaauugaggaaaauacguaauaauaaaauauauauauauauauaaaaagagcacugacugcucuucuagaaguccugaguucaauuccagcaaccacaugguggcucacaaccaucuguagugggaucugaugcccucuucuggugugucugaagauagcaacuguacucauauacauaaaauaaauaaauaaauuuuaaaaagauaaaacaaauuaaaaugauccaauuuuaaucuaaaaagaaaggagauuagaaaaccaggucagcgguuaagagcaccggcagcucuuacaggacccagguuugauucucaacacauacaugguggcucacaaccaucugugacuucauucuccagggauucaauacccuuuaaaaaaaaagauuuauuuauuauuauacauaaguacccuguagcuggcuucagaugcaccagaagagggagucagaucucauuacgggugguugugagccaccaugugguugcugggauuugaacucaggaccuucagaagagcagguagugcucuuacccacugagccaucuccccagccccucaauacucucuuuugagguccaugggcaccaggaagacacauauauuuauuugcauauauauauauauguaaaauauucauuauguacaaaauaaaucuaaaaaaaaguuuaaugguccauuuuuuucccaaaaacauagaguggcccucaaauacacaugaagauguugaaacccacacaaaugaaaacacuucucaucuccgagucuggcaaacauggaaaaguccgcccacacauucugauagcgaggcuuugaggaagugcgcaugcucacacacggcuaugggaauucacacccaacaagccucuggagggggauucagcagcacgccuaagaaccucguaugugcacaugccgucugagcuagcacuuacagaaauaugugugauaaaaaccacacguguguacauaucuauuuucuuacguugggaagguacuuaaaaguugaaacuacaguaccacacaaugcucuuauauccacacugagaugcugcuaugcugugaccugcaagcucuggacucaacccguccuggggcgaccagaaaaugaauauaaagcaaacucacagacauucacgaagaagagcugggguggggugggauaugcaguuugauggagacucgccagcugccugaugcuuacuauauacgguguuugcuauauacggcucaccaaggaggcagguuagaugauuuggguagggggucaguuggaggggagcaguuucaggcuacagucacucaggaagaagagguuaugguugauacuuucuagacauccuuacucagaccuugccuuucccccgaggcugacccggcgaaggaauuaccauucccacgagucccugaaaugauaguguuccugucaaccaaccacacacauucacuuaggacuucaucuguucuccacacuauuauauacuaaagugccuuaauuguugauaagucagaucguuacacugccaauacuuauuuaaaaauuaaaaccaauaaugcuucugccaggagggcauggugacauacaucuuuaaucccagcacuugagaggcagaggcaggcagauuucugaguucaaggccagccuggucuacagagugaguuccaggacagccagagcuacacagagaaacccugucucaaaaaaaacaaaacaguuucugccaugaaaaaaaaauguuuuaaauugagguuuuauguauguauacauauauauauugcuuuugaagcccacuucauauugcuuuuaaaauucaagauuauuuguaaucucugauaguugggggugggcaagccauagcauuauauguacuuuucuaucucugugaaagaaaacaguuaaugaauccuaaacuagaaaugucgguagaguuggcagaucuguccuuauuugcuguauauacacuucuguaucauauaagcguccuccauuugaguacauucacuaagcacauauuugaagaaguagacaggugggaauagcuauguuagaugacuaguaucaaagagcgguggccggagagcuagcucagugguuaagauaacuggcuguucuucaaggggacccgcguucaguccccagaaccuacauggcagcucagagccuuuuggaauucaaguaacaggggagucaguguccucuucugaccccugugggcaccaugcaugcauauggcuuacagagauacauauagacaaaaacacccauacauauaaaauuaauaauaauaauaauaaugacaaugauauuuuaaaagagagagcaauggggguuagagaauuggcuccgugauuagagcacuggcuguucuugcagaggacccagguucaauucccagcacugacaugauggcucagacuaacccucagugcuggaguucaauccauggccucucacccuccgggaagugguugaugucaugguagcaaggaagcuggcaguauaguguuuggaacagaaaagggauagaagugcccacuuagccauggcaggucucacuagccuaugaagucuagccuccagggcagaacggagguguucacguuacuuuaccauucgguacgaugauggcuuucccgcugaugagccauuguucucaugacugauuaaaacacacuugaucacaggcaggucuugguuuguaacggucucaagaaucauuacugacaaaacaacuguaaaacaaagcagaacaaaaaaauaaugacguugguacgggcacacuguagggagaaaaucagcauaugucuuaccacagaacaagagaacgaaaugcaagcggggggggggggggcacacgggacgaauagucagaagcgaguacaggaaggaaaguuucaugaaagcuguuguagcucugaaugacagcagggcaucccauggagcuagcuguagccauggcaauguucucccucugugcugagagagaaacuuagguugcugucuuagucaggguuucuauuccugcacaaacaucaugaccaagaagcaaguuggggaggaaaggguuuauucggcuuacacuuccauacugcuguucaucaccaaaggaagucaggacugggacucaagccggucagaaagcaggaacugaugcagaggccauggagggauauucuuuacuggcuugccuaaccuggcuugcucagccugcucucuuauagaacccaagacuaccagcccagagauggcaccacccacaaggggccuuucccccuugaucacuaauugagaaaaugccuuauaguuggaucucauggaggcauuuccucaacugaagcuccuuucucugugauaacuccagcugugucaaguugacacaguugcuaauucugggaucccguaguggacagcuuccucucuccucucucucucucucucucucucucucucucucucucucucucucucucuccuucuucuguuagagagcacaccaaagaccucagaaaugcaugcuaggugacccucuaucaguaaguucuuuccagggagguacaucaacccuaagcccucaagcuuagguauuuuuagagccuuuggagguauuugcuuauuucguuuuaauuacuuuugagcuagcacacagagugauguguuucauuaugguacuuuucauguugcgcuucauuuaagcuucuugguuaaauaaaugcaaauaucccaguguucauagcgauauuuugaccaaaaaaaaaaaaaagcucuauacaaaggccaccagaaucaaauuuauucaccgacccaguggcucuuacacugccuuuagcagugagggacuacucaagaguguguucuugucauucagaauaucuuuuacuggcccuugagugauagaucuaauagaggcaggaaauaaguguaugugcccagccgauucugucccuuguaaucucagagccucugggauauuaguucccuucucaucacagucucuagcauuuuuacucuccacucuuuuaaaaaugugauuuugccaaguguggugaggcaugucuuuaagauuuauuuauuuauuuuaugcauaugaguacgcuguugcugucuucagacgcaccaaaagagggcaucagaucccauuacagauauuugugagccacuaugugggugcugggaacgaaacucaggaacucuggaagaacaggcagugcucuuagcugcugagcuggugcgugucuugucuuuaaucccaaauuccuuucauuugaacccugcuuggucuauauagcaugaucuaggccagccaagguuaucuagugagacccugucucaaaaaaccaaaccaaccaaucaauuauaacaaccaugaugccuuuauggucuaauucacuuaaauugacuacguuagagcauuuaacuuaggugauggguauaauguguuaaagcuugaccuauacaagcaccccaacacacacacucaaaucgauugugagcuuuucuuuuauccuccaaaguuuccugcuucaaacagguugcuguccucagauauuguccugcagcuaaacaugggauuccagcugcauucucagcaacgucugcuacaacaagaccaucagucuuucugucacuugaaauuguaucaucauugcaucugugugugggccacaggucagguagcugagcuaguguggugcccacuuuuaccagcugagucaucuucugccuacaagacuuucccucuuccuccggcauacuaccuuagauagacaguguccccucuuuguuucuuuguuucuuuguuguuuuacuguggugauguacucucuucagauaguuugaucaauucaaguucuucaagguuuauuuuaaaggguaauauguuuauuuuaaagguuauuuuguaaagggugauauguauuuguaacacacggggcuuuuaacgucacacugcaucugugucugaucuuuguuuuccugguggccuugcugaggcucauuuccuugccuuuuauuaaccuugguuaccucggcuugucauugcucugcuucucucguucauuggguuuuagcccuggucaugauuuuuuccuuuucuuuucuuucuucuucuucuucuuuuuuuuuuuuuuuuguuuuuuuguuuuuguuuuuguuuuuguuuuuguuuuucgagacaggguuccucuguguagcccuggcugucuugaaacucacuuuguagaccaagcuggccucaaacucagaaauccgccugccucugccucucaagugcugggauuaaaggugcgcgucaccacgcccagcuaugauuauuuucuuuaacuuugcuuauauggagcugaaucugcuauuuuccuuuuguuucuucuuuucuaguauuuuuuuuguuuuguuuguuuuuuguuguuauuuguauuguuuguuugagacaggguuucucuguguaacccuggcugacccagaacucauuccauacaccaggcuggccuugaacucagagaucugccugucucugcuuccugagugcggggauuaaacuugcacaacacugcgguuaacuuccucucaguguuugucuguuugucuguuuguuuguuugcuuguuuaaugugaagccauugcuuugagaucuuuauucuuuuguaguggcucucaccuauaauaccagcacugaaaaggcugagcaggcagauaacguccaugaauuugagaccacucuuuaggcuacagagcaagcaagccucugucucaaaaucaugacacuguagcuaaaagcuguaauuacuaauuaauaaguaaauaucuaauaagaaucuaauguucuaaauuuggggcugggggcaugacucaguaaaagagggcuucccucaaacaugugaggugcucaguugaaucccuaacaaaaaaacaaaaacaaaacaaaaaaaaaaccccaaaacuggaaaacagcaacagcucgggcuagaagggcgucucagugguaaucccugcucgagcaugacuuuagaggaaccucacauguuaucacauucaucgucuuuuccuuacucuucaguucaaacuacauuugauuuucugguuucuucuggacccguggacucuucauaaccgugcuuugauuucucaaauacgucuuucugcuagcaauuucuaauucgguaccguuucugucaaaugauacaucuuuuacaucuggaaucuuccgaaguuuguuggagucguguuuuguagcucagagcagaugcugucccuguaggcucaucagcugcgugcgccuggggguggggguggggguggauguucagcugcuguuaucuuagcggcuuggucgacaguuggucaagacuucucuuugccucauugauggcuucccugccggugcuaaugacugacagaggcugaacccugagaagaugauggccgauuugcuggauuuuccuugcaccucagccagagcucccacacacaguucccagcuuuccuagacacguggauggaugguuaggagucuuuuguucuuuugauaaaacaagccuuccauuacaagugacucugccccgaaacacauucugaugcugcuaagguccuucuagacguuuagauuaggguuagcaugaaauuuucccuucauuuuaaugaaugaaugaaugaauuaauuaauuauugagacagggccucacucuguagcucuaauagaccuaaacucacuguguggacuggguuggccuugaacucacagagagccuucuaccuuugcuccccagcccuggcauuaaagaugugugccaccacuccuggccacucauucuuuucugcuuagccuauuccucucucauguguaggaaacuucauuuauguggcacaaagguugaacuuuucucuuuuaaugaaauuaacuuuguccuuuuaaauacugauuuucauuuuuauguuuuaauuaaaacuuuauuauaaagaacuugaaaauaaaauugucacacagcaaaauuaccuuuuugcugugauauugguguuaaguuuaugagauuauuggugugauuaaaucuaucauucuguccuuugauuucuauguacuuuguuugcuuuuaauucccuugucuucuuuuuucuggcuucuuugggaauaacugacuuuuuacuugagugugugugugugugaguguuugugugugugugugugugugugugugcauacagaggccagacauugacauguguguguuacucuguuauaguuacuguugaggugcugugagcagacaccaugacgaaggcaagucuuauaaaagacaacauuuauuugaggcuggcuuacagcuucagagcuuuagucugauuucaucaugguagaaaacacgacagugcgcacgcagucagauauauuggcuggagaaggagcugaggguucuacaacuugaccugaggcagaagaagaacugacacacuagaccuagcuugagcguagaccucaaagcccaccuccauagugacacacuuccuccaacagggucacaccuccuagcagugccacucuuugugggccaagcauucaaacccaugagucuauggggaccacuccuauucaaaucacuacagucuccaucacucacaaccuaauuuucugagacagguucuuucacggaaccugaguuucuguuucaccaagagggccagcaagccacugggaucaaccuaucccuacauccccagccccagcauuacagaggcguggccuucaaauggaugcaaccgauccaaauucucagaacaacgguauuuucugaucacuccuccuguaugauaagaggcauuccuggagggaugugauaagcacaucuccucagcccagauggagagcccacgagagagcaagauccagaugccaccaaaguccagcuggcuugaaccagugaguuuuauugguguuacaaaaauaugggugaggggucacuuacaagagcagaaaugacucaaagaaugaugcaucaccaaagcccaucccagcaugagcucacacagcugggaacccggagcccagugcacagccugcaggcagcucagcagguuggagagcauccuuuccaagugacuccauugggcuaagccucuugcaggcagcgcugcuaguuucuguuucucccgggcagcuaguuggucaugaucaucucaagagucgucucugcagcuucuauugcuuacucugguagggaccuagugaaucccuucaguuuuaggggcuucuugaagcuguuuugaaguuauuuuuaucucccugcuuaggaugaaauguuucaacuucaggggaaacuguuaugcaacacaacaucauuuguauccauaauauacaaagaacuccucaaacgcaacaauaagaaagucacaaagcaaggaaaugaguaagugugugggaauugcaucacaucaucagccacauagggaaacacaagucaaaaccacaacaugcugugaauuagaacugggaggccgggagggaagcuggcagcaaaauauuaagacuccgacccaggcugagaggggaaccagggacaaacccagaaauccugacugcagcccgugcagacaauaguguugagcaacugcaaucccuauaugcccuuggggcagaugaagaugguuacgcauuuauguagccuaaaacccaucuauacaauaccaugcuuauguauuuacccaggagaaauuaacacuaugcgccuguacuugaauuuuuacaaaaccacucauaauuggcagaaaccaggagaaaacggaaguucaaaaggcaacuuaauagauaaauaaacuacgacauagccacacauuagaauacuauucagcaauagaaagggaaaauacugauauauaauagcaugagguaauugcagagauuuuucugagaguccagacaugguggggcacagcuuuaauccuagcaugcaggaggcagggggagguggaucucaugaguucuaggacagccagaucaaaacaucaacaggcccaaagacauuauucuuuguuuguaaaccgagucaaaagaccgcauauuauacaguuccacacacaaucuuugaaaagagggggaaaauagcaacagcaaagagaugauugacugccagggguuguguguagagaaccggggguuuacaaugaccacaagaaaauugggggugcgauggauaugcucugcguguggacggugaugucaguugucugcuugcuucuaauaaacucugggaagcagacauuuuaaaaggcgacauugcuguagcagcgugacucaguacucaugcguaacuugacgucaucagugugaggguucuuucccaagaauccguuccaaaguggaaauucccagaucauuguggcaaagccagguggggaccugagggagcguuggaaucaaaaaauggcggggaggcucccaaauuuaucugcuuugaaaggaaaagaguggcccugggaagggugcuuccaggaggaugacguuagucuaaaaucaaagucuaggcuaaaguaguucucucuugagaagcucacgguuccuccuacacuguucauaccuccaacccgcuugacucacgcuggagccucuaauaaagucuuuucuuaauaaaccacaacguuguuucgcacaacaccagaacuagguaaauccaggugugguagugcaugccuguaagcccuccggagcuugcagcccucaggaggcugaggcaggagaguugccucaacucucaggcaagucuggucuccaugaguucaaagccagcgagcuacagagugaggcugugucucaaccagcagacacaaaacucaaagugaacaaauaaauauaagcucuccggcgacagagcuauggguuuagacgauaugagacaggggaaugccaagacaccucaucgccuuuucuuucuuuuuaaacaauacuaagaagaaguuuagaauuguuacauguaugccacaugauaccugauaccuucagagucugaaagaggacaucugauccccuggaacuggggacacagaugguugugagcugccaugaggguguuagggacagaacugaguccucuccaacccucauuuuccauccaagcauuagccacacccuaacauuuuaccaucuugauuagccucaaaucaggucggccucuguauuaccguuaucacaauuaaagucuugacugugucuggccuggaccacugccaacagcuccccagcuggucccugcaugccagcucagcucuccauccuccacauugacaccacacauccuccacccaaaaccuucaccacucucuggcaagguucuucccaguuuuggauggacucacagaucccuuuagaaaucaugcauguaaugaauauuuuucccuuaaaaguaaauaaauaaaacaauguacaugggugaccgagaaggagagggagagggagagagauauaacagaugcccugaaaccagucagagguucuuggucuccaugauaaaggccaagcucccugccagcaagauggcucugugcaugagaacagccaugcaugagaacccaagcuuugaucucuggaccuacgugguggaaugagacagcgacccccucaagcuguccucugaccuccauacacauaccuuggugcuccugggcacauaagugcgugcaacacacacacacuaaauaaguauaaaaaauuaauuuucugaguuagaacauuauaaaauauagccaugguaauccuagagaccuuagucacuuaggacuaagucuuagagacuuagacccagcaaccaagacaagaaauacgguuuuccucagguauauuacccugaacccgguuuuccuuagguguguuacccugacccuuguuccuugcuggguuucuuuccuacuugcugggacugccuucccccucugcuucccccaucacacaucuucucagcauugauggaauggucuccucucagaagcuuggccuuaguuucugucugcgugagaggcuacacuuccguagaugcuucuaaaauuguaccacaacuccagcucuguggcauagcuggcaccucagccgccagcagcuuagcauuagcccgugaauccuuugagggcagugcugugagguaauuuggaggugauguaugguaccuggaaagguaccagggacagaacuaggcucgcaugcaugcuaggcuggguaagugcuguaauacggaggcucagcacagcccuggggagcauuacauggguucuagaaguagaccuugcucaaaagcacuuagaaguagugagagagagagagagagagagacagagacagagacagagacacagagacagagacagagagagacagagacagagagagacagagacagagagacagagagagagaggccauacacacaggauugacuccaagccuccuaaggguauuuucagacucugucucccuuucugcaaagcauacaccuaagucaggcacugcagacucaucugaugacggggcugucuccuguucaaaaagagaaacuucagugcaaagccauucccaccaccaaguuuccucuuugcauuuugaguccugagaugucuaccugcauuuccuccaagaacagaauaaguagcacugggaagccugacucugagcacagaggauuuuguuuuccagacaagguuucuucuccguauagcccuggcuguccuggaacugacuccguagaccaggcuggccucgaacucaucaagguccaucugccucugccuucugagugcuggaacuaaaggugugcacuaccacugcccggcaaucacagauuuugaagacagaauuuaguguguaccuuauaauuaaaauccaguauuugagagaaaaaaaugacaagauccugcuccaguguagacuauagcggauucuuggcucccaaucaacauaauaaugacaguagugaaaacacacacacacacacacacacacacacacacacacacacacacacacacacacaugcacuuuacuguuuaaacaauccccccgaaauaccaauaguuccucuuuuaggaucuuaugcaaucccucuagccgcaaaagaacauuguguguguacuuuacauuauuuuuauauuuccuucacauguguugguaucuaaagaacaaaaugcuaugagccaacuuaacaaccguccgugacuuguacaacaacuuucgucguuauuuccguaccacggaggagacagucgcugcagaaacuagccaaaccacccaggcacagggcucacgagagacccugucucuuaaaggaagaaaaccuuuugaccuuguagccacagcuuaagcuuccuuagaagccacagugagggagaaagcccaacaaaguuugcagggguggugaccccaacacuuggagguaggaagaacucaaccaggccgaucuuguuggugagacucugucucggggggggggggggggaaacgacaaaaaacaaggcaccucagacucuaaacacucuccucagguaaacccuugagaguccuaagaugaucugagugaguaacugucggguagacuaagcuaugcaguacguuaaaccaaauuuauauuccuauuuucuguaaggccccuuuguaaguccugaggacuggaugugguagcauccaugucuguaaucucaggacugaggaggcagaggugggaagaguugguuggggccagcuugggccaaaaaaacccuuccucaaaaagucccaaagaacccgggcagugguggugcaugccuuuaaucccagcauuuaggaggcaaagacagacagaucucugagaauuugaggccagccugaucaauguagcaaguucugggacagcuagggauacauagagaaacccugucuugaagaaaagaaagagagggagggagggagggagggagggaggaaaacaauaaauguaauauuuuauuuuauaugcuaauuuuuuaauuuacaaauaaaaguuugccaugauuuuuguuuuuguuuguuuguuugucaaaucaaaauuucacccagagcuaggagugguagcacaugccuuuauuccuagcacucaaaggcagaaagagggagguggaugcccgugaauuugaggccagccugauauuacagagugagcuccaggucauccaggacuacauaguaagacccugacuccaaaccaaguaaaaaaaaaaaacaugcuagguaauacuuagaagguauuuugagucagcaagaaggauucuucucucccucccucccuucccucucucucucuuuugauggcaaucucugacauccaauucauauuucauugccaggggcuccugccacacugauuuccgaguaucauuagagagugaagacaggagaggcccagucugaacugaggagaugguacgggguugggguucucaguggagcagaaacacucccuggugagaaaauguccucaacacauuugcucaaagcaccauucaguaaacugcuucuugcuagguaccauggccugagcuacaggaguuuaggaccagccauaguggaaagaccaaauccaaacagccgcccagccaggcugcaaaauauaccuuuacagucuuggcacuuaagaggcuaagccauccuuggcuauaagauucucucucucucucucucucucucucucucucucucucucucucucucucucacacacacacacacacacacacacacacacacacacacccuauucuaaaccaaacugcuucuuccccacaugcaaaagauuguauucaacuuugcaacucaucauuuauuuuaccucaacugcaagaagauugcuuuuuccacaggcauauaauacaaucugucuauaguuaagaaauuuuacaagguaaugcccuugggacuccuauucuuuucuaguugaagcaucacugaagcaugcugucuuuauuuaauuuuuuuuuuuuuuacccuuguguguccacacgauguggauauauguaugguucacacuuguuagugcaggcaugugcaggccagcaugcacuucuggaggucagaggagaaccucaggucuuuucacccuccaccuugucugaggaaaggcuguugcuugcuguugcauggcuggccuagcugauccauguuuucuaaggauucuccugucuccuuccccauaucccuguuucccugauauuacacaccaagcuuggccuuuaaauagguucugaggauucaaacucaugcuauguuuaaucuauagguauuuagcaaucaaaauaucuguugguaguacucuaucucuuuccucauuguaaaauauauauauaugaaaacagcugcugaaaaguuaaacuaacuaaaagggaaucucuuggggcaggagaaaggguucagugguuaagagcucuucuaguguacugggguuugguuuccagcacccacaugguggcuuaccaucaucuguaucuccaaggcuaggugauuuggcgcccucuucuggccucuguguacacugcacacacauuguacauauacauguagacauaccugacuaccugaguuugaucccugugacccauguagugaagggacagaacugacuucuacaaguuguccucugacuuccaccugcuuacugugacacacacacagagagagagagagagagagagagagagagagagagagagagagagagagagagggagagagagagaaagagagagagagagagaaacagaaggagcugggcagugauggugcacacuuuuaaucccagcacuucagagagagagguaggugaaccucugugaguucaaggcuagccuggucuacagaacaaguucuaggacagccaggaauacauagaaaaacccugucuguuucaaaccccacaccauacacacacacacacacacacacacacacacacacacacacacacacacacaaagauuuaugaaaugcuuuccuugggaaagacaaagacuauggaucuguuaaauagaauaagacuggauauccauaccuaagcugagacacuaccauccuuugccuuuuugccuacauuguccaaaacaguucugugcuugacacagaaauaagcacucaauaacauggauuaaauuaaaauuuuucuccucauuugugcuucuauucgcuuuucucaucugaaguuuuccuaggaaaugcaaacuccagcuuuaaagaugaccuuuauuguauuacguguuuguauguaugugugucugugcauugguaagugugugugcaagugcugguguguacauaugcucagagguaucagauccccugaaucuacauuacaaugguugugagcuaccugacauggacacuaggaacugaauucugguccucugcaagagcagccuucacucuuuaccacugggucaucucugcaaccaugccuuccccauccuuacuauuccugaccucauuauuuucauagauaggcacuuucaaaaccaaugaaaacaucuuaacugauaacuaaaaguuacuacaaguaucauuccauuuauaagauguagagcauucuuuaauagcauggaggagucccccccccccccauuaacccucggaaaauuuacuacaggcugauaugaaguuccuaugaagaaauuaauagcuaaugugaacucagaugaagcaggaauuaaaaacuaaagcacaagagucaggggccaucacagguccgguauccaaagggcccauauauuugagugcuuggucgcaguugguagaacuguuuggaaaggguuagaagguguggccuuggaggggugugucacugguaguagacuuuugggugucaaaagccuacaccauuuccaguuagcucucucuuugugugaaucaagauauaaacugcugcuccaguaccaugucugucugccuauugcuaugcucccaccaugacagucacagacucucauccucuggaacugcaagcuccauuaaacuccuuuuguuuucuauaaguggccuuggucauggugucccuuucuagcaaaagaaaaguaaccaagacagguugguacuaggagugggguguggaggacuucgggacuuugaccaccauaaaaagagcuuaaugcacuaggcacuuggaagacaauaguguugggagcaauguggaccagggaggcccaucucuggaaguuuuacaggggaaaaauacuagcaacugggcuugagaccaucuuucugauauguuggcaaagaaugugacugcuuuuugcccuuguccuaagaauaugccugggacuuauuucuuuggcacaguuuauuccaggguagccuuauagugaccguguugugugguucugcgugaucacucucuugccgaucuacagugaaaagggggcacaagcagggcaaaaagaaauuuuaaaaauguacaguuugaguugaaaaagagcaccaggaaauuuaaaguugaagccaagucuugugcucagagaguuaagaagcuuaaagaaaagcuuaaagugggggcuggagagauggcucagcgguuaagagcacugacugcucuucugaaggucgugaguucaauucccagcaaccacaugguggcucaaaaccauccauaacaagaucuggagcccucuucuggagugucugaagacaguguacaguguacaguguacucacauauaguaaauaaauaaauaaauaaaucuuaaaaaaaaagaaaggcuuaaagugacauggaauccagggaguccugcccucaggccgagaccccacuuacuuaagcugagagucuaccuuuaguuaugaagcauauaggaguacaccgguuguggaaugucccuucgcaguuaaggagagcgucugagaccaggccugugucagggaacucccuacauggagacccacagaggccaaugcuaaaagcugugaaaaugaagucuggacuguguuggagacccuaggauguuggggauaccaaagcuaugggauuccugccaaggacagcuucagaccaagaaccagcucaucaaagagaagugugucacagucagcgaggcuggaagggcagagcugucuaagcuuuugacaucagacagagcacaggauuuggaguuugcccuucagucuugcuuugauccaguauuucuucacuacauucucguuuucacauuccaaaugaaaauguauuuucuguaccguuguauguuggaaguacacacuuugcuuuugggcuuuugauuuuacagggaauuacaauuaagagacugccuugagucucagaagggacucugaacuuuuaaacuguguugagagucuauggggacuuucacuugaucuuagccaaaaggccgagaagcgaucuauggggacuuucaaaguaggauuaaaugcgcuuugcaugaugacagggcuaaaagccagcaagugggggccagggaguguacugucccguucugaggaagaauggcccccuuaggcucaucuguuugaaugcuugugccacagauauaaaaccaauugggaaggauuggguguggccuugauggaguagguaugucauuagggguagacuuugagguuucaaaagcccaagccauucccaguuagcuuucugugucucaugcuugugggucuagaucugagcucucagcuacugcuccagcacagccugccuaccaugucugugucagccccgcccccagaagagccauggacucacccucgaaaacuguaagcaaacccccgagaaagucuuucuuuuauaaaaguugcuuuggucacagugucucuuuacugcaauagaaaaguagccaaggcaaccaauaacaacgucagcaacaagacuguguccugcugcucuaugaacuccucggccauaauggaagagacagucucucguuuguugucauauugaaauccucucuuugaaguagcagugcccaacacaaauaaagccacauguacgugaggccuggagucugagccccagcacugaaggagaggggugggguauaacagugauuugcucuuuguaaaucucaccaacuggcaaaagugauauagagugaguuugaggaguggggguaacuuggaagcugagucacucuaugucuugacguacagugguuauguagguacacugauauauaacaacuggggaguggacacagaagauuuugcacauguguugcgcuuugaaucuggagagggacuaagacauuuccuacgaaggaguucagugcgguuugagcauggcugcaaguccuacucugauucugaguuacuucccuagaacccuuuagcccuuuagaaaaaucaucucugcuaugggaaagucacuaaucuaaucucauacacagccaaagcuaaccauuuugcauuaauagagccugaaaagaaaagcacgccacgccaugcguuugagaugucccugugcaucaacucgcuuaagaaagguacagcguucuccccauccuuuuccuuuauagccuacauuuuuuaauuuuaucaucuuuuuuuuuaaaguaauuggaaaccguuucugcucauuuaauguugcaaaauguuuucucuauuugucacggaagguucaagccagaauccuaaauguuggaaaugaaggggaaauaggccacugggcagacugaggccaagccaggagugccucagaaggcugcaaaacuagggcagggccugaucuccccccacccccacccccgacuucuagaacugucuccaacuccaacucaauccaacccccuugucuucccaaacagaaagcugacgcgagaccgauuagaacugggcagaauggggacuuuccccccuauaguuaguuacuauuuucaaucacagcuaugcuucuacccgaacaggcaacuugggagaguaguccuaggaguccuugaaagugucacuaggguuuaauccuaaaauaagaaaaguauggagaggggaaggguagcuaguuuuuaaauuuauaaaucuguuuugcauaguauuuccaaaguaacuagccacugagugaagcgaaaauugguacaggugggggucguuagcagggaugaccgcucuagcagaggaugcucgcaguuuucccauuaguuugcucugucagccuacaucucaaagaggugagaacgcaccggcucgagaaucuauaguacccagaggucgggucagggagucucgggccaccugcgcugcugaagaagacucucagaggcugacggagcauccaagcccaagcccaggcgcgguggccuggggacugagcugcagaggagcgcugcggaggagggugagggcaggggugggcaaaccaaagccaaguucaccgcuugaaaggggggacgugaaagaggggagugaugcggcggcgaggggagcgcgcgguggguaugagggagugaugcgcgcucggccggggugcagagggggugaggggccuuaccaagcagcagcagccgccggucgcugcgcugcgccaacgcccgcauggccuccggagcgcgcgguagccaggccgccggcccagccugugaugcggucccagcggcgcgccccgggcugcagguggcucgcugaaggaugcgcgucacugaccacagauucccucggacuggugcagagcagagggggaggaaccucucuccagaggccgcggccgcucgcugcuaggcgggcugaacuggcgcagugcugcagccgaucccacgugccc

SEQ ID NO: 12356 - RNA, 47128 nt, Mus musculus
ggcuuuucgcgggagcgggagccgugaggcguugccgucagucagcuaccgcugcgggagcggagcgggucggugcggccggguguggcgggcgugcgcuccggggucgugaggccgugagggacgcgccugacaccccggaggagccagucgaccuccuucacggccacccggagcagcugccccggugcagcccgcggcguccucccagagggauccggcgcguccagaguccgcgguagcugccccguucugcagucgccggauuaccuaacgugugugucucggcucccugauuagucaaugugaauaauucuaaauaacguuagguuugucuugucauugacucccaccauagccacuuucgggugcugugauguaucuaguagccacuugguuggaagcacaguuauaaacuguccccaucuucaugauaaguucugcucuugucccaaaagauaggccugagguaggauaagcuuccaagcgauucugguuuuaccugucacaagaaaccaggcuugugcagugucuguuauuuucucuuuugcagacuuccuuaccgagcaucggagaaauacuguagagaaaaugcccguugaauacaaaaggagaccaacuuuuugggaaauuuuuaaggcgagaugcagcacagcagguauugaggaauuuuauaaaaccugguaaauuaagucccauuaaaaaaauauuuucaauaaaauaagucaaggugaaugcuugcuuuaaaaacaaacaaaaaccccagcaccugggagacagaggcagguggacuucucugaguuugaggccagccuagucuaaagagagagauaaagggcuuuauagagagccucugucucagaaaaacaaacaaaaaauuacuugagcuagguuauaauccuauggaagcugaggcagaaaacugagccagguggauuaaaugaguucaaggccaacuugggcuacauagggaauuccuggaugucaggagcaacagagcuuagaccuaauuaaaaacaaaacacaaaagagggaugaaagugacccuggucucugcauuuguuccucagcaucaauuuagcaggcauuagcugauuccuguaaucucaccuuugggagguagaggcaggaggaucaggaguugaaggugauuugugcuguaaacaggucguggagucagauccaguuaacauaaucuuuuccuggucaaucagaugauguagaauaccuaaacugauggggaacuaacucuuugacuuccaguggaaagaacuguuuugaaagggcuacgagcaaaucagaagcauuggugaugcuagugaugaacacuuuucaaaccuuuuaugacuuauuuuguuuugagcuguaugaguguguuuguguauuugcucugugugugucggugccuacagaagucagaagaggacaucagguccccuggagcuggaguugcagguugguugugggcugugauguagaugcuagacugaguuugggucuucugcaagagcuucuuaacccaagagcuucuuaaccacugagucauuucuccaacccuagcuuucucuguuaaaugacaucgucuugcuccguaaccaugacugauuuacgauuugcuauguagaucaggcugguuucaaacuugcagugaccuuccugagugcugggauugcagugugaacagccacaccaggcucugaauuagauaucauaaauaaauauugacagugcaugaaaaagaucacauccauuaauauuacaacugaucugauaaguuuuugaagucuggaagaagucagcuacuguuaguucucuagaaauuguuaauuucauuuugaaagcucacaucucaucauuagcaacacacuuuugucuuuacuauaaaagcccacuucauucuagagaaaaugccugccaaacuucugucugcaaaaaugcuacaugcauuuuguuucucagaaaggauuaaaaaggcaggcuaaggaauuaaagcuuggucccaucgguggcuuagugggugaaagugugugcuacauaggucugaugaccaguuucuaagccagaagcaacaugaagguagacucuugauuccaugugcacacaucagauacacggcaaugagaagguuggagcaugagcuucauacuguuccuuuuacguuguuagugagucccuggcauucuccuguggauugcuaggcaauguuaagugcuagugcaguuggguccacugccuucugucauguaggugcaccagguguuuacauaccucauuccuuguuguacagauguugacauugugaaaaggacaaagaacaccaugcucuaauuaugaaaauauauugaaccccccuaugccguggguaacagcuauauagggugguuggguccuguuugacauuuuguuguugccauguaagaaucuuucucauguuuauuugaaacucuggcccauauucaaagauuugucauagugauggaguuuucauaaucauuucaguuuuaucuaugaaguacaugcuugcugugaguaguuuggguuuuuuuuuuuuuuaacuuugaaucaugaguauuauuaagaagguuagaaacauaauauaccuaaacucuuaucuccuuguaaguuuuguaaaauuauacaaacguuagugcacuuucaaaagauuaaacuaauaaucuuguuuaauaaaccuuuaauuacuggucacaauuuuuuuuaaggauuuauuuauuauacauaagcacacuguagcugucuucagauacaccagaagagggcaucagaucucauuacagaugacugugagccaccaugugguugcugggaauagaacucaggaccucuggaagagcaaucggugcucuuaacccuugagccaucucuccagcccccacuggucacaauucuuauuuguuuuuuguuuuuucucuucucuuucucuuuguuuuauucauuugugucuuuuguuuuguuuuguuuucuguauuuaauuuaguaugcacuagauuauggagucuuuuguuuuguucuuaguuuuuugguccucuuugagacaggguuucucugcauaucccuggccauucuggaauuugcucuguagaccaggcuggcauuuaauucagagaucugucugccucuuccuggcuucccuccauugcucccuugcucucucccucuccuucuuccucuuucuuucccuccuucucuguccuucccucucucuccccugcuccccccaccccuuucuugauuaguuuucaagauagggucucauuauauaggcaagcuagccuggaacuuauauaauccuucuguaugcucccagaugcuagaauuauacauuguaaugucauacccaagugagaaaugguguuuuguuuuaugguuuugguuuuuguuuuuuuuaagauuuauuuauuauuauaucuaaguacacuguagcagucuuuagaugcaccagaagagggcaucagaucucauuauggaugguugugacccaccaugugguugcugggauuugaacuuaggaccuucagaagagcaguuggugcucuuaaccacugagccaucucuccagcccgaagagauauuuuuguagaccucaagcgugagguuuuccugccccaacccucaagugcuagaauuacaguuguauaccaccaugcccacuuggucaacauuucaaguuccuuuuguuuaguauuaguuuguuuuauuguuuacgucuugauuuauuucgugauagggacaggguggugggucaguuagaggacaaccugcaagagucuuccaccauguggauucuacucaugaccugaggucaucaacuuugaugguaagcaccuuuaccugccaagccaucuugcuacaguguuuuguguucugagaugaagaucucaauguguugccuguaagaucuucaaaauuguaguccuagcagggcggugguggcgcacgccuuuaauuccagcacuugggaggcagaggcaggcggauuucugaguucgaggccagccuggucuacaaagugaguuccaggacagccagggcuacacagagaaacccugucucaaaacaacaacaacaacaacaaaauuguaguccuccugucucagaccuacugaaagcuggaacaacaggugaauacaacugugccucuccuuuauucuucacugugaucuuugaagcuuuuugcauuuauugauuuuacaugugugcguacacauauccccugugaugguuuguauuauccuugggccagggaguggcaccaucugaagguguggccuuguuggaauaggugugaccuaguuggaaugggugugucacuguggguguggguauaagauccucacccuaguugccuggaagucagucuucacuggcagccuuuggaugaagacauagaacucucagcucugccugcaccaugccugccuggauacugccaugcucccaccuugaugauaauggacugaaccucugaaccuguaagccagccccaauuaaauguuguuuuuauaagacuugccuuggucguggugucuguucacagcaguaaaacccugacuaagacagaaguugguacugagagugguguauugcugugauaggccugacuaugcuuuuauuugaaagaauguggauuuugggacuuuggauuuggaaagcaguggaaugcuuuaaauggggcuuaaugggucauccuaguaggaauauggaagacuuuguugcugggagugauuugaacuguguugaccuggcccaagagauuucaaaggagaaaaauuucagaauguggcauaaagacugguuuugugguauuuuggugaagaauguggcuacuuuuugcccuugucugaaaaguuugccugagacuaaggugaagaaacuuggauuaauugcauugacaaaagaaguuucaaaaaagcccagcagagacuuuguucucugguuaagucuuaugaagagaaguuugaacaagcauagcaagcuuagaaaggaaaaauauaaaauauaugguucgaguauuaaagggguaccaggaagugaaauggagcaaaaucuuguguucuaggagauaaaagauuaagggagugggaccuugggacaagauucuacccagcuuaauuagauccaggcauggugguacacaccuuuaacccaugagacaagcaugcugaucucugcauucaaggucaaucuacagagcaagaaccaggauagccaagcuuaggcagugaaggauuuagaauaauguacuaguacaaggggauuauguucuaguuccuguaagcagcagaacuuggcagcuucagccauguggcucuggcucuagaguuaagaauggaaggaacuacugggaaaauugaugcugguuagcuggagcuaaggaauuagcggugauuaagaagagaccagcaucguugagguaaaaucuucuggaaauuguuuucugggagcacaaagaagcuguguuccagagauacccaaggcuguaccucaugcuguggcuggacuugguaaugugucugcuugugaaagaaugaagggaucauggagagaagcugaggcuuagcacugugagaggccagggaaggccauuggagaaggugaagccucagcuguaguugauggcccaggacugaaggggucaagcaaaggauuugaggcuuggcacccugaagagagccuaugagaggcuguuggugaagccuagugggaguggaauaccccaguguauuggagaugucaguaccauggagugaucaccaagaacugcaacuguaguggaguggaucaaccuuagaaugcuacagagggcagagcuggaaaagugaugccagcccuuaggaggaguccaaaagaugaaguggaaucccggacacugaaacaagaagcuguaacauugaaauugccuuggagacucaaagauguuaaagaugccagagccaugggauacaugcugaggaaagcugcuaacagggaguggaaccagcccaggagaaagcaguuuguugcagucaacaaaguugaaaaaggaguggagaucugaagaccgcuuugacaucagccauggagaugcagaguuuggaguuugcccagcugguuuccugccuugcuuuggggauuacaguuaauuaaguugaaugaaucucaaaaaagaccuugaacuuuggacuuuuaacauuguugcaacugcaauagacuaugaggacuuugaaaguuggacuagaugcauuuugcauuaugcuauguuuaaguauggcccccauagacucauguuuuugaacaagucuauggggaccagggaguggaaugugaugguuuguauuauccuuggaccagggaguggcaccaucugaagguguggccuuguuggaauaggugugaccuaguuggaaugggugugucacuguggguguggguauaagauccucacccuaguugccuggaagucagucuuccacuggcagccuuugggugaagacauagaauucucagcuccuccugcgccaugccugccuggauacugccaugcucccaccuugaugauaauggacugaaccucugaaccuguaagccagccccaauuaaauguuguuuuuauaagacuugccuuggucguggugucuguucacagcaguaaaacccugacuaauacacccccaugacacaauaaugagaaaacaacuucugaguguguguuucagucuaacucagguugucaggcacagcauggagggagucaccuuuggcaacccuguucuuuauaaugaucuucauuguucacgaguuucuccgugucauucauuaaaacuaagaugagguuuuugucuuuuuugcagauuuaggaccgauaagccucaauugguuugaggagcuuuccucagaagcccccccauacaauucugaaccuccggaggaaucugaguauaagccccacgguuaugaaccacagcuguuuaaaacaccacagaggaauccccccuaccaucaguuugcuucaacuccaauaauguucaaagaacgaagucaaacucuaccacuggaccagucgccuuucagagaauuagguaacuagcuaggugugguggcacaugccuuuaauccuagcacuagagaggcagaaacaggugggucucucugaguuugaggccagucugcuuuacuuaucaaguucgagacagccagagcuacauacuggagagaugcuuucucaaaaaagaaaaaaaaagcaaagaguucaccauagauuuaacuuggguaaaucauguuaugugaugaaggguacaugaacugggacuuugggcaaaguauauaaaaucagcucugugaugaacugaguucuauugugcaaauccgucuuccucaucucuuuccugacugaaggauggagauaguggaaauacugugugauaagcuuugguucagugaaauaauuuagguauuuaauaaaugccucuucuuucuuccuaugcuuaacauaucagcaacaaagauuuucuaaauuaugacuuugauauucaaaaugacucgucuugauguuuacuaagcuguauuucuucaagucauuauaggguggagauuuuuuuguaaucaauuucuuguauuuuaauuugauaucaguuucucugaccuaugugccagguguuuauaaacacuuguuuaguaaaguugugcguucacucagucucuguaacauuuauuacuuucuugacauguaugcccuuuucuuuagaguacugcuuugugauaugcucagugaacaugucaggcauuguaauugcuguggauguagucagaagacaguaucuuuacugguugaugguggugcauugauccuagcauucaggaagcagaggcagguggaucucuaugaguucaaggcuagcccagucuacauagcaaguuucaguauagccagggcuacauagagagauucugucucaagaaaggcguguacagggaaacaaacaucuuguccacaguucugcagguuuagcaguguucguucagagaagccagaugguaggguuacaaccaaggguggaaugcaaaaggauagcaucauaacagucaagucaaaugaggccaucugcuuaccaguguaguuugguagcgugcauguucaucauugaaaagcccuaguuuuuguguccaacaccaaggaggaagaaaggaggcaggggagguugcagucacgaagccuugcuuucccaguuguauucaggagucuaaaacugaaugguugaaagcuuuucacagaaggauggucagguuggacuaggugucuuccgugaugucauauauggggugcacaccaucccuugagaugaguuucuauagcaggccccagcaccuuuuuuuucuguucuuaaguucaaaaaguaaaagcucaaaauguacagugucugcacccucacuggauuauuuuacuguuucagggaagguuguugcaaguaguaaacauaaaacucacagcaaaaagaagaccaaaguggacccugugguagauguugcuaguccgccucugaaaucuugucucagugaaagguaugaugagacugauguauauuuuauaagugcauaagacauguucuauauguuuguuuuuagggccuggucucacugcaguccaggcuggcuuugcacucagaauccucuagccuuagccucucacagggcuggggauucagucaugaaccgucaucuugcauaucuguuauuaaaauguauuuaaauaaaacauuuucuugcauguguuuauuucacagaaauaagcugucaugcagauuguuuuggccacguaccuucuggaagaacuccuauuuuuaaacaaaaaguaauagauuccuuaauuuaguaauuuuuauguuagaaacuuugaaccaggucugguaacucacuccugaaauccuagcgcaguaugaagccagcccaggcuaacuuagcaagcccuugucuccaaaaccauaaaaccaguacgcuucggugcucauugaucuccuuguugcugcuguuacccuuuuaacccaaggccacuguuucauuuugucuagcccucuuacucugcggugcacacaggcaguacuacaacgagaaaagccagguaugagcacagcaaauguucuuauuuuuguugucuuuugagaccuuauuuacaucuaauuuguacuaugaauguguugccaauguguauguguguacacuaugugcaugccuugguguccagaggccagaaaugagauccccugaaacuggaguuucgggugguugugagcugccuguauuagguucuaggaacacaggccuuuugcaaaagcagccagugcuguuaagugcugagccaugucgucagcccuauuuuuuuauuuguaggucuuagaaauguuaauaaagaucuaauaauuuucuaucuuuucacccacagugguaucuggaaguuuauuuuauacaccaaaacucaaggagguaaauguucugcuuugguaacuuaagguauaucaguugagaaugggacaguguguauuaucccuuugacuugagaaucaagaucauuacuuagcaaacuguuucccagaggcauuaaguaagugauaaaugaaaaugugaaugaaaaguuaaucgucaguguuucuguaaaauaacgaccgucuuucuuuguagggucagacaccaaaaccuauuucugagagucugggaguugaaguggauccugauaugucuuggacaagcucauuagcuacaccaccaacccuuaguuccacugugcucauagguaauagugacaaacguguacuggacaagaagagccagaggaggcugcuaaguugucaucuccagucuuauguuagaaagaaaauguggaagggcuggagggauugcucagugguuagagcacuggcugcucuuagaguauccugguucaguucucagcacccaugugguggcucacaacuguccauagcuccaguuccaggggaacuggugucuucuucuagccucuauagacuccugcaugcaugugauguacauacauauuuguagacaaaacacccauauacagaaaauaaaaguaaaggcuaaacauguaagugaacaugaaaacacauauuacugugcgauaaguguuuguagaacaauuuuuuguggguuuuuuggguuuuuuuguuuuuuguuuuuuuguuuuuuuguuacuuuuuucgagacaggguuucucuguguauuccuggcuguccuggagcucacucuguagaccaggcuggccuugaacucagaaauccgccugccucugccuccuaaguguugggauuaaaggugugugccaccaccaccuggcaauuuuuuauguuuuauuuaaaaugcaaucaaagggucacauauuuuaguagucugucaucuauauaugauaacaucauacacauuuauccacaauauauagccauguuacguaugugugcuuauucauaagauacguguaugacugugguaauccuuaaauuaugaguuuauauucaaaccauaauuuuuuuaguauuucagguuuguuuguuuuguuuuuuauucugcaugugugcaaguaugcccaugugcaggugccacagcauuaguguggaggucagaggacaauuaacaggguugguucuuuuauuccaccaugugcaauccagggauccagcuuaggguaucagacuuggcagcuagcgccuuuaccuucuaagccaucuugccagcccucaaacuagggcuugaugauuccugccaaauaacuuuaguuuugauccauuuagcuagaagugacuggacuuucuuuuguuguuguuuucuaaaagaauuauuuauuuauuuauuuaauguauaugauuaugcugccacugucuucagacacacuagaagagggcaucagaucccauuacagaugguugugagcugggaauugaacucaggaucucuggaagagcagucagugcuucuaacugcugagccaucuuucuagccucuuuuuguuguuuauaugaaauaauaaaauaaaagggcugaaggauaagaagugauuagcauuaauuaugccuuccaucuguaucauugucuuaacagaggcuaaaggcucccaaggagccuuugaagacauaacuuuacagaucuuucaucugcccuuguagagaacauaaagcuaguaucaccaaaccacauuaagaaacagugugacagacuggagagauggcuuagagguuuuaaacacacuggcugcccuucugaagguccugaguucaaaucccagcaaccacaugguggcucacaaucauccacaaugagauccaaugcccucuucuggugcucuuucuggugaaagcagcuugugagcuguuauaaauaaauaaguugccgggcaugguggcacacgccuuuaaucccagcacucggggagguggggggggggggcagaggcaggcgaauuucugaguucgaggccagccuuguuuacaaagugaguuccaggacagccagagcuacacagagaaacccugucucaaaaaacccaaaaaauacauaaauaaauaagccuauuuuaaaaaaaaacaacaggggugcuggugagauggcucaguggguaagaucacccgacugcucuuccgaagguccagaguucaaaucccagcaaccacaugguggcucacaaccaucuguaaugagaucugacucccucuucuggugugucugaagacagcuacaauguacuuacauauaauaaauaaauaaaucuuuaaaaaaaaacaaacaaaaaaaaacaacaguaugacaaguuagaccauguugguguuucucguugcuggcuuuggucacacuuucagauguguguguguguguguguguguguguugggggggguuccugaagaaguauguuuguguauuaauuuuaguguauaauauauaauccacuacagcuaaauuuaauuguuuuacagcccgagaugaagaagcacgcagcucuguaacgccugcugacucucccgcuguaagucagugucaggcugguguacucuccguacuacucacucugaaugccuucacuugauuuuguuuuguuaguggugcuuaugcuuuguaaaaaauauuuuuuuaauucucugagguggccacucauguauguaauauauuuugaucauauucacccucucuuccuccucuaacuucccccgugauccuucccaacaugaccuacucucaacuucacguauuuuguucuuuuuaaaaugauccccugaauccacuuagcgcuccuuggugcauauggguguggggcacuggagaauagggcagcugacuaguggccauaccuuccccccaggugacucucccuuccucaguagcuggaacucacucuguagaccaggcuggccucgaacucagaaauccgccugccucugccucccaagugcugggacuaaaggcgugcgccaccacgcccggcucuguuuuuuacuuuuuuugggauggguuugcuaugcaguccuaacuaacuagccugaaagucguguaaaccauuuuggucucaaacuugggauggucauccugcuuuugcuucccaagcaguaggauuauaugugugugucacugugccccagcuagccugaauuuuuaaacugcaauuuauaauuuuccuaaguguuuggagauguuucuuaacaugauccuguaugcaauuucuuccuauaaaauuuuuucugucuuucuauuugguaacacguacguaucuauguguguaaugaaagaguuauacuaauuaaugauuuugaucacaauuucugcagacuuugaaaagcuguuuuucuaaccacaaugaaaguccacaaaaaaaugauagaucuguucccucagugauugacagugaaaacaaaaaccagcaagaagcuuuuagucaggguaaguaugucuguuuaguugagcuacucaucugaacugaugacacuguccuuuucuuagggagaaauacauugcuuuucuuuuucucaaccuuugaaauauagaagauagaaacuaacuagauagauuuguuuuucauaauuguaauacagaauuuauuaacucgcuacacugggguugauaguuuuuagaauacuagauugaguacauagcacuauuaaaggugacccucaauuguauagaacaggaaaaauaaugaguuauuuaagauuaggguaugaaaaaagacuuugaauacauugggauccgauuuuaggagaagagugacuugcugaaagaacuggcauucagaauaaccucuuacugcugaccuguguauuauuuaaugugagcaauuucugaaaagaauugugagaauaauaggaagaauaugguugcauuguaaauauuauaaugugcuuuuguuuugaauuuuaacagguuuggggaaaauguuaggagauucaucuggcaaaagaaauagcuucaaagacugccuuagaaagccaauaccaaauauucuagaagauggggagacagcuguugauacuuccgaagaagauaguuucucauuauguuuuccuaagcguagaaccagaaaucuacagaaaaugagaaugggcaagacaaggaaaaaaauuuucagugaaacaagaacugaugaauuaagcgaagaagcuagaagacaaacugaugauaaaaacucauuuguauuugaaauggaacuaagagagagugauccuuuagauccagguguaacaagccagaagcccuuuuacagccagaaugaggaaaucugcaaugaagcuguacaguguucagauaguagauggucucagucaaaccuuucuggucuaaaugaaacccagacaggaaaaauaaccuuaccucauauuucuucucauagccaaaauauuucagaagacuucauagauaugaagaaagaagguacuggcucuauuacuucagaaaaaucuuuaccucauauuucuagucuuccagaaccggaaaagauguucagugaggagacugugguagauaaggaacaugaaggacagcauuuugaaucacuugaagacuccauugcagggaagcaaauggugucuagaacaagucaagcagccugucuuucuccgaguaucaggaagucuauauucaagaugagagagccacuugacgagacuuuggguacuguuuucucagauaguaugaccaacucaaccuuuacagaagaacaugaagccucugcauguggauugggaauacuuacugcaugcucacagagagaggauucuauauguccuaguucaguugacacuggaagcuggccaaccacucucacugacacuucugccacugugaaaaaugcagguuugauauccacucuaaaaaauaaaaaaagaaaguuuauuuacucuguaagugaugaugcaucucuucaaggaaaaaaacuacagacacacagacaguuagagcuuacuaaucuuucagcccagcuugaagcaagugcuuuugaaguaccauugaccuuuacaaauguaaauucagguauuauucuuuuuuucuucuaauguauauagucuuuaggaugagauuaaguuuuccuauuugaauauaaguuuuuuguuuuuugaauuuuaagagaaacacuugcuuacuuucuguaguuuuucagaucucuuuuugguuugguuugguuugguuugguuugguuugguuuggugagaacccuguguagcccuggcugucuuagaacuuaggcuggccuggaacuuagauauccgccugccucugcccccucagugcuuggauuaaauccgugggccaccucugccugauucuaggaaucauuuaaucucagagaguaccuauauagauuauugucgagauuuuggauuuggucuuucgaauuaugucauucaaacuuauuggggcaguuggcaccauauauuguugggucuuuguuuuuuguuuuuguagcauuuauugugcauaugugugugggcauaugcaugacacaugauguauguguggagcucaguggauuacuugucugagucaguuuuccuuuuucaccauguggaucuucagguccucaggcuuaauggcaagugcauuuauacccuaagccaccauaccaucguccccucuuuguauccuaugcugguuuuuaacuuagccuugagugaucauccugcuuuaaucucccaaguaguuggaaccacagauuuaccacugugucuugcucuauggcuccuaagacagcuuuuuauccaaacacguuaggaauuugacugcuuagcuccugcuuuaaaguauuuauuauguacaaauuacauagcuaaaaaugguguuuacuuggaaagcugaagcaggaggauuauuugagucuaggaauucaaggccagccuggggaacauaagagagacuuguuguuucuguuccauuccucaucuccauggugugaaaucaguuuugucucccugugagaaauuguaaauagcauggugaauagguugaugguauugguacuagauuaccaaagaguuguuugagcuccagagaccuuggaguuuauagauacuuaugcuacaucuagcauuuuauguggaugcugggggccuggauucaugucuguaugacaggcacuucacugacuaagcuagcuagcucuuuaggcucuucauguagaaauuuaguaacuucaaaauugcaauuguucaaggauuuguuuuaaaucucuaagucacccuuugcucuucuuguacuucuuuuuuuguuuguuuguuuggguuuuuuguuguuuuuuuguuuuuguuuuuuugagacaggguuucuguguauagcccuggcuguccuggaacucacucuguagaucagacuggccucgaacucacagagauccgccugcuucugccucccaagugcugggagcgccaccaccgcccagcuuucuucuuguacuucuuauuuuaaacacuauaacuugggaaaagcacugaguggaugcaauuaaucguacucuaacuuguccuaucacucuguuuucuuaugcauagguauaccagauucuucugacaaaaaacgcuguuuaccgaaugauccugaagagccauccuugaccaacucuuuugggacugcuaccaguaaagaaauuaguuauauucaugcauugauaucucaggaucuuaaugacaaagaagcaauagucauugaagaaaaaccacagccauauacagcccgagaagcugacuuucuguuaugcuugccagaaagaacaugugaaaaugaccaaaaaaguccaaaaguuuccaauggaaaagaaaaagucuuaguuucagcaugucuuccuucagcagugcaacucagcagcauuagcuuugaaucacaggaaaacccucuuggugaccacaacggaacaaguacucuuaaauuaacucccagcucaaagcuaccucugucaaaggcagacaugguuucuagagagaaaauguguaaaaugccagagaaacugcaaugugagaguuguaaaguuaauauugaacuaaguaaaaacaucuuggagguaaaugaaauauguaucuuaagugaaaauucuaaaacuccugggcuucugccaccuggugaaaauauaauagaaguggccucuucaaugaagucacaguucaaucaaaaugcaaaaauagucauacagaaggaccaaaaaggcucaccuuuuauuucagaaguagcagucaauaugaacucugaagaacuuuucccagacagugggaauaauuuugcuuuucaaguaacuaauaaaugcaauaagccugauuuaggaaguucaguggaacuccaggaagaagaccucagccacacacaagggccuagucucaagaacucucccauggcaguagaugaagauguagaugaugcgcaugcagcccaaguguugauuacaaaggacucagauucauuagcugugguccaugauuauacagagaagagcagaaauaauauagagcagcaccagaaaggaaccgaagacaaagauuucaagucaaauuccuccuugaauaugaaaucagaugggaacagugauuguucagacaaauggucagaguucuuggauccagucuugaaccauaauuuuggagguagcuucagaacagcuuccaauaaagaaauaaaacuuucagagcauaaugucaagaaaaguaaaauguucuucaaagauauugaagaacaguauccuacuagguuagcuuguauugacauuguuaauacccuuccauuagcaaaccagaagaaacuaagugaaccucauauauuugauuugaaaucaguuacuacuguaucuacacagucucacaaucaaucaucuguuucucaugaagauacugacacagcaccucagauguuaucuucaaagcaagauuuucauucaaauaauuuaacgaccagccaaaaagcagaaauuacagaacugucuacuauuuuggaagaaucaggaagucaguuugaauucacacaguucagaaagccaagccacauagcacagaauacaucugaagugccuggaaaccagaugguuguuuuaaguaccgcuucuaaggaguggaaagauacugaucuucaccucccaguggaucccucuguaggucagacagaucacagcaagcaauuugaagguucggcuggaguuaaacaaagcuuuccucaccuguuagaagacacuuguaacaaaaauacaucuuguuuuuuaccaaauauaaaugaaauggaguuuggaggauuuuguucugcucuuggcacaaaacuuagugugucuaaugaggcucugagaaaagcuaugaaacuguucagugacauugaaaauagugaggagccuucugcaaaaguaggaccaagaggauucucuucaagugcacaccaugauucuguugcuucaguguuuaagauaaagaaacaaaacacugaaaaaaguuuugaugaaaaaucuaguaagugccaaguaacauuacaaaauaauauugaaaugacuaccuguauuuuuguuggcagaaauccugaaaaauacauaaagaauacaaaacaugaagauagcuauacuagcucucaaagaaauaauuuagaaaacucugaugguaguaugucaaguacaaguggcccaguuuauauucauaaaggugacagugauuuaccugccgaucaaggcaguaaguguccugagucauguacccaauaugcgagagaggaaaacacacaaauuaaggaaaauauaucagauuuaacauguuuggaaauuaugaaagcugaggaaacauguaugaaaucuucagauaaaaaacaauuaccuucagauaagauggaacaaaauauaaaagaguuuaauauauccuuucagacugcaagugggaaaaauaccagagucuccaaagagucauuaaauaaaagugugaauauuuuuaaucgggaaacagaugaauugacugucauuucagauucuuugaauucuaaaauucuccauggcauaaauaaggacaaaaugcauacuucaugucacaagaaagcaaucaguauuaaaaagguauuugaagaccauuucccaauuguaacugucagucaauuaccagcucagcagcauccugaauaugaaauagaaaguaccaaagaaccuacucuguugaguuuucauacagcuagugggaaaaaagucaaaauuaugcaggaaucuuuggacaaagugaaaaaccuuuuugaugagacacaauauguuaggaaaacugccaguuuuagucaaggaucaaaaccccugaaggacaguaaaaaagaacuuacauuagcauaugagaaaauugaaguaacugccucaaaaugugaagaaaugcagaacuuugucucuaaggagacugaaaugcuaccucagcaaaauuaucauauguauaggcaaacugaaaaucucaaaacaucaaaugguaccucuuccaaaguacaagaaaacauagaaaauaauguagaaaagaauccuagaauuugcuguauuugucaguccucuuacccagucacugaagauucugcuuuggcauauuauacggaggacaguaggaaaacuugugucagagagucuucucuauccaaaggcagaaaauggcuuagagaacagggugauaagcuuggaacaagaaauacuaucaaaauugaguguguaaaggaacacacagaagauuuugcaggaaaugccucauaugaacauaguuuggucauuaucagaacugaaauugauacaaaucaugucucugaaaaccaagugucaacccuccuuagugacccuaaugugugucauagcuaucuaucccagucuaguuuuugucauugugaugacaugcauaaugauucaggauauuucuuaaaaaauaaaauugauucugacguuccgccagacaugaagaaugcugaaggcaauaccauuucccccagaguaucugcuacaaaagaaagaaaucuacacccacaaacuauaaaugaauauuguguucagaaacuggagacuaauacuucaccacaugcaaauaaagauguagccauugacccaucucugcuggauucaaggaauuguaagguaggcucacucguguuuauuacagcucauucacaagaaacugaaagaacaaaagagauagucacagauaacuguuauaaaauaguugagcaaaacagacagaguaaaccagacacuugccagacaagcugucauaaaguauuggaugauucaaaggauuuuauauguccuagcucuucaggugaugucugcauaaacucacguaaggauaguuuuuguccucauaaugaacaaauuuuacaacauaaccaaaguaugucuggacugaagaaagcugcaacaccaccuguugguuuggaaacuugggauacaaguaaaucuauaagagaaccuccccaggcagcccauccuucacgcacuuaugggauuuuuagcacagcaaguggaaaagcuauacaaguaucagaugcuucauuagaaaaggcaaggcaaguguuuucugagauggauggugaugcuaaacaguuaucuuccauggugucacuggaagguaaugaaaaaccacaucacucugugaaaagagaaaacucuguggugcauagcacccaggguguauugucacucccaaaaccccucccaggcaaugucaauucaucuguauucucuggauuuagcacugcagguggaaaacuggucacaguuucagaaagugccuuacacaaaguuaaaggaauguuagaggaguuugauuugaucagaacugaacauacucuccagcauucaccuauaccugaagacguaucaaaaauacuuccucaaccuugugcugaaaucagaaccccagaauacccuguaaacucaaaauugcagaaaaccuacaaugauaaauccagcuuaccaaguaauuauaaagaaagugguucuucgggcaauacucaaucuauugaaguuucucuccaacucucucagauggagagaaaccaagacacacaguugguauuaggaacaaaaguaucccauaguaaggcuaaucuuuugggaaaagaacaaacuuuaccccaaaacauaaaaguaaaaacugaugaaaugaaaacauuuucugauguuccugugaaaacaaauguaggagaguauuacuccaaagagucagagaacuauuuugaaacagaagcaguggagagugccaaagcuuuuauggaagaugaugagcugacagauucugaacagacucaugccaaaugcucacuguuuacaugcccccaaaaugagacuuuguuuaauucgagaacuaggaaaagaggaggagugacuguugacgcaguugguaaggauuuacuuuugcuuuggucuacuggucucucucaagugauucauccucaguagucuuguagguuacuaguauuaguguuaaaaacuaauuuucccccccuguggaguuuagaagacagugauuuagaacuugauaucuguaagucuguaccaacaagucauauuuuaaggaucuuuaguguauuuuuaguugauguugugaaauuaugcuaagaaguuuuauuuucaacaaagcuaguaaaauguuaauauuucccauguguguaaagaaguucuaauucuggcaguuagaagcugguuucuaguauagccccaugacuuaauuaguacuguauaugacuuaguuacuuaguuacuguacucaucauuuguugccucacuucucugagccuguucccauauccauaauguauaguuaaugccucucacaagguaauuauagauaaaauguuuaguacuaucaggcauuauauuugauaguuguaaucccagcauucaagaaccuaaggcagaaggauugcuaaguucaaggcagccugguuuaaauaucaugacccugucuccaaaaaauccaucaauuaauugauuacauauuuaaaaucacaaaauuuaaaauaaguuacucaacauugaaccugacauguuacugaccuaggcagagaaccuaguuuuugcuugcuuccuucacaaauauucuaaacacaguuuaauacuaaauaauguccuacucuuuuucagaauucuuuauauauauggaugauuuuccugcaugucugucccuauacuguguacaugccuuguauccaacaaaagagcauauuggauacucuaggacaaguguuacaaagaguagcaagcugccacauggauucugagaacaaccuaguuccucucggagaauaucagugcucuuaauacuauuggacuauauucuuauuucucauuuaaauguguaaugacuuagugaaacuauuagguuaauaaucuacagugagcauguuuugguaguguuucaggcuagaaagaaucuuuauugaaucaguugacauuggcaaucaugaucaauuucaaaacuaauauuccaacccucgugugggugauuuaaaagauauuggcucuauuuacaagcuuguggacucagaguaucggaauaauuauauaucuucuugucuagccuuaccauauaguggagugaggccuggaaguaguuuauuaucagccauccugccagaaacagauuuacuucaucaaauauuauacaggucauauucuauaugagcaaauuuaacuguguaauacuuaucugugggguuuuguuuuguuucauugcuuaccauguauaagucaguacuuuaguuauaaagggggaaaucuagucuuuuauaaggcgaaacugauacaaccacaaauauguauggaacuuucuuuuuaggacaacccccaaucaaaagaagcuuauuaaaugaauuugacaggauaauagaaaguaaaggaaaauccuuaacaccuucaaaaagcacuccagaugguaauuuguuuuuauucauaguuuuucucugaacaaguacucugcauguuauucuuacacuuuccucccuugguucauuucuguguacagaaugguuuaauuguuaaacuuuugguguauuuagaauguggaugguucauccaugaugccuacuagggcacugacaaagcuguaauugcuaauguaagaugcauuugaaauagugacuauagacuuaaugaaagugguaaaugaccugcaccauuuuaucaaagucacaugaucgaugcuaccaaaugagguguacauuucucagucaugauuugacucuauccuucaacuuacuacauauagaugaugccuugccucuuaguccauugcagucuuuugaguuuccuauuacuuuuuuuaaugcuuguuuguuugucuaucugcuuuucuuuucuuuuugguuuuuuuuguuggugguggugguggugguuuuuuuuuuuuuuuuuuuuuuuuugguuuuuuggguuuuuuuuuuuuuuuagauuuuuauuuauuuauuauauguaagugcacuguagcugucuucagaucucauuacaggugguuauaagccacuaugugguugcugggauuugaacucaggaccuuuggaagagcagucaaugcucuuaacugcugagccaucucaccagcccuuuuuuuggguuuuuuguuuguuuguuuguuuguuuguuuguuuguuuguuuuuguuuuuuggagacaggguuucucuguauagcccuggcuguccuggaacucacuuuguagaccaggcuggccucgaacucagaaaucugccugccucugccuccugagugcugggguuaaaggcgugugccaccacgccuggcuaugucugucugcuuuucaagacaaggugucucuauguagcccuugcuucauggaacucauuuuguagaccaggcugaccuggaacucacaaagauccaccugccucugccucccaguuacugggauuaaaguugugugccacuacuaucuggcuuaaauuuuuguauuuaaaauaaaacaaacuaacaaacaaacaaaacuauuuaguauccauauauaugacuucagugaggaggagcccagggccaucaggucccuagaaguauaguaacauucagcuguguguugggaauucaugugcaagagcagucacuuccuaugagccaucuccccagcuccaaguugacaaacuuuauuacccaacauuuaaccaccuuugucacugauagacuuuuuagacugaaaagccuuaaauauuaaaaaauauacagaccagacacaaacuucuuuaaauucuaauuuuuacuuaaaagcuaaauuuuaccucaggcaaaaauaauuuuacuauuguccuuguagauauaaccuuauuuuguuuauuuaagaaaaaccucaggcugcugaagugguucagcugguaaaaguaccugccacuaccuagccugauggugugaguucaaucccagcacaccacauuuuagaaagacagcacugacuucuggaaguuguccucucaccuucucugcacaccccccccacacacacaaacaugcauacaugagugcacacacaugugcacauacaugcccaauaaugaugaguaaaauuaauucuaauaaaaagacaaaaaaacugcugaauacccaaaucugaguaauuaguauuuuuuauuuucuccaguaccuaugguaauccuguagcaauaaaguagcuacuguguaucaaccaaacugugaaaauaaguugucacaggauaagugugacuucuacaggcagauaaacaagcuguacagauauucucuugaacagugaacagguguauguaacagugcugaugguggggccuguaaagaucauugugggcacuuagccucuguuccacagaucacccauagaaucaccuuccuguagaauagauauagaugguucaaauucacaguauauagagaggcauaagaauucugggucuggccaagcgugguggcauacgccuuuaaucccagcacucgggaggcagaggcaggcggauuucugaguuugaguccagccugauucuacaaagugaguuccaggacagccagggcuacacagagaaacccugucucaaaaagccaaaaaaaaaaaaaaaaaaagaaagcuauacucagagaagucuuaaauccaccccagucacacuccaggcuauucuccaauuuuccuaccucuuacuccaugguuuaucugucugcauuuucacaccuuguuugcuuuuuggggggagggaauguaugcugcuguuuuuuuuuuuuuuuuuuugacaguuuccauagaaacuaucaaaaauugccaaugccaacuauauuucaaguuauaacagcaggguauccagaaaaguuuucaguuagcuauaauugcaccucagauaaacaucacuggcuauaacacuaccaauguauaaagcuagggaaugcugcugaaugaauauguaaauguauuucuuacucauuugcaugguugcauaguaaucaaucaugugacuguaucccaguuuacucaguuaaucccuaauuaguggacaaauuguaggucuaauagccguaaguuacauguugagaaugaguacuaucuaaagcuuuucuucugaaccuucguaaaaccaaacuuuaaagauaucuacaccgacuaugagcuaacuguaaugaauacuaauaccaggacuaaauuuaaaacugauuucucugagguuugaaauguugguuauuugucuuauaguuauaagccguuugcaaguucaguauacucgauaauuauuuaucaaauaucuauaauguacaaugaaaacuucagugucuaacguuuugugaauauuuacaaugauguauauuuaauagaaauggcaacuaaaaccucuuacuuuucacuaauacuguagagugggaucuuuuuuaggcacaguaaaagacagaagcuuguucacacaccacaugucuuuagagccgguuaccuguggacccuucugguaagauuuaaaaaaaaaaagaaaaaagaaauuaguauagcauagaaaaaagauguuuguuugcuuguuuuuuuaaaguuaauaacuaacucauuuagaaugaauuagaaaugugugcuagaaaauguauaacuaucuggaagaaagaaaagcaaggcgggugggauuggaauggaagagaagacugagcuacuagcauguaagccccugcaggucggcaagagaaggugguucagagcgggaggggccacacuuguaaggaauaacgacagccuuggauguugugguaucguucugugguguaaaugcuaacaagagcaaaucagucaccugaucucugucucucaacacacaggcacacgcacacgcacacacacacacacacacacacacacacacacacacacaugcacgcacacacacaguacgugcguuuguugccagacaagcauacugaaguacucucucuccaaugcagcucaaguaaagaaaggcaaggagcccagcgcccacaucuuaccucaccugcucaagagcuucugucuaaagggcaucccuggagacacucagcuuuggaaaagucuccaagcaguccuauaguuucaaucuuaccggcucacgacguuucugccacaagaaccgaaaggaccagacauucaggcaaauccaccaaagucuucgucccgccuuucaagaugaaaucacaguuucacggagaugaacauuucaauagcaagaacguuaauuuggagggaaagaaccaaaagagcacagauggagacagggaagacgggaacgacagccauguucgucaguuuaacaaaggugacuacccucugaaggccacaggguaugauaugagaagucuuuagguacuauguaacauuuugacgugguuuuugucuuuuuuuuuuuuuuuuuuuuuuuuugguuuuugucuuuuugcaauaacuuuugaaaucuugauuucuguauguguucaggugcaugagcugccgcacacacggagggcagcuuugaggaguugguuuucuccuuccauccugcauucugggauuugaacucggaucaucaggcuugugcacaaagcacuuuuaccugcugagccaucugcugcuccugguuuucccuuuuuugguuagaguagugguucucaaccuucccagugcugugaccuuuuaauacaggucacagguacuccucaugucgcggugauccccaaccagaaaacgauucucauugcuacuugauaacuguaauuuggcuacuguuaugaauuguaaauguuuuguuuuccauggucuuaggugaccccugugaacggauccuucaagcuucaaaggggucacaacccacagguuaagaaccacuagacuagauugcuauacuauuaauguuuuccucgguauuuucucccuuuuguggugauaaguaauuucagaaccuuuuuuuaagauuuauuuaucuauguauuauauguacauaaaugcccugucuucaugcacaucagaagagggcaucagaucccauuacagaugguugugagccaccaugugguugcugggaauugaacucaggaccucuggaagagcagucaguguucuuaaccacugagccaucucuccaccccgagaccuuucauauuuucugaaggaaaagauuagguucaaauuguuguaaugauuucuuucaaagauaacuacuuagugacuuuucuucuguuuuuuuuuuuuucuuccuuuaacaaaagccaggaguuggggcuauuucaguggauaaagugcuuguuguacaagcauaaagacuugagcucagaucucuagcauccauguaaaauccaaguguguaguacacacauggaacuccgaugcuaaagaggcugaaacagaauccuaaagcugucuacccaaccagcccggucaaguuagggagaucuggguucagagacccugucucaaaguggagaacauuggauuaaaauacuccauguuaaugucuggucuucauauacaugugugugcacacacauacacacaugcacaggcacacacaagacaaauguaaugguggcgcaaggccaggcaugaugugcucaguccuguggugccaucacucgagaauuugagucagaagcauugugaguuccugaccagugugggcuacauagcaagacccuguuucaaaaaacaaaagcaaaaaaccaaaacagccuccuuugggaacuguauaaacguagcuaugaagacacuggaacagaaaaaggcuaggaguucaguguuagcuuaggcuugagugaggcaagaaggccaucaggccuaguugaagacugcugugacuacauuuauuuuuaucauguuauuuuucuuccaaaacugagcugaaaacaauuacaugugcuucuguucauuacucaaccuguagacuuaacagagauuaggcucccuguucucugcauguugaagcaaaacaaauuaauacacaucuuucauaaagcaggcugugccuuuuguggggaggaggguuucucuguguagcccuggcuguccuggaauuugcuuuguagaccaggcuggccucaaacucagucccaccugcuuuugccucugucuccugagugcugggacuaaaggugcugccaccaccccgaaguaaauacauaauuuuuguuguuguuucuuugagacagguucucucuuuguagaccaggcuggccuggaacuuacugagauccuccugccucugcccgcgcccccaguguagggcuaaagugugugccaccagcacucuguucauuucacuuuuguaaauuauccuuuaacagauuuaaugucaagccuucagagugccagagaccuacaggauaugcgaauuaaaaacaaagaaaggcgacaucuccgucugcagccaggcagucuguaucuuacaaagucauccacccugccccggaucucccugcaggcugcaguaggagacagggcuccuucugcauguucuccuaagcagguaaaccgcaauccuaagggaagccucaugcuguuagcuagaguuugcaagcugucuuguuuagagaaugaacaugauccugcuugcucaucaguccagaggggcagccucccuccucugccaggcuuguccucccguaccaaagcgaucuauacugcaaaacugcugcuugugcuccagaucucacuugucuugauggcaagugcucugagcuaggcacgaggggaaucuagucauuagccuugauuuaaagugugagugacugcuuucuggagguucugguaucuaauucuagugaagacuuuacuguuugguagaauguuccugagcagacggcuggaagugacagcaaugacgucaacagugugugcugaagcuuugugugcacuggacacuccucuuagagcuagcuucacaugccucagugaccgauggcuuuagccucacagccucucgugagaugugcauuauuguuuugucaggcaagaggacuaaggcacagagaggguuaaguagcagcugaaggauaacagccuggagucauauuccaacacacgggucugaccccagagcuacuguguaaagggaaagacacuugguuggucauguuugggugaagcaaacaccugauagggcccucugcacuuuuacgucugggcucuaaaaggaaguuauuagcaccauuauuuguacagcauaauggagcauuuugugaauuuggaugucugccuggugcaggggccgugcugaucuguguuucauucauuuuacgauauguacuacugaagaagcacagccugccacuggagaaggcagacauugcuuaucugcuuguucccacagugccuucuuguggcagauuuaaugacaggaagauacaagagaaaauaaaaaguguaaccaacucuugaauacacaagcaguuuauaaacaugcuucuaguauagagggggcuuguguuguuuugucugugcauguguaugugugugugugugcuucauacccaguguuuucugcaugcuaagcaccacuuugucacuccuuuauccuccugggccaguuaacuguucuauagugacuauuuuaguacuuaagugaacaguucuggauaaguuuaguuuuguuuauauucuaggucuguauuucacuuuuuaauuuuuuuaucacauuuuucuauuguuucuuuuguacagcucuauauauacggcguuucuaaagagugcauaaacguuaauagcaaaaaugcugaguauuuucaguuugauauucaggaucauuuugguaaagaagaucugugugcuggcaaaggcuuucaguuggcagaugguggauggcugauccccuccaaugauggcaaggcuggaaaagaagaauuuuauaggugcuguguggagaaagagauuuuguguuaacuuuguauuuucucucucucucucucuuuucuuuccuuaugacucaaguuaaaauuugcuagucauuuucuuuuuaaucuggauucuuuuguuaaaauguauuuuaguucacuagacauuguuuugaaaucuuuuaaaaauugaaugugauuuauuuugggauuuaaugaaguauauuuuuuguuuucuuuaaauugguuguauuuuuauauauuaugggagaaaguugaauuugaauuugccuuaugguauucucccauuuuugucauuuccuuuuucacuguauacuuuaauaaaauuuaaaauuauaagcacuaaaauuuaaacagaaaucuauaacugucaguaauguaaccagaaaaucucagaacauagacaugaaccacucagaagcuauacacugguguauacacacacaagcuucugcgugauugcguacgagagaauagugacgguugagggaucugauauuauucuguguuuuuauuguacuguauauuucuuugcucagggcucugugugacacuccagguguggauccaaagcuuauuucuagcaucuggguugcuaaccauuacagguggauuguauggaaacuggcagcuauggaauuugcuuuuccuaaggaauuugcuaauagaugccuaaacccagaaagagugcugcuucaacugaaauacaggcaaguugaaaggauggcaguaagugacugugucauucagucugcaguuuccuguguagcuccugacuucuauaacaaaggugguguauaaaccaguucugaguaacagccccccuccaagucccuucccccaauauccucuccccuuuuccucagagaaggggaagccuaccuuggguaccaccccauccugggacaucuaguccaagcaggacuaagugcauccucucccauugagacccagcuaggcaguccauuuaggggaaggggauccaguggcaggcaacagagucagagacagccccuguaccaauuguuaggguccaacaugaagaccaagcugcacugcacaucuacaaaugugcaggaggucuagguccagcccgugcauagucuuugguuguugguucggucuauguucuagcuaaaaucuuaagaauuaucuuuucaguauaucuuugaugaauuuuuuguuuuuugagacaggguuucucuguguggccccugacuauccuagaauugacucuguauaucaagcuggccuugaagucagagauccuuugccucugucuccuaaguacugggacuaaagccaugugucaccaugccuggcuuaauuaacugauuuuuaaaaauuuuuugcuuauuuauuugugaguguguguguguggauaugcacuccagaagagggcauuugaguccuccacuagcacacucugccuauuccuuugaggcacggucucucucucucucucucugaacuuagagcucccacuuucuuggcuaguauggaagccaauccccagcagucucucugucuccagggaccucagagcuggaguuacaggcauguacucugcucagcuuguuaugugugugcugggaucuaaccucuguccucauuguagcaccacaagcucucuugacuuuguugcauuucuagccuagugaacuagcuccacuguuucucaaguauccgcuggcuuuguuuacagugagcccccagggguacaguugcuagaaucagcaucuuggguuccuuuucagauacgauguggaaauugacaacagcaggagaucggcucuaaagaagauacuggagagggaugacacagcugcaaaaacccuuguucucuguauuucugacaucauuucaccaagcacaaaggugucugaaacuucaggcgguaaaacuaguggugaggaugccaacaaaguggacacgaucgaacucacagaugggugguacgcugucagggcccagcuagacccuccacucauggcucuuguaaagaguggcaaacugacugugggucagaagaucauuacucagggagcagagcuggugggcucuccugaugccugugcaccucuggaagccccagacucccuaaggcuaaagguaagcuacauuauuguacacucuggacaaggaccagcccguaacucccuuauauuccagagcgguaauuuauuuaaaaugauguguuuacuucgaucguaaggauagaauuucuugacaauguacuaguaauauaagaagcaaauuuuucuaacaguuucugcugguuaggggaggcagagcuauuucuugagcuagaugaacuugcaguuaaugaguaagagucagucuauaccagaauugaguuuagguaucugugccucuguccccuccucccagcaccggaauuacaaguucaugcuaccauaccuggcauuuucccagugcuuuugcggauagaacucagauccucaugcauacagggcaagaccguuaccaguuaagccaccucccaccccucaccuauuuuucuauuugaaauauuuaaauagcauugauccuuuguaguagaaguguaugugugaguuugaguaugugugugugugcaugcacauguacugcuagagaaucagaccuugcauacucugggcaggugcacuacaguagauuauaccccaagcccuacaguagaaauauucuugagaaauacauucuguugaaguaguuucccuuuuguacaguuuuugcuuacucacuuuuuuugccuuuaucagucauuuuuaugagauuuuaaaaaaaguuuuauuuuaugaguauaaguguuuuuccugccuuugcaccauaugcagccaguucccucugaggccagaagagggaauuggauccccucgaauuagaguugugagcauauguguaguugugugguugcuaggaauugaacccagauccucugcaagagcaaucagugcucuuaacugcugaaccaucucuuuagcacccucuacacacacacacacacacacacacacacacacacacacacacacacacacgaauauucucuuuuaaaaaaagaaagauuuauuuauuucauguauguggauacacugucacugucuucagacacgccagaagagggcaucggaucccauuacuacuacaugauagucuauaauauuuacagcauaccagcucauuauaugugaucuaauuuucaaggacauaauuuuuuuuaaagauuuauuuagggcuggagagauggcucagugguuaagagcaccagcugcucuuccgaaggucaugaguucaaaucccagcaaucacaugguggcucacaaccaucuguaaugagaucugacgcccucuucuggugcaucugaagacagcuauaguguacuuagauauaauaauaaaucuuuaaaaaaaagauuuauuuauaugaguacacugcagcugacuucagauacaccaaacgagggcaucagaucccauuacagaugguuguguggaauugaacucaggaccccgggaagagcagucagugcucuuaacaacugagccaucgauccagccccacaaauguucuuaaaagaucccaaaagaaugauagaaagucguaaaguagaauuuaguuuguauuuaacuuuuuuuuuucuguccuagaacucauucuguaagcuaggcuggccuugaacucagagauccauccaccugccucugccucuccagugcugagauugcacgugugcaccaccauggacuggccuguguuuaacuucuuuuuucuuuuuucuuuuuuuaagauugauugauugauugauugauuucaaaagcuuccaaauguauuuaucagaggauugucaguggagguggaggguacaggauuaucuuucuaucucaauugaaaugaugccaugcuaaguacuccguuacuuaguaacauuaaaauugcaauuaaguccccuuauaauuaaagaucuucaaacaaauaguuuugugaacaaauuacauacuucacuagaauuuuaauccuuuuuuuuuuaauuagguauuuccuucauuuacauuuccaaugcuacuccaaaagucccccaagcccuccuccccacucccacuucuuggcccugguguuccccuguacugagguauauaaaguuugcaagaccaaugggccucucuuuccacugauggacaacuaggccaucuucugauacauaugcagcuagagacacgagcucugggggaugcugguuaguucauauuguuguuccaccuauagaguugcagaucccuucagcuccuuggguacuuucucuagcuccuccauugggggcccugugauccauccaauagcugacugugagcauccacuucuguguuugcuaggccccggcauagccucacaagagacagcuauaucaggguccuuucagcaaaaucuugcuaguugaauuccucuuuccuuuuugcagauuucugcaaacagcacaaggccugcucgcuggcacagcaggcugggguucuuucgugaccccaggcccuucccucugcccuuguccucacuguucagugacggaggaaauguuggcuguguggauaucauuguucagagaguguacccuuuacagguauggugccuuuugaaacuuaucauguaaucccuuucuuuggagagaaucugaauguuccuugcuguuuuuuuacauugucaguggguggagaagacagugucuggauuguacauauuucguagugagagagaagaggagaaggaagcacugagauuugcagaggcccagcagaagaaacuagaggccuuguucaccaaaguccacacagaguuuaaagaccacgaagguaaaaugggcuucguauuacaaacuuuauuuuugguuuugguuuugguuuuucaggacaagguuucucuguguagcccuggcuguccuggaacucacucuguagaccagacuggccuugaucucagaaaucggucugccucugucucccaaguguugggauuaaaggugugcgccaccacugcccggccaagcuguuauuucuuacaguguuuuauaaauuacaugaguucucgucgaguaauugcuuuuuaaaaaaaucugcaucugcuuuuuuuuuuuuuaacuuaaaaaaauaccacauauacgaaaaaaugaaagccaggcucaugcccuuaaucccagcacuggggaggcagaggcaggcggauuucugaguucgaggccagccuggucuacaaagugaguuccaggacagccagggcuauacagagaaacccugucucaaaaaaccaaaaaaaaaaaaaaaguguucugcgcuccugcagaagaccugaguucaguuugcacugcccauaaccacccguaacuccaccuccaggggaucccaugcaccacaugccagugucacacuuucauacaagcacacguacacauuuacucagaaauggacuuuuaaaauauagacuggacuugcacuaucuagcuuauuuaaaauuaucauuagauuauaucauuuucaugaauaaaccgaucgauaugaaaaauaaguuauuuaaguuacaaguuacaaauaaaccccuauguguagugcuuuaacugugacugcaacagucguugucaccauugucgucuucugaugcugcugcuuuucuuccuccucuuccucuucuucuucuuaaaugaagcuauuaguagacagcugcuuguuuguuuuuaauguuuucuuuccugucacagcacauguacagaaggucaaggacagcuuauaaagcuuuucuguccuaccuugugggucccagggaucagaccccgcuguuaggcuuggugacuagugccacuaucagcugagcuguccugcugcucuuuguggcucuuuuuugucuaaccucccuccuuuuggugcuuuugcuugacucuaugguuuucacucccaaguuuugguucuagccgaucacuguugcuuucuucccuuccucccgcagaagacacaacacagcggugugugcugucccgcacacucacacggcagcaaguccaugcucugcaggauggagcagagcucuaugcagcagugcaguaugcaucagacccagaucaccuugaggugaggaagagccaggugacgagccucaguccccagcccacugggaagcucucuccugcuggccauuagagcaagcccauguugaaauacugcaucuuucaggaggauuucuguggcaaguccuugauucugcaucaaguagagaaugaaaaaguuugagaguuucauguaugacauucacauaguuuaaugugcagucgaaggaccagagagaaggccaguugguaaaggcuccugcugccgagccaaagccuuaguucaaucccugggacccaaaggguauaagcagagaaccagcuccuuccaguuuucuucugacuuaugcaugcucaaguuaaauacuuuuuuucaugguuuuuuugaaacagggauucuuuguguaacccuggcuguccuagaauucgcucuguagaccagacugaucuugaacucacagaaaucugccugccucugccuccucugagugcuagaacuaaagacauguaccacuacaccuagauacuauuaauuaauuaauuuguuuauuaauuaauuuauuuuuaagcaggcagagcuugcuuuuuuagccagcuguguggcaugugucugugucccacguacucuagggacuaagcagcagaauggcaaguugugugagcuggggacacagcagaauucugucuagagaaauggcuuagcaguuaagaaugucagagcucuuacucaaguucccaguacccguguuaggcagcuuacaacuaccuguagcuacagguacacauguacacguuaaauagaugaauauacaaaaagcuuuuuaaaaauuguauguuguuccacagaggaacuauuaaauuacuauuaaauuaaguuuauugggcugcagcaauuaagagcauuggcuguucuuccagaggacccguguucaauucccaucaccuacauggcagcucacaauugucuguaaucuagcuucaagugauuugucacccuuacacaugcauacaugcaggaggaacacuaaugcacauaaaaaauaaauaagucauuuuuaaauuaagcuuauuauauaggaaguaaggaaaaaagccauugagccagccuguccuaugucagcuaugcaguuauugaaguugucugugccucacucucagcagcucuaacacugagacaguaauagaacacaaauccuggccugccugugaaggucaaaugacuaggacauuuaccaggcacaaauccauccuucugucaauguucaugucagccauuugaaauguacaugugcugguuaugguuagaagauacuuaguagucaagguuuggcuuagcccuagggaaaucugucacagggacucacagagaagccguuugaggucccuagagcauugugugauagccugaguagugaucugcacccucaggucuggucugguuucacaugaggcaguccugcuaggguaggccggacugccauggugucugcucuguuucaaugcuuaaaugcccacaggcuuguuucagcgaagagcagcuaagagccuugaacaacuacagacaaaugcugaaugauaagaaacaagcgcggauccagucagaauuccggaaggcccuggaauccgcugagaaagaggaggguuuaucaagggauguuacaacuguguggaagcugcggguuacaagcuacaagaaaaaggaaaaaucagguuaguaugcaagguuuuuuggcuuuuguuuuuuuuuuuuaauucaguuuguuaaauuaaaaggugaucuuccauaugacagaguaugaaauucauguaaaauccaaugagugaaaugggcuccgagcaccacccacagagcagggaagccuugggucuuuguuuuugccauguuucagaaaauggucaccagugugucuaccuaccugucaugucccuuucucugaacagcucuguugaguaucuggcguccaucaucagacuuauccucccuguuaacagaaggaaagagauacagaaucuaucaucuugcagugucaaaaucgaagaguaaauuugaacggcccagcauccaguuaacagccacaaaaagaacucaguaucaacagcugccggucugcaccucuccuuaugcaguuuccaccuugaucaaugcagagcccuucuuagagccucaauaugcugauucuuuguucugcuuccugcagguuuccagugagacuuuacuccagguuuaccagcccagggagucccuucacuucagcagacugucagacccagccuuucagccuccuuguucugaaguggaugucguaggaguuguaguuucuguuguaaaaccgauagguaauguacagagugucuaaugucgcuuuucauugguucucuugaaccaauugccuucuuaaauuuggggguuuuuguuuugguuugguuucuuuuuuuuuuuaagauuuauuuaugcugagcagugguagcgcacgccuuuaaucccagcacuuggaaggcagaggcagguggauuuccaaguuugaggcuagccagggcuguucagagaaaaaccaaaaaaaaaaaaaaaaaaaaaaaaaacccaaaggauuuauuuauuuauuauauguaaguacacuuaagacacuccagaagagggcaucagaucucucauuacggaugguugugagccaucaugugguugcugggauuugaacucaggaccuuuggaagagcagucaguggguuuaaaggugugcgccgccacagcccagcugccuuguuucuuaauaaaaagcaauucgauaguacuucaggagaauaacuuagauucuguuuugugcuguuuaacuuuauaaagugauuuuucaguaguuaaaaucaaauaauuauaaucugaccuacugguggaacauucuaaccucugaucucucaagcuuuuaauagucuccagcaucuuggcuggcuucuccucucauguauguacuuaugcauuuauuuauuaguuuuauuuuguaucugggcaucacaccuagagcucacacugcucugcagauguugacacuaaucucugucccucccuguuuuauugugccuuuuaucuacaaggcucuuuccuuuucaccugcagugugcacaaaugugaaaguccagccaagaccccuguguaggcacaggcuuccauuucuugauuauuuauuguauauagaugccucagcauuagcuccuugcucucccucauugcacauuaaccaugugaugugcccuugcuguuccaucaguuacccucacuguucccauagacagccaugcuggcuucugugcccucauggugcuggucaaauggagccuugcaagaggcccggcaaaacagugccuacuccuuuccaaacccguguucuucuuuuagcuuugcugucuuccuuggcacucuguaaaaguagcuucuguucuccugaaguaauuguugucucugaggcuuacugccacaaucugcuaaccucgcccuaguccuggaagcuucuggccuccauacaaucuuaucuaguucuagaauguuuccaaccuuugagacuuacugcugaauaagcuuaccuuuuccaguucuuucugagcucuggcuggcugguucaacucagcuguucuggcucaagccgacugauucugucucuuucucucucagccucuucacugaauugcucuucuugaucguguacugacuuuggcaauauguucucaucuucuggcucauucugucuucugugucuagcuuguucucucucucugcaacccaucuuucuguaacuguccaaguaaaacugccccuuucucuuucucucuuuucuguggugcucucuuaaguaaccucuaggccuuuucuugugagaguugggaauagccuaucucugauucauucugucagaucuuucucggauucgucacuuugucugccccucaguuagacuuucaaacuugacugcuuccuucuacaaacuaaccuuaccuacauugcuuuggauuaaagauguauauuaaggacuuuucuauauucuagccagagggauuaaagguguguguuaaggacgaaccacacuacaacuagaaacagguguuuuucaguaaauaacacaaucucgggguucacagugugaucaaauauccugcaacagcacuccucagcaccuaacagcaccuaacagugucuccaccccacaacuggcucccuuuugggaugcaguguuguaaaggcagggcccugucuaucugcaucucccacccuaaaggagcaagugccauaggacaagcucuaccacacgugauaaauuccuuggggcacaucuuugcaguuagaguuuccccauuccucccaucucugcucacuuacuguccuuucuguugucucagucuuuugcguuguuuugagauggccaggaaccaugcguggguccucuggaagagcaguguccuagcagaaguguucacugcuccugacaccagcuucugugcagcccugggccugaaagcucuucaagcuucacacucugcuuuuuguccucauucccugucaggcaccuugccucaggaaugucacuuguaugacaguacauuuauuucugcuucuauuugcuuuuuuuguuguauuuccuaucuuuauccauuauggucacaggcaacuuugucuuuaauuuugcuuucugcacacacugugcacaucucacuuugccauuucaugcacgagucuguccuguugugguaaaauaacacaugcugucaguuucugugguccugcaggcuccuuuccaacuuacagaucuguuuguugacccugauccugagggucuaaaguuucguagcagagucaguuugaaaaaucuuaagaauuuccuuguucgcugggcggugguggugcacgccuuuaaucccagcacucaggaggcagaggcagguggauuucugaguucgaggccagccuggucuacaaagugaguuccaggacagccagggcuauacagugaaacccugucuccugucuugagaaacaaaaaaaaacccaaaaaacaaaaaacaaaagaaaagaaaaagaaaaaagaauuuccuuguucugugguguuuuccuuacagguuucguucuguccuccacugugccugcaaacccucccuuccccucccacucuccuucccugcucgccuuccuuccuucccucuuguguuuggugaguaguagcugacugaugugggguuugucucuagcuguuaaguucaucagccacauagccaugucauucccugcuaucugagucacacugaauccgcacacugccuguuauagaagguagguagcucauuuguggauuccauuaguauuuauugaguaauuguucaaugccaggugcacagcagagaagaauuccuuccugggagcacugugguggaagauggagggggaggaggagguaacaaacaaaacaauggagggccaaagggaagaagaaaggacaggguggggacagagcugaugcucagcugccauuuuagacagcauucagaaaagaccucauugauggugccagaaaaaaacugaaagagaagccugcagagccugaggagagucccgguggcuguaugcuuugguggagugugagagaggcacaaaagaaccagguguaugggugcuuggauauacuuuuacauuuuauauugauuauuauguguggcaugugugcagaggucagagggcaaggcagcuuuauggagaugguucuuucuguauaccuugauguagggucucaggauugaacuuggacuaucaggguuacacaacaguuaccuuuacccacugagccaucuugcuggcucccuuguauauauuuuaacuuuuacuucaauggugaugggaagucacaggaagguagaggagggacaggcuuugaccuuuucacauaucacuugagcuauuacauugaacauacaguacaaagggugugggcacaaacagggacuccaggaggaugccaugguaagagucuaggcaggagaggaugacaaaguagauagaagcugugaacacgauucagaacagcagacagguucugguuacccucugaagguaggggaacaguauggguguccgaagcugcggaagacugggauugccacuugcaaaagaggauuugauaacaacccaggggcaugguuugcggcuggugucucagcugcaugggaagcuucugagauguggcuucaggacugugcucacagacacaugaacuuuagaucagacagaguacuugagcgguagucagagcugcagaugcagacuuuaagagcauugguauacccgagagaugcaaaggagagagacugaauguauucccucugaguggagaagaggagacagagggcucuguuuugacacuuggguaucaggauuggggcacauauaaaggaggcagggagugcagaggagugcagagagguggagugcugaggagcacaguacgcugaaagaagagacauugcucugugugugugugugugagagagagagacagagagacagagagagagaggagacaauggcuaacuaguucaacuaagguguucugggccaaacuuuucccugagcugacugauucaaacugacagaagcuucucucugcuucugacugaauggcucugcuuggcuuccagcuaacucuggcaaucuguucuaaucuuuuggcuccucgucauucucuggcuaguucugucuucaccugugucuagcuuguucucucuguaaccuguaucuguaauacuguccugguaagacugccaugcacacacacacacacacacacacacacacacacacaccaccccuaugucuagcugcucucuguaaaacuguccucaccucuuucucucuucugccccugggcugcuccuaaguagccucucuuuccugucuguucuuaugagaguuugguguaucauaucucugcuucgucacuuguuuaaagggaaugaaaggaaaauagaaucaugaucaagagaauaguuuuuagguaaaguguugcuggcacacugaggguagagugugcugaagaagcuaaggaagagaggcaaggcugacacugggcagucagcacagaacauucuguauccagacacagaugagacaagcuguauccaucagcagagaggcaagaguacuuagauaggguacuaaugcagaaauugauggagagguagacacuugcacagaccucuuuuaauggcuuuuguuuccuugcugaacaggaaacaaagucauccauucauccacugaggucaguauguggaaggucagggaaucauuaccuaagagagugggagagccuagccuagguacgucccagggcugcccagguccaggccacccauagcucucaguaacccuccuucauuuucucaacaguuuuuuacauuuuggaagcacaaggcacugccgguucaucuaugaucugugcugcagcccuguaucaacacugcuuccccuuuagugggaagugaauggggaaacugaggucuacacaugggggaaggggguacaugccuuuaaucccagcacuuaggaggcagacacaggccaauccccaugaguucaaggccagccuggucuauagaacaaguuccaagacagccaggaguacacagagaaaccuugucucaaaaaaccaaaaauaaacaaguagagcuaaggucuguuacugauugucagagucagagccauacaaaagcugugcuuggagaaguaucuuuccucccugaggaacuaacucucccgagucugguccuccccuggcccucaaguccucaccuguccaguuuccuguucagccuuccucacucuuggcucagaacuguagaaacguguaugcguucucccugucuccuuccugcuaugucuuucuggagagcuuuuccuaguuagcacugccuugggguuuucuuccuucuuuucacaguugcccaggaaaccauuguguggguggaacacaguuacuccccugugagugagagcagaugaguugcuuccagcauuccauaguuucagacuauggagagugaccuaggugcagccacuaccauggcccuugcucacauguauuuuacuauuauuuaauggucaucagucuucagagcagagugcuagaaguaagaaccccgaguggaagguaggauggccauagcuuugcuaggcaaugccaguguuuucuucagaaggaugcaucaaauguccacucuccuggacaauuaucaguguauaugcugcccuguggccucgaaauguuuggcacugaaguucaaacaccuuaaguaaugguucauucuaggaauucuguguauaucguuauccucgcaguucuaaagauaacaaugacuggcauuuucauccuaggucuugcuccuuuggucuaccugucagacgagugccuuaauuuauuaguggugaaauucgggauagaccuuaaugaagacauaaagccacgugugcuaauugccgcaagcaaccuccagugccagccagaauccacaucaggagugccgaccuuauuugcuggccauuuuuccauauuuucugccaguccaaaggaggccuacuuucaggagaaagucaacaacuugaagcaugcuauugaggugagauuagggacuuggaagcuggaccaacaggugccuggagagugcuuucagcccagugauuccacacaugcgcacaugugcucauucacacacacacacacccaugugugcucauucacacccucccccucaccccaguacucucccccuucaccccaguacugagaauuagauuuacaucaaauuuuaagugucuuacaaggcaugguggcacaugccugcggguccagaauuucagugucagcuuuggcuauacagugaacaccagaccauaggccauauaaacacacacauacacacacauggguguauauguuguguguguaucucaagacccuagcuaaagaacaaacaaacaaaaguggguuucauucuucuguucugaauguuuuauuucugaaagaaaacacuuucugagaacauaaaugugugaauuagcaacucagcacaggcuuuuccaauuuauucucuuagaauaucgauacauuuuacaaggaggcagaaaagaagcuuauacacgugcuugagggagacagucccaagugguccacaccgaacaaagaccccacccgagagccccaugcagccuccacuugcugugcuucagaucuccuugguucaggaggucaguuccugguaaguuaguauggaaguaagguguuucguauguccuagcaaacaugauggaacuaaacugcauuuaaccugugguuaguuugcuguagcugaggcauaggcuauguggaaaucguaucuuauuuguugaaguaugaauguaaaacucugggagcagacuacacuguuggcacuuugagaacaugugcuugcaagauccuuugcuggcuccugagcugggaaagcuggcccacagcuguugcuuagucucuaagcucaggugacuccuuaaucauaggggugccuagcugccagggcuggccagacugguggcacugcuuaguaccuuaauucaaucaagcaguccucaccccauacaagaaaagugcuuguuacaguuaggagccuagcaaagaaaaacacuaaacaguugccugagacucaggacugagaaaagaaagguguuagagcuccacggaggccagccguggucucucucuggaggaaguagaucagacucccacagguaguccucugacuuccuuagguauguuguagcaugugaguacuugcauacacacauacacacaugcacaugaacaacauguacacaaaguaaguaaauguucagaaggaggaggaggaguuguugagcaguguguauccuuuuuaaaaugauuuugacaagccuguuguuuugggggguuauaacacugaaaaguuaaagcauaaaugaugucauguguuuguuucuuuuuuucucuauuuuuaaucuuauauaggaucucuucauuuuccuuuucuagccuuuuuuuuuuuuuuuuuuuuuuuuuuuuuuuugguuuuucgagacagguauagcccuggcuguccuggaacucacuuuguagaccaggcuggccuugaacucagaaaucugccugccucugccucccgagugcugggauuaaaggcaugcggcaccacgcccgacucauuucuggccauuuuuauacaucugucacuuugcaaaauuauuuccugugggugaggaauaagagcaugaauguuuggcauuauuuacccuuuagcaauuggaaaggaaagguguccuguugguguauauagguauuuucuaaugaaagguuaauucuaauuuauuuauauacaaguguuuauuaugauaggcuccucuuuuguguguuuuguuagaggauuucaccuacuggucagcaaaguuaucaaaguccuuuaucacacugcacacugaaagggaagucuaugccccuggcucacucagcccagauggcagcaaagucuuggaguggagagaacgagauugaugacccaaaaaccugucgaaaaagaagagccuuggauuuccuaagucggcugcccuuaccguccccggucagucccaucuguaccuuugucucuccagcugcacagaaggcuuuucagccgccacggagcuguggcacgaaauacgcaacaccuauuaaaaaagaacccaguuccccgcggaggagaacgccauuucagaagaccaguggcguuucucugccggacugugauucaguagcugaugaagaacuugccuugcucagcacccaggcccuuacgccugacuccgugggaggaaaugaacaagcguuucccggugauuccacaaggaacccccagccagcacagaggccagaccagcaaguagggcccagguccaggaaggagucucucagggacuguagaggcgacagcagugagaaauuagcuguugagucuuagccucccgguuuguaagauguguacaguuccaggcuacucauagguguucgugugagaaggcgggaguagcugcacucuacugaagcguguguuuacugcucagaugcucuaccuggucuguguugguguaacuaaagcugguugucaucgacugauuuaaaaagcuuuaggaguagacuggaucacuacaacuaucauuuuauauacaaaauaaacauagcuuugcuuuuaguuuaga

SEQ ID NO: 12357 - RNA, 26424 nt, Mus musculus
uccuuugcuuuuuuuuuuuuuuuuuuccuuugccggagucgagcgggugcugcuagcggaggcgccauauuggaagggacaaaacuccggcgacagcgagugacacaaauaaaccccuggacccguucguccccgcaacagucagggccgcgauguuguaccuagaggacuauuuggaaagugagugcgcggcgccggcgacgcggcgggcgggaucggcggcgggcgggagcgcgaguggccgggcgggcgggauggcgggagggagggggagcgggggauguuucuuucucacgguaacuggcagccucguugugagccgcccccccucccguacgcacgcacgcacgcacgcacacacgcgugacgccagcgcgucccuucgccguuggccccgcccucugacggacugugccuuugacagugauugagcagcuuccgauggaccuacgggaccgcuucacggagaugcgcgagauggaucugcaggugcagaguaaguggcgcgucuccacggccccgcgcagccccggccucccucgggcaucgccuggcggguccuccgcgcuacuuuuuucaggcugugacaaggaggcggcgggcacaccguaccguuaacacgcggggcacagcaaacacaguuguuuguguacugcauggagaugacgacacugcaccgcaguggaaacucgcgugauuuucagaagguuugcacccgagccuggauguggaaacuuggaguucugcauucagacuuaaaaguucauuacauuccgaauuucuccagagcaaagacauagaagggcaggcuagggacccuagugaacucggaaggccgaacuuugacaaguugcauauuaauggaagacacuuagagcugugaacagcguggacacuuucucagccagaaaugagugagagagaucagauuuuaaggaaaucacccgcuugcucuuuagaaaacuguagacguuugauaggcuucccuacugguuucuuguuuuguaaacacaaccacgucauucaggcuggucucacacucaauauguauaauaauccuaggcuugcucuaaucuccucaucuuccugcuucugucugccuagugcuuggcuuuucaggcauugcuagcauugauuuuuuuuucugucagugcuuggcagcuuuauaugugacuuauuuccaaaaugaaccuuguucuuuugaaaaagccagacuggaagaggcucaaagguaacuugaguuugcuaagggcuuguucucuucauucaugagccucugccgccccugccccucauuucuguaccuuuugucccugacuguacuuuucucaucucagucucugggucaucucuuggggugcauugcccaauagccucucauaaaucugugacuggaauaggugugcuuuuucucuuugacuuuaagguaguugcaguaguaaacaccugccgaagcacauuccagagggauugaguagaguuugguggcagacagauuuggguucacucuuggacaggacgacuaggacaacuccagccuugcugccuggggggcuuguuugcuuuuuuuuuuuuuuuuuaaaaacugacagucuucugaggauuuaaacuaauacagauaauuaggauguauaaugcccauuacaaauagguuuagaauaaaggauaauuuaaaacauugucaaucauucaauuuuuuuaaaauucugggauaguuuggauuuaaucuauucauaugacagugcuuucaaguuuacuuacuuuguaauccuggaguuuucggaaacaaagugaguaggcauuaaaaguaucagcaugucuaaggucagcaaguagcugaaaguaaauuguguuuuaaaaaugaagauuaacuagagcaucucagcaucuuuuguaaaaagccauccugcucugaaguugcuuaaaugauaaauauagugggcaauuuuuucuccauuuccaucacaacaaaaccccuuuuauuuauuuuuuuagcagccauccacugaggucauuauuuuugaccugggcuuuggcgaagccuuacauagaguaaauagcauguguguugagugaauaaauggugagcaacggucacauauauuaucccuuccugugagaggacgugaugaggugcuuggugcuauggagcaaguguugacucugucaucacuauuuuuauuaaaagaaguaugagaccgucccaggaguacuguuaguaagcagcucugauugccguaaccagcugacuuaaugccauuaacuuugauuucagugcggguuguggcguagauccuugucuguacaauucacucuaccuugauuacuggaaaauguuuugaaauagcaaagucaguacagaauauuucagcuuuuuaaaaacuaauguaaugaaggcaccacugcuuauaguacaaaauguguauaagcuaaaacagaguugucagaugucuuuuuuuuuuccucaaaucaaagcaguuuggucggcuaaguaugaaauguuuuauugugucagaugcaauggaucaacuagaacaaagagucagugaguucuuuaugaaugcaaagaagaauaaacccgaguggcgagaagaacagauggcauccaucaaaaaaguaagugugaugccuuggauaauuggcagucacauugggacccucuaggagagauaguaacauuacguagauaccuggauauggagugagggcacuuaugagggacuugggggcacuugguauauucuagaccagcaguucaacucaaggggcagaugaccuuuucacagggucaccaaaagccaucggaaaacacauuacgauucagaaauaaucucauggccgaggcucaccacagcaugaggaccuuuguuaaagggucacaauauugggaagguagagaagcacugguuuagagcuuccuguaauucuugcugaaguuuauuuuagcuagugcugcgggccuuaaggcuguccugcagauuagauuacagauuagauaagcucacuagugcugugugugugugggaucuggugucuuucuuuaguggugucuaggaacacaacuuucaaagauuuggcuuugguccucacugccauguagcugugugaccugggucaagucuuuuaacaugaggaagaauaaguccuuacgccuaaccuucauauaaaguuuucagggauauacagaaacauuaaucuuggaacugaaaauuucaauuguguuauuuauucuuccaucuguaaggaagauugucuguuaggaggggguaaaccagcuuuccuaagagaagugguccuggcuuguaaaaaugcccagguaugaaggagguuagagcuugcguauguuaaccuagaguucacuagccauccuuuucaacuagaaguuuuucaugcagcacaauuugaacauacccccaaaagucuaguugucuguggaaacacauaggguacuuuuuucuuuuaugaaaagaaaauuuuugguuuuuaaaaauaauauggagaaauauaaauuauaauuugagugguauuaauugauaaccuaauuuaaaacuagagcugucaaccaauuggauagcagaaaccuacagaucagaauccuuucuauggcuguaguuuugcuguaaaaauuggggcaggagagauggcucaaugauuaagaacacugacuacucuuuuagaagaccagauuuuauuuccagcauccacaugaugguucauaaccauccacaacugcaauucaagaggaucugaugcccuccucuaacuucugugggcauuuggcacacaaacaugcauucaggcagcacacuuacacacauaagauauuuuuucaaguuguuaaaauggaguguucuguguuuugauauguuagcuaacucuuagcacucuuguucuuuuauaacucccuaggaaagaggguggacuugccauaauuuucuuuuauauauguguuuucugagguuuuugagcaucuuuuaauuuuuggcauuguacuucauuucuaaugucccaacccucccgaccuuggaggcuuguuauugcuaauaugaugagcaagugauaacaagguauaguagugagaaagcauaugaguauguauguauguaugcuagaauuaccagugcuuaaaaugaaacuauuuuuccuuaggacuacuauaaagcuuuggaagaugcagaugagaaaguacaguuggcaaaccagauuuaugauuugguaaguaaaagagugugcauauuauacugugugugcuagaauucuggacuuuauuuuauuagcuuaaguguaaacugaaguguugcucccuugaucauauuuaauuugagaguucagugucugugucuugguuuccuugaggaagagucauagacguucacaguuuaguuaauaggucaagagccacacaccucagugaagacuacuguacauuuguggguaauauuuuuagaaagaacugguuuuauuuaauuaauccuauucuaccauuuugcaauuguuucuaugauaacaugugauuaagaguacuauguuagugagagucuuugguggccugaugaaaaugagaaagaggauuucccauaucacuguuuaccuagaggaugcuaauacauaguuggcaucaccugggucaucagauuacacccaaaagaaaagaaagaaaagaaaacauaaagcagacucuguguuaagugugugcuucuuguuuugauaauuuugucuuacuguuuuuuuuuuuuaauuuguuuuaacuuuguuuuuuggggguuuuuguuuuauguuuuuguuguuguuugagagagcaaacaugaaguugggugaguagggagguggggggaaaucugggaggagaggagaugggggaggagaaagaauaugaugaaauguauguaaaaaggguuuuuuuuaauaaaaagaaaagaaaggaaaaaagguguuucucucuugcaagaguaauuccaaaaguuugaaaucacugagagauacacuuaggugugcuucucagauuguugucaugaugacaucaguaccauaugauaggaagcgucuguuuuuaaugcaaagccucuucuuacuguguauuauaggaaaacuaauuucuuuuuguaucagaguaacuccauguucaguuugguugaguugaacuuugacauuuugacucuuucuuggcuuugcagugccuacuagauacaguuuuccauugaaagauacaugcgaauauaguuguuagugagcaugacacauuauagagauguuccagguucaucucucuuacuggugcacaguacucuaaccaaaagcaacuuagaggaaggaaagauuuguuucagcuuauagguuauaguuccuaguaacacuuacuaguuguugagaaaaguugggacaggaaguagaaguauaagccaugaaggaacucuacuagcuggcucauacagacuccugcuuagccagcuuauacagcugucagucacuugcccaagaaaugguaccacccacaguggauaggaccuucucgccucacuuaacaauuaccacacacacaccccuccaggcaugccuaaaggcuuaccugaucaggcugcuuuucucucagaugacucuaggcucaaguugacaguuaaagcuagcuaggacaaaggucacucacccgccuuauauaugcugcaugcaaaugcuugcauuaaacuaagaaaauuguaucagauaaguguguuuuuauguagugaaauacauuuuuaaucuugguaaagcaacaacuuguuguaaagaaacucacguaaaacaaaagggaagcuuucuugaaaagccagugcuuccugcuucgaggcuucggaaaaugcucgucauucuccucucucaucccacccccugcugaaacagucuucucaagaagccguccuccccccuucaugucuucucuucccgugggacccacuuuaguuagaguucuuugcacugacaugggugggaggguauuuccuggagcauggguaacuucucagagacuccagcacugaagaaaguggcacccacaccccccagucaccacaacugacaucagagcaaccaucaggaagggggcaaccucauaggucccucuuauccaugaugaacauuggcaggcucaauguugugcaaguaaccacagcuacagugacuucaccaguauagcccuaugaaguccagaaauauauucuuuguuucgcaucucccuaucuguggcugaaccaggacguuccaggcccuggaagggacuauauggauggauaucuauuuagggcugaacacacccuaucccauguucuuggcaucuugauuaguuacgcuucucugcauuaagugcuacaaacugcggucagaagguuucucugacugaggcugaggacagcacuaacuuguacauauuaacuugagcauuuagaaggaaauuugacaugaccauuuagcaaaaaccauaguaguauguuuuccucuagggucuuuggccuccccaucccaugaccguuugaccagauuuauaguauuuaggcauuuuuuuuccauccugggcuucaaauccaaucagaaagcugucuguuauucccauaaugucaaggcauuuuuggcccagagggggcucaucuugucugacagguugucacagcacauggcuuacaguuggguaaacacuguugaugccuuuucuccuacagcagugugcgugguguccucuggcucugggacagccuccagcucaguuccagcuugaggucucugucuagggauucuagggcucauagggaacuggcgaguaaguacuaagauauaguucuacgcggugccuguggaguuuagaagaggauuuggaaccuucggaguugaagacaggcugaugugagcuagcaaccaaacauguccccuggaaagcaguguaugcuccuaaccauugagucaucuccccagccccugcauaguagguuucaaaaauccccuuuugagauuaaauuaucuuuacauuuccucugcuuuacacugcuuacaacauuuagugacuucuauaacagugcuguucacuccuuaagaaacagggcccuuauuccuguuuguucuccggugagccaucuuaccugcugguuauuuguaucuucugugaacucuguuccccuccacuugcugccuucugaacuggagcaucgugugcaguuucuccaccucugaaauaccuuuuguguuugcgucucauuuucuuccacguuguaugugucugugugugucuguguguuuguguaugugugugugucugugugugugucuguguauguguguguguguguguguguaaucugagauucuaguggaguucuuggacuuuuguccacguuuuucauuaccuucuucaucacuaccaucucagagugcccucacuugcugugacagucccugaaguugcuugucgcgcacacaguuggagauacuagcagcugagaggcuggugccccugaaaacuugguguccucacuuuuauuuggaucguuucacuaggcauugugcaguaguccuuguguuugaauggaaucuguuucuuuucucuucuuccccaugguuacuuccuaaacagugccauuuccuacaaacaucccggcucugggcaugugaucuuggcuuucauagacaggauuacaguuugaggcuucuuagugaacauuucuucaauuauugcuaugccauuaucucuuccugucagguauacaauugucaucucuuucuguagcuuuacuuauuuaccuuuuacuccuccuccuccuccuccuccuccuccuccuccuccuccuccuccacuaccaccacccugcagucugucuguuguacuuuuaucucucugucucagaugggaucucuccauuuaguccaggcuagccuugaacuuaggaauggucacuuuuacuacaguuccuaucccuucccguaccaucuuugacuuggcuauaucacauaugcauucuauuccuuaucuucagacauugcguucuuuucuuauauuuucuugucgucuucuuguauaccacagcauuuaaacauucacuucuccccuaucuuuuaaagacacuuagacaggcacccaaacaaauauuguucuaaaauagucuuucuugaguuucucauucaggcuuuuggguguucuuuaucuucagauaauuccucaguccuuugcaacuuguauucuuuuugccaguccccaaaacuucaguugauaacuucugggccaccauagucccgauacugcuguuuaccauucucuuucuguuggcauucuugcucauguaucauuacuugaaggcuguacaaaaauguugccaccuuuguggccuuuccuggucucuaaugucagaaugaugguguuccuugauucuguccuuacccuuacucuuuuuuauucuucaaggguugcucagagaucauuuuuacccucucuuaauucucugucaagcgcaaggaagaucagcuaccauaucauacaauaaguuguugggucagaugcucuuucuauuaccuacccacauaccuuccacacaagcagagaacuacuucucaauuaccuucccaucuagucucuuaguuucauaaacgagacagcaauuccaucagcacgagcauuucugaguugcugagucauauuaucugagacugucgugucugucacuucuccccaucucuaucucagaagguccacugaugugugcuuuccacacuggggcacuaaaaguccuccucccggccuccuucccaccucuuccaccucaucgccguggacugaucuuucacucacaaguaauuucuccacuuguuuaaacugcuguaguucaaguacuucuuagaaacaggauuguaguuagaaagauuagaguauauaugcacuaaacuguaauguagguuuugacuaauguauguacuauugugaccauagucuagaaaaaauaaagagcgagcauugcuggccucuagaaacccacuuugcaccaauucuagugccugagcccucuaauauauucaucacuuacugaaaagacuuagagucgcuuucuaaaugguguuucaacuuugauuugucauguuuauucuuuuuuaaaauacaagcauuuuggggaauuuaaaacaugaaaacugcauuuucaucauuuuuaccuuuuuuucccucuaagucauccucccaugugccccccauugccuuucaaaucuaugacuucucucucucucucucucucucucucucugucucucucucucugucucuccaucucucucucucucucucucucucucucucucucucucucucucucucucucucucucuguguguguguguguguguguguaagggggagaucugauacuggcucuaucuaucauugcucauguguacauaucuuagagcuaaccacugggauugaauaaccaacuagaagagaacugauuccucuuuucucaccagcuguugauuuccuguagcucucgucuagggguugugaaacuccugacaguugguguuuauuauguagauuuacuuaagcaaucuuaagcaauaguauuguugaaauuccaugggugcagccucccuguuauguguagaagacaucuaccauuagaugucccgguccucuggcacuuaaaaucuuuucacucacccccucuuuccaugauuuuuccugaguccccacguccuaccgagcuauaaagcuuaccacccauaccagugacuagcauagcaagacauccccagugcugcacuggugacucugaccuugggagugacuaacagcugccuuguuggacucaaggcuugcucuuuaggaggaaauccaugucgcuagaguaaaccuguccacauacucauggccuuauagaccuuauagacccuagacaaggcgcuacugcugccauguuuccuaaaccaauauaauuuauaauuacacuuuuaauauuuuucuauaagcccacagauaguguugaucuuacuccucauccauggagcucuguugagcagauggaggcuauugcagagauccacaacuggugagacgaggagaaugagugaccguggggugcccggccccaguugauaaaucuaucaugcuuauucuaaagugcgcagucaucaugcuggggccuugauugaaagccauuugcauuuugcuccagacuuaguuuacuguguucugcaggcuccuccuugauccuggcuuugcucgguucuuuuuaguauucuuuuaaauaugcucucaugguuuuguuuaguuucuucaauuuagaucauuuauuuuuucuaauguauauaauuugugaaagaauuuuucuaaaggaagaguaggagauuuguucugcaaaaagagacauuuuaaaauacuaaaucuuugacuuggcaagauggcucagguuguuggcaccugcugccaagccuaaugaccuggauuuuaucccuugagccuaugugguggagggagcgagcggacucucaugaguuggccucugaccucugcaggcuuguagaauacuugaguagacuuuacuaaucugaagguucaaaaugugaaauguuccccagaaaugaagcuuuguggucguuguaaaaaauuugugcgcacaccuuuaaucccagcucuuaggaggcagagacagguggauuucugaguucgaggccagccuggucuacauagugaguuccaggacagccagggcuacacagagaaacccuguuucgaaaaaaaccaaaaaaacaaaaauuaaaaaaauuaaaaauuucacaucugauuuuauuucauaucuuaacaggcuauaggcaaagcaggauauggauauucccuuuagauuguguauauaugagaugaaaguuuguguugaguuugauucuguccucaggauaucucauugguuuauguaaagcuccccaaaucugaaaccauuugaaaucugaaacaccucugcagcccugcauagacauuucuuauaagagacacugaaccugucuguagucagauuucaugauucaguguuuuguauaaaacaauguuuucauuaugccuuuucauacuguaacacuuuauuugcuuuuaacaucauuaguaaauggauggauuccuuugaccagcacuauacugguuaugucauuuauuaaagaaagaaaccauguugucuaugaguaagaaacauuuagaaacaaaaaguuaccuugcuagauaauuuccuaaaaccuaauaauauauaagcagucauuaaacacuuguuuauauuccuuaaucaaauaucacucucuaagaaguuuuacauugcaguacccaauaaaguugauuuauaugcacucugccaaaaugacagcuuucauugauacuugagugcuuuucauagucuggcauuucucaccacucuugaauuugcuucugcuuauauaucccggccuguaccugaggugauugcaucucagacccacauucugccuguaaauuugagaguucuucaccugauacucuaaauaagaaaaacuguucugugagucugaccuuuugauuggucuucagucccugcugucuuuuaggaagaugguuagauguagcuuauguuccagggccucaaguacuugguuaagccaaagacagaauaguucacauuuucaucuaaucauagaauuuagagauggaaagaacuauuuuaugacuuaucagaggauacucugaugucauuacucucucguaccacuaccaguucaccuucuuuauuacagcaaaauccuuucauagcuaaaacucaucugcuauugcuauggauuuucucugaggaccuaauaaacuacccuuucuuuaaggucaagcuagaugucuaaauuggaaaauucgacuaucugggaagcaauuguccauguagaaacuuuuuaaaaguuauauguuaguuuaauguagguccuucacugacacauucuaaaaucugaacauugaaaaacagagagauucaauagagaaaaauaaaauauuagaacucuaaaauauuaagaaauggguuuauuguuguuuuauacaaagaggccaaguguggcuaaauucuuuauucuuaugaacaugccgaguaauguuugcuugccucagaaaaguucuagaaaaggaccauagucuaaauuuagccauugugccuggguuacaggaugauuugaagcuguagaagagagagcguuuguggagagcauuuauuguuguuagguagggaacugaucaguaagacucuugugcuuaacuuugaguuuggaaucugugacaaacacgcucucucucuuaaguagacuaauacccucauuauuaccguaaaccauccuuacaaguucagguauguguagaggggcugcaaaaaucuaagaccuugcucuacgcagcaccugugugcuccuggcagugauuagcaagaacggcucuuccauucauguggguugagggagggugugagauuucaguuguguucaauuuaucuccuuuuauaguucuugacuacuguuugcauagcuguaucuugaggguuuuagcuaaaguuuaaucaucuggucaacuuauucucugacuuuuaauuuuauuuuaguaaguauaacaaugauaaauuuaagagaaauaaucuacauuuucuaggaguugcuuaaaaaguaauuaguucacaguugcuuuugaaucaagaagccauuuccagagcugccacccucagggugguuauggcugcucuugccugcugagguaggaaauuaguuuugagaauuuuuaauucuuugaauucucuugcuucuucugagucaucuagugaacuucaucaauaauauauuuaguaaaacaauuucaaguagagagaugggaugaauuaaguguaugguguggggagaucgccugcauacacuuuagagcacccucccaggcgagacucuagcauucugccucucuagugucugugguacagacuagaccauucuuucuuucacuuggaacauacuguuugauaauguccauauuuaugauugcucuauuccaucuauuuacaugcagugugcucuucccuucgucauuucuuccuuggugucuaccucggcccagggucacauggcuaugucuuuuauucuuguacugcagaaccucucccuuugcugcauuuacauucuaucuucuucuucuggaagacucuuuauaauguuaaaaauguuaggaauuuugauuuguuggcuaaauucuaauuucacagaagaugcauuaucuucugugaaggcugggauuuuuuuuacagucuucacaugcccuccauuagcgccaaguacauaguagaaacucaauguuuauugcaaguuuaauuuuagauaaauugguggaagguuuucauugugguguuuuagaaugaauauauuuaauuauucugaguucccuuaagauuaaauuuugacaaugaaagagacacuauacuguugaguaauggauuuuguggucauucuuuuguugaaagcaagaugcuauuacaggaugcucaaaaguuaucuguguccuauuaauuggaguaacugucccaaacauaugacaccaguaggcuuuaaauauuauaacuaugacuucugccaaauucugaagaguaauuuguauguaaauauuaagugauaaccuggcuuuaaauggcugaaaaaucauaaagaaauauguugaaaguuguugcuaacauacaaaauauaagcaauaggacacuauuacuaguuuuucuauuugaauuaugugucucuacacuuaaaaagaaaaaaaaaguuuauuccuauaacaguuucagaaggaauuagauauaaaugaggaugcauuaucuacuauauguagauaauuaaaucuuaagucuguaaugcaacagcuguauaaucuugggcauguuacuuaacucaucugagccaguaggguuuauuguuuuuggugggggguugguuuuguuuguuuugcuuuacuuugcuuucuguuuucacauggaaagaggauugccuuaaauuuuagggugaggacaucuguccuagcuauuuucaugucaccuugguacaagcuggagucaucuuggaaaaggaaaccucaguugagaaaauaugcccaccagacuggccugggaacaagggucucuccugggaagagaccccaggaccaaggcaacuguuagaauagaauacccuuccugagguuucuucauuauccuaugucagggagcgcgucagcacucaggaggccaccagaucuguagcugagagagacucugggccuggcaugagcuuuugaaaccucaaagcucaaccccagugacagaccuccuccagcaaggccacaccuccuaacccuuuucucacagucccacucccuggugacaaagcauucaaauagauaagccaaauggggugccauuuuuauucagacuacugcagcaagacuggcacauucucuuaacugaugcauguggcagggcccagaacccacuccugagcacuguauggaagcagacugcacaagccaugagggacaagccaguaagcagcauccucuauggccucugcaccagcuccugccuccugaguuucuacccugacuucuaggacaauggacuaaaagucauaaauuaaaauaaaccaccccuaaaguugcucuuggucaugguguuugaucacagaaacagaaaaauaauuaggacagcauguaaagcacagggcagaguguuaccuggccuuuaguagcaucugaccugcuucuugucuuugguagguuuuguccuccucuuccucauguuaggaacaaaguacuuaauugaauaacuuacugaaaauuuguucuucauuuuauauacuguaguacauuggucauaggguuuguuauuguugagagaggcgggggggggggggguagggagaguaggagagggagggggagggaaggagagagugaguguuaguuuaaccauucacuauauagcucuggcuggccuggaaaucacuauauagacuaugcuggccuggaauuuacaauguagaucaugcuggccuggaacucagagaugccugugcaccucuuaauucccaauuacaggcauacaccaccacacccagcaacucguuuguuuuuugagauuuacuuuuguacuuuuguauuuuaauuaugcauauucuuguuuaucuguuauaugggucuauguauaugggaacagugccuguggaggcuggaauggaaccccugcaacuggggccaaaaguugugagccaucccaugugggugauggggaccuaaccucugguguucucuaagaguauaaacauuucuuacauauaccugagccauuucuccaucuucuacugucccuagucuuaacagugauccagucagccuagauuuugaaaauauuguauuguaaaaguauuguaauaaaaauaucuuuuaaagaauuugauggauauuuauuuaucuuuaaaauagcagguuuggaaagaugauaauguuugacauuaaucuuauaaauauguuaggacacuaccuaguugaaggucauaauuuuccuguuauugaaagauucauaaguaaaugauaaaaaugaaaauuggccauaacuaagccaagcuuuuucaaaaauguagauuuuaguuaaaauuuccuuuuguuuauuaauguuugcacaaacaaugguccacuucccugccuuguagcauugauugcauuugugccuuuguuggcugaguaucuucccuguuaguguaaggcaguuugcaugcaguguggccggcccuaggauaaaguugagacagaagguaacugaggcacguuuugagaaguugccgguucuccaacccucggaacccuguacuuacuuugauucucacagccccucuucugaaaaucggucacagaacauuuucuaacagauuugagacgcugcuuucuuaaaaauaagguuggggagguauuagcccaguacccuaagauguacuaagauauaaguugauugacuagucuaaagauaugaagcagacuuaccuuuuaguaaagaaauauugaaguuucgucauuaaaccguacguuagcugggccccagauuuugguguuaucuuuuuuuuuuuuuuuuugaaacagguagaucgccacuugagaaagcuggaucaggaacuggccaaguuuaaaauggagcuggaagccgauaaugcuggaauuacagaaauacuagagaggcguaaguacaauuuaugguuuuucuauucaucuuggagaguaguuuucucacaaaagccugccagaucauauaugcccuuugguggaugguagccucugggucccguaacuucuaggcuggcauugaagucuuugggucauaaacacugagagaaauaugcaggcugucagucuacucccucuuuaugaagacagcauacaaagucuuucacuuuguguuguuuucacuuugagaugggaccaugcucuauaaagcuugccgccccagccuccagaccauugugauucugagcacgugugcccacauugcagacuccgugcguguuuaauauucacauaugcuaaguuagaagagaguuagagaaagaaagaggcaaaaacguccaaguguccaccgugagagccaagccacgccuguucugugugcuucagcuggcagaauuguugagacuuugcuccucaccuguguggacugagguuuccaucgcuuccguaacacuuccucuugugcugggaagucuuuucaaaaccuccccuuaucagaagaacucauccuaauauuuuuuguuguuguuacaaacuugaugugcuuaaacuuagucccagauaucgccugggcuuaacucuggggauuccccaaaacgugagcaagacagauuuguguuuaaccaguuucacaucuucucuagccuaacuaggugagguagcaguuuguugguagggucagaggagguagucacugagugguaagggaaccaaguuaguccucagggugauuucuaugacaguccaguuaggguccaacagugcucauuccuugguacauucaccagccaguucguuucuauugccagguaguggguuucaugacuacaggguaccuaagcuguguuuacaggggcgugugaggucaacuggacaagccaggcgugugucuguuaguaaggauugcaauuuuaaauuuaaaaguagauccuugcuucacauaauuaucuucuuuauuggugauacuuuuauuccggaggaaaccuaucugaggauaauagauacuggggaacaaaaugaaauguuguaugacuaccuuugaagguuucuuucuuuuggaaaugcuguugguggcugugaguaagccuugccugccuccucacugcuucagggaguuaaugacacaaccacuaaggacccagacacaggaaacggaacggggucacauacaaacuguucauccugcccugacaucacuguaucucaacgaaucuuuaauaaguugagagaauuucuucagaaguguuuuaaagcuugggauuggggguuaugcccuuuacuguuugcaagcaaagcccuaagcucuuuuuuggaacugucaguauugcaguuaauuuuugugauugaauuucuuuguaugcaguaauauccccaucaccuagaccuuuaggauaacguauuaaaaggcuuucaauuuuguuacuagauugaauuuuuuagaucucaccauuaauagaguuguaauguccuuuuuucuauuugugugacacucagcaugaaagauucucuaauuagauauuagcauaucuugagcuguuguguacuuacggugaauacugagaagugagucuuccuccuuagagagaggacugcucaggaugcaauugaagauaguaacucucuacaugucugucuaaagugauaugccagagguuggcagucauaugugagggccaucuuguuggggguugguuuaaguggagauucuauagugacguuuaauccuggauugucucuguguccccucucuaggaucuuuggaauuagaugcuccuucgcagccagugaacaaucaccacgcucauucacauacucccguggaaaguaagucuggcucaaguacaguuuagcaccguacaugucaccuguaugugcucuuuuauuagcucuacauaagcaaaugagaaacguccuuuccuuucccuuuuuaaaaaaucggcuuuuuccaaacccagacacuauugcauaugccagcaagauuuuacugaagggacccugguguagcugacucguaugaggcuaugccagugccugguaaauacagaaguggaugcucauagucaucuauaagauggaacacagggcccccaauggagaagcuagagaaagcacccaaggagcuggaggggccugcaacccuauagguggaacaacauuaugaacuaacaaguacccccagagcucgugucucuagcugcauauguaucaaaagauggccuagucagccaucauugggaagagaggccccuuggucuugcaaacuuuauaugccccaguacaggggaacgccagggccaagaaucgggguggguggguaggggagcagggugggggaaggguauagggaauuuucgggauaguauuugaaauguauauaaagaaaauaccuaauaaaagaaaaaagaaaaacaauaggcuuuuuaucacaguuuacguguagacuuuuccauuuaagcaacauauauuuaauuugggaacaggaagucuguucuaucagcgcagaaacagauauaaaacagaucuagggagugguacgacugacccaacuauacacuucuucauguaggcccauuucuuucagccuugccuuccagugcuuagcugauauuuaucaugugauaaaaucuuguuauuagugaguuagugaaaggggauuauugguugcuacauuuuuuugacaagucaauucaauaggaaagagagguaaauuggaagcuauucuaaaugguaggcaguauauuaugauggacuuucucucgugauaaugugaaaccguaguacaucguggauugucuuuaguuuuuugcuccuaguuucuaaagugcuugaaaugucuguucucuccaugaaccacgugacaaagacuguuugcuuguccccuccuuggugagcauaaugguccauuucacaaggaaccgagaucauaacuguacugauuuauaaagggguggaaguauuccucucuguaguccccugaaguuugaaauuugugaauuuucuuuuuauucagaaaggaaauauaauccaacuucucaccaugcagcagcagaccauaucccugagaagaaauucaaaucugaagcgcugcuguccacccuuacaucugacgcuuccaaggagaacacgcugggugaguuucguuucucgaaagugguaauuugcuuguuuuguuuauguuggaguaagggauagaggagcgcucaagauuauaauccacacaugugcuaccucugaagucuacaugaugauaagaaggaaaaggaaaauugccuuguauuuuccaguugauucaaucccuaaaguauaugaagaauuuaaauuuaauuuuauauauggggaaauaauuuauuucaaucucagaaaccuuauguacucugcaaccauuuuuuuuucuucuuuacagguugucggaacaauaauuccacagcuuccugcaacaaugcuuacaaugugaacucgucccagccccuggccuccuauaacauugguucauuaucuucaggggcuggcgcaggggccaucaccauggcggcagcacaggccgugcaagcgacagcacagguaauagucguggguagaggcaagugcuacauugguucccgucacuggcaaaccucaguaggagccacuagguguuagcagagcuuucagacaucauauaguuugagcuugaaguugcccuuuuaggcuaguugguguuuuaguaauaaugcagagaaguuauuggguauagagugacgcaucaugccaucacguugacccuuuucccaguuagugcacaaguuaccuuccugucaucaugaggacaauaucugcucuuucuguaccauugggcuuuuaucuguguuggcugcaguuagcucauuucugugguuugcacauagugugaguuaagacauucuauuucccauguuuauucucagcuuagcaugaaaaagacucugaauuuuuccaugacuuaaauaaccauaacguguaacacuuaaagagaaaauacauauuuacauauauugauguugucaauacaugucuacuuaagaugaaagaagggcgaagaacaucgaguuuaaaagccaguuacgaagcauuuaagaacaaugacuuccagcugggaaaagaauuuuccauacccagagaaacagcuggcuacuccuccucaucggcacucaugacaaccuuaacccagaaugccaguuccuccgccacggacucgcggaguggcaggaagagcaaguaaguuucccauggcagugugugucuuuguucaggguuguuguguggagcuguauccauacaucuccagggauuaaccacagcaggguacagugauccaggcuaaacacuggauaggcaguuggcucucugcacugccucaccuugaaggcaggaaggaagucuuucaacuguuagagucauuuguaauuguucucaguuaguauguaagugacuucuuuuuacuuucuuuuguucuuucagauaaaucauuuugugucacuauuccuauuuguaguuuagguguuuagaaacccuguugucugagcugaaggaggaaaaaaaggugcaaaugagagaccaaaagaguuaguuauauaauaaugcauuuuaucuuuauuuuaaauguauuacuucucuacaaaaaucuccugaaagaaugaucaauguaaagucuccacagaacuauuauacaucuuaaaauugauaugaauugcccacauuuaguugaacuccuuauaauaaauuucugcauguucucuggaauagaguuggugguaaacaguuguugaauucugauacucucagauccagcuauacuugauaggcauaggacacaugccaacugauguuaggacuuugccaaauacuuuucuauauuuguacuuagguuuugauaagaacucuuuaauuuacuguaaaaacauuaacagugugagaugguguaacuauuauucuugaacacuaccaaaaauuuuaagucaaugguagauaguaaccuuaauuuagaaauuaucuuuaaaaguugaaacauuuuaagagaauuuucuucuauuuauuuuaaauagaagauuuuaagaauauuuccuucuuaaaggaacuuauucuccagaaaacaaaaauuguaaaccuagggucagaccucagcguguccuuuccuucugugucggugacgaggagucacucucggggaaccgccccagugaacaaaugcagcuaaucugccuguaauuuuuucagaaacaacaccaagucuucaagccagcagucgucguccuccuccuccucgucguccucuuccuccuuaucucuguguucaucgucuucaacuguaguacaagaaguuucccagcaagcaacuguagugcccgaaucugacuccaacagucaagucgauuggacuuacgacccaaaugaaccucgguauugcaucuguaaucagguaaaaacaucuacugcgugucuauaaaaguguagucugaagaaacaagaaagaaaacuguuuuaaaaucagcacauuuuuaugcuaacuaaaaucaagaaugguuuacuuauaauuuuugucuuauaaaaguaguauacuugcuauaaauaccaagaaucaugaauuacguguaaugccaacuuucccauacaaccuauggugagacauuugaugucacaacacauguacccugcaugcaugauguaauacaccacuggcccuguggccuacacagcagaaacuccucccugugauggugcuagagacugggagacccgugacgaaggcgcugguugacuagcuaccuguaaggccagucugugaguuuaaaggcagugcuuuucuacugaguauuuaugaaucagagagaagaagaucauauugugcgguuaugcaaugugccaacuucuuaaaugcuuguaacauacuuguaauguuuaucuaauuuucuuugaaccagguauccuauggagagauggugggaugugauaaccaagaugugaguauugcauuuuccuauauugggauguaaaaagguguagaugacugaguauuugucuuauuaauucuauuucccaguuuggcaaucagguuuucauuugggauaacuacauuauccugaugaaagcaucuacauggcuuuaaugauuuuccugcuucaguguuucaagguggcacuacucguguuagguucagauuaaauucacaaggauuacuguuggcaguucgaagugcuuucuuuucuuuccgccuaagauacuguauuuaccagaguccugguuguuuaucacauugaagaagugaaacuaaaaggaugcucagggauaauuaagaccuaaugugugguuauuucccucguuauuauagcauucggcauucucuccacaaggggcuuggacuguacaagccaucucugaugggaaacugagaggagauuugagaaaggacuccugcuuccugugcuaggaaggguauuaguuacuugauaagaacaccgugacagaaagcaacuuaaggcagggaagggugucucuugacuuacaguuccaaagggaacacaguccaucuuggcagggcacgcauggcagcaggaguguaagguuggccugguagucaggaagccaccugauucuguuucacccacccagggcaggcagaagggaggcagcaaguacaaguggaggcaggguuugaaaccuccaguccaccccagugaagcacuucuagcaaggcacccuguccuaaagguucuagaaacuuccuaaacagugcuacuagcuggggaccaacugagcuuaucaggggaauuucauauucaaaccacaaaagggauuuaauuuuggauaaagaugcauguuugauuaaauacuguuugauugucuagggauuuuggcucauuccuuaacugcccuacagcaguuuuguaccugcuacucccuuuuguaccuguuguacuucaaaggaguagcaugaaacuugugaccuuggugacaccaguggugucagaauucugauauuaacaagagucacaaggacaguuguguguguuccuucccugacagggugggugcacugugcucuugagaagggcacagucccuccccagcugucccgugcagucacuuguguguguauguggggagguguuuuaaagcaguguccucuggggucccuguaguuccuccagugcuguuguggguaucaagccuuccuguggagugaagaauuuuuuaauauuucagagaggaggguuuccuccauaucucuggauagagcaccagaaaggaaacacagccaguugauggcuuuaguuacagcuagcucauuccacuuccagagaacaauuauggcuggauauuuuuaagucuuuuacauguuuuccuucuucauguaagauucauauucuuuauucuuuggaagauggcaccgccuggcggcuguccaaguugauggcagcaaauaaauguccauucuuuagugcucagguacuagaguccaugacgucucucuuaucaaagaagcauccuuuuccuggguguccauguuuucauccaugaggcacaucugucagacucaguaacguuuagucacugccaggguccaagaaaucugaucgcacagaccuaaguuugguuaaaugaaauacuguguguccuaagcauuuuuuuuauuauuauuaucuguucuuuagaaauaccaacuccccuuuuuuuuuuaaauuuucucuuccaguguccaauagagugguuccacuauggguguguuggcuugaccgaagcgccgaaggggaagugguucuguccgcagugcaccgcugccaugaagagaagaggcagucggcacaaauagagagggacucuauugucacugcaggaaggaggaacuccagcucgccauuuuauacaggacgcuaggaggaaagacacgaggacgaagaagcagcucaucuccaggccaccacuuagaggauuacagagacaauccuauaagaucuugaacuugaauuuuaugaguuguauuuuaauaauguaaguaaauuauuuaugcacuccuggugugcuaugaauauuauuccaguuagccuuggauuauuucuguggccaacauaugcagacauuuguacuccaaccauuuucucaaaguaaugggcauucuauaauuuaaacuucaaagaauuccaacgaugaagauuuuaagaaaguauuuuauauucaacagguauauucagcugcauguacuguacuccagagcuguuauguuacacuguauauaaaugguugcaaaaaacaaaaacaaaaaacaaaauacaaacaaaaaaagucaguccuucuaaaaaggauuuaagauaaugguuuuuaagaugccuuuauaauaagcuuuguuucuuugugaaacucauucagcaggcugaaggaauugguuuaugugguaaagugggcugguguccucuagaguaccuggguacauaaacagaaacuccuguagguaaaaccugauccgugccauuagucucuauguuucugcauccagauagagugcagcucacgcucaagggggugggggcgggggcuccgggggaaagggcguuaaagugauacauuuuuauaccaaauguguuuauuuuuuugugcgaguaauccuuaaauuggaauuguauuagguguuaaaauaaaguuuuuuaaaaaauaacuuguauuuauacuuuacacacuuaauuaugaaaauuucuuaauugcaauuuauuccuaauuuucauaauccaaaaaagauuagagguuagcaugcagaaugcuauguaaucuaugauuucuauaaugauggcuggaaauuguguuaugaggauaaggaaagaacauuuuaaauguaaauuugaagugucaaauguauuuuucuagaauauuucucuggcuuugcuuugaaucuaagggauauaaaaagaaccuaauuacaguagauacaaugaaaauaauggcuauagauguuuggacuggaagcaguguggccaauaugacuuaaagagaccuuaaaauauaauuuuguuuuuaauucucugacaucgugauguggcaguuaauuaacucuuaaaucacucugggcuuugugaaaccaaaauaaugcagguugugggaugucuucaaaacacuccuaaggacuuguucuauaggugcuauuuaggugauggacuuuacauaguggagacuucacuuaauagauguucaguagauggguagaaaaauugaugaaacuucaaagaucagacuuccucuacauugaaauauaugaaauccacauaugcuuuaaugaagcccacuucugaaucuuuuagaacuuacccagaaggcaguguuaaaucuacguaaugcuaccuacguaaugauuugacagauuuucggagccucauccagcuguaagauccuggaacgcugaacugccauaggcuuacuugaugacuguugucagccccagagauggguucauacaguucuuaggauuucagcucgucaggagugugaugaccucacgauauuuuuaagccuuuaagcaguguauauaguugagcucugucagcucagucgcaugcucucuggagaugcuuggaugagaggcguuuacgugcuguaaucacacagugugacucuucuaaacucauccacccuuugaacuggcuggaggaagucaccuuauuuuaagagaaaguuccuugucaggucagggccaggggcauuccuguguucagucgcuauagcuccucccucuuguguucuacuuacugagucucuuagaaagaaagcacagaagcaagcuuugagcucaaacguugacuuucuuacaaacuauacaugaagaaauacaccaaaauuuuacauuaaagauuuagaaauuaguagaaccugucccuaaauuagauagcuauauguaaauguguaugcauacauaccauauauggccaaacauggaacuaccucacuaaagcaacauuuccagcaauuacuauucuuuguuacauuuacaccaagauauucagaaucuuuguuguacaaaaguucuguaacaguggguggcggaaaaaggcccaagugugaguucacaguuuauagguggugaaaacgaggccuuacugcuguagucuauauuuaaauguucaugguaacacauuugaagcaauaaauggcuuaauuaaaugccu

SEQ ID NO: 12358 - RNA, 51166 nt, Mus musculus
ggauugugcggcugccgccgccgccgcugccgccgccgccgccagaggacuggaggaguagggaguuuagcgcagccgccggagugcuaggacaacgaccauccagccggagcugagcagggcgggagcccggagcuucccugucggcgcgcggcccgagggcgcccgccgucaucuccuucccucggccuccgcgcgccggaggagcgacgacgggaugcugcggcugugaccgccggcucgcgccccugucacccagagugggacccgagugcucgcccgccgccagaagugacgacccuggacgcuccaccccaccggcgacaccaugagcucgggccagcagcccccgcggagggucaccaacgugggcucccugcugcucaccccgcaagagaacgagucucucuucuccuuccucggcaagaaauguguggucaguagccgagaccccccugucgccaccccccaacgucuacuggcggguucgggcugggggggaacgggacucaaggguaggagggagaaggggggcaggcucggcacggcuggggugcugcugcgggccaggccuccagccucccgggcccuggggcuccccucacccagcucuccgggugcaggccugcccggcccggagccaccucccccagcugcuggagaacaagggagugucaccuccauaggccugcccaguagcccagguccgccgggccgggccggguccgugcccuugcugcagguucaaacuuuacucuagaccacaaggggauuuuguucgugcaucagcagcuuaagaucucaggacaggaucccagcauuggcccuugcuucacuucccacuucuggaucuggguuaucuucuuuaacaaugcuagagguuuuaggaaugaauagauggggaaagaagcgaauuggauuuucgguccgccuuaaggauuccgggagagaauaaagugcagugcagguucauggacacuuaggaucagagcaagggcaggaaaugcgccugcucccaauugcaaaaaacaaaaacaaaaaaacaaaaacgggguuuauuucuccagcagaaacuaggccuaguuucugcucuccgccccacuguggguuuuucuuuuccucccuggcguuguggggugggguguagggugcuguucgcucccaagccaugcguagggaagcgacaguuucuaauagcucacggccuuugggaucaaaagugguucugaguuuggugcugugaggaggcccauuccaaccccagauggcggauugggagcaagcaguucugugggaaggggaauggguguuauugacggaagcauucauuacguuggcugcaggccuuucugggguggggagguucucugggugaaggccuuaucuugaucuuccugaggugacugaguugaaagggggauuguuggaaugcuagccggcucccuuucugccguguuugcuagcucucacagagccugugccucuggaacccaggaaacacccagagaaguuucagccgagcugaaccauuucauauccucccuuggcaauguuggagaugucagaaucagacuacaccugcugaagaaguuaagaggagacaguuucuggaaaguuaccagauuaauuguuaacuucaugaucugacuguucauaucgacuuugggaaaccaaaucauuccaucggacuuaagauguauuucuuguucuaaaauuuagacuuuaaagaacacugcguucacugacuaaaguagaaaacagugguucaaaaaaagaagaaaaagaguuugggagaaaauuuacuuuaaagaugaaccaagucuguccucuauaguucuuuaaacaaaugagaaaauggagcucuuggccccaagucacauaguaauuuaggaauguaacuggaacuauaugcccaguuacuuuguacuuuccacuacaucauguuguuuggugaggauuuuguuccccuuauugauuugucucucaaagugguguuaaaggaauaacuacuucauuuuuuacauaaaauuaauagaaauaaaauguaaauuucuuaaagcagcauuaauuuuugcauaauuuucaguuuagggaaaucuuuuuauuuuauuuuuauuuuaauaugagcugccugcaagcaggguagaggucaucuuugcuggucuaguaccuuuaguguacagucuaucaaacauuaaguagcucacuguguucacauaccaggcccgugaacuucaggcauggcagacauucauuuguguucuaguauaugcguugcucagagcuuacuguaguguuuacccaggguuucaaggaaaugacagaugugggaguauauuucgauagacaaagauaacacggcucacuguaagcauaaguggguuacugaaaugguuacaaguagucagugcucaauuucuuuacaucauauauuauuaaucaacuuuaccuuuugaauugcaguaacuuaaaaccacauuguuguugcuuucuugugaaaauuacuguaaaauaugaagccuuuggcuuaauagagagcaauguaaaauugguguuauggaauaauccuaauaggcuuugcucagaggguuuuuuuguuuguuuuguuuuguuuguuuguuuguuuuguaguuuaaagcaacagugaaauaaaugcauucucauaaaucaagcagcaaauuuacaggucagaacaaauauaauaagcagauacauugagagcucuaucuacaaaguuaagaaaugaaaccauuauauggugccagauuuuaaguaaguucuucauuccuucuuucaucgaacaaaccugcauuggguaauuggauguugaggucaaaaaucaaaauugaugcuugcccucagggaacuugguguuugaagagggaaacaacacguaaacugaugagucagucagucagucaguccuuuacaagaccgacaagauagcuuuguagucuagucaggcaguguggguuuaagcuccgggucaauuugaacaagccucuuuacuuuccugcucugucuuugcuuuuccuaccuguaaaguuagaaugcugucucauguaguggucaugcugguagggaguauaucuaaaucucugaaaacuucuuagaaacagauggagaacuauugggugaugggagaguaaagggaaaguuugauagagugggcaacaucugagcaagauuaacaggugcuaacuagguugauaaaugacaagaaaggacuuggaaaauaagaguuugcuagggaacagggauucugccuguauuuccacauucauguauauauuggaaucacuguagaaauauuagacauguguggguagguucaauuucuugauaauuagguuuccuaggucugagguagagcuugauuuuuuuuuuuuuuaaauccagguuagugggaagauuugaauguauacuacaauuugagaguagaaguuuauuucuguggguaauucuagaauugucccauuggaaacauuggaugccacauugacaaucauaggcuuucuuuugcuggaguuugaguuuugugaguuaaaguuaaaacaaguucuuugacugcagcaguucuuugucuuaagaugucaaggcacauuccauaacuaagagacagguacaguugaggaagcauuguuaguggugagccacauacaggucagggcucacuuugacaggauacuuggguaaggugaaggcaguguagaaaugaacuauggauugugagagggaugacauaggacaucccgaagguguuuguagaugccccuguaaaauaauaaugagccugaacuaaagcaguuuauagguagagaauucaaaggacucuuagaaugauuaagucccacuuagauguagagggugaggcaagggaacugcagcaaaggccgacauuaaaggagagcagagaaguauguaggcacauacauuucucaucuucuggaaauaauucguuuuauggaagaaaugacucuuagaaaucuguugcuaugguauaguuucaauaaguagacuuuauggaaauuaggauuucauuuaaagugaaauguaauaagugaguauguguuauaacuggcauggaguuaauaguuguagugguaucacucccuggaaggauagucucauacacuucaagagcaagauucacuuaccuuauguuaagggacugcugacuuucagguggaguaauagcuaacuuguguaaggcacgugcgcauucacccuucuucauccauguggaguuucauauauguaguucccaguaaggagcguggaaaguaaaaccuguggccacuugugucuagcccccuuucugaaugguuugagacuggugaggauuggccuucuuuuccccugccauacucaccuguuugcuugguuuauuuccuuguuuuguuuuuaacuauuagugauugcuagauucuuuucuuaaucaggaagaguuuugccuuaauuucuuuuacuuccucagccccuguuuuuauuacucaucuucauuaguuaaauuguguuuccucacuuuguaugcaguucuaggagauggaccuaacaucuugguauuuuucuauaauuuucacauugcauaauuuuuuuuuuuuuuuuuuuuuuuuuuuuuuuuugguuuuucgagacaggguuucucuguguaguccuggcuguccuggaacucgcucuguagaccaggcuggccuugaacucagaaacccgccugccucugccuccaagugcugggaucaaaggcgugcgccaccacgcccggccacauacuucuugauugaauaauuauaauuggucauuagauucagucuuaggagccuagucagcauuucucacugcuugaucaaguugugaaaaacuucauauucuugacagauacuauuaccugaguucaguuucuucauuaagcaaagugguuucauuccccugcuaagcuaauaucuucuugaugauggccugcaauaauuaagggaagggugguagaauaaaguaggauaugccuuucacuuugagcaaugaggaaagaaagcuaaaauucacuggauuaggaauauacaaccaugaaaagugcccuccucuguggugggaagaagauaaggaccaaauuaugacagaagggaagauuagagccuacuuuguucuguagagugggcacauuucccaacugucgcaucuagaucuauagaacggucuuacuaagggguuuuaaagaauuucaguuagaaugggugccaccuaugaaguacuuuagggauuuguagaagcaugugaagagaauuguuacugaaauuacucaguguucauucccauugauggcaaaaacauuuuagaucaguuguagcgauuuuguuaagucagucaaguaugaauccuauaaagaagaaccuuucagcagaccucuuuaaggaggcucauccuuguucuucuuaagcccgucccugccccuuugcucugccacugguuuguuccucuguuauggacaguguugaguauuuuacuuaaaauacaccauuccaaaaguuauccuucagcuuuaaaauacuacuuacaaugaauacaaacuuguugaguggagaaauaaaaugaagucugcuggaauaauacagaugaccuaggaccuuccuuauuaccuguguuagaaaauguuggcugacguucugaagagugaguugccuccuguggugccgcugaacagcuucuaucguguagucaauauuguauguucagaaacagaauacguauguauuuauugagacaaggucaauaaauauagugcagacuagucucaaacuuaggauguaggugcgagugaacuuuaauuccuggucuugugccucuaacuccagaguuagggacugcagauguguaacugugacagccuaacuguuaggguguaaggcaugguauauuucaaguuauaaaaccugggaagaguaagauucaaaugaaauacauguugauaauauuucauuuuuuuucuguccauauuccacaguuuuuuaaauaaaugauuuuaauggaagcauagugcuugcuuuuucaauuuuagguagaaaaaauaauuuuaaaagagcuuuguuacauaauauuuuguagcucuaaaaguugcagcuuucuucccauauuuaacaaccuaguauuauauuuacuauaaagauucuggaagcaacacaagucagugcauucuuauuuaccuuuauaaggugugcacuguuauuuguaaauauaacuuuuuacugguuuacaaauaaccuaaaauaguaauucuuuaacugguauuaguuauuaaauagaagcuguuugguaucuucgacuguauucauaaauggugcauaacaagaauaaaccuuguuuaucgcaucacuaucaauaacuuagagaaccagaugauuccaucauuuuaaugguaauaaaugguaguaaaaaauaaauggcacucuaaccucacuuuuuaauuuucuguauaaauaugugauacggugauaacuggccuaacauaaggaagguucuggcuuucagguuggccggaaauaggaaaacucccuuuagaaaguagagucaagugaaaaauauguaguaaguuuauaguuuaauucucauuaccauuucaguauucuggacucuaggguuccuuugugguaggaauguguuuagacuuucaguuugucauugaagauugcuaaaggaaucacaucuguagaaggaacgcucaugaaagacuugcuagauugaagcaaaggggacgugguaagggaguccaggaaugcaugauacuguguugggguuaucacaaagcuguaugcuugggaacaguaucaaagucuuuauuuacaaaguuaaacauucaucuuagguuugaaaaagcugggauuauuuacagacaaaauacuuaccagaccuguaguuccaaauuuuaaaaguaaaaaaaucaaaucuuuauauacuauugaugauugaauauugaaaggucucacgguuaccgaggggaacaguguaguccuugugugacuuggccagcacuggagcaggaugacauacuacuuuuccggcugcugugacaaaaugccugacaaaagcaacucgcaaaacaaaacguuuauuuuggcucacagugugaggguguggcucaucaccgagcauggcagcggucagagcugugcuagcaggccagugaggcagagggagugagcauaggcugcccagagguuacuucuugccucacuuucuccuuuugugauguuuauucaguucaugacccccucgcccaugguuguuacugcccauuuaggaugguuuugccuucuuccauuaaagcugucuggaaaugcccucacaggcacucccagaaucucuccuaagucauuccaaacccagugaagggacacagaagauaagugaucacaaguguuuuccauaagcaauugaaggacuagcgagaugcuuaauuuaccaaaaaauaaaaccaaagaguauuuuauauauuacacagauccuuuuuaugcuagagguauguuuccuuguccauuuauaccuauuucauucuuuuauucuuucauuuaaugccauucugcuacauuguaugaagguauaguuauauggaauuuauuggucucuauuaauaaauagaugcuauauuuagccagguaccauaaaaccagguagcuuauagaacaguguauucucucauuguuuuagauugaaaucucaaaucaaaggaccagcagaauuuguuucuucuggagaaacggagcgugaaucuauuucauacccgucuuccaacuucuaguagcuacuagcaauccuuaagguuccuugacuccauccaguguuugccuuuacaaauaacauggcauguuguacucauucugucuucuccacuuacaagaacaccagucauacugcguuagggccagccuuaaugacuuaaaggcccgccuuuccaaauaggauugccuucacaggugugaggguuaguauuucaauguaacuuucaagaggacacaauucagcuugauaucaauauguuuuuugacuuucaaaggaaaguuuuuguaauaugauaaacauccaaaugugcccuuuccaguauuuauauagaauaaauuauaagaacuaaagcuaggacacaagcauuaccacgugggcagauaacugcuaaucaguccuguccuccacacaauuguuagaaacuaccuuuucaucaguggccggcauuuuaaaaaugucuuacuggugaaagaaucucauuguuuguuuuguagauuuagugaaacugaacagcuuucauaucuguugagcacacauagucuucuuaggccauuuauuuccucuuaguaauuuggaagaacuguugauugguauugaauaauaguucauaucauaguauuuugguaauuugugguuuaccuuuugcuaacauuaucauuaugcaaauggucacugaauaaauacuaaauuuuccuguggguguuacugcagucuuauaucuuuuccccccucuguuucaaaagcuuuauuuucauuugauucaagguuugggaggugaggggcuccagagcauuuacagaguuguuuagugguaggagagacucagaugucagcugacugcuauagagcacaggagccucugguaggcuuccaggacuucugguaguacuuaaacuuccccagggacagcuggggccuagccacucccaucuucuuggaagugccccuuacagaaguuguagaaaugagagacccuuaggucagaacccagggcaagaagauccagaaagcccugguucagguucuccagcgcccuaguucugcccccagucagucuugagaaggcuucugcacuuccucagcagcccagccaccagcuguucuguucuuguauugacaacccugaagcucuuucucaggcgguuaggaagagauggcggcagcccagagaggcagcuguagguugccugaagguacagaagaaccagcaguuacuguggccucugaucaucagugaugcacagugugggacauaaccucaccuaugauggggacugguucuggggcuggcaagaaggugcugcuggagagaguggaaggcagcugaaaguguaaaaggagggaguccccgugucuguucuguagaaacacuguugaagcaagacgcggaucuaucuagggccuuggaugaccugccuuguuauaucaauauuuuuuauuuaauauauuuacuaauuuauguuuuaccuuuugaaaaugguacuucaaauuuuuggguuuucaggugaacuuaaagcuaguuuuauauucucuucuguuucuuucauuugcuugcuacuugucuucagugaguauaguuuuacaaugaugauauagcuugauuuauaccaaauugauaauuaaaauucagauuuccuuugcaguuuuguuauuuucuuaggcacuagacauuucuuuaaguacaaaaaauaucgcucagauauacuuguuuaaauaauauuuaagcgugcauguguguauacagacacugcacugccuagaguuaacagcauucuuccugcuuucccccuguauggauuaggcuccucaugaagaucuuucuucucgguggcuugacucccauccuuuuuuaugcauaucuacacaucucuauguauaucugcauucuaaaagcaguuguaugaaaaacagauauaucuaucccaugcuuuuuaagaguuuuuuuuuuuuuuuaauuuggagucuuaaauggaugaaaagcagacuacaauaaccgauuaacagguaccauggcuaucuacagacagacagcccauccugauugcucuguaucuccccucauccuuuccuacauuauuuuaaaggcgcugacucuucaccauuauaugucuaucauccagucauucuaaguaaaagauugaucacuauuauuaucuuuugaaacaauuggcuucuaguuucauugauuuuaguuuuauugauugauacuacuguuuuguuuucuauuuuauugacuucuauucugguccuguuguuuccuugugcuuaauuugcaucuucuagguuuucuuaucguagcaauuauugaacuaauugaugccuguacuguuauuuuuaaaaagugauuuuggggcagaaagcuggcuuaucaguuaagaguauuuacuacucuugcagaagauuuggguucaauucccagcacccauauggcagcuuacaacugccuguguuucuaguucuagaggauccagugcccucuucugaccuugagcuucuaaaagcacaugauauccaagcauacauucacagccaaguacacauaagauaaaaacaaguauuuuuuuuaaguaaaaaaugauugcuacauguuuucuucuaaguacuauaucauggguucucacucauguuauaguauaucagauuggaccaauaguguucaagucugcuuuacccuugcuaauuuaaagcugcuuuauguaauuuuuuuauugccucaaauauuuuagaacucuuagguguguaaguauuuacacuuguuaugucauguugaauugacccuuuugccguugugaaguaaccucuaugcuucagaauacuuuuaucaaaaaucagcuuugucugaaaauacuaccacugcagcuuccuuuuagcauggaguuauagucccuuuucauucuuccuuccuuagucucagugucuuuauuucugguauguguuucuuguaggcaugauaguaguuauccuuaauaucuggaaaagugaggguuuuuuuucccccacacaaaauaugucuuucugacugcuuuucagauuuuucuguuacuaguuauauuuuugagaaaucuauuaaugauguuccuuuguauaguuuaauguuuuugugcugauuuuuguuuauuucuugggcauauaauuuacacuaguuugugacuuuagaaaaaugucagacauuguuuuuaaugcuacccugcccucauaaacgucagucacaugugcuaagguguccuguacaugacugcugggcucuuucuuuuuuccucucacuuaguauauaguacuuauuacuaugucucuaauauuucaucuggcccugaacucaaagagauucuccugccucugccucucugccucagcaccucugccucucaagugcugggauuaaaggcuuuugccaccacaacuggcuaauauaucuaguuuaguauauggaauaaaauaugauguccuuguauacuaaggccaauuuuucugacuggcuuuggucucuaguggagcuauguucuugccuuuuuuuuuuuuuuuuuuuuccugguaugcuugggacuuuuuaaugaaugccaaguauucuaaaguuuaacuaauuuuauauuuuugauguuuuaaaauauuuuauguugguacacauucacauauacugagugcaugugcugucacccccauauaauuugcugcugucuuaauuacuguucuuuuacuaugaagagacaccaugaccgaggcaacuuaaaaaagaaaguauuuaauuggggcuugcuuacaguuucagaggauggaucuguggccaucauggugaggaacaugacagcaguagcugaaaggccacaucuuaccaacaaguugaaggcagagagagggggagagauggguuggccuuuggaaucucaaacucccccucccccaaccccccagugcaguaccuccaacaaggccuuuccagagcaguuccaccaacugggguccaaguguucaaauacaugagccucuggaggccauucucauucacauugccacaacacuauuuuuacuuauuuaaaaagcuauaaucaauuuucugaggaagauccagcaauacuucuccugggcauauauacccagaagaaguuccaacugguaauaaaaacacaugcuccacuauguucauagcagccuuauucauaguagccagaagcuggaaagaacccagaugccccucaacagaagaauggauacagaaaaugugguacauuuacacaauggaauacuacucagcuauuaaaaacaaugaauuuaugaaauucuugggcaaauggauguaucuggaggcuaucauccuuagugagguaacccaaucacaaaagaagccacuugauaugcacucacugauaaguggauauuagcccagaaacuuagauacaauuugcaaaacacaugaaacucaagaagagggaagaccaauggguggauacuuuguuccucccuagaauagagaacaaaacacccauggaaggaguuacagagacaaaguuuggagcugagaagaaaggauggaccaucuagagacugccauaccuggggaucuaucccauaaucagccuccaaacgcagacaccauugcauacacuagcaagauuuugcugaaaggacccugauagcugucucuuuugaggcuaugccggugccuggcaaacagaaguagaugcucacagucagcuauuggauggaucacagggcucccauuggaggagcuagagaaaguacccaaggagcuaaaggggucugcaacccuauagguggaacaacaauaugaacuaaccaguacccccagagcucgagucucuaccugcauauguagcagaagauggacuagucagccgucacugggaagagaggccccuugguauugcaaacuuuauaugccccaguacaggugaaugccagggccuagaagcgggaggaggaggguauagggaacuuucgggauagcauuugaaauuugaaauguauauaaagaaaauaucuaauaaauuuuuuuuaaaaagcuauaaucauuguuuaaaagcugucaccauugaauauguuucuuuuacuaaucaaauuauuuucuuuuguuguauaaauuaauaauauauuacauuuucuauuuagcauucuuuguauauauuugaauauuuuucugacuugguucauuuucuuuuuuaaaaauaaaagucacguuauugaaaauaauuuacaaguauaacauguagugguauuaauguagauacucaaacaagcucuugcccagacccaaagucucuauaucuuauuguuaguuccuuuucuugugucugugauuuuaagcgauuuccauaaggaaagauuuauuuaggcucacuacauuacggauauaguccaaggcuggagagacggcucagugguuaagagcgcugacugcuugcucuuccaaagguccugagugugccacaguggguguggaggucagaggacaguuugagggagucgguuuacgcuuuguaccaugagucccagggauggaauugagguccucacgcuuggcagcuggagccuuuaacccacucagccagcuaggcagcccuuuguggagagccuaaaccccagcaaguugacaaccaaaauuaaugaucacaguggucuuaauuauuuuccuauucugaagaacuuuuggcauuucucauaagucaaacuuagugguagcaaauuuccuuaauuucuauuugaaaaacuaccuuugaugaacaguuugcuggauacagaauucuaaguugaggaaguuuuuccuaacauuuuaauuacuuuaugauucugaauguuugccugauuucugaggacaguucauuauaauucuugucuuuauccuagaaugggagaauauucuucagugaacucaucuucaauguguacuucaaauugaagcacauuuagugaguccuuaacuuuugaaacuaucuaauaauaacuauguuuuuccuuuuuuuuuuuuuuuaagaaagaugcagagaaguuuaugaggcuuuuucucacuuugguuaauuguauucugacuguaauuuuauuguggcccaaagcucugcucguacuaaguaccuggcuagugucaauugaguuuggcuguuaggagcucacuauugcaguauguggagauagcaguaacuucaugcauguacucacguacauucuuaccagaggacucguguuuguguagcauuuuauccugguuuugguaguguuccauaagcucucucagcccaaccuguuccuuucuaaaaacaagcuucuucacagagugcuaggaaacagcuuaaaguaauccagacaguuaugcaaugcacagcugggagauucuggaaaggcucugauagcagucaggugacuuauuuuaaaauuacuucuuucuccuuggagacaauguucaucauuaaagauuuacuguugugauggcucuauagugccugaucgccacuaaccauguagcuuuagacaguugaaagguuaauucaaacugagaugcucaguaugaugaaguaugcucuggauuucaagacugaguauagaaagaaugcaucauagcacaccaugacaccugauuaaugcugauaugcaggaacuuugcuuauuuaaauaacguuugcuaaaagucauuucacuacuuaaacauuugaagucucauuuaucugccauuuacugggcagaugcagaguaaagucaacaucaaagcacuagcaaccuguggaucuuaugcagaaguagugcuuauaguuuuguucagaccuuaagaggcguuguuuuauaugaauuacaaaauaaaagacacccaugcauacuuacucucagaugacacccuguaggcacacucacccuuucuuuuauggacuguuccgugucagugagcgcaucauuaccaaaggacauaauuaauaguggauuuaaugcuuccuuagggaaauauuaaguccauacauuccaacacaguauuguguuauaggaaaguggcuuuuuugauuugguuugguuuucuuguuuuuuucguguuuuguguggagguagggguggggcugauagaagugggagauaagagaaguaagaaauaagagaaacaggaucgaucccugaggcaaacuggcuagcuagacuagucaguaagcucaacucugucucauuaaauacagaagagagggauugaagaaagcagcacccaaugucaacuuucaguguccgugugcacacaugcaaauguguauacugcaugcacauaugcaaaagguuaaaguauaauguauaugauguaaaauaugcagacgagaagugauacacuauguaaguuaccuucaaaauaagcuuaagaauaucuaaugcuuaaaauaaaguguuucuauccaauuguuuucuuucuuugucauuaaggcuuuguuuuagcguauuuuaagauucaucuauguuacuaccuagguuuucauucuuuacucacuaguaguccauugaucuauggcauguuugcuuauucucuuauauuuuugguugugagccuagccuuuaacggcugagccaucucuccagcccauguuugcuuauucucaugguuuugaguggaguugcuuacaguguuuacagaagaggcugccauaauuguuucaugacuuuauguacaucuuuguuucuaaugaguaccuggaagaauucaguuaccaaagggcggauguauauuucucuuuauaaagaacugucagccaguggcccugccaguuuugaccuucuaguucagcugcucucuccucaacauuugcuguggucugugauuugguugcugggagugaauauggaacggucucccaagugaauucuuacuuauucccccuugaggacugcugaugucuauggcuauuuaccauuugggcauuuuguucuuuauagacuuuucugcaguuuguaaugcuuuauagcuauuuuuaaauguauuuggacauauggcagcacuuagaaauguguuucugacuccuaucuaacauugucuuuucuaacacauccagugauaucuuuugguuggcuacucauuuuaauuaucauaaagacuacauuuucuuuuaaaaaauuuuuuuuugauuucuaagaugucuugaccuaugcugaauuaaguguagugagucuaaguuuuucuguuuaguuuuuuuauucaccaccuuuuuguuuucacacagagugagugcagcaaaagaguccugugcagugacuguaggagucuuucauugcagacagacuuuguccagugugcuaauugaguacagcgauuuguaaagguuuacuucagugacuuggagcacuuucuuggagcccuuuuucuugcuuaauggacuuuauuuguucucuuauuuuguguuuuuaaaauuuuuuuguuaguauaauauugauuugauuauugcauacuuauucuaaaucuuaaaaucaguuguggugagacauacuauuuuuuucugugcccuauuguugagccagcugucuuccuggguaggugaacugugugugguuaugauuaauauuucuguguugguacagaaauguuuuuguuugcuuguuucuuguuuaucgugagguaguuugguuuucgggcccacgcccuuuaguugguacuuuuaucuaggacugagcagauuaguaaacaugcuuuaauuuccucuuguaguaaacccguuucuucuagggcuaaugauuuagaaauacaaguaaguuucucagcacagcuugauacaaguuccauucuaaauaguuauuaauaguuuuauuuggaauucuguagagaaaacaaucuuaggauacaucagagagguaguuucauuucuguuuuagaaacacuacaguaaauugagcacagugcaucauaaguguaaaauggauguaaaucucacuuucugcauuuacacacuccguuccuggauauguuuccucgguggcagugcgcuugcuuagccugagacgcuggguucucugccuagcaccacagcggggacaugguugggggcuggggugguguuaacauguuuuccauuuaacuccuuuccuuccuuuacaccauuuaccaaauacaaaaccuguuguaauuuuuaaccugaacuuguauacuaauacauaucauacaagagaaauucaugaagcagaguaaacuggaggcagaguaucucugaaggagcgauuauaauaucucuggcaaagagaaguguaaaucugauuuuguugcuacagugcuguacugcuucggggagaauugcagucuccucaggcccuuuuagaaaguagcaggacaguaaauacuuucuguguugguacagaaucgggcugagcauugugggcuccaucauggggcaguuugaauaucaaaucuacucccuuguaugacaacgagcauauuaguaaacauguuuuaauuuccucuuguaugaagcuugcuuguucuaggccugcuagcuaaauacaaaaugcaagucaagcagcauauauaaaagguagagcagcacuuuguuuaucauugauuucuuucaagaguugagaagaaaaagaauguguguacuuuagaauaucuuuaagaacuguagucuuagguaagguauuuaaaaaacaaaaugaaacugacuuugacugacuugaucaaaaaggaauuuauuggcuaccacaagaucucaugggauccaaaauaaagcagcagugaaucuugagcagcaguagggucaguggaucagcucuuggucagcuucccuacguugcuugucauaacccauugcugcucgaaucaagaaguuacugggagcugaucugaguugaaagaaagaaaagaagggaagaaagcaagcccuuauaagccugaauaugcugcuuagucagggccauuaaagguugucuuaugugguuauuugcuaucagauuagcauugcuuuucuauguccuuccucuuugaucguuuauguggaaguccaacaaguuaaacaugguuguacauauauguagguaccugucuguggcuauauuuaagggcuuggcuaauagagaguuauaaagcagaaugacaaacagaauucgaauccaaagucaguuacuuuuacuuuuaccuguucugguuaggccuuuaccucugggagacaaagcuugcuuauaacuguagcuucuguggcaacauagcaugguauuaagcaauccuuacuuuuaauuucaaagcaugaggcucaaaugcuaauuuuuccuagauugcaguuugucagaaagaugaucuuuugcaagacuaauaccaugcugugacuugaacaggucauuuaaguuuuaaaaauccaaacauauaccugauuuuaaagcaaaaauagcuauguaaaaauuaacaaguuucuuaucuacuugucugcauuucccagcuguuccucuccucuuuaaacacaaaaggacuaggaagguggcccugggaacuaguuucaccuucaugcuugcuuagggcaaaugcauagaacuuuguuucauccucugcacauuuguuauauacucuugccuuuucauuucacaucuuguuugguucacauaaccuucauuauuacuuaagaagaaucuuuccuuccuuccuuucuuuaaagccacguauaauacccuguuguacaguuaaacugguuuauuuaauggaauaagcaaauauuuuucuuaguuauagugaaauuuuuaguugcauauaauuuggauaauuuucagguugaaagauuuaaauuaguguagaauuuuucaauccuuaaugauuuugcuaaaaguauuucuuucuuuaacaugaguuacccuuuauuuauccuuccuuaaguagaccaaauacuucauugaacugauuuuaacaccuacaugauaagacuacauuguauauguaaacacuuggauacuuuacauuuuaugcacuauuuacuuagcccaauguccuuuuuuauuguaggacacaaacuguuauucugguguuuccuagauuuuuuuuuuaaccaugauaacuugccucuuaggauucuuauaggcuaguuacaaccccuucccccuuuaaaaaaaauacuguauauuauuuugcuucuguaacacauuucucaucccucagaagcuucuaacugcgguguuuuguaaaaugaauucguuuguuugggagcauguaguagcuuuuugucgcgucuauuucuugguauuuccuauccacuaaagaagaguuagcuuaacuccaacccugauccuuuauaagaaaccaguccccuggaaaagaagacucacuagcucccauuuucucuccuucccucccuccuuacuaaaagagguuuagucagcacauugcaauuacucaacaguaggggcauaagcauagaggaauugccucugagagaggguggauuauggggacuuuuacuuaagaacuauugucuuuugacuaggacagcccaccaugcaacuccugaacacagacucugccauggaaaggagagcagucuugauaggugggcauuuguuugggggcagaggcugcacucaguucuaucauucagguacucagaguugguggcaaagcagcauggaaaaacucguacuguagaaacuuccugguagggcuuguucuguuuuguugaguuacggcuuucguucuacguuccuccaacagagaaaauaguucaauuuggggaaguugauuggaggcauuuuccucauuagaacugagcaggagcaacacagggaggaccaccccuaccuaucauuuguuaacucuggcaaggccucuguggggaaccauaaaaagagaacuauacuuuaguagaaugccuucuuagcuagcccagaaagcuaaaaguaucugggaagucccaugguagggcuuaauagccuugucaaagcaucauauugagauggaacuguugaacccagugugaugucagugcugggcaaaucauugagugaacaagaucagucucaggaggacugcccagaagaaaaaguacaguguuccagccugugugucagcguccuagaaaccuuccuggaagugguagaagauuaagaggaaagacacaagaaacugaagcugagaucuggugggccaugcauuuagauagagauguaucaaccucuuagauauucaguacauuuacgugaaugaggaagcaguuagauaaucuuagagggguucucuguaugggaauagccugggggggggggcaugauccugcugucaguaggaccaagaaugugguuucaucacacacuugauuuuagcuaaaagucaacaguuggucagcaucuauauuaggaccagggaaggccuugccauuccccuaagccagacccagucuuuaucauucccaucugaaguauugaugucccugacaugacaguguucaugucauggaugcucauucugggguaaacuuaguccccacacuauaggguguuguuauccuaguuaguuuugucaauaugucauagccuagaauuaugggauuggccugugaacaugucugcaggggaauuuguuuuuuuguuuguuuguuuuuucuuuuauaauugaugucugaggacccagucuaccguggauagugucaucucuggccaguggucuugggcuauauaagaaagcuagcauggaccugugaccaagcaaacaguauuccuccaugguuucugcucacagucuugcuggagauuuuugacuucucagugauguggacuguguccaugugaaagccaaacaaaaucccauuucugccauucagauuucaccagagaauugccuuggccagagaucugggcuagugauuuuauuagcaaauuuucuguugcugugauaaaacaugaccagaagcaacuuaaaggagaaaugguuuauuucgucuuuugcuuccagagggauaagagccugccauggcgggaagacaugguagagagcaacaagcauggugguuggaacaggaagcugagagcgcacagccuuaacuacuaccuguaugaagcagagcucaaacuaaccauccacaccuuccugaacagugccaccaaacuaggggccuuaaguagugaaguaccuaagcugggaggaaggggagaggacacaugcaaaccacugcuccagggcaggagugccugggacaugagaggacccugaccacugauacagucuuuucuaucuuaagccccguaagaauggggcugcaacggacgauucuuauuaugacuggaaacuauuucccuuaccauuuugcucacacucuauacugaucagacauauggaacuucauuuuaauaagggugucuuagggcuuuauugcuaugaagagaccccuugauuccagcagcucuuauaaaggaaaacauuuaguuggugcuggcuuacaguuucagagguuuaguccauuaaugucauggcaggcagauguggugcuggagaaggagcggagaguucuacaucuagaucugaaggcagcaggaagugaacuggcuugaguuucuaagaccucaaagccaugcauacuccaacaaggccacaucuccuaauaguaccacuuccuauggacacaaagggcuaccagauugauagaagauucauacauaagguuagaugaggaaugacuaaaauaguuugagcugaggaagagaugaccuaguaaguaaacuuacugaagauacaucuuggagaagucaacaugcuaaucgccccucuccaauaaaaagcaaucuguaaauaagggagaccugcuuguugguaguucugcuauuaguuacagcaacuauaccugucaccgagcagauacuaauggaaacgagaguagaaaauacauugucugugggugagaauugcugagaaaacagcuaaagacucaguauuuucuacauaacugcuaaauagcaaaguacucuuauugcuggaacauaaagguauuuuugaguuuugaaccuccaauagaaaucauacauuuuaaacaaauacuguaaaaucacuuauuaacuaugcccucugaaagauucuuacgccaguaggggagaaucccuuccaacaagcaccugugcuccugccuggcuuuaucuaauugauuuuggaauugcuggcugcuguuucccuaagugggugagguuacuuggcauuaagaguuauuucaugaagugugauuugaaaacugcauuuaguuguuaauuuucccuagauacaaaauucucuuuuucugauugcaucguuuuuuguuuuaagccaauguaaguaaguuucgugucuuuuauauaguuuagagggacuccccccaagaaaagguaucagcacuaaauauaaauuuagcauuuauuuaacaaaauucagaaagacucuuuuacaauacauacuguucuuuaguggaaaugggcugugugcuugaaaacauguaugagggggugacagaagcacuuugacucuggcauccugcaauaaucagaucuuccaaacagccaccauaucugccucccaccuugucccaagggagaagcaauaguaguuaccuccacuacccucuuccaguccaaacuugaggauuucccguaauccgacaaacugcaagaggauguuucuaccuggccuuagaucagucaguucccagauaagagacagcauuggagcugagcagauaucaacccucuauggcuauuuugucuacuucccuguaaacuacccuuaaauaugacuugccauguuccaucugggccauuccugcuucuguuugccagcccuugugggcauguuuucgugauccacccugugguguccucuucucuccaccucucuuuuccgcuccuggucuuugccucagaaagccugggaaccagagccccacccaccucucuucugcccagcucuaggcuguagcauccugauucaaccaauaguuuuaaacuaaggagcaaggucacuugguguaccugaaaaucuccuuggcccuaguggcagccagucuuuggggggcaguauuuagcauugcaacacagcaaaagaccaaaccuuaacagugccccuccuaccugugucuaaggugacucuagugggaaacucagaagacuacagcaagccuugccauugguuuguaguuaauagugacugucauugugggugcaaauaauuguaaaaaucuucaaggugauuugcaguuucuuaugaauuugcauuuucagcaccuccugagacuugaguaagggucguaacuuuugagugaucuuucucuauauaacauacugcaaucaaugagggguuuugucuauaaaguuucuuuagaaaugucuucuccccuccaaucuguucugauaauaguaguaaagccuaaaguaaguugaaaguacaugucuguuccaaccaaaauagagggaaaaagcuagaacuauuuguuagaggugauagguucuuuaauauaagcagucuuaagugucccuucccuuugcugcaaacaagccaccuacuucuuuaugacuugaaacaguaccaguugauuucucaccauuuggcaagugaguucauuauugguggcaccuauaauuuuucuuugaucccagguuuuuagaacaacucugccuuccaggaaacuagaucacaauaugcaaauacuuuccaaacauucauuuauuugcugauguacuuuuggucaaaaaaauuucauggacaguuccagagugaacagaaagaagacaggugggagcaugcgugccuggcgaggcaccaggagccagucuccaauaaagauuaucaaacuauggcuguuuaucuguuucaacugaguuaaacugacuuugguguuauguuagcaguacuguuaaguuuuccccuucuauguuuccuucacuccccagucccucagugccccaaagugcccaagcgccuaaccucucugucgccccccaccccacccaucuguuuucaucuuuuagguuaaauaguacuuuaggaaauccuuucuuuuauauuuggguuuuugaguuuuucuugcauaaccacauuaccccucgguaacaguuacaguguucuuagacuacauguucacaaggauuaagucuguccaguuuauuucuauuuucagcuccauuuggaguccugccuucuccuauaccauccugccuguguaguaguuaccuaauaaacacuugguaaaucaauauucuuccauaguaguuucugcauagcugguaugcggugguggagugcuugcagaccauuuugcucauugugacuggucccaaguuaauggcugguuucgucuggcuccauugucuucucuugggauccuguucaucaguuuugcuuuuccucuucccacagcagcuucagauuuacuuuuguugcuguuguuuguuuuuauguuuuaacuuucccgauucuguuuugagguugaugcuaaacaaaaaguaguguuuauuuuaaaacuucuucacugagauaaaucacuuuauaagaauucaaccaaauauuuuguauaugcucacuuuucugcuucuuuuuauauucuuuugaguagaauuucauucccgguaaucaugaguuuaguuuacuucauguguagaugcggagcauaguaucaaaaucagaaugugcuauuuuuaauuaaauauuuguauguuccauagaauauggcuagacuauaaguauggguuugcaaauguauuucaggugcugugggaaauuacagucuuuuacuggguaagacauccguguggaaaguuauuccgccuuggaguaagaccuagcgguuacacaggaaaguugcagagaaacagaagaaagagcagugguugcagccugcaaagccaacccaggaaguugauagugcuuuacugaagggcagugagaagaaaaugucuucccuucccaggucuaccucuuugcuucugacaugaaaguucucagcaggaaggcuuugcugaguuacucaguacugagcuaucugggaugcauaagauuugauggcucugauucugaauacaugacugcagugcauuugucuccuguuuaacagagucauaaccuuuauuagacuauuaagacauggauaucuaccccaaaguacuugucccuagguuguuuuucauuaguaaccuugauugugaaagauaaaagcaguagaguugauuaucuucaguuaccuaccuuaaaggcauggaaggaaucuuuguauagauuuaacuaccacacuguuaaucuaauguuaaccugauacuugguucauuuuauugccuggaauuuauauauuaaauauuacacgcacgagcuauuuuugcauauacugugguuauuaggaauuauucaggaaaggcuuuauaaaauacuaaauugauagcaaaauuuuuaaacauguuucugaaaauugcuuauuauuggguuuuccguagaauguguguguggcaaggagagaggugggagaacuauguggaaaauuauagcauaguugcauauuauagcaucauugcauaugcaaauauuuuaauuuuugucaauauuuaaacuuauguuuuuauugucuuuguauuugcauuuacaucccgauaauguucuacagucuucauauugaugcuuuaugaacaggcuucugaagauaaagaguuucagccucuagaaagaagauucuuuuuuaauuuucugaaacuguuagguauuaguaaauagagagauuguuagaugucuuuaucuggugauuucauuguuuuuugguuuuuguuuuucucuucagaaauuaucugggcagcacuacaucagaggccuguaaucucuacauuuucacuaguauacaaaaucuaguggguuuuuuguuuguuuguuuguuuuguuuguuuguuuguuuguacccccccaccagugguauucgaugcuuucuuuguugaaguuuuguuugcugaggguucaagugguucucaaccuuccuaauguuguaacccuuuaauacaauuuucauguugugaugaccccaaccauaaaauuauuuaguuucuacuucauaacuguaauuuugcuauuauaaugaaauaauaucugauaugcaggauaucuaaaaaguaaccccaagagggucaugauccacagguugagagcugcugguguagaggcaggcaauacaggcaauacagucuccauaggcuaauguguacucauauucuucaauaucaccauguaaaccggugucccaguuaacauauuguucauguuccuaaacugucuuuguaauuuuuaauaauguucuuguggaaaucucccaguucucugcaugaagcuucggugaaauuuuuuuaauuaaaaacacaacauugagcauggcaacccagaaugucuguaaagacuucugggucuuaguugucuacggaucuuacauuccugauuuugacauaaauaaaaauuuauuuauauaauagcuaaaaagaauacuuuucccagaaggaaguccccagauguaauuagaugauagcaauauaccauaccuccaaaucuuaauauagucugcugcuuauacagugcccguauuuuauugaacuuauacaucauaauuacuuaaucaguuccaacuuuugauuauuuagauuguauauguuuaaaaucccaggauucaugaaauggaagggaacugguugggaagaaaggaaucauuugggaguagggaggacaagaaagguuugugagagguacauauuaucaaaguacauuuuguugugccuuaugaaauguuacaauggaacccacuaucauguauaauauaugcuaacugaaacugggaaaugacucaugaaauaauuuacuuuaaugcuuacauuuaaaaaauaaugguuuucauagcuaguuccuuguauuuugguuuaggaaugagauuaaugguauagaagcuauaauuguuauuuucagauuuguuagugcugucucuauaugugagugccacuuuaagagaaauaaguagcuaccuuuaaaauuuuaacauaaaaaaaaggccuauuguuuuauagaagucaccuuuuccugauaggauugucccaccauuuaaauguuuguguccucaaaaugcaguguaauuaaggggaugugagaauauaaaaucugaagugcaguuuaucuauaugacucgugagugacuuuaguguuguguuucuugaguguaaugagagguuaaaauggcagugacaaugaugacuacauggacuugguauuuguaagugccuauuucuagauacaguuuaagaaucaaugaauucgacuuuucaauaaauugguauggguauuaaauuaguuauaacuucaaaaggaagugacuuaagauaaugaguguucauuguguucucuuucaggaagcuagugcgguugggugguccuggcuuagugcuuccgagggugcagucaggauguccgcgggggcuaugaaugcuguuuugaagguaauggcugcucacuugcuauuuugcagacuaugucuucagcaguggugcaguuguaugcagcagaucggaacuguaugugggcaaagaagugcaguggugucgcuugucugguuaaggacaauccucagagaucuuauuuuuuaagaauauuugacauuaagguaaguuuuguuuugauuucauuuuaacauuuuuggugguuaaguugucagccuugguuauaauuuagucuacauguucugauugucuuguguguguuuuaauugacauauuagaaaagugaggauuguuguugauaccucaauagggauauuggaaccgaguuggagccuagauaagaauauugagauauucucuuaucuaugacuguuuucuguccuuuagccaucuaauguucagugugcuacucuaggcauugcucccaaacaucaaucguaucaguguuuccuuugagucaggucagaaaagaacauggagaauaugagcaaguaucugugaccuugacaaguuuggguuaugcuagucuaaaagcugaguuuuuuguuuuguuuuuuguuguuguuguuuuggguuuuuuuguuguuguuguuguuguuauuuugguuuguuuguuuugguuuguuugucuuuuucgagacaggguuucucuguguagcccuggcuguccugaacucacuuuguagaccaggcuggccucaaacucagaaauccaccugccucugccucccaagugcugggauuaaaggcgugcaccaccacacccaaguuuuuuguuuuguugguuuuagguuguuuuguggugcuuuuuuguuuuuuguuuuuuggcuuugugagacagggugucucuguguggcccuggcugucuugaaacucccuuuguagaccaggcuggccuugaauuugcagaaaucagccuaccaauuccuccagaguucugggauuaaaggugugcaccacuacuuggcuaugaugauuucuuaauuucuuucuugacuuccuuuccucccucccucccucccucccucccucccucccucccucccucccucccucccucccuuccucucuuccucucuuucucucuuucuuauuuuuuacuuucuacaugcaucucacugcccaccucccaguugcccucucccacaauccuucuccucugaauaggugcccccucccuccagguauccccucacccugacacuugaagcaaaguuaggcuagguuucuuuaaggauagguugaccauaucuuuucaagugaaaugaucacauagucuuaaaaggaaaaaaaauccugaaacaaaccauuaguuuugcauaacuuuuauuacacauuguuacuauaguugguuuguuuuauuacuguucuuacuauacuucacauauaaauuaaacuuuuguaaauguguuuguacagggaaagcuauccauagguuccagaugucaguggaauguguaccuuagaauguauaucuccacugaugagaguagacugcacuagugauguguuuuaucuucucccugggucauauagaauaguacuuuuuauguaggccuuuuugucuuggacuuuccuuauagccucuuauucauuuugcucauuauaaguuaguuguuucaggggaacacaaauauuuuagcuuuguagauacuguuacuuauaaaagugaucauuuugcuaaaggaaagucuauaagcauaucuuccuguaguuaagccuccacaguuuguauuuagauguggcagugaguguaauaggacagaaaguaaauaugucaaucaaggcuggcagugagccuggacacugccacugugugguagcucccuggaucccagcuuguuagcuguuauaaagcauugcauugcauugcaauuuaaguuaugcuacuuuaguuaaugcugcuuaaaaucugugagucccaggacagcugagagauguggaauacgcccaucaccaacacggacugacuugacagacagacauuuuuaggaaagaaagaguaugugcauaguuugaaagagaaccugcaaguagcuuuguauuucuuaucagugauaggaagcacucuuucaaaacagaauaacuauacaacugcacuaaaaagaagaaaugcccacuguaguggucauaaauacauuuauagcagguuuuauuuauuuuuucuuucugucuuuuaauaaguuaaacuuuauccacuuauuagagcuuaucaaagaacuuccaagaagauugaaucuucauuauuuagggacuguucauuuacaaaguaggacacugugucauagucacgguugugggcugcaugcucuucuuuuuccagugaugcacaggcauugccugcugccuucugugguuucuucuuuuuggccucaaguggggcaggacuugcagccucuaaacccagcacucuccucaaaaagcagcaaucgauguguauacaugaucaaagcgccuaagugcaggccagccugaacuguugauuuuucauauuuuaaauuugugauguaguuggagucuuggauuucaaaugggcaguuauuacauuuuucucacuauuuaauucugguuggagaucaccauugcuuaguaauuauaaauaaccaccuuuggcaugaagaauuaauauauuucuuacacugugucuguagauaugauaguauguagaucucuuaucucuuauuuaacuuugguguguuuuaaucaccuguguugcugcuccaugauugaugguauuuguacuaguguuuccuuaggccauucugcagaaaucuagaauucaaagauuauuauugaagagcucagagaagguguauuggauuauucugcaucuguaaaucgaggaaaagaguaucgaguauuacuguaauguuugguagacuauagccuaaaacuuagcuaauggagcuacacaguggagcaucuuacuugcuuaggguaauauugguaaucuagugagccuaguuauacacucaccuaagggguguacuuggaaaugcuugcucuauugaaugagaccacuuauaaacagguuacuguauuguguauguguaugacaaauaaagucuuuguuuauagaaacaguucuuuaaagaguugucugcuuuuaguccaaggagauuuuuaguacauuuuaacuuuucuucuuuucuaggaugggaaauuacugugggaacaagagcuauacaauaacuuuguauauaauaguccuagaggauauuuucauaccuuugcuggagauguaaguccugauuucuuuuuguuuugauaguuuuuauauuggcuacugucuuaguuacuuuucugucgcugugaagaaauaccaugggcaggcaacuuguagaggaaaggguugauuuggaacuacaguuucacagggugaauucaugaccgucaugccaguaaucacagcuacgggcagggaggcucaggagcaguagcugagagcuuccaccuauccacaggcaugaggcaaaaagagcuaacugggaaugauuccugguuuugagagcccacccacaguguccccaacacuccagcuaggccacacuucauuaguccuucccaacuuggggucaggcauuuaaagcagugagccauuuucauucagaccuccacaguugccuuguuguuuauaaaguucuguugaaaucauacuugauuuccccccccccccugaaaacaaaguauuuaguuguuaaguuucugccaaguaaggaaccuuuucugauagucuuuucugagcguuuucccuaaaaguuacuuaaaauguaacuuuccuccuuuagaaguggacuucugugaacugucauuauuuuuguuaucuaaagcuaaguccaugcacuuuguuguuuguucuuuuugauggaaauacuucagacuugucaaguagcucuuaauuuugccaaugaagaagaagcaaaaaaguuccgaaaagcaguuacagaccuguugggccgacgacaaaggaaaucugguaaauaccuccuugcuuuuccuuuuucauucuauacauaacauggcccagacugcucaggaccagccucggcuugaagagggcuuccugagagaaagaaggggugucuugagaguggugcaaagaaagauucaaagucaaguccugggcccaagcuggcggccuagguugugcagagauggcuucuauugcuuucuguuagcucaucucaugcaguccaaaagcccaguuuuuuacuuacguaucaauucaguuauuuaguccaaguuuccuuuugauuauccuaugaaucaguaucccaugaccucucuagcccuuugauucuuaggagacagcaagcauacauauuuuucuuaacauugcagaggaauucagagauagacccuguccugaaauuaccauuuccaacaugacugagcuuaacauuaucccagacugaccucaaacuuaggaaucugccugcauuuguaccuuuguacguuucugacaagcuggcucauagcauacauagccuuuguuucuuuugauucaugaagccucucauaauucauauuguaauuuuauuucuugcauaguugaaaaauuacauauuuucaaacuuauguauuuagaauucuuucccauagccuuaagaacuguccugaaggucccagccuguaccauuuugcugagacauagccgcacccucaacuccuggacucaugcuguuucuaaccaccaugcagucauuaacgcuaacagggaggacauuccucggaggaaaagagcccuccacugcuaguacugguuccagaaaaucuguacgugauuacacaagcaagccuuaagcccacagcagccaucaacacucguggggacucacaccugggcccuguuccaggggcagaagcugucucacucuguccccaccaaggccacacuggguucggcauguuacuguauagacugugggaaucuggcuuuuuugcccauaugcauagagucaauggcuaguguuuguugugaaacaguuaaaguauugcagcaaaguucauauagccugagauauuuauugucuagcuuucucuacaacaagguuccauauuaccuaccucaagagaaauauuuuuauuuugcuaaacuuuuuugcaaauaaaauucuauguucacugacucuuugaauuauuaauagcauuuaaaaaccaaguuuaaguauuuuuuugguuuguaaaugaauacuuuuuauugcaauucuagucuuuuuuauauuauuacaagaaaaaauuaauaauuauuaauauugccaaauaaccaguguucaaauccaauguauuuacaguauguuuuuuaaaccuuuuuauuguuaagaauuucacaucauguaccccaaucccacacaucucccugucuguccauaucugcucucuacccuugcagccuucccccagaugaaaacagacuaaaaauaaaaugaaacaaaaccaaacagacucucagcacggaagcugcagcauguugcacagauacccuuugccccacagcuugacuugcgaauguugauugcagugagucauuggucugcuuggaggccucgggcuucugcuaugcucugaauacuagauccucacugggacuccucccgcucuuccucucucagucucucauuuucucccucucccucucccccucccccauccccuccccugaugcccacagugugugugugcucaaguaggucugguguguagaggcaugaaaguggugucaugugaucuuguguuucauccuugauugcuguucuauauugagucagggucucugguugaagcuagaggcagccaauuguggcucaugcagcuagccugcuuauucugggcuucccugccugccaccugcaaagcccuccaugaguucuggaauccuaacucugggccucacacuugccaggcaagcaccauuguccacuguggcaucucucugagucuugagaguuguuucuagugacaauuugugaugguuaucuaguggauuuuugugagauccauuagaauaagugacauuuuugaagugaaaaggaauugaaaacaguuguuuaaaguaauuuauuugaaacaguuaaguuuacgauaacuuuuauguaguguaggaauuccccccugcauauaguggcugucuauacuuuuagguaaaguguuucaguugcacagagaacauggccuuaagaauacagccgagauggucacuguuggcuggcucuucauacucugucaaacccugucuccuccuuuuuuauucaauuuuuuuuuaccuuagccacaugacuagcuaguaacagauugaccugauaucuucccgucacuauagaccaucuguaaccuuuucucucuccaaggcugucucuuuaguguuacuggguccauguuuuuguaguucugaaauucaguuauagauuuaauuuuccugaguucuaugucguuuucaguagggaugugaacacugcgcuccucauuguagggugagugcuccuaugcugcuaagacaucccacauucuacauauuaauuaacacugucuguuaacauugcuagcaggugucucacaggagccucagauucuuuuucagccaaacuuugcugauuuuuuucacuuaaaugacuuccaaccgaggauauaugucuucagaaauugcucuaaaaacuuuuauuuaucucaguggauuuuauauuuaagggauaacuuugcaugcagagauuaaugucacuaugaaaacuauagauugauaguguagaaauugcuuccuuuaaaugaucauaguguugcuacaucugauuacaagauggaauguuacaucuauguauuccauugguaggauuuuuaauuuaaccaccaauuuuaagcguuacaaugugguuuguuauuuauaagcugauaguuuuaaugcacuagucacuaauauuucucuuauaauuucagaaaagucuauauuagaaaaauaugugaaaauuauauuuguuuaaaauucuuuaaaccagccaaucauggcugugcaugccuauaaucuaagcacuugggaggcagauguaggagaguucuaugacuuuguuggucagccugaccaacguagacauuucucggucagacagugcuaacuaacccugaaaaccggccuccaacaaacaaaaaauuguugaaguuugcuuugggagaagugucauugucucuugcauuauucagugauuucauuuuagaccugugugugugugugcguguguguguguguguguguguguguguguguguguguaccccucaaaugccccuuaauuuuaccugucucuccccauauucccucccacuacccuucccauccccacuggauccucccagaaaacccuacccauccauucauaaauauuuauucuauuuuccuuuucuaauaagaucucucuguucacguguuagucccuuacucaggagcuacccucugguucuuuguauaaaccguggcuugguugucauuaacagcuacucucacagagcauuaguuucuuaggcugcugucuaucucugcacacaguacuuugaguguagauucuaucaugucacuguccucccaccucaggacuacuccaggucacagccuuccaugugacaaaucccugauaaacuuguuaaccagcuccuuucccuguguccucgacuccggucuuuauggcaucccucauacauacugaauaaguuuuuuucuuuuauuuggaugucuucauacuuaucuuuuucagaaagaucccuuaaucaucuacacauuaccucaagaguaagaguuuaaaugaaguauauuauaaagauuuuacuuuuguuagauauauaugucugcuuuuaaugcugguuuuauuuuuaauucuaacagaaaaaagacgagaugcuccaaaugguaaguuuuugaugauuauucacaaauuuuuuuaaauuacaauuuaauucuuauagaaauauguuuauguauuaauacuuaaugguuaugauaaaaaauagacuaauuuguucuuauuuucaauuguggaaugauaggcaaaacuuagaaauguacuguucuuaauuuguuuccuaacaugaagcaaagguguagugugaagguggguauuauuauucucuauguacucucaaguuuguuguuuagaaucggcaugugcuugagucuuucugaaagguauucuguuuuauuugguguauauguucauuucuuuucaagauuuuaaaacacuuucuuuguaacauaauuuuaauauuugucauguguuacaugacacacuuuuuaaaaugagaauuuaagcaugaaaauguguuuagugcuaacuguacuugcauacaaccccucuugaguuugguaaugaacucuuuaaugugaugaauaaauucugcuuuccuccuacuccauguguuuuuuucuggagagaggacccaucgcuuuuaucacauuugaaugugagccuuguaaauuccgauugcuucaagaaccuuaaucauaagagggcauguaguugcugauuuuuaaaugcaucccaaaucuucccucagaacuuaaaaagauuauucagggaaauuuguauaauacaaaguuuuuaauguagaaugacuguugguaauuauugaggucugugcucuuuacacaaaaauggauugcuuuucaauuuugagcuuaagucuauuuuccagauacaaaagaugaaccacagacagauguauuauuauuuagccuuuuaauuuuuuaaugaguaauugccuucaauauuguuuauucuguaccaaaguuugauauauuugucuuuugcgugaaaauauuacuaauaauaacuuacagggcuauugggggauauaaaagauaaucaaaaugcuuagcauaaugaucaauaaacguuaaauuauugucauuuaccaccugccaggcauuguucaauaaucuuuugaaguagcuccuguuuuacuccuggguaauagaugaaaaaaauaggcauauauaaauaaauuguuucacuauuaagauugggggaaaguucuuccccaaguggccugacucaugaguaggccauagucacuguuauguuagaugacuaaaggagagcccagcuuagaagagaaugaguaacacaucucaagauaggaaucugguauguggcagaggcgaaagaaacagcugagcccugaacuguucaucuaugagccuuuaaugcaguuuagaaguuucucuuaguagaugucaguauuguaauguugggauguuccuguguuguguuugguaugcacauauugaguacuaguuguaaaggccuuggggggggggcaucuaauuuugaaaaaauaacuugaaauauuaauagaugcgugaaucauauaauuaaaaaauuuggaaacauauuucaauaugcccaacauuuauuuguaaauaggcaccuaguugcugugauacaguuugaauauuccuacugaguuacucacaauuuucacgucuuucuuagauuguucuuggguaggugaguuggugguuguuuuugagacugucuguuuacacagcccugacuuuucuagaauuuacuuguagaucagguuggccaugaacucacagugaaccacuugccucugccucugccuccugaguguugccauuaaaggcugcuuaaguuuuuaguuuuauaguuuuagccuuugguguaguaguacuaacuuauuuuuauuaaauaaaugaggaagguuuuuuguuucuauuuuuucauaguacuguuaaagggcaaaaucaugcugcuaguauugccaauauauucguccuuuucaacuuauaaagauauauaguauaccaacauaucacauauauaguagugagugaugaggugcauugugggaguuuucuuuuuggcuuuuuuaguccagcaaguuuugcucucuccauuguagagagcaauagcuuugauauuuuagcuuuacugcguuuugaagugucaccacuagguggcaguggauaccuuaccaaugguuugcucuguuagcuuaucaaaucuuuuuaaaaaaacacuuuaugggcuggggagauagcucaguggguaagagcauaaacugcucuuccgaaggucccaaguucaaaucccagcaaccacccauaaugagaucugaugcccucuuuuggagcgagcggagccaaucggagcaaguccuaaauucaauuccuaacaaccacaugaaggcuuacagccaucuguacagcuacaguguacucauauacauaaaauaaauaaauaaaucucuaaaaaaagauucaaaccaaugcaaaagucucagcuuugauuccuaucacuaguagugauauuuugaaacauuuugaaaauugucauuaauguaaugaacucaaaggaaacuuggccugagagaagaacuugucagagaauuguauauuaaagaauguguugacaaaguucaggagaugauaagaauuuuuaaguugaauguguuguagaaugcaucauucaguuucacuccuagagauauuacuaacauucucuaaaguccuuaggugcucuuaccauucgaucuuugcaguucucaguguuagaauuucuugcacuuuaaauauuuuuauauaauuaaaggcuuugugccuucagauagccaacuuucauauauacucuugggaaaagauuagaggacuuaagucuggcaauuugggggggaguguuagcaaaaaaauuuuauagcuuuuuaaauaaauuauagguaaauagguugaaauauagcuuuucugcuauauauaucauuuuaucagaauuacaauaaaaaacaacaaaggaucacuuuaguuaaguuuuauauauagaucaguguacuuuauaagauuuaauauuaaguuguaaguaagcagccauagguuaaguaaguuauaaguuaugauuccauaaaauuauuuucauaaauuauaugccucucauaccauuuugacucucuuuguaggucccaaucuacccauggcuacaguugacauaaaaaauccagaaaucacaacaaauagauuuuaugguucacaagucaacaacaucucccacaccaaagaaaagaagaaaggaaaagcuaaaaagaagagauuaaccaaggcagauauuggaacaccaaguaauuuccaguaagacucaucuuuuguguucucaucauuuaaaaaaaaaaaguaaaaaaacugaucuugcuauacugccuaggcuggccuuguguuugggauccucggccucagcuuucagagcaguaugugggauuacaggugugcacuacugcacccagcuugaucuucauucuuuuuguguacucuggacugcucugaauuuuuagcuucuuauacaauuuugguuuaagagguucuuguuguuuggagcuaagaugaaaggaugggcuauccggagacuaccccacguggggauccaucccauaaucagccaccaaacccagacacuauugcauaugccagaaagauuuugcugaagggacucuguuauagcugucucguaugaggcuaugccaguaccuggcaaauacagaaguggaugcucacagucaucuauaagauggaacacagggcccccaauggaggagcuagagaaagcacccaaggagcuaaaggggucugcaacccuguagguggaacaacaauaugaacuaaucaguaaccccagagcuugugucucuagcugcauauguagcagaagauggccuaguaggccaucacugggaagagagaacccuugguauugcaaacuuuauaugccccaguacaggggaauaacagggccaagaagugggaguggguggguaggggagcaggguaguagagggagaguauaggcaacuuucaggauagcauuugaaauguauauaaagaaaauaucuaauaaaaaaacgagguucuuuguuuucuguuguugugguagaagagucaacauaaaaacaacuuacaggaguaaguuuauuuugguuucuuuucuagagaggaggucagccaucgugauggagaagcuuggcuauaggaguaugagagccgccuggcauugggaugcagagagaacaggaagugggggugggcuauaaaacagucugucaccagagauacaugcuccuagcaaggcucuaccucauaaagguucugccaccuucccaaugacaccaccagcuaggaacagaguguuccaauacaugaaccuauggggaacauauauccaaaauaugggaaccauguauauguucaucuguuuugggaauuuggugggguuuuuguguuauuguuguuguuucuauuuugcacagagagaaugaauggauuaggaaaaaguaagaacuccaaaggagcuggcuuccagggaagaacacccauguguaguccuuucuaaugguuggagacaucuugagacaguuguaucuucugggucacccaagcuggccuagaauuccaagucuguaggcauauguauacaacaagccagucuugugucauaaaucugacaguuuacuuuucuaucugaaaaaauuagauguaauuauuuuuuuauuuaauucuugaaaauaaagggauuuuuuuuccacuuugauguauaaucagcaggaggauaccuguaagacuugucuagaagcaaaagaaauugagcuguaugcagcacaucucaaguaucuuuaugcauuauuucacaagcccuugucugcauuuguuuucuaauuuuaucuguuuuccauguuaggcacauugggcauguuggaugggauccaaauacagguuuugauguaaguaucuuuuuaagcuauauuuccuauugcucaaaauauauaggaaugcuauggcuuaucuuggacuuuuuuauuuacaguuuuuaaaauauugcuuauuagaauuugaaugugcuauaugcugcugagguuugaauucauaguauuguucugucauaguugcuaaguccuuuaagggaaaauuuuuguauuccuucauuuucugcuuugaaugcauagagaaaaaagugauuuuucuuuuuuuuuuuuuaaguaaugaucucagaagaauaucaaauuuuggaaaaauaaguacaaauucuuaguaucuaguuauaaaauaacccaguuuguuucuaaacugagauuaaacuuugagguacuaccaaggaccucugggcacagcaaagagguggaauagaugaacacaagaacugguauugaguggguuaauaaaaauaugaauagaaugcccucuuugacagcguggaagagagaugaaauacaauagaaaaucucucauguuuaucuuucauaauagaaaauuuaguguuagcauuuaaaucacauaaccauuuuaaaagucugaguuuaauuucagaaggacacagguaaauuauaaguuuugccaugauuguuuugaacacaauugccuacuuagaaguuguuuuaucuguuguagcuaaauaauuuggauccagaauuaaagaaucuuuuugauaugugugggaucucugaggcccagcuuaaagacagagaaacaucaaaaguuauuuaugacuuuauugaaaaaacaggagguguagaagcuguuaaaaacgaacuccgaagacaagguaacuuuggaucuauuuugacuguuuuuccuuuuaaauuuucuaagauuagcaucauggugaacaacuaugcaccccuccuugagcagaaucuuugaauguauggaugacaaauucaguccagugucacuacaucuuugcuuacuuugguaugacaaaagccuugagccaggcaagggacgacgaugaccucuacccagcaccugggaggaggagcaggcauauuucugugacuuugaggccagccugcucuacauggagggcuaccuagauaacugcaucaugagaccuugucuucaaacagaccaaagcaugaugugauuauuaauguaaagguuaccgugugaucucuuauaaaacauuucagaauauaaauuauuuaaacucuuucuauuuugaaauacagauuuucuuuuuuucuuuuuuauauuucaagaaccuauuauacauuaaaaaugauuuuaucuuguuuauauuuuauuuguaauuauguguuucuauauuguggggguagggagugguuuugccuauacgugcaauacuugcagaaggaagaagaggacauugaaucccugagaaccagcauuucaucagucaguugaaagcuguccaacauuuuuuuccuaagaacaaaaagauaaauuaaugauuuauuuuuuuuagagcgagcacauacauaaauuaguauucaaagguaugaaaacagaauagagagauuaauaaaauuugucuuaaccuacuuaauuaguaaaucuuuuuucauuuauuuuauaaaaucauaaaauuagauuuauaaagacacgcaaauuugugauuuccaucauaucccuguguguagcuccuuaaguauuaaguccauuaacuuauaacaaucuguucuucagguccaccacaguggagugguauguauguggaacaguguguggaccacuacgcugaauuuugcaugauuugcuguguuuuuuggaguagcuagaauuuauauguccugccuucaaaaacuaauguuuugagcuugagcauaaaggguuuuguuuuuguuuuuuguuuuuuucuuuuaauguuuguauguuuguauuuuuuugguuuuuugauuuucaaggacaagguuucacuaucacugcauauuccugcaaauuccuauguagaacagguuggccuugaacuuauaagagaucugccugccucugccuccugagugcuggaauuaaacgugccugucuccaucaccccacguguaaagaauaauguguaguaaaaagagauauauuuguauaaaucagcauaaauguugucuauaacuuagauuauuuuauugaaguucucuauuaguaaacaccucuugcucacagcacucacguuuuuacugguacuaauuauaguauuuuauaaauguuuuacacauucauuuuucaauaaccuguauaaaauauguuuauauugacuagaaucaaggaagauguguaaaagaaauuugaauucacagauguaauugucaucucagaggcuugcugcuaagcucacccuuuguaguucuuucugaacucuggcugcugcuggcugaacucagcuguucuggcccagacgccucucugagcugacugaugaaacuggcugcuuuugacuuuucacugaauugcucugcuuggccgccuacuuacuuuggcaauacacucuaaucuucuggcucuuauucucuggcuuguucugucuucaccugugucuaguuuguucucuuuguaacuucucuguaaaacugaccugguaaaacugccaccgcacuaaucuguccuccucucugccucccuuucucuuccucccuuccucucucaagagaggcugcucucaaguagacuacuuucuugugcuguucucgugagaauugggaugggcauggccuaucucugacucauucugucaaauucuuucugauugucacuuugucugcccuucagacacuacuuucagacauggcugcuuccuucuauaaacuagccugacuuugauuguuagggacugaauguguguacuaagggugugucugcauucuagccagaucacuuaggccuagaaggucuuugaaugugaucccuugccagagcagccuugugacuggauuaaaauuucuguacaaggauggagcaguauuagugagcacaguaucacuuauccauuuaagcacuugacaguauucccauaaauuuauagcuagauaacauuugucuguuauauuuucaugagauaacauggcgucaguuccuaaauguuuuaugaauccuguaauacuauaugacuuuguaguauuuucugcuuauaagcagaagaauuauacauaggaaauuagauaagaauuaauacaugagcugggcaugguggcgcacgccuuuaaucccagcacuugggaggcagaggcagguggauuucugaguucgaggacagccagggcuauacagagaaacccugucucgaaaaaccaaaaaaaaaaaaauuaauacaugagaaauaaaauuaucuacugguauuauuaauaacacugauguuggucugaaguaauaguuuucaaauacgucagccuuuuuauguuccauaaacucaaagguauuuuuuuucuauaagauucaguauucuuguagauuaacuaagaguauuuguuuauauuuauguauuacauauauuuauaugcauauauuagaagcauacuuuuuguaacuuucaugucuucuucauuacuuuuuuuuuuaauuugaaaaauaccaguucuuauuuucuuucuggaguuugugaacaccuaaaagucccucacacugguggcugcuuggccagcaucuuggugcaucuaccugccuaacaguggugucuuuacucuucaauguuaauucugucacguuugucccugugaugggguuuguuuguaauagauagaauacaaauaauaaaaaguaaggauugguaauagauuauuuauuuuuuaaaaugcagugaaguuuucugucacuuaagacaacagaagugcuggggccuagagagauggcuuaguagguaagagcacuggcugcucaucuagaagacguaggcuucauucccacuacccucacgacagcucacagcucuaacuccaguuccagggaaucugacacacucuucuggcaugcauggcacccauggcagacagcauucaugcaggcagaacacucauacauaaaacaauaaguauauauuuuuugaaagaaagaaagaggagggagggaggaagggagggaggaaggaaggaagagagggaaggaauaaggaaauagaagugcucaugcugugagggcuccuuuccucuuguagaauuguacuaagggaaaugccaguaacauagguuaaauaauguuacucaguaauguguacaccuuacagagcuaaauauauuguuauuaugggucccaagaucucuguaacccaaaaagucaguuucucugaucagauuuuaaaugaauggagaacugauaaaaugcuuacuguuacauugauuuguauaugucauugguaaaaucaugucucuagaaauacaacauugaauccuuaaaggauuuauucacuuccagucuauguugauaguacuauaccuuuggauuuguuuuccuaauauaucuuacaucuucacuuaaguagacaaagaauagaaauauaacuacugggguagugauaauuuuuuauuaauaacugcaguauaauuuuauaguuuauaaaaaauguuucuuaauaauucagaucuacauaaguaauugaacauuuaaccaaacaaccaaccucuggugauaccaagucuagagcuggugacuagguuuugguaauauuaaacacuguauuauagucaaaggauauauguaaauuagauaaugaaacugugucuugaaagaaaggguuauguuuggcuaauuuugauugauguuaauaaauucuaauaaauuuugccauacuauaaaauuuguauuuaaaauuuauguagaaucuaaauauuuaauucuaaagagaagguugucauuaauuacuaugaaaauggcauuaauugcugucaauguaagcuaaugcuuacaagcaaaguguuuaauuacauaaaguaauuuauguaaaguuuaauuacauacuguauuuaauuacauaauuauauaaaguuaaaaaaguauauuuucuuaagugugcacgugugugcauguguguuccuagggaucaacccuagggcaugcuaaacaaaguuuuaccaacuagcccuaucauuuuguuguacaauugcaugcugugugcaaugccaugcacagcugugcauauaugggcuccugcagagucuggaagaacaucagaaccacuggagcugcaguuacaggcaguugugagcuguuagcuguaggugcuggggacucaacugggccccuaugcaaggccaagcacagcuaauuacugccgagcucucucuccagcuguggauggugaaggaaguuacuuuauuaaauguuuaugcuuucauuguuuucucugcucuuauuucagcaccaccaccaccuccacccucgagaggaggaccucccccuccuccucccccuccucauagcucagguccuccucccccuccugcccgaggaaggggggcuccuccucccccaccuucaagagcuccuacugcugcaccuccaccuccaccuccuucuaggccugguguuguuguuccuccgcccccuccaaacaggauguacccuccuccaccaccagcgcugcccucuucagcaccuucaggcccuccaccaccuccaccuccaucuauggcaggguccacagcaccaccaccuccuccuccaccuccgcccccaccagggccaccaccucccccuggccugccuucugauggugaccaucaaguuccagcuccuucaggaaacaaagcagcucuuuuggaucaaauuagagagggugcucagcugaaaaaaguggaacagaauagccggcccguguccugcucaggaagggaugcgcuuuuagaccagauacgacagggcauucaauugaaaucuguaaguaaugagaccuuuuuauuuugauuuguuuguuucuuuguuuguuuuugguacuaugggcuuuuaccacaacucauuauaaggugucuauauuacaggcuuacucuuuuaccuuuuauaauuuuuacaaugcuugucuguauacaaagaaagguacauauuuuagaugaauaucuguaguuguguaauccauacuuaacauaaacguauaaaauauuaguuaccauagaaagagauaccuuaugcuuccaacagucacugaucugauagcuuuggguuaacuuugucuaauucuaaauuucauguagauggaaucuuacgguguguuugcaauucguuguucuagacuuuaaauaaaagaaacuaccuacuaaacaggggaguacauaauaacccugucuggaagcaagugcagucagucaucuugguaacucaacaccaguaacuaugaaaaggaaaguauacacuaaauuuuuauacuuugaaauuaaaaauaauaaaucagacucuacagaaaauugaaagagguuccaacuuuaaaauucacaauaguaaugguguauaaguuuggauuuucugacuuagagaaaauaagaucauuucaucaucuuuuaaagguucagaacacuucccauguuauauuucaguuacagauaagcugucuuaccuugcuguaugugugccacaggagguccugaugcucguaugacaaguccucugcccucugagccaucuccccagacccacacagaaucuuuucuaaauauuuauaauugaguuuaauaauuuucuucuccaaggugucugauggccaagaguccacaccaccaacacccgcacccacuucaggaauugugggugcgcugauggaagugaugcagaaaaggagcaaagccauucauuccucagguauggucacaugaucuccacggagcgugcgggagggcuuuuauaggauagaaacaaacaggcucguaauuucuguuuauuuaucauuuucuuugugaccguuuugucuacuaacuguguaggucugaguuuacagcauauuuaaucauaguguuugcucaaugacuggucugccuaaaauuuaguagauaccaggacaccauagccauauguaaacuagaagagagaccauguaaaaagugaugaauuaauuaauuuccuauacugggaaaugccaauggaaucuuugacaagcagccacuaagcgaggcuugagauuucucaaugucauuucuguaguauucugaaaauaaccucuauaaugacaaagacagugugguaguacagacagacacucagaccaauaggaagugauaagaauacaguuaaacuguguuucauucauucugaacaacaaccagguaaaccuagauaaaaaagaccuuaauuuaaaacauggaaugagccaggcuguggucacacaucuuuaauccuagcacuuagaaggaagagucagaugcaucucuguguuugaggccagccuggucuacagucuguuccagggcagcuggggcuacacacagaaacccuguuuugaaaaaaaacaaacaagcaagcaaaaccauggaaugcuggagaagagcgggucagacuucuuuugcuuuucucuaacuucuguuacuuuuuagguuaugauacuaggaaauuugucuuauaggaaacagaagauacucuguuuuuaucuaacucacauccauaguaucauacacgugguacuggcucuguauuguuuuaauaucaucucuuacaaacuuggccuucauaaguuuuaugagguguagauaugaaaaauuggaugccaucaaaaucugcauucauuuagaggaugaugacugaacaccucuacaguacuccugcuguucaggauccuccgauacauagcagaccaagucuucccugugguggagcuuguauucaaguaugaagacagucuaagaaaccgagguagcagaauuaugaggaagaggaaauggaggagucagugauucuggggagaauuacacaggguggucaggaaaugccucuuuugaggggugguucugagugggaucuaaaugauaagacagagaggaaaguaguacuuccaaugaugaaauauggaggaaaaaguucagugaggguaggggacagagggaagugguuguagcagaaauggugaauggaaggccgggaggaggagggcaggagggcugggcaagucaugcgugaugcuucagagagagcugcgagugaguccagauggcaggagccggccauggaaggcuuaaaagucucccuccaucugcucugaguugaauguacuggagagcagcaauaacugagggaaaaaacaauccaaccugauaguggguguggacugugguaaaaaggaagugacuugauggagggagaggaaaaaagaauuauuuaauaacucauaugccuauucaccugaaaggauggugaugucacuaaaaugggguaacuagagucaagggagaaaagcagauugugggaagaggucaaaaucuaaaauucuagguuugcaaauuacugugugaacccaauucagaaaaccuacacaaguuucauuugacucauugaaaacacacugguugaaaucuuuuucccguagguagugaggggcuaaaacccaaauggugaaucucccgucuucaucuuugaucccauccauagucuguagauugauuuuauuccguuaauuuuaaaccuucuuaguaacuagauucuagaaauuaaauguuuguguuaggagucagguaguuggaaaaaugacuugagaauuauuuaugcgugcuuaacuccugcuuuuggguuuauuuuuagaugaagaugaagacgaugaugaugaagaagauuuugaggaugaugaugagugggaagacugaucuauauauuauauauauauauuuuuaaggugaaauacuaaacacuacuuccugucuauugaucuguaaaauuaucauguaaauguucuaccaauuggcuguauauuuuuguugccuuuuuugcuuuuuuuuuuuaaauuaaucugugcaauaccucauuuaaucuguaaagguuuguuauaauccuauauaaagcuacuccuuguugcugugugcaaguuuacaucaggaugcucacgugauuugugaauauuuucauuccaucaacaagggaguuuaauuaugugugagacugacacaaaccuuaauguaauuuaguuagaaugccagaaggagaacacuauuuucauacccuacuuuuucuguaccuaaauuuucuuaauaaaauuuaguauagcacuacauucuuuuuuaagugauguaaacuuuaguuucuuuagccccuucauuuugaauaugaugccacauaugaauguugaagcugauacauugcacaauucucuagacaccacucacuacacuaaugcaguuuuucaaauucuaguauuauguguugcuuaagaucacuacagagaugcuacugaagagagacgguaguacagcucucuugcaguacugccugccguugguaagcaguggcauccgaaggcaggaacccugaugagcccucacgugccuguccuugaccaaggugacuuuuaugcuguggcaacugugacaggcuauuuuuuagcaaagaguuagacguuuguuaucaugccccaaaauaguuugagguaacauuuuuggagguagcuucgugcaucauaaacaacuuucgugcucgugucugacucgagcgguaucagaacagggcugggauggagucuucguguuuugcacccugugcauugcuauauucacaaguaccaacuguaggagucagagguguuggcaaaaguaugcaugaaugcuaaccuuugcacauacucuguuuuuacuuugauggcuucuccagguuuuugucagguaccacauguagaauuacauuuuucuuaaaagauugaucauccaaauggcaaauuucuuagaguccauaacugauuugauagauuuuucuuuuuaaauaaaacuucacagccugcacaguuguuacgcauacuacaugguauguuacaauuaggguuuccuugccucuuuacaguacacuaauccgccuaaagguggcuguuugauauuuaccgugauaauuaccuuaccuaccuaccuacuuucaauacacuuuagguagccgauuaucugauuuaagugcagacacacuuuucucacauugaguuguaugcagaauguagcuucagauguauucauuauaguuacaauauccaacuaaaaaguacgcuaucuagaaguauaccgaccaaaaucuaguauugacaugaucuugacaggcuggaccugugagauaugguuugaauuuuaaccaguuuaucacauaaccucuagagaccaugcaucuaguuauugucaggaauaauuuaaaagguuuagucgccaaaagcaguuaaguggugcaguaagauaguuaaguuauucaaagaguguuacccuccuugcaagaguaacugaagcacauuggaaagauucucaauuuuguguuuccuguaaaaacagugcucucugcugcuaggaccuuuuuucugcuuccugucauuuucauguggcuugagcucugagacgugcggaugaggcuggacaacuacuacccauacaauuagggggucaaaauaacuuuaaauaaauagcaucggacuuucauauuuuucuuuuugacguggagaaaacauuuucaugccuaaaaaugucuuugagauaaugccaauucugaugucccuuaccuuuuggccaagaaguuugagauuuuuucagcuaauuuguuauuugaccagaaguugucuggggagacugaguucuuugaguugcauauaaauggggguauauuauuugccaaagguaaaauugaguuuauucuuuuucauacagaaauggauuuugcuuuuguuugcuuuuuauuuuuguguaaaaucuaaauuccaggagcuaugggguucauccaggcaugaaggcuaauccacucugaguaaagugucaguugcacagcuccguccucuucugucuugcacuguggguggcacuauuuauuccugugcgucaucuggaagccucacggauacauccagcuaugugcuugucugguagccuuugcguuuaacaaacuagcaugaggccuuucauaucuaaaugcugugugauagacaauuucagcuagccacauauuguauuaugaaauucauaaagauuuucaaucauucaauuucauuuaucaacugaaauuuuguuuaguaugugaauuuuuuuuugaaauguauaguaaauaagauguugcacugguggcaauucaucauggaacauaauaaaauuaauuugacccaaauaguauaaa

SEQ ID NO: 12359 - RNA, 178352 nt, Mus musculus
cuguguuuuuuucuuuuuguccucuuuuguuacuaacauuuuucuuuuucuuuuuuuccuuuuucuuuuuuaaaauaaaaagcauagauuuccccuccuuaccccuccuuuuacaauggucucuucuccgcucuaaguccucccacuuccuaguucaaguuucauuugugccccgacugccccccucccugccccauugcauuguuugugugcggcaccugcaguagaaaaucccagcucuccaggucggucugggagcuccuccacccuccucccuggcgggccuccuccaguguuuauauguaaggguauugguugaccuuggcaggacucaguggguauccaguguagacgguggaggcuggcgaggcgcugauauaggucuggugggcaaacugggcuggauacugacugggguggauggugggcgagggcaggacccggggccccaugcucacagggaccugguggacgaugcuggccggauaggcagugugcugcacgguguggcgugcugagccuugggaugccaccaggugggcuacagugccgguggagccuagggcugugggcgcuguauagguguagaggugaggcuggguggggaggugggcagccgcagccaggugggggugaacagugccauggcuggggcuguugugcgggaagguguacggagcuugcgccauggucggagugauguaggccugcugucgacggugacucccggugcgguccgcagccaugugcugcugggccugagaaggaaaagcagcagagacagcauuagggggaggagggggaggaaggacagaaggagaagcaggagugacaacagaugcuucccuucaaaagcagagagcuugaagauuuguuuggauugagaaaguaaugucuguuuggccaaucaccaggcuagggugcuacucagcaggcucagagcaaagcugggacacuuggcugaagggggagaaggacucucucucacugacugccuucccacaucaugggagaucucacucuagaacugggucuucuagaaagaguucaagcaguaacucucucuccuguaaagaucccgcauuucggggcaugcgugcaagucuccgggugcucccuccaugggucugggugcuggcugugaggaccucugcagcaaggcaacuucagggauagccuggcgggccagggcaacagcaugccagcauguccaccuuuugcugggcugacacagcaccaugugggcccuccuaacagcaggucuguccuaccaccacguuacuaaguacugucacuuagcuuuggccuggcucucugcgaacaagauaccgccuuucccaggguuggucuaggguagcaauaagccaaugaggcccguuaagggcacugucuccuguggccacugggguuuaccuggcugagauugaggggcugcugcugcuggaagugggggccuggccgcugcugacgguaggcgauggcuccugaagagcucccugaagaguguccacugguggaggucacggugcuggaggacuuggacuugaaggaggacgaauggugacuggcacugaucgcugagggaggaagaccagccauacaggucagucgcaugcccuuggcugucuagaugugcucccucccuuucccaacagcagccuuccaggaaggacauguuccuaagacuguccaggcauaaaccacuuagcccccagaccuaguugggcauucaccuugacucuagagaggcagcugggcucuggcccuuggcugcaugguauauuugagcugcaaaugagggagagaggagaagcaaaaucaaggguaaaggugcaggccuacgcuagucccacacucacugguccucugggggaaguguuauagcaauaccugggagguguguggaagggaggaggccugccugguuuccucccagaggaucagaugugaucaugcuaauggcuggaccuagcacacagcagaaguuacaagaaggcugcgguucuccugaccucagacaggaugagacuaacucucccagggaacggccugacauaacauaacugcuguuccuauguuacuggcaauguagagacucugcccagccaggagguugcucuacacuuuggucacugugauuccagaccuguagcuggggguggcauaagagucugcaucauaacacauucugagaguugauuggugcuccugggugagaagaccacagccuaauggguaggagauugaggaagggcaauaccuacaucagauggcuuuaaguaccuggccaagggagcccagagcuuuauuagagccuacuguuugccugacacuguaacauguaccaccugggaaacagauggggugagaguggcaacuaggaagcaucucaaagcauaaaggcaagaggcagagguagaggauacagggagaugcuaaugguuggucaggacaggcucugacuguccagugggcagggugagaccaucaccccgaguaaaguaagagugauacuuugcagagaaaagcaucuaacuguacaggccacaacccuccucccuuuuauuugugauagggucucacauguaacccaggcugcccucaaacuugcaacccuccugucucugcuucuucugggaugguauuauagaucaccagaccuguguaagcuauaggcucuuuacugaacaauacccaagagccaacaauaggcaagcaacaagcaggcacacaguugaggagauacugcaugucccuagaaccugcacaagagccuaggcaaacaugugagggagaaggccccaggcaccuccucugugcucuaugguucaaaugccugaaggaacacaagaggccuaugaauuguauuauugguguuguaugcuuuaaaagccacaguuaauauauucauucuacucuguaaaagcuaaagaacaaagaagaauuaguugagaagaaaauggcuuugguuuggaguggaaggacagcugccucccauugccccaggugccagccuaggcaggaacgaaaugccagaugggagacaggagcucgaggugguggcgauucucuaagagcuuugcccaaggggagacagcaugcuuuaaggaagcaguaagucccucaucuccaccagcacaaggauaucugaacacucucacauugugucaugcagcuaaugauucauuuccuucauugaguuucuggaauugacuaaauaaggucuaaaucuuaucuugggacagguggcacuacacacuaaggaaccauguauaauaaaagacuuugaaugauuugggauagaucaacuuuuugacaaguuccaggguuaugaagucgggguuguaaagcccaagacaagcccugacaaugggagaaguguuccagcaaagguauuggguccagaacaaagggaaacuggauaccucgggggugggggguggggggugggggugggggggugggcagaagacagaggggaacaucccaccucuuaagaaacucucaaccccaagucuaggaagauugauugcugggaggggggagauggugggucccugaaucuaaaugugcacuggcacccaaggccucuuccacuacccccugcacugaauucucucaggaggugccugggaauugguguauugaacuucccaggaguccagaggcauccuggugccagugaagcagacuauguuuaggacucagugcccagacuaagccaguuagauucucagagcucagccaaacccuggaccuuugaggacgagcuaugaggucaaacagaaagcugcacgucuaggcugucagcagagcuucccugucucucuaggcaccaggagcuugugugcugggguugagcuccucccugcuuggugacagaccaucaacagaucucugcuuuaguccagcauccuagaaacuuuguagggaugauguuagaagaacaaucaguucaagggauuacagcuugugccugccaaauggcaauguuagaaagagcccaguguccuaccuauggcauuauuguggugacaagauaagcugaucaaacugucagaguggaagagccuggauguaggaagggccugaaggggucaagagauccagguagugauuucucuuacuggggugaaugagguggcaaugggccugcaaugagccuucacuaucccaaugcagcuucugugggccugggggacagaugcgcagucaugcacugugugcaugcaaaugugcuuaggcacagguaaucuguacagcacacccugagaggccacugagaaccucugugcucuugcaguucuuuuguuugguaagcacaguagcuacguguuucuaggaacacuacuuauauuagagcuauaaccgugggguucauuccacaugcacaccgccuuacugagcagcucagcagccucauguuauuucuuagucagggcacugugggcccacacucugcuucucaccccgaguacugacucugaaaaccagcaucaacuccccggacugugggcagcugggacaugaagaugagcagcagugggugcagggcagaugucugaagagaguagcuggggugccugaaagaggccugugagcauacccaccccacaugggucacccccagucagacaauaagggagaaaggagucuaagccccuuuccauuuccucucuggcagaguugccugguguaaaaagggcccaaucccaggcuugcugugaauauugggaaaguauugccagcuggccgcagaaggggaccuggaaaagucuccacaguucucaucuuaaucauauccagcuccucgagcaacagcaccucagcaacuugguaaccaccagacaagaauccuuauucuccaggguaacuucaggcaucaccuuggccaugucacaugacaaacagaaggucccuuucugacgucacaaagaugcuaccuggccuggcugcggcugaugacagcacguagcagaagaacaaacuugcagauucuuuggcauagccucccaguucuuguaugugagcaggagugaaggagacccugaggagcugcuguugaggaagagcacggagagccgcugccugacuucaaaggcuaaggucacuggcuuucugccagggccccguuuucaggacaagccucaugcaaugucaguuaaguaaggcagagagaaaugugcucagcucagauuucugugcccaaggcaaaguccugacccucacacggcaaggucagaucaugugcuuccucuccagacacuugcucuacccuagaaagaugucaggaauguucaaaccgguugauaagaaaguggggugcuuccauuguuuaucaaccaugacggaagcagagccaccuagaggacagcugagcucucagaauuucaaaaggaaaauaaauauucuguauagaauaugaugauaauguaugauauagcagaaucccacuguggcugcuugaagaaaaaucaaguguacaauguagaugaccugaaauaauuagguaugcucuguuucacuaguacuaacauuucuaauagcagagaaagagaaaagcagagaaauggcauggcugugcuguggucccagguuaccuggcccuaggcugucacauucuaccaacacuucacuggccugggucuucaguggggguacgaugauggugcggggguugccagugcagugauucucuaggccccccuugguguccaagguguuggugccguugugcccugugcgcugcugcaccgaguaggggcugguguugcuggaggagucagaguagggagagucguggacggugacacagcugaugacauuuuuucuuugcuuggagacugugcugcaaaguuaaaggaagaaguuaggacugcaggcuggcugggagguaagagaaccuguucugggaagagcccuuggcugggcccugcaccagaguacuugggaagacaggcagagcaggcugggcugggcugggccuggggcacacugauacuucuggaaacuaacaugugagacaaucagcggugggucuaggcuguccccauguggcagaguuaguggagcugggugccaagcccuccgaccacuagaacaggagucugucugagugaaucagguagauggagagcuggaauuggagggaauggcccugaguuugggcucugagccuaugagaaucagcagagaaaggaagaggugcccagugauucgggacgcugcuggaggggcagaggaugggcgaggggcugaagaccucaucauucagaaacguugagaaacagaaauugaguuggauuugagugauuauguucagaccucccaggaccgaccgcuggguauucauuuuuagggaugaccuagccuuccugcagaguucccauccccugggccaaggucaggagacaguacugucuugagcucuaacggcaagucuccugugugcuaaugccaccaaggaguggcucccaaacccuggucuucauuucuaacuagaacuuuaccuagaaacagggaagagccagcguggaguagcucuuggcuagcacuugcuuuucauagagcuuuaugcuccugcgguuacucugggaaccaguucuaucugccuguggcuuggugacaggcugcugggauggcagauguggaaccuaugguguauuaugcaagguuuuaaaaauggauguucaucuauuuuuguacacugaucauuuauuuuuaagaaauaacaauugccuaggcaaggagggccgcuuuccagcuaauccaauaugggaaaaagcuaguauuuauagaaucugaugggguuuccaguggcccucguaccccaggaguguuaccuaacaccacagacccaggccgggcucuuuucaaggugagcuauuuuuaucacucaggagagaguggggaagugggcacuuccaaaggcagcuuggcaggaggccagcagaaggucaguagggcuguggaccuccagaggcaggaaggugaaagcucugggggaccuggcccugcuccugacagccagcacuagugacaccagggcuggaccauuccugagguggccaggcucccuguucuugcugauuuagggcagaagacucuagcugggucuguggguuagaacccgggaugauagggccuugggaauugguugucuacacaaugaugauacagguaauggcagaaccaguaucauacuguacagcacaugugaagcagagcaccagauaaaguaucacuaguguuauagaggaggagcgucucuaaccccaaaccccaaaggcccccaacucuaaaacuuuuugaguugugacaugguaguguuaguaggaagaccugugucugaccugauaugguagucaauaagaaggccuacuaaaauuaacuguaaaauuuccuucaggagauaaguacauggaaaaauuugaaauucaaaacauuuuugguucgaagccuuuaaaaauaauuuaaauuuuuauugagaauauauauauauauauauuuguuguuuuuuuuuuuuuuuuuuuuuuuuuuucgagacagaguuucucuguguagcccuggcugcucuggaacucacucuguagaccaggcuggccucgaacucagaaauucugccugccucagccucccaagugcugggauuaaaggcaugugucuagauuuuuuucaaauaauguguucuggucaugguuccuucucccucaacuucuuccagauccucucuaccucaauccacaccuuuucucucucucucauuacccaugcucucucucucucucucucucucucacacacacacacacacacacacacagacacacacacacaugcaccaccaaaaccccacaaaaauauacaaacaaaucagcauaggacaaaacaaggaagcagaaaggagugaggaaauguagaagcagacacucccucauccacacagagaaguccuacaaaaacagucagaaaccacaauauauaagcaaaugacuuguaaaguauauacaaaaagaugcucagagaaaucacuaggaaacaaaaguccuccaaaaaugccacugaguucauuuuguguuggcuguuuggugcugggcacgggccugcccauacgugugguucgcacaccagugagauuccucuggggagcuaauucuuccuaagugguuaucacuugaaaacagcuucuguguuagggacagggccaugugcucacuuccccucucagggcugggaccccaucuagcucagaccugugcaggcccccauccaagccuuaucaaagacaggauuccacuacguagucuagacuagccucaaauuuagagauccgccugccucugccucuuaagugcuaggauuaaaggcgugugccaucauaccuggcaucucaagucaacccuuuuagauaaaggcuauucaacuuguacucuuuuauaacacgggaaagcagcucugcaugaaaccuuaccaggacuuacugaggaagcuucuugucuacucuauguuaagcccgaagauugauagggaagaaaaagacaagucauuaguuugggaucuuggagaucuacagucagugccacagggaauagcuaugcagagaaacagaagcacgccucuguccuugaagaugaaaagcucggugggagacuguauuacaacaugacaaguuaaacgguaaaagcucuaaaguaaccaguuagaauaacggaugucacacagccucccacgaugaacugucaaaggacucuuccagaugacaauuguuaagaacccaaaagaaggugaggaaugaacuggucacauagauuuacagcucuucauauuuacguacuuauuaauuguuguguauaugugugugugagagagugagugugugcgcacgugugcaagugccuacagaagccagagacaacgggaugcccuugaccuggaguuacaggcaguuaugagccuccugauaugggccuaggucuccugaaggguauuaugugcucugaacucuccagccaucucuccaaaccuuugagugaaguucuuauaugaacccuauguaucacuuaaaauaagccagacacaaauucugcaugagucaacacaagaaacauguagaauaggcaaacucauucaaaagggaaaaaagguuacagauaucagaggucuggagaauaggguaggcagagaaaaauauaaaauuauuuaguggauacagaauauuggguuugaaugacagaaaaguuuuagaauagauaauggugacaaucagugccaccgaauggcuaaaauguuaaauuucaugcuuuaccauaauuuaaaaaacuaaugugcaaucucccuagugaacuguacacaguaaauugguggauuauacaauacaugaauuauuucuaauuuuaaaaagcccauggguuuauccacaauaaaaagcucccccgauagauauugccuugggcgcuguaguagcacugccucagcagaucucaggggcuacagguaacuguaucugugccaagaauuagagagcgaguccccaggaacaaguucaugaaccuggauagcaggaaaagcaauggcgauguggagccaaugugaaagcuggggaguggggagggccugcugcucuuugcugugugucgggaguagucgcugguccugagcagaacuguuugauguccugugguuggcuguggaguaucccucccaccugcacagguacauagugcuucugggaccagggauggagcugggaauucauuccgggaaaguucccaagggggaugcagaaggcgugcuacucuguucuucacucaagacuucugucacugucacuuguacuugauuaaaugacccaaacacaguggcuccuuuuacagucuccugaaaugggaauauguucugcugcagggccaugaucuguaagucaaggacccaugugaagauagagguuggcucccaaugugucccugcaaaugguguucuaguuuuggcucugcugucccuugccaggugggacccugggcaaccacagcccuguaccauccaccuagcccugacccacucugaaauuacuagggaaagugggagagaguauuugcaguaugaaagggcccauuuugaauaucccacagagauuuauuaugaaagacauucaagauaaaauccagucuacuguucaugucaagagaaaacaaaucucuucagcgagagggacuuacacaugcacgggguccuggccauuuccugcugagccucccuucccucaucauauccauuauuuagaaagcgagcaagcaaagcaacaacauacaauacuaauuuugaccaaacuguaaucugaccucagacacaauuuaaauugugcccauuuggaauuuguaacccugauuugcuaauuauggagaggcuguaguuggucccccccccagauuuuauauauguauguauuuauuuauuuagucuauauggguagcuguacugaugguugugagcuaucaugugguugcugggaacgaagguugcucacuccagccagccccgcucgcucuggcuggccuaaagauuuauuuauuauuauauguaaguacacugaagcugaaggcacaccagaagagggcgucauccaucauuacagaugguugugaauucucaugugguugcugggauuugaacucaggaccuuuggaagagcagucagugcucuuaaccacugagccaucucuccagcccgaagaagcucccguuuaaugcagauaaaacuuccuaacugcgggaacuuucugaaggcacacuacacuaccucaugaacuagcacacugccaaugaaggaaggcuuucugcagagucccgugggagcgggaagcguggcuguaacugggugcuaccugucgcugucuuguuaucuggaaugaggugggggcagagaagcuccccaaacuccuccugagguucauacuuuucucuguggcugggaagucccgugacuaacaagcaaaaucacacggcagcuuaacauuguaucuuuuuauacaguuuuguaucugauagguuugggaaaggugaauuagugugauagcucuguuucuauucuugucuauugcuagaaauaucugcguacuagguaaacauacuacccagauuagagaacaguggggagcugcuaaacagcucccuuuaaaaaccaaccacaccucugagauuggcacugcugguucuucaggcuccuacaugucaguaccacggggacucguuccaccauugucugugauuauuauugacaguuuaucaaucccauucugagcugguuaauggaagagagagagagagaggggggggggagggagggaggaggggaacgagacauauuugcucaaauggccuugacagacaccacuucugaauaagaagcaaagcugcaagagcucgagacuccauuguguugucauggcaauagaugauuuucaucauuuuaaaaugaugaagggaaauaaggagcuaagaaguauagaaaugaaccgcagaggaggaaagacaggcacaggagcaggugcaagccucugaccccuccaucccuguagggucccuucuggaauguaguucugauuucuauuugcuaaucucagucaauuucauccuucaagaccaaggucaaaacucaucuccuccaauaaacuuuccgugacuccucuaucuccacugacuucagagaaaauaccauaugugaaaacaaaccccaaccuccugcucuuccauuccaacaccgauggcauacacgggacacacaucaaauacauaccauucaaagugcugcguuuguguuauuuccuucaguccuuagaacaggacuacacgguaaagacagugauuacuuuccucuuguagaggaugacugcagauaaggaggguuucgguccuucgcuuguccuagaucaagccaucugcagucuuaaucacuacgcgacauggcccucugccuccccagugacaguccuagcaaaugcugcaacaguaaaaugaggcaaacgcuccuuucuggugucuccagggcccauuuguuaagaguggcuuucuggggcauggggugauuuccauggagaguuucccagcugaaggaaauaagacaugaggguucagccagccuuacugcuuugauccccaugagcagaaauaccaguggauuacuuuuaaccugcuccuacugaggaggauaagcagcagagccugcagacuaaaguccuccuuuugauguucuauagcuuuuaauuuagcuaucagguugagaaacgguaccuuaaauguguuuguuuacuguucacguauguguguuugugugugugugcugaggcaugaggagcacaguguccucaggagauguccaucuucuuuccugagacaagguuucccucuggccugcagcuugccaaguaggcuaagcuaggcuagucagccacugugucucagggaaucugccugucuuuguaaccccagggcuggauuuacaagcaugcacuaccaugcucaaguuuuucauguggguucugggguucauguucagcuccuuaugcgugcauggcaagcacuuugccaacuaagcuaucuuccauucaccacaacuuuaguaugguccauauauuuuauucaaaugguauucucuguuaucuauaucuguauguauucacuugcacaucugucuacauuaaggucagccuucacaugaccacucuguaggacaucagaaaggggccuggaaggaggugcugguuuuccuuccccuuucuucaguaguuaguucagcucucucuuccucaaccagucugacucagcuggcuugggcugcgguacauuaagcccauguguugagcacgugccagagcagauccaauuccucucuggugcccauagccccagcuauggaaggugaggaguaaagaggaggcugccacacaucaguguggcagugguauacuagagcaugaggauacgaugcuggggacagacagguugcagugcugccuuuucaggaugcagcccuucagccuugaauggaagccugugaugaagaugcacugaggauggcugaguguacggcucccauugcuggggcugagucacaggacaaacagguuccaacuuaggcauguguuagagcacaaacgucccuuacauggcgcugugagucuggcuucuggguucccucccucuaguuggcagucacuggccaggagcacauucugaugcugguugugcggggcuucuuaaccaggauaggagggcagugagguuccacuguuguaggugucagugcaaagagauuccaauucaggcugaccucuuugcucagguaauaauaaaugucguuuuucuuucucugguuguccauuuuucaggcagaagucauuugaacaauaguuucagacugugacuuaucugaaauaauuuuaccaccuuuuaaauuuaguacaaagaagcaaaauaucuugugucaacucuuuugggggugggaacuaaauccagagccucauguauucuggauaagcaacugaacuacaggccuagcccuccauuuauaaauauauauaaauauuuuaagagugacuuaggacauugcuuucuuaucuaaagccuccugugauauuuaugaucccauuuucuuagaggugacacuacuggcaacauuagcugaacagcccucacgaaucugcuuguguguuaugaaguguggaauguagaaguacccugugacccaccuuuucuacuagagagggacacccagugagucagugauaggcaugggaauaacggacccuggagaaaaagucuuaugcuaaucagcucaaugaaucacuuugaucagauacuuaaaaguuuuccuuaugacaggcguuugcacgucauggcuucucuaagacugcgucugcauaggugaguuagguaugaggaucuugauaaacagauacaucuuuguaaacacugaucaacaagauuccauguuaaaggagacagagaugaugaaaugcuucccucaucaaaaacacuuaaaauaggcagguucuacuuaauucugggaaauauaggaaacagaaugcuuauuguuuaguguuucuguuuuuaugucuacucucuagccaugauuagaaaaguccccuagucuacuagugaaccacugaaauagagaaaacacauuuauuaaaauguuacgcaacacuggcaaauuuuaaacuucugcccaucuccugagacugccacagcacucuagaguaccugguaccuaugccuucagcuccucauggcccugucacagcucccugcauauauuggaugcuaucaggggacugguuacagaaggugaaggagagacuuaauaacuguaaaguuaaugacuaaagagaaauaauuauuaaaaaaauuucaucaaugguguaauacuuccggaaugaauccaaauucccuuucuugagccuuuauuaaucugaccucaucacuuggcuuucuugggccguaguuuccucauuuauugaguggaaauagaagugacaagcaaacugcaguaaacugugugcggucugcuacgguucccuucaguucauccugccccaugucucuacaugcuguggauucuccugcccggccauuugcuucggcaacuaacagugcccauauuuguggucaagaucuucccuugauauucuuuuaacaauucuaggcaaugccaucuaguuuuggagauugagugacauugucagugaggccuaaauauguggcuuaucauuuaucuuauguugaugcuaaaagucacucuguggucacccugugaguguucgugacccuugaugcuuuagcuguugugcagagacugagccacacugggaaacaagcagcauuugaggaccacacuggacugagccacacugggaaacaagcagcauuugaggaccacacugggcgccucaaaugcuagaucugggguaagcagcaaggagggguucagacagaacaaucaagaugcucaccucccaggagaaaugugguuugcuggcaaggaugaccagaguuagagacuggugcuuugaauaagauguccccaguaagucuugggcauaugaauacuugauccccaguugucuguuuuggagaauaaggaggcgaaaccuugauggaggaaguguguugcugaaggaaggcucugagguuucagaggauuuaugguuuugaauuagugcucuuugucuccccugugguuugagauguagacucucagcucuuccuguugcugacggauuuagcucugccaucuggauucuaacccucuagaaccauagccccaaaucaacucaucugugaguugccuuggccaugguauuuuaccauaguagaaaaguaacuggucagagugucuccaaagcuugaacagaaagcgggaggauaggggaugcuguucagcuuuggagcccauggccaagugcuuuuuuguuuaggugcaaacaguauagucuugguuuucuaggccugaugcuuuuccuugaacuucuucgagccuucugacaaaucccucauuuccaucuaaggggaaaugccucaaaaaccauucccaugcccaccccauuuccuccaacauucuuccuucucuuggauaaggcuugcuucugggacacucuguuugcuccccuuuggcacucugccacaucagucaccucacuuaagucugcaacucucuccuaaacucuccugagacuucgcuagcuucucuggaggagauguucuacuuccugucagagugauuuguacgugucuugucacgcuuauuaucugcaagccucaagaagagagagucuguccccuuauuuguauacuacuugaaguuccagccauacugucuuacaaugguggggcgguaaauagucacuguguuaaauuucaugguaauuacaauuuccagaacacauaaucguaaguuccuuuacuuucuaguuguuaaauacagucaugguuacgugauacaauuacacagugguuuuucuauuaagagcuauuggcuucaacuagacuuuucuaucuuuuuggguccugaacuauuuucuaaggcaacaaucauaucucugcaguaaguaucacuacugcaucuuccucugcaagcucccugucaccagggugggugguugaggcccuuuaccaucgcuuugugguuuagucugcagugcaguccccuguauuuccuauguaucaugccccuguguucagggugugguuccucacaugucaccuaccccugguugcuguccaccuuuacucugggccucggagucauuuuuaucacaguucucacaagcugccacgcauuucauuagguuuccuccaagggacacaguuccacauugcacuuccuuccgcuuucaguccuccuggcucucuggccgcugcagagauggcacucgcuguccugcccuccuacucucuagucaagccucuccugagccacucguguucagaacugcugucaauucacaucucagacuucaaaagcgacauugcaaucuaguugacagccaggucuuuaaauugcuuuugcguuucuccagcugugcucaggacugcucagcuuuucuuaaacagcgcuacaaauauaugcacaggcuuccccaagccaggggccagucuggggcaagaagagucuuccucucuggaaggagaccaagcccuuaacauucucagguuuggacggauggaacacggacucaauuugggggcuauagucacaaaacaaagugaggccaguucuggaacaggcggaagaauguaaaguaauauuacggugcaaaaccaugugccuggccucaccaacccucugucccucagacagauagcagauggcagggacagaaacacaacagugcaauaucaaauuacacugauaaccacacugagccacucagcaagaaaaacaacacacauacuagucccacugcugaaaacucagacuccuugccuuaaccuggaaggugaacggacugcaugccguaggaacggcuauggugagaauuaaccugaaggugaacgggcugcacgcuguaggaacggcuauggugagauuaaccugaaggugaacaggcugcacgccguaggaauggcuauggugagauuaaccugaaggugaacgggcugcacgccguaggaacgggcugcaugcgagacuaggcuuuagcugaacauuuaguaaugacugcaagcaugaaaauuaucaucaucaaaaccacuugugaugaauaaugaacagcauuacaucuaaucaggaauaaacaauuugggccuaacuaugaacaaggaacucugcaccuaguugugggagacacuagggugacuggaagcucuggcuugggguggcaggggccucuucccugguuucgcuccuaaugcaaagguccuggcaggguauggcugugugacuguggguucugugaggccuaacguccucggggcacagaaggugacuguacacggucugggccaccugagcuggcggcucaggaaggaggcauguuugcugagucugguugcaaaguguagaaaagaggcucuggugucagaguuagcacucucacaaauauaauaaauauuucuucccuagacccaggaagcacacacagaguaaaauaaauuauugcuacuuuggaauaaacaguagugcucucuggguauagagccaacuggcaguuugaaggauuggguuaaucagacauagggaaauuucugauuaauuggauaauuacuucaaauucugagugagccaaggcaauguuaagagagacauccugaccagcugggaauauauucaauagccggaggcuaaagcuuguaaguguuaaaacuaagcugggacugggagccuaguuuuuauagucucauauuccuaaauguuuagggauuguaacuauuuuuuaaggccaaacucacucaaaauuauuuugguuuuuaaauguauggcaaaauuguuugcugcucuccugaaauaagcuuaggguccaagaacaugggaaaaugaagaugcaggggucagcgggggaaugauggaaucucagcucuguccucagagucuaugugcacagccucaccuggugggggcgugcuucugcuccucuucuucaucggugucacugcugauggugaugacacugacuguggggcucggggugucggggaugacaaucgucugccgcugucgcucccggguggugcuggaggccacgucgccccacccacaggugacugaggugcugcaagcugggcugcuguguaccauggcgcaccgugggggaguguucuccuugacacgcuuggaucgcugaggggagcugauagccugugaagaggucaccucacagguggagacauuucuguaaugacaaaacaacacgauuuacaaggagggucuggcccuacaucuccaucuaacuuuaaaauaaaacaccaacguuaccacaucuccacaggagaaaaucugaagcccaugacaguugaccucccuugugacagaaaauacagugcuucuagaggccuucauucaggacugagguuaggaccucugcugggccuucucugggcucugguuuggguccauauaccuguuuuugagagcuggucuuuuagagacagcuguccugaucaggauuuuagcugucagauccaacacagcugcauaagacaaucuucaggacuaaagcccagacuuuggcuucaucuagcccucccucaaugguauuuguuuuaggaguggugagaauuuucuuccugaugguugguuuauuauuuaauuacuagcccccaauucugugcugggauugaauuagauagucuagccuggagccauggagccacacugcuaccuuaagacacuuguaagaguuucuagacuaaugaacagguguguguguguguguguguguguguguguguguguguguguguguauguguguacacgcgcaugccagaggucaaccucagguguauguuccuuaagagcuguucaucuuguuuuuugagagaagacaguucccuuacuggagcccacugauuuagcugauugcccaaguuccccagggucugcuugucucuaaccucagcacucggcacagguguguacugccaugcucagcuuuuuuaugcagguucuagugacuaaacguaggucuuugugcuuguguagaaagcauuuacagauggagugaucuccacugccccuuggcucagcguucccuucuuucucuucugguaaggccauagcuauucagauuuggggaugugcaaugggaaacaaagaaaaacaaaacuuuuuggaucuuaaccuaagccucauggcaggcuuaucaauuaauuuguauugcaauaaaaaauuaggacaaauguaagaggaagaagguacacuggugcaugccuuuaaucacagcacuugggaggcagagacaggcagauuucugaguucgaggccagccuggucuacagagugaguuucaggacagccagggcuacacagagaaacccugucucgaaaaauuuaaaaaaaaaauggauaagccaaaucugaguauuguagcauacauaguuuaacucuuuuaaaauuaauuauuaguuuuagauuuauucaucauuucauguguaugaguguuuugucugcauuaugugcacccuggugcccuaggagguuaggaagacgguaucagguccccugggacuggaguuacagaugguugugagcuaccauaggguuugggaauuaaaccuggauccuccagaagaguagucagugcucuuaaccagugagccaucuuucuagcccaucaaagagaacuucacugauugaccugaaauucuauauuaaguucugguaacucuagggaacaauuaccuucuuuucuucccaucaaacccuuugcugauccugguuagugcccaugcaguaaagaccaaaggcaagagagaauacaccuuuggcucugcuauguccuuagagagucuagcaccuuuuaaguaaagaggucgaaguaagauaagcauaacuauagaacauauuuuuaaguuaaugaguuauguuucugaccugaaauuucaaaaaaguacauuuuuuagugauuuuuaaaaauauaucuugauaauuuguaaucaaauggaaacuucaaagguuugcuguuucuagaaaagacgacagagacuguguggccaaauuuaggcaggacuuugaaccuuuucauaggcucaacugugcacuucuuuauaaaaucuaguuuuagcuaagaaccuugcuaauucauuuuagcuagaggacacucuucccaucucuugauaucuagaauacuagaccuaaugucugaccagauuccuccucccccacucucccuuaggugauggcuaaucaccuucagagaaucuuguuaggguuguuuagcuacaauccuccaguuucugccaucuccuaucugcuauuuucccuaugugaccuagacacuacucccuggguacaaacucucgaugcccaugcuauguguagagcugagcccacucuuucuccuccacugcagcaucuuuguauccaucccuguggucucaaauaaaaucuuccuuacugugcuuuaacuacuuuuucuuugguaaaaugacugaagcacucaagacauuaggugcaccaugacucuaggccuccaccuuagagugccagagggacaggcacuaggaagagucaagaggcacagagcccagagagagugcuuuuagcaaauuccagaguguuccaugugcugccagauguucccagcucuuguaggaagagcugcucccugcaccaggccagggcagugcacuggcaagcccuacuuccaagugguguuuagcauuucaaucuucugguguuucuugcuggcucucaucaccuaccucacagaugacuggugcugcuuacucuuccuggaggagguggugcugguugguuguugccucaucacaugggcuacacccacauuuaagggcugggcagcuggaagggucacaugaccagucaagagugcaggcugcugcaugaugggauuguaaugacuuccaugagcaugcguguuccugaacgagaaacgagaacaaaaggcaccucagugguuuuauagaacucaacucuuuaauaagacgacgcuucuccggcagaccugucgacuggaaggccuguguugaaguaggaguacuggcugaugaguuagaaccaagacuuucaaggggaaagaaugucaaguguguagagucagagucuguaagcucuagagagaugggaugaguagccucugaccuguaaaaucccugagcaggugcuuaugcugaacaguaauacauaccuuuuguuuuagaauuuacaaagcaacuucaauggguucuuuuauuccacuuugugagguaggcaggaugucguagauacaccauuuuauuaaugaggaaauuguaguuaaugugaaaaacaaacuuuggcgacugggagccauauguuucuggcguuaggaaucauuagcguucuuuugaauucccucaguagcuaacacaaugcucaggcauguagcagcugaucaguuaauuacacgcuugcugaaugaacaauuagauuaacugaagggugacuagacucguauagaguuuguauuaaaucaaaauuacuaacagucauacauaugcucacagagauaugcaggcagcuugcauccuggaguuggguuacauuuuaaagucuuacuauauggguuggaugaaucuuaagaaaaagccuuguuuuccaacagaaauguuuaaaguggugauuaauucaaagaucugucuguaaaagcccacuuaacauguaauaaaauuaaaagcuaaagaauuauuuauuugaacuuuaaaaaaaucauuagauuccaucuuuguaacuugaaaggauaaauaggaaaaaaagacaagcauuucauaguacuuuugauggucuuugagacgugguuggccuuuggaaaggaacguggcgcugacuuucuguucuuuauuucccuacagauggacccuuuuccuuggaaaugagggcggcgcuggcgcuccucucuuguuuguuuccuagucacgguuauggaugcucuuugacccacaaugagauacagagaucgggaggauguggagauggaagagaggugaaagaaggcagaacagaaaagaugcaugaacagggcacauauacugcagaaaugaagugagcucuaacugccgaagacaaaggaaaagaugcugugguggggucucccuggaaagucuggguggggugugggcugucaugacugggugaagggaggaugccgagcucauucugccacauccaggcacugcuacacugcaugugacagacaggccaaaccuuuucugugccuuuuaauugacaacccucuauccccuaccccacaauccugugagguaagcaucauggccccacuuuauugaaaaacaaacugaggccaugaaaguuaaauaaccugccccaggucuuacacagccagacuggaaaccaguuuggucugguuugaaacugcuuccacuggaugcagagcgcagcugugaggacaaccagggauuuuccuccugucagaaaguagauuuacauggaggagaaagcuguacuagacaccugacucagagaacuaacuagccacuugccuaccuuuuccugagagugaguuaguuauuuaagauaguuucacuauauaccucagacuggccucaaacuugugauccuucuaccucagccaaaguguuaagauuucagauauauauauauugccacaccgaacccaagagcucuauauuccaaaaaggaacuagggaggcucucagagggguaagcagacuaucagaagguagcagggaguacuuucugcaggagguacaucccacaggggccacagagcuggggacaacuggagggcugucauauggcucuguacuggucaaggagggcauugugacaguguugggaugagggccagagggaaaaugacaagugccuaugaaaacagcagagcagguguccaugaggaagccgcugaggugcaugggcaguguuggagacagaugccgagugcuggcaggugguggcuggagucccuggggucuguggaggugaacucucucaucuauaagacaggcuguuaacugaaaaggcacacuuaauaagcacgccagagcucauccuuccaaaucuaucuuaucuguuaagcuuucccuggggagcucagacagacaggcaccuaugucucaaaacuucaugagaacacuuucuagaauugcuuagggcuuuggggacucucuucuguauuccuucacuggugacaaauguuugcuuucugaaagggacuuaauucugagaaaaaccuagcaggguuuugugaauuacacugguguuuaaaagauguaacugaguuuuggguagaaaauuaaucaaacugaauuuuggcugucuugguauaguguuuaaaccaccucccauuacacaguagccauagcccacaugauguucucugucaguggugaacacaacucucaucccagaaacucugcugacccagaaagauugacuguuuaccuccagucagccaguugcugagugccugccauggucucaggaaucacagcugcaugcuguacagauguguggguggccacgccagucagcugcugccaugcuggaggaaguaggaucuguugggccccaccuggccaggccugcuguaagacagaggauauccauaccaucacacuuuauuaauuacuuaauugguuuacaugaguccagaacuuaauccauggggggcugugcuggaucuuaugauggguguaaaaguguggacugcuuguuggcuucaaaaaacccaagggaggcaacaaaaggcauagggcuacagaacaaucuggaaggaauuaggucaucuuacaaaugguuuccuuaugaaucuguucuauuauucuugaagcugucuaaaaauccauucauugacuuguccuauaaacuaugugcaaaagacugagcuaacugggucagaugaggaaagccuucuaucaaguguccuagauuucacacuugacucauuuguugguuuuucuuuucuuuucuuuucuuuucuuuucuuuucuuuucuuuucuuuucuuuucuuuucuuuucuuuucuuuuccuuuccuuuccuuuccuuuccuuuccuuuccuuuccuuuccuuuccuuuccuuuccuuuccuuuccuuuccuuucccucccucccucccucccucucucucucucucuuucuuucuuucuuucuuucuuucuuucuuucuuucuuuuuuagacaggguuucucuguguagcccuggauguccuggcacucacucuguagaccaggauggccuugaacucagagauucaguucuucuguuuaucaauuaucauguagaguuuuaucuucuggauuugauucucacuuuuuacaacccagagacuauguaguacuggcuuacaugugagagaaagugguaagaguaccaaacuuaguugugacauucagcuuaaauaacaaauaacuucaauuccucaaggcagagacaagaaagagacuaggaggaacccacugcugccaccucucaauaugaagaaccuuuaugccuuuuuccuuuaauagaccaauuggugggcaugcauaugugcagaaugcuuuaaauucucugugccucccucucuucucugcuuguuuuggucauuaauugauucucauugaacacaucugaccaaugguggacauacagagggccaucaugaaaugcuucuuggaugggucaauagguuugaacucuuaguuauacuucucucuguccaugaagccagacauaacuaacauuuucuaacucaggguuccaaugacugggcauguguuuaauaugcauguuuuaacuucuguauaaauaaacaguucuauaaaagacuacauuuccagucaagacuuaccaagcauaaugcuuauaaaaaugcauauuucagaucugccccauuucccaguucaucauucucaggauaucaguguggccugugaaaucucauacacauuuugauauugcuuguuugcuuacugaucuguugugauauaggcagaaagccagagacugcugaucauaccauaauauuuaaugucaucugacaaaaugaaagcauuaagucuauacguuuauuaauaauagcaaauugcauuucaaguuuacugagcucaugcugggcguggugguccaugccuuuaaucccagcacuugggaggcagagacaggcaaauuucugaguucgaggcuagcuuggucuacagagugaguuccaggacagccagggcuacacagagaaaccgugucucgaaaaaccaaaagaaaaaaaaaaguuuacugagcucacugaagggaaauauaaucuaacuaguaaaccacuauaaauucaaaauauuaaaugagcuagguacaaugaauggugcaaaccuuuagucccaacacucagguggcagaaacaggugguuuucuaugaguucaaggccaacuuggucuacacaguaaguucuaggcuagucaggguucaugguggaagccuauauuuaacaguuucaguuaagauuguuacugcuuagugaucuggaacucauuugcaauucuauaaaaagcaugugucuuggcuaaugucauuaaaaaauguauguugauacuaagacaaggucaucuuuuuucuccccuauauuccugacuauuagcauuuuaccucaaggcuaugagagaaaaacuuuuuuuuuuuuuuuuuuuaaaaaaaccucuuuuacuuacugugaaaguggugcuuacaaauacaaucagcucauucaguugauauuacaccacacaucuauaauuuauuacuacuacuaggaaugaaacuaguauuucuuuuacaaauacuacuauuguggaugucugucugaugugugaaugcauacaagcaugcagauuccggagacaacuuuugagagucagauucugguucucgccuccuauuuuacaguucaagaaccgaauucaggucaucaggcuuuugaggcaagcacuuuuagccgcuaagccauauugcuucccgccccuccuuguuugagacagaaucuugcuauguaugcagacugcacuugaacuuaagauccuccuagccucagccuaccaagugccaggaccauggguaugcgccacuaugcuggcuggagcaugcugugugucaagcaguauuaagucaggaauggauuuuuggacuuaauauugggcagguaggguaaggacuacuauuucuucccauuucuuaagugaguaaacugagacagagaggucuagaaaauauggcaaauuauuguuuucucugaaccuaacaugucaguaaagaaauaaaacguaucacuuuguaaaagcaagaagaaugaggaacagacaguuaaaaauauucuagagguguaacaacauaugaacaauuaccaagaaaguuagcagauugaauuacuccaagauaaauccacauaugaaaccaggccagaucccugguaugcaggugucuacuguccccagauccagaagcuaggcgauucuccagggaaauggagaaguucaagagaaaggagcuacagaaaugacauuugaggauaaggacucugccaguaaagacgcugggcuugccucuagucacuccacaaggagccccacggucaguagcucaucccagccucagcuuucucaguguacugaguacuuuaguguuucaguccuuucuuccuuccuuccuuccuuccuuccuuccuuccuuccuuccuuccuucccucccucccucccucccuccuuccuuccuuccuuccuuccuuccuuucucucucucuuucucuccccccuuucuuucuuuucuuuucuuucuuucuuucuuucuuucuuucuuucuuucuuucuuucuuucuuucuuuucuuucuuucuuucuuucuuucuuucuuucuuucuuucuuucuuucuuucuuucaugcacaugaguacacuguagcugucuucagucacaccagaagagggcaucaaaucccauuacagaugguugugagccaccaugugguugcugggaauugaacuuaggaccucuggaagaauagucagggcucuuaaccacugagcuaucucuccagccuuaguguuucagucuuaacuauacacaagcaguuaaaggagcuuuacaggagcuuccaucuaacguggaagagauuaaagcaaaaauaaaaugaaacucacaugaaacaaaagcaagaucuauaauggucuauaauuaagauccauagaguuaaaaaauaugcauuuuacuucauauagauauguacauauggaacaagauaaggagcucccauaaauggagaauucaaaacuacaguuuaaaaaaaaguaaaaugaaauuucucaggaagcaguguagacagaacacacacacacacacacacacacagagggcugggggcaggggggggaagagauacauuuaaagaguaauuuagaaguauuaacauccaggcuagggagauggauuaguggguaaaguguuuaccaugaaaguguaacgaccagaguuuggauaccuaauacccauguaaaugucaggcaggcaucagcauuugggagaugaagauaggauuuuuguagcaaauaccuagcuagacuacaauaacaagacaggucuagauucacaagagagacagaucucgccucaauauauaacagaauccugaaccuccaggccagugcugacagcauccacaauggaccuugaccuucuccaaucaaacauuaagaaaguuucugacuugauucugacagugagagggaguuuuggauccugcuccuugaaaaaaaaugagucaagaacuguuccacccaucuccccacuuuugcgugcuaacugggguuugggacuuggaaauguggaggucacagacuuuucuggaaguaucaaggguuuccuuuguaaggguuucuguaaaaggucgcucauaugucccuaacugugcccucugccauaugcacauucuuagggugugucagaggcuuguuucucuguagaggacacaaccugcugcugagagaaaggggggaagagacugaaaguaacgggugggauacauuuaaagggccaccucuaaaccuucacacaguccucaaagugcuuuaaaugcucagaagaagaaaacaaugucaaauuuggggacaacauuuaaagcacauaacaguauucagaaauuucaugucugagagccuagaaaucuacucacagaaaaaugaaggccuaaauuucaauauuuaauuauuauucuaaaaauaaccaccacuuaguuugaugaguuacuguaauuuuguccuuuacaaggaguacauaaagacaaugauuccauuuucacaggcuagcacgcuggggcagaugaaaugacagaaagaaaaagguagccaaccauuagccagugcaauacaggauaggauucguucauuuuucaaaaauaagaaacaugucuuagcaguugaagacacacaggucuacuguguccauuuauggguguguucuuuguucugcuccacucuauguugauucaacaaauucccuaguggagaauauucaacuugcuucuaaggguuccuuuuuauaaacacuaugccaauuaaaauccuauacacauaauuuuucaguuguucacuuuuccaauuacagauuuagguuaaaucaacuugaagguuucuaacacuagagauucuuuuccuguaagucggagguagggcucuccacacuaugauuaaaggacugagacaaauuuggaaaugcugagccuguugguuccacucaacugaacaaugggggaugucucuguuagcuagcaagccaugcuuaguauuucuaacagagcugcuccuggcuuacuuggauccaguguguaaauacaaaaaaaaaaaaguguguguguguguguguguguguaguucucuaauaaucuuugaaaauauacagggaaaucuacagauuccaggcucacugggaggcuggucuggacuucugacacucagauaaagggugagcaaaugucuugacccucaacugaucuguaugcaggucucuucuuugauuuauaguggucuuuucugaacuccucaccacagaacuauacagcagcagcagcagcaauaacaacaauaacaauggacuuuaaaaagacaagccuguuuuaaagacagguucucuguugauacccuuucaacaaggcacacacaacuuugugugccaccaguugcuaguguugcugccacuuaagcagaggcaguuuagauauaagaauaaagagacacaugucuagaaucccuccaucuuagacaacuuccauaucaucucucuccugucaggugucaaggauggcuugaccuauaagugucaacuuaacuguuaagguaguuucccaaaagguugucccaaaguguucucaaaucagauaagggcucccuaagaaaggcaaaucaugcuauuuugcauuuaugaacacagaugaaaaacuacuaaucacaguaguagcaaacugagcucagaaaggcaugccaucauaugaagcacaugaucaaauaaugugucucacaaguauaaggauaauuuaacacuacaaaaucuaucaacagauuagggaaugaaaccacaugguuauucaaauagaugagaaaguacauuugauauauagaauauuuacuuaaaauuaaaauaugacaaacugucucuauuaacuacuuagaggaaauaaaauguguaguaggaaauagcuuuaacaacuucauuuagaaagcaaacuagacagaaguaaaagaucccugauuuucucuguuauuaaacaucauuuagacugcccuacuuggcccaggauauauaaacaauagaaaaaaguacaaggauccaagauuaagaaauaaaacuauuauuuggaacuacaaagacuugucuacaaggcaaauucaaaaggauucacaaaaacagaaggcuaacuacauaacaauccuaauagacccaaauuagcuauauuccuauagacuaaaagcaaaaaaugaguacaauuaauaaaaucaauauaacaaaauguaaagcauuuauuauuuauuuuuauguauauggguauuuugccugcauauauuucugugcaauauguguguggcugugcccacagaaaccagaagaggcagucauuggauccccuagaguaggaguugugaacaacccugugggugcugggaauugagccuggggccucuggaagagacagugcucuuaauuacugcaccaucuuucuagccccacaaguucgcuugcccaccugccugccugccuccuuuccuuuucuuucuuuucuuucucucuuuuucucuuuuucuuuuuauggauaaauuauggaauaaaauaaaaugcauauagaaauuaaaagagaccagaauaccuaaggaaaaauugaagaacuuaaaagaacauucccuaccagauaccaugacacaguuagugaagacuggauauuagagaggccaaugaacuacaagagagccaaggacagaccuaugcaauuugacguccuauaacuuaaaacgaggaaaaacacuucuauaaacaaacuauucugagaacaauuuggggaagucuuuugggaaacucccucacuuaaacauaaagccgacacuaacagggcaagccaucuugaugcccgagagcagaaagaugacacagaaguggucuaagauggugggaaaauauggacaucugugucauauguuuagaauaugucuugguucugaugguucugacaucuaguuauugguuuuguuuuaagacaggucuuacuguuugguguaggauggccuagacucacuauauagccuagccuggucuagaacucacaauccuccugccucagccaagcuguguaugguaugacaaguaugugccaccacaccuggcugcuauauggcucucagcaagucccuauguuggucaaguagugacaaauauauggcaaaaauguugugaggauuaaacaaauuaacuguaaagugccuggcauaaagaaaauacacuugccauuggaucaagugucuuuaaggacugacuucugguauugcaccaguacuguuaguauaaauuguaauacuuuauacauuuucuuucuuuuucuuucuuucuuucuuucuuucuuucuuucuuucuuucuuccuuccuuccuuccuuccuuucuuucuuucuuucuuuuucuuccuuccuuccccuuuccuuuccuuuccuuuccuuuccuuuccuuuccuuuccuuuccuuuccuuuccuuuccuuuccuuuccuuuccuuuucuuuuuuuuuuuuugagacaggguuucucuguguaacccuggcuguccuguaacucacucuguagaccaggcuggccucaaacucagaaauccgccugcaucugccucccaagugcugggauuaaaggcaugcgccaccacugccuggcuacauuuucauuuuuuaucuuugugaucuuauucuacagucagaccaucuauauggauaaaagaggaaggucccagcccacagcuucugcaugucugguuuucccagcucuacaaaugagggcauagucuccagggcucuuugacucuaagagccacuucuauuuuacaaggaagaaauuugaggcaaagagauguuaacugacuugccuuaggucauugagaauugcuagcagauuuaggauuaaaaccuagguuuccuagaugaauuugcuuuacaaacguacaauaauaauuucccuagacucugagacuaucuaaauuucuucuuggaauugucacuagacacuuagggagguaauucacuuggggaucauuuagaacauuacugacauauuccaauguccugacaaauuccaccugcuccucaccagggagucaguaaagauauaugucuuuugggaaagcauuaacacggaugauggaaaaugagcaacacagaagagaauuaccugagcaagcaggccugguuggaucugaagaggcugagcuccuggcgccugggugacgauggggacagcauuuuccauccgcacugaguagccagcgugcuuggagggagaggccugcaggccuguucaguacaccgcgaggaacaggagggaggugaaugacagaaacacugagacccuuccaggcagcuagcuagcuuuacaacuuagucuuggggcguuugccuuuuaguuucuaacaaguuaaaaggaguccccuacuacccaggaccccuccccccuccccaaaagcaaagcauguggggccaaaaccaggacaguuaaaaugacaaauuacaagaggaaaacaaugguugcugcccaauggagauaacugagugucacagcaaagggugcuggggacaucgugucccuuggagggcucccucuagguuguauggcugguaucugagcauaugugaccuugagcuuucuguguaaagugugacaagguacacagucaucucuagcugcuucagguccacaggaaaggagcucugugaucauggccuugggaggcaccauucagacaaauuuauauucucuacaugaagugagccuaugcuggcugucagagacuggcaauuuucuacagauaccguacagagagcauuucaugugaggaaagcuggagcugacaucagcauaacaauggacuagacaaugcgccucuuuacaggcagcuggcuagagccacagugcuggcaggugcugagaacaacaacaaauggacuugguacuggagcauaagccgcauuguuucuagguugguggcaauacgaguccagccuccaaagucagcaauagcagcauucuuaggaagggcuuucuucccugacaggagcacuccaggaagaagcaggaguuagagcccuaaaggugguccugcaagaagcaguuuagccuuaccuuggaagccagggggacacacgaugagagcuugcuggaagggaucaggucgggcacaaauuugggcuguucccgucugcaggggcaugcuccgcggggccaccgcggccauggaugccgcugagggcugguagagugcagauugguaguuuaguauggagacuucgggauuggcuaaggaaagaguggcacuggagguggugggagccuaaaggaaugauggggauuaaacaaaaauaaacaaaaauaaaaaaugagggaggcgguauguugggagacacgaaucuaaagcaaacaaaugaauuuaaaggagaguuaaacaaaccaaagagcaaaaaaagcaaaaagaggggcaggaauccagcugaacccucaugucugugggacccacaccccucacuucugagaaguuagcuuagucuaggaaaccaucugguugggggcucgaauguagcucaguagaguguuugccuagcaugcaugguacccuggguucaaugcauaaaaacagccaugguggcaaauuccuguaaccucagcacucaagaggcugaggcuggaagauucagaaguuuaagguuuucuuuggcuauauacugaguugaggcuuaccagggcuacaaacaacaacaacaacaacaacaacaacaacaacagaacaaaauuguuuaaugaacgucucuuuucaucccagcuggguagguuugguuugagagccuuuauauuccuuugauuugacaguggaaugugaugcuggggagggcaggaaaagcuaagccccuccuccuucuccaugucuuagcuuggcuccuccaacuugagggguuucagaugcacuuauacuaugcagccagcccacaaacccugcucagucuccucucccuuggguaaaguagucuaugcuugguaggacaaaucauugaagaugguccucaggccuggguccuauguaaacagaucuuagcauggaagccuauguagcagaagggaagcccaggcagucugcaaggagccucuugcucagacuaagggcagugcugugugcagacacccuaagcccacgguaggagcugccacuguaaaagcaguagauggcaaauaucaggaucuaucuuuugaaacugaacuucuaaugaaaacaaagcuguagaaggaaagcaaacucuuuguugggaauucauuuguuuuucuccuuagccuucuucacgcaaagagaggcagaaguuagcaauggcuucagacugaagcugucuagaaggaguuguaccuuuagagguuguaaggacuaaggguuaaaggagcaggugggcucugaguaaauguucacauauguuuggccacauacacuuuaauauuugggggggggugcuugugggaguagggaacuacuuuuaacuuguuagaaacuaaaaggaaagugucccauguaaaagaacacaaauguaaagagaauuucaaguggaguuaacaucaaauuucauaaaaaugucaagcccucuuuuucuuuuuauuuuuuuguggugcugcagaaaucaaacaaacccagagccuuucguacacuaggcacuuccacuacugagcuaugucucuaguccuacuuugcuuuuuauacuuagauuuugugcuggauuuugguuuaagacaacacauuuauuugaaaauuauuaccaauuccuauggcauacuuuuuuagauuuugagcugcauauuuaacugugugugcauuuucagcagucccuguagugccuccuggaaguaugguggggacaugcaugcacacguaggagccggugucuauacugaugacaacacccagcuccaguuuuccccaccauuauucuuccuggcagcucccuuaccacauuuccacugucaucucagacacuaugagcucaggccccgagggucucccgcuggaggccauggcaccaaucucuucccaucugacugggcuuucccauccucugaucagucacuguuccccaugccucugccuuccaacaucccuagaacaaugggcuguuucuucuuguucucuggcgcccaggaccuguaagccccuggccagugagucccugcucucuacuucucuuucaguaguugggcacaggaucauuuucucucuuuuaauuuuuaaaaaacauguauggguguuuugccugcauguuugucuguguaccauguaugugccuagugcucacagaagcuaggaaaggacauugcauuuccuggaacuggaauuacugaugguuauuacugaggggaacucgggggucccgcuugagguuuaacuggccuguuuguuggggcaguuggguuagccucucacuuaagccaacuucucugcauugugucugucuccguguggcucucucugcucuaccucccugccugcuccugcucuuccuucugucuccugugucuguccuucugccuggucagucugccccagcucuaccagcucuucauucugcagaaggccacacucuuuacuccuccaguuggaaucagucagcagcaggacgauacccagcccacuuucuggguugccucucagcacugaggucugugugacuauccccacagcagccugccuuucuguuuuaggcaggugaggaagagacagacauuuacauauccuucuagccugugcugacccagcaacugacaagugagaacacagggacacauuuuuuuuagccaguaaauauaguacuuguggguuacuacaacagguuauguaugagccacaacaugggucugggaauugaacccagguccuuuggaagagcagccaguguucuuaaccacuaagccaucucuccagccuugaaucauucucucuuaaagaccacuuuacgcauuagcacccugcuuuguacauaagcaucuguuuuugaugaagggacccugguauagcugucuuguaugaggcuaugccagugccuggcaaauacagaagugguugcucacagucagcuauuggauggaacacugggcccccaaugggggagcuagagaaaguaaccaaggagcugaaggggucuacaacccuauagguggaacaacaauaugaacuaaccaguaccccuggagcucaugucucuagcugcauauguagcagaagauggccuagugaccagaacugggaagagaggccccuugguauugcaaacuuuauaugccucaguacaggggaaugccagggccaagaagcgggaguggguggguaggggagcagggcggcagcaggggggggggguauagggaacuuucgggauagcauuugaaauuugaaauguauauaaagaaaauaucuaauaaaaaauggggguaaaaauuccaguaacagccucaugagugcaguguaugcaucuugaccugguaccguuuguuuucuauagacccuuagguaccuuccuagucuaguuguuuuccuagccuacugugaauauaggcuauucaucucauaggaauccuguggcccacagaguuaucucugagccucugugcuuuggggucagccuuggcaccagggcuccaaagcagaacuuucccagacaguagaguugagcuauuccuguguguucuuguacaguaaucugugacuguguggcucaacgccugccacagugugcugggcaguguggucagcacccuaacugaugccuccuugggagaaggacucguaggggaggacuugugguccucugcuugucugccugacugacuuuauguguguaaccuggaucuggaucuguuuucagcucauguacugcuucucuaggaguggaacucaugucaugauaugagugccaguccccagagugaccaguaggcaugaugaccguuucccucaguuucugauccugcuuagggaucagcugaugaaaguauguaugauggugugggugacuuuuacccuguccucugugguucuaagagcuguuuuggauaacaaagagaaauaagaagaaaaaaauaaguucacugguaacuuauguugcaaagauaggcccaagugguucuuggauacaguuguaauagacauuucaauuguugacaucucuaagaacaggauguaagccuaaccuauaaguucaguuaaaauucuugguagaaggauauaucccuaaaagaagacaccuuggaaauguuaauaacgaggcugaccuuaagaauuaaaccaagaacacgcaggaaggacucccuacucaauguuacuaauauuuuuugaaaguacauagaaauuaugauguauuggcccagcuuucuugagacauaaacaauuacagauuagugagcacuuugaaaagugcuagucuacuggauauauguuaagagcaacaaagaacucauucuguauccuuccacuaacaucaaucuguaggugaauuuuguuguuuuaaacauucaguguucaggaugagcaaaacuccagggucccguggaguaaacacagcacuggguuacuaguguacaaagggaguuuuguugcacuuagagagcagaggcugucuaggagguacuggcugaggaucuccacaggauucaucugugagucagugugugugcuucaaggguacagacccugacaccaggcugcugcaguccaaacccaaacuaccucauauguacuaacauagccuuuguuaagaggauuaaccacuuuaucucagugucuuccucuaaaggacagugacaauaugcauuccacauggaugccgggaggacugaauggugccaugccgagaaaagucugacccaaugcuuccugccagaaguguggccacuuuguaauaguaucagaggaggggaagcaugccuuagugcuuaagucuagguuauaauccaaauaauuuguuuuucugauauaucuaauuagggccuaacacuuccaaguucagaugauggagaguuuugcucucuggaucuuaguuuuguaggacagcacuucaucuucucaaugcuuaggccuacaucacacuaaguucacagccguuuuuuuucacucugguccuaccuagcaaccuugcagucucagugucauggagaagggaggugcccuuacuugggaccugccauugugauuuucaguuuuggugauacucuuugggacggaugugaggcuaucauaucacaggaaacauggaggugggcugcucugauguagaccucagucugauggcuauaaagagaucuauagaagggcuggugggguagggggagucagcugaccucauacaugaucugaggagugcccguuccugugugcugucuuacauagauugguauuggaagggacagauggcagaugggaacgaagaauuugagguuagagcguuaggauuaagagucuccuaaggacugaugggaaaacaagccucaagguaaugaagaaagcgccagugguugcuuugagaagcucuagauggaaaggccuuaacuugagggcuaguugaagggcugguaagaaaagucuuugacccuaagcacuaagugugagcuuuucacuggacagauagcgucaggaacacugauggccuccagggggcagcagauuccagauggcacucagucuaagcagagagaguuagcagagagaguuagcaacuagaauucaagcuaagagggaacaggccaauaaagcccggcgaauaagagcagugcugaaggcaggggccagugacuccucagugaugggagaggaccagccaacaaaaguggacagccagcugcugcauucacacaguagguuuccauacuuauuccucugcucugaagguguauguccuuaugcagagguaugaacaacacaaaggacacuguugucauuacagauugguauuagggcuggagagucugggaaugcuucuuuggggacuuauaagacuggaagaugggaguaacgguucaagccucugagucuagaggugggugaaucagguuguggagagucuucauucaguagcucuuuucugaguguauuuucugucuguauuucagacaucguccuauguugcugagccugccaaucugcagaagguugaaaauccacgugaagggaagcucagcuuccuguaucccuugggaagagcugcuaggacuccggugacagaccuaugagcuggcuuuucuaugacauagagaaugaacagguuuuuccucuccugaauacagacagcauggacacagggugcaaggagggacuccucuagcucugguucuacaauuucuuagcaggcuuuuuuccccacauuugcucagaggaaaacgggaagaggcaccaucucagucccagagucaaaacagaaacgucuccccuuggcuucuuuaaaaaaaaaaaaaaaggcugaggaagcaggcacuuuagcuuccaggcccaaaaggacaacaugggaagacugcugggguuuggagggggauaucugggauaucugaguccugaugguuagccccacccaccuuucccuggugccugccacucaccugguuguggacaguggucagcugguuguuaaaggucauggucaaguugguggaugugcugggggccacgugagugaugaaagguguuuugcucugguucacugugucauacauauucacccggcgcuugcaaaucuccauguuuuggaaacaagauuugacacuauauaugcaaaagguggaggcagagacacauggacaagaaagagggugagguggaggaaggagagaaaagagaaagaaaaagacagaaugguuaauccaguaagcaaaacaaucaguaaauauccacauuagcgucaaauagcccagcuuuccccaagugugcugcugaacugucagcacugugugagcaaauuucccauugucuucuuguccuuuaucugcccuggauggacagacucccuuaucacacacaugcuucacugcaucuaccccccucccacccccccauuaccuuuucucacugcucauucuaaguguagugcuugaccaacgagauuaacucuccaaccaaggacauuaggagcugcuacaaccuacuucugucuuccuuagggacaacaugucuagccucucaccauucuagcaucccaugugcuacuagcaccaucuaugggucagccaaauaauucucccacccagggucaugaacuuaggcugacuugucucacuggaaccugucacgaaaugaaaacaaugaaagugguuacuaauuuuuacugagagcagugauauguguuugcagucuccuauucagucuuguaccauccacaagacagaauuaaaaucauuguuccauuuuuacaagugaagccaaaggucuaagacagauaaugugccagacaaauaaucacuaauuggcaauucacaccccuccuucucuuuuacacauuccuaacuuccuuauuccuuucuuguccuaauucuugucuaguuccaugaaguagaauucucuccuccauuuucuuccugaaucaaaacuaaccccuaauuacacaggcauuaaaggaguacaggucccggcaugaaggccuuuaguggccucuugaaggccuuuaguggcaucugccauuccagcuccuaagcauccacuguguucuacucacuucauaugcugcuccucaugcgcuucugccucuucuguuucuauggccacuuuugcucaagugcuaauauuuaagacaaagccucauuuaaucuaugauuuaaaaugucuguugcaauaacuggauaaaacaagguaacacuuaucuaucacuguauacuacagguaugcucuauuuuggacaaaauggauguuuguaggcuaucccagaauauuauuuucaugaaagauacauuccaaauuucagaaauugaaucuggucaugacccagagaguccuacuucuuucuaaguuaaugacuauuuacacuggccgcucgauacacaacgcauggugaguaaacugguaguccuagagagaagagaaaacaugcucauugguaaacaacagcaugccugaagguccuggugaguaccaagugcaugcugcaugcuuuuacauugagcugaagaugauaaaaugauguggaugcauuuuuuuuuugggaugcauuuaaagcauucagugauuuuaugaugguucaauguauaguuuucaggcuauagagcuuuuuuuuuuuuuuccucccuacacugggcuaaaauuugacuguugggauaagacaaacauuuuuacuuuggguuaguuuauaaaacaauuggcuuuuacaaauauguacaccaaaauauugguguagagaaaugagugguuuugcuuuuaccugcaaaaccuuaugcuagagcagcuuaagcccaggcccgcggguggggcccaaagcaggcuggguaggccugaaggcucggucccacucuagagcgcuucaaggucuucugggaaccuacaaauauucagcccacucuuagguaggccuagggguaaccugccuuucccgagggcugaccuucuaaguucuaaauugccauugcuccuagugaaacacacuacggaagcuuccuuacuaaacaaagaacagagcccugcuuaucuaagugcccagguuuugggugacugacagggcagaaggccaauaggagcucucugaagcaucugccucccuaaucccccaccucacuguuucccuaucaucuuucuuuauuccuaaaguuagaaaggcuggcuuuguggggauuugccuuucuucccgggggacagacugacaccuucuuaacugccuccugcugagaaacagcauagguguuauacuuugaguuuggaaggacugugugcacagucccucuuugcacuaggacuugacuguuucaaauguucccugaauuaaagagauacugucuggucuugccgugcaaguugacuuacuucacuaacugcuauggaaaagaacugacuuaaaagauacacuuuauggugguuguggcccacuuguuaagcugggagagguuggguccagccuggaaacucagucaaaucuaauuuuggucauaacguugcugacuguggccucacagcaguccuuaccccagguccugaaagagccuuuccugagcaugcugcugucccugcagaaaugugaggaugugaucuauucucucaugucccagugcaucacagcuaagguuaaggugauaucacccacuucccguucacagaaaacccauucucuuucucucauucccagaggccuuuccaccagguuggucuuucucuccaagcuauuuucugaguaccaugacuacuucaguagccauccugauaaccugucaaaaccuacauuuccuaccucaugaccuugcucucacccuuaucauuccuuccuugggcugucagcccuggaccuguuucuuaagacaagcucaagcacccuguuucccuggccucauucccuacccuucuggugcauuugacuauaacuauuaucauaacucucucuagaguugagcagaggacacucauugggaucuauugaguuuccuuucucuuaggugaaccuucaguagcuuccauuugggauuauaauuacuauaucaccagcaucuucaacuuccucauccauuugucauucucucugagcaacuuggcagcaauucaaccuggacaaacucaacuguuuucucuaugccuucacuuacaccaucaauuuaugcucggacccaaauguucaaagcucuacccgcuuccuucccucuccuaggauuacagcacuuguguauucccgcacacccaccuuucuccuauauuucucugguuaguuugcuaucaugcucugcuccaguuaccaggaccaacacacucucucuuccccucucccucucucugccuuccucucucccucccucacauaucgcuuuucuuauuucucucuguuucuuucuuaacauuccuuuuugcauguguauaugugugggagcauauucguguuuguggauacgugggcgugcauguagaagucaaagguugacaugauuuuuuuuuauuccuaaaaagguuuauuauguauguguuucugccugcaugaauuuaugugcaucaugugugugcaggugucugagaaggccacaggccacugaagccucuggagcuagagcugcagauggcugugagcugcaugagguggauacugggagcugaacccagguccucugcaagagcagcaagugcucugaauuguugagucaucucucuagcccccaaaucuuuccuugcuuuaacuuaauuuuuaaaagucuauuauguguauguguguuuugcuauguguuugucuguguacugcauauuugccugguguucagacaggccagaagagggcacuggauuccgagacaaaaguuaugguaguuauggacaacugccauguagguguagggacuagaacccagaucuucugggaaagcagagcuaccauggagccauuucuguggcuucccugagugccuugccugauuacccuucacguagucuagcuagcguguuugccacugggauccucuaucuuuaccucuugagcucuguuuacagguagaccaccugacauuuacagaccgauggggauccaacagcaguccucacagcuguaugacaaaugcuuuauccacugagccaccucuccaaccacaguuaucauguucugcauuguaaagccaccuuguucucaacagaugaugucaucaucuacuucugagacagaagcugucugacaggaacucccucaacuuuccucugcuauccugugcaccugcugacacccacgucucucccaccauaucaucuuuuagugacaggguccaucucuccacucagcaauaaacaccaacucaacagaaacuacucacaaguaaguaccuuuugccuugaaucucucauuugcuaccagauucuucccauuaguauuugcuuaaauuuccucauucuucaaaaauuuccuuuaguccaaugguucucaaccuuccuaaugcuaugacccuuuaauacaguuccucauguuguagugacccccaaccauaaaauuauuuucauugcuacuucauaacuguaacuuugcuauaguuaugaaucaugaugauaucugauaugcaagauggucuuaagugaccccugggaaaggaucauuugagccccaaaaggguucccagucaggcuaagaauggaucagagcagccauucucaagcucugaucucuccacagcccucauuucuuccuuccuuuucacagucucacuuccuguagucuauuucucugcucucacuuuaucuuucaaccugcccaacaaguuucugcuuggaaauggcugucacuaaguaagagaacugcaagaucucagacacuuuuuucuagauuacugauacagcagcagguuagaucugcauucaacacgaguccaaccagccauucaccugcuucucaguccuuuaacugcugcaucgagcuucugauaaaaggcaaaacccucccugagcacggcuugcucgagcgcugacuucugcagccucagcauguugcccccauuccuaggucugguguucagucaugcugcagaguucacacaggcagugcccugacuucucacacccaucuuuucccucacccuucacagguuauauucuugggucuucuggccuauugagcaagcuccuuguuggauggacucaucauaccgcauuccuuucuugguaacagccauugucuucuaucuucuucccugaagaccauggcuuagcucgaaaguacacagucuacuuuguuccucauuguacuccagugccugguacagcccacaguaugccaaagaaaugaagcaaacuagacaguucacucugggacaguuuugggacuaaccuuuggcacugaugcuagauugcuuuagagcacugcuguuuugcccacuucccuuugugcguugauauccaaguucaucuggccccaaaguccccauguuccaccauucccuucuuuuugguacaaacuguagucuucagcccaaccucgccccacaagugcucuaagugcuuugaugacaaggagauccugauuuugcuuaugugcuguaucuauagcugcuuucagcuauaacugagaacggagaugcagcguaggaaccagagggccacaaagccucaaauauuuccugucugggccuuuaaguguugcccuugguacaagcauaguaggcacuuacugggcacuaugggggaagucaagcaggugugucauggugacaaaggggugguucagaguuucaaugggagugacucucuuaucagcaucgauggucagcaucuucuuuaacaggucaaugaacucccgucggucugccuucucuacuaacaugucacucccuuccaaaucuguugucauguucaccuggaaguaagcggggacaggugaguaagagccauaggauaucgucugaucucaagcuccccaucucaggugccagaggguagacugcccgccaugguccugugugcugcuacuguccacgggugauggccucuuauacgcuaggaacagaauggcugcgggagucagguaccagguagggguuggggcagaaagaggccaccaugguugacaccugcacauacaucccagugucaaggcacaaagcugcuccuguuuuaacuggccacggugaagugcagcuuucaucacaccuuauuaaaaauaaccacgggaugaaggguucuggaggccgauugcauaacagugcgcaugcacuuaauucuccucagccuuacuuuaaaaaaagacuaagaugagacauuuuaugcuauauguguuuugucacaagcacacaacaacaauacacacacacacacacacacacacacacacacacacacacacacacagaaagcucuaagauaaagcaguagaaaaagaaaagauggggaaaaguguauacaaccucuggagaagaaaagagccuggguucccucuuccuucaucuuuaugacaucacccuucccuuggucccugacugugacuagaaugauuucggucccuguguucccugcaguugccucuggccagggaagagagugcagcugaacacaggacuuuucucccaaaggcaggucucuacuagcauggccucugaaaggcuuugcuuucaauguuugcuugcuuucuuccuucccuuucuuucuuuucuuucuuuucuuuucuuuucuuucuuucuuucuuucuuucuuucuuucuuucuuucucucucucucucucucucucucucucucucucucucucucucucucucucucucuuuccuucucccccccccucuuucuuucuuucuuucuuguuuuuuuucaagaggggcucuggaaagcaauuucaguuuccacagaccaucuaagcuacuaaucagcugacaaguguacuuuacucagaaccaggcuacacucaucugugcuaagaggugugcuaaguguuuauugggcuacagcuuuguuucucaguguuuaaaaggaacagucauucuggauugcucagaguuuggauuagucucuaacuaaaaguaccugaagaucucgaauuaucugugauggaaagguaaggaaggucuguagucgcugcuagugagcugacagugacugaguguaauggucugaauugggcuucccuaaaggcugaauccaaguccuaaucuguggaagcuaugaaugugaccuuguuuagaaauagggucuuugcagauauaaucacguuaggaugaggccauauuggauuaggaugguccugaacacaauaaucagugcuuuuauagcagagaucugacagugggagcagggaugacacagggauaacagccauguggaggguaaagccggauuagagugaugcagcugcaaguaaggaauucugaggcugccagagccacggggagcccaacacauggaugcuguccccuagggccuucaaaaggacuguggccuugaggacacugacaccagacgguuuuagccuccagaacuaugagagaauacauuguguugucuuauacccuccaguucacccuaucuuguuauguaggcccuaggaaauggacacacugagccaugagcaucaacuccaauaugccaaugggcuguaggucucagcucuggagccagugccugccuagcacacacaaggcccuaggaacaggugaacgugagguuccugguaaaacaccgaaguagcuaccccccaccaccaacuuggguugucugucuucuaccugaagacuuguuacuggaccuuggcaacucucauaguuauugaaugucaugugcucuauuucuagccuaagagccugcuuagcuuccaaaucccaaugcuuugauaguacauauuauauuuaaacuguauaggauucaggcccuuuuagcaccaguaagguuggccacuaccuuacaaacaagaagcaauacaauggagcuauuuuuucuaaagaguugguuucugagaccaaaugguuucuuacuaagccugucauaugauuguucauaagcaaaggcaaugagcauaguuaaguauaucacugcugguggguuuuauuuuuuauuuucauuuauuggcuuuaaacaaaaaacaggguuucucuacauaucucuagcaguccugaaacucacuauguagacuaggcaagccucaaccucagagauuccacuugcuuugcgucccagaguggugggucugaaggcaugcccugcccugcagcuguuuuuuguuuugcuuuguuuuuuaaagggccugugcugcauauucacucacagagcuuaccugggccauaucauccaaacaguugaaaauguacuuucuugcuuccuuugacuuaauucccgucucugcuucauggucaucuggugucuaucggagaaagcgaaaccuggucagucagacagcaccgcucaggucacugaaucucaagcuccugggcugcugcuuccacccaugguccuuucucacuuugcagaggaggagacuuugguuucucggaaaguguccuacacaagagcuccuuucucuguccauccacacuagcucaccuuccuuccgccccaggcucccacucaugcccacucugguacaguuaccaaagacucuaaagagaacaugagaccacacccuuccuacucugcagcuuuccauaagcugaagguaagauuccaccugggaagaccagagcccuuugugacaccuuaacauuuuauuuuacuuagcaaucccuuacaccuacagcuccuaugcuguuucaaggcacacuaacucacuaaauguuuuccauaaccacaggcauuaggaugacugcucuccucuuuuacuacauggaaacacaaaaauauaaaguucugggggacgaccaacauucccagcuuacaaguggcagcuguuuccagagcuuguauucuaugcugcucuuucaaagacauuuaucagcuauuggcuaggaaacuacuuuuucuacuugcuaggugguuuggacucaucaauggaucuaaggcaauuaauucuggauaaaggccagcacacuuuaagcaguucaaccccaaggaacaggugaugaggguccugguaaaacaccgaaguagcuaccccccacuaucaacuuggguugucugucuucuaccugaagacuuguuacuggaccuuggcaacucucauacuuacugaaugucaggugcucuauuucuagccuaagagccugcuuagcuuccaaaucccagugcuuugauaguacauauuauauuuaagcuguauuaggauuugauugggguccugucaaaccaaaccaaaccaaaccaaaccaaaccaaaccaaaccaaacuuaguaaaacccaauugcaaaacugcaaaaaugaauuuacuacagacuuaagucuuuauuacuaucuccuucccaggaaaaguaugucaauuuuaauuacaagacacaguuaaaguaaaagcaaaauauguuucaauuaaggugaagucaccaagaguuuaugguauccauuguccuggaugaagaucugcugucuucccagggguuugugacauuugcauugcaggcuacuuucccugccuuggaaaaaucccucuguacccuacagggcccagcacaaauauugcucccugcccuuggcccuggccuggcuuuuucuuggcucacuuaggucacgcuauuucccauguucuuuccuuuuaggaagaggauaguccauaugguagccuagagcuuggggcacugguccuguuucuccauggacaguggguuccuuaagagcagaguguggcugcuucaucuguuuagcacgaagcagacaugaaggaucaugagauuaaaucccagaaauucagcggucuucccaugggacacagucucucacacagcagugaggcaaggaagcagguguuuucaaucauucagauccugcaacaccuuguauucacaacucuauccuacauccccauuuugcuggcuagauuaaagucaucaauuuguaaauaccaaaagcucauuuuugucuuuccuucuuucacuauuaggccaucaguagaagugagggaguguuuuuccuaccuuuagccuccacaaaggauacggugagucugugucacgguugaaaaaccuaguugucuuugucccugcacuuaauaaauauucagcugguaaacccuguguuugugaaauauaccgaaucugcaagaaaagaugagaaagaggucagggcuuuuccugucaugguacauaugguauacugauggcuuugagaaaaauggaauuaauuuuagagaaacaagaaguaaaaagaaagaagaaacacacacacacacacacacacacacacacacacacagagagagagagagagagagagagagagagagagaggaagucaggauaaguuuaauaagugaauaaggcagguucuaaguaaaugguaaucuaagguuuucuggauggagagugaagucacauagagaauuccugugucacccagaccuaccugaucauacucagaagcaccuggguauaauggccagcccaggaacaguucagcaaugacacaaccaagggaccacaugucaauugccucacagaauggcaaaccaaggaugaucucaggggcccuggagagaaagaauggaagaaugaauucugggguaccuguguggggucuuuggucuugagagaggucugcauugcagagacucuccauucuuuggcuuuguuaucuaguuagaagaggauguaguuagcuugcaagugccgaucgaguaagggucgguggguggcaguacaacagaccuacagugaagcaugucugugggcaucaccaccaucacauucugaccacaugagcucaugaccugauaaccacaccacaaaugguaggaaguuagcuuuuguagcugaacaucuggaauucguuauaaagauugccuaauauuuaggaaggaauuccuaaacucuacuuucaggaauauguaaaaauagcugcucucacuuaaaauaaggcaauuaaguccaaaauccacucaucccaaugaucuuuguccuaggcauuuguauuacauuucuucaaggaaacacugcuauuacuuuucccaucugugucuaaaagguugaucucuauaaaaguucuuuaauguuacaacuauagaaccccauucaugaauagauagaucauccugagagucaaccagaauucuauuauaaacaguccacuccugguuguaggagcuaaugucucuguaauugacagacaaggccacauagaaauuucaaaggcauuuuaaagagaaaguacacauguauuugguaaccaagaucagaccacaaagucuuucuuuuaaguuuuauucaugugcaucugugugaaggaaugucacaaauguggggcaagagggcacuaagucccuuggaacuggaguuaaggcaacacuaaaucaagggacaaaagauuacaaacaugugugauauaaacacaaccaugagaaggcauguaccacagcacacaccauacuucagcagcuaccacuuuggaaaaacaaaacaguaugcaaggacaaagcuaauaaacagaagcaagccucaagcacacaucuuuccuuaauccucuccaaguguuaccaagacuaucugcuuccuccauaccucauuucucagagcaauggccuccuaaauguucccgccucuuaaccuugucugagaugcuccuacacucaugugccacacuagagggaucaggauggccugugcacugucguagucuuggucagcaucucagcucugugucuugagagcugccucucuucuauacaacugcccacugcuccugcuuuguuaggccuggcuuccuaggugccacuuucccauacccaaauuucuugccucuccauauccuuuccuguccauacccuuuacuagagcauccuccuucuuuguccaaaugcucuauguaccaucuucuuuucuuucuauucuuccccuacaugacuaucaugguuuuguguuuauccugaaugaaacacuggguugggggauauagcucagggguaguguacuugccuaguaugcacacaguccugagcucaaucuccaguauuauaaagcagguauguuggacucuuacuuagaaauaggguuguuguagguuuaauuaguuaagaugaagcuguaucauagaagguggguccuaguacaauaugacaggugucuuuauuaggacagggaaauuuggccucagacacugacaagauagccauaugaugacagagguggagacugcauuuaugugccacaaaccaaggaguaccuacauccacaaaaagcuagagaaggcagggaaauauccucuccuccauccuuaaggcccagcuaacaucuugacuuugguccucugggcuccugaacaucaacagaguagcugcuguuucaagcaguacauuuugugguccuuguuugcagcucuaggaaacuuugcacagcaaucaugccaacccucacagguuuagauuugacaucuaaaccucagucucaucuuaaaacugucuuuucaguucuaggcucccuagaucucuuugcaagagauccagguccaaucccuucaaucccccugccacccgaccauccacgugccccgguccaaagucuaccucaaaugagucccucuucucccucuccccugguauaacuuuggccucagcaacucuucacccggugcuuccuguuuucccuucccucaauaaccuuccaaucagcuuguguuucaaagcccucaguggcucucgcuguacucagaaucuaugaaucucucccauggcucaggcaucaacguuuccccaguuagggacccaguuugccuuuccacugucauuucaagucacuuuucuacugcaacaggcucuggugccagcagugucuuuucaacuuccagaauaccuugagcaccuccuggaccaguaggcuucaggugauguaguugcuuccaccucugugcucgccccauggcucucaaacagcuuccuccucaucuuucacagcucggcuuaauuguccccaccauagacaucuccucugacaccaguuaguugccaucuccagcaccauaaaugucaccuuauagcacucuccccaauaacauccuuacugucucucuuccucuacgaagcccgugagggcagcccagugccuggcauuuaguugccacuuggucaauacauacauguugaucgaauacaccauauuaaauauaagaagugugaaacacgaguuagggugggaguucugugcagugcagacaaaggagagggaagggguaagucuucacaaggaacuaagucugggcccugguacaggaggacucagcuacagauagcaggcacugaggcccaaaggggcaugugugugccagcccaugcucaguugcacagacaccugagcaagggagaugggaggagagccuguguguuuaucugcagaugguucaccaaagacugacagcaagaaaggugaaguguggaaaccugaaauuggugccaaggucucucacaguuacgauuucaccccucuuuuuuauuuuggggugggguggggugucacuguaccucuaaaguagaucgcuaaaauauaccaugaaguuguaccaagcucggcuuucacugguacuagguaaaugaaguaguccucaauucaugcuucuauuauaguuacuaacucagcucuugcuuuuggucucagccuucccuuucaugucucaaaggauaaguuccuuuucucugugcauaugaaaccuauuuuugaacuauuuuuuucccuuccuaucccuuccagucuuccuuacucaaauauaugcugcucccuuugcaucuacuaucuacaccaguagaucaagauguaaacaugaacgaaagacuggugcaagagauauucacuaagcaucugcugcccccaaaggacuaucuuaaaaaaucucucugauuagauuauuuaggacacuaaaaacccuuugaacauucaugaagugucaaauaauuacacccaagacagagaaaauaccuucuuauauccuaacauggcacuaaaaguucuucuuguuuuccuuccuuuuauucauggcagggagagacgucucauuggcuagcucacuauacagcucuggcuggcuguguacucugucucugaaacucacagacaucugccugccuguaccucuugagugcuaggauuaaaagugugcaccacaugccugguuaaguuguaguuuauaauaauaauaauaauaauaauaauaauaauaauaauaauaauaauaacaauaacaauaacaacaacaacaacaccucugucauuuuugacccaucaacaacacauuugccuaucugucucuuuuuaaaucucuaagaauauggucugggucucauuuaucuuagauuccaagcuagguacacuggcgcugcucuuucaguagcuguuugaggccccaggaaagaaagauacuugucaggcuagugaggaggcucagcagugaagguaucuguauuuauagcaaccugaguuugaucccuagaaucuagguaaaggugagaggagggaauuuacacuaaguuguccucugacuccaugugcaugguaugguguauauaugugcacacgcagcacuaauaauaauagauaaacuuuauuugaaaagaacccacuucucucuuuggaugccugcaaucuggggaaauauguguacucugcugugauuuuguacauaccuuguuccuaugaugcuagacucccaggcucugaguucaugaaggcucacucaaaacucaauucuaaaguucuuuuguguguguguguguguguguguguguguguguguguguuuagcuucccugucaguagcugcagaagugcccacucuuuccugaggcauauuugaccaggucacuccacacugggcuuuggcuucagcugcacuuggucucuuauucaaauguuuagccauucagugucacuaugugccaggcacuaugcuggggcucaggagcaaacaauaaagcaaagccugggggcccuuggaggucacuaucuaguuagaggcagcuucaugcagacagcgcagguauacuacauggaacguguacauauuacaugaagaagggcaagcugggcgaggaaagacaagagcugagaggucugagcuaaccuuguaccuggcaaggcagggguagccuccacgcacaaggcagugaguacuccucccccaugucacugcuguagcaccagugcuuaggcuguggacggucccauauaccuuucuagaagggacaacugugccaacagcagcacccagcagcucccucuggaggcuggcgacaucaccuuggcaacacugugacaagagacacucugcuuuggcucuuccagauuuaggaggcuugagggcacauuccauggagguuguuucuguccucagaguugugccaguacaagaaggacccuggguacacggaucucuguucugcagaucacucagcugacagcugcucuauacuuacacugccauggugccaccucaugcaaccauuuuaaagacucucacuacuauuuuggggcaucaaaaauacuuuaaacacauacaugaagugucagacaaaauugcaccuaagaaagagagugauuauuccuuuccaaugugacccucauaagauaccauacauuccauuuucuaggggagguuagaaaaacaacugucacuuucaacacaucagugacugaagcuuuguuauuagcuccacugcucucuugacagugcacauaaggaauaaguuauucuucgaucagucuagaccacgugacccugcagaggcuggcuuccaagagaggugugaagacugcagccaggagcccagugcacauggguccaauccuaguauuuuuuaaguacuggccauauaccucauucuagaaggaggggccagaaagaagguuaaauagagcauggcaggaaguaccucacaaaaguucuaggacaaucaagcaauucuaaauaacuuaccuauuaucugacuuaaucuauauggcaguaaucaaacaaaaagaauacccuuuuucugguguucuuuuuuggugcucuggauccaacccaucguuccuucuccucaugugaaagacacccuuuuuucuucacauuagaagucacagccacagaccucucaucucacuguagaagcagagcucccuccuauaacccgucuucuacuuauuuggucuaaugcagauggcaauagcauucacagagcuacaaggcagggacugaaggcagcacuugcccugcccugcccugcccugcucugcccuucggguagucuuccuaucaauaugguaguugagaugccagagugauacccugggaacaaaacccagggaagaggucugaggaucuaaucgaggagcugacccuguguguacucacaacauucauuguagcagaggucugugcugcaggagcugggcacacacccugcucauuccaguguccuuggcuaaccacuggcccagagucaaguaucuugcucuugcccacagucuaugacagagcaagggcaagguucacaugcauuucugauguaaguguucagccugcagaccauucagagagccuggggagagcugagcacgucugggaaaaugcuacucaauuucuccaaguuuuauuuuacccucuauaaaaugugauuauuaaucucacuuuuuccucuugucuguauaguaacuuaugaagauaaauuauggccaguagaauuauaaagcaguuugaacuccuuggaagcaagaaacucuauuagucccugguauuuuauaaucacugauauuauaagguguacucaaauugaacugcagugaagaagucuguucccacaaauauaugcagauugaaaguaaccucgauauggcuggggcagaagcaaucaaaauguaaaauuguauuucagauggguuguuaaaucuuauguuucuauugcaauacuaaggagacuuggcaaugcugccaugaguucugagccacugcugagacugguggccuggaauggaggcaugggacuccaucaaagccacauagggcccaaaaaauagcaacagaaaucugaaggagaaggcaaaucugagaggaacgagagcucauguagaaaacagccuucaggguaaagacuagagaacaccuuaggguaccacucaggaugaauauucuuggaucacagguaaggcugccaggagaacuguccagcauccguagaaaugaguucaaacuguguccaggaagucacagggcggcccaacuggggauuuaaacagugaugcaggccuggguagucucaggccaaccagggauuuaguuuugaaaaagauacaacuucuucagcaaaccagguaggggaggaacugauuugucuuugauuaaggggaugaguagaagguaagaggaacccaugggugagggucuaagaucuaaacacuggcagauauccaccuggaccucccguuaugugaguuuauaaggagccaugccuggaaccaacucaacugcuggaaaccuugaacuuuggccucacucuccagcucuaaugagcugaagaaccaucacagcagagauugauaguagguuuugaguccagaagggaagcugaggaaacccuacuuagccuuuagguaacagcuugauacagcagacagagaaaacacaaagcagagaucuccauguaggaucuggggccacugcucaaugcucauaaaacugugaugaugaggauuaagaccuucgagacccucgcugaaaacugguuuuggcuaucaccaauaaaaaugcucaagacauugaaacagccuuguguccauaugggaaggugacuuaaucacaguuuggucuacauguugacaucugucucaugccacacugggacagucuccaaaggacgcuggcuuucuugaucucacuggccauuuccagcacaauguuaggaccagagggguagcuauuuuuauuuguauuggcagugagccucuuagcucugaaugagauuuuuuccaagugugcacuaauacacauguauuuucuaugcuaauccuugauuccuagggcuacuacacuucugccaaggacaccaucaaaaucaaacucuaguucuguugcuuacauauggaagaaaaaguugacucugggacacaaacugaauauaacacaaaggcaguaguauugguggacugaagccagcucucagauuucuaagguagauucugacauuagccuugcaguuuguuuguauguacuaggguagguaaaacaaagcaaagaauacagcuugguggugguggcacauuccuuuaaugacaacacuugggaggcaaaggcagguggaucucugaguugaaggcuuagucugguuuacaaaucuaguucuaggaaagccagggauacacagaaaaacucugucucaaaacuaacaaacaaacaaaccaaaccaaccaaccaaacaaacaaacaaaaaagaauacacaaacagagacauaaagucacuuaaauaaagcuaaauuggcuugacauuugauaaacagagaaagaaguaaaaauaaagacaaacuccccacucuguguguaucucacugagaauguuccuaggaagaacuagcuuagaucuuuucuaggaagagccaccaaggcucaucucagaagcacucagcaccccuggaauuccuagaauccucaccucccuggcugggcuaagcuuucauugccuguuucuggccuggguggccuacguuuuccaauccugucucugguguugucaaagguugcaggagagagcccaugcagggcuacagagccaccuggaugggcuuuauguuggugccuuuugccaaaguauacgcucaacaaauguuaguagauaguuacuagccagcccaaggaaauguuaguagauaguuacuagucaguuaguagauagcuacuagucaguuaguagauaguuacuagucagcccaaggaauugaauucugaggucugcuaguauccacauagugcuuuguuuuacacuuauaacuucaggugcuuucaacaaguaaagaauacuuauuucauugagaaagacagacacaaagaaguauacaacaaugccuaggaagaugucucaaaacaugcaggguucuauaccccccuucauguuugaucccuacuacccagauaaaaacccagaagugguaauccucauuugcaaucccagugcccagugcaugugggaggagagaggaggauccugggguuuucuaauuaaccagggauuuccaggcucugucucaaaaaaaaaaggcaggcaugauauuugaaguugauuucuggccuccacaugcacacacaaaaagaaagagagggagggaggcaagagaggaagagagaaugcauaaauguggguauguucaucccauuguacaccuaccuaucccacacaacugcauacacacauacacacacacacacacacacacacacacacacacacacacacagagagagagagagagagagagagagagaaacaaaaaauauuagaaagcaaagacaacuacagcaaagagcaccccagaaugucaaaccccucuugucuucuacauacuguccuuucuccucaaagggccuugaaaccugugccuguaugccaaaggcacacaaaaaaugggugugagucacauuggugaaauggaccuccggccucagcugucccccgucgcaugaaagucaagauaagguaggucugacagaacuggaaagggcagaacuaagagacaaagcaaguggacagaacaugcacaugggugacaugcgucuuacaguuucuucugcucaaugguuuccuucugcuuuguuaacuauguugacugaagcugagggcuaaauuugugcaguuauagauucuaaggggacaccugcugauucuggaaagggccaacucaaacaucucugucaucugccauggcuuucugagggcaaucccucauuccucuacccugaaagggaauuugaaauuucaauuucugaggaucaacugcacauacagcagcaucucuauauuuggccuggugacauaucaaagcuaccaacagagugaaaaucugaugucauggcauggaggggcuagcuuuuuccaugucaaccuaguagucaaggcucacucucuaccaagacagugauauuaccuaugugucgcuuugcugauuuaaacaucaacauucacacugcucugacauuuagcuuugacugauucauucugaguacucaguaaauguuuguuggguaaaugaacaugagccggagugucagugcuucccuucccacagugcccugugccugggcuggagagaccucugcacuccaauucauagacaagggacugcaccauagacaaggcucauuucucccacccuuaucuggucaugugauuuguaagguuaaauggcaaagccacuauuuauugcugcugauuagggauaaaagagaggguucugacacuagaaacuuauucuuugaaaaggagguacauuuggugucacugacuggaaccagaccaauucagagaacagaagccagaaaccugagcuaugaaaaagaccccacugagcaugauggcaugcacucuagagggugaauuuccacugcaguggcagggagagcaucagagauuuccuucugaucacuguauagugaguggaggauuaccagaaccaagggccaaagcuagcuagcacccugcagagcgaguucucagcagaaacuuggagcuagcugauaggguauauauugacccaguaaaaguaggauguggcuaucuccaagcaagcaggcaugugugggccuagaugggacauggagaugaggccagcucucuagggaaagugcaaaugauccugguuuugccagaaaaccaaaccugcaaaggggacucucaagagcauguccuucaagacuacagcaguaaacacccauagaacagguuucacuauggcccacugucuuauaaguaugcucuccugggauuugcccagggccaggacaagggaagagcucuugcagcuauaggcugguugccucaacagaaguuaggaacagggguauucugcugaauaagguggguacaaacucaagccaagggcaacuuauuuaagagauaacuuucaauauucaugugcuagggaaauaaaacuaaacccaaauuugcuugcuuauaucuuaguuccacaagaaaggcucagcugucucuuuaaaucugccacuagggcaugcagaagugucgcaggcagguaaucugaaugucaucugaaccaucaccucauacagggauggauggcauugcuguccccuggugacagcugcugaauccugagacacccacagaaaacuaagcagaacacagcagaucuuucuguuggggcaagaugcugaacuauucccccagguggaaauaccauugccccuuuuccccauaaacugcagguuuuauuuuaacaauugggccucuuuuguaaucuaagagcugggacugcaggccuuuggaaaggagcaacacucggcaagagauuagaauguucauuuuguucucaugaacaccaaacauuccucuagcagagugagcuaacugguggguacuggaacuaaggaguugcuacacuuggggauaagaaguagagaggagggagaaagggauuguauggcaaggcaauauggagggcugaaaggcugugcucuccacgaaagccucccauuuccugucacuuccuucaucaccuccagcacaguuuugugucuuuggaaaaugguuuuuuguucccuccaggacaauccccucaccaaggggaugugcuuuccucuguccucccacucacauuagaacuguacccacuuucacugguaggguuagcuagucagcucugcaccuagacuggaagcaccuuggggccacaggcuccacauccuggugucagugcaccuugcagcaccccgcagagccuuacacacaggaagugggaggugugaacagaaccgcuugacuuugcucacgugaugguugugauggugaugguucaggucagcaccucucuccuaccauaaaaaccuagaaauuguucuaucacacuaaagugauuaugagaggauggagugagaaugcacauucugauuauuuuugaggacagaagggagagggagugauaaugggcauuucaaugagggaaauuucaggagaaacaaacaaacaaaaauccugcuuuuagcaaaaaucugaccaagggaauuuguacaguuaaaaacauaugcauaaacugauggggugguaggaagaaagaacauaugugaacaugugugcacaccacacauacacaucuaaagaugaagaaacaguaacaaagacagagggagaagacuaaauggaagauuaaaaaggaucaccuaacuacuuuuccaggcaauuugauagauuugaaggaauggccaaaauccuaguaugaggaacucaguuuucuugcuaccaaagaauaagaguuugcaauagcaucugcaccagcaagugguggccugucaccugucuccugagaauagaaggaagugucugcaugcauguauucaggccuguuuuggacucccaagagaccagaaauuccugagggagacagaacccacacugguuuccuaaggaaguccuggcaauguucugcugggauuagcacugugcacagcagguacuuaguaccaacugacaaaaggagccaaacucagaggcugcaguugaaaagcucuaacccaggacuguguaguucuuuuucauuuagccucaacaacugacaaaaagagaaagaaaaauaacaacccccuaauccuccaaggauucgacugagaguugauucugaagcuaaguaaaaccuugccuuguuagaaauuuggcuuggauaaaaaucccacagaaguguucgugguugauuaaccuaagugcucucucagcaaacacacgcaugaagaagcccuggugcacauacacaauggauguuuacucagucggaagcaaugaaauuaugucacuguaggaaaauggacggaacuggagaucaucaugucaagcaacagaaacccaacucaggaccagcgcuguuaggaggcacucagacacauuaaguuucccuggacucugaagaaaguaggaaacagaaaauggguugauuuacaguuugcucaaugggugugugugcccaauguccucccaccaugccaguagccaucuuacaauuuuuacaaagccauaagccaaagguuagaacauaugcaaauuuagcugugagagaaguuaacaagccccucucuaggggaaaagaggguuuggcuccagauggccuccauauuacucuaagaauauuuuaugcaaguacagauugaggaaaauggggucuuaaauaucccucauuuuuuaaagauaagaguuucaagucguugugagaacccauuuuuggccuuggagaguuuccuguuccuaaguccauuuguacuauagguagaaaggguuucuguggugagcuuuggagcccuuacgaucgaucucuuccuuugggcacaguccucacacuggucacuauccuccaggcuuguagcacugucucugaucuaaguccccaucgcuccuucucaucugcuucaaaagacccuauuguuugguuccagguuuggggcugcccccuccuccuggguuuggcaucaucacuguaugcuauucccugacuguucugcuuggcagagugaauggaugacacugggaguuuuccuuucccuguaggcauuguguucaauaugggcaaauauuuguguagccucaguauugugcauuaacacaaggacagaaucauuagugauuagauuuuucuaugggaaacagcaaagcauuggagagaaaguaaaccccaguggaagauaaaaaaugcuaagggugggcaucuuaaaguauuacucagaaacaaugugggaaauggcagaauuguauuuccucuguucuucuaaagggaaguucaggagaaggucagaaggagaacaaugcagaccaucuaucacacagccucuccccuagaacggucccuuacacacugcagucucagauuucaauucuauaauuauaccaccccccaccccauccccaucuccgcuacagaaugcucgccaccauggccuccuuaauuauauauuucauuuccauuuacuaacacugggacuugguggccacugccagggugggcccauacaauguucccucucaguuacauauacaaauguuacagaauccauacauguugcuaauggugaccuucaaucaucaacuuuugguuuuguuuauugaacaaacaagaacuagguaucaguuguggguuuuccugggggaaaccauauugggauaccuuuucuuccccuuaacaguuucguucaagccaaaccuuguuuaaggauacaaaagguggucuugaaagaggcuauagcagcauggggccugagguguagguguuugagagcaucagcaacacccacuugccauguucuuugaguugguggguggaucagaaagggaguaccagaaauggaugccauggcagacccugggggaacccuacuccuucaucuaacucacauaagauggcacugaagcuuuguguaggagacuuuggauuacagcucccaaacuggucguuccgcuugcucugcuggcugcacgcuaacaaagaauagucgaggaacacccccauagaacagacaggggugagcuaauuagcacuccaucugggagcagaggguagaccccaagcugucacgcuaaagcagugguucucaaccugugggucgagaccuuuugauggccaaaucaccauuccacaggacuugcacaucaaauauuuauauuauaauucauaaccguagcaaaauuacaguuuugaaaguagcaacaaaauaauuuuaugguuuggguuacuacaacaugaagaacuauauuaaagggucacagcauuaggaagguugagaaccagugcucuaagugaugguaugagcaggauuuuaauuuaaaaaaaaaaaaguacuuuagaauguuccagagaaggcauuugugggaaugagcuauacauucaggggauuuaacaucagcggguggucccagaaacguuaguaaaugaaacacaaaucacugugauguguguguuauucucuuaggucucuuuggaaaaccccuuuuaguguuggauuguguuuauaaagguuuuacggagggacuucugggaacacaguggugacaggcagccucugagauggccugugauagucuacauccccuuaucugguguuccauuauaucaagugggguaaauguguggaaucgauaagauaucacagaaauaaugaugugugacuugugagauuagucguaaaaaggcacuggcuucuagccuguugaguuuugaaucaccugcuauuggagcaagcaguggccauauugagaggauaaugagugccugcuagcaggcagcgccagcuugccagucacaagagugagccuccuuagacucccgcaagugucaaguguuuauagcccuagcuaagggcucagugaguacagucucccaagacugggccaggacuaucugagccaaguugcucucaaguuacugacccccagaaacugagaugauaaccacuuagugcacaagccacuaaguuuuaaggcaauuugucccacaguuauggcucauguccaugugaaggaaugcuaugcuccuaggagagcagacccuguacaaaagcaacucuagauuacucucuggucagcuucaauggaacagccuggacacaugugcugugcuccacucagucccuauucugacuggacuuacuuaaauaucuucuccuaaggagaacaaugaugcuagaggcuuuccaaacacuuuaaagcuggcaggaccaaacuuguaggaagaaggcugcaacuugcuauccuacaggaaggagccaacagagauauuaacaaauugaccugcauaaaacuuaaacuauuuauauuuuuuaaugagaaaaguauuagcauauacuaguuacauauaauaauggguuucauuguggcauuuccauacauguacauauuuugaccauauucaagauuuaauucgacuuauuuuauuuuuuuagauaguguuucucuguacagcccuggcuugucuagaacuuaccuguagagcaggcuaccuugaacucacagagaucugccugccucugccuccugagugcucagaguaaagaaucuaaacuuuuuagcauugagaacucaggugguacuaccuaaggguagggacuuccagcuucucaugaaaauuaaaagcucaggcaauucuagggcccauauuuauugacagcaaugaugaucugaggaugguggugcugcccuuucauagaccccugugugccacuugcuguagcugcaucagcuuacagcggcaccaucuggcucuacuggcacuugaauucucagauggauaggagagagacuagauguagggagacaaguaaaaugucuaaaaauaaaaguuuuuauuuuugauuggcacuuuagagaguuacaaaauuaguuuucuuugcuaccccccaccugcaccccauagcugcuaucuccccuccccuccaccccuguagcuaggcugaccuagaacucugcuauauacuucaggcagucuuuaaauucuugaucuucuugcuuuagccucaugaguucugggauuagauaugugccaccaugcccuguacuuucaaaauuauuuuucuuugacuagacaaaaagcugcccagaggcaagaggccauuuaaaauuuagaaaguauguaaaacaacuacugcacuuuacauuaaguagcaugcauuuuaauagcaacguuuauucaugaagguuuucuuauguaaggccucugcugagaggaaguaugauguuccaucuugcgacaaucuggcuuucuacuacaacaauaauuuacaauaacagaagaaagaaaggcucuggugccacagcucugugacuaucugcuggauucuucccuccuacaagacagaauaauucuuuucuggccuucucccaguuauguauuugauaaagaauuauaaucaguucuuagaguagcuuacucgggaauuaacuagccagccacuggauaacugaugugaacaauccucuguagcuuuuacaaaacucuggaaggagaauguggcuaacauauauaucaugcucuuaagaaaaccauguccaaguggccgagagcucaacggggaaaagaaaagagaagaccuuggguugcuuacaagucacucaaggguaguuuucuauaagagugggagcaaggacagaaugaguuacccuguuccccuaagcacagugagcauugugguaaccucaacugcccauaucuacugagcuuccaguacauuugagacucucuguuagaggugguacuaagcaaugguuucuguuuucauggauuuuugcaauuggagugcacauagcaagugauacauggaggaaggccagaaggagugaucucuuuuuccacucaauaagcaauuaccaaacauccacuaggcacuaggcacuuaguauuugggcauccacaagaaagucuuuguuccuguggugcuuacacuccagaggccaccagggaaugcugccacugacuagagagaacacagaacuuaaggggucaggauuagguaggcagacuucagugcugaaagagaacagagcugcuggugagaaaguagccuaagcaaagguagagguggggaaacaaaaagaauguuuaagaggacaaggaagggcgugggggccagggcagugcaaaggcaagugauaccaggguggaaacuaucuugguuauuagcaccacaguccuggguggacaacagcuucuauuuguuuccacacuuaggaaaaaaggccccagggcaucuucuccaagcaggaaggaguaagcacugcuggaaaacacagagcugaggcuuccuaaagcuguaccacggagacuugaugaggcagagcaagcgcaagccuccuguaccagcacacagagcagucugaccagcagacuacagaagcagugaguggccucuuuguaaagacaggccacugaaaagcccagaugacaagugaccaaggacacgaucuucagugcuucagaaccagcccgagauugccugcucuguccgaugagaucuguuuuaugacacauuacacaugggacaagggaaguuuguuucucuuucuaagggugguagggguagggagguagggguagggaauacaccugcugcaccucugggauuuuuuuugcaggagcagugccuauguagcugaguuggccagaugacaaagucacagaaaccaagaaugauuuuaauugcacuccagacaggcucacacuccuacaggccuaacugcacaagcuacacaugaaaguuucugugauacaaaugugacucuucaaguuaaauaugauuacaagcaaaucucuggguguguucaugcacuuagaauggcuuugaugugacccccugcguguuuggagccugucaccuggucucauugucucugcuuuccauauuuaugaagucauccaggcuuacuuccagguggggcagauaucaucaagaaauacugaaaauccagaaagagcagagagcuggggugccaugugcaaauuuauaaguccaagaaauucuaauuagcaaugacaacaccucucccccaaaaaccccuguguucauuuugauaucccuagcaauaucaacuccaaaccuacuuggaucacccacucaguguuuuggggggcaguuuacaucaagagaacagcuauuaauaagugcugcuguugagaucccucugaguggaaaguuaaacagggugcuuuuuaauguccuugccaacagcagaguucuuggggucaggcgaugcuucccucugaucccaugcagcuuccuauccacaggcuacagagagcagugacaacagucucuucacacagagacaccuaugcuugggaggcacucacuuggauuacaaagucucucuaggaaccagaguccuaagucuggagcuaagaugcugaugagcaagucguugaggucucaggaccuaugaugcuguuaacagcacccaccguucaguuaaguagugacaucuacgguaaaaugcaaaccaggagaacagaggagaagucagcacugcgagaacaaacuuuguaacacgccagaucgagccagguccaccuuccacuuggauugaagacauuagccccagggcaaaggaagcuggucaggagcccggggaaggacuucacugccucuucuuccaggugucuguggguggcaggugcaugcgaauuugcagagugagucugucguccuugccaguagcaucaguuuacccuacauugcagggcuucaucuuaucacuuaaacgugcucacuuuucucucucccuucucugguucuuccaguugagauagcacugcuugcgcuguuucugcucugcucuucugacacacugcuuuagccuuccuucaucuuugaaggaaccccacaaauccaacuggaggcaugaggggaaguguguuacuggggaccuuaccacuguuuaauguuauuauaaucuuaaaggcagagacuccauugucccaguuacagagaaggaugagaauugaagguagagcggggagacagguccggaggcuagcugggugcuacagagguaguguaaggacacccacgcugacuacacacuugagaagcuacauggcugucacuauccaccccuccccuuaggaccacacacuguuucuggccuauagcuuugccaugcccccuucuuugauuaacuggccugcugucuucaacauucucucaaaaccuucaagguuuguaauugagcaagcuggcucucuacugccuccuccugcuacucuccuuuucucuggcuccuucuuguggauccuguuccacccgccaugguacaugucacccucagcuggcaagugccauggguccagucucuacuggagucuuaaagugaacucaacaucccccuccccucaccacauuucuccuaaaggaaccaugauggucuccccaucugaagucaguaagaucgacagugauccgcacuaucacauuugucuccccuguaucaugagacucugcuuucuuccuuuuuucaucuuccuuuuuuagugacauugaacuucugaucauccuacccaccuccaaagugcugagauuauauauagacacacugggauuauaugcaugcaccacacugucuaagauguuuuuaaaauacuaagguaguacuggggaccaaacccagggcuuucuguacaccaggcaagcacucuaccaacugaacuucaucuguaccccuuugcuuuugaaacaucccucaaagauacuggcuccccaucugcucucauggccucgacagaucuuagagauaaccccuggggacuucuguuuccagccuuccccauuuccaaucaauuauugccugucccuagacuuguuuuccuaaaaggguuuucacugcccuacuuccuuccucaagcaucaacuugcuuaucacaggaaauccaaguucuauuuacuugaaagucccucaaacaacuguucucuuagccuaccaaguuucccucuggguucaauuuccaaugucgucuuugaaucugaucuucacugugauuguuauauacucuggugcuaccuucucacuccaccuuugugugaguucucucucucucccuuccucuaaugacagaauuuuacauuuccuucuagcagucacugcauggccucauucuaggcuugugcccucaaugagagccucacagugaacucugcugccuuaaugccgauacuccacaggauucccaagugccgucuguuaagacuguuucagcuccacgcguugugauccugcugugggaauggcuuauguuggcuccaauggccuuucagacauggcuggcaugauuuuucacuuuacugguuccucaaguccagacugcaccuacaggugaagguggcuuuucucugaguauggacgagcucuaugcauucugccugccacucaacaucccuggugauauucucacuugaauggauccuucuggcuuguuggccaguagaucuaugcagucuugccccucucuauccaaacuucuguuucaagucuccucucuuuccuucagcucacuuuccaauuaaccuaacacugucgugggcacuccacuguuucuaggugcaggaguuggucucuccagcuaagcugcaagcuucucuaugaaaauccauggcacuaucauagggccucaccaaaacccacuuacuugccuuauaucccucuauuggcuaccauuuuccuagauguuccucaagaggucuacaucaguguucaaagagcuggcuuccaaagcaagcucuaacuuaccuacuuugugcuuguauuccacaauucuguugagaugaaacaccaugccaauaagcaacucauggaaguuuauuuuggcuuaggguucuagaugaaucaauguggugggguggcacccagcaagugucagucucuugcuggagcaggaagcugagacagcuuuaaacucucaaggccucuagcggacauacuucuucccaaaaggcagcagcuucugaguccccccaaauagagccaacuggugaccaagugcucagcuauccaggacuaugagaggcauuucucauucucaacggcaacuuuuguccucuaucugaaggucugaguuuucucuagugcaaggugcucagaaccacugaccuuacauauuguaagauguguaugcauauuguaugugugagaaacuaagagacagacaauccccaugaccauuugggcuacaaccagcuccaaguuucuaaaacuguggaaaccccuaauuaagaaaagagcaccaucccagccaguggacuuggucggcuuuuauagaaaagcagcccacccaaaagugaugaauuggagcagucuagcuccaagucuagcucacuugcucaugcaaaaaaaauaugcgaauagccaggcuagaaaguaagugaugauaagccaaacauuuucaacuucacugaauucuguucauggaauaauuucuaugugaaaugggaaagcaaacuuaaaauuuuuucauagaaauuaauauaaugacaacaguacacacacacacacacacacacacacacauauacauauaaaauuuuaucagccaaacguuaaguuuuccaagaacuuuggcuuacgaaaggcuucauuccugggaagagauggcagagcuccaguggauggagcaggucugguuggaacaguggauggggagaucuucuuugcacauuucuaaucccaaguagucauuguuacacccauuuccuaccacuuccuucaggcagaaccucaggaagggcugaacuguuuguugauuguacacuggugggccagacuaacagccugccucagccuaggcuuacuguacacacuguaggcacacaaaauaagcuagggaccuguggucuuugggcgcaugauaggaaguucaccauggcugccuucgagagguagggguuugcucucuccuggaaguuucccuggcugaggaaggcuggaugcugacaugcaugcuaguaccuugugguaaugagacacuaggcgugagacagacucccuagcaggcagauagggagaggggccaugacuaguaguaaagguagccagccuguuccuuacccucuugacuugagacaaaagcuugguagcuugaaacaaaggccuuguaggcuuuugucucccacuagcaggcccuguugaugggcuggcucacugaguucaaggacauguaacacaacauuucuaagccaccaaaaacaaacaaacaaacaaauccuggcuuucuucaaacugaccaccuuaaauaugggaaggaaaacucuucggagguuugagagggguauaacgcaucuuuccuuaggauugaucucccuuauaacagauccauaugcagcuuuacauguauaccuguauauuuaaaguaagaacuauacuuccccgcacuuacagcuugaauacugaacugcuccaauucaucacuuuugggugggcugcuuuucuauaaaagccgaccaaguccacuggcugggauggugcucuuuucuuaauuagggguuuccacaguuuuagaaacuuggagcugguuguagcccaaauggucauggggauugucugucucuuaggaaauugaaaaggggacgguugggaaggaggaggcccugggaaaaauggcaaggccuuugggguuucaaaugcugcaggcauccuagaaaaguaaacguagacaguuucugguuguuuuuguuuuuuuguuuagagccuaaaaauaaguaagaguuacaugagcaggguagaguuugccuacuguguucagcacaaggccuuugugucuuccauguacaucguguacaucucggagacuuuaaguccucuuuucaaaaggaaaugagggagauaaacaacacaaguuuacccccugcccagguagcagagacaggcuaguucaucugggguuaacccaagaguccaucuuugggauguuaguacugcaaggccuucuucuaucugugggucagacuccaacccugcaaucacuuguucucagcagccaaguguuuccaaauccccuuucucuggcugcguucauucccuguucacaguccuuucagcucgagauaagaaugggguaggaagcaccuacagaggguuagccaaacacgacauaaaacaaggaaagaauuauuuugagaaacagaguuucucuggcagauccagugacagagaaacucaugggccucagaucuuggcaggagaugggaaaugguaugugcucuaucaggaaagcuccgcccaguuuagaagggaaacagaagcuaaaaagaccagagcacacaaacacuagugucuccuccccuagcuugcccuuccacauuccagaggauccuugcucuaacagacauccuuugguuggggcuacuggugguaugcugagaggcugauccuggaggggugaggugaagucaccauuaauguuugcugacuucuuaggcacaaauaccaccucuauggucaacuucaagggaccaauaauuuaauugcuagcucacaaaguuucugauuaucuuauaccuagcuccugcaaacugguaaauaucaggccuaguucagucuguaaaguauuuauacccuagaaacccuggauacucgcuuuagauccaucacaagaguccucacuacagcauccuggcucaccacacuucaaaccuguuucauccuucccugaggaguucacugaguccauuggagggauguagacuaaaucuaccuggugucugucacaugacagcuuucuauguauuuuaagauaguugccacaaacuuguaucuucuuaacugcauucuagacaaacaucuccucuucccacuuucuuaacuacccuucacaucaaaaauaugacugugccagaucaagugaauauaagaugcuccauguguaacauacaauacuuauuacuugcucuaaauucagucaugggccauauuaggauguuucaauagugauaaacagauaacaugugacagaaaucccuugggguuauauugucuagugaugcugucuucguuuacuaaagcacacccuaugguacucacaaaaucaccuaaggacacguuucucagaaaguauucccaucaguaagugacacagacuguuucccgcacuugguccugagcuugcguuaucacagucacuugacaaccauuugauaguaaucauuuguucuuacauaacugacuuccucagcuccucuucccgaaucuuauaaugugcuucauaauucaucaggucucucccguuaacugauuaaaaggaaaacaugcaaagacucuacuguucucauuaaauguuacaagguuagccuggcuccugagccacugagaacguuuucagccuugacucuaucgacaaggaucuuaguuaucuucccgaagguuuuaaaaccuacaaaccugaagaacaaccuuuuacugccuuguucaagcaacuccuaaaggcaggauccugugguacacuacaaggcuccagaccuaacaauucuccaacccauguucagucuccaugucuccaucucacucauaggauuucaagcaccuggcaggugccucacuggaauuuacaauaugccuucagcugggaaguaacauauaaccucaaggauuugccuaguauuuuccugccaggccuaucccucaagaagauugugagggaaauaagugggauucaugcagcaugccuauuucaguguggucaggcaagccgcugcgauauuucuauagucacuuauaaacuuccugccaacaauccccacugaagauuccugggaaccaguggcaugccuagguccuucuacaugggaagcuuuccccucauuucccuccuuaggcuagucagacguuccugaaaugccacuuucuuuacacacccuuucuucccaacauuccugauacccuaagucuugacucugacuuucauguuacuuuggggcccuagcucacuuauggcuaccuuaaacauuuggcucugcuuucgggaguccaacucuaucuacuaucaguuauaccaaucccuacauccaccucccuccacccagaaacuccuuuugcuuucugccauuuaaauuucccacuggcacuccaaagugcauuccaagucuccucuccauaaaguuuacucuccacuccagaccccaucuacuucauacagcauucacuucacuguuuacagucauggguuuuacaacucaguaaacuggauugacgauuacccaauucugcuccuucugccuaaaaagaaauuuacauccacggaugaggaauggcagggcagaaaaggcaccaggccugaguaugaaggacagcucugccguuaucagcugggcaaccuaugggcuuucucaacugacaugaggcuuggguuugaaacuauacuaaaaguucuuuagaagugaagaaggggcaaaaggcugucugagcagugaagcugggagggacuuuaggaaaggccacuguaaacaauggcauuuauaacugaggaccaaccaauaaaacaaaacauuuuaaauagcuggggcuggggaagugggcccagcaggaacaaacacaagguguaagaaucuaaccuuaggacauugcuaccuguacacuucccaccuuugaaguccagagccagacucaggaacuaacuaguccagagcuuccuaaaucuaccucucacuuccucuaaagcuuacccugaguccuuccccagagcuguccuucagaaaucccagaaguggacucagagccucuguaaacuaauguuuucuuuucacuuagcuaccuggcuccaagcagacuguucccagaggauccuccuuucacaucaggccaccuguuuccaaggggaucuuccuguaaacuugcuuccgugaggacccugcucuuacacuugccuaccuguuucuacaagguauguucaucccaugaggcccuucccucauacaggucauuggauuccaugaggacccuccccucaguuccgucccuucuagcuugucuaaaugaagacagucucagcaguuaguaaucucaugcugccuucaucuucucccucuccaauggcaccuucaccuuucuuuccaacuauuccagagcauuguuuuacuauaauuucccuuuaucuucacagcacagcauggcucccccuuuuuuuuuuuuuuucaguacuucucuuuagaggauacaaagagcuacaccucugcuggucucugaucaguaaucucagguuauacugccauccuaauaaguuuuucuguugucuucgcucucucucuaccaguaguccuuugauuucagagcacuguuuccuuugcucaaagcauaaaugacugaaauguacuuucugguccuaaauccucccuaacucuaggaugcaaggacagccuaauaaacauucacaauguaacaacacaagcagcccagaaucccccucugaucuugucauagauggccuguugacacuccccccaccccaacacacacacacacacacacacacacacacacacgcacgcacgcacgcacgcacgcacgcacgcacacacacacacacacacacacacacacacacgcacacacacaccauuguaacaaugguuugcaaagacuuaaaaaugcgucuggcuauuucccagcaguuggucuucuuccuuaucucacacccagugcuugcuucccaaccuuugccaccagguucuccccacagucccuacuccauuacaggguccuccuggcugccacacccaccuccuaauguaaacuucuacagcccaggaauugggcugggcuccccacuccccccacccccagcugcccuucccuguauaauccaaccauuuugguuaccuggcccucugucugcccuuuaccaucgaggccuuuggucuggcuccccccucucccuucaccucccccucacagggucaggcucuagacucucccuggugucugccuguggcugcacucucccacauauccacaauaaacuuucuuucccaccaucccuaggagcagccauguccuuuccuugugaauuuacuuuuucauccacuaaaugcuagggcuacugagauuccagguaugcaccugucuggcuuaaaucuuuuaaaaucaaagcccagcagguuuguuuuauguaaaauaucuuaauuuacagugcccccccccccccauuucuuaguugccgccuuagcuaugcaugcacuaacccgcuacugcaggcugcccucacacucagacuccugucaauucccaguccacuuauccaccugccuacccugugaacacacacacacacacacacacacacacacacacacacacacacaccugaagagaagcugcacuugcagagauugauugauugauugauuagaauuccaguacugaaaggcugcagguccagagacuuuaucuugggcuacuuuuagccuuccagaacagccauuccuugccuaccgcugugucugaacuaacaucuugugacuaacaaaaaccauuuggaaucuauuaacuuagcagaccacuggcuuucaccaacccgaaagcuaaggaugccaucagauagcaucugaggucuaaagaaaaaccuccuccaucuugccauaacugauguagccaccaacuugccuucauuuauguaugacuuuuuuuuguucuguaaaacuauaaaauuucaugaaacuguuuccauguuggaacauggaauuuggggaaaucuaagguuguguuccugggccauggucacucaaaaggaccccaaaauaagcuaucucuuauucacuuucagaugagagaugugguaugugccaacaccacccaccuacuucuacuaaaccaucugauuccaguauugacuuacuuagaacugcaaguguucuuuagucuccucacauuuucaagugaguacugagauaauguuuuccuguguggggucaccugcuuaguaaacccuacccagaugaccuucuggugagaauauccauucagcaugcuguuugugcacugugaauaucugccaugugaccuggucaccugcagcuucgcagauggucuucacuuguugagucuucuguauccagcuauaagcucuucuaacuaguaaaaaggaucucucucucuuucccucucucucucucucucucucucucucgccuuccacccccacccugugugugugugugugugugugugugugugugugucugugcaugaguguauguguguguguauaaaaucccaggccuguccagauggugcaauaggcucuggggaugggcaguuucuugguagccagaagccaguuucuagaaggaucaguaauuacauacacuaaaaacuauauccuagaaaagauguuaugguaagcauauuuuuguagauugccauuuuuacaauaaugucauggcaucccugaaaagcagugauuuuguuuuuuaaucuucccuccuuuagggggaaaaaaaaaucaaaaugaggaaaaaaaccaacaacaauagaaaaaaaggacaaaacaaaaauaaacaaagacagagagucuagagucgguaggaugccaggcuguucucuagucccagccaccauucaacuuuaggucuucaagagacuugaaaaggcaggacuggcacgguguguguccucuaaaacagaaaugcaagaauggcgaguguugagauccacugaaggaucaucuucucaagagccaaaggccgggagcaaauguuaguuuacauguuggcaaauaccaucuucuuccuuaagguuuuaacugagcagauaaagcagcauggagcaacuguccuccugaggagauccucaccugggguagguaaggaacacagauaaggacgucauacauggccaccgccacuuguaaagugccacaaaaauaccauaauagaccuuauuuuuggugaucuugcauguaauuauugaccaaccccuucuagugcacaugugugugcucacauaaaacauguuagaaaagguagcaaacaacuuccuaauaaaaacuaagacuaaagcuuaggaaaaccaauauauacaaaagcuaaaaugcaagcaucacacagauguguuucccucaagucuuuaaauauacagcuauaaucacagcauuuguacggguuuucgguuuuaugugauagccugcacuuauuuuugcuagucuuuacacucucaauccagagccuaucaauuguuaacaucuuaauuuucuaacuuuaucugucaauugcuguuugccuucaacauucaauuuuuacuaaaaauagaagaaauuauauauacccacauuuuucuguuuuccuuucuuuucuuuucucuuucuuuucuucuuuauuucuugacuuuuucuuucuuucuuucuuucuuucuuucuuucuuucuuucuuucuuucuuucuuucuuuaagauaggggucauccucuuuguagcccuggcuguccuggaacucacuuuguagaccaagcuggccuugaacucaaaagauuugccugccucugcuaggauuaaagguauaugccaccacuacccagauauucacaugguuuaagaaauuuauaauauuuacaguguuaugagauuaucagguaaaauggcacaaacuacuuacagcugccaguaagauuugcugaucugacuuuuacaaggaucacauuauuuuaaaaucaauuuaacaauuuuugaucuacuccuugugacaacuagucaaacugaaaagugacacuaaacugugcucagucacugcuuuaggauguuuagauaguggcugaugcuucagaaacagccuugacuuaauggcuuuuguaauuaggagacaaagaaugagcuguuuuaaaaacgaauugccagauuccuaggaaagccuuuauucauguauauaacacccaaaacauauuaguuagcuuccucacacuagaacaaccuaguuucauagguagcaaguaguggacauacuguauuuuacuuggaauuaucuuuuaggugagagugaagagaccauuuauuaacaagugacaaauauuaauuagaaucaacaguaucauacaauaauagauaugcaaaccaaagaaguuugauuaaugugcaauauuggaaacagucaugaauaacaguuaaacaguuauuuaacugggugucuagucugacauucuuuacuucaaguucuguuaaauaacuuaagacugauuagaagaaauuaacaaauaaaaucaauccuauuagaguuuaauauuacucauuuugugaugaaaaguuacacaaauauuagucagagcugcuugaacugaaugguacuaauuauuaaaacugugaaccauauauuuuaauacugcaccaugcacaaugaauauauacaaugaaaucuuucuuaaaacuacauguuggcuauucuauuuaguugaaauaaaacccugcuuuguauccacaugguuaagguaaaaaggccaaugaauggauuuuauuuuacuuuucuaaacacagccacuuauaggguuggccuuugucuaugggccuuucaaaugucaaugguauuuuaaaaauaaucaaauaaccgcagaagaauucaugcuacugcacugcuucaaccugugccuuauguaaugcagucaauuuacugaaggaagggccaguucaauuuuccuaucaaaaccaaaaaaaaaaaaaaaccaaugacauggucuuacaaagcucuuucucugaguuaaucucuuuagcccacaacuaccuucucagaauucagggcuuaugauuccaguggagaguggccuuuccagaaggaucauggaaccuucuuuccuuccagaagccaagcucagcccuguuggccagggggcugauguguauacagccugcucuuagccauuucaaagguugacauaaacagaagccacucucucacucugaggagugaucuggcaggggagauaaaccaggaagggagauaagcauauugugacuguacaugaguaaagacagaggugacauuuuaauaagacuauucuucuuugguacacucagagaucauaaaacaacaacuuaaauuuagccuuuaaagauccauauguggaugggaaaugagagugaaauaaauuuuacacaaauuaucuguugugcauggcuuucacauggacgacaccuggcugaccauaugagcacauaaaugcagagggaaauuccugucucacugcacuguuuccuuacaauaauacuguugcaguagacggaaagugauggaauaagaguacugaagcccaguguaaucaaauguaugugcgcucguacacgcacgcgcacacacacacacaccccuaugacacaaugcuaauagaaauaaaagucuacaaacauuaguguguuagaggacuugcuacugaugccagucauaugaaggugcgaucaagcacaggugcacacacugccagguggcagcagugguccacaccuuuaaucccagcacucaggaggcagaggcugcugaggucagccugguuccaggacagcuagggcuacacagagaaacccugcuucgugggcugggagaagcaccuacaccuacauccaaagacaauagcuuuaucuccuuccugggccacccuauuuuuaauguuuuauuugcagagaugccaagacagccaaguggagcacaaugaacaggcuaacuguauucuuuccuaggucuacaagaggguuuggcugaaacaucucuuaaauugcuuucagacauuuggcaaagugagaacugauacaacaaaagcuagacauuucccucucucccuauugguuugagagguuggcuucgaaggcugcuucaccacacaaugaaugcuauacacugcuagcugagggcuguagaccugugaaguuccuccaaaucugcacuccaaguuaagaacacaaauguccugcucagcuauucaugaagcacaagaaacaucaugcaauuguugaccacugcuguugucugcagcaaggagcaucuggcugccacaucugcauuccugauauucagaacagagucguuaaggcugagucuaaguaucuuuuaguuuggaguacaacuugaaaaauaaaacuuuuuaaaaccauagcuugaaauaaugaacugaaagagggauuuuucucuagaaaaaaauuaauagauuuuuauaauacuugagaacaaagcauuacaacaagcauucagcaaacggacccuggcuucucaaacaguagcaugagauauaaaguaagcaucagaauccuagcacucuggaggcagagcaggcggaucucugaguucaaggccagccuggucuacagagcaaguuccaggacagccagggcugcacagaaaaacccugucuugaaaaaccaaaaacacaaaaacaaaacaaaacaaaacaaaacaaaacaaaaaaagaacaagaagaagaagaaaauuuaaaauaguaauuaugccacagacagguuuccagaaaacaucacugauaaacucuguauuuacagauuuacucuaacagaacuguuaacaugacauuuucucaaacaauggugauugcccugcacugaucuguaugccagacucuauaaauacugcugaauguagaucagaaaauuaaaguuguuaaaaacuaucuauauaaucugugccuauuccaggacuacagcugauaauaaaguuuuaaggaagugaccagugcauuuauuggaaauaaucauaagcaaaaucuaggcauggaaugcuaucauucacauggaaacauaaagaacugcuagcuacugccauuuguguacucugugguuuguguacauccaagguuuauuagaguggucucgauuuuuauuaauuuacuuacauuuuaaguuacauuuaaucauuuacucuguguguguguguaagcaugcacaagaagaggugcauaauacuacagugcagauguggaggucagaagauaacuuauaaaagucaguucucuccuuucuccaugugggucccagggauuuaacucauguccucagacauggcaacaaauccuuuaccugcugagccaugccacuggcuccuugguuaauuucuucuaguuugugucuauaguuuaucuauucauucacucauucaagauuccccuaauaaagccaggcgugguggugcacgccuuuaaucccagcacuugggaggcagaggcaggcggauuucugaguucgaggccagccuggucuacagagugaguuccaggacagccagggcuacacagagaaacccugucucaaaaaaacaaaaaaaacagaaaaaaaaaaaagauuccccuaguagauaugaugugugguaugcauugauuuagauacuagagacaguauagagcauagagagaaaggagugcacucucuuacccucauggaaucuacauuccaacacgagcacuuauagacuugauuccuaguuuacuaauuuaaaaaucaaaugcuguuuuuauuuaaguuggcaugaaauuauaaaguaucuuggguaugaaacaccugucaagauuauaaaaacuggagaaauucuaaauauauuaaccaagaacugaaagaaagaaagaaagaaagaaagaaagaaagaaagaaagaaagaaagaaagaaagaaaaagaaaggaaggaaggaaggaagaaggagagagaaaggaaggaagaaggaaggaaagaaagaacaaacaaaagaaagaaagaaagaaagaaagaaaggaaggaaggaaggaaggaagaaagaaagagaagagagaaaggaaggaagagggaaggaaggaaagaaagaacaaaagaacgaaaggaagaaagaagaagagaaagagaaagagagaaagaaaggaaaggagaaaagcaaaagucaauuuuugcagacuucagaaugggagcauuucaacagacauuaaaaguaacauuuuuuauuaacuuugaugauuaagaucaguaaaccagaaucacaauuuauuuaacauugugaacugucuucaacuugaccacccauuuucaaguuaaaucauaaagaauuuauacuuuuacuguucugaccaugguaugauugaguguucuguaauuuacucaguguccuugcaaaacaauaauaaguuggaacaaagcccacaggcaaaaauaagguuuaacacugcuucaaucauuaaaacaaauauauuaauggcaauuuguuagaacaggaagucccagugauuagacccaagaugaccuaaaaagugauguuugaaacuuuuuuuuucccugagaaaaaggggggaaccauccuaaguuauaccugaaacccaccugcucuggagcccauggggaaaagaacauagacagugcacugagcaugagcagaaagaugcuggcugcaaacaaagucaagggaguuggcugguaacaugaaagucauggugauacugguaauggugucuugcucuuuuucgugcucugcccaucuccucuucuucagaguaaaccagguuuucugggaaaagagguucugccaccaucuccacuccuagcuccccugucaucuuccacugcuuuuguaagacuaaguggagaaagcauggggguugaagaagcuccuggagacugaggucugggacaggacaugugugagggucucuguggcuggguggaccuguuaccaagugcgucugcuuccugugggaccuuccacauauggggccuccaguguggcagggaguuuggggaagccuggcuuuuucugauuuauuucauuucuguuguuucuaggaaguugccagaaaggggcuaaaaacaugcugacuuuugguuuggugaucuuaagcguaaauagaauagagaaguuaagauuaauuuauuugaacauaauauggauaauaaugaugccaauaacuaaauuaacguggcauguuacaguuuuauugggucuuccucugcuuuagauacucauaccuauuggagauguccucuuuuuuuuuuuuuuuuuuuuuuuuuaaaucuaaaaugaggccagauuccaaacaacuaaugcaggaaaucaaaugcuugggucuuuucaaucuuuaauuuugggggcuggaguaugugcauagauaugagcacacauguggaaaucagaggcuuacacuggauauuuuccucuaucauuccccacuuuuuuuuucuuuucuuuucuuucuuuuuugagacagaaucucuucagugaaccuggaacucaaugaucuagccauccuggcuggccagaaaguucuagagauucaccugucuccaaaguccuagugcuagguuacagguguguccgcuguaccuggcuuuuacaugggugcuaggaauccugacugguguggcauguacugugcccacugaaccaucucuaaagccccaauuuuuuauuucuuuaaacaguaagaaaaguuaaacccgauccaccccauaaucagcauccaaacgcugacaccauugcauacacuagcaagauuuuaucgaaaggacccagauguaggugucucuugugagacuaugccggggccuagcaaacacagaaguggaugcucacagucagcuaauggauggaucacagggcucccaauggaggagcuagagaaaguacccaaggagcuaaagggaucugcaacccuauagguggaacaacauuaugaacuaaccaguaccccggagcucuugacucuagcugcauauguaccaaaagauggccuagucggccaucacuggaaagagagguccauuggacacgcaaacuuuauaugccccaguacaggggaacgccagggccaaaaaggggaaguggguggguaggggagugaggguggguggguauaggggacuuuugguauagcauuggaaauguaaaugagcuaaauaccuaauaaaaaauggaaaaaaaaaagaaaaguuaaacccuugucuauaugguauugccuagguggguuaagggaagagagagcccuaagaaccggcacaguccuggggcaggaugagccugggauagcaggaguuuagagaaagcacugccaaaggauuucagaggcgaaacugcacaagcuacaagaagaugaaagaagaauggacuccaggcagaaugguucuagucaggcuuaagaagcaaacuugguguaccaacauugguuuucuggaacaaauggaagaaaaauaagcacagccauaauaaucaauuaaucuucuguuuuaaacuucaguugcuagagcuaauuaacuauuucacugagauuuuuaacauuuaaaaccacuaaagaauauuacuaaacaaaacucuauuugcauuccugaaacuucuauauuucacagcccuuagacauggucucgggguuccagccccagcccucuacuuccugccacccagacuggcuccccacugaacagcugucuacugaccagauuucagagccaggaugcuucagcuucugcuucuaucagucuugaaaccaacacugggauaaacgcucucaucuugaguguauuuauccugugucuaauuuuaguuuuauuguaucaaaaugacugacauggguuuaacugcuuugucugauagauguuggugcaucagacugacagaugcucacucuuacuguuauuagccugauguauucugacuaauuuauagaacgagagaggguauguuuucuccuacacauccauccugcucaguggcuguaccaucaucaaacauucagaaaggaccagcuaugugaaaagcauuaugcuaaucccugagagcacaggagugugagcgcagucccagccuucaaggaaccuucgggagggagacaaaaaaacacauuuacacacagauggcaggagaagaauagcaaaggugggcucagguacugucacuuggggcccaagaacaguuauaaaggcaaugucaccaggaagcaagcaacacacugaguuaaaccugacuguuuaacucagagaccacaaggacaaagcaagggugugagaaagagcuugcagguggaccccgaugugggugacaugaacugggacauugagccaggcuguuucagauacgacuuaaaggauauucuguguucaaagauaccucaacugauggcugcaauaucuuuauaggagguuucuuauguccagacccuucccacagcucuauucuacucaauuacucucauauuaacuuucccaauuaggccaguccuuggucaacagagcaccgaguaagcacuggugcuuuagaacaccgcccggagguagcugcacucgucgucguugccuuauuccucuacagcggaauccagcaaacugucugaaaaguaaaaagcaacucagcucagcaggcuguauaugcuguaacuccuuucuguggccaacuauucaucucugccuacacaguacaaagggcuuaggaggcuuagaagaaggacuguagauuccaggccaacccugucaacucuacccuaucaccaccaaaaaaagggcaccgagacaguagauaaaggaauggauauauggucauucugcaggccuuacuuuacuuccccuggcauggaauucuaggcucacccaugucaauuuccuuggcugccuacucccugccuugcguccuuaagcagucuucaucaucauuacugacucucaccagaucucagcacccacuacaucuuccuguuugcccugcugcucuucaagagauaucugccagggaccuccuguaugcuaaggacuaaugcugguuucucagaguggaugacaggcauuuuuuucuggguuugugggcauuaugacagaggcagggugacaggaagguagaagaccugcuguuugguucaggacugaugccaaguuccccuuccuuucagccaccacuauuccuucucucuacaaucaaacaccaggaagaaagggugagcagcacagugccaggaaaugccucccacagcuccuuguacacugcauacucuaagcacacgugcuacauugaacugagagaaaucuaaauuauucaugcccuauuaauugauauguaaguacacauuucaaaaucuuacuuuuucguuuuuugagacaggggguuucucuguguaguucuggcaaucuuggaacucuguagaccaggcuggccucugccucccgagugcugggauuaaaggagugcuccaccacugcccagcuccuuacuauuuuuuaauguauacauuacuacauuaggauguaaggguagacuucuaaggucuaugcccauaagggaaaccagaaauaaacacaagccugagguacacacacauauauauuuguauguauuuauuagccaauaguaacaaugaaaugacaacaguaugaccacccuccggcugaauaaaauaccuuuuauuuaaacagauaagcaauuaugaagauuuuaggcuaaggagaaagggcuacuuuuagcauauggaauggagcgaaagaauuauauauagauacacucacaugcucggauguauccaucuuuaaacagccuaucaaaacugucuaacacacugcuggcuauaaaugugcuauaccugacagggagaaaauuccaugaaagauuauaaaagcuugcuagaagcauuaaaaauuuccagccauuucauuauuugucauucagcaacuguuaauauuacuuuuuguauucuuagugaagcuugaaauuaacauggcuuuuuguuuauuucuucauuucugcacccuugucagcucaucucaggaaugcaguuuguuagcuggcuuacugcagugccaaagagaaagcuugggaagcuuaagccgacuagugaaaggcucugcaugaaaacacauuugcguuuuaaccucucagaagcagagcaguuaacuuaaaauaaauauuuaacaucuuggugcuuuuaucaagacucguuuugacauggacauguuccccagggaacaaagucuacuggaaaaaguugauugaaaagaaaaggugaaucuagaauuuucaaaggaaaaccaaucuccagaaaugcuccucccuccaaaaaucauuaaucugaauugaacauaggcuuagcauuuugaagucucauagggaaguagucccaggcaaugccucuucugccccagcaauguuuuuguugugugccugccuggcugcugcccuacccugcuccacccccauagcuauuucacacauggauccugauuuacacccaaggcaccuuauugcccaggaagcucaagcaagacguagaucuugauaggagagcuaccaaacacuccuggggcacagacagggcagcaagccauaagaagucuggucauccccugguagggaccauuuauuaaguuucuuuugcugacuucacuccuuccuuacacagugccuugaguuuugagaggaugacauuuauaagggguugcuggauguguucugaaaacuacagagcuugacagauaugaguguccgaugcccccaggaacaagaguggucagugaugguaaccaaaauggcuuugcuaaaugguucaaauguagcaaagucauaaacaaacaaacaaaaaacccaaaagaacccaaaccucucgggauaaaaugguccagaauuuuucagaagacagaauccugucucauuuaauauguacacauuuaccugagcuuccuauauuccccgcucccagaacaagguauaucuuacagguaacuucgcauuuggguguguggccaccugccagacaaggcuccgcagaaugaccugaauauaucauuuuaagucuacucccauaggacugucaccggaccagggggccacuaaguuacacaggaacugcaucuaguuuuuccugccccaugaacuuccuguaaagagcauggucauacuguauucaucucuccuuuuuuuggcacuaacucacuguagaauaaaaucacgcugagucacagcaugacacagccaaucuccaucucuauuuuaggcacauuuuacacacaggagcuggcaacacaccuuuccugauauaaacacagcucugacggccugcaaauuucaacugggucagucuugcugcauuauuugacuuacuugaaacuuuauuuaaauuuaguuuuuguuugggccaauuuugaugauaaaauuuugugcugcaaaacugaggacaggcuaaguggagguggaggaaggaggguggacagaguggggaggagagaggagggagggagagaagagggaggagggaggaggguggaaggaggagggaggagguggcccuguuuuucuggucccuccaaauggcuuuauuagcugauuuugaaaguuugcgguacauuuucaaaaugcucaacaccccacaauuaaaccaaaccacaaaucuacuuccaaagccaaaggaugcuggauuuuaaagccaaaaaauguacugggaaaacccagugguauacaccccuucuucccuuaguuccucucucaccaaaauguguguaaacaaggcaggacugaaagacaucucuauugaaugcugaacacuaugaaaggaaguaucucuguuucugggaauucagauucaacuuguuugcuuuauacgaaaauuaaggauguaguugccaccaccagagaacaccuuuaaagaucucuacaauaaaagcucccauacuuuagaaaauuucugacuuuccaagaagcauacgggauguagccuggauguuuaugugccaagcugaguaugcuaugguaagcucuuuucuuauggggaggagacuagaguucccuguguguagucuuccagcauuccuucuucauuccgagcugaggaugcuucuaggagccucucuuggagaugcucaauugcucuugacuuuccugucucagccccuaccugaugagacuuuggauuuagggcagagccaguguucagggucagguacaauguggcuacuacuccagauucuaauuuuacuugcuauggaguggagaccuuuuagaguucaguccuaaaugaugucagcaguguuaucacccaccacauacccuccuucacucacacauacacucauuuauuuacucauaucuuccacugaggaccuacaauaagcacuguacugcuaccagggcacugcguaagauccacaccgaggcucaagagacuucuauuugaucaagaccagauaaacaugaaauuaugugagcagauguuagcaaugaggguccugcugggguacaggacaggcaugccaauucugccuccuacaggaucuaccuaggcugcuacuucucauagaagcuuccccuagucaucucagaugugucugccccagccucuaggucccuuagcugaacagggacaugcaaggcucuugccuccacaagaaucuguguuccuucacagcaggaucugccacuuuccccucaucucugagccccuacuguaccuaacauccucucuggcaugugucagugcucgcaaauguuuacuguuguuccaaguauauucaaugguaaaccacagaagugagaccuucugaguacuguacugaaagcccacacacacccauuuccucugaagaccuagaagacaaaggcagggccucugaacgcuagaccugccaagcuacaaagaagcucuguacuccccaaagcuuuugcuccccucucuagccucaucccuuaccuuuugaauggugacggucccuuccugaggcuauucagcaucacagagucacagauggggaaggcgagcagaagucccaucuuuuuugaugaaauaucaaggcaaugcagggaaaggaagaugcccuuucauuccagagaugagacauuuucacaccacgagcucacuaacaacuugcacuggcuagcaaugaaaacaaggcuauacaauauuuagcauuucccaaaggccuguaguuucagauagaguccaggcuuugaccuucuuuauggucuuucugacacauauaugcuuuauguuuuagaaugaagauacagaaagaucuguguuaauuaucuacugccacauaaccaaucaccaucauagcuuaaaauaguaguucuguagguuagagauucagcaguggccuagcugggcgauaugggucagggucugucaagaagcuauaaucaagaugcucccuuuccaaguucacuaacacagccguuggcugaagaucucaguucuuccuuaugugggcuuuuacagggcugggcucacaaugggagacaaggaacaggcaccaaggcagaagccagcauagcaucuauaaucuaaucuuugaaguacuaugccaucauuucugucagauccuacagagcccacaaaucagcccugaauacuaggagaugaggaccacugggagccggcuaccacaggcauacucuagcaauggcguucauauaucuucauuaugauugguuauuuccuuuccaaagucagacagacaaauggacagguagguagguagauccauaacccgguauuauagacucaccaacaaaauuuucaacagauaguuuuuuuuccuccuauguccuuaaaggacuacugauacauuagaaagaaucuguaauuacaaaauagggucagaacuuucaaauggagauauccaaaacuuucuuauugugagaaauggcauuaaguacauucauuucauauuauuguaucuucaucuccaccuacuacaucuaagucuaauggaaaucauacauaccuauuaagcaauaacuccagcacccguaaccccugguaacuacuguucuacucacugucucuuagaaucauacuauuugucuauuuguaucucaccuucuggggcaugugugugugugcaaauguauguguguuuuuauuaguaaucaaacccagagccuugcguauucuagguuucagcagcccaauuuccuuucuuuucaaagugugguagcauuuuagugugugugugugugugugugugugugugcacaugugugugcacauguguguuuauauucuauuguauauaugcuauaugcuauuucuucauuaacucucuuucuuuaaaaaaauuauuuauuuuauguauaugaguacacuguagcugucuucagauaauccagaagagggcacuagaucccauuacagaugguugugagucaccauguaauugcugggaauugaacucaggaccucuggaagagcugccagugcucuuaacugcugagccaucucuccaagccccucauuaucucuuaauagacacuuugcucuaccuuuugacugaugugaacaaugcugcugugagcauguguauucaagcauucuauaauuauaaaaaccaaacauauuugaacauguuaaacaugagugagcugaaggaugaagaccuuccugccccgcugguagacaguccuuggccugccugaggcuagggccuagccuagugaucguaggcaauggcuacagagaaaugcaguuuuauucuauucaaaugcacuggggggauuggagagaugguucaauugguaaccauaaaacccaaguucauauccccaaguaaaaguccuaagugguagccagcauccaugacuccaguggugagaguuggggaaggcaagaagacaggcaaauccuuggagcucauuggccagccaguuuaaccagucagugaguaccauggaguacccugcuuaguagagacccugucucaaaacacaaaguggaagaguguugaggaagcacugugaugacuacugcccuccacaugcaugugcaucgucaugcacacacacacacacgugaacacauauauaaacacacauacuacacauacauauuauuaguuuaccuucucaaaaauaauguccuauuguaaaauacauguuguuuuuuaaauccaaacaaacaaaacucuugagauaaggaaauuuuuuaggaagaaauguugacucuuaaaauucaacugauaccugaguaugcuguuauaugccuguacuucuaguacucagaaggcaaggaaggaggauugugcaucccaggcaaggcugggcuacaaagaguguaugauccagucuuuaaaaaucauaaaauaaaacuaaauaaaaaaaaacucaguuaauaguucuaaacugagguggagaauucaaaaguauagaaauaauaaguauauaacaaaacggcucuucccuucucuccaguagggcaacauagcauaccaucuugccuagaaaacucuccuucaccuauguuagccuaauguuaccucagccacaaucaaggacauccacaggaagagcucuugaguacagaccugucugccauggucagauccuagaagucagcagaguucacauauagcuuacccaucuagaggugaaucaagcuguggaggacuguaaaguuucauaaguaauucaaaacucuaaacuucuaucccuuuagaaagcaguuauaacacucaauaacauacauggcaaauaucugucccaugccaagugggauuagaagcuggggaugcaggauacacuacugaagaaaacagacaaguauaacgaacacagaaaauuugguauugcuuaagaauuuggguuuuaccaaaggguaggaugugugcugccucaaucaguacucagccuguccaguccaugucuaaagucucccaccaggcacagcucaccaggaucaacauggcaaaucucuggaggaaauccuggauuucucauaugaacaccuuaagcaacacaggaccugucuagaaaccaagcccucuugcccugaauuaaacaacauucugguucaaacuguuuagauuuguguuuacuaauauucugaagcaacucugggcccaguacacacauaggugggagaagaauccagacacuaaauggauuuccaaaagaugagcaaaaacuauuggagagcagauucuaggguacucuacaaagcuguggauuugagcgcagccaaaguauacaucuguucuuaagcaacacacauuuuuguuaccuugccccacuguaugaugcugccaaggcuggcaaacacauggcacacugggccuggagucacaucccacagggccaacccauacaacacuccacccaucgugcauccugccaagguccugaccaaguaggugguggaacuaacgacuuacuugcugagagaugaucccuccuugcacugucuuggcccucaaagcuccagauccucauacuuuuucuacuauuaucaguuuuaggccucuccugugcugggggagacuacuagcaaaugauaucuuggccuuuaauagcagaaacaauugagagcagccagacuaaaagagagaggggaaggucucaaaaaauuggccucucaccuccucaccuuuggggucuggggauaaggucaaggcuagaaggucgaagcugguggcugcugucugguguucuuccaagagcugcaugaggggcaugaucccaggggagugucagaggacuagcugcuucuagucuucauccacaucucauguuagcaucaaaucguucccaaaauaauguguuaggacagcauuuguguaucaaucauaugauucccucgacuauuuuuaacaccagagauaaguuccuguguaaaucauuuuccuucuucucaccucccacccaaccaacauucagucagcaaacuuaaaaauacuguccauuaaaggagaauucucccacauguauauauaauaucuccaggacuaaccagcaacucauaaggcauguagguacauuuaggagcuaaugcauauuaaaguauauuauaacaucauuuccagucucauuaaagcucagaccuuauauugucacuacaguuccagcccugacaguaauggucaauagagagaaacuuaaauuucaaccuuuccuaauugucagcccccagguacagagucaaagcuaaagauuauucuugucagagccugcugagugucacacugguuagggcuccaauguacccagaaacuccacaguguccuccccaaaaguagagaaaugggccuuuggcagguuggucugcccuguuguuuugaaaacauagguaauggggcugucuaauucagucagcacagugauguuuaugaagugcuugggacugagguauagcugguguaaagugugccauccucaaauuauuuuugguaugugcucucuuacaaaaagaaaucaccuugcuauccaauuugaaaugaaaauaaauauuucuugugaaagagcucagaacucuuuucaccaaacaucauuuauuauuagcuaaaugcuaacuuucuuggagacagacucaucauauccuaauuaccauguguuggcaauggguuccguacuugaccuacugcagggcuaagccccaauuggaccuacgaucuccccaucccugaagaaaaauaucucugcucugagaguaauguguuaccucacauguaaucccguggcucagaacuccaaagucauagcuuauacuuuguuagagaagagucaggacuaauuggggccuagagauuuccaacuccaaaauuagaaaaugagaaagaggcagaggagaaggaaugaguaaauaaacaugagaaacagagcuuuugcaacagggggcagggaugaaggcuuucagguagcuuuccaugcaggacaagcaggguauccaugauugccuuccuuacucaguaagagcucuuguccaggacuccagaggaaagccugggcccuugggcuaagaaacagccaagaccacaggcuuaaaagggcaguaagcaaaauacugcagagacaaacuggguccaagaggacucuggaccacagugcuggacuacaguucauuagugaccauacauuaaaaucugcuuuccaaagagcaucucuaaucaauuaguggcaugaguguuauuuuagacauagagucagaggaugaagaaggcccaaagcagagacauaagaccugccuuucacagggccagggcucucuccaucugauacuuggcucacaggucuacaaacuguuaccugacgcucugguagauugccuugggccuagagugaauuugaugaaaacuggccagauaggaaucucuugaugaaggaauagguuuauauaauugccaagaucucuuugggggccccagugguaagauucugugggaacucucuagccugguauuaucuacucaguggcaguggcuagcugcagagcuggugacuauuuccuuguaguccuguguuuccucugugcucacaucuugcacuguugcugauaaggcugagugucacauaacacggcagugcugguuacuuaguguucaccaccagugacaacaaauuucugcuuuccuuuuacauaagacagcauuacacccccuagguaauaugguugugcuuagaaccuuuaaccuggcacuuuauacaaugugagaaauugucagggccaaaaugaaaacuuaguccuuaaccucagcaacucucaaccccugaaggaccaagcagagcagguuaugagcuggcuaugacuacggaccagcuggcucuacuccuuccuggcucuaaguccuaggacaagccagguucuuaacuuccacaugugcaagugaggaagagacagagcugcucugaugagcacaugaaauaguauacacagcagugcucugucaagugcaaaguuauacuuuaaaaauagauauaaauuaauaaauuauuuuuuucuaugaggagaaaagagcugugguacuuuuauuucuccuucuaaggaaaguuuaaucaggaaagccagaguauguagagaugauuuuuaaaguauauguuuuaaauccauaaucuguacauaaacucaaagaugucuuuguaaaaaaaaaauaauaauaaggaacauggcuuggcucaugcaggcuggcuacagaguggguccuagaagccugcugaaugucacuaacuccuuacaaggacaaagcuugggagcuagcucuguguaccuaccacucgucuugauuucaagaccuuggaucacacaguaauccuguuaaaagugcuuuuccugugacgccgacuuaagggacugagauggagcucuguccucaucuguagaagguggagguggguggggaaggauuggauucacaugauaguaacugagcuuucacuauuuuccaaaugagaaaauuuaaaugccaaaagcccuaguagcugaauaacauucaucacaaaaacauccaaaaguauuauaaaaaaaagucauguauguaaacauuuaacauaaguugccuacacauuauguauaaagaauaaaacuggauucucacuuauuugugauaaaugccaggagauagauaagcaagggccaugggcuuuuaguucuuaguuuaggagucaaggacacugcaugaggacuggcccaguuagacuggcucuagcacuacuguguuucuaacaaguuugggacuuaguacaacaaacauaaagagaugagcauaugacauuagaagccacuggcagcggggcugauucagacaauggugaguagggacaucugaacccuaggaagaucagagaccaaccauucugggagaauaagccacucugaggcagaaaggcaggcucuacaucacuuagcagcuaugggauuguggacaauuuugccucaccccuuugagcuuguuuucucagaagauguuaccuacuuagaagagucccaaacaacagacaguguaagaaacaugucugguauaaaaagguacugaacacagcuauggaaugcuauaugcuugaugaauccauuuguaugccuggagccuauuagcuuuaaagcaaggugaguccaauauaauauauacauauaucuguguguuguguuuaaacacauuucauaaaacucauaauggcaaugcugaggaugagaaaaaaauuuuuuucaacucaaggaacacucccucuggcaagaagaacaaagagucucccuggauuccaguuguacugcaugcuagcaacuccuuuucucagcuacuagaugagagugauaacagccaccuugagaaacaaaugaggcccuggcuuuggcaggugcauacagagugccacugucuuucauccugugcugaagcagaaggcuaagggugcuauuggugcucaaguauuuacauuaugaaacuaugagagacacaugccaggcccuuggaaaugaguccauaucaguacuuuuauucucuaaauuccuguuccacauguguuccacaugcagucagcacuaaaaugcuguugcaaguucaauguaugaaaagaaugauaauccaacucuaaaauaagucacuuuuuagaaguacagaguacugucuuugaaaaacugauucucaacugagaagaaacuuggacguagaaaagcaagaaagcaucuuuccccaccuaaucaaaaaauacucaagaaugggucagucugaguggaguauauuacucaguacuuaagguuugccagcuucucauuugaucugcagaaacagacacacugaauuagcaaugaaguaaauguguuagguuuaaucugcccccuccaucucugaaauaauuuguuaugcuccacucugacaaaaacaugcagguuuucacguucuucaaaugacaccagcuagugguaggaguguggcucugucaucuagcccacugauggacacaccuaccaacacuccgccaauguaacuuagacuccucauuccagcaaugcacagcuuagaguuccaacaugugucucagagauaggcauuccuaugcugaggggucacuucugccuagcucagagccacucugguccuggaacuaugugggcaucccuugcuugucaaucggggucucaaagcauccuuccccauacugaucagcaauguggacaagucucucauuaccugguaaucccaucauuccuguacauccagccuuguccauaaaaacccacaauguggcaaacuggaggcagugucugcuuuggcuugguagaaagacauuagacagcagaugagggcugagggguauagagugaguggguaggcgggugaaguuugcggugugaacuccagguccagaaccacuuaggacaggcagcugccacaguauacuaguugcacccaaguauuaggauaaaaguuucucacugucauauaagagaugcacuguaaaauuucagggaucauggcaugcaucugccuaagacugcagggaaauacagaaacgcacggguuuguuucaccaccugcuaauauucaucugcacuuugcuggcugucuacuucuccugccuuagccucugacuaugaggcuugccauuuuguccagaaaacaaacaccugccuauagcucauguacuucacucacaaacaccaccuccaugaaaacuaaugaaaagguaguaaaagugaaaugcaguucaugaauauucauagcaucucccacugccagcagccauguauguucuaucauuagaugaggaggcuguuugcagccuguaucucagagaguugugucccaucaucaaagugaccaucacagugggcagcucagaaggaggggaagcccucaauaaaacugcauggucauuagguggcccaggccgccuuuuaucaugagcuagcugggcagccuuaggggauuuacacaccauuuccuauggucacacaauuaagaaguggguugagaaugccaacccaauuaccugacaucaguacacuguggggaaaauguuccauacucaugauauauaaauaaauauaucugggcuguagggcagaaaaaugguucuuuagagggcagaggaaagccaauaaucaacgcaaaucagaacuagucuauggaaugcuuuauaggacaaaaaaagucugcuaaacaaacaaacaaacaaacaaacaaacuuccuugagaaaaaaauauguauucaaagguuugggaaagauggcuuauucaguaaaugcuuccugcgaaugcauaaggacuagaguuugaacccucagcauccucguaaaaagcugggcaugguuacugcugauguauaaucuuagcaccagcaaggcagaggcaaggggaucccugaagcucacuugccaucuaguuuuuccaaacugucaaucuccagguucucugagaaagccuaucucaacuacaguggaggauacgugagggggacacgcagcauggacagguggacaagcacacaugagcauacacacauccaaauauguaccaggaagaaaacacaaauaaaggagacuucugucugucugcuacauagagacaggguuucucuauguaacagagccauagcugaucugaaacucacauuguagaccaggcuggccuugaacucacagagaucugccugacucuaccuccugagugcugggaucaaagguguguaccacuacgcucagugauaaaagagauuuauaguaaugaaauuuaccaugaaaaagguucuagacaaacugcccaacggcuuuaucaacaaauuuuuuucaucauccaauuuaacuaaggucauuuuuuuuuccacagugauuuucaucuuaucuuccucacuugacacuuuugaaggacaagccuaguccugacuuaguaugacacagggccuugcuuauaacagaugcccaauuaauguuccuggaugaugaagaaaaagaaguaacauucagcuagaacauagggaggaacaagucauguucuuacaugugagacuugacagcacuggccacagggccagcaggcacaaacugacuaaccauggacucuggccaguggaggcucacagacaagaguggccauugcauaugcugaugaugaggaaaagagcaaauguauaaacacacaacucagaucucccucuuccuucucaucugaaggccaugaggauaaaugugauuauccaugugucuuugcugaugacagaaacuggugcuaaaacagauagaacccaaguacuuucuguauccuccaaaccccagcacaaaggaaaagaugacaauaaauaguguuauuccugauauauuaaaggguuuugggccugacaacucugaaaccuuacacacccauacucacaugaaugcaugugcacacacuuuaggaauacuggaauauaaacaaaauccccuccccuuaucagucuuucuaaaacagaggggccacacuggaggccgcugugggauuccugugaacugaggcuggugcaucccucagggaagucuguggucucucccagcaccaguggccuccuacgcacauggaacacacaggggccugcagagauccugaauaaagcugucccuuuguuccuaaggucaagaaaaaccaaaugacuaaccuagaaguauccuaaaaacacucaaauucuagcuggcaugucuaacaacuuuaggguuuacuuaaaaauuaaccucaaaaugcccaaauuucaguuucuaguaaaacucaucuuauuucaacuucuucgccugaaaguaauuuuccuuuuucugcuuaaaaaaugguucacggagguaaaauuuacauacuauaaaacuagccaugauaagguaacuauuuggugcauucacaagauuguacaaauccccaccucuaucuaguucccaaaugcucucugacucggagguaaaaccccuuuacccacaaagcaauuccucccauugucccuuucucaggccccuggcaaacaugucugcauucugcugaguuagucuauuuuggauuucuuauaaugugaccuuuugugucuacuuucuuucccuaagcaagcaguuuugauguauaaccuuuuuuuguggggggggcaggggugacagcuaucaguauaucauuccauuucccacccugcccccagccucccaguccuccagccccccagcuugcuacuguuguuuugauaaauaaaauuguguuguauccguucacugcagucaaccagagaugcacauuuggauuggccugcuucuuggcuaccguauauaguguuauaugaacaugcauguacaacaauucaaguagauguuuucugucuuuuacaacauaaaccuggaaauagaauuccagggaucauauggcaauucuauguuuaauguuuuuaguaacugccaagcuguuuuccauaauggcugugccguuucacauucccaccagcaagaaaggguagagaauauuauuuuacacauaauuuauuuuaaaguuuccuaaauaauuuucauuaauauuaacccuugugcuccacaaaaaucuuagggauuucuuugagaauuuuuauuuaauaggcccugugaaaucucuaaucuccagccccacucccauccagcacagacaauaugacaauuaccagaagagagcagacacccagaaugucuaccauccagcuggcugcccagaacuaacacccagacacaauuagcaaacaaaugucugucugcaaguuccaucgaugaagagaugucuaauacagauuuuucaaggaaguaagaauuuauagcagaaaaggaggaaaugcacagagggcagaguggccacaggaagguaagcagagcugaaaccuguguaaauagacaagcagguauuaaaaaagacaagaaacuguagccacaugggguacugaguaucacaucucuggagauguuuguggccugccuucuucaggaguccagccaacucugcucaucccuaggucuuggaacuuggggaccaagaaccuggggggagagagagagagagagagagagagagagagagagagagagagagagagagagagagagagagagagagagagagagagaacaugaacaaacuacugaagagugagucccuucaucucucugccaguacugagcaucagugucucauuuccaaagugcuguggggagcauaucucuuaccaaagaacuccccccuaccugccaggaaagauaaugcugucauguuucuuuagaaguguucaauuucaguaguaaaacaaacccagcaauucuccugcugugcaagcaaaauugaaaguauuuauguguggugagucuugccugccugaugaaaagaggagcagaaugaauauauacaugcuccuucccugcuccuuuauuaccuggagaccagagauagacuugagccugccugccugccuucugcagccuccauugcagcaagaugcuacauuuugucagagggaauauccaccaaaaaucagguuggugugaguaccucgagcucaccugcuuggaagucagagaggguuauagcugggcagugugagcugggaugugucucucuguaccaagcccugggcaacuguucccauugcugaagcccagccaccugcacccacccugucuacacucuuagacugaguguugagguugaggcugcuucagaucugaguccaucauaguggcaagcgacagucugugcacaccgaggggcaugcagacagaaugcaugcacagcugggccugguaucagcauaccuaggaagauaggcaugcucacucugccugcacaugcagccagcuucagacucugacacugaauuggaauuuuaaccaggguguguaugugugcacacauacaucacacuuguguuguucuguccagggguaccaaauuaucaucaugaucacagacagaacuaaucaauaacucucagucauaugauguccauucagaucaagcacaugcuuuccgugugacaagaaaacaaauacugauggcauucucuagaggacaacugacaguuguuugaaauaggggaggaacaaagcuacuuaaacacauuccuagggcuauuuucaagggguuagagguggucccacaccccaccugauagccaaagauucucaaauuccugcuuucuggaguagauaggagcuagcucacagauagcacacagauaacccagggcuaggcccugugucccauggaaugaagacaguaagguuucugagcuacccuuugaguugcuguaaagaucagacagaaccuuguuccuagaaauacacaaagacuugaguuaccaaugugagugaaggacuggucaaauacaacaauguguuguugaagcagaguaugccagccaggcacccagcucuaugaauggcuacuuaaucugcauagcaccauauucccugaaccuuaagcaaugggccuuucagucagccuauagagaccucccuuuuuucuugacccauuucacugagauuuucuacagaauucuccuauggcuuccccaaaagagcauguauggcuggcuuuggacccaggcucauuggguuggggagggcucuaaaagguccugaagcucuuaucaaauaagaugugcucagaaaaaaguguucuugcucugaagaagccauagaguauacuccccagccuagccucuuuguauccccacuagcagaaccaaaagaguaaaaaguagguacacauaaccacuugcugauaaagcuuauaaagcaaaguaaugaggcagagacacagcaccaugacaugacauagaaacagaaaagccugggacaaacaaagacggaacagcuuuccggccagugcuaguagcaccuaauuugaaucaauuaacccgaaacugaagagacccaugggaacacuccuuacaggggagcccugacacaugauaguaaagcagccagcuagcuaaguucuggaagcugauuucuccuuacuauauuucccagcaucuaaguauggcaggcaaauucacuagagaugugucuacuuggaucuguuugggacaacuauguucccuauacucagccagugaggcagguugauuacuaucucuuuaagugucuaccauuagccuuggaagcauaggcaggcauaagaaaagagaaaggaaaggccaauaauagggaaggaggcaagugcaugggucucaaagcuccccagaccucauggguaacagccucucucagugaacuaaagagacauuguaugagagauaaguuacaagcuggaaggaugcugagccucugucccuuaacuuucuucccuacacucaucuagcggaggcaaguuguuuacaguaccuuuaaagucacuggucuugagucccuguccugguuggcuugcuugcuuccuuucuuuaucagcuugaaacaagcuaaggccaccugggaaaaggaaccccaguugggaaaaaugccuccaccagauugccuguaggaaaucugaagaacacguucuugauuaaugauugauaugggaggggcccagcccacuguggacagcaccacccccagucccaggaaagguggugcugggugguauaaagaagcaagcuguuuaagacaugaggaguaaacuaaguaguauuccaucauugucucuguuucgguuccugucucuagguuccugcccuucuugaguuccugccuuaacuucucuuggugauguacuauaauaaggauguauaaggcaaauaaacuguguccuucccaaacuguuuuuggucaaugccucccaccccaaaggguuucucuguguggccuuggugguccuggagcuuacucugcaaaccaagcuggccuugaacucagagauuugccugucucugccuacugagugcugggaaguaaauguuuaucacaggaauaggaaccaaacuaagacaguguuuaauaguguaagauaguaucuagaaaucuuuuccuguugugugaguuuaacauucaaguuucaugaaggggguaguggggaaggcuagguuuggggacagagugggaguaaucagggaguacccuagaugagggauagcucaggcuagagaauggcuagugagcagaaacagagugggcugggagggacagaagcaucaagacuuggaauuguaggcuagggguauggaggauagagaggacuaggaggagggacuaacagagaauggagaaaaacuuuaggaaggauuccaggagagaggaagacagugggcucauggaagagcaaucuuaacaaugcucagacuaacauggcacagccagaguguuccacauauggcacaagcaggacugcaagcaggugguguggccaagaggucugcucagcucggcaaacaagagaaauauuccccuuaggaaugucaaagagaacugucaucuuaaacugaauuaccagggacuccaagaaauauacacauuuuaaugaccuuguuucuuccaaggaaacaaguaaaagguccugcaaaugagaaagggcagacaguaagcugugcucauagucgacuuugagcugacagaagcuggguguguggccuguauaagcugccagggucauccuucaaggcccaugcacugagacuuggacaagaucaccuuugcacauccaggacagccagcagguacucuuauuccaggggguaaauggccuuucccaaaaaacugacuacuucccauacugaguaugaaaaugccuguaagugggaggcuuacaggaaagacaggcuggcuugggggaaaguacuguaggaaaacugccacacacucagaugguguacagguacagccugaccauggagaacugcaagcacaaggagccagaugaacgcaucccacugguccuugaugucauuugggaaucccaaagucugggcauuucaguguugaguuucugccucucuccuauggugaucacuauccugacucugugaguacaagccugugaccuucucauggaacagcacugagagaagcugccuacuuucgucagcagcagcuauuuaucccaggcuuguuuuuguagguucccccacccagccauuuccagaaaugacuguuccucucuuccugacccuucugugacagaauaaacaagacaucuuuugcccaaacaccacagggcaaaacaaaaacaggaagagaaagcaggcacacuaaagcuuuagauguaaaauuaucaguguuuuuagaagaagauagauuuaaaauguuaaguuuuaaagaacuuuaaacuuguaugcuauuuuguuucgcuuuagcacaugcagacuucuguuaacaccucuuuacucagacuccaauagccucugacucuuguugcugaucaggguggaugucugacucuauaugccaagugcacugauguuucagggguucacacuuggugcuuuuauauuugccaauguaaguucaaauuuacaaaaagaaggaggcuagaccaccuuucuuggagguaaguagaugacaagaaaaugacaacaacacuuuguucuuuauguuuguucugacuacagaacuuguauuuccauugcucacauccaugauaaugaggaugccacuggaaacauaccccauaagugaacauccacacaacaaucaacacagacacacagcacaucuggcacacagcacaucuggcacacacuggcagugcugucugugugggggaucuagagcacuacucuuggcgcucugaccuuuggguugguggcacugaaugaggaagaucaucaaauaucaaaugcagaugugucccccauucugucauucuccucuaguccugcaccuagucacaggccacaggacaucaggcaucacuauggguacagcagcagcaguguggcaaugagccaagucuucaaacuagauaggugcauccaccuucccccaccaaccacacucaacacugcccaacacuguuauucucccuauaugcuacuuacuuugcacugucuucugucccaaucugguacaggagagaagccauuagccauaucccugaccugcaggcuugcuccuucaacaccucccgauugcagugcuagagauggaagggaaguaaguagugcaugaugccugaugcuuggugggugggacaacuuguaauugcuaaccaugccagaucagacacauccaugcaaucuaugacaagaagacuuaaggaaccugggaaagaauggguacuaugaccaguagcugaguugcacccauggaguugucuccuuuguuucucaugacaacaucaugaauuacucagguuccugucuuaaaagaaauaaagccugagaaagauuuggaaacuugccugaagucacacagccauaaaguaguagauccggaauccaagcccaggucugucugcuacauauagcaacaaugacaaaaguccugacaacagugcuaacagccgcagauuaaaauagcagcuagcauuuaugaguacuuccucugucccaggcccucagagcagccuaggaugagcucuguucucuccaggaagucuuuguucacucagcuuucucgccugaagacaagauuagagggugccugagcagcauauccauauaguccccaaaccagaaaagaaacaagaggucuuggggcccgagcaccagcucuagcuccuucaguagcacuagucaggcuuugccuguuaccccugggguaguccucuccagcuuucuacauaggacaaagcagaugcaugaugacuuugggaaacuggcugguuaaaguuuuggacuacugacuucagguuuuaacugaagucugagcagcacagaagagugugugugugugugugugugugugugugugugugugugugugugugugugugguguauaugacucuccaggaggcugaaguugggucccugugauccagagcucagagaaaagccgaaugauauggagucaagacuuguuaaaaaggaaggacuugucugaggggguaacacagagcuuggccagcaaggacgucugguacauaacagagaguuauauuauggaagcauaggaagcuacuaccauugccaggaccccacuccaguagccauccuucuccacaaaugagugacagggagugcuagcuucaaccugcauuauucaugaauggagagacuuuggaaauaaaguggcugaccuccaucagccaucagccuucaucauuucccugacugcccugugcuccacaugugggccuaccucuccgccugagcaccucuguaggccaccucagaacccagacccacacuauuccuagaggaaagcuauagggguuaagugaagguagguagauggaugcauuagcuucaaguccucaucucccccacaaaacagcacagaacuccguuuugaauucuuagucuacaauauuuuuuuuuuuuuuuuuuuuuuuuuuuuuuugguuuuugguuuuucgaaacaggguuucucuguauagcccuagcuguccuggaacucacucuguagaccaggcugaccucgaacucagaaauucaccugccucugccucccaagugcugggaucuaaggcgugugccaccacgcccggcuuuagucuacaauucuuaaaucugccuacaaaagcauuuuccuuaaaucccuuuccacuuaugaauaccagccaugugauugguggggaacacaguagccaauagcacagacacagugcugcagcucacaugggguguggauuacaccaucucagcuuuguauacuuuggcuucaguauucacugugcuuaacugccuuguagcaacccccaggaacacuaaagcccauuuagucuucacacacacucaucuccaaagagugcagucaaguuaaagggacaaaagcagcucuaaucuuagggacuccugcuuuuucuaugcucugcucgagaaggcucugugcagcuucuuacaggggauggaguccuauaugcuuccagcuucuaguuccuaauaacacuuaugcuggucagcaucauccugcuagcccuuauuccugauucuuggaccaccuaccaaagagaccaccugaacacaaaccucuguuuguuuaggggucugcuaaugggaacccaaacaaagaaaaugguuccuuaaugucacccucucagcuuuuaucuaguaccacggguacccccaaaacacugauuccccuaugaagcacaagcuaugcuuggcuuguuuguucucaguuacccuccuugacaacuccaugugaggcagcagcugauggggacagagaagaguuaccaugcacccuaucuggcagaguggugagcuagaagggacugagggcagcagagacuugcugccgugggguagacuugacauaguggccccaaacaccugagagaaugggaaaagugacuggagggcagcacaagccacuccucaguuuauucagagagaggagugggaccagggagcucaucccacuucagguuagagaccguccuugcauagcugaggguacuccuacucaugucuugaaaggucagcacaaaacacagugccuggcacauacuuggaaauaaaaaaaauugcuuguacaaugccugaaugggaauuauggcccccaucacagcuggggccauggagagugaccuggagcuaucaacaggagaucucuuaucuacugaaauuauacuaaagucacauacaguacuaucuccucugcugggcaucugcuuucuuauuccuaccucauuccaaacauccuccucugaaucauccacccccucagucugccaacccucaugaccucucccaccacacucaacaacuaccuuauagucccacauccccacagcgccgcccccccccccuugcaggagagguguguggcuaugagucauguaggagcagcaccaagccuucccacaugcaaauaagguuucccccaaacucucaguccaagccaauuagagguaccuguuguagaacccugaauuacccccaaaacuguauauaaauccauccagagaauuaaagguguucgagaacuacucuguugucugaguccuuuguuccaagagcuguaacacuugggaagagaucggcucuccugaagccugaggcuccgcugcacuccucacuggauagucagccucucagcccagcccaacccaacucagugcaguuaccagugaucuggaaggcagggcagagacuccaccucccugcccacacucgcuucccuucgccggaacucucccacuaggccugggcagagaucuccguggaaagccucuggugcucaggcccacacccaccccugaguuuuagagauuuaaucacaagacguuuaacaaauggacccucagaggagcuacaaaucgcuuauaagaaagaucaacagcucaaggccagacugccaccugugaccccuucucuaaucuugacaggggacacucuucauacugugugagauagauuaaagcccaaaccacaugcagcacauacacaaagugugaccaugacgacaaagaagguagaaggaaacuuuagaagugacugugaugcacauacagacuccagucucacugguggaucuuuaucuacaaacuuuacaucugacagcuacaacuugucaacagccuucugaaugucaauacuggguuaaaaugugugaagaggaaaagcagccaggcacaggccuguauuucuacuacucaggaggcugaagccagaggauuguaagcuugaggcuaagcuagucugguagauaggccaaacugagccacuuaaugagacaccaucacaaaauuagaaguuggggggaugggggugcugauuaauagaauccuaggcaccaugcccaaggccccaagucugaucaccagaaaaaaaggaaggggguggugcagggagaagagggagugaacagagaggaggaagaagaggaagaggaagaagaggagggagaggaggaggaggaaaaggaggggaaggaagaagaggaggaagaggaggaggaagaggaggaggaggaggaggaggaggaggaggaggaggaggaggaggaggaggaggaggaggagaggauuggcugugaaacuugaccaaugccuguuucugcucuccucccagaacaccugccuauuaaccuggcuuggcauggcagaugucuccaguuucuaacaagcaucacgagagacugaggaguggcagggucucuagagcucauuuugaaaacuaaucuauaacuugaguccaugagugguucuaucccucccaucuuuaggcuuaaaggcaugcagcuggcagcccuacaaggcagaaagcugagcugaguuuccaggacacugacacaacgucuguaucugggcccucagaccccacagacacuuggaaggcuucuguuuucugagguggauggucacuucugucuugaacauauacauguguccuuccuuaaaugugugcucaccugcaagcauucucuggcaaugcacaucagcaucccugcagaaagaguuaaugccacccuuucucacaagcacacccauaacugcauauuguguaugggcuucacugugcuauguguaagucaguacuuaugagcaugcacaagcccuuacucucuuguuuuuggcaagguugcagcauagagcuacucaaauacaugcaggcuacccuggaaauuaccaaguaguuaugagcaugaauuaguaauuccugaaagaaaagacuaauuucaaaauguauacuauauaaccgaaggucacagggacaauggagauuugaaaaguuaccagcccaguuaacuuauugaucacuuuuuuauagaaacagagcaguggcucugcuuguuuccacauguguaugaguuggcaaaugagacugucaguaagcuggauagugucacaugcuaugcuccaaugugagccugcacauaccucuccuccugcuguuuuaguuccaaacggcagguuuaagagcuaaugcuugccaugcauaacugugugcagguucuguuuuucaagugagccagucaccuuuuaaauauuaugaucugcauaaguuauaccauuuuugaaacuucuguauguggcaacacccuuuauugaagugacuuagaccuucagucuacaaucuggcaguguggaaauauacccuguucacaguucaugggaaacuaggaaagguucccagugugggucaaugaugccggaaucacccacaggggaaagacuccuuccuccacacaacuagaaucuccaacuauggcucacaaccuggugagcacaaguccugcucacaacagaauccagauggaacagugcagguggcucacugcuaacagugagucagggaaacggguggugagggcaggaccaggacugaggcugaggugaccuuccagagacuauuacuuuguagugguggugggauuugaaaccaggcccuagcagacgagaguuucagaauccaaccuuagagagagcaaagucaccaagcaaaaaugaaaaacaaaccccauacuguucucugguaagucaguucugaagucaauuaucagaaaagucaagcucacuaauggguccacagucagacaacgggguggggucaccauauaaucuagacccucuguuuucauuccugaauuaauacguuauuccuggaccuugugucucccaucaacuuucugucuauuugccuuuuuccaacugauauaucaucacuaaccuccucaagaauucacagacgcuuccaacauguuacucugacuaaaccccagcuccucaugcuguagucaaaacucccuacugucagagcucacaccucuauaccacuaugcuucaacccagcccuucaaccacuugcacaacucuuuuguuucucccaucuuccuuuuuauuacaaccuccauggccuuuaccccaccucagacuucccugaagaucuaccuagagaccccuucaccacaggucucucuggucagcccaucgugcaaaagaccccuucacugacccugagcucuguggcggcuuuacucacgucugcuacccacuuccaucugguacauaguggguucauaggaagugucuguugaauaaucauacacuuggaauaccaaauuucagaauuauauuucuaggaacuucucuuuaaaucugaaagagacaauuaacuuaaaauuugagaauguaccuuucuuccuauaccauuaauagguagauauucagagcuacucaaucauugucugacauaaugauuggaacuaaaauuaauuuccaucucuaccuaacaaccauuccagaaucaucuggaagauagccucugcacccaaaacaaucaacugagagaguauucuuaaaaaucaaucucucucucucuccccuccauccccccccccccggugugugugguauauggaaaugcuuaugugcccuggcauguaauguagaggucagaagacuuccaucauagggacuuuggggaucaaacuuaaagauuagcagaauuaguaguaaguauccuuaacccucugagccaucuuaccagcccuuauuuauguucugguuuuuaugcccacuuuuggagaucuuaucaauggucuuaaaggucucaaaaaagucuauacaaaauauuuugaacaguccagagcagaaacaaaacuguacacacugucaccuuugacuaucuuuugcccaaccgugaauuuuucaugguuuuucagaguuuaauguuuggucuuguuuuuaguuugcuggugauacugacagcagaaauacccuaguaccaguuaacuguuugcucaaaaacccaaacuuuggcaucaauguagaauuaaauaauggccuggcagggacuucuuuagugagguaauacaaauaaacagaaccaccuuccacugugaucuuuugccaccugaaagguggcaccuuggaggaagccugcucucagcuggaacaggguuucucaagaaucucuaggguagcguaggguaggguaggguaggguagaggaugagacugugccccacagagggcacaauagcucagagacaggaucuagcauaauucuguucauauaagcucuccagguucuuagguaugagagagcuugagaagccgcacugcugacagcuacccucagagcugaccuucaggacguagguuaagucgggagacacuccuauaccccuuuauuacaccauaaagaccugacaaagcaacccugauuccuuaaagccacauaucaggccucccucacagaaugcuaacagcagcucugcgguaggcuaggaacgcaggaaaggugaggaaagggugaggagaggcagaagcuccucacucugaagucuaauuugccuuuuauacugagugagggccaaaaaagcucaauacaacuaacaaagccaaaacugcccagagaaauaaucauguuuuuucuaaagauaccuuaaauaggauguuaaaaacuaaugaaugagguccacuuggagccagaauguuugaaacuuugugaguuuuaucauuuugauguacagcuuuuucacuccuaaaucuaaacaauguaccucauaaaaaucuucacuauuuuaucuauaaaugggaaaucuucaaugucagagaaauaaguaaaccuaacucauguauuuuuauuuguuuugaaacuuuacuuaaaauuaagcuuuucuuaccuuuaaaccuggucaguuacaaccuuugagcaauguauacuggcucagccauaaaaucuuguauguagccaacugugacguugagaagccacccuguguacugagugcacaccauccuuuuccuauauuucucuaaauacuuaauaaacucacuaacuuuacuuuacccuggcccuuggggcucuuuccuguggccuuguugaggauccagaugaguugguggaccacugagaagaaaggggacuccuggggcuguaggggcagagcuggugccagcucucuaccaccacucagaauucauccaagcacauaucuagcuucuaggaaaaauaguggcuuccaggccaccaccuuccuccccacaucccucaggcugagaacaggaaguucacuucauaucacuuuuuuuuuuuuuaaaccauaccugaugggggccaugggaggagcacuaaauauaguccuguuuaaaaugauaaaaggacaaaguauucaacccucuuaaagcggaguguuccuaaugugccaggcucaagacagggggcuccuggggaaagauggacccagagcacauaaugaccucucuguccaggaagcuugaaagcacccuuccucucucgaaaaaagucccugaagguaugcuuuuuuuugggauaaggaccuuaaugauaaauaaucaaagagcuucucuuguccacucuccccaaguaaaagguaaaguaggcaggaaaucaccucaacaguuucaucuaggcugacuguccuacacagcaggaugagcaggguccaagcugaaugcugugcucguaagcuuccgcuggccuauguagcaggagacugaccacuccggggcucaaaugaggccugcggcaggcagaguacuaugauuaauuuagaaaugaaguuaucauuccaggacucugugcccuugucccuagcgaaaguugcuuagcuggccuugagaacccaacaccaugaagacgggggcaggggguggggguggggggucauucugccuagaauuuuagguauuagucacuuaaggccuaaagaaagggaguacucagauggaagugggaaugcaggaaguagaggugacugugccuguugacaaaugagaaugacaaguggggagcuccuaacuguaaucagccuuaucaccccaugaggugcucaaauggauggcugggccauaaagcuggugagaaaggacaucaagucuaagacgaggauucagaccugccccaguucccauggaaaugucacugccauucauaggccuccugagcuaggguuccugaaagcaaaguacacugcagaguccuuggcaggaggggcacagagugggcagagugacaggggcacagagggcaggaauacaaaacaggcuucagagucccaaauguaacuucuugcgucaaauuuugcuacaaggaugcaaugcuuauuaaauauaguuuuaagccuauuacaagccuccauggccaauuuuuagccaaacuucaaugaagcuguccacuuagagcaauacagguuaacuaaauaauaaaaccucacacagcccuuggcuuggcacaguuugcccuaaauucagaccaagaacuggcaagaaauagccaucggcauccugaauuuguaagucuaaauauaaagugacaggaaagccuccauuuugcaguaacuacagagcaggccccagcaaaagccgccucugggguaagcuguuucucuaugaugaaccauagaguugccuuucaagaaaagaguuagucacucuccagagaauauggguugucagccucccuuuuuaucucaaggaggggauacaguuccccacugagcaggcugcaccuuccuggauggcucccuuccaggcugaaugguggaaagagagccagcagagguagaccuagccuccugagugugaagaaguaugugagaacuccagggacagagggcaguguguguaccuaagugcucagagaaagcccccacuucucacauuagaugccagggcuagggaggagcuccagcagccccagcacucaggagugcccugaagaggagcagagaagccuuagacucacagccuacuuucucaugcuccggaguuugagguucuuuucuugccaauuucuggcucugugggacuggucacuauugcuuccaacacagcucuuuuaaauauaaaaauaaauauauuuugccauucuacaacccugaaccucgguuucuaucuccacugccuccugacgcuguggcucccacaagcuggccauugcacauaacacuagauuguaucacauaauggugcaacagcauccuggaacugguauaaaaacuccggccuccagcuuauggauuaggaaguuaggcagucagcacaaaucacacagccuagugaauuuagggaucaguucaguucuggacuuuacuaaugccaaagccugcagcaugcugaaaacucugggauggccaggaccuuguuuauccuuggagcuagcuagcuaguauuuuuguacaaggcccauauuagaaaugagauaaaugcuugugugauauuugaaugugcaagaguguagauguguuuugaucccauaaggucacuaauucaaauaaugguccucaguguagugauguugaaaggugguaaggccuuguggaaguucauuaucagugcuguccucaggaggaauuaagguuagaaaccccugagugaguucucaucaauaaaaguugucuuaaaagcuugaaucaaaucuugaacaauuauaugucuuccuaucuagucaugugaucucuuacuccuaugcaugcucccaccauuaugagaccaucuaccauaagcugaggagagcaacaugaccuucaacaauaagccucuuuucuccacaaaauuauccugccuugggcauuuccuuacauuuaaaggggggauaggaauaguuaauguuccuauuauaaacuuaucacaggaaggagcaacuggccccaggacaaagaucuucccuuccugcagcaacuuccacaugacuaaaauaguagucuuuuaagaaaacuacuaucaaccuauuacacacacacacacacacacacacacacacacacacacacacacacaccaucaaccccugcuuguucaaaguuucgaggacuuauuccagguacuauucacaaaucuucugaucuagccagguaggucauccugaucuccuaaacgagccuugcauuuugcuacccugugccugucacuggcacccccuuccuguucuagcugaauggauccucuccaucaagaaggaccugacuucuccaaaacucuuuccaacucucaauguccagaccaagauuauuuuacucagcugcuucucagauagcuucucgccaucccuccagucugcauguauucuaaucuuucaaccauauacauaaacaaaaagucucuuuuuguuuuuagaaagauuuauuuucauguuugcuugaauguauguauguauaccacuugcauguauagaggccauaagagggagauggauuccccuggaauuagauuuacucauagcugugagcugccaugugggugauggaaagcaaacugaaguccucuguaagagcagcaagugcucuuaaccauuggaccaugucuccagccucauauuacggucucugucugguaacaaccauuaucauuauccccaccauggccucugcacauucccuguggaugccacuggaccuccugcauccugacuaucuccauggaaaaugucuuaccgguaguaucuggauugcaaguacguagagcagacagcuuuggacacaugacuagcugaaccaaagucaaugaccuucacucgguacgguugucuggauggauccaccagcaugauguuuucugguuugaggucagcauggauaagacccaggcuuuugaguuucaucagggcuguggcuaccugcuggaggacugggcgaauauacuugaggggcaagggacuaaacuuguucuguuucagaaagucauaaagguucugcuccaacaucucaaagacuaagcacgugugguucuugugcuggaagcacucauaggcccgcacaaaauuguagucaucagcgcucuccgugcucagccgggccaagaugcucacuucaaucuggccuugccgggcauaggaggggugguucuugaggaucuuaauggccacaauuucauuggugccccguuuccagcacuugaccacuugcccaaaugucccucgccccaagaacucuaaaaccucauagguguuggucauggagcacaguacuucaugcugcaccagcugauaguccccuucacuguuggagccacuguuuuuggagguggcaguggaugugguggcaguggcuacaguggccccgcuggcauuauucugaaucauggguggaugcucuucaaugaucugcacgcugcuuguguucucaaucuccucacucuugcgcuugaguccacauuuuugguaggugucaaggaggcucacagugcuucgacgcauuagguuaugugguccaccgaggacuugcccggugacagaagugcuacuugcugauguuacaacuauguguccaguacuuccugggaagaugauggucugcucguaagguaggcuuggguuggggauuggcaaggaggugcugacgguuguggaggcuggcugagaaggugguauguucuugcucuggcuguacacuuugcugugggagccguacccagucaugucccaguuggaacuuggcucuacuuuuaguuucuucacacuacagaaggcacuugauugaagggugugaggggagaaaacuugcacaugugaggccauaccuauaaggaaagaaaaaggaaaauuaauucuuucacuccuccaauaauaaacguaaucgacucauuuaggcucagauuguucuuccacucugaaagaagcuuaaggacuggggagauggaucaauggguaaagcacuucugcgaaaguguaaacacuugaguucagaucccuagaacccuuguaagcugggcacagucacaugcaacuguaaguccauagcucccauagcaagauaggugacagagacaggaaaauuuccaggucaugggcuaauaacuagccugacauaugcagcaauaaacagcaucucucaaacaaggcaggagguaaggacuaacaccuagaguuguccucuggacaacauuacauuucuuggucugcaugugcacaugaacauauauacaugcaugaugauuuaaaaauucagcagcuugaaaaagcaaaucaguuuccacccagaaacacauucaagucuccuuguuugugagaccuauggcucccauauucugccaucagaucuaccagcguuaggauagaagacuccuaaaaacagagucaaaaauagucaagaaucagauaaagaaucaggacuuaguucaucauuuauuuuuuguaauuaauuuguaacagaaaccaauucuccauuccuuucagguugcaucuugcuaaaucugaagauuauaucaaguaucccagguaaguguuacauacuuagcaccuccauguagucagcuuagccuugucaacagauagcaauaacuagguucacuacucuuaagaaacacguccuugcacaaacccuagcacaggggucucucgugcucgucuaugcucugaguggggcagacuacauaccaucugguacccucaucauucugaacucuauaaggcugaguugauggaugauuugguguccccuucagacaggacccaguagcaccgugugugggcuccuugcucauuguuuuguuaaucuagacaguaagaaauuucucucaagaauccugagauuuuaggugcuggggagauggcuuugucggguaaauuguucaccaagcaagcauaagagauugaacgugauuuccagcauccacuggauaugcagaugggguaaggagaauuggacauggcuuuguguacccaacacugaggaggcagagaugguggguucuugggguucauuggucagccagucuagccuaacuggugagcucuagauucacugagaggccucaccucaaaaacaaauaagauggaaggugauuaaaggaggcccagaugucaaccuaaagucuguaaacgcucacacauaauggaagcugagagugaacgaacuaugauuucauauuugcaacucagauaaucuuaaaacugcuuaagaccuuucugaaguagcuguacaacuuauaauuauggugauacuggaaauuuuaaaaugugauauauagauuaaggaaaaaacacuacagcgacaagaaaggaaaaccccuuaaagguacaagaagaaacaaauaaccaauuugcugccuuggauaaccauuucuuguguguguguguguuuucauguguauacaugucugaguaugcauguacuaaguguauagaggccagaggcugauaacagguuucuuuuucaguugccauaguuucagagaaaaggucucucugcugaacauguggcucaccaauucagcaagacugacaggccagcaagccccugagaucuuccuguuuccacuuccccaguguuuggguuacagacaccuggcuuuguagugaaugcuaaggauggagcucagguccucaagcuuaugucacacugaaucagccaccuccucagcuccauugccauuucuuacaauggcacuuagaaggugaagagaccgccaagcuuuacugauacuuaagcaucuagcagcugcucucugacccccagcauugucuagagugguuccuuaacaccucccucuuaaugccauccuuugucccccaauccucccucucuucaauggauccccaccuaucuugcccagaauucugaggucagucacauucugcuagucccauaauccauagucucccauuuuuucuauagaauucuguuucugccauucccauccccacuuuaagcuauugaugauuucuacuuuuggggccaaaguuuuuagcugguauugaacaagguuguucaaaugcaucacugaccuaaccuuucccucugccuccaagugugugugcaggcacaaaccuccaacuuacaagacagaaagaguaacagucacagccccucuucacgccuuccuucuuaccuauaaauuacgcuucauguacucuuuucuucaaugcucauucuuaauccuucuccuucaacauauucaaauaucauagaccuguguucuuaagguaaauaacuuccuaauugccuaauccaauggcucuuucagccccuauucuccuuaaccucucugcaacaucugauaccgcugaccaccacuuccuucuugacguucuuaucugcucuaaugugaaucuguaacugccuuccuccucccaauggcuaauuacacagggguuaaggcagcuccucuuccuccuuuaaaaugcuggcacuccuaguauucuguuuccucuggaaggcaucauucauuuagacaguuuaaacaguuaucucuaugcaggcaacucccacaugcuuaucaugagccaaguucccacuugaauauuccaguaauauuauuucugucuccuacuacauuaaaaugaucuuccaaagcugaacuccuugucuuuccccuaaaacauagccauuuaugcuucauuuuaacauuuccauucuauuaauaaaguauuuaucuaguugcuugguucccaaacuguggacuuaccuugaugagucuucauuaucacagcaaauaaaagacagucuugauugauuucgccuucuuuuaaaauguccuuuuuuaaauuaaaaguauuuaaauagcuauauaaggcaacaugucucauuuucaacuuuuuaauuucuguucauuuugccacucccauagcugaaauccucauuacuuuucaaaagcaacccuaaaguaaauauaggauccuggucacuggaaugagcgcuaaugugccuguaucuggcccgcagauuugucuuacuacauaaacuucuaagcauuguuccucuguccaaaagcuucugguggcuccuuggugcccaggagauaaagcugaaguguuaacacacauccugauucccauucaaccauuuagcuucaucuucgaccacugauccuccagaaaucucaacucuagaccggccucaccccuuuuucuagaauagcauaccuccugcacuugcuucauucacuccccaguacuuuuuaccuucugccaugaagucauugcuucucucaacuaaagaccacgcaguuuagaggcccaauuuaacccaaauaaagacuuuuuuaagacgcaagggagaagaccagauaugguguacaugacuaaacuuucagugauugaaaggcuaagagagaggauuuaagaacuggagacuauucuggaccacccauuaagacccugacucaacccgggcgugguagcgcacgccuuuuaucccagcacuugggaggcagaggcaggcggaucucugaguuugaggccagccuggucuacagagugaguuccaggacagccaaggcuacacagagaaacccugucucgaaaaaaacaaaaaaggaagaagaggaggagaagaaggagcagggggaggaggaggaggaggaggaggaagaaaaaagacccugacucaaaacaaauacucuagaaugaaaaacaauaccaaggcagaggcuguucggcuccugcgcuggcuggacagucaugcucugccugugcuauggcagcaugugcucugacguccuggaggcaggucuggucuuagccuaaacucuccucugaaucugccuuuacggugagacuucccuucugguuugaaagcugacuccaagguucaccuggguacuaugacuaauaugccuguguaugucuguaugucuguaugucuguaugucuguguauguucaccugggcacuaugacuaauaugccuguguaugucugacaugauuacuguuugacaugguuauuuugguuuguuaugcaaccauacuuuucaccuacuuuuaugucaauauuuuccuaauaccauagcacaaaaaguaguuauucucuacuuacuaauaucacuuaaauauucauauaguuacacaugcuauaagccagacaaguucaaccuguggccugcuggcuucauguguuccaguacacuaaugaauuugcuccaacacauuugcaaauggcauuuuguuacaaugucaaaaggucugauacccuugaaguaauacagaagagagcaauccuuggcuuuaagcuaccuaugaacagaagagacuaagcaaaauuaacaucuaucuacuucagcucuguccuuugacugucuccugcuucucacucaaguuacuaaggaaagggagaguaggaggggaaaagaagaaauaagcugauuacacacagagcuucagaggcacuggucccuguccucaguguuuuagaaguucuugguagagaggccacauugcagaguggaauuuuacaaaggggaagaggguagcuuaugacuuauuuguuauugggaugauagccaagggucauaaacuguugaaauaaucacuggcugccuugggugacagaugcccaggaucagcaaggagaccugcauggcuggaaccucucuauacccaucauuguggccagcagcugccucagacucuggcuggggcugcuguggucacugcugaggucaacagccacuauuccaagaacuagaacuaacauuuccaacaaccuuuuuaccuuuguucuauggcaugguccaucuuccuguggaugugggaaggagaaugcucaaacaaaauauagcuaaagaaagucacuaaggaugauuuuuuuaagcccuaaaaucuuuauaaggaacaaaacacuggcaguuuguagcuucauuuuaaaauaaucucacauccauaaucaaacuuaugucuaaacaucucuccuuggaagucuuuucuggaacaacccuuccugguuaguuuagcucucuuuguuaagcccacaaccccugccauuccauuuguucagaucccuaaggcaagggacagggaagaggugggggagaccuguauguuuuccacucuaaaggaaaagcuaaauguuuccucucauuucuuuaugguuugaccccuguacucuucaaggacuacugaccuccuauacacacaaauaauaauaguaauaacuuccccucagaaauggcaggcgcugacuggacaucuucaguuugauccuauauaaaauuucaaucuccgugucuccucuugggcucuuagaagaaaacguggcucugaccccuacuagcaaggauagguuuaacucccugaagggcaguauggaggacccagggaauaacacaauaaaucugcaauaauuacaccugcuccuuagagguauagcccauccagaccuuucuauaaaagccucgguggccucucaagauaaaacccuacauaauggcuguauauccagugauugcugauacauagggugaagugucuacaaaggaguauucucacuaccaugccucuggcucuuaagcaggccaaaggcaugagcauugaacacaucuuuccauauuucugggcuuauggacaaacuaccaauaaaagagauauacuuacaaacucacuagaaauguagcuaacuuacaucucaacuguaugcaauaaauuccucacuucaugacaaauaaaaaguagugccuauaaaccugauuaaaaacagucacacagaaugacagugaacauuuuaagucauuccuuaucacuacaacaaagacaaaacugucuuauguaccaaacaaacccaggucccaaagguuucaagugccuuuugguaaccugcauguuuaaacaaugaagaugaacugcucuuuagguuccccgcaaaugcccacuucacauuaaaacguaucuacaauaaacccggguuucaaagcaucugccuuguagucuuuucaugggugccauggaugcccacaaacuuccaucacacucgacuccagccucuguauaaaaucauggaccauucuucagauuguaaauuagcaagcaccagugcacauguggcucugggagaagugucuuugggagucugauuaucgugguaugcucaucccauuaacacaugccccacacaaucuccucacacagggaugaguugaaagcugugacaucaggucauggugugggcuccuggaauaggggcaaaaucagacccugauuugaagcucaagccuggacaacucuguggcucguugucuuucuuagucuugaagguuuaaugagaaacccuuucagaguuguaggcaacuuuuucugccucuuugagucagggucuugcuauauagcuaagcuagcuucaaguaggaccaucuggccuucaacacuucaacucaguguugggauuacaaguguugguugucauacucaccuaaaaagcuaaaaguuuucaugaucuugaguuuuuaaccuacuauauuuaaaaaugacauuuguuaaaagacuggcuuacuuaguguauuuuuccuaacauauuugcuuaguuucuucauaacuuuuuauuucacaauuggaugaacuaaaaguugcuucacaugugaguacauuuccuuuccauuucaccacccaaauuaucuacuggaagaucagacucuggugaaacuacagggauaagugaggguuauauaugauuaauuuuuuucauugaacucaguuucauugaacucagcaaagcucaagagaaggaauuauaaguaaaaauaggcaucauuuuuuaucaguauuuaagguuuaauuuaggcuuggcagauaugaaauagauugccacucaaaauccaguuacauaguuaaagagcauagaguccagauccccacgagagguacuaaccucuucacuuucuaaaaccuuccaggcauauacugccugaauaaugaguaucugaugaaaguuacaauguuauuuuguuucccuauaauacauaauaaaaauaauucauucccauacuuaauagaauauccugucuucuauaucauauuuugcacauaagauauaaguuauaaaucaauguuagaaauauaugucuauggcugaguguagugggguaugccuuuaaucucagcacuugggaggcagagguagucugaggcuagccuggucuacagaagauagccagggcuacacagagaaacccugucucaaaaccucccacucuuccccuaaaaggaauuauguaucaaauggaaauuuuuaaacaccuagauaagggaaaauuuguauagcccuugauaaacuugugauuauuuaaugccucagaggauugaagaguauuagaaaaaauucuucauugauauacuacagaauauucauaacuguaauaauuauccugugugucagguuuguauuuuaaaagagugugaagcaauuucagguuaccuguuucuaagugacagauuuucaaaacagugaguacuaaauaucuuuuggggcuuuuauaucauuuucaaucagagaguguuuaugcacuaguuguauaauguuagauacaugauaugacuccacuugagcaguguaaaauuaaccacaaguucuucagaauccuuacugauaaugacagcagcaauacgauugcagcagcgcugagcaucuggaaaauaaacuaagucaaucaucuggucugcauuacaggucuucucuuuauaagacuggcaugggguagaaggaaaauacaaaaaugucuacagcaucgccauuagcugggcaugguaucacaugccuuuaaucuaagcacccaggaggcaaagauaaacauaucgcugaacuggaagccaguacaaaguaagagaccaugucaaagaaaagaaaaaaagaaaaaagaaaaaggcaucaccauugaccuaaaggagcuuaaaagucucauagcauaaaguccaaugccaauuuaaaaggacaacugccgaaguaaacagcacaguucagagaagaacucacucagguuauagccaggcaagauuugauaagaugugaacugugauuauaaagauggaugaccuuucggaagguuaggcugguguuccaggauccuacuaggaggguguaauuccucagucucgcaguagagagcaaccagcaccauugucucuguccucagaaagcuucugcucugcuuggaaacaacugaagcacauuugcauaucaguaauauauuaacaaacgcaaaggcaauaaucaaccuccaguggacacugcauaucaacugccuccuuagauucugguggcucuaauagucuaaaaacacuucuaaacacacaaagcugcugugaggagccagcucgccccugacccagccuguggcucuuacucgguuaccacacauguaauuaaucaaguuucugagacuuucauggucacuccugcucuuuucuggacuccaggugcuuaucaggacugugagguaaggugcauuucuccuaugcuuagggaaaugacggaagucaccuaaagucacucugcuacuagcaggguugaauuuggaacugaggucugccuagaucucaaacucaugucauuacucaagcuucugcuucacuuguuugguucuugaauuagaagaaucgaacaugaggccaggcagaguagcacccauggucagaugaaagccaaaaagaagaggaaacagaucuagacuacaggacagagcugacugcaucaaccauaacgaauacccacaacgaugaccaugguguuuaacauuugugucuccucuggucaggaugacguuugagaaauguuuuaaaguuauuuuuaaaacuaaauauguuucuucuaagaagcaauugucccuuuuucaauaugcaauggaccaguggccagaacacuggucuugaguaagaagccuuagacuaaguggccuggagagguugcauggcaaacaggaagguugucacaauagcccagagggcaggggagggggaucugaaccaaggaacugucugagaaaacagaaagaaaggggaaaaauauauggcuucagagagaaaaaccagcaaguuacugacagguuucaaagcagagggagaagaaaggaaaggaaucaagugugucugagggaugagaaguaggucugcaggugguaacagaggggaugauggaacacgcugccaaacuuuuuuucuugggaagaagaguuuccaacaaguuaaauaacaagcacuggauaucuaugcucaaguaucccggcauuaacuuccacuaaaacauggaaacaagaacuugguuaauuuaacugaaguuagcaucaggagcugcugguguuugacaggcagcaucugguaccucugugcaaaguugcucucucucccucucugugugugugugugugugugugugugugugugagugugugugugugcgugcauguaggcagaagguuaguguaagguaucuuucucaauugcucuccacuuuauuuuuggaaacgagacccagaaacacucaauucaacuaaacuggcuggucaggaagcuugagccacuuucccagugcuaggauugugugcacgugcucagcuuuuugcugguacuagagaacucggguccucacguuauacagcaggcacuuuaccaacuaagucaucuccagccucagguugacucuugaaugaagauaaaccauuuugaaaggagaacggaacccaauaugaugggcuaagccugcggaggauuagccaaaaggagaagguggcaagguggccuaaacuuaugcauggauaaaccaaaggcaaugggaaagguccaauauacugaaagacagacuguggacagauaucuaaggaauagauacuacaaagaaaggcuucugugcugagacucuugagaguuacuacugauugugagaaccagaaaaggcuccugcuaggugucaacaagacaacaacaaggaaaaaaucagguggaagaauggacaagauguugcagcugcagaugcuuaaaucuugauaaaaauggaauuuaugugaguaacacuguuucccaggagaagcaauccuggaagucuaacagacgccauauacagucauccuuggaggguacagagaggaugucaaagacuaugaggaggacucaugagucauggggaaagccaagaaugaagugaaaaaccacaguuaggggauugguccaggagaauggaaacaggaggaguggcugggccuggcgggaaugugucagcagcccuccuuucucccagaggucggaggagaaaggaggaguuccuuccagggacaagaagcagacacaccacacaugcccuuugcuuuuccaagaaauguaauucucuuaagaacuuuccaagccuuuuguauuaucugccauaggcuaugcuucuuuaaauuuuaccauaacuuguguuuaauucagaaaacauuuuccuccugcuauuugaaaauuccucagacauuuaccaacuuacugguucacuauuugucaaaaaaucagcccuucuugguguucagacucucuucucaucuuuuucugaaaguuguuaaccuuacccucaaccccaagcuucucuuuagugacuuuuugugacuccccuauacugaccaugcauacacccaaugucgcgcaguggaugaggaccugcugucuaaaacauguuaguguucacaagcagucugagugcucucaacuuggcaaggccugggaagguagcagagggacagcacuuuccuaccauguguaagaacacugaaaauaguaaugauacauucccagaaguacgaccaaucuggaugacuacugagaagauacacguuucccagucucugcaauaaauaugcagcaacaagaaaaggaaaacaaguuugugaaaaacaacuccaaaacccccuuucaaacuagaguugcaaugauggagacuuauugaaaacaaacaaaaugcaagaacaauggcauguguugcuugagacaggaucucacuguguggcccaggauaaccuaacacucgaaauucccucucaguuuucuagaauuacagggauggaucaccaagccuguccaacuaacaaaaagccaguggcugcuaacauaggcauauucgucugguacagcuccuuucuuagucaggguuucuaguccugcacaaacaucaugaccaagaagcaaguuggggaggaaaggguuuauucagcuuacacuuccacauugcuguucaucaccaaaggaagucaggacuggaacucaagcagggcaggaagcaggagcugaugcagagaccauggagggauguucuuuacuggcuugcuuccccuggcuugcucagccuucucucuuauagaaccaagacuaacagcccagagaugguccaacccacaaggggccuuucccccuugaucauuaauugagaaaaugccccacagcuggaucucauggaggcauuuccccaacugaagcuccuuucuuggugauaacuccagccugugucaaguugacacccaaaaccagccaguacaccuccuuaacaaagcacugcagcugguggcuggcugaugacaaaauagcaucucacaguucuacaggccagaggaccacaaucaaugcauggucaggcuugguccaagaagggagggaaugaggucuuucaagccuccccaauuggcuuuuacauagcuaucuuuuuccuuguguccuguccucccuguauauacauguguuuagauuucucccguugauaaggaccucugucauacugaugguccacccuaaggaagcuacuucugaacaccaagaagggcuaauuuuugacagagggaaccaguaagucaguaaucuccguaaagcucucuuucuaaacaaggucauauucugagguccuaagggucaggaauucuacaugugaacuuggggggcacaaaauacauguaguaagcauaaguuuaagaaggccagaagcacuuuacuaaaauguaauguugucaagaugacauaacauuuaaaauaaaauaaaauaaaauaaaauaaaauaaaaauacagccuuugcuuuuuauccuuugagguaagauauuucauuuugugcuuucccugaauccugccuuaaauaaccuguaaguguauauuagucacacauauggaaacaaguaagagcaaagugcuuacacuaaacugaguucugcagaguaucauugugugucugggggaggccauagagagcuauaucugugcaugugaagaaaccacugcagugacuugguuaucaaggcaaguagcagguuaaagacaucaacaacaaguucuaaaucugaauaugugggacaggucugaagccuccaugaagacccucuaauggacagcugugacaaugcugcaccuauguauggcuggggaagggagggucccuccucaugcuuacugugcuguuaaugguaguaaggcucugaauucucaccaaaauugcucuuuuuguccuuagagaccaccucagccacccagacuuacaacagucacugaggaggccgaguaguuggcugguaaggucagucagccucacaugaauuaugcuaucccuuagaaaugccuuauaaauuauaaagugagacucauaagcuggugugaagaaaauuggauauucccaaauguuugcuuauuccaugcucaguucacuacuaaauugguuuuuuucaagcuuagccagaaaaucugauacacuuagaagcagagcuucccauguuggugucuuccacuaugguaaauucuuuucuauuacuaucuguucaucaaaaggguguguugaacuuccugcucccagcagcugucuauaauguggccuuauuuggaaacagggucuuuacagguauaaucaaauuaagaugaggucauuagggugaguccuaauccaaccugacuggcgccuuuauaagaaaagaaaaguccacauaaugacacaggcagaaacugaacgcaguugcaauguaagauacaccauagacuacagggucuacaagacccuaggaagagaaaaagaguucuacauggugacaccuuuguuucccaucugcggcuccagaacugcagaagcuuacauuucugugguucucagccaccugguuuguguuacuuuguuacaguagcucuaggaaaggaauauacuacucuguaauacaauucaggauguauuucacugagaaaaacaugucugcauucaaacuauaacaaaguauuuuuagcugucacuuaagccaaauggcaacuuguccucauggcccucacagccuguauuugucaccucuaggcagaaaagcugcagaaguauccacagcuuuccuccaacacuguuguucccauuccagccaggacacugaacaacuaauucaugaugcaaauacauucaugcaucaugacugaggucugacuucagaacaccaugaaacuucacuuugucaucacuggggauccuaagagcacagacaggaacaacaagacuucaccuuuccuaaccucaacuucuugcugugguaggaaaggggagcguaacacagggucugcuaucacugccacacccagcugcugccucuguccucaccuuuauguguuccucugaauacuuucucagaugcugccagccagcugcucagagaacuuuguggagcguguugccuaggcgcagugaggcugaugaugggaaauggaugggcccugcuuucccugagaagucucucaggcagggcucauucaccuuccgucugaggguaugacaaucugcugcucuugcuggucuguguggcaacccuauuugcuacagcaacucuaccuucccuuuuuuauucucuggagaacuuugccauuccccucaccugcuuucaacugucaucugauuaaauucaguuacaggucaguuuagggaagcagaggaagugucaccuacugugacugaaagggcaggcaagagcaaugaggagaggaggcagagaaaguuagggaaggaggaaaaaaaaaaaaaaagagcaaagcagugacggccuaugccuuuaaucccagcacucaguagguaaaggcaggagcaucucugaguucaaggucagccuggucuacaaagcaaguuccaagauagccagaacuacacagagaaacaaagagaaaauaagaaucccugaaucaggagcacccucagaauaguaaacacugccgugcgcuuuggaaacuauggacuacaauaaugcaguguaugguaaugugugugugucugcauacaugugcagauauagaaggcagaugggaucccuuauccauacauccaacaguccacgcucacucacacggacucuaaaaguggguucuguggucuuucacaaagacauuauacugugagucacugucauugaacauauccccugauauuauuacucaacagcuccauaauucuaagccacuugaccuacagcuggcagaagugcuugcucucacaugggucccugccauuggugucucaggccauggcugagaugucagaugguacacuguggugguagaugguauagccucacaauaucgguccucuccagugucacugugcugugggcuccaaggauuaguuuuagaucauuuuugugucucuaccagcuaugccagaagcaguucuaccccuauguauccagcaggccacuuaaccucaauuccuuccccuagaaaguggggauaauagcaguaaaucacaagggcuuugugugcauuaaacaaguguuguguuuucuguuucuaacucuggcacacagugaacucuuaaaaagaugaauagugagaaacaaguagugugaggcuggccagcccaccaugguuaucaaauuacaugaggauagguuguaaaaacugguacucacaaugcucagcaugcuggcaaaggugagggaugcggcaugcagguuuuuaugaaugaacaagagagcagaaaaaaaaugaaaugagaagagauuuguauuaggacaauuaugaaagugaagcauuucuuuuuauguauuuucauauuccauguuacuaaaaaugccuacugaaagcacaaaaauuauaaauaaaaaaguuauaauaaaauuauaaauaaauaaagucuuagaaaauuauaaauguuucgguuuguuuuuacugaaucuuaguaacuuuucuugagccuuucacucaaaguuccugcuagaacuuaagagacucaagucauauaauacaaaaguuagguuuggccacaagugaggccuuaagccaguuuuuuaaaaaaaaggugugagagagguauuguuucugggccagaacuuugaagccagggugagaauuugucuucuuucccuugcuauauaagcagcccugauccaaggaggagaagcuguuuggccagggggacuggaggaccucaguggcccaauggagcaugcacgugagcaaucuguugcuguguguaucagaaccaucuaaggagcacucuacuuuccuuauguugccauuguggcugaaugugguuuugucuugaugcacaaggugcuuagccaucaaaaccagagcucacacuccugaggaugacguacaacuucuaaguaguuuaacccuuuucuuccuuauuuuaaugugagaauguuucagagagaugaagguauaaauaaugagaugacacuggccaucauaaguguuagugacuucaaguaugcacacaacaauuacuaccuagauguuuuucugaauaagcagaagguauagaauuaaaaaaugccuccuggaaacuuagaggcaagucacuuucugguuacuaaaaugagagcugccuuucaaacagagccuggacacuacugauaacaggucuggguuccugcaggggaauaucuguuuuuaucacauguugguguuucuuaugagaagaaugggccuuucucacucugcuccagugggauuccucagcuccaugaugcaaugguuaucuuuuugguaaagaauauucaaguccugacaucauaguaguaauggauauuacucaugguaugcucucaagcccagcauggcacauucuguacccucuuuaucacugaaguaagcaauggguuuaaaaauaacguugcuuacacacccagaguaccaaugauucauuaacaacugaacaaauacugcucuggacuccaaaauuauacagaauuuuauauacaggauuuugaggcauagguauuuuccacuucccuaguagaaguauuauauuguacagaccuacagaucuuuuuuuuuaauuaaauauuuucuuuauuuacauuucaauguuauuuccuuuccugguuucccuuccaaaaacccuuauccccucccuccuccccuugcuccccaacccacccaaucccacuuccugggccuggcauucccccacacuggggcauagagccuucacaggaccaagggccucucuucccauuuaugacugacuaggccauccucugcuacauaugcagcuagagccaugagucccaccaugugcuuucuuugguuggugauuuagucccagggagcucuggggguacugguuaguucauauugcuguuccuccuauggggcugcaaaccccuucagcuccuuggguacuuucucuagcuccuucauuggggacccugugcuccauccaauggauggcugugagcauccacuguuccggugaaggaggcagaggcaggaggaucuggaguuugaggccagccuaggagaucuacagaucuuaagagaaggaaaccuuaaaaauguacaaauucgggauuuaacaaguuaucugauuuaugacuccaaaauugccaaccuaaaguguaauuaaugauaauauccauacauuugcaaucccaguauaugaaacauuccaaaauaaaguccuuacaaggauaguucacaguggucauggugaugucuaggaaugagagucugugauuucccacugauaagcuaaggguguuggguuuggaguuuuacucagauucuuuaaagacaaacaucuccuccacagcagacguucugcuuagacaucuauaugccuuuugguuagcucugugcuuaacaagcaccucuguucucuugagaucccagauaaggccuugaaccauaaaggugagguucuccugacuggcugcuaggcuucauucauucaaacaauccagaguaagcaacuagccagccacuccaaagaugaacuaacuuguaccagacuuucagaaucaaauaauccuagaauuuuuaaagucagauuuucaaaucugcuaaacuaaggauucuauaggucauggugaauagucaaaacuaucugcugaguauguauauguacaagcaaaaugguacaaaaguauugcuuuuuuuuaaaaaaccagcaugcuguggaguaagaccagaaaagauaacugaccacagaaagcagcuaugacccucaccaaucaaauaucacugacucagagacaaggcacucccagugguggauaucuauauaggagaaaggggcccaaguaucagggcugaugaccuuaccuuuauuuaagauuuaugagauaucuaccucucacaggaccagggaugguuugcagauacaccaaaccaucaaaaucaagaugagaugaagcaggaccaaaucaucuacagggaacccuuacaggggaagaugcaaaugcugaacauugcugagcucaucaggacagcagcagauggauuuggagagacaggcuggugucugaguuugaggucuccagcaccugguuuugauucuguccuggacgcauaauggauacgguagagaagggagugggguuucugaaugggaaauggauauguauagccaaagacugauggcugugaugcuaucuguggugggcuaugaagcccacuguggcagugucuaugugugagguaauagaagccuguaugaagauggugucaggagggcuggagacagcucagugguuaggagcacugguugcuuuccgaggaccuggguuugacucccagcacccauaugagagcucacaagcagcaguuccaaggagguucucaggccuucccauggcuucuacaggcaguaggcaugcauagacauacauguaugcaaaacaccuauacacauaucuuaaggaugaugccaguggaagaguaauacaguggcuuguguucucaugcuaauuguguuacuccaaaaaccuuguuuacgauguccugcauguaggcuaaaggaagccugcccccaguuggcacugauugggaaauaaaguugccaauggcugggcaggguuaaagacuuuuaggauuccugggcaaaaaagaagaggagaagaaggauuccaccaugugaaggagaggagggugagacagcugaaacguaggcacuaaggggaagccgucccaugggagggcugcccagcaggcagcggggcagcaaaaauaaaauauagacuuggaaaauguuaacucaggaauaccggaggggagugugugcuagccauggagagguucaggaaguccccagccauugagcuaguaaggcauauuaaaaaaaaucgguguguguguauguguguaugugccuguaugucuuucuuucaggaaucuagagagcucugguggguggcuagaagugcgugugaccugcccgggagaucaauguggauuaacucuucacugcuacaggguaaggccuagccaaagacaggagacugaagaccuaucuaaugucuugagacugauggcagaagagagcagacuggaaaaaaacccaggcucagauggcuacuucaggcaaacagcugcgagaagagagaagggcaugcccugcaguucaagugccaggcugaacaaaggcacucuacucugucaccacaaagagaugaggcacaguuguguccaguuaggugaaguacauccccgagggaccacaggcagcagaaugcagaggacacacacuucuggccaagcuuccauccagccugcccucauuuucuaaggccaaagcugauuggaaacuaaaucagcucucagccugguccccugaguuacaaugaccauguucucagucaaaacugggagacacuacaaaagaacauaaaauccaaguccuuaauaggggugagauuuaaggaaagccacaauacuaaaaggaaacacaacaauucuagcccuacugggugaauugaaaaaaaaaaugugccaaccagggugcuucuguuuccucuaaaauauaaagaaaaugauccaaguuuguacaucccaucuaaugguggauacugaagacguuugugguacuucaccugcagcaaacaaacacacucagcuggcucccccaagacaaacugaaaugucaaggcagucuucuacugugccuguguggcucucacaggccagcucuugugguccugggccugcuagccaagcaucugcauucuguuuuaccuagguacaaaugaagcuaagggcccccuucccaccuuccuaaagaaacacauuccccuuuucuguccuagcucaaaugaugugguucauacaguaguccggcugaucucuucagugagccuuaccuugcuaaauaguuucuuuucuaaaaaauugcuaaaucaaaacaaaagguaugagaauacauucuaaauagaaauacagaaaagaguaaagaauacacauauugaugucuugcuucccagcuuuuacuccacaaaaauccggaaacuggggguuagaaaacuugcaaggcaauggucagcagcuagcagacuccuccuagccucagaucuccugagugaguuaccagcagccuccuccuagccucagaucuccugagugaguuaccaguagccuccucaagccagugagcuccaggagaaaaucaucucagcaggggcuuacuuuccugccuuuagccaaaccacaguauaaaccugcugggaaugcaucucucccuacacugcaggaaaggaagcugccaagcaaaggucagaugacaaugcccaggugacaguccaggaucuugugauuuucuuucaguuuuuaaauuugaaauuauuuccaaaugaaaaucauuaacugucuauggauggauguuacucauuagccacuguagucuggguccucgggaaccauccgugucccacccuccccaccccaugcuaucuauccccuccccgugcugcucuuccaccuggcuccucucuuggaaaacaucaaugcuugcaccuucuagggcacacuaccuuaccucuuuuuugcuagggccugugucucugaagaguuugcugcguguuuagggugguuuuuaaaacuaguaaaccuugacauuuuauuuaccacgucacaaagcuugcccucuuaaaauguacaguucagugauuucaaaaagagccaugugauugucaucacuaauucuaaaacauuuucaucacucugaacagaaaucccacagucgucugucccaucuccccuucccacaggcccuggcaaccucugauccacuuccugucucuauggacuugccuauucuagacacucagcauaaguggaauuauacagcccgugggcuuuguugucuuccuucacuuuguagaagucucucaagguuucuccauguacguguccgcauuucauucuccuucacugccacagagaccauuuaauagaucugguacaguuuguuucuccacuccucagugauggacaucuggguugcuugugcuuucuggcugcaacacacaaugcugcaagaaacuugagcaaauuuuuccauuacucuuggguuuaucuguagagugggguugcugggucaugagaggacuucauguuuagacuuuuaaggaaucguuacccauuuucuaaauuagccuucugaaauccccaaaagucccaacauacauguuccaggcaaugguuccaggcaagacacacugaaagcaauucuauagaaacagcugcccuccugucaucaguagaaacauaggcuacauucagagcaggauucagggucuguucaacucaaggcaaauaagcaaggaaagcugcgagggaggcaauuggugucagcagcacggcuggccugcauccucccaagagcaugccagcaccuggcauggcagucaaggcuggcacaaugugcaccaggccaccagaugaagaggcacucugugcaaggagcagcugcagugggaugcaaacugacaugcucucacugucccaucacaggccacuggucaggaacucaguagaguuauuuacuguugcucuagggcauacucuuuaaagugccuacugagaaacuaggagaaagauggaagagguaaggggcaggugaaaacagagaacaguaauccaagggauguauuaggaagacuggugcauuagugcuuaaagucuguuaguccugguauauuccagagugaauaaagaaacuguacccuuauggucuggcaacuaggggagagaucaagucuaccaccuguacaauugaugauucaguguugggcauggguccucucagagcuggcaggaaccaaaugccaaggcuucauucuugucguuuuuaggcagaaguacaaauuccagagcuaggcaaagaagcaagcuuugaggcugggguaggucagguugaugagguaaggaagacauccuuccacaggagagagagcaaggagcuaugcaucagugaaugccuuucauguaucuacccaagaaacacucagcucaggcacagccacuauaucugggcccccauuccugggccuucaugccccuguucaucugaaaugcucuuguccuucaacccacucuccucaggacagacuuuauuggcaggccugacauuauuuugcuuuuaaauuguauuccaaaggcaugcugguaucucaggcacauuuuaaccuguggugguaaagaaagaaaggcagguggcuugugagcuggcaucugucccaccauacacagcuguucaccuggccccagcaaaucugcucugaccuguccugccuucuauguuacuuccaaucccaugaguagcuagcaguuuaguacagcucuacauugccauaggcagucaugccaucuugugugcauuuauucuuccaguugccacucaguacauacccacuacaauuacuguuguuagcuuuuagcaucuggaauaugcucagccuuuaaagucccagaucacugaugugauggcaaaaagucagaggaaacgaaaaaaugcaguuaugaucuuuauagaaacuuucacccaaucaucacggcaccccugugaguuugucauugucaucagucucucugcagagggaacagacucagggauaccagcaggccuagcuacccaaggucauaagcuggccaaaggacagggacagacuucaaauguuucccagucuaacucuaaagccuguguuugcuauuaacaauacaaauaagaauauuuuuuaaaacuccagcuggcucauauauaugcugcgauccuagcacuuaggagacugagguggcgccugggcuacaugagauacuaccuggaaacauaagaaacaaacccuacacacuuauucaaacaugauggcuacauauucaaaugugaaggcaauaaucuguagaauaagcaagaguggaggagucggggaauacaaauucaaguguggauuuuaaagaagucaacauuuacaagcauagguuuccuuggcuauaaaagaaagaugauuucuaaaaugugcuuaguauccugugagguguuaauacuuauggggggaaggaaguagggucaaauaguuucugaaaugacagguuaaaauaauacuaagcuauugucuuuauugcagaacuucauagagcucacugugaaucaccaacagggccugcaauauacccuauagcccaaauuuguuuaucaaagagaaacuuuuuaaaccacaccaaguauuuaauauuuuuuaucaggagaaaagacuggaaaauaauggauugguuauucuaagguaucuuuuaacuacaacacaguaauuuuacaccguagcauccuaauuagucagcaaccuucuggagguuuuucuaagauuucaguaagguacaggcaggucaagauguucggagaugccaggguagucugugaacaacuauuccuauaauggccucauucauacaaagguauuuccccacuuuaaaaguaugagcugaagagauagcucagcgguuaagagcacugacugcucuuccagacauucugaguucaauucccagcaaccacaugguggcucacaaccaucuguaauggaaucugaugcccucuucuggugugucugaagacagcuacaaauauguaaaaaguaugaacaaccaaaggcaucugggcuagccuuguccuccaagacacaucuccuaggcaccaaggacuacuugacuaacuugagaggagucaauacauccguccauaacccaccaaguccaugucuaaggaaaggccaaguguuuagaucgggacugugccuuuacaacuuuauaccuucucaaagugacagggauagcucucaagcgggcccuccagacccuuuguaucaccacaggccccuuccccuggcagccaugaagagguccuagccacagaggucaagaacuuuccaggagaauguaagaucuuuuaucuuggacauggagagagucaaucauacuggcaaaaagggagugugugccugccagaaauggggaggagagagaagguguugagauuaaaaccaaggguguacaaggcagagaauacacacugggacauagaguucagugucaguagcuuugaagacuucccauaaaacucucuugucaauaaaacaggcacaugauuuuccuugagcuguuuuuguaugugacuuaaaauugccagaucacuccuggaaaacacauuacucaucucugcaguggcacaguggaaaaaagucaucaccccagauguaaaaccccuuauaaucccuauccccaauaaacaggaugaagggcucucaggcaacaacaacaaaaagcuguacauccacauagaaacggagggauaguagcaguccuaaauggguccagccaaucauccucucuagacuccagcuauccugcugcuguggauucuagagccugcuguaggaucaggguggcucaggcucggagcuaaaaggagccaugaaaguaucuaaggugaaggcuuaagaacaguuaguaucaggaaaauuaguccuagagagcaccuagaagcucauagaccucucugagaaaccugcgaugagaggcaaacacagacugagggcuagcugcaaauccaggcacacuauccacagcauauacagaacucuacaacucaacaacaaaaagauaaauaugcauuuuuuuaaugaguaaagaauauacuauauauuucuauaugcaaaaggacaugcaaaugacuaauaaacacauauacaccaucauuagucauuagguaaauauaagccaaacacaaugauaugcuaagaaauuuuaaaacauauguccauacaaaaacuuguacacaaacauuuaaggcagaauuaugugaaacagucccaaaguagaaacaacucaucuauuuguagacaaacaaaauagcaaacagcuauggcacagaguauuauuugcaagaaagcacugauauauacuauaauggggggaaaguggcaauauugugcaaaggaaaauaagccaggcacagaaggcuacacuuccauuuacaugaaaaguucaggacaaacaaauccacaaagaaguuaacggaaaguaacacagagaugagguuucuucgggggauaaggaugaaaauguucaggaauuagacacuaauuaaguacaccuaugugaguagucuaauaacgaauauguuugugguauacuaaguuauaucucaauaagaugauggaaagcuggcucugugacugcucuuccagggguccugaguugaauucccaguaaccacaugguggcuuacaaccauguguaaugggaucugaugcccucuccuggugugucugaagacagcuacaguauagucauauacauaaaauaaguaaauaaauaauccuuuaaagaaacaagacuguuuuauaagauaggcuacaacagcagcccucccaguccacuguucugcuuccauaaauuuagcccucuauguugugccaagauaugaaaauauuaaacauaaaauuccagaaagaagcaauucguaggcuuaaguuguacauuauuucaaacaugacaaacuugaauuguccuguuccaguucuuugaucaauauuucacauaguauauaauauaugcucuucagucacauggcaacuacuguagccaacaugacugccccuaaugcuacaucaaagagccauuuccucggcaaacucaucagggaaauaucagauaaucucacacuguagauaugacagugauauuuugagagaaagaaagacuauaugcauauaucuuuauuacagcauauuguuagaauuauuuuauuauuuauuuuaucacuggugaccucuugucauuaucaugguuuguguguaggagaagcaucaucauauauaagauugagaacugucugcaguuccaggcauccauuggucuugaaauccuagauccucuguggauaaggggaaauugcuauagugccuggcacacauuaucuccagugacccucaaagucaggucaucccccacauuacacaugaggacacuugagaauuagagaggaacagauaauugucaagggccacaacagagccucauuauggacagacggacacacagauggaguggauuuaagcuagcuuugccaacuccugaggccacauuccauucaccuuaccaugcugcuucuugccaagauaauaagcuaaccagcaacuauggaauggcucucuggaaaaaaaaaaaaaagauuacucccuagaugaagggucacugagcaauaaaaaaugugaguguuagaagucccauuaaaggccauccuugccaaauuccuccacuuuccagaugaauaagagaguacaaaagugacuggcccuaccaaagugggaagauugguagguacacccacccucuugugucaccaaagcagcuguauugcucucugcaauuaguuaaggacuaaaggaagccaaaguucccugauaaccagacguuccgcagccuucaaaugggccagccuugucuccaggcacccacuagaagaccacucaaauguuccaaaucaagcacuauguccccacauuccacaagucugcucuuccugucauuuucccuuucuaccaucacuaccuagguucuccaaggguccaagcuggcugcccaggcuuaccuuucucaccuggcucccuucaaccucaauuuccagauaagucugaggcccuuugacaccuagauccuacuuauuccaguuuaccuguuuacuauaggcagagcccuguagacucaauaaauguucguucuacccagaagccaaucuugccaacaaucagacauggcccugcaagucauagccagaacuauuuaaacacagaagagauggaugaccucaugcaaacagacgagaggaaaguuauuaaagcacagauuaagcccgggagcacagggcagaugggguugggggccucccucugugugcauccugcugggacaaaaaggcacauggagacaccagggcugccaaccgcaccugcaaauuauuaauuauuuuuguguggucccuuugaacgcuccaucugugauggcuacucuagucaaauaacuacauucaagugagaaaaccuguaacugaagacuugguccauucacggcagguuggauacccacuguccuaugaccauuugaggcgaauucaggcucuacuauucaaaccaaagccuuucuacaaacacuaaacagagcauucuggauauuuggggccucagugcuuucucucugugccucucuaauuguacucacuguauauuacuuggcaucacuucaugccuuuuguugcuuuguuuaauccugucugcagugaguugauaaguucuuggagaagccagagcguguacuuacguagagugauguaaguacagcagaauggaguguuuggagccccccuggcacacugcacccgauaaguacuggcuacuaucuaucagucacuauucuagcauggaugcccaggaccaaagcugcucaaguugaaaacagcuuuucuucacccucuucuccuuuccaaaccucuucuagaacuaaaacuucuuucugcccuauccaagacccaaugauucuggcugagcaucaucuccuuccaagccaccuccucugcugccuagagucuagucugccagagggggauggagccaaaggagagcagguuccucucuaauacacagcauuuccacaugacacacuggcuggucucagcguucagagaaaauauaagacuugagaagcuauuuguuucucuaugaaucagaaaugauaacuauguagagcuggaaaaagaagcaauuuuuaaauuauacugggcacugagccaaagccaguagugauacaaugacaacagucauuuguccaggauggccagaacagucacaaggacucgcucuuuuuuagugugaaacugcaucuaacgaugcccaguugggguuccauuuuagauucugaaauaucccacaugcagcugaugcagcagcuucuugagauuaugggguggugcuagggagggggugaagguacacagcaaagagaaaggcagaccuagccagggcugagcuucagcucagcaaaucuaauagcagagacgccaugggaaccucucuacuuccugaaaaguagucuagcuagagaccccaccuuucuaacccuggcaccagaguuaaagcccaacagggacuggcacacaaaaccugaaaagaaaccuacaccacacucuugcugccucacuucuucugucugccacuuuauuucauauuccuaugaaguacuaagcugcauaagacaacuuggacuuggagaagaaauagcaaagcccugcugagcauuguuuuaguaaaacacugagaaaauuugcuuguguuguuucuuuucccucccaccaucuccugcacuugagggcaauuccauacacaugccaggcauggcuaagccuaggugaccuucccaggagccccauaaaggauucaggaacccugggaguucuccuuggccuuaugccagugccauucuuauguucuagaucugcaacaccuaagauaguagccauuagccaccaguggcuauucuuaaguuaaauaaaacacaaacgucccuuggccucagaagucacauuauucuaagcacucugaugguagguaugagaaaauauagaaaccagacuucuaucccugcagaaagcucuuuuagauuaguuaguauuccagaugguagcauuuaaacuauagguggccaauuuaaaaacaaaagaaaacuagccaggucugguagcaaacaucuguaauccuagaggcugaggcagggagaagagaucucaaguucaaagccagucaaagcuacaaagccugucuaugcuuuaaaaauucauucauuuauucacuuaaaacccucugcuccuuguggucuugaacaaacuguauuuccaucucuaacaaacaauacugauuucuacaaugagguaaaaggucaccucaaagccacauccucacagaacaagcauugguaugcuucagaaguuguucuguuaguuucuccuuccugaacucucagccuuguauccagacucccaugcugcaaggggagcuuuaauuagggcacaugaggggcucucuuuccucuucuggaguuuacgaauuacuauuucuccagggaucugguauuagucugcaaaggcugcagcaaacaguacuaagaacugggugacuuaagcaaguuuacugccucacagauguagaggcuaaaaguucaagaucaaggugcuggcaagcuuguuccuucugaggcugggggaggggagggacugagcuaggccucucucccacugucuggugguugaugacaauauuuggugcucauuggugaauagguuuauuaccccaaucucugccuucauguucguguaacauuuucccugugggugugucugugcccaaauuucucccuuuaugaggacaccagucauauuggauuaggggccuacccugcuucagugugaccucaucuuaacauaauugcaucugcaacaaccauauuuccaaauaaggucacaaucugaagugcagggagucaggacuuuagcauaugaacugggggauggggugcaauuugccccauaauaggcccucaaagccuaaaagaaaaagcaauccuccuggcauaccaucugccuuccauuauucuauuaauaugaaaagaacuguacgaaauuauuggcuacucagcuuugcaggagcagguggugaccccaggcagaagcuuaugccacauaaggcuauuuccauuauacaucaagcaaacucaagccuauuacaguaguuuuaacaagauccaaaaaccaaaacuaaagccuggacuuggacaaaagugaaagaaaaaccaucccuuaucaauagucacagugcugguguaucccucuacauuugccuccuggagcccccucaugggacagggaucgucucuaagcagguaaaugaaacacaagugggagccaucuuccccugaggcacagggaggcauuugucacagugcucauguaaagcacuugccugagcucagccaacaaggucauaagagauagaaacucgccaccaguacagugagcaccagguguuauuuaugcagugagcuuccaauaaggacacaaggaaagaacugggaugguuuaguuuuccucugcugugggaacacugaccaucgugcugacugucugaaucaacugaaaagagcuaaagaaaggcuugcuuuucuugaugucuuguguaucuucucugauggcucuuguguaucuucucugucagagcugcucuagugcauggcacacuuauugagucauaagggauaagagaauggugguggcagguaacagggaagaccaaugagaguuagguaguagaaagacuaguuucaauccucuuucacacuuauaggaagaaagauguuggacaaacaucauauuguccaauguuuugaaugaggaaauaggcugagagccuaguaccaagucucugagugcaaagccaaauccuagccauuuccggacauucucaaaggagaucagcagaggaauggugccugggcacagcagcaaggcuagaaaugccucuucccacugaccccaucccucccuccuuuguuuaugcugcacuacacugguucacacugugcuaguacuggucauuccccaaccccuuacaaggacagaucaucagaacucauuauuagauuaaguaaguacuuaaucacaaucacugucuccucugacauuugcugaagcccucuuccaugccucuuucgaguaagauugacaucagcuugaagcacugcuauccccugacucagcugccuuuggcuuccuguuuguucccauccuugcucacccucugcucaacccaacagucuggcuuuugacuucuauacuccuuuaaauaccuggccuguauagagaugacaacgaggcaucuuaguuauggcuccauggcuuuaacaguuagacuucguccccaggagugguuaaagauagacauuagcacaguuuuccacccaauuauccuauuuacaaaaauagaacucuccucugugaguguuucaaauagaggccuuaauuccuacagaugucaaccuuagcaggucgauuccuaaacuacaucagugagcuggcaagaagcauggugagcgauggaacaucacuucaaaucaucucucaaaucaucucucaaaucaucgcuucagauacauucucauguaguauuagaaaucaauacaccugugcagagacaucuauucucuaguucuagugagaacugugugacagacaggaggcaggugugaagaguaagugggccuagugcauggcccaccaccagcacagcaccaagguuaagcauucagauuuccugugaguuccaaguuccagaauaugaaauuugcugagguacauuuugauauuauaucuugaauuuucaauaaaaacucuacaaaagagagacauucugguuuuuuauuugcuagggggacaacauuauucaauguugcgcuuacugcuucccagauuaagguucucauacaaaauacacucaacacaagcuaaaggaagccuugcuuuucuuucuuucuuuuuaaaaaaaaauauaggauuuauuuuuuuauuucauguguaugucuuuugucuguauucaugucugugcaccccgugcaugcagugcccucggaggccggaagagggugcuaaauccccuacagcuggaguuaaagaaggcugugaccugccaugugggugcugggaauuaaaguuggguccucuggaacaaccagugcuuuuaauugcugagcuaucucuccagccccuugcuuuucuugagaggcugauaugucuucaauaaaaguagaacuuacagcauuuaccacaccagcuuuuuaucucuacugccacgagacuccagaucagugagaagcucagcuaagcaucucuacagucugcuugucugagauuccugucccucguaucuuuaaacuacuauaauuguuuguauuuauuacgaucauuuuccuaaauucuuuuacugugcuguguauaacagcacauggagacacgcugcaaaacaagucaaaacuuacagaaaaaaaaguaugguauaauuaauugacuagaacucaauuaaaauaaucaccauaguaaauaaggccaaauuuagaaaauacauuccauagccagagaaacuauuuaaaaauuaacauguugaagcagaugcuccaaguugcuuaucugacagucauccccucuuucucaccugacaaaacccgaccugauccugacugcagagccaguccugguuagccuaagcaaaucauucuguguuuguggauaacugauccaggcaucugccacaaaacuguacacuuugagagguacgaaggaggagcaucaggggcuggagaaggcagaccuggccggagccuuagcuccucagaaggcucccgggaugcuuuucuccaggggcuacccagaacacggcggcgagccuaacaaguucaucucuaauaaauacuacaugcaaaaggcucucacuuuucuauaaaggaauucaaaaggaaggaagaaagggaaggagauagggagggaagaaggaaagaaagcaggcagccccauuucagaguauacuccauauccccucagcauuagaaaaaaaucuucuuaucuguaacucuaauugcucacaagccaccaacauuuugccuuaucuaacuggcuuucuucuuuguuugagacaaguucuggcuauauagcuccugcuagccuggaacucacuguguagacuggguggccucagacucacagagauccaccuauuuagcuugcuucagcuuccugggcgaggauuagaagcauguaucacaaggcuuggcagccuucuuaaagagacacacuagacacacacgcacacaacacauguacacauguugccuaaggcucaacaucaacugaacuccaacugccuacugcaucucccugcugccccugcaccaccccuuaagugugcccuccucuugcuaccuagagaacacugacauagacaucaaaaaaaaaaaaaucaaagaugcaauauagcacagaaccacucuucaaacccugacaaauaaaauaauccacuuuuaauauucuagucuccuccaccucuaucuaccucaugccugcucauuacuugaguuguccacauguaacuuucccacccagcucucucccuucuguaccaagucaugaccacaucccuucuaaggaacugaaagccaugaagcccauucaguggguuugagccuauugcaucuccugcuugcucccuccgacuuuucuuuuugagggcagaauuccccacugucggcuucugggcagcacauccugcugcucugccuacuuuaucagaugcacggaaggcaaagcaauacacucugcugaagcgccuguccugcugcaaagccagggacuguccuucaccaacauuuccagcuucauuccuaaauuucccacacucauccaaugaacugcuaucagcuggagcuauacacaucagagcucaucucauaguggacucagaugacaagugggacagaaacaaguguauuauuuuauugcacaauauguccuuauuaccaugaaaccaacuccaagggcaggucccaccauagggucagucucucagcaagggcacagguguguaucuguccaagaaucuucugugacucuuuaaaguuacucaggaaggcacugugaguucacuaguuuguucucggcugaacaacuaccaugggaauucacauacagugugccucaaugcacuggcuccagaaaggaaaguagcagaggcgagcuuccucuguggagcagagggcagcagagguaccagagugcccuugaaaaagacugguaaagcugaacgaccaguaacuaaaaagccagcuucccagggagcucaauggaaguggcuggccagguagccauacuagaaucagggaagacaguaaguaaucacuagagacuuccuacaggccaugguguucacugagagcagcacuaacucuaaggaugaacaccagcauggcacaugcccacagcauaaaugccagaggagggagaaacaguaaugauaccaauaucaugagggacagagaaaacccucuccugggaccauacacaaagaauauauuucaacacaacauguaaguuuuuccaacaagauagauaaggguuuauguaucaucauagcccauuugcuuagagacaggcagacggacagacagucggauggauggagcaaagagaaaggggcaggaaaugaaguauguuggacaugugaaaaaaauccaaaagugaagcaucuggagaccugcugacucucaaaucuuguuaaauggcugcagugugaggaaccggguauuucugcacaggaguaacauguacacuaccccacaggcgcugggccacacacccuaauccaauacagcacacauaguuuuuuuaaaaauuaaagugcaccugucccuuuaacuaugccaacugugagauggggaaggcgccaguggaaaggcauuuaaagcagauugccccauuuagggagauaugauucuuggaaacgaagacuggcauuuuuccuagacuaaagguuacacagaauaaccaaagagaaagagggcaacagccucaccuguuaggcuuccaccugacuucaaaggcaggagccacacaggagccagacguggaaacagaggccaggggaaagcucaaggccccaggcugcucucugcaguaauucaggauaguccugguuaccucaaaucucuguuugccuuuaaaaagaggacuggggaagcauacugugaagcagucaggucugaaggcaaagaaaaagggagagccuguccuucaagcccuugacccuuaauugcagaaccauuugaggaaugcuaauuauuuuaucuaaaucuccuaugauagaaggugcacaaacaauagauggccugcaaauauuaucuaguuuaguaucagggaaauagacaacucaaaaccuuucgugucaguggagagcacaacugaguauguccagaccauuuugaauacagcaagggaagagcuaaaacuacacacuucagacauaucaucucacaacacgacuaaaacuauuaagaaaaagaggaagagaucuuuguauacagcaagaaaaccaguuccaucaaaaacaagucaggucagaauguacacauaugugcaggcauguucaaucacauagcacacaugcuaauaaaaucuagagcugcuuagcuauuccuggguuauguaaagggcuguggcuuuaguucacuaguagauaauuuaucuauuauacaaagcccaagggguuugacuuccagcauugaagaaacuaacaaacaaggaacuuaaauuuucuaaaaauuagccaguuguggaacugcacaccuacaccugacaggcugaauagaggaaucucauguuugaggucauuccacaucacauagcaagacuauguucaauguauauguauauaugucaggggugugggcaaauccucucuucugcauaucagcccacagguagauuuccuggggaagaaggcaaaggugugaagggagacaaugauggaauuccaaaaccagagagguccaaacacucucacugcccuggauaggaaauaugggugacuugaagucauguggaagucugauucuuugacuagaaauggaugaugcacguaagugauacaaucaacgcacagaugucccugacuaugcaagaacaguuggccuuggagacuucucugucagacaggugcucccagcacuggggauguauagccugauacuuugaacccacuucuuugcuauuauuuccuguagaaagcuucugaaaaggggguucuugcuuguaaaaaggccuaacuagaaagaacuauucucucuuuccuaugggcaucacuggguuuagauguaacaccugaaauggcagcagccauuucugaacacaucuuggaaagagugcugguguuuuguuuuguuuuguuuuuuaaagauuuauuauauguaagcacauuguagcuaucuucagacacccuaaaagagggcaucagaucucauuacagauaauuuugagucaccaugugguuacugggauuugaacucaggaccuucagaagaacagucagugcuuuuaacugcugagccaucucuccagcucacguuuuguuuuuuauagaaauguuuauuauuauggccagaugugguggugcaugcuuuuaaaccagcacuaaggaggcagaggcaaaaagaacccugaguuuugaggguagucuggucuaucuagugaguuccaggucagccaggguuacauaguacuagugagacaucucaaaucauuaucaucaucaucaucaucaucaucaucauuauuauuauuagugcuuguguaugugauauguauagggacaaaugagugccacaguguggacaucagaagacaauucuguggaguugguucccuccuucaugugaguuccaaggacuguacuccggucauggguuugcaagugcuuuuguguacugaaccaccucagcagccuauuauaaccaaccauagaaucgaccuccucagaccuugcuagcagugagacagugagcuuuccuuuauguuaacacucauaauuugauuuaugucccuuaaagauaaaggcaccccaaccaauaaucuaauaaacaauacauauaacccaaagcagagcgacagcuuucucccaccccacugagcucuaagcagaugugccuaaccaacaagggaaccaugauuguuucuauuuccuauccgccuugcaguggacacugcacaguccuaugaggccauuucccaagaaucuguaaaggucaccugguccaccagccacuguaugcauccaauggugcucacucacucaucuugaacacauccaggaccaaacagagcuuguccucagugcugcugcuaagagauuccagcaugcagccccaauuccagucugaugagaucugcuuccuaugccuuucaaacccuugguucaaguagacccacagcuaauuguucuuaucuaucugacuuucaaauauuacuccuguccuuguuccuuucagacaaguauuuucuuacaguaaaugcgugaaccauauuucacuuuugccaucucucaggccaggauuuuggagaauucaguuugucucacuuaaccaaugaaugaucaauuaguuaaucucuuccuccuuuccucuguuuuuuccguuccucccucuuucccuccaauaaaaacaugccuaauauguaauaaucucuaaaucuuuggaccauauccaaaagucuaugccaaccguucaacacaaagaaucugaccuaauuaaaacaucaucuucaaaauauuuauauuuuuaaaaaguauuguuuuucugacauuuaaucauuucccuuucuuuacaaacuauauguauuuuagcuaugaugucuuaaagaugugcauggaagauaaauggaauuacaauaugcccccugccuaccauguguaucagauaaugcucucucauauguucuuuaauuuuuauuucuauuuucauguauaugaguauuuugcuuauacaugugcaugcaagccagaagagaacaacaaauccccuggguuugaaguuacaggugguugugagcuaccacaggggugcagggacccgaacccagguccucugcaagaacagccagugcuggccugcaacucagagauccaccugccugugccucccaaguacuaggguuaaagaugugugccaccacuauccagcuuuacaacugagucuuaauuggcaucacuuuuuucuguaaacaccuuacaaaauaaauuuagaaaaagguuuuaaaacacaguucuugguaagcucaggacuucuuaaacacacauaagcugaucaagcucuucaacaaccccauuccaauccccagaacaauacuuuuccccaauuucucucuuuuguuuuuuuuuuuuuaauuugcuagcaacuuguucaguagacauagucuagugguaaaaccuaugcuccugaaaagauaaugagacucuuagacauaugugccagcagcucacagucauuuguuuuaauguaagaaaaaguaauguugauuaucacaaaccauacaucauacaaaauuacuuuugccaggcuguuggauauaacacaugacuuucccagaggagaaaaacaacccucccucuaauuauguuuugccuggggaaaaacagaaauuaauuuauauguacuaaaacagauuuuaacuuuaaaaaguugagguggccuagaaacauaacagauccagucacugacucaauaagcauuuauuaaauaccaaauauuuaccaggcauugugucagcauugugguuuuagaauugaaagccuguucucugcucucaugaaaucucaccaaugugaacuacaagugaggacuaauaaauauacagaggagccagggggaaacucagcuacucacaaugagauaucauuacacacaagaauagcuagcauaaaaugcaaacacaugcuacaacaugggugaugcccaagaacauuaugcuaagugaaaagagccagcugcaagagaccacacauuuuaugauuccauuuauaagaaauguccagaauaccaagcagaauaauguuuucuaggaggagaagggggugagaauggagaaggacuguuaaugaguacaggguuccuucugggaaugaggaaaauguaaaaacucaaaguaguuaagauacaauauucugugcauagacuaaaauucauuuaacuacauaguuacaaaagugacuugugugaaucucaauaaagcugucaaaaacacaguuagaaaucaacagucuaguuauucaaguaaccaguuagaauauaaaaccucauuauuugcaagaaguagauugaaaguuacauagccuauaaaaauaaaacuuucaaaguuacuaaaguacacaagaaagaacacacaggggaaauggcauuagcuaggaagacugcacuuuagaaacacugcucccuccuaaguacuuuaugaauuuaaugugaucccaauggaaagguuaacagacaggcuuauuuuuuuccuggaaucaaguuacguugauucuaaaguuuuaauggaaaacaaccacggagaauagccaguaauacucugaagaggaaacaccgugagagagaacuagucuucucagauguuaaaagccucagguuucaauaaucaccaacgggggaaacacacagaguucaaaugcaaaacccaccacaaacuuacagaaugcugugacauuaugauaacauggcaaaaacagaaaccuucagcaauggaguugggacaacugaguacugggaaaauguaaagcuacauucaaaccucaggacacauacuauccuaguuuaaaaaccaagugaaccaacauauaaacggaaaaaauuagauuucaauaauauccaaaaggaaauuaaaacaagacacaaaaaaggucuaauacugaaucaaaauaccaaagcuaauuuuaaggagauauauuuuauuacauuaaagagaugggcuaaacaucaugacuaacuagaaaaggauuuuuuacaacucacuucaaauacaguguauaaagaacuauuaggaauaaggaagaaaagauaaacaaaauauugagaaaaugugugaaguucagaauacaguuuacauaaaacaaauauaaaaugcuaguuaaauauaugaaaacauaaucuuauuuauuuaugauaaaagaaauaauuauaaaacuaaauugaaauguuaagugucacuaccaacaaagcuccaaaaguuuaaccucagauagcaugggugacaucucaggaaaauaaguaucucaauguauugcugugaauguggagugugguacaaccacagccuugccaauugugggucuggugcauuccagucaaccugaaccuaacaaaaccuuaggcauaggaaacuagagacuaaagaaauacgcucauccucucuacagaaaccucagccgacucacguggcagguuuaagagucuauccagcaacugcacagggcuaacggacuacaaggaaguucacaacuagguagguacaggacagcagccugcagugaaugcugacuucaguguaucagauucaaaagacauuucaauuauggaaauacaguaugaacaaauuauuaaauaagcuuugcugaaauauaaaauuagcaagaaaaaagauuauaaaaugacuaacauuaugucauuuaaauuuuuucauauuccuauuuauagagaaagaccugaaaagucuggcuaugguaauaucuaauaagagugauauuuuaaaagcaugaggaaaccuguagcagcagcaggaacaugcguuguacaccuauugcuuauuucuaauguucuauacugcaguguuucaaaggcguuaaauaaagcuucaagauucccauuaaccuauaaaagcccaucugaaauauuaucuuccugguagcaugcaggauucuuggaauaacagaauaaucuccacauuggagcaccauugcuuagaucauucucuggcaaaucaaagauuuuuuuuuuccuagaugguaggauuucaauaaaaauaaagcaccuaccaguugaggucuaagagggauaaaaguggagcagaguggauuuucacagggccagcugaaaugccuccacaagcaauaauacuucacuuccaccuccccaccugaaaaccucaccaaugaaguccaaaaggcucaggggaaauggaaacuaacaaacuucccauagcacuccugucuaggagagagcugacuuaccaagacaggccugaugacagagcaucugccucagaauugcccucugacaauaaaggcacaacuucacaaccauggacaccguaauuuuuguuuggaaucagcacugcauuuuucuacugcagcaacauauaaaaugugugugaacacaccuuauagugugauugucuacugacuuagcaucucuguagugcauaacuauaauaugguggacaccacagagacugucacaacacacuccucuccuauuggagucugcagccucauggaagaagaaaguggaaaacaaggucacccaaaccaaugauaccugaaaagguuacauuaugaaugaaaaacaaaugaacaaaaaacaaaacaggguguucugauguuggaaaucagcaugugauugacagugagggcuagggaaugucaggggcagggaguaacauuuggacucugacugaagagugaguaggagcuugccagguacuccaugcagagagacuguacauaauggcauggagcagcaaaccccgaaacaggacagccacagaacugaaagagucaaaauaauggcaucaaaggagacuggagaaauaagcagggagcgcugugaccucugcuauucuacagaacuguacugaaaguggaugggaagcacuugcauaucugaaguggcagagugacagaucuaacauucacuuaauaucauugugguacauugggacaugcuggagagacucaagauugagcaugagagauggcgugguggcacaugccuuuaaucccagcacuugggagacagggcaggcagauacuugugaguucgaggccaaccuggucuacaucacaagacuguugaaauggacuauguugaaauacuugucucaaaauaaacaaaacaaacuuuaaaagaaaagggggagaaggaagaggaggaagaggagaaggaggaggaagaggaagaggaggaagaagagaaggagagccaugaguagccaauuuaggaagcuagaucaugcggcugggagacaacuguaaaaggcuagaggcacaaucacgaggaccugaguucaucccagcauccaaaaugggugcaguaaugcauacccaugaugaccccucugcuggggaagcugaaauaggcagguucuaggaauuacuggcuagccaguccagccaaaucagugaguucugugaaagacugucucaagaaaacagaacgauuacacagacaccugacaucaaccucuaacauucaccacaggcacaugcaugcauguacacacacacacacacacacacacacacacacacacaccaaaucagucaaaauaacagaguauuuaauaacagaguagguuaauggugcccaauucagcucaaaguauacuuuugcaaauaaaauauagcccaccuuucuguugcuuccacauggcaacuacaguacgcgcaguguugcccaaaguccaagagauauauuaucuggaccuuuauugagaaaguuugccagucccaggguagguaugacaguaggaacaauuggguucacaagucacaguccaccuuccuuacucaggauucugugcuguaaauucaucuguucacuaaaacugguuugcaauuccaaaaucaauacucagggcacuuucucucauuccuaugcaauagcagaauagcugggaggccaugcugcccucaugugugccuagcugaaacccagcaaagugaugcucugacuucuuauuucagcucuuacauagggaacaacugcccuauauaccauauaugguacuuuuuuuuuuuuuuuggucuuuuugugguuuuuuuuauuuguugauuuugcuguuuaaaaaugcuaaagauuuuuguuuuuguuuuuguuuuuguuuuuugggguuuuuuuuuuuuuuuuuuuuugguuuuuuagagacaggguuucucuguguagaucuuggcucuccuggaucucacucuguagaccaggcuggccucaaacucagagauccgccugccucugccucccgagugcugggauuaaaggugugcaccaccacugcccggcuaaaaaugcugaaguuuuaaacacugugaugagguauucauaugagcuucaagauauaagaaagaugugcuguuccuuaugagaaaaaagcaugcauuugauaagcacauuugggcuuuaguuacagcauugcuggcugugaguucagugguuagcaagauagcucagcaguuaaagcaccugucacuaaaccugguaaccuaaacucaaucccugcaacccagguauuaguagacggaaaaaacaacuccgaaguugaccucugaccuccacacaagccauggaauacauacauauguacauacauauacauguguguguauguacacauauauauguauguauauguguauauauauauaugcauuccuccuccuuacccucuuacccucuuuuccacacacacgaacauacaaacacacacacaaauaaauaaauagaaguuaaaauugucuguaagcagaaacauacaaaaacauuguuacaaaauguauguacuaaauuacaucauuacaugaauguuacuuuauguaaaacaccaauguuaaugaugccauguagagaucaauuaaaaauaugaccaaaaacucacaggaaauuaguccuauaauuucucuaccaauaauggcucccuguucauuaauucaggguucacagcaacuuuacagaacauaauaacuacagcuaauaaugagaauggccauacuuaagaagcaaaaaaaaaaaaaaaaucaguaaaaagcagugauggauuaaauagaaaguaaacaaaagcgugaaugauuccacuguuucugagguccacugcuguguggaauggauuggguggggaaaagcagagaacuugaguguacuucacacaaugaccaagaguuucuguuuagguguuagaguugggauacccaugagaucucuacacagagaugucaaauaaaccucaugacuccagaaauuaauuaguuaauuaauuaauuaaaaaaaaacaguccaaguauugacagaacuuugagagucacagauacacuuaagugguauucaaagucugggacacaagucacucaaagagaaaagaauuagaacacaggguccagacccaaguacagcaaggaacuccuuuccuuccacaauaagcaggagggcucauucaagucuuuaucuuggaaguuugauuuguuuaauuugaaagcacuuuguggaagaaauuaaucuauugguauauaucuaaaauaugacaaauguucaaaugacaugguaaacauaauuuggagaaaagaucuuaaaauucagauaaacuuuaauguugcagggaauuauccuaaggaauaauucaugaugguaaagccagaaauaaucuuaacauuuggggaauguuuacucugacaauauuaaugauauuuuccugugauuucaucuauagauucuaaucuuagaaauuucaaccuuuccagggauuuaauaaauguccacuucuauuuccuucaagcuuuaaaaaaaaaaaaaaaaaaaaaaaaaaaaaaaaaaaaacccgacccuagauucuuugcuuucauucacuacaccacaagcugcucuuuuuauccauuuggugcaaugcuguccaguaggcuccuagaacagucucuggcaugcugaguauacucaguggauauugguugacucucaugcuuuaaucacauaagacguauaagaaugugguguaacacgauauaacuugucagcuuuucucuccucacuuuggggcaccuccuccaucauuuguugaacacucucaagcagcagagucuggcucaccuaauuugucccacagauaagagaugucauauggccugcuaggagccagccagggcuguauaucauggcagagcacuugcuuaaaauguggaagacccuggguuugaucccaauauuuggcugcacucucaaacacaugcauacacacacauacaugcccaugcacacacgcaugcauccucucucucucucucucucucucucccucucucuguuucucucucucucucucucucucucucucucucucucucuguuucucucucucucucucucucucucucucucuccccgugauaacacaugccugugguucuagcacucaggagcaggaggaucuugagaucuaugcuaaccuuuguuacacagagucugaggccaguaugggcuacauagaaagaucuuaucucaaauaaaacaaaaggcaugcuauacuugaagugagugguaugguuuguuuuuguacuggguucacuacucuucccauagaagaccuaacuucuaugccuaccacuuuaucuuucaaggaaaguaacauaaaucugucucugcaguuuuaaaauauucagacuuugacugaaacaaagucauuuaugucuagagaagaaccaauguauuuacuaauuccacuuccuuaucuacaaugguugggaagucuccacuacagaggcauaaccugacaauaaaagguacccauuggaucuaggcugcuuuguauugagccuucugcagagagaacugccuaccuuccuaugucaucuguacagcuugcuaacagugcagccaacccugcagcaaugccacagggauacaguaaagucuuacuaugcaacaggcaaccucaugugcuugauaagucugugugcaucagcuguucaaaacucaucuccuugcugaaagugggcucauggcuuggcugcccuguuccacaccccuccuccgcaccagccacuguacuguguuucacucucacuaccuugucuggcuuggguauugaagaacauuuauguuggggagauuaacaaucuagcacuaauggucuuaacuuaguuauuucuucucuaugaagaauucuagauccuuacuguaugcugucugggccauucuaacaaaccugugaggaggagaguggccaacacgucaagacaagagcaggcugguaucaguggacucagguucaagcucuggcucugcuaugacuagucagaggcuuugaauacauuauuaaauacugucaagccucaauuuccccuuccauaaauugagaaaaucacagagcucuuaaacauuagcuaauaauaauauguuacuaugugaaugaugacugcccagucuguuccagagucccagggccaaacugcagacuaguuggcuguggaaggcgcgaaggacauaccuccugcaaacacugacaugccagaggggaugggaaggucuaugagaagacagaggcagccucugcacauuccugagccucucaagaagucauagucacaaagcagcaggacuaccaguccugcuaaugucgugucgcucccacacacaucgaagaaaaauacccaucugauuuuaaaugugcacugauucuucauuaagaacacuccuccaaaacaaugacuuuccacuggaaauguaacuggggccuaucacagacuuuacaaauuaaaacucuaggggcaaggccacauguuuuaacaagcccucuaagugacugaugguucuccaaaauagugccccacaaagauacacuucagagaguucuaugacaucccuuagacccucccaccuaccaggauaacaaggaacaaacaugcccaagauccacagagccagaaggauaaguagguaggcagaggggcccuguggguagauaauaagcacuuaaaguggagaggaaagauacugucaaggaugagcaggaggggaggccccaacugccaguggccaaaacucauacagcaaaguagcuaccagauuuacaaggucuuccaugaaguuucacugaugggaggaacaugcugacuauuggagcuaccuuagcaagccauaggacaugggucaguuucaugaccccuguacuuuaugaagcaacuccaagcaugagaugaauaggagggaaggaagaaaaugaggaacagaacaugaggugacacaauuacagcugccauuugcacagaggaaacauuucaaauagucuucauuacugaaguguuuggaacacaaggugccucccuauuagcacugccuuuaggcaagacucaaagcaccuagcaccccauucuauggcugaggggucuccagaaccaaggggugugcccauccauuggcugagaauccacuaucuaucuccuacauccccagggcuguaggcucccuguccauagaucucaagccuucucagggucuauggguauguacuccuaggccugacaagcauccaugggacacucuaagucccaagaggaggugagguggcugcaguuuggacucacuaaccaggaagacagaguggcauagguaaucagaugcaugcuugccccaggaucugcuaaugucaaagcaaaccugcccuucguuuguacucucaucaguauuaacuaagaucuguguccagaagucauucagcaggacagaaaugcuucccagccaggucaaaaccaacaccagugcaagugugcucacaggguccaguggggucagguuguuauugaaagcaguggccagucucaaguuuguggucaugucaaagggcaagaaugacucaaaacuggaccuuaggaaggcaaauuuguucuaaaagcugcuuaaugacuuaaaaguguuuugagguucugugaaacuaauccuaauuauacuggucccuugccugugauuaucuguuguuaauaaguagcucauagugacaugcuguaaacuugucaggaaaacauaaggaaucaucuccuaacagaagacugaaaaugcucgagcugaggaccuugcucuccucaggaaagaaaaacacaaccuuuagaugcuggccuaaguggcacugagugcaaugcugcaggcuggcagguaccccaggagauuagaggucaguagcucccucaagcacuggggauaacagguagugguucugaugaauccuaggaaccuagaagguacgcauucuaggcuguugugagcuucugugcacacuccacaacuccaccccacucuacccuagccuuccuaggcagcaucugcagccucuuuuugaucuggacuuuaggauccucacgugucagagguuagaacacuaacucauaaaggcccuaccaggcuguacuaugguccaagaaggcccuguacaauguaaagaagccuacaaaaagaagagagucuuaaaagaauuuuuuaaaacaaaguuuuacccaaaccagcaagucucccugauccuagaucccugccagagguacaggaggaaagcaaaacagaacaaauacuucuugaaccucugggccagacaccacugacaaauacucucucugaauguacucauagaccacucagacaccagccaucuccagaguacucacaccuccuuccacaguacccagccuccuggcaggcucccccaaguucccucccuccuccuauuacauccaggccacuaaaaaaucaccugguucaaguaucguuuugauacuaguccccuucuccacaccauaaaaugucucuugaauuggaaccccuuuuaagcuuugacaacugauccaaaacacuuacuguccucaucugcuggucuguuuugugcuuaccacuccagccaagcaaaaaucacuuugcaaaugaaucccauuaugcacucugcccauucaccuuguuaagccagcacaagagcuuuggcuguuucuguugucuuuauaaaaggacuaccucauuuauccagcuucccuggaauaggcugaugcacaaaauugaucuacauaaauuaauuucccucccuaccagaaacuuaacucuuuauguggccuuaaguccuuuguggagugagucaugguauaaucaagugaaacuuuauuuugaccauuuucauuucugugauacauuagacagccuuccccaucucaguaagcagaacauaaugaauaucaauucaucuuuuccuuaugguucaggucauacuuaaugaacuacagugaucauucuaggcugucacuauagauagaaaugauucaaagugaagccgacuucaugugugccuucuggagugaccuuucacuuucccuggaaaagauucucugaaacagccuucccaccugaaguccuugcuaucagcauggauucugaugaccggaugcagguacacagaauguggaggguaaacuagcugucuuucugcagaauuccaggaaucugaaaucugguuuuugaguucuauaaguuuuuuauuggaggguggagaaaaguggggaaaaacaaaacaaaaacuuccuuaacuugcaauaaaccaguuuuucaaaucuuuguuuuguguuauuuuuacaggcuguagguaaaaggaccacaaaaacggacuucuuaaauaggaugaugccaaaauucuauacaaaacuggcacgauggagucugacaaacccuuggaaaagucacuuugaaauugaagaauaauucacagauugaauaaggaaauauugguguggagggaaaugccccauuuucacuaccaagccuuuguaaucaagaugugaucuguaacugugaggaugagaggggcuguuucaucccauguuaugaagugcuucgaagcaauuucucacugcagcuggauagaaccaccaagggaggggugccuuguucuauuauguauuagauggcauucuuugugacaaagguuuuuauaaugucuacacauuagcacacacaaaagagucuaucagucuuacuucuauuuaaacauggcacuuaauugauuagaauguacuagggcaaaaguaguuaggcaagaaucauaaaagaaagaauacuaaguacuucacuacagauguagucaauagcagauucacauauaagugacaccacaagacuauuuuuuaguuuugaagguuugcuacuuuuuuugguaaugguuuccuuaaguuacuauuuuaauagcaaagccaugcaucagaaaaugaccugguggcaaugagacuguccacuauacuuuguccuuucuacuggcucuagacuaucaaggaggaugcccucugaagugagcauuguaaccacuaccauuaacaccuggcucacugacugguaaaacagguauggguuuugcugacucagaaucuauaaagaauuugacaaccuguccuuucuaaccugggcgaaguaauauuacacugagucacaagacucugugcacucuuuucuucaaccaagagcaauccaaguuagagauacuuuauauccucuauauucugucuguuccauagcagacacuuccacccuaagagcuggaaauagacagaugaaauucaaagggauguguagagcagagcagaagguagcaucuuuauugggggugagaauguuagacaaaaguauaaaaaaaaauauucagcaggguacaggcaugguacacacaucuuuaauuccaguacucuggaggcaaaggcaaguggauaucugugaguuucaggccagcuuggucuacuuauauaguuccaggccagucagggcuauuaagucagauucuaucuuuuuuuuuuuuuuuuuuuuuuuuuuuaaggcucaggauccaauuaagugcaagccaugaauccugcgcuguuguaaaguauugcucagauggcauuaaaaagaagucaaugcuacaaauguuuauaaaguuccuacuaggguuaaggaauguaaagcuacauuugggaacacaaagaugaaucagacauggcucuugcucuccagaaauuucccaggaagugagaauccuaaaguccuucucuugcauguuucauacuaauaagauuaucauuaaagaacugcauuuagauuugauuaccaccauuuuucuuaauggagagaaacuagagaguuuacaacagagaaaggagauauuucagaagcaaaaauaggcucugggguugggggaaguaaggaguccaauuauuaucuucaaauauaugaaagguuuuagagaaacaaaguaaaagaaaacaauuugaucaaaagcaaaugagauuuauagcaggccccaggaucucuguaccaucagauucaugaacuacuagaacugguuaaugaggaauugcuaauguucucuccugaauaauagcuaccagugagcugaagauucaaaucagggaaugaguccuugcuaagggcaaaggucaccucucauucucaggaauaccuuucaggacacagcugcaggaaaaagagaggggguguucuuuccucaguagcuacaaagggacuaggaaggcugccgucuacuauaggauuagacaaaggcauauccccuuagcccccucccaggugauucugcugagggcagggaggcagcuuucacuucucagagacuccugcuccgaggcucuauguuccugacuuaagggcacagccagacuuuucccagaaugaccuccuccugggaaauaacuacugugugacgacccaucuauguucaccagugaguccccaccacaugacugucuggaagacaagugagauggugaagccaggaaggaauucuccaacaggcacucauggaugugagacccacucacaacacaaucuucaacucuaaauguaaaaagcagagguaccccagcagcaugugcaugugagaacaguauuugcacugaugaggauacacaauaaaaguuaaauaaugaagccgggcagugguggcgcacgccuuuaaucccagcacuugggaggcagaggcagggauuucugaguucgaggccagccugaucuacagagugaguuccaggacagccaggguuacacagagaaaccugucaugaaaaaccaaaaaagaaaaaaaaguuaaauaaugaaagaggaaaacagcauccucugcaaaagagguugugauauuuaaauaauuucuaaggaaaucuguaaugagaagcuuugaaauucauuuaaaaaauuaaguucaacuaaagaaaacauuucaauauaaaagagaaauuggggucuucccuuuguaccuuaagaagacaagaguauguaagaacugucauacacaaaaacaaacaaaacaagcauuucaucugggucagacacacugcccagugaaucuguaugaguuuaaauauuuugacuuucacuuccccuauuccugaacucccagaggucagaggccaagucuuugucauuucucuaaacgcagaaccugccacgaggcccaggccacagcagagccuuugugaauguuugcugacugagugcacgacagaugcgccuggucugccgagugagggaacaaacagggaguucagcgaguagaaagagcagaaaguacaugacccaaaucucggucuaagucauaaucaccaucaucaaccugcaagcuucucagcuucuuuuaaagaaaaaaauaaagaucuuccuguacucuggguuuucaauuuucuggguuuuuuuuuuuuccuccuuucuccuuccacaaaguauugucgcaugaaauggagcuauugugagugugggccuuucaaguucgaacucugaguggucacacaagucugcuggcauuauuccgaagccagccuuugacugcaaccccaagcagcugaaucgucauacuaaggcuaccagaaagcacuagcaaagaacaauaaaaacugugcacauguccuacgcucuugaucaucaguacuuugcuccauacaagccucaagucaccuuagccuuagccuuagccauagacuguucucuacggaagaaaggaagaaagaaaugaaggagcacaaaacauaaaauaugaaguauguaagcagcuauaacuuacauaaagcccccaguuuucuuuggugagaaauucauguuuaauugccuagugaggcagccccugacauguggcuggguaggagccucuccucugagaagaaccaguaaggaacuuuuggggacuccuuacccagccugccaccuuguacaggaauggguccuugcuaagguccuugcuguucauucucagggaugccuuccaggacacagcugcagccccugaaagucugccucccagguuguuuguacauuuauaacguagcacaaaagugcugcuauggaagagacagucucuacuugaaaccagcagaagcuugaugggaauaaagacuccagaaaggucacagaggaagaaaaaaagguucuuucuucuguggcuauggggguuuauuguugcugguucccaaacuagaaaaggaauagcaggagauuaauaauugaaauugaaguguuccuauugcugguuuucuaaacuauuugaggguuaugcuuucccuagagucaucaugccuguaaacaacuaggaagacagagagauuuaacacauacugagaaaaugccuacuccaggcaggaacucuacuaaauagacucgguucuaacuguauccucacacaauccaauagaggcuaaaaguucugaaaaguaaaggcauaaacucauucaacccccacuuucccugauuugaguguccugccauccugacuaguuucaaagauaaaacuaaugaguuugauucacuauucagguguagcaauaagguaaacaaugguuaugcuuuguuauucacaaaugugcgacaaaaacacaggcaaagauacaacagacuacucguugcaaaccucuuuucagggaagaugauuccuaaucuuauugcuccguuugcaucuugguggccaggugucuucggguccaucugaugagggacuucagcaugccaguguuuacaagucugaaugugaaagguucuuugguuuccuccacacugaucaacaagccacgucucaggcaagugaggcauaguuaacuuggaauuuaggucucucuaguugggaauccagaguuacagaccccugugacugacuuuugcacuacaugcugaaaaagccuugguaagcaaguugauggagaaauauaaucacaaggcaaauguuuaaccuucuaagaaaauaucccccuuuauuacaagaaguuuaacuugaucaguaucaagccacugaaaacuaaugugauauuuauaagccgacucuuaaagacaguacuggaagacuguuacacuuugccacuuauuaaucccuauuaucaaauaugcuuuguuucaaaaacagcacaccugucuagauuucuacauuccagccuucacucggaaucugagucacacuccauuugagaaauuccagcuagaaagucucauguguaauuagaccucugagaagaaucauguggaacuauuaggaggagaaaucccucuuuuggagaagucuauuaaaaaaaaaaguccuguucauuuaugaccacacacacacaccccacagucccuggguucugguggaaauaugauaaaagucagguucacugaguccacagauugucacugggggucaagggagaggucaguguaguguuggccauacucugcacugugagugagcaugggcacuggaagcauaggccuugacuacggaggucauuucucugucucauagcaugccuaacagucucucucaaaaagaccagacaggccugagcucugggcugaguaacucuggguugguggggaagaagugcugagcaagaggaggaaaagaauucuagagauguaagagaugcucccaaagaagaaaaaaagcuacaaacaaaagaacaauuaagagaacccacagacaaggcccaaggaaacccaggauggaaaggaggugacaaauuagguugccugggauagaggagggcuggaaaguaaaacuccaagcagagagagaccucugaaccccacagucccacaguguaacacuuuacacaccuguaauugcuuuuccgacacaaucacuaaaagaacaauguccuaggaccaacugugcugggucuuacuuagccccgggggcuagccuacauuccucauggauuucaaaugaaaucaacauaaucaaugaaguucccaggguggcuuuguucaagguugacaaaauacaucccgacccaccuccccagcuuccuggaagaggaauuuuuauuccucuauuacaguugugaauucaaugccaaguucuuucuaaaaugcucacccggaguguccagcagagggagucucaaggagguacuuaauaaagagaaaacuguuucauuuuaacacucuagacagugggagcuuugacugcagccccccuccccuagacacagaugaacaaugaaugcccgacauggguucuccuacauguucacguccccacuggcauguuucuagucuacgugguggagugauccgaaauuuuguuuuguuguguggaacgguuaaauagaccuuguguucuucggaaucaaagaggaaagccccuggaauaacauuucucuguugcuuucuaaacagccccuuuguuucuaagagacucuggaaaaaauauuuacaguccauagguuauuuacagccuuguuauucagagccugaaugguaagagaguccaugcagaaaccuaauucauuuagagcccugguacuaauaacagauuuucuuuucagauaaguuuuuuuuuuuuuuuuaaaucagccucuccuaacagagauaaaacuauuaaugagaucccuguuucacucggcccaacaguucccuggguuuauaggauuacaaucuccccuagccccuccucuugguuccuggcaaacccguuucccucucauuugcgauuucauacacagaauaucugaacaaaaccgaaagaaagccagauggacccacgcuaaaaguauguaaagggcugcuauuucaaugauuucacgagagaaacauuuucacgacgaaauaacugaaaaaaucuggcacacuuugguugaaaaauacccgguacuacaagcacacaaaaccccauagaagaguaaaaacuuaguugauuccggcuugauuuucucgcugcaagcugacggaacugacugaagagaaccgaaagagugcgcgaggcagcuguaucgccuuaccuuuucuuucuucuaaagacagucaaaugggaaaaaaaucagccaacgccaggugaaggugcacagcaccgaucuacccaggccgagccagaaaaccuucuuucgcacccccuuccccgccccccccaaaaagccaaacuacauucucccuuccacacgccaacugcggggagauuuugagccuauuucauuguucugccugggucugaaauggacuuuucaucucaacccucucucaucgcuuggccccuuucaaucggauuccacagccaccaccaccaccaccaccccccaaaaaucggaggcucgggaagaauaaaggaguguggggugggaguggagauguuuggaaaagggagcagagaggacggacaaguagaaaggagaucguuuaaagguaaugggggaggaccgcaucaccuucauuuaucacaaauaaacagaaagcagucacggauccgucuuuucccacacgccgcccccauuucuuuucuuugggcagcagcccaccggcacacaccccccagccgccuucucugcccuggaaauaagauccugcuccaggccggcuccggucccgucuggacccaggaugggggcaccggggaaggucgcgagcccccaggaccagggcccggggcugcggccgggggcugccgggcgaggggccgcgggcagaacaaagcuacgggggccgcggcuggccgagcgagcggggggaucgcgggccgggugccccuuaccuucguacacgggggccaucggggccgggguguccgcgguucauggcaacggagaagggaacgcggcgcgcgagcucggcccccucagccucagugggaaucugccaucuugagccugugucuccgcucucggcgcagcccaggccgccagcgcccgcaucaccgccucacuuggccggcgccgggggagggggccgggcgggcgcgucgccgccgccgccgccgccgccguagccgcggcccgggcccugcgcggggggcucggccggcccggggcggcuaaggcgccgaggccaagggccgggcggguccgcgagggcgggagccggggcgggcugcggcggccagggcccgggccggagcucagcuccgcauggcugugaggcgggggc

SEQ ID NO: 12360 - RNA, 178352 nt, Mus musculus
gcccccgccucacagccaugcggagcugagcuccggcccgggcccuggccgccgcagcccgccccggcucccgcccucgcggacccgcccggcccuuggccucggcgccuuagccgccccgggccggccgagccccccgcgcagggcccgggccgcggcuacggcggcggcggcggcggcggcgacgcgcccgcccggcccccucccccggcgccggccaagugaggcggugaugcgggcgcuggcggccugggcugcgccgagagcggagacacaggcucaagauggcagauucccacugaggcugagggggccgagcucgcgcgccgcguucccuucuccguugccaugaaccgcggacaccccggccccgauggcccccguguacgaagguaaggggcacccggcccgcgauccccccgcucgcucggccagccgcggcccccguagcuuuguucugcccgcggccccucgcccggcagcccccggccgcagccccgggcccugguccugggggcucgcgaccuuccccggugcccccauccuggguccagacgggaccggagccggccuggagcaggaucuuauuuccagggcagagaaggcggcuggggggugugugccggugggcugcugcccaaagaaaagaaaugggggcggcgugugggaaaagacggauccgugacugcuuucuguuuauuugugauaaaugaaggugaugcgguccucccccauuaccuuuaaacgaucuccuuucuacuuguccguccucucugcucccuuuuccaaacaucuccacucccaccccacacuccuuuauucuucccgagccuccgauuuuuggggggugguggugguggugguggcuguggaauccgauugaaaggggccaagcgaugagagaggguugagaugaaaaguccauuucagacccaggcagaacaaugaaauaggcucaaaaucuccccgcaguuggcguguggaagggagaauguaguuuggcuuuuuggggggggcggggaagggggugcgaaagaagguuuucuggcucggccuggguagaucggugcugugcaccuucaccuggcguuggcugauuuuuuucccauuugacugucuuuagaagaaagaaaagguaaggcgauacagcugccucgcgcacucuuucgguucucuucagucaguuccgucagcuugcagcgagaaaaucaagccggaaucaacuaaguuuuuacucuucuaugggguuuugugugcuuguaguaccggguauuuuucaaccaaagugugccagauuuuuucaguuauuucgucgugaaaauguuucucucgugaaaucauugaaauagcagcccuuuacauacuuuuagcguggguccaucuggcuuucuuucgguuuuguucagauauucuguguaugaaaucgcaaaugagagggaaacggguuugccaggaaccaagaggaggggcuaggggagauuguaauccuauaaacccagggaacuguugggccgagugaaacagggaucucauuaauaguuuuaucucuguuaggagaggcugauuuaaaaaaaaaaaaaaaacuuaucugaaaagaaaaucuguuauuaguaccagggcucuaaaugaauuagguuucugcauggacucucuuaccauucaggcucugaauaacaaggcuguaaauaaccuauggacuguaaauauuuuuuccagagucucuuagaaacaaaggggcuguuuagaaagcaacagagaaauguuauuccaggggcuuuccucuuugauuccgaagaacacaaggucuauuuaaccguuccacacaacaaaacaaaauuucggaucacuccaccacguagacuagaaacaugccaguggggacgugaacauguaggagaacccaugucgggcauucauuguucaucugugucuaggggaggggggcugcagucaaagcucccacugucuagaguguuaaaaugaaacaguuuucucuuuauuaaguaccuccuugagacucccucugcuggacacuccgggugagcauuuuagaaagaacuuggcauugaauucacaacuguaauagaggaauaaaaauuccucuuccaggaagcuggggaggugggucgggauguauuuugucaaccuugaacaaagccacccugggaacuucauugauuauguugauuucauuugaaauccaugaggaauguaggcuagcccccggggcuaaguaagacccagcacaguugguccuaggacauuguucuuuuagugauugugucggaaaagcaauuacagguguguaaaguguuacacugugggacugugggguucagaggucucucucugcuuggaguuuuacuuuccagcccuccucuaucccaggcaaccuaauuugucaccuccuuuccauccuggguuuccuugggccuugucuguggguucucuuaauuguucuuuuguuuguagcuuuuuuucuucuuugggagcaucucuuacaucucuagaauucuuuuccuccucuugcucagcacuucuuccccaccaacccagaguuacucagcccagagcucaggccugucuggucuuuuugagagagacuguuaggcaugcuaugagacagagaaaugaccuccguagucaaggccuaugcuuccagugcccaugcucacucacagugcagaguauggccaacacuacacugaccucucccuugacccccagugacaaucuguggacucagugaaccugacuuuuaucauauuuccaccagaacccagggacugugggguguguguguguggucauaaaugaacaggacuuuuuuuuuuaauagacuucuccaaaagagggauuucuccuccuaauaguuccacaugauucuucucagaggucuaauuacacaugagacuuucuagcuggaauuucucaaauggagugugacucagauuccgagugaaggcuggaauguagaaaucuagacaggugugcuguuuuugaaacaaagcauauuugauaauagggauuaauaaguggcaaaguguaacagucuuccaguacugucuuuaagagucggcuuauaaauaucacauuaguuuucaguggcuugauacugaucaaguuaaacuucuuguaauaaagggggauauuuucuuagaagguuaaacauuugccuugugauuauauuucuccaucaacuugcuuaccaaggcuuuuucagcauguagugcaaaagucagucacaggggucuguaacucuggauucccaacuagagagaccuaaauuccaaguuaacuaugccucacuugccugagacguggcuuguugaucaguguggaggaaaccaaagaaccuuucacauucagacuuguaaacacuggcaugcugaagucccucaucagauggacccgaagacaccuggccaccaagaugcaaacggagcaauaagauuaggaaucaucuucccugaaaagagguuugcaacgaguagucuguuguaucuuugccuguguuuuugucgcacauuugugaauaacaaagcauaaccauuguuuaccuuauugcuacaccugaauagugaaucaaacucauuaguuuuaucuuugaaacuagucaggauggcaggacacucaaaucagggaaaguggggguugaaugaguuuaugccuuuacuuuucagaacuuuuagccucuauuggauugugugaggauacaguuagaaccgagucuauuuaguagaguuccugccuggaguaggcauuuucucaguauguguuaaaucucucugucuuccuaguuguuuacaggcaugaugacucuagggaaagcauaacccucaaauaguuuagaaaaccagcaauaggaacacuucaauuucaauuauuaaucuccugcuauuccuuuucuaguuugggaaccagcaacaauaaacccccauagccacagaagaaagaaccuuuuuuucuuccucugugaccuuucuggagucuuuauucccaucaagcuucugcugguuucaaguagagacugucucuuccauagcagcacuuuugugcuacguuauaaauguacaaacaaccugggaggcagacuuucaggggcugcagcuguguccuggaaggcaucccugagaaugaacagcaaggaccuuagcaaggacccauuccuguacaagguggcaggcuggguaaggaguccccaaaaguuccuuacugguucuucucagaggagaggcuccuacccagccacaugucaggggcugccucacuaggcaauuaaacaugaauuucucaccaaagaaaacugggggcuuuauguaaguuauagcugcuuacauacuucauauuuuauguuuugugcuccuucauuucuuucuuccuuucuuccguagagaacagucuauggcuaaggcuaaggcuaaggugacuugaggcuuguauggagcaaaguacugaugaucaagagcguaggacaugugcacaguuuuuauuguucuuugcuagugcuuucugguagccuuaguaugacgauucagcugcuugggguugcagucaaaggcuggcuucggaauaaugccagcagacuugugugaccacucagaguucgaacuugaaaggcccacacucacaauagcuccauuucaugcgacaauacuuuguggaaggagaaaggaggaaaaaaaaaaaacccagaaaauugaaaacccagaguacaggaagaucuuuauuuuuuucuuuaaaagaagcugagaagcuugcagguugaugauggugauuaugacuuagaccgagauuugggucauguacuuucugcucuuucuacucgcugaacucccuguuuguucccucacucggcagaccaggcgcaucugucgugcacucagucagcaaacauucacaaaggcucugcuguggccugggccucguggcagguucugcguuuagagaaaugacaaagacuuggccucugaccucugggaguucaggaauaggggaagugaaagucaaaauauuuaaacucauacagauucacugggcagugugucugacccagaugaaaugcuuguuuuguuuguuuuuguguaugacaguucuuacauacucuugucuucuuaagguacaaagggaagaccccaauuucucuuuuauauugaaauguuuucuuuaguugaacuuaauuuuuuaaaugaauuucaaagcuucucauuacagauuuccuuagaaauuauuuaaauaucacaaccucuuuugcagaggaugcuguuuuccucuuucauuauuuaacuuuuuuuucuuuuuugguuuuucaugacagguuucucuguguaacccuggcuguccuggaacucacucuguagaucaggcuggccucgaacucagaaaucccugccucugccucccaagugcugggauuaaaggcgugcgccaccacugcccggcuucauuauuuaacuuuuauuguguauccucaucagugcaaauacuguucucacaugcacaugcugcugggguaccucugcuuuuuacauuuagaguugaagauuguguugugagugggucucacauccaugagugccuguuggagaauuccuuccuggcuucaccaucucacuugucuuccagacagucaugugguggggacucacuggugaacauagaugggucgucacacaguaguuauuucccaggaggaggucauucugggaaaagucuggcugugcccuuaagucaggaacauagagccucggagcaggagucucugagaagugaaagcugccucccugcccucagcagaaucaccugggagggggcuaaggggauaugccuuugucuaauccuauaguagacggcagccuuccuagucccuuuguagcuacugaggaaagaacacccccucucuuuuuccugcagcuguguccugaaagguauuccugagaaugagaggugaccuuugcccuuagcaaggacucauucccugauuugaaucuucagcucacugguagcuauuauucaggagagaacauuagcaauuccucauuaaccaguucuaguaguucaugaaucugaugguacagagauccuggggccugcuauaaaucucauuugcuuuugaucaaauuguuuucuuuuacuuuguuucucuaaaaccuuucauauauuugaagauaauaauuggacuccuuacuucccccaaccccagagccuauuuuugcuucugaaauaucuccuuucucuguuguaaacucucuaguuucucuccauuaagaaaaauggugguaaucaaaucuaaaugcaguucuuuaaugauaaucuuauuaguaugaaacaugcaagagaaggacuuuaggauucucacuuccugggaaauuucuggagagcaagagccaugucugauucaucuuuguguucccaaauguagcuuuacauuccuuaacccuaguaggaacuuuauaaacauuuguagcauugacuucuuuuuaaugccaucugagcaauacuuuacaacagcgcaggauucauggcuugcacuuaauuggauccugagccuuaaaaaaaaaaaaaaaaaaaaaaaaaaagauagaaucugacuuaauagcccugacuggccuggaacuauauaaguagaccaagcuggccugaaacucacagauauccacuugccuuugccuccagaguacuggaauuaaagauguguguaccaugccuguacccugcugaauauuuuuuuuuauacuuuugucuaacauucucacccccaauaaagaugcuaccuucugcucugcucuacacaucccuuugaauuucaucugucuauuuccagcucuuaggguggaagugucugcuauggaacagacagaauauagaggauauaaaguaucucuaacuuggauugcucuugguugaagaaaagagugcacagagucuugugacucaguguaauauuacuucgcccagguuagaaaggacagguugucaaauucuuuauagauucugagucagcaaaacccauaccuguuuuaccagucagugagccagguguuaaugguagugguuacaaugcucacuucagagggcauccuccuugauagucuagagccaguagaaaggacaaaguauaguggacagucucauugccaccaggucauuuucugaugcauggcuuugcuauuaaaauaguaacuuaaggaaaccauuaccaaaaaaaguagcaaaccuucaaaacuaaaaaauagucuuguggugucacuuauaugugaaucugcuauugacuacaucuguagugaaguacuuaguauucuuucuuuuaugauucuugccuaacuacuuuugcccuaguacauucuaaucaauuaagugccauguuuaaauagaaguaagacugauagacucuuuugugugugcuaauguguagacauuauaaaaaccuuugucacaaagaaugccaucuaauacauaauagaacaaggcaccccucccuuggugguucuauccagcugcagugagaaauugcuucgaagcacuucauaacaugggaugaaacagccccucucauccucacaguuacagaucacaucuugauuacaaaggcuugguagugaaaauggggcauuucccuccacaccaauauuuccuuauucaaucugugaauuauucuucaauuucaaagugacuuuuccaaggguuugucagacuccaucgugccaguuuuguauagaauuuuggcaucauccuauuuaagaaguccguuuuugugguccuuuuaccuacagccuguaaaaauaacacaaaacaaagauuugaaaaacugguuuauugcaaguuaaggaaguuuuuguuuuguuuuuccccacuuuucuccacccuccaauaaaaaacuuauagaacucaaaaaccagauuucagauuccuggaauucugcagaaagacagcuaguuuacccuccacauucuguguaccugcauccggucaucagaauccaugcugauagcaaggacuucaggugggaaggcuguuucagagaaucuuuuccagggaaagugaaaggucacuccagaaggcacacaugaagucggcuucacuuugaaucauuucuaucuauagugacagccuagaaugaucacuguaguucauuaaguaugaccugaaccauaaggaaaagaugaauugauauucauuauguucugcuuacugagauggggaaggcugucuaauguaucacagaaaugaaaauggucaaaauaaaguuucacuugauuauaccaugacucacuccacaaaggacuuaaggccacauaaagaguuaaguuucugguagggagggaaauuaauuuauguagaucaauuuugugcaucagccuauuccagggaagcuggauaaaugagguaguccuuuuauaaagacaacagaaacagccaaagcucuugugcuggcuuaacaaggugaaugggcagagugcauaaugggauucauuugcaaagugauuuuugcuuggcuggagugguaagcacaaaacagaccagcagaugaggacaguaaguguuuuggaucaguugucaaagcuuaaaagggguuccaauucaagagacauuuuaugguguggagaaggggacuaguaucaaaacgauacuugaaccaggugauuuuuuaguggccuggauguaauaggaggagggagggaacuugggggagccugccaggaggcuggguacuguggaaggaggugugaguacucuggagauggcuggugucugaguggucuaugaguacauucagagagaguauuugucaguggugucuggcccagagguucaagaaguauuuguucuguuuugcuuuccuccuguaccucuggcagggaucuaggaucagggagacuugcugguuuggguaaaacuuuguuuuaaaaaauucuuuuaagacucucuucuuuuuguaggcuucuuuacauuguacagggccuucuuggaccauaguacagccugguagggccuuuaugaguuaguguucuaaccucugacacgugaggauccuaaaguccagaucaaaaagaggcugcagaugcugccuaggaaggcuaggguagagugggguggaguuguggagugugcacagaagcucacaacagccuagaaugcguaccuucuagguuccuaggauucaucagaaccacuaccuguuauccccagugcuugagggagcuacugaccucuaaucuccugggguaccugccagccugcagcauugcacucagugccacuuaggccagcaucuaaagguuguguuuuucuuuccugaggagagcaagguccucagcucgagcauuuucagucuucuguuaggagaugauuccuuauguuuuccugacaaguuuacagcaugucacuaugagcuacuuauuaacaacagauaaucacaggcaagggaccaguauaauuaggauuaguuucacagaaccucaaaacacuuuuaagucauuaagcagcuuuuagaacaaauuugccuuccuaagguccaguuuugagucauucuugcccuuugacaugaccacaaacuugagacuggccacugcuuucaauaacaaccugaccccacuggacccugugagcacacuugcacugguguugguuuugaccuggcugggaagcauuucuguccugcugaaugacuucuggacacagaucuuaguuaauacugaugagaguacaaacgaagggcagguuugcuuugacauuagcagauccuggggcaagcaugcaucugauuaccuaugccacucugucuuccugguuagugaguccaaacugcagccaccucaccuccucuugggacuuagagugucccauggaugcuugucaggccuaggaguacauacccauagacccugagaaggcuugagaucuauggacagggagccuacagcccuggggauguaggagauagauaguggauucucagccaauggaugggcacaccccuugguucuggagaccccucagccauagaauggggugcuaggugcuuugagucuugccuaaaggcagugcuaauagggaggcaccuuguguuccaaacacuucaguaaugaagacuauuugaaauguuuccucugugcaaauggcagcuguaauugugucaccucauguucuguuccucauuuucuuccuucccuccuauucaucucaugcuuggaguugcuucauaaaguacaggggucaugaaacugacccauguccuauggcuugcuaagguagcuccaauagucagcauguuccucccaucagugaaacuucauggaagaccuuguaaaucugguagcuacuuugcuguaugaguuuuggccacuggcaguuggggccuccccuccugcucauccuugacaguaucuuuccucuccacuuuaagugcuuauuaucuacccacagggccccucugccuaccuacuuauccuucuggcucuguggaucuugggcauguuuguuccuuguuauccugguaggugggagggucuaagggaugucauagaacucucugaaguguaucuuuguggggcacuauuuuggagaaccaucagucacuuagagggcuuguuaaaacauguggccuugccccuagaguuuuaauuuguaaagucugugauaggccccaguuacauuuccaguggaaagucauuguuuuggaggaguguucuuaaugaagaaucagugcacauuuaaaaucagauggguauuuuucuucgaugugugugggagcgacacgacauuagcaggacugguaguccugcugcuuugugacuaugacuucuugagaggcucaggaaugugcagaggcugccucugucuucucauagaccuucccauccccucuggcaugucaguguuugcaggagguauguccuucgcgccuuccacagccaacuagucugcaguuuggcccugggacucuggaacagacugggcagucaucauucacauaguaacauauuauuauuagcuaauguuuaagagcucugugauuuucucaauuuauggaaggggaaauugaggcuugacaguauuuaauaauguauucaaagccucugacuagucauagcagagccagagcuugaaccugaguccacugauaccagccugcucuugucuugacguguuggccacucuccuccucacagguuuguuagaauggcccagacagcauacaguaaggaucuagaauucuucauagagaagaaauaacuaaguuaagaccauuagugcuagauuguuaaucuccccaacauaaauguucuucaauacccaagccagacaagguagugagagugaaacacaguacaguggcuggugcggaggagggguguggaacagggcagccaagccaugagcccacuuucagcaaggagaugaguuuugaacagcugaugcacacagacuuaucaagcacaugagguugccuguugcauaguaagacuuuacuguaucccuguggcauugcugcaggguuggcugcacuguuagcaagcuguacagaugacauaggaagguaggcaguucucucugcagaaggcucaauacaaagcagccuagauccaauggguaccuuuuauugucagguuaugccucuguaguggagacuucccaaccauuguagauaaggaaguggaauuaguaaauacauugguucuucucuagacauaaaugacuuuguuucagucaaagucugaauauuuuaaaacugcagagacagauuuauguuacuuuccuugaaagauaaagugguaggcauagaaguuaggucuucuaugggaagaguagugaacccaguacaaaaacaaaccauaccacucacuucaaguauagcaugccuuuuguuuuauuugagauaagaucuuucuauguagcccauacuggccucagacucuguguaacaaagguuagcauagaucucaagauccuccugcuccugagugcuagaaccacaggcauguguuaucacggggagagagagagagagagagagagagagagagaaacagagagagagagagagagagagagagagagagagagagaaacagagagagggagagagagagagagagagagagaggaugcaugcgugugugcaugggcauguauguguguguaugcauguguuugagagugcagccaaauauugggaucaaacccagggucuuccacauuuuaagcaagugcucugccaugauauacagcccuggcuggcuccuagcaggccauaugacaucucuuaucugugggacaaauuaggugagccagacucugcugcuugagaguguucaacaaaugauggaggaggugccccaaagugaggagagaaaagcugacaaguuauaucguguuacaccacauucuuauacgucuuaugugauuaaagcaugagagucaaccaauauccacugaguauacucagcaugccagagacuguucuaggagccuacuggacagcauugcaccaaauggauaaaaagagcagcuugugguguagugaaugaaagcaaagaaucuagggucggguuuuuuuuuuuuuuuuuuuuuuuuuuuuuuuuuuuuuaaagcuugaaggaaauagaaguggacauuuauuaaaucccuggaaagguugaaauuucuaagauuagaaucuauagaugaaaucacaggaaaauaucauuaauauugucagaguaaacauuccccaaauguuaagauuauuucuggcuuuaccaucaugaauuauuccuuaggauaauucccugcaacauuaaaguuuaucugaauuuuaagaucuuuucuccaaauuauguuuaccaugucauuugaacauuugucauauuuuagauauauaccaauagauuaauuucuuccacaaagugcuuucaaauuaaacaaaucaaacuuccaagauaaagacuugaaugagcccuccugcuuauuguggaaggaaaggaguuccuugcuguacuugggucuggacccuguguucuaauucuuuucucuuugagugacuugugucccagacuuugaauaccacuuaaguguaucugugacucucaaaguucugucaauacuuggacuguuuuuuuuuaauuaauuaauuaacuaauuaauuucuggagucaugagguuuauuugacaucucuguguagagaucucauggguaucccaacucuaacaccuaaacagaaacucuuggucauugugugaaguacacucaaguucucugcuuuuccccacccaauccauuccacacagcaguggaccucagaaacaguggaaucauucacgcuuuuguuuacuuucuauuuaauccaucacugcuuuuuacugauuuuuuuuuuuuuuuugcuucuuaaguauggccauucucauuauuagcuguaguuauuauguucuguaaaguugcugugaacccugaauuaaugaacagggagccauuauugguagagaaauuauaggacuaauuuccugugaguuuuuggucauauuuuuaauugaucucuacauggcaucauuaacauugguguuuuacauaaaguaacauucauguaaugauguaauuuaguacauacauuuuguaacaauguuuuuguauguuucugcuuacagacaauuuuaacuucuauuuauuuauuuguguguguguuuguauguucguguguguggaaaagaggguaagaggguaaggaggaggaaugcauauauauauauacacauauacauacauauauauguguacauacacacacauguauauguauguacauauguauguauuccauggcuuguguggaggucagaggucaacuucggaguuguuuuuuccgucuacuaauaccuggguugcagggauugaguuuagguuaccagguuuagugacaggugcuuuaacugcugagcuaucuugcuaaccacugaacucacagccagcaaugcuguaacuaaagcccaaaugugcuuaucaaaugcaugcuuuuuucucauaaggaacagcacaucuuucuuauaucuugaagcucauaugaauaccucaucacaguguuuaaaacuucagcauuuuuagccgggcagugguggugcacaccuuuaaucccagcacucgggaggcagaggcaggcggaucucugaguuugaggccagccuggucuacagagugagauccaggagagccaagaucuacacagagaaacccugucucuaaaaaaccaaaaaaaaaaaaaaaaaaaaaccccaaaaaacaaaaacaaaaacaaaaacaaaaaucuuuagcauuuuuaaacagcaaaaucaacaaauaaaaaaaaccacaaaaagaccaaaaaaaaaaaaaaaguaccauauaugguauauagggcaguuguucccuauguaagagcugaaauaagaagucagagcaucacuuugcuggguuucagcuaggcacacaugagggcagcauggccucccagcuauucugcuauugcauaggaaugagagaaagugcccugaguauugauuuuggaauugcaaaccaguuuuagugaacagaugaauuuacagcacagaauccugaguaaggaagguggacugugacuugugaacccaauuguuccuacugucauaccuacccugggacuggcaaacuuucucaauaaagguccagauaauauaucucuuggacuuugggcaacacugcgcguacuguaguugccauguggaagcaacagaaaggugggcuauauuuuauuugcaaaaguauacuuugagcugaauugggcaccauuaaccuacucuguuauuaaauacucuguuauuuugacugauuugguguguguguguguguguguguguguguguguguguguacaugcaugcaugugccuguggugaauguuagagguugaugucaggugucuguguaaucguucuguuuucuugagacagucuuucacagaacucacugauuuggcuggacuggcuagccaguaauuccuagaaccugccuauuucagcuuccccagcagaggggucaucauggguaugcauuacugcacccauuuuggaugcugggaugaacucagguccucgugauugugccucuagccuuuuacaguugucucccagccgcaugaucuagcuuccuaaauuggcuacucauggcucuccuucucuucuuccuccucuuccucuuccuccuccuucuccucuuccuccucuuccuucucccccuuuucuuuuaaaguuuguuuuguuuauuuugagacaaguauuucaacauaguccauuucaacagucuugugauguagaccagguuggccucgaacucacaaguaucugccugcccugucucccaagugcugggauuaaaggcaugugccaccacgccaucucucaugcucaaucuugagucucuccagcaugucccaauguaccacaaugauauuaagugaauguuagaucugucacucugccacuucagauaugcaagugcuucccauccacuuucaguacaguucuguagaauagcagaggucacagcgcucccugcuuauuucuccagucuccuuugaugccauuauuuugacucuuucaguucuguggcuguccuguuucgggguuugcugcuccaugccauuauguacagucucucugcauggaguaccuggcaagcuccuacucacucuucagucagaguccaaauguuacucccugccccugacauucccuagcccucacugucaaucacaugcugauuuccaacaucagaacacccuguuuuguuuuuuguucauuuguuuuucauucauaauguaaccuuuucagguaucauugguuugggugaccuuguuuuccacuuucuucuuccaugaggcugcagacuccaauaggagaggaguguguugugacagucucugugguguccaccauauuauaguuaugcacuacagagaugcuaagucaguagacaaucacacuauaagguguguucacacacauuuuauauguugcugcaguagaaaaaugcagugcugauuccaaacaaaaauuacgguguccaugguugugaaguugugccuuuauugucagagggcaauucugaggcagaugcucugucaucaggccugucuugguaagucagcucucuccuagacaggagugcuaugggaaguuuguuaguuuccauuuccccugagccuuuuggacuucauuggugagguuuucagguggggagguggaagugaaguauuauugcuuguggaggcauuucagcuggcccugugaaaauccacucugcuccacuuuuaucccucuuagaccucaacugguaggugcuuuauuuuuauugaaauccuaccaucuaggaaaaaaaaaaucuuugauuugccagagaaugaucuaagcaauggugcuccaauguggagauuauucuguuauuccaagaauccugcaugcuaccaggaagauaauauuucagaugggcuuuuauagguuaaugggaaucuugaagcuuuauuuaacgccuuugaaacacugcaguauagaacauuagaaauaagcaauagguguacaacgcauguuccugcugcugcuacagguuuccucaugcuuuuaaaauaucacucuuauuagauauuaccauagccagacuuuucaggucuuucucuauaaauaggaauaugaaaaaauuuaaaugacauaauguuagucauuuuauaaucuuuuuucuugcuaauuuuauauuucagcaaagcuuauuuaauaauuuguucauacuguauuuccauaauugaaaugucuuuugaaucugauacacugaagucagcauucacugcaggcugcuguccuguaccuaccuaguugugaacuuccuuguaguccguuagcccugugcaguugcuggauagacucuuaaaccugccacgugagucggcugagguuucuguagagaggaugagcguauuucuuuagucucuaguuuccuaugccuaagguuuuguuagguucagguugacuggaaugcaccagacccacaauuggcaaggcugugguuguaccacacuccacauucacagcaauacauugagauacuuauuuuccugagaugucacccaugcuaucugagguuaaacuuuuggagcuuuguugguagugacacuuaacauuucaauuuaguuuuauaauuauuucuuuuaucauaaauaaauaagauuauguuuucauauauuuaacuagcauuuuauauuuguuuuauguaaacuguauucugaacuucacacauuuucucaauauuuuguuuaucuuuucuuccuuauuccuaauaguucuuuauacacuguauuugaagugaguuguaaaaaauccuuuucuaguuagucaugauguuuagcccaucucuuuaauguaauaaaauauaucuccuuaaaauuagcuuugguauuuugauucaguauuagaccuuuuuugugucuuguuuuaauuuccuuuuggauauuauugaaaucuaauuuuuuccguuuauauguugguucacuugguuuuuaaacuaggauaguauguguccugagguuugaauguagcuuuacauuuucccaguacucaguugucccaacuccauugcugaagguuucuguuuuugccauguuaucauaaugucacagcauucuguaaguuugugguggguuuugcauuugaacucuguguguuucccccguuggugauuauugaaaccugaggcuuuuaacaucugagaagacuaguucucucucacgguguuuccucuucagaguauuacuggcuauucuccgugguuguuuuccauuaaaacuuuagaaucaacguaacuugauuccaggaaaaaaauaagccugucuguuaaccuuuccauugggaucacauuaaauucauaaaguacuuaggagggagcaguguuucuaaagugcagucuuccuagcuaaugccauuuccccuguguguucuuucuuguguacuuuaguaacuuugaaaguuuuauuuuuauaggcuauguaacuuucaaucuacuucuugcaaauaaugagguuuuauauucuaacugguuacuugaauaacuagacuguugauuucuaacuguguuuuugacagcuuuauugagauucacacaagucacuuuuguaacuauguaguuaaaugaauuuuagucuaugcacagaauauuguaucuuaacuacuuugaguuuuuacauuuuccucauucccagaaggaacccuguacucauuaacaguccuucuccauucucacccccuucuccuccuagaaaacauuauucugcuugguauucuggacauuucuuauaaauggaaucauaaaauguguggucucuugcagcuggcucuuuucacuuagcauaauguucuugggcaucacccauguuguagcauguguuugcauuuuaugcuagcuauucuuguguguaaugauaucucauugugaguagcugaguuucccccuggcuccucuguauauuuauuaguccucacuuguaguucacauuggugagauuucaugagagcagagaacaggcuuucaauucuaaaaccacaaugcugacacaaugccugguaaauauuugguauuuaauaaaugcuuauugagucagugacuggaucuguuauguuucuaggccaccucaacuuuuuaaaguuaaaaucuguuuuaguacauauaaauuaauuucuguuuuuccccaggcaaaacauaauuagagggaggguuguuuuucuccucugggaaagucauguguuauauccaacagccuggcaaaaguaauuuuguaugauguaugguuugugauaaucaacauuacuuuuucuuacauuaaaacaaaugacugugagcugcuggcacauaugucuaagagucucauuaucuuuucaggagcauagguuuuaccacuagacuaugucuacugaacaaguugcuagcaaauuaaaaaaaaaaaaacaaaagagagaaauuggggaaaaguauuguucuggggauuggaaugggguuguugaagagcuugaucagcuuauguguguuuaagaaguccugagcuuaccaagaacuguguuuuaaaaccuuuuucuaaauuuauuuuguaagguguuuacagaaaaaagugaugccaauuaagacucaguuguaaagcuggauagugguggcacacaucuuuaacccuaguacuugggaggcacaggcagguggaucucugaguugcaggccagcacuggcuguucuugcagaggaccuggguucgggucccugcaccccugugguagcucacaaccaccuguaacuucaaacccaggggauuuguuguucucuucuggcuugcaugcacauguauaagcaaaauacucauauacaugaaaauagaaauaaaaauuaaagaacauaugagagagcauuaucugauacacaugguaggcagggggcauauuguaauuccauuuaucuuccaugcacaucuuuaagacaucauagcuaaaauacauauaguuuguaaagaaagggaaaugauuaaaugucagaaaaacaauacuuuuuaaaaauauaaauauuuugaagaugauguuuuaauuaggucagauucuuuguguugaacgguuggcauagacuuuuggauaugguccaaagauuuagagauuauuacauauuaggcauguuuuuauuggagggaaagagggaggaacggaaaaaacagaggaaaggaggaagagauuaacuaauugaucauucauugguuaagugagacaaacugaauucuccaaaauccuggccugagagauggcaaaagugaaauaugguucacgcauuuacuguaagaaaauacuugucugaaaggaacaaggacaggaguaauauuugaaagucagauagauaagaacaauuagcugugggucuacuugaaccaaggguuugaaaggcauaggaagcagaucucaucagacuggaauuggggcugcaugcuggaaucucuuagcagcagcacugaggacaagcucuguuugguccuggauguguucaagaugagugagugagcaccauuggaugcauacaguggcugguggaccaggugaccuuuacagauucuugggaaauggccucauaggacugugcaguguccacugcaaggcggauaggaaauagaaacaaucaugguucccuuguugguuaggcacaucugcuuagagcucaguggggugggagaaagcugucgcucugcuuuggguuauauguauuguuuauuagauuauugguuggggugccuuuaucuuuaagggacauaaaucaaauuaugaguguuaacauaaaggaaagcucacugucucacugcuagcaaggucugaggaggucgauucuaugguugguuauaauaggcugcugaggugguucaguacacaaaagcacuugcaaacccaugaccggaguacaguccuuggaacucacaugaaggagggaaccaacuccacagaauugucuucugauguccacacuguggcacucauuugucccuauacauaucacauacacaagcacuaauaauaauaaugaugaugaugaugaugaugaugaugauaaugauuugagaugucucacuaguacuauguaacccuggcugaccuggaacucacuagauagaccagacuacccucaaaacucaggguucuuuuugccucugccuccuuagugcugguuuaaaagcaugcaccaccacaucuggccauaauaauaaacauuucuauaaaaaacaaaacgugagcuggagagauggcucagcaguuaaaagcacugacuguucuucugaagguccugaguucaaaucccaguaaccacauggugacucaaaauuaucuguaaugagaucugaugcccucuuuuagggugucugaagauagcuacaaugugcuuacauauaauaaaucuuuaaaaaacaaaacaaaacaaaacaccagcacucuuuccaagauguguucagaaauggcugcugccauuucagguguuacaucuaaacccagugaugcccauaggaaagagagaauaguucuuucuaguuaggccuuuuuacaagcaagaacccccuuuucagaagcuuucuacaggaaauaauagcaaagaaguggguucaaaguaucaggcuauacauccccagugcugggagcaccugucugacagagaagucuccaaggccaacuguucuugcauagucagggacaucugugcguugauuguaucacuuacgugcaucauccauuucuagucaaagaaucagacuuccacaugacuucaagucacccauauuuccuauccagggcagugagaguguuuggaccucucugguuuuggaauuccaucauugucucccuucacaccuuugccuucuuccccaggaaaucuaccugugggcugauaugcagaagagaggauuugcccacaccccugacauauauacauauacauugaacauagucuugcuaugugauguggaaugaccucaaacaugagauuccucuauucagccugucagguguaggugugcaguuccacaacuggcuaauuuuuagaaaauuuaaguuccuuguuuguuaguuucuucaaugcuggaagucaaaccccuugggcuuuguauaauagauaaauuaucuacuagugaacuaaagccacagcccuuuacauaacccaggaauagcuaagcagcucuagauuuuauuagcaugugugcuaugugauugaacaugccugcacauauguguacauucugaccugacuuguuuuugauggaacugguuuucuugcuguauacaaagaucucuuccucuuuuucuuaauaguuuuagucguguugugagaugauaugucugaaguguguaguuuuagcucuucccuugcuguauucaaaauggucuggacauacucaguugugcucuccacugacacgaaagguuuugaguugucuauuucccugauacuaaacuagauaauauuugcaggccaucuauuguuugugcaccuucuaucauaggagauuuagauaaaauaauuagcauuccucaaaugguucugcaauuaagggucaagggcuugaaggacaggcucucccuuuuucuuugccuucagaccugacugcuucacaguaugcuuccccaguccucuuuuuaaaggcaaacagagauuugagguaaccaggacuauccugaauuacugcagagagcagccuggggccuugagcuuuccccuggccucuguuuccacgucuggcuccuguguggcuccugccuuugaagucagguggaagccuaacaggugaggcuguugcccucuuucucuuugguuauucuguguaaccuuuagucuaggaaaaaugccagucuucguuuccaagaaucauaucucccuaaauggggcaaucugcuuuaaaugccuuuccacuggcgccuuccccaucucacaguuggcauaguuaaagggacaggugcacuuuaauuuuuaaaaaaacuaugugugcuguauuggauuaggguguguggcccagcgccugugggguaguguacauguuacuccugugcagaaauacccgguuccucacacugcagccauuuaacaagauuugagagucagcaggucuccagaugcuucacuuuuggauuuuuuucacauguccaacauacuucauuuccugccccuuucucuuugcuccauccauccgacugucuguccgucugccugucucuaagcaaaugggcuaugaugauacauaaacccuuaucuaucuuguuggaaaaacuuacauguuguguugaaauauauucuuuguguauggucccaggagaggguuuucucugucccucaugauauugguaucauuacuguuucucccuccucuggcauuuaugcugugggcaugugccaugcugguguucauccuuagaguuagugcugcucucagugaacaccauggccuguaggaagucucuagugauuacuuacugucuucccugauucuaguauggcuaccuggccagccacuuccauugagcucccugggaagcuggcuuuuuaguuacuggucguucagcuuuaccagucuuuuucaagggcacucugguaccucugcugcccucugcuccacagaggaagcucgccucugcuacuuuccuuucuggagccagugcauugaggcacacuguaugugaauucccaugguaguuguucagccgagaacaaacuagugaacucacagugccuuccugaguaacuuuaaagagucacagaagauucuuggacagauacacaccugugcccuugcugagagacugacccuauggugggaccugcccuuggaguugguuucaugguaauaaggacauauugugcaauaaaauaauacacuuguuucugucccacuugucaucugaguccacuaugagaugagcucugauguguauagcuccagcugauagcaguucauuggaugagugugggaaauuuaggaaugaagcuggaaauguuggugaaggacagucccuggcuuugcagcaggacaggcgcuucagcagaguguauugcuuugccuuccgugcaucugauaaaguaggcagagcagcaggaugugcugcccagaagccgacaguggggaauucugcccucaaaaagaaaagucggagggagcaagcaggagaugcaauaggcucaaacccacugaaugggcuucauggcuuucaguuccuuagaagggauguggucaugacuugguacagaagggagagagcugggugggaaaguuacauguggacaacucaaguaaugagcaggcaugagguagauagagguggaggagacuagaauauuaaaaguggauuauuuuauuugucaggguuugaagagugguucugugcuauauugcaucuuugauuuuuuuuuuuuugaugucuaugucaguguucucuagguagcaagaggagggcacacuuaagggguggugcaggggcagcagggagaugcaguaggcaguuggaguucaguugauguugagccuuaggcaacauguguacauguguugugugcgugugugucuagugugucucuuuaagaaggcugccaagccuugugauacaugcuucuaauccucgcccaggaagcugaagcaagcuaaauagguggaucucugugagucugaggccacccagucuacacagugaguuccaggcuagcaggagcuauauagccagaacuugucucaaacaaagaagaaagccaguuagauaaggcaaaauguugguggcuugugagcaauuagaguuacagauaagaagauuuuuuucuaaugcugaggggauauggaguauacucugaaauggggcugccugcuuucuuuccuucuucccucccuaucuccuucccuuucuuccuuccuuuugaauuccuuuauagaaaagugagagccuuuugcauguaguauuuauuagagaugaacuuguuaggcucgccgccguguucuggguagccccuggagaaaagcaucccgggagccuucugaggagcuaaggcuccggccaggucugccuucuccagccccugaugcuccuccuucguaccucucaaaguguacaguuuuguggcagaugccuggaucaguuauccacaaacacagaaugauuugcuuaggcuaaccaggacuggcucugcagucaggaucaggucggguuuugucaggugagaaagaggggaugacugucagauaagcaacuuggagcaucugcuucaacauguuaauuuuuaaauaguuucucuggcuauggaauguauuuucuaaauuuggccuuauuuacuauggugauuauuuuaauugaguucuagucaauuaauuauaccauacuuuuuuuucuguaaguuuugacuuguuuugcagcgugucuccaugugcuguuauacacagcacaguaaaagaauuuaggaaaaugaucguaauaaauacaaacaauuauaguaguuuaaagauacgagggacaggaaucucagacaagcagacuguagagaugcuuagcugagcuucucacugaucuggagucucguggcaguagagauaaaaagcuggugugguaaaugcuguaaguucuacuuuuauugaagacauaucagccucucaagaaaagcaaggggcuggagagauagcucagcaauuaaaagcacugguuguuccagaggacccaacuuuaauucccagcacccacauggcaggucacagccuucuuuaacuccagcuguaggggauuuagcacccucuuccggccuccgagggcacugcaugcacggggugcacagacaugaauacagacaaaagacauacacaugaaauaaaaaaauaaauccuauauuuuuuuuuaaaaagaaagaaagaaaagcaaggcuuccuuuagcuuguguugaguguauuuuguaugagaaccuuaaucugggaagcaguaagcgcaacauugaauaauguugucccccuagcaaauaaaaaaccagaaugucucucuuuuguagaguuuuuauugaaaauucaagauauaauaucaaaauguaccucagcaaauuucauauucuggaacuuggaacucacaggaaaucugaaugcuuaaccuuggugcugugcugguggugggccaugcacuaggcccacuuacucuucacaccugccuccugucugucacacaguucucacuagaacuagagaauagaugucucugcacagguguauugauuucuaauacuacaugagaauguaucugaagcgaugauuugagagaugauuugagagaugauuugaagugauguuccaucgcucaccaugcuucuugccagcucacugauguaguuuaggaaucgaccugcuaagguugacaucuguaggaauuaaggccucuauuugaaacacucacagaggagaguucuauuuuuguaaauaggauaauuggguggaaaacugugcuaaugucuaucuuuaaccacuccuggggacgaagucuaacuguuaaagccauggagccauaacuaagaugccucguugucaucucuauacaggccagguauuuaaaggaguauagaagucaaaagccagacuguuggguugagcagagggugagcaaggaugggaacaaacaggaagccaaaggcagcugagucaggggauagcagugcuucaagcugaugucaaucuuacucgaaagaggcauggaagagggcuucagcaaaugucagaggagacagugauugugauuaaguacuuacuuaaucuaauaaugaguucugaugaucuguccuuguaagggguuggggaaugaccaguacuagcacagugugaaccaguguagugcagcauaaacaaaggagggagggauggggucagugggaagaggcauuucuagccuugcugcugugcccaggcaccauuccucugcugaucuccuuugagaauguccggaaauggcuaggauuuggcuuugcacucagagacuugguacuaggcucucagccuauuuccucauucaaaacauuggacaauaugauguuuguccaacaucuuucuuccuauaagugugaaagaggauugaaacuagucuuucuacuaccuaacucucauuggucuucccuguuaccugccaccaccauucucuuaucccuuaugacucaauaagugugccaugcacuagagcagcucugacagagaagauacacaagagccaucagagaagauacacaagacaucaagaaaagcaagccuuucuuuagcucuuuucaguugauucagacagucagcacgauggucaguguucccacagcagaggaaaacuaaaccaucccaguucuuuccuuguguccuuauuggaagcucacugcauaaauaacaccuggugcucacuguacugguggcgaguuucuaucucuuaugaccuuguuggcugagcucaggcaagugcuuuacaugagcacugugacaaaugccucccugugccucaggggaagauggcucccacuuguguuucauuuaccugcuuagagacgaucccugucccaugagggggcuccaggaggcaaauguagagggauacaccagcacugugacuauugauaagggaugguuuuucuuucacuuuuguccaaguccaggcuuuaguuuugguuuuuggaucuuguuaaaacuacuguaauaggcuugaguuugcuugauguauaauggaaauagccuuauguggcauaagcuucugccuggggucaccaccugcuccugcaaagcugaguagccaauaauuucguacaguucuuuucauauuaauagaauaauggaaggcagaugguaugccaggaggauugcuuuuucuuuuaggcuuugagggccuauuauggggcaaauugcaccccaucccccaguucauaugcuaaaguccugacucccugcacuucagauugugaccuuauuuggaaauaugguuguugcagaugcaauuauguuaagaugaggucacacugaagcaggguaggccccuaauccaauaugacugguguccucauaaagggagaaauuugggcacagacacacccacagggaaaauguuacacgaacaugaaggcagagauugggguaauaaaccuauucaccaaugagcaccaaauauugucaucaaccaccagacagugggagagaggccuagcucagucccuccccucccccagccucagaaggaacaagcuugccagcaccuugaucuugaacuuuuagccucuacaucugugaggcaguaaacuugcuuaagucacccaguucuuaguacuguuugcugcagccuuugcagacuaauaccagaucccuggagaaauaguaauucguaaacuccagaagaggaaagagagccccucaugugcccuaauuaaagcuccccuugcagcaugggagucuggauacaaggcugagaguucaggaaggagaaacuaacagaacaacuucugaagcauaccaaugcuuguucugugaggauguggcuuugaggugaccuuuuaccucauuguagaaaucaguauuguuuguuagagauggaaauacaguuuguucaagaccacaaggagcagaggguuuuaagugaauaaaugaaugaauuuuuaaagcauagacaggcuuuguagcuuugacuggcuuugaacuugagaucucuucucccugccucagccucuaggauuacagauguuugcuaccagaccuggcuaguuuucuuuuguuuuuaaauuggccaccuauaguuuaaaugcuaccaucuggaauacuaacuaaucuaaaagagcuuucugcagggauagaagucugguuucuauauuuucucauaccuaccaucagagugcuuagaauaaugugacuucugaggccaagggacguuuguguuuuauuuaacuuaagaauagccacugguggcuaauggcuacuaucuuagguguugcagaucuagaacauaagaauggcacuggcauaaggccaaggagaacucccaggguuccugaauccuuuauggggcuccugggaaggucaccuaggcuuagccaugccuggcauguguauggaauugcccucaagugcaggagauggugggagggaaaagaaacaacacaagcaaauuuucucaguguuuuacuaaaacaaugcucagcagggcuuugcuauuucuucuccaaguccaaguugucuuaugcagcuuaguacuucauaggaauaugaaauaaaguggcagacagaagaagugaggcagcaagagugugguguagguuucuuuucagguuuugugugccagucccuguugggcuuuaacucuggugccaggguuagaaagguggggucucuagcuagacuacuuuucaggaaguagagagguucccauggcgucucugcuauuagauuugcugagcugaagcucagcccuggcuaggucugccuuucucuuugcuguguaccuucacccccucccuagcaccaccccauaaucucaagaagcugcugcaucagcugcaugugggauauuucagaaucuaaaauggaaccccaacugggcaucguuagaugcaguuucacacuaaaaaagagcgaguccuugugacuguucuggccauccuggacaaaugacuguugucauuguaucacuacuggcuuuggcucagugcccaguauaauuuaaaaauugcuucuuuuuccagcucuacauaguuaucauuucugauucauagagaaacaaauagcuucucaagucuuauauuuucucugaacgcugagaccagccagugugucauguggaaaugcuguguauuagagaggaaccugcucuccuuuggcuccaucccccucuggcagacuagacucuaggcagcagaggagguggcuuggaaggagaugaugcucagccagaaucauugggucuuggauagggcagaaagaaguuuuaguucuagaagagguuuggaaaggagaagagggugaagaaaagcuguuuucaacuugagcagcuuugguccugggcauccaugcuagaauagugacugauagauaguagccaguacuuaucgggugcagugugccaggggggcuccaaacacuccauucugcuguacuuacaucacucuacguaaguacacgcucuggcuucuccaagaacuuaucaacucacugcagacaggauuaaacaaagcaacaaaaggcaugaagugaugccaaguaauauacagugaguacaauuagagaggcacagagagaaagcacugaggccccaaauauccagaaugcucuguuuaguguuuguagaaaggcuuugguuugaauaguagagccugaauucgccucaaauggucauaggacaguggguauccaaccugccgugaauggaccaagucuucaguuacagguuuucucacuugaauguaguuauuugacuagaguagccaucacagauggagcguucaaagggaccacacaaaaauaauuaauaauuugcaggugcgguuggcagcccuggugucuccaugugccuuuuugucccagcaggaugcacacagagggaggcccccaaccccaucugcccugugcucccgggcuuaaucugugcuuuaauaacuuuccucucgucuguuugcaugaggucauccaucucuucuguguuuaaauaguucuggcuaugacuugcagggccaugucugauuguuggcaagauuggcuucuggguagaacgaacauuuauugagucuacagggcucugccuauaguaaacagguaaacuggaauaaguaggaucuaggugucaaagggccucagacuuaucuggaaauugagguugaagggagccaggugagaaagguaagccugggcagccagcuuggacccuuggagaaccuagguagugaugguagaaagggaaaaugacaggaagagcagacuuguggaauguggggacauagugcuugauuuggaacauuugaguggucuucuagugggugccuggagacaaggcuggcccauuugaaggcugcggaacgucugguuaucagggaacuuuggcuuccuuuaguccuuaacuaauugcagagagcaauacagcugcuuuggugacacaagaggguggguguaccuaccaaucuucccacuuugguagggccagucacuuuuguacucucuuauucaucuggaaaguggaggaauuuggcaaggauggccuuuaaugggacuucuaacacucacauuuuuuauugcucagugacccuucaucuagggaguaaucuuuuuuuuuuuuuuccagagagccauuccauaguugcugguuagcuuauuaucuuggcaagaagcagcaugguaaggugaauggaauguggccucaggaguuggcaaagcuagcuuaaauccacuccaucuguguguccgucuguccauaaugaggcucuguuguggcccuugacaauuaucuguuccucucuaauucucaaguguccucauguguaaugugggggaugaccugacuuugagggucacuggagauaaugugugccaggcacuauagcaauuuccccuuauccacagaggaucuaggauuucaagaccaauggaugccuggaacugcagacaguucucaaucuuauauaugaugaugcuucuccuacacacaaaccaugauaaugacaagaggucaccagugauaaaauaaauaauaaaauaauucuaacaauaugcuguaauaaagauauaugcauauagucuuucuuucucucaaaauaucacugucauaucuacagugugagauuaucugauauuucccugaugaguuugccgaggaaauggcucuuugauguagcauuaggggcagucauguuggcuacaguaguugccaugugacugaagagcauauauuauauacuaugugaaauauugaucaaagaacuggaacaggacaauucaaguuugucauguuugaaauaauguacaacuuaagccuacgaauugcuucuuucuggaauuuuauguuuaauauuuucauaucuuggcacaacauagagggcuaaauuuauggaagcagaacaguggacugggagggcugcuguuguagccuaucuuauaaaacagucuuguuucuuuaaaggauuauuuauuuacuuauuuuauguauaugacuauacuguagcugucuucagacacaccaggagagggcaucagaucccauuacacaugguuguaagccaccaugugguuacugggaauucaacucaggaccccuggaagagcagucacagagccagcuuuccaucaucuuauugagauauaacuuaguauaccacaaacauauucguuauuagacuacucacauagguguacuuaauuagugucuaauuccugaacauuuucauccuuaucccccgaagaaaccucaucucuguguuacuuuccguuaacuucuuuguggauuuguuuguccugaacuuuucauguaaauggaaguguagccuucugugccuggcuuauuuuccuuugcacaauauugccacuuuccccccauuauaguauauaucagugcuuucuugcaaauaauacucugugccauagcuguuugcuauuuuguuugucuacaaauagaugaguuguuucuacuuugggacuguuucacauaauucugccuuaaauguuuguguacaaguuuuuguauggacauauguuuuaaaauuucuuagcauaucauuguguuuggcuuauauuuaccuaaugacuaaugaugguguauauguguuuauuagucauuugcauguccuuuugcauauagaaauauauaguauauucuuuacucauuaaaaaaaugcauauuuaucuuuuuguuguugaguuguagaguucuguauaugcuguggauagugugccuggauuugcagcuagcccucagucuguguuugccucucaucgcagguuucucagagaggucuaugagcuucuaggugcucucuaggacuaauuuuccugauacuaacuguucuuaagccuucaccuuagauacuuucauggcuccuuuuagcuccgagccugagccacccugauccuacagcaggcucuagaauccacagcagcaggauagcuggagucuagagaggaugauuggcuggacccauuuaggacugcuacuaucccuccguuucuauguggauguacagcuuuuuguuguuguugccugagagcccuucauccuguuuauuggggauagggauuauaagggguuuuacaucuggggugaugacuuuuuuccacugugccacugcagagaugaguaauguguuuuccaggagugaucuggcaauuuuaagucacauacaaaaacagcucaaggaaaaucaugugccuguuuuauugacaagagaguuuuaugggaagucuucaaagcuacugacacugaacucuaugucccaguguguauucucugccuuguacacccuugguuuuaaucucaacaccuucucucuccuccccauuucuggcaggcacacacucccuuuuugccaguaugauugacucucuccauguccaagauaaaagaucuuacauucuccuggaaaguucuugaccucuguggcuaggaccucuucauggcugccaggggaaggggccuguggugauacaaagggucuggagggcccgcuugagagcuaucccugucacuuugagaagguauaaaguuguaaaggcacagucccgaucuaaacacuuggccuuuccuuagacauggacuugguggguuauggacggauguauugacuccucucaaguuagucaaguaguccuuggugccuaggagaugugucuuggaggacaaggcuagcccagaugccuuugguuguucauacuuuuuacauauuuguagcugucuucagacacaccagaagagggcaucagauuccauuacagaugguugugagccaccaugugguugcugggaauugaacucagaaugucuggaagagcagucagugcucuuaaccgcugagcuaucucuucagcucauacuuuuaaaguggggaaauaccuuuguaugaaugaggccauuauaggaauaguuguucacagacuacccuggcaucuccgaacaucuugaccugccuguaccuuacugaaaucuuagaaaaaccuccagaagguugcugacuaauuaggaugcuacgguguaaaauuacuguguuguaguuaaaagauaccuuagaauaaccaauccauuauuuuccagucuuuucuccugauaaaaaauauuaaauacuuggugugguuuaaaaaguuucucuuugauaaacaaauuugggcuauaggguauauugcaggcccuguuggugauucacagugagcucuaugaaguucugcaauaaagacaauagcuuaguauuauuuuaaccugucauuucagaaacuauuugacccuacuuccuuccccccauaaguauuaacaccucacaggauacuaagcacauuuuagaaaucaucuuucuuuuauagccaaggaaaccuaugcuuguaaauguugacuucuuuaaaauccacacuugaauuuguauuccccgacuccuccacucuugcuuauucuacagauuauugccuucacauuugaauauguagccaucauguuugaauaaguguguaggguuuguuucuuauguuuccagguaguaucucauguagcccaggcgccaccucagucuccuaagugcuaggaucgcagcauauauaugagccagcuggaguuuuaaaaaauauucuuauuuguauuguuaauagcaaacacaggcuuuagaguuagacugggaaacauuugaagucugucccuguccuuuggccagcuuaugaccuuggguagcuaggccugcugguaucccugagucuguucccucugcagagagacugaugacaaugacaaacucacaggggugccgugaugauugggugaaaguuucuauaaagaucauaacugcauuuuuucguuuccucugacuuuuugccaucacaucagugaucugggacuuuaaaggcugagcauauuccagaugcuaaaagcuaacaacaguaauuguaguggguauguacugaguggcaacuggaagaauaaaugcacacaagauggcaugacugccuauggcaauguagagcuguacuaaacugcuagcuacucaugggauuggaaguaacauagaaggcaggacaggucagagcagauuugcuggggccaggugaacagcuguguauggugggacagaugccagcucacaagccaccugccuuucuuucuuuaccaccacagguuaaaaugugccugagauaccagcaugccuuuggaauacaauuuaaaagcaaaauaaugucaggccugccaauaaagucuguccugaggagaguggguugaaggacaagagcauuucagaugaacaggggcaugaaggcccaggaaugggggcccagauauaguggcugugccugagcugaguguuucuuggguagauacaugaaaggcauucacugaugcauagcuccuugcucucucuccuguggaaggaugucuuccuuaccucaucaaccugaccuaccccagccucaaagcuugcuucuuugccuagcucuggaauuuguacuucugccuaaaaacgacaagaaugaagccuuggcauuugguuccugccagcucugagaggacccaugcccaacacugaaucaucaauuguacaggugguagacuugaucucuccccuaguugccagaccauaaggguacaguuucuuuauucacucuggaauauaccaggacuaacagacuuuaagcacuaaugcaccagucuuccuaauacaucccuuggauuacuguucucuguuuucaccugccccuuaccucuuccaucuuucuccuaguuucucaguaggcacuuuaaagaguaugcccuagagcaacaguaaauaacucuacugaguuccugaccaguggccugugaugggacagugagagcaugucaguuugcaucccacugcagcugcuccuugcacagagugccucuucaucugguggccuggugcacauugugccagccuugacugccaugccaggugcuggcaugcucuugggaggaugcaggccagccgugcugcugacaccaauugccucccucgcagcuuuccuugcuuauuugccuugaguugaacagacccugaauccugcucugaauguagccuauguuucuacugaugacaggagggcagcuguuucuauagaauugcuuucagugugucuugccuggaaccauugccuggaacauguauguugggacuuuuggggauuucagaaggcuaauuuagaaaauggguaacgauuccuuaaaagucuaaacaugaaguccucucaugacccagcaaccccacucuacagauaaacccaagaguaauggaaaaauuugcucaaguuucuugcagcauuguguguugcagccagaaagcacaagcaacccagauguccaucacugaggaguggagaaacaaacuguaccagaucuauuaaauggucucuguggcagugaaggagaaugaaaugcggacacguacauggagaaaccuugagagacuucuacaaagugaaggaagacaacaaagcccacgggcuguauaauuccacuuaugcugagugucuagaauaggcaaguccauagagacaggaaguggaucagagguugccagggccugugggaaggggagaugggacagacgacugugggauuucuguucagagugaugaaaauguuuuagaauuagugaugacaaucacauggcucuuuuugaaaucacugaacuguacauuuuaagagggcaagcuuugugacgugguaaauaaaaugucaagguuuacuaguuuuaaaaaccacccuaaacacgcagcaaacucuucagagacacaggcccuagcaaaaaagagguaagguagugugcccuagaaggugcaagcauugauguuuuccaagagaggagccagguggaagagcagcacggggaggggauagauagcaugggguggggagggugggacacggaugguucccgaggacccagacuacaguggcuaaugaguaacauccauccauagacaguuaaugauuuucauuuggaaauaauuucaaauuuaaaaacugaaagaaaaucacaagauccuggacugucaccugggcauugucaucugaccuuugcuuggcagcuuccuuuccugcaguguagggagagaugcauucccagcagguuuauacugugguuuggcuaaaggcaggaaaguaagccccugcugagaugauuuucuccuggagcucacuggcuugaggaggcuacugguaacucacucaggagaucugaggcuaggaggaggcugcugguaacucacucaggagaucugaggcuaggaggagucugcuagcugcugaccauugccuugcaaguuuucuaacccccaguuuccggauuuuuguggaguaaaagcugggaagcaagacaucaauauguguauucuuuacucuuuucuguauuucuauuuagaauguauucucauaccuuuuguuuugauuuagcaauuuuuuagaaaagaaacuauuuagcaagguaaggcucacugaagagaucagccggacuacuguaugaaccacaucauuugagcuaggacagaaaaggggaauguguuucuuuaggaaggugggaagggggcccuuagcuucauuuguaccuagguaaaacagaaugcagaugcuuggcuagcaggcccaggaccacaagagcuggccugugagagccacacaggcacaguagaagacugccuugacauuucaguuugucuugggggagccagcugaguguguuuguuugcugcaggugaaguaccacaaacgucuucaguauccaccauuagaugggauguacaaacuuggaucauuuucuuuauauuuuagaggaaacagaagcacccugguuggcacauuuuuuuuuucaauucacccaguagggcuagaauuguuguguuuccuuuuaguauuguggcuuuccuuaaaucucaccccuauuaaggacuuggauuuuauguucuuuuguagugucucccaguuuugacugagaacauggucauuguaacucaggggaccaggcugagagcugauuuaguuuccaaucagcuuuggccuuagaaaaugagggcaggcuggauggaagcuuggccagaaguguguguccucugcauucugcugccuguggucccucggggauguacuucaccuaacuggacacaacugugccucaucucuuuguggugacagaguagagugccuuuguucagccuggcacuugaacugcagggcaugcccuucucucuucucgcagcuguuugccugaaguagccaucugagccuggguuuuuuuccagucugcucucuucugccaucagucucaagacauuagauaggucuucagucuccugucuuuggcuaggccuuacccuguagcagugaagaguuaauccacauugaucucccgggcaggucacacgcacuucuagccacccaccagagcucucuagauuccugaaagaaagacauacaggcacauacacacauacacacacaccgauuuuuuuuaauaugccuuacuagcucaauggcuggggacuuccugaaccucuccauggcuagcacacacuccccuccgguauuccugaguuaacauuuuccaagucuauauuuuauuuuugcugccccgcugccugcugggcagcccucccaugggacggcuuccccuuagugccuacguuucagcugucucacccuccucuccuucacaugguggaauccuucuucuccucuucuuuuuugcccaggaauccuaaaagucuuuaacccugcccagccauuggcaacuuuauuucccaaucagugccaacugggggcaggcuuccuuuagccuacaugcaggacaucguaaacaagguuuuuggaguaacacaauuagcaugagaacacaagccacuguauuacucuuccacuggcaucauccuuaagauauguguauagguguuuugcauacauguaugucuaugcaugccuacugccuguagaagccaugggaaggccugagaaccuccuuggaacugcugcuugugagcucucauaugggugcugggagucaaacccagguccucggaaagcaaccagugcuccuaaccacugagcugucuccagcccuccugacaccaucuucauacaggcuucuauuaccucacacauagacacugccacagugggcuucauagcccaccacagauagcaucacagccaucagucuuuggcuauacauauccauuucccauucagaaaccccacucccuucucuaccguauccauuaugcguccaggacagaaucaaaaccaggugcuggagaccucaaacucagacaccagccugucucuccaaauccaucugcugcuguccugaugagcucagcaauguucagcauuugcaucuuccccuguaaggguucccuguagaugauuugguccugcuucaucucaucuugauuuugaugguuugguguaucugcaaaccaucccugguccugugagagguagauaucucauaaaucuuaaauaaagguaaggucaucagcccugauacuugggccccuuucuccuauauagauauccaccacugggagugccuugucucugagucagugauauuugauuggugagggucauagcugcuuucuguggucaguuaucuuuucuggucuuacuccacagcaugcugguuuuuuaaaaaaaagcaauacuuuuguaccauuuugcuuguacauauacauacucagcagauaguuuugacuauucaccaugaccuauagaauccuuaguuuagcagauuugaaaaucugacuuuaaaaauucuaggauuauuugauucugaaagucugguacaaguuaguucaucuuuggaguggcuggcuaguugcuuacucuggauuguuugaaugaaugaagccuagcagccagucaggagaaccucaccuuuaugguucaaggccuuaucugggaucucaagagaacagaggugcuuguuaagcacagagcuaaccaaaaggcauauagaugucuaagcagaacgucugcuguggaggagauguuugucuuuaaagaaucugaguaaaacuccaaacccaacacccuuagcuuaucagugggaaaucacagacucucauuccuagacaucaccaugaccacugugaacuauccuuguaaggacuuuauuuuggaauguuucauauacugggauugcaaauguauggauauuaucauuaauuacacuuuagguuggcaauuuuggagucauaaaucagauaacuuguuaaaucccgaauuuguacauuuuuaagguuuccuucucuuaagaucuguagaucuccuaggcuggccucaaacuccagauccuccugccucugccuccuucaccggaacaguggaugcucacagccauccauuggauggagcacaggguccccaaugaaggagcuagagaaaguacccaaggagcugaagggguuugcagccccauaggaggaacagcaauaugaacuaaccaguacccccagagcucccugggacuaaaucaccaaccaaagaaagcacauggugggacucauggcucuagcugcauauguagcagaggauggccuagucagucauaaaugggaagagaggcccuugguccugugaaggcucuaugccccagugugggggaaugccaggcccaggaagugggauuggguggguuggggagcaaggggaggagggaggggauaaggguuuuuggaagggaaaccaggaaaggaaauaacauugaaauguaaauaaagaaaauauuuaauuaaaaaaaaagaucuguaggucuguacaauauaauacuucuacuagggaaguggaaaauaccuaugccucaaaauccuguauauaaaauucuguauaauuuuggaguccagagcaguauuuguucaguuguuaaugaaucauugguacucuggguguguaagcaacguuauuuuuaaacccauugcuuacuucagugauaaagaggguacagaaugugccaugcugggcuugagagcauaccaugaguaauauccauuacuacuaugaugucaggacuugaauauucuuuaccaaaaagauaaccauugcaucauggagcugaggaaucccacuggagcagagugagaaaggcccauucuucucauaagaaacaccaacaugugauaaaaacagauauuccccugcaggaacccagaccuguuaucaguaguguccaggcucuguuugaaaggcagcucucauuuuaguaaccagaaagugacuugccucuaaguuuccaggaggcauuuuuuaauucuauaccuucugcuuauucagaaaaacaucuagguaguaauuguugugugcauacuugaagucacuaacacuuaugauggccagugucaucucauuauuuauaccuucaucucucugaaacauucucacauuaaaauaaggaagaaaaggguuaaacuacuuagaaguuguacgucauccucaggagugugagcucugguuuugauggcuaagcaccuugugcaucaagacaaaaccacauucagccacaauggcaacauaaggaaaguagagugcuccuuagaugguucugauacacacagcaacagauugcucacgugcaugcuccauugggccacugagguccuccagucccccuggccaaacagcuucuccuccuuggaucagggcugcuuauauagcaagggaaagaagacaaauucucacccuggcuucaaaguucuggcccagaaacaauaccucucucacaccuuuuuuuuaaaaaacuggcuuaaggccucacuuguggccaaaccuaacuuuuguauuauaugacuugagucucuuaaguucuagcaggaacuuugagugaaaggcucaagaaaaguuacuaagauucaguaaaaacaaaccgaaacauuuauaauuuucuaagacuuuauuuauuuauaauuuuauuauaacuuuuuuauuuauaauuuuugugcuuucaguaggcauuuuuaguaacauggaauaugaaaauacauaaaaagaaaugcuucacuuucauaauuguccuaauacaaaucucuucucauuucauuuuuuuucugcucucuuguucauucauaaaaaccugcaugccgcaucccucaccuuugccagcaugcugagcauugugaguaccaguuuuuacaaccuauccucauguaauuugauaaccauggugggcuggccagccucacacuacuuguuucucacuauucaucuuuuuaagaguucacugugugccagaguuagaaacagaaaacacaacacuuguuuaaugcacacaaagcccuugugauuuacugcuauuauccccacuuucuaggggaaggaauugagguuaaguggccugcuggauacauagggguagaacugcuucuggcauagcugguagagacacaaaaaugaucuaaaacuaauccuuggagcccacagcacagugacacuggagaggaccgauauugugaggcuauaccaucuaccaccacaguguaccaucugacaucucagccauggccugagacaccaauggcagggacccaugugagagcaagcacuucugccagcuguaggucaaguggcuuagaauuauggagcuguugaguaauaauaucaggggauauguucaaugacagugacucacaguauaaugucuuugugaaagaccacagaacccacuuuuagaguccgugugagugagcguggacuguuggauguauggauaagggaucccaucugccuucuauaucugcacauguaugcagacacacacacauuaccauacacugcauuauuguaguccauaguuuccaaagcgcacggcaguguuuacuauucugagggugcuccugauucagggauucuuauuuucucuuuguuucucuguguaguucuggcuaucuuggaacuugcuuuguagaccaggcugaccuugaacucagagaugcuccugccuuuaccuacugagugcugggauuaaaggcauaggccgucacugcuuugcucuuuuuuuuuuuuuuuccuccuucccuaacuuucucugccuccucuccucauugcucuugccugcccuuucagucacaguaggugacacuuccucugcuucccuaaacugaccuguaacugaauuuaaucagaugacaguugaaagcaggugaggggaauggcaaaguucuccagagaauaaaaaagggaagguagaguugcuguagcaaauaggguugccacacagaccagcaagagcagcagauugucauacccucagacggaaggugaaugagcccugccugagagacuucucagggaaagcagggcccauccauuucccaucaucagccucacugcgccuaggcaacacgcuccacaaaguucucugagcagcuggcuggcagcaucugagaaaguauucagaggaacacauaaaggugaggacagaggcagcagcuggguguggcagugauagcagacccuguguuacgcuccccuuuccuaccacagcaagaaguugagguuaggaaaggugaagucuuguuguuccugucugugcucuuaggauccccagugaugacaaagugaaguuucaugguguucugaagucagaccucagucaugaugcaugaauguauuugcaucaugaauuaguuguucaguguccuggcuggaaugggaacaacaguguuggaggaaagcuguggauacuucugcagcuuuucugccuagaggugacaaauacaggcugugagggccaugaggacaaguugccauuuggcuuaagugacagcuaaaaauacuuuguuauaguuugaaugcagacauguuuuucucagugaaauacauccugaauuguauuacagaguaguauauuccuuuccuagagcuacuguaacaaaguaacacaaaccagguggcugagaaccacagaaauguaagcuucugcaguucuggagccgcagaugggaaacaaaggugucaccauguagaacucuuuuucucuuccuagggucuuguagacccuguagucuaugguguaucuuacauugcaacugcguucaguuucugccugugucauuauguggacuuuucuuuucuuauaaaggcgccagucagguuggauuaggacucacccuaaugaccucaucuuaauuugauuauaccuguaaagacccuguuuccaaauaaggccacauuauagacagcugcugggagcaggaaguucaacacacccuuuugaugaacagauaguaauagaaaagaauuuaccauaguggaagacaccaacaugggaagcucugcuucuaaguguaucagauuuucuggcuaagcuugaaaaaaaccaauuuaguagugaacugagcauggaauaagcaaacauuugggaauauccaauuuucuucacaccagcuuaugagucucacuuuauaauuuauaaggcauuucuaagggauagcauaauucaugugaggcugacugaccuuaccagccaacuacucggccuccucagugacuguuguaagucuggguggcugagguggucucuaaggacaaaaagagcaauuuuggugagaauucagagccuuacuaccauuaacagcacaguaagcaugaggagggacccucccuuccccagccauacauaggugcagcauugucacagcuguccauuagagggucuucauggaggcuucagaccugucccacauauucagauuuagaacuuguuguugaugucuuuaaccugcuacuugccuugauaaccaagucacugcagugguuucuucacaugcacagauauagcucucuauggccucccccagacacacaaugauacucugcagaacucaguuuaguguaagcacuuugcucuuacuuguuuccauaugugugacuaauauacacuuacagguuauuuaaggcaggauucagggaaagcacaaaaugaaauaucuuaccucaaaggauaaaaagcaaaggcuguauuuuuauuuuauuuuauuuuauuuuauuuuauuuuaaauguuaugucaucuugacaacauuacauuuuaguaaagugcuucuggccuucuuaaacuuaugcuuacuacauguauuuugugccccccaaguucacauguagaauuccugacccuuaggaccucagaauaugaccuuguuuagaaagagagcuuuacggagauuacugacuuacugguucccucugucaaaaauuagcccuucuugguguucagaaguagcuuccuuaggguggaccaucaguaugacagagguccuuaucaacgggagaaaucuaaacacauguauauacagggaggacaggacacaaggaaaaagauagcuauguaaaagccaauuggggaggcuugaaagaccucauucccucccuucuuggaccaagccugaccaugcauugauugugguccucuggccuguagaacugugagaugcuauuuugucaucagccagccaccagcugcagugcuuuguuaaggagguguacuggcugguuuugggugucaacuugacacaggcuggaguuaucaccaagaaaggagcuucaguuggggaaaugccuccaugagauccagcuguggggcauuuucucaauuaaugaucaagggggaaaggccccuuguggguuggaccaucucugggcuguuagucuugguucuauaagagagaaggcugagcaagccaggggaagcaagccaguaaagaacaucccuccauggucucugcaucagcuccugcuuccugcccugcuugaguuccaguccugacuuccuuuggugaugaacagcaauguggaaguguaagcugaauaaacccuuuccuccccaacuugcuucuuggucaugauguuugugcaggacuagaaacccugacuaagaaaggagcuguaccagacgaauaugccuauguuagcagccacuggcuuuuuguuaguuggacaggcuuggugauccaucccuguaauucuagaaaacugagagggaauuucgaguguuagguuauccugggccacacagugagauccugucucaagcaacacaugccauuguucuugcauuuuguuuguuuucaauaagucuccaucauugcaacucuaguuugaaaggggguuuuggaguuguuuuucacaaacuuguuuuccuuuucuuguugcugcauauuuauugcagagacugggaaacguguaucuucucaguagucauccagauuggucguacuucugggaauguaucauuacuauuuucaguguucuuacacaugguaggaaagugcugucccucugcuaccuucccaggccuugccaaguugagagcacucagacugcuugugaacacuaacauguuuuagacagcagguccucauccacugcgcgacauuggguguaugcauggucaguauaggggagucacaaaaagucacuaaagagaagcuugggguugaggguaagguuaacaacuuucagaaaaagaugagaagagagucugaacaccaagaagggcugauuuuuugacaaauagugaaccaguaaguugguaaaugucugaggaauuuucaaauagcaggaggaaaauguuuucugaauuaaacacaaguuaugguaaaauuuaaagaagcauagccuauggcagauaauacaaaaggcuuggaaaguucuuaagagaauuacauuucuuggaaaagcaaagggcauguguggugugucugcuucuugucccuggaaggaacuccuccuuucuccuccgaccucugggagaaaggagggcugcugacacauucccgccaggcccagccacuccuccuguuuccauucuccuggaccaauccccuaacugugguuuuucacuucauucuuggcuuuccccaugacucaugaguccuccucauagucuuugacauccucucuguacccuccaaggaugacuguauauggcgucuguuagacuuccaggauugcuucuccugggaaacaguguuacucacauaaauuccauuuuuaucaagauuuaagcaucugcagcugcaacaucuuguccauucuuccaccugauuuuuuccuuguuguugucuuguugacaccuagcaggagccuuuucugguucucacaaucaguaguaacucucaagagucucagcacagaagccuuucuuuguaguaucuauuccuuagauaucuguccacagucugucuuucaguauauuggaccuuucccauugccuuugguuuauccaugcauaaguuuaggccaccuugccaccuucuccuuuuggcuaauccuccgcaggcuuagcccaucauauuggguuccguucuccuuucaaaaugguuuaucuucauucaagagucaaccugaggcuggagaugacuuaguugguaaagugccugcuguauaacgugaggacccgaguucucuaguaccagcaaaaagcugagcacgugcacacaauccuagcacugggaaaguggcucaagcuuccugaccagccaguuuaguugaauugaguguuucugggucucguuuccaaaaauaaaguggagagcaauugagaaagauaccuuacacuaaccuucugccuacaugcacgcacacacacacacucacacacacacacacacacacacacacacacagagagggagagagagcaacuuugcacagagguaccagaugcugccugucaaacaccagcagcuccugaugcuaacuucaguuaaauuaaccaaguucuuguuuccauguuuuaguggaaguuaaugccgggauacuugagcauagauauccagugcuuguuauuuaacuuguuggaaacucuucuucccaagaaaaaaaguuuggcagcguguuccaucauccccucuguuaccaccugcagaccuacuucucaucccucagacacacuugauuccuuuccuuucuucucccucugcuuugaaaccugucaguaacuugcugguuuuucucucugaagccauauauuuuuccccuuucuuucuguuuucucagacaguuccuugguucagaucccccuccccugcccucugggcuauugugacaaccuuccuguuugccaugcaaccucuccaggccacuuagucuaaggcuucuuacucaagaccaguguucuggccacugguccauugcauauugaaaaagggacaauugcuucuuagaagaaacauauuuaguuuuaaaaauaacuuuaaaacauuucucaaacgucauccugaccagaggagacacaaauguuaaacaccauggucaucguuguggguauucguuaugguugaugcagucagcucuguccuguagucuagaucuguuuccucuucuuuuuggcuuucaucugaccaugggugcuacucugccuggccucauguucgauucuucuaauucaagaaccaaacaagugaagcagaagcuugaguaaugacaugaguuugagaucuaggcagaccucaguuccaaauucaacccugcuaguagcagagugacuuuaggugacuuccgucauuucccuaagcauaggagaaaugcaccuuaccucacaguccugauaagcaccuggaguccagaaaagagcaggagugaccaugaaagucucagaaacuugauuaauuacaugugugguaaccgaguaagagccacaggcugggucaggggcgagcuggcuccucacagcagcuuuguguguuuagaaguguuuuuagacuauuagagccaccagaaucuaaggaggcaguugauaugcaguguccacuggagguugauuauugccuuugcguuuguuaauauauuacugauaugcaaaugugcuucaguuguuuccaagcagagcagaagcuuucugaggacagagacaauggugcugguugcucucuacugcgagacugaggaauuacacccuccuaguaggauccuggaacaccagccuaaccuuccgaaaggucauccaucuuuauaaucacaguucacaucuuaucaaaucuugccuggcuauaaccugagugaguucuucucugaacugugcuguuuacuucggcaguuguccuuuuaaauuggcauuggacuuuaugcuaugagacuuuuaagcuccuuuaggucaauggugaugccuuuuucuuuuuucuuuuuuucuuuucuuugacauggucucuuacuuuguacuggcuuccaguucagcgauauguuuaucuuugccuccugggugcuuagauuaaaggcaugugauaccaugcccagcuaauggcgaugcuguagacauuuuuguauuuuccuucuaccccaugccagucuuauaaagagaagaccuguaaugcagaccagaugauugacuuaguuuauuuuccagaugcucagcgcugcugcaaucguauugcugcugucauuaucaguaaggauucugaagaacuugugguuaauuuuacacugcucaaguggagucauaucauguaucuaacauuauacaacuagugcauaaacacucucugauugaaaaugauauaaaagccccaaaagauauuuaguacucacuguuuugaaaaucugucacuuagaaacagguaaccugaaauugcuucacacucuuuuaaaauacaaaccugacacacaggauaauuauuacaguuaugaauauucuguaguauaucaaugaagaauuuuuucuaauacucuucaauccucugaggcauuaaauaaucacaaguuuaucaagggcuauacaaauuuucccuuaucuagguguuuaaaaauuuccauuugauacauaauuccuuuuaggggaagagugggagguuuugagacaggguuucucuguguagcccuggcuaucuucuguagaccaggcuagccucagacuaccucugccucccaagugcugagauuaaaggcauaccccacuacacucagccauagacauauauuucuaacauugauuuauaacuuauaucuuaugugcaaaauaugauauagaagacaggauauucuauuaaguaugggaaugaauuauuuuuauuauguauuauagggaaacaaaauaacauuguaacuuucaucagauacucauuauucaggcaguauaugccuggaagguuuuagaaagugaagagguuaguaccucucguggggaucuggacucuaugcucuuuaacuauguaacuggauuuugaguggcaaucuauuucauaucugccaagccuaaauuaaaccuuaaauacugauaaaaaaugaugccuauuuuuacuuauaauuccuucucuugagcuuugcugaguucaaugaaacugaguucaaugaaaaaaauuaaucauauauaacccucacuuaucccuguaguuucaccagagucugaucuuccaguagauaauuuggguggugaaauggaaaggaaauguacucacaugugaagcaacuuuuaguucauccaauugugaaauaaaaaguuaugaagaaacuaagcaaauauguuaggaaaaauacacuaaguaagccagucuuuuaacaaaugucauuuuuaaauauaguagguuaaaaacucaagaucaugaaaacuuuuagcuuuuuaggugaguaugacaaccaacacuuguaaucccaacacugaguugaaguguugaaggccagaugguccuacuugaagcuagcuuagcuauauagcaagacccugacucaaagaggcagaaaaaguugccuacaacucugaaaggguuucucauuaaaccuucaagacuaagaaagacaacgagccacagaguuguccaggcuugagcuucaaaucagggucugauuuugccccuauuccaggagcccacaccaugaccugaugucacagcuuucaacucaucccugugugaggagauuguguggggcauguguuaaugggaugagcauaccacgauaaucagacucccaaagacacuucucccagagccacaugugcacuggugcuugcuaauuuacaaucugaagaaugguccaugauuuuauacagaggcuggagucgagugugauggaaguuugugggcauccauggcacccaugaaaagacuacaaggcagaugcuuugaaacccggguuuauuguagauacguuuuaaugugaagugggcauuugcggggaaccuaaagagcaguucaucuucauuguuuaaacaugcagguuaccaaaaggcacuugaaaccuuugggaccuggguuuguuugguacauaagacaguuuugucuuuguuguagugauaaggaaugacuuaaaauguucacugucauucugugugacuguuuuuaaucagguuuauaggcacuacuuuuuauuugucaugaagugaggaauuuauugcauacaguugagauguaaguuagcuacauuucuagugaguuuguaaguauaucucuuuuauugguaguuuguccauaagcccagaaauauggaaagauguguucaaugcucaugccuuuggccugcuuaagagccagaggcaugguagugagaauacuccuuuguagacacuucacccuauguaucagcaaucacuggauauacagccauuauguaggguuuuaucuugagaggccaccgaggcuuuuauagaaaggucuggaugggcuauaccucuaaggagcagguguaauuauugcagauuuauuguguuauucccuggguccuccauacugcccuucagggaguuaaaccuauccuugcuaguaggggucagagccacguuuucuucuaagagcccaagaggagacacggagauugaaauuuuauauaggaucaaacugaagauguccagucagcgccugccauuucugaggggaaguuauuacuauuauuauuuguguguauaggaggucaguaguccuugaagaguacaggggucaaaccauaaagaaaugagaggaaacauuuagcuuuuccuuuagaguggaaaacauacaggucucccccaccucuucccugucccuugccuuagggaucugaacaaauggaauggcagggguugugggcuuaacaaagagagcuaaacuaaccaggaaggguuguuccagaaaagacuuccaaggagagauguuuagacauaaguuugauuauggaugugagauuauuuuaaaaugaagcuacaaacugccaguguuuuguuccuuauaaagauuuuagggcuuaaaaaaaucauccuuagugacuuucuuuagcuauauuuuguuugagcauucuccuucccacauccacaggaagauggaccaugccauagaacaaagguaaaaagguuguuggaaauguuaguucuaguucuuggaauaguggcuguugaccucagcagugaccacagcagccccagccagagucugaggcagcugcuggccacaaugauggguauagagagguuccagccaugcaggucuccuugcugauccugggcaucugucacccaaggcagccagugauuauuucaacaguuuaugacccuuggcuaucaucccaauaacaaauaagucauaagcuacccucuuccccuuuguaaaauuccacucugcaauguggccucucuaccaagaacuucuaaaacacugaggacagggaccagugccucugaagcucuguguguaaucagcuuauuucuucuuuuccccuccuacucucccuuuccuuaguaacuugagugagaagcaggagacagucaaaggacagagcugaaguagauagauguuaauuuugcuuagucucuucuguucauagguagcuuaaagccaaggauugcucucuucuguauuacuucaaggguaucagaccuuuugacauuguaacaaaaugccauuugcaaauguguuggagcaaauucauuaguguacuggaacacaugaagccagcaggccacagguugaacuugucuggcuuauagcauguguaacuauaugaauauuuaagugauauuaguaaguagagaauaacuacuuuuugugcuaugguauuaggaaaauauugacauaaaaguaggugaaaaguaugguugcauaacaaaccaaaauaaccaugucaaacaguaaucaugucagacauacacaggcauauuagucauagugcccaggugaacauacacagacauacagacauacagacauacagacauacacaggcauauuagucauaguacccaggugaaccuuggagucagcuuucaaaccagaagggaagucucaccguaaaggcagauucagaggagaguuuaggcuaagaccagaccugccuccaggacgucagagcacaugcugccauagcacaggcagagcaugacuguccagccagcgcaggagccgaacagccucugccuugguauuguuuuucauucuagaguauuuguuuugagucagggucuuuuuucuuccuccuccuccuccuccuccucccccugcuccuucuucuccuccucuucuuccuuuuuuguuuuuuucgagacaggguuucucuguguagccuuggcuguccuggaacucacucuguagaccaggcuggccucaaacucagagauccgccugccucugccucccaagugcugggauaaaaggcgugcgcuaccacgcccggguugagucagggucuuaaugggugguccagaauagucuccaguucuuaaauccucucucuuagccuuucaaucacugaaaguuuagucauguacaccauaucuggucuucucccuugcgucuuaaaaaagucuuuauuuggguuaaauugggccucuaaacugcguggucuuuaguugagagaagcaaugacuucauggcagaagguaaaaaguacuggggagugaaugaagcaagugcaggagguaugcuauucuagaaaaaggggugaggccggucuagaguugagauuucuggaggaucaguggucgaagaugaagcuaaaugguugaaugggaaucaggauguguguuaacacuucagcuuuaucuccugggcaccaaggagccaccagaagcuuuuggacagaggaacaaugcuuagaaguuuauguaguaagacaaaucugcgggccagauacaggcacauuagcgcucauuccagugaccaggauccuauauuuacuuuaggguugcuuuugaaaaguaaugaggauuucagcuaugggaguggcaaaaugaacagaaauuaaaaaguugaaaaugagacauguugccuuauauagcuauuuaaauacuuuuaauuuaaaaaaggacauuuuaaaagaaggcgaaaucaaucaagacugucuuuuauuugcugugauaaugaagacucaucaagguaaguccacaguuugggaaccaagcaacuagauaaauacuuuauuaauagaauggaaauguuaaaaugaagcauaaauggcuauguuuuaggggaaagacaaggaguucagcuuuggaagaucauuuuaauguaguaggagacagaaauaauauuacuggaauauucaagugggaacuuggcucaugauaagcaugugggaguugccugcauagagauaacuguuuaaacugucuaaaugaaugaugccuuccagaggaaacagaauacuaggagugccagcauuuuaaaggaggaagaggagcugccuuaaccccuguguaauuagccauugggaggaggaaggcaguuacagauucacauuagagcagauaagaacgucaagaaggaagugguggucagcgguaucagauguugcagagagguuaaggagaauaggggcugaaagagccauuggauuaggcaauuaggaaguuauuuaccuuaagaacacaggucuaugauauuugaauauguugaaggagaaggauuaagaaugagcauugaagaaaagaguacaugaagcguaauuuauagguaagaaggaaggcgugaagaggggcugugacuguuacucuuucugucuuguaaguuggagguuugugccugcacacacacuuggaggcagagggaaagguuaggucagugaugcauuugaacaaccuuguucaauaccagcuaaaaacuuuggccccaaaaguagaaaucaucaauagcuuaaaguggggaugggaauggcagaaacagaauucuauagaaaaaaugggagacuauggauuaugggacuagcagaaugugacugaccucagaauucugggcaagauagguggggauccauugaagagagggaggauugggggacaaaggauggcauuaagagggagguguuaaggaaccacucuagacaaugcugggggucagagagcagcugcuagaugcuuaaguaucaguaaagcuuggcggucucuucaccuucuaagugccauuguaagaaauggcaauggagcugaggagguggcugauucagugugacauaagcuugaggaccugagcuccauccuuagcauucacuacaaagccaggugucuguaacccaaacacuggggaaguggaaacaggaagaucucaggggcuugcuggccugucagucuugcugaauuggugagccacauguucagcagagagaccuuuucucugaaacuauggcaacugaaaaagaaaccuguuaucagccucuggccucuauacacuuaguacaugcauacucagacauguauacacaugaaaacacacacacacacaagaaaugguuauccaaggcagcaaauugguuauuuguuucuucuuguaccuuuaagggguuuuccuuucuugucgcuguaguguuuuuuccuuaaucuauauaucacauuuuaaaauuuccaguaucaccauaauuauaaguuguacagcuacuucagaaaggucuuaagcaguuuuaagauuaucugaguugcaaauaugaaaucauaguucguucacucucagcuuccauuaugugugagcguuuacagacuuuagguugacaucugggccuccuuuaaucaccuuccaucuuauuuguuuuugaggugaggccucucagugaaucuagagcucaccaguuaggcuagacuggcugaccaaugaaccccaagaacccaccaucucugccuccucaguguuggguacacaaagccauguccaauucuccuuaccccaucugcauauccaguggaugcuggaaaucacguucaaucucuuaugcuugcuuggugaacaauuuacccgacaaagccaucuccccagcaccuaaaaucucaggauucuugagagaaauuucuuacugucuagauuaacaaaacaaugagcaaggagcccacacacggugcuacuggguccugucugaaggggacaccaaaucauccaucaacucagccuuauagaguucagaaugaugaggguaccagaugguauguagucugccccacucagagcauagacgagcacgagagaccccugugcuaggguuugugcaaggacguguuucuuaagaguagugaaccuaguuauugcuaucuguugacaaggcuaagcugacuacauggaggugcuaaguauguaacacuuaccugggauacuugauauaaucuucagauuuagcaagaugcaaccugaaaggaauggagaauugguuucuguuacaaauuaauuacaaaaaauaaaugaugaacuaaguccugauucuuuaucugauucuugacuauuuuugacucuguuuuuaggagucuucuauccuaacgcugguagaucugauggcagaauaugggagccauaggucucacaaacaaggagacuugaauguguuucuggguggaaacugauuugcuuuuucaagcugcugaauuuuuaaaucaucaugcauguauauauguucaugugcacaugcagaccaagaaauguaauguuguccagaggacaacucuagguguuaguccuuaccuccugccuuguuugagagaugcuguuuauugcugcauaugucaggcuaguuauuagcccaugaccuggaaauuuuccugucucugucaccuaucuugcuaugggagcuauggacuuacaguugcaugugacugugcccagcuuacaaggguucuagggaucugaacucaaguguuuacacuuucgcagaagugcuuuacccauugauccaucuccccaguccuuaagcuucuuucagaguggaagaacaaucugagccuaaaugagucgauuacguuuauuauuggaggagugaaagaauuaauuuuccuuuuucuuuccuuauagguauggccucacaugugcaaguuuucuccccucacacccuucaaucaagugccuucuguagugugaagaaacuaaaaguagagccaaguuccaacugggacaugacuggguacggcucccacagcaaaguguacagccagagcaagaacauaccaccuucucagccagccuccacaaccgucagcaccuccuugccaauccccaacccaagccuaccuuacgagcagaccaucaucuucccaggaaguacuggacacauaguuguaacaucagcaaguagcacuucugucaccgggcaaguccucgguggaccacauaaccuaaugcgucgaagcacugugagccuccuugacaccuaccaaaaauguggacucaagcgcaagagugaggagauugagaacacaagcagcgugcagaucauugaagagcauccacccaugauucagaauaaugccagcggggccacuguagccacugccaccacauccacugccaccuccaaaaacaguggcuccaacagugaaggggacuaucagcuggugcagcaugaaguacugugcuccaugaccaacaccuaugagguuuuagaguucuuggggcgagggacauuugggcaaguggucaagugcuggaaacggggcaccaaugaaauuguggccauuaagauccucaagaaccaccccuccuaugcccggcaaggccagauugaagugagcaucuuggcccggcugagcacggagagcgcugaugacuacaauuuugugcgggccuaugagugcuuccagcacaagaaccacacgugcuuagucuuugagauguuggagcagaaccuuuaugacuuucugaaacagaacaaguuuagucccuugccccucaaguauauucgcccaguccuccagcagguagccacagcccugaugaaacucaaaagccugggucuuauccaugcugaccucaaaccagaaaacaucaugcugguggauccauccagacaaccguaccgagugaaggucauugacuuugguucagcuagucauguguccaaagcugucugcucuacguacuugcaauccagauacuaccgguaagacauuuuccauggagauagucaggaugcaggagguccaguggcauccacagggaaugugcagaggccaugguggggauaaugauaaugguuguuaccagacagagaccguaauaugaggcuggagacaugguccaaugguuaagagcacuugcugcucuuacagaggacuucaguuugcuuuccaucacccacauggcagcucacagcuaugaguaaaucuaauuccaggggaauccaucucccucuuauggccucuauacaugcaagugguauacauacauacauucaagcaaacaugaaaauaaaucuuucuaaaaacaaaaagagacuuuuuguuuauguauaugguugaaagauuagaauacaugcagacuggagggauggcgagaagcuaucugagaagcagcugaguaaaauaaucuuggucuggacauugagaguuggaaagaguuuuggagaagucagguccuucuugauggagaggauccauucagcuagaacaggaagggggugccagugacaggcacaggguagcaaaaugcaaggcucguuuaggagaucaggaugaccuaccuggcuagaucagaagauuugugaauaguaccuggaauaaguccucgaaacuuugaacaagcagggguugaugguguguguguguguguguguguguguguguguguguguguguguguguaauagguugauaguaguuuucuuaaaagacuacuauuuuagucauguggaaguugcugcaggaagggaagaucuuuguccuggggccaguugcuccuuccugugauaaguuuauaauaggaacauuaacuauuccuauccccccuuuaaauguaaggaaaugcccaaggcaggauaauuuuguggagaaaagaggcuuauuguugaaggucauguugcucuccucagcuuaugguagauggucucauaauggugggagcaugcauaggaguaagagaucacaugacuagauaggaagacauauaauuguucaagauuugauucaagcuuuuaagacaacuuuuauugaugagaacucacucagggguuucuaaccuuaauuccuccugaggacagcacugauaaugaacuuccacaaggccuuaccaccuuucaacaucacuacacugaggaccauuauuugaauuagugaccuuaugggaucaaaacacaucuacacucuugcacauucaaauaucacacaagcauuuaucucauuucuaauaugggccuuguacaaaaauacuagcuagcuagcuccaaggauaaacaagguccuggccaucccagaguuuucagcaugcugcaggcuuuggcauuaguaaaguccagaacugaacugaucccuaaauucacuaggcugugugauuugugcugacugccuaacuuccuaauccauaagcuggaggccggaguuuuuauaccaguuccaggaugcuguugcaccauuaugugauacaaucuaguguuaugugcaauggccagcuugugggagccacagcgucaggaggcaguggagauagaaaccgagguucaggguuguagaauggcaaaauauauuuauuuuuauauuuaaaagagcuguguuggaagcaauagugaccagucccacagagccagaaauuggcaagaaaagaaccucaaacuccggagcaugagaaaguaggcugugagucuaaggcuucucugcuccucuucagggcacuccugagugcuggggcugcuggagcuccucccuagcccuggcaucuaaugugagaagugggggcuuucucugagcacuuagguacacacacugcccucugucccuggaguucucacauacuucuucacacucaggaggcuaggucuaccucugcuggcucucuuuccaccauucagccuggaagggagccauccaggaaggugcagccugcucaguggggaacuguauccccuccuugagauaaaaagggaggcugacaacccauauucucuggagagugacuaacucuuuucuugaaaggcaacucuaugguucaucauagagaaacagcuuaccccagaggcggcuuuugcuggggccugcucuguaguuacugcaaaauggaggcuuuccugucacuuuauauuuagacuuacaaauucaggaugccgauggcuauuucuugccaguucuuggucugaauuuagggcaaacugugccaagccaagggcugugugagguuuuauuauuuaguuaaccuguauugcucuaaguggacagcuucauugaaguuuggcuaaaaauuggccauggaggcuuguaauaggcuuaaaacuauauuuaauaagcauugcauccuuguagcaaaauuugacgcaagaaguuacauuugggacucugaagccuguuuuguauuccugcccucugugccccugucacucugcccacucugugccccuccugccaaggacucugcaguguacuuugcuuucaggaacccuagcucaggaggccuaugaauggcagugacauuuccaugggaacuggggcaggucugaauccucgucuuagacuugauguccuuucucaccagcuuuauggcccagccauccauuugagcaccucauggggugauaaggcugauuacaguuaggagcuccccacuugucauucucauuugucaacaggcacagucaccucuacuuccugcauucccacuuccaucugaguacucccuuucuuuaggccuuaagugacuaauaccuaaaauucuaggcagaaugaccccccacccccacccccugcccccgucuucaugguguuggguucucaaggccagcuaagcaacuuucgcuagggacaagggcacagaguccuggaaugauaacuucauuucuaaauuaaucauaguacucugccugccgcaggccucauuugagccccggaguggucagucuccugcuacauaggccagcggaagcuuacgagcacagcauucagcuuggacccugcucauccugcuguguaggacagucagccuagaugaaacuguugaggugauuuccugccuacuuuaccuuuuacuuggggagaguggacaagagaagcucuuugauuauuuaucauuaagguccuuaucccaaaaaaaagcauaccuucagggacuuuuuucgagagaggaagggugcuuucaagcuuccuggacagagaggucauuaugugcucuggguccaucuuuccccaggagcccccugucuugagccuggcacauuaggaacacuccgcuuuaagaggguugaauacuuuguccuuuuaucauuuuaaacaggacuauauuuagugcuccucccauggcccccaucagguaugguuuaaaaaaaaaaaaagugauaugaagugaacuuccuguucucagccugagggauguggggaggaaggugguggccuggaagccacuauuuuuccuagaagcuagauaugugcuuggaugaauucugaguggugguagagagcuggcaccagcucugccccuacagccccaggaguccccuuucuucucagugguccaccaacucaucuggauccucaacaaggccacaggaaagagccccaagggccaggguaaaguaaaguuagugaguuuauuaaguauuuagagaaauauaggaaaaggauggugugcacucaguacacaggguggcuucucaacgucacaguuggcuacauacaagauuuuauggcugagccaguauacauugcucaaagguuguaacugaccagguuuaaagguaagaaaagcuuaauuuuaaguaaaguuucaaaacaaauaaaaauacaugaguuagguuuacuuauuucucugacauugaagauuucccauuuauagauaaaauagugaagauuuuuaugagguacauuguuuagauuuaggagugaaaaagcuguacaucaaaaugauaaaacucacaaaguuucaaacauucuggcuccaaguggaccucauucauuaguuuuuaacauccuauuuaagguaucuuuagaaaaaacaugauuauuucucugggcaguuuuggcuuuguuaguuguauugagcuuuuuuggcccucacucaguauaaaaggcaaauuagacuucagagugaggagcuucugccucuccucacccuuuccucaccuuuccugcguuccuagccuaccgcagagcugcuguuagcauucugugagggaggccugauauguggcuuuaaggaaucaggguugcuuugucaggucuuuaugguguaauaaagggguauaggagugucucccgacuuaaccuacguccugaaggucagcucugaggguagcugucagcagugcggcuucucaagcucucucauaccuaagaaccuggagagcuuauaugaacagaauuaugcuagauccugucucugagcuauugugcccucuguggggcacagucucauccucuacccuacccuacccuacccuacgcuacccuagagauucuugagaaacccuguuccagcugagagcaggcuuccuccaaggugccaccuuucagguggcaaaagaucacaguggaaggugguucuguuuauuuguauuaccucacuaaagaagucccugccaggccauuauuuaauucuacauugaugccaaaguuuggguuuuugagcaaacaguuaacugguacuaggguauuucugcugucaguaucaccagcaaacuaaaaacaagaccaaacauuaaacucugaaaaaccaugaaaaauucacgguugggcaaaagauagucaaaggugacaguguguacaguuuuguuucugcucuggacuguucaaaauauuuuguauagacuuuuuugagaccuuuaagaccauugauaagaucuccaaaagugggcauaaaaaccagaacauaaauaagggcugguaagauggcucagaggguuaaggauacuuacuacuaauucugcuaaucuuuaaguuugauccccaaagucccuaugauggaagucuucugaccucuacauuacaugccagggcacauaagcauuuccauauaccacacacaccggggggggggggauggaggggagagagagagagauugauuuuuaagaauacucucucaguugauuguuuugggugcagaggcuaucuuccagaugauucuggaaugguuguuagguagagauggaaauuaauuuuaguuccaaucauuaugucagacaaugauugaguagcucugaauaucuaccuauuaaugguauaggaagaaagguacauucucaaauuuuaaguuaauugucucuuucagauuuaaagagaaguuccuagaaauauaauucugaaauuugguauuccaaguguaugauuauucaacagacacuuccuaugaacccacuauguaccagauggaaguggguagcagacgugaguaaagccgccacagagcucagggucagugaaggggucuuuugcacgaugggcugaccagagagaccuguggugaaggggucucuagguagaucuucagggaagucugaggugggguaaaggccauggagguuguaauaaaaaggaagaugggagaaacaaaagaguugugcaagugguugaagggcuggguugaagcauagugguauagaggugugagcucugacaguagggaguuuugacuacagcaugaggagcugggguuuagucagaguaacauguuggaagcgucugugaauucuugaggagguuagugaugauauaucaguuggaaaaaggcaaauagacagaaaguugaugggagacacaagguccaggaauaacguauuaauucaggaaugaaaacagagggucuagauuauauggugaccccaccccguugucugacuguggacccauuagugagcuugacuuuucugauaauugacuucagaacugacuuaccagagaacaguaugggguuuguuuuucauuuuugcuuggugacuuugcucucucuaagguuggauucugaaacucucgucugcuagggccugguuucaaaucccaccaccacuacaaaguaauagucucuggaaggucaccucagccucaguccugguccugcccucaccacccguuucccugacucacuguuagcagugagccaccugcacuguuccaucuggauucuguugugagcaggacuugugcucaccagguugugagccauaguuggagauucuaguuguguggaggaaggagucuuuccccugugggugauuccggcaucauugacccacacugggaaccuuuccuaguuucccaugaacugugaacaggguauauuuccacacugccagauuguagacugaaggucuaagucacuucaauaaaggguguugccacauacagaaguuucaaaaaugguauaacuuaugcagaucauaauauuuaaaaggugacuggcucacuugaaaaacagaaccugcacacaguuaugcauggcaagcauuagcucuuaaaccugccguuuggaacuaaaacagcaggaggagagguaugugcaggcucacauuggagcauagcaugugacacuauccagcuuacugacagucucauuugccaacucauacacauguggaaacaagcagagccacugcucuguuucuauaaaaaagugaucaauaaguuaacugggcugguaacuuuucaaaucuccauugucccugugaccuucgguuauauaguauacauuuugaaauuagucuuuucuuucaggaauuacuaauucaugcucauaacuacuugguaauuuccaggguagccugcauguauuugaguagcucuaugcugcaaccuugccaaaaacaagagaguaagggcuugugcaugcucauaaguacugacuuacacauagcacagugaagcccauacacaauaugcaguuaugggugugcuugugagaaaggguggcauuaacucuuucugcagggaugcugaugugcauugccagagaaugcuugcaggugagcacacauuuaaggaaggacacauguauauguucaagacagaagugaccauccaccucagaaaacagaagccuuccaagugucuguggggucugagggcccagauacagacguugugucaguguccuggaaacucagcucagcuuucugccuuguagggcugccagcugcaugccuuuaagccuaaagaugggagggauagaaccacucauggacucaaguuauagauuaguuuucaaaaugagcucuagagacccugccacuccucagucucucgugaugcuuguuagaaacuggagacaucugccaugccaagccagguuaauaggcagguguucugggaggagagcagaaacaggcauuggucaaguuucacagccaauccucuccuccuccuccuccuccuccuccuccuccuccuccuccuccuccuccuccuccuccuccucuuccuccuccucuuccuccucuucuuccuuccccuccuuuuccuccuccuccucucccuccucuucuuccucuuccucuucuuccuccucucuguucacucccucuucucccugcaccacccccuuccuuuuuuucuggugaucagacuuggggccuugggcauggugccuaggauucuauuaaucagcacccccauccccccaacuucuaauuuugugauggugucucauuaaguggcucaguuuggccuaucuaccagacuagcuuagccucaagcuuacaauccucuggcuucagccuccugaguaguagaaauacaggccugugccuggcugcuuuuccucuucacacauuuuaacccaguauugacauucagaaggcuguugacaaguuguagcugucagauguaaaguuuguagauaaagauccaccagugagacuggagucuguaugugcaucacagucacuucuaaaguuuccuucuaccuucuuugucgucauggucacacuuuguguaugugcugcaugugguuugggcuuuaaucuaucucacacaguaugaagaguguccccugucaagauuagagaaggggucacagguggcagucuggccuugagcuguugaucuuucuuauaagcgauuuguagcuccucugaggguccauuuguuaaacgucuugugauuaaaucucuaaaacucaggggugggugugggccugagcaccagaggcuuuccacggagaucucugcccaggccuagugggagaguuccggcgaagggaagcgagugugggcagggagguggagucucugcccugccuuccagaucacugguaacugcacugaguuggguugggcugggcugagaggcugacuauccagugaggagugcagcggagccucaggcuucaggagagccgaucucuucccaaguguuacagcucuuggaacaaaggacucagacaacagaguaguucucgaacaccuuuaauucucuggauggauuuauauacaguuuuggggguaauucaggguucuacaacagguaccucuaauuggcuuggacugagaguuugggggaaaccuuauuugcaugugggaaggcuuggugcugcuccuacaugacucauagccacacaccucuccugcaagggggggggggcggcgcuguggggaugugggacuauaagguaguuguugaguguggugggagaggucaugaggguuggcagacugaggggguggaugauucagaggaggauguuuggaaugagguaggaauaagaaagcagaugcccagcagaggagauaguacuguaugugacuuuaguauaauuucaguagauaagagaucuccuguugauagcuccaggucacucuccauggccccagcugugaugggggccauaauucccauucaggcauuguacaagcaauuuuuuuuauuuccaaguaugugccaggcacuguguuuugugcugaccuuucaagacaugaguaggaguacccucagcuaugcaaggacggucucuaaccugaagugggaugagcucccuggucccacuccucucucugaauaaacugaggaguggcuugugcugcccuccagucacuuuucccauucucucagguguuuggggccacuaugucaagucuaccccacggcagcaagucucugcugcccucagucccuucuagcucaccacucugccagauagggugcaugguaacucuucucuguccccaucagcugcugccucacauggaguugucaaggaggguaacugagaacaaacaagccaagcauagcuugugcuucauaggggaaucaguguuuuggggguacccgugguacuagauaaaagcugagagggugacauuaaggaaccauuuucuuuguuuggguucccauuagcagaccccuaaacaaacagagguuuguguucagguggucucuuugguaggugguccaagaaucaggaauaagggcuagcaggaugaugcugaccagcauaaguguuauuaggaacuagaagcuggaagcauauaggacuccauccccuguaagaagcugcacagagccuucucgagcagagcauagaaaaagcaggagucccuaagauuagagcugcuuuugucccuuuaacuugacugcacucuuuggagaugagugugugugaagacuaaaugggcuuuaguguuccuggggguugcuacaaggcaguuaagcacagugaauacugaagccaaaguauacaaagcugagaugguguaauccacaccccaugugagcugcagcacugugucugugcuauuggcuacuguguuccccaccaaucacauggcugguauucauaaguggaaagggauuuaaggaaaaugcuuuuguaggcagauuuaagaauuguagacuaaagccgggcgugguggcacacgccuuagaucccagcacuugggaggcagaggcaggugaauuucugaguucgaggucagccuggucuacagagugaguuccaggacagcuagggcuauacagagaaacccuguuucgaaaaaccaaaaaccaaaaaaaaaaaaaaaaaaaaaaaaaaaaaaauauuguagacuaagaauucaaaacggaguucugugcuguuuugugggggagaugaggacuugaagcuaaugcauccaucuaccuaccuucacuuaaccccuauagcuuuccucuaggaauagugugggucuggguucugagguggccuacagaggugcucaggcggagagguaggcccacauguggagcacagggcagucagggaaaugaugaaggcugauggcugauggaggucagccacuuuauuuccaaagucucuccauucaugaauaaugcagguugaagcuagcacucccugucacucauuuguggagaaggauggcuacuggagugggguccuggcaaugguaguagcuuccuaugcuuccauaauauaacucucuguuauguaccagacguccuugcuggccaagcucuguguuacccccucagacaaguccuuccuuuuuaacaagucuugacuccauaucauucggcuuuucucugagcucuggaucacagggacccaacuucagccuccuggagagucauauacaccacacacacacacacacacacacacacacacacacacacacacacacacacacucuucugugcugcucagacuucaguuaaaaccugaagucaguaguccaaaacuuuaaccagccaguuucccaaagucaucaugcaucugcuuuguccuauguagaaagcuggagaggacuaccccagggguaacaggcaaagccugacuagugcuacugaaggagcuagagcuggugcucgggccccaagaccucuuguuucuuuucugguuuggggacuauauggauaugcugcucaggcacccucuaaucuugucuucaggcgagaaagcugagugaacaaagacuuccuggagagaacagagcucauccuaggcugcucugagggccugggacagaggaaguacucauaaaugcuagcugcuauuuuaaucugcggcuguuagcacuguugucaggacuuuugucauuguugcuauauguagcagacagaccugggcuuggauuccggaucuacuacuuuauggcugugugacuucaggcaaguuuccaaaucuuucucaggcuuuauuucuuuuaagacaggaaccugaguaauucaugauguugucaugagaaacaaaggagacaacuccaugggugcaacucagcuacuggucauaguacccauucuuucccagguuccuuaagucuucuugucauagauugcauggaugugucugaucuggcaugguuagcaauuacaaguugucccacccaccaagcaucaggcaucaugcacuacuuacuucccuuccaucucuagcacugcaaucgggagguguugaaggagcaagccugcaggucagggauauggcuaauggcuucucuccuguaccagauugggacagaagacagugcaaaguaaguagcauauagggagaauaacaguguugggcaguguugagugugguuggugggggaagguggaugcaccuaucuaguuugaagacuuggcucauugccacacugcugcugcuguacccauagugaugccugauguccuguggccugugacuaggugcaggacuagaggagaaugacagaaugggggacacaucugcauuugauauuugaugaucuuccucauucagugccaccaacccaaaggucagagcgccaagaguagugcucuagaucccccacacagacagcacugccagugugugccagaugugcugugugccagaugugcugugugucuguguugauuguuguguggauguucacuuaugggguauguuuccaguggcauccucauuaucauggaugugagcaauggaaauacaaguucuguagucagaacaaacauaaagaacaaaguguuguugucauuuucuugucaucuacuuaccuccaagaaagguggucuagccuccuucuuuuuguaaauuugaacuuacauuggcaaauauaaaagcaccaagugugaaccccugaaacaucagugcacuuggcauauagagucagacauccacccugaucagcaacaagagucagaggcuauuggagucugaguaaagagguguuaacagaagucugcaugugcuaaagcgaaacaaaauagcauacaaguuuaaaguucuuuaaaacuuaacauuuuaaaucuaucuucuucuaaaaacacugauaauuuuacaucuaaagcuuuagugugccugcuuucucuuccuguuuuuguuuugcccugugguguuugggcaaaagaugucuuguuuauucugucacagaagggucaggaagagaggaacagucauuucuggaaauggcugggugggggaaccuacaaaaacaagccugggauaaauagcugcugcugacgaaaguaggcagcuucucucagugcuguuccaugagaaggucacaggcuuguacucacagagucaggauagugaucaccauaggagagaggcagaaacucaacacugaaaugcccagacuuugggauucccaaaugacaucaaggaccagugggaugcguucaucuggcuccuugugcuugcaguucuccauggucaggcuguaccuguacaccaucugaguguguggcaguuuuccuacaguacuuucccccaagccagccugucuuuccuguaagccucccacuuacaggcauuuucauacucaguaugggaaguagucaguuuuuugggaaaggccauuuacccccuggaauaagaguaccugcuggcuguccuggaugugcaaaggugaucuuguccaagucucagugcaugggccuugaaggaugacccuggcagcuuauacaggccacacacccagcuucugucagcucaaagucgacuaugagcacagcuuacugucugcccuuucucauuugcaggaccuuuuacuuguuuccuuggaagaaacaaggucauuaaaauguguauauuucuuggagucccugguaauucaguuuaagaugacaguucucuuugacauuccuaaggggaauauuucucuuguuugccgagcugagcagaccucuuggccacaccaccugcuugcaguccugcuugugccauauguggaacacucuggcugugccauguuagucugagcauuguuaagauugcucuuccaugagcccacugucuuccucucuccuggaauccuuccuaaaguuuuucuccauucucuguuagucccuccuccuaguccucucuauccuccauaccccuagccuacaauuccaagucuugaugcuucugucccucccagcccacucuguuucugcucacuagccauucucuagccugagcuaucccucaucuaggguacucccugauuacucccacucuguccccaaaccuagccuuccccacuacccccuucaugaaacuugaauguuaaacucacacaacaggaaaagauuucuagauacuaucuuacacuauuaaacacugucuuaguuugguuccuauuccugugauaaacauuuacuucccagcacucaguaggcagagacaggcaaaucucugaguucaaggccagcuugguuugcagaguaagcuccaggaccaccaaggccacacagagaaacccuuuggggugggaggcauugaccaaaaacaguuugggaaggacacaguuuauuugccuuauacauccuuauuauaguacaucaccaagagaaguuaaggcaggaacucaagaagggcaggaaccuagagacaggaaccgaaacagagacaaugauggaauacuacuuaguuuacuccucaugucuuaaacagcuugcuucuuuauaccacccagcaccaccuuuccugggacuggggguggugcuguccacagugggcugggccccucccauaucaaucauuaaucaagaacguguucuucagauuuccuacaggcaaucugguggaggcauuuuucccaacugggguuccuuuucccagguggccuuagcuuguuucaagcugauaaagaaaggaagcaagcaagccaaccaggacagggacucaagaccagugacuuuaaagguacuguaaacaacuugccuccgcuagaugaguguagggaagaaaguuaagggacagaggcucagcauccuuccagcuuguaacuuaucucucauacaaugucucuuuaguucacugagagaggcuguuacccaugaggucuggggagcuuugagacccaugcacuugccuccuucccuauuauuggccuuuccuuucucuuuucuuaugccugccuaugcuuccaaggcuaaugguagacacuuaaagagauaguaaucaaccugccucacuggcugaguauagggaacauaguugucccaaacagauccaaguagacacaucucuagugaauuugccugccauacuuagaugcugggaaauauaguaaggagaaaucagcuuccagaacuuagcuagcuggcugcuuuacuaucaugugucagggcuccccuguaaggaguguucccaugggucucuucaguuucggguuaauugauucaaauuaggugcuacuagcacuggccggaaagcuguuccgucuuuguuugucccaggcuuuucuguuucuaugucaugucauggugcugugucucugccucauuacuuugcuuuauaagcuuuaucagcaagugguuauguguaccuacuuuuuacucuuuugguucugcuaguggggauacaaagaggcuaggcuggggaguauacucuauggcuucuucagagcaagaacacuuuuuucugagcacaucuuauuugauaagagcuucaggaccuuuuagagcccuccccaacccaaugagccuggguccaaagccagccauacaugcucuuuuggggaagccauaggagaauucuguagaaaaucucagugaaaugggucaagaaaaaagggaggucucuauaggcugacugaaaggcccauugcuuaagguucagggaauauggugcuaugcagauuaaguagccauucauagagcugggugccuggcuggcauacucugcuucaacaacacauuguuguauuugaccaguccuucacucacauugguaacucaagucuuuguguauuucuaggaacaagguucugucugaucuuuacagcaacucaaaggguagcucagaaaccuuacugucuucauuccaugggacacagggccuagcccuggguuaucugugugcuaucugugagcuagcuccuaucuacuccagaaagcaggaauuugagaaucuuuggcuaucagguggggugugggaccaccucuaaccccuugaaaauagcccuaggaauguguuuaaguagcuuuguuccuccccuauuucaaacaacugucaguuguccucuagagaaugccaucaguauuuguuuucuugucacacggaaagcaugugcuugaucugaauggacaucauaugacugagaguuauugauuaguucugucugugaucaugaugauaauuugguaccccuggacagaacaacacaagugugauguaugugugcacacauacacacccugguuaaaauuccaauucagugucagagucugaagcuggcugcaugugcaggcagagugagcaugccuaucuuccuagguaugcugauaccaggcccagcugugcaugcauucugucugcaugccccucggugugcacagacugucgcuugccacuaugauggacucagaucugaagcagccucaaccucaacacucagucuaagaguguagacagggugggugcagguggcugggcuucagcaaugggaacaguugcccagggcuugguacagagagacacaucccagcucacacugcccagcuauaacccucucugacuuccaagcaggugagcucgagguacucacaccaaccugauuuuugguggauauucccucugacaaaauguagcaucuugcugcaauggaggcugcagaaggcaggcaggcaggcucaagucuaucucuggucuccagguaauaaaggagcagggaaggagcauguauauauucauucugcuccucuuuucaucaggcaggcaagacucaccacacauaaauacuuucaauuuugcuugcacagcaggagaauugcuggguuuguuuuacuacugaaauugaacacuucuaaagaaacaugacagcauuaucuuuccuggcagguaggggggaguucuuugguaagagauaugcuccccacagcacuuuggaaaugagacacugaugcucaguacuggcagagagaugaagggacucacucuucaguaguuuguucauguucucucucucucucucucucucucucucucucucucucucucucucucucucucucucucucucucucucucucucucuccccccagguucuugguccccaaguuccaagaccuagggaugagcagaguuggcuggacuccugaagaaggcaggccacaaacaucuccagagaugugauacucaguaccccauguggcuacaguuucuugucuuuuuuaauaccugcuugucuauuuacacagguuucagcucugcuuaccuuccuguggccacucugcccucugugcauuuccuccuuuucugcuauaaauucuuacuuccuugaaaaaucuguauuagacaucucuucaucgauggaacuugcagacagacauuuguuugcuaauugugucuggguguuaguucugggcagccagcuggaugguagacauucugggugucugcucucuucugguaauugucauauugucugugcuggaugggaguggggcuggagauuagagauuucacagggccuauuaaauaaaaauucucaaagaaaucccuaagauuuuuguggagcacaaggguuaauauuaaugaaaauuauuuaggaaacuuuaaaauaaauuauguguaaaauaauauucucuacccuuucuugcuggugggaaugugaaacggcacagccauuauggaaaacagcuuggcaguuacuaaaaacauuaaacauagaauugccauaugaucccuggaauucuauuuccagguuuauguuguaaaagacagaaaacaucuacuugaauuguuguacaugcauguucauauaacacuauauacgguagccaagaagcaggccaauccaaaugugcaucucugguugacugcagugaacggauacaacacaauuuuauuuaucaaaacaacaguagcaagcuggggggcuggaggacugggaggcugggggcagggugggaaauggaaugauauacugauagcugucaccccugccccccccacaaaaaaagguuauacaucaaaacugcuugcuuagggaaagaaaguagacacaaaaggucacauuauaagaaauccaaaauagacuaacucagcagaaugcagacauguuugccaggggccugagaaagggacaaugggaggaauugcuuuguggguaaagggguuuuaccuccgagucagagagcauuugggaacuagauagagguggggauuuguacaaucuugugaaugcaccaaauaguuaccuuaucauggcuaguuuuauaguauguaaauuuuaccuccgugaaccauuuuuuaagcagaaaaaggaaaauuacuuucaggcgaagaaguugaaauaagaugaguuuuacuagaaacugaaauuugggcauuuugagguuaauuuuuaaguaaacccuaaaguuguuagacaugccagcuagaauuugaguguuuuuaggauacuucuagguuagucauuugguuuuucuugaccuuaggaacaaagggacagcuuuauucaggaucucugcaggccccuguguguuccaugugcguaggaggccacuggugcugggagagaccacagacuucccugagggaugcaccagccucaguucacaggaaucccacagcggccuccaguguggccccucuguuuuagaaagacugauaaggggaggggauuuuguuuauauuccaguauuccuaaagugugugcacaugcauucaugugaguauggguguguaagguuucagaguugucaggcccaaaacccuuuaauauaucaggaauaacacuauuuauugucaucuuuuccuuugugcugggguuuggaggauacagaaaguacuuggguucuaucuguuuuagcaccaguuucugucaucagcaaagacacauggauaaucacauuuauccucauggccuucagaugagaaggaagagggagaucugaguuguguguuuauacauuugcucuuuuccucaucaucagcauaugcaauggccacucuugucugugagccuccacuggccagaguccaugguuagucaguuugugccugcuggcccuguggccagugcugucaagucucacauguaagaacaugacuuguuccucccuauguucuagcugaauguuacuucuuuuucuucaucauccaggaacauuaauugggcaucuguuauaagcaaggcccugugucauacuaagucaggacuaggcuuguccuucaaaagugucaagugaggaagauaagaugaaaaucacuguggaaaaaaaaaugaccuuaguuaaauuggaugaugaaaaaaauuuguugauaaagccguugggcaguuugucuagaaccuuuuucaugguaaauuucauuacuauaaaucucuuuuaucacugagcguagugguacacaccuuugaucccagcacucaggagguagagucaggcagaucucugugaguucaaggccagccuggucuacaaugugaguuucagaucagcuauggcucuguuacauagagaaacccugucucuauguagcagacagacagaagucuccuuuauuuguguuuucuuccugguacauauuuggauguguguaugcucaugugugcuuguccaccuguccaugcugcgugucccccucacguauccuccacuguaguugagauaggcuuucucagagaaccuggagauugacaguuuggaaaaacuagauggcaagugagcuucagggauccccuugccucugccuugcuggugcuaagauuauacaucagcaguaaccaugcccagcuuuuuacgaggaugcugaggguucaaacucuaguccuuaugcauucgcaggaagcauuuacugaauaagccaucuuucccaaaccuuugaauacauauuuuuuucucaaggaaguuuguuuguuuguuuguuuguuuguuuagcagacuuuuuuuguccuauaaagcauuccauagacuaguucugauuugcguugauuauuggcuuuccucugcccucuaaagaaccauuuuucugcccuacagcccagauauauuuauuuauauaucaugaguauggaacauuuuccccacaguguacugaugucagguaauuggguuggcauucucaacccacuucuuaauugugugaccauaggaaaugguguguaaauccccuaaggcugcccagcuagcucaugauaaaaggcggccugggccaccuaaugaccaugcaguuuuauugagggcuuccccuccuucugagcugcccacugugauggucacuuugaugaugggacacaacucucugagauacaggcugcaaacagccuccucaucuaaugauagaacauacauggcugcuggcagugggagaugcuaugaauauucaugaacugcauuucacuuuuacuaccuuuucauuaguuuucauggaggugguguuugugagugaaguacaugagcuauaggcagguguuuguuuucuggacaaaauggcaagccucauagucagaggcuaaggcaggagaaguagacagccagcaaagugcagaugaauauuagcagguggugaaacaaacccgugcguuucuguauuucccugcagucuuaggcagaugcaugccaugaucccugaaauuuuacagugcaucucuuauaugacagugagaaacuuuuauccuaauacuugggugcaacuaguauacuguggcagcugccuguccuaagugguucuggaccuggaguucacaccgcaaacuucacccgccuacccacucacucuauaccccucagcccucaucugcugucuaaugucuuucuaccaagccaaagcagacacugccuccaguuugccacauuguggguuuuuauggacaaggcuggauguacaggaaugaugggauuaccagguaaugagagacuuguccacauugcugaucaguauggggaaggaugcuuugagaccccgauugacaagcaagggaugcccacauaguuccaggaccagaguggcucugagcuaggcagaagugaccccucagcauaggaaugccuaucucugagacacauguuggaacucuaagcugugcauugcuggaaugaggagucuaaguuacauuggcggaguguugguagguguguccaucagugggcuagaugacagagccacacuccuaccacuagcuggugucauuugaagaacgugaaaaccugcauguuuuugucagaguggagcauaacaaauuauuucagagauggagggggcagauuaaaccuaacacauuuacuucauugcuaauucagugugucuguuucugcagaucaaaugagaagcuggcaaaccuuaaguacugaguaauauacuccacucagacugacccauucuugaguauuuuuugauuagguggggaaagaugcuuucuugcuuuucuacguccaaguuucuucucaguugagaaucaguuuuucaaagacaguacucuguacuucuaaaaagugacuuauuuuagaguuggauuaucauucuuuucauacauugaacuugcaacagcauuuuagugcugacugcauguggaacacauguggaacaggaauuuagagaauaaaaguacugauauggacucauuuccaagggccuggcaugugucucucauaguuucauaauguaaauacuugagcaccaauagcacccuuagccuucugcuucagcacaggaugaaagacaguggcacucuguaugcaccugccaaagccagggccucauuuguuucucaagguggcuguuaucacucucaucuaguagcugagaaaaggaguugcuagcaugcaguacaacuggaauccagggagacucuuuguucuucuugccagagggaguguuccuugaguugaaaaaaauuuuuuucucauccucagcauugccauuaugaguuuuaugaaauguguuuaaacacaacacacagauauauguauauauuauauuggacucaccuugcuuuaaagcuaauaggcuccaggcauacaaauggauucaucaagcauauagcauuccauagcuguguucaguaccuuuuuauaccagacauguuucuuacacugucuguuguuugggacucuucuaaguagguaacaucuucugagaaaacaagcucaaaggggugaggcaaaauuguccacaaucccauagcugcuaagugauguagagccugccuuucugccucagaguggcuuauucucccagaaugguuggucucugaucuuccuaggguucagaugucccuacucaccauugucugaaucagccccgcugccaguggcuucuaaugucauaugcucaucucuuuauguuuguuguacuaagucccaaacuuguuagaaacacaguagugcuagagccagucuaacugggccaguccucaugcaguguccuugacuccuaaacuaagaacuaaaagcccauggcccuugcuuaucuaucuccuggcauuuaucacaaauaagugagaauccaguuuuauucuuuauacauaauguguaggcaacuuauguuaaauguuuacauacaugacuuuuuuuuauaauacuuuuggauguuuuugugaugaauguuauucagcuacuagggcuuuuggcauuuaaauuuucucauuuggaaaauagugaaagcucaguuacuaucaugugaauccaauccuuccccacccaccuccaccuucuacagaugaggacagagcuccaucucagucccuuaagucggcgucacaggaaaagcacuuuuaacaggauuacugugugauccaaggucuugaaaucaagacgagugguagguacacagagcuagcucccaagcuuuguccuuguaaggaguuagugacauucagcaggcuucuaggacccacucuguagccagccugcaugagccaagccauguuccuuauuauuauuuuuuuuuuacaaagacaucuuugaguuuauguacagauuauggauuuaaaacauauacuuuaaaaaucaucucuacauacucuggcuuuccugauuaaacuuuccuuagaaggagaaauaaaaguaccacagcucuuuucuccucauagaaaaaaauaauuuauuaauuuauaucuauuuuuaaaguauaacuuugcacuugacagagcacugcuguguauacuauuucaugugcucaucagagcagcucugucucuuccucacuugcacauguggaaguuaagaaccuggcuuguccuaggacuuagagccaggaaggaguagagccagcugguccguagucauagccagcucauaaccugcucugcuugguccuucagggguugagaguugcugagguuaaggacuaaguuuucauuuuggcccugacaauuucucacauuguauaaagugccagguuaaagguucuaagcacaaccauauuaccuaggggguguaaugcugucuuauguaaaaggaaagcagaaauuuguugucacugguggugaacacuaaguaaccagcacugccguguuaugugacacucagccuuaucagcaacagugcaagaugugagcacagaggaaacacaggacuacaaggaaauagucaccagcucugcagcuagccacugccacugaguagauaauaccaggcuagagaguucccacagaaucuuaccacuggggcccccaaagagaucuuggcaauuauauaaaccuauuccuucaucaagagauuccuaucuggccaguuuucaucaaauucacucuaggcccaaggcaaucuaccagagcgucagguaacaguuuguagaccugugagccaaguaucagauggagagagcccuggcccugugaaaggcaggucuuaugucucugcuuugggccuucuucauccucugacucuaugucuaaaauaacacucaugccacuaauugauuagagaugcucuuuggaaagcagauuuuaauguauggucacuaaugaacuguaguccagcacugugguccagaguccucuuggacccaguuugucucugcaguauuuugcuuacugcccuuuuaagccuguggucuuggcuguuucuuagcccaagggcccaggcuuuccucuggaguccuggacaagagcucuuacugaguaaggaaggcaaucauggauacccugcuuguccugcauggaaagcuaccugaaagccuucaucccugcccccuguugcaaaagcucuguuucucauguuuauuuacucauuccuucuccucugccucuuucucauuuucuaauuuuggaguuggaaaucucuaggccccaauuaguccugacucuucucuaacaaaguauaagcuaugacuuuggaguucugagccacgggauuacaugugagguaacacauuacucucagagcagagauauuuuucuucagggauggggagaucguagguccaauuggggcuuagcccugcaguaggucaaguacggaacccauugccaacacaugguaauuaggauaugaugagucugucuccaagaaaguuagcauuuagcuaauaauaaaugauguuuggugaaaagaguucugagcucuuucacaagaaauauuuauuuucauuucaaauuggauagcaaggugauuucuuuuuguaagagagcacauaccaaaaauaauuugaggauggcacacuuuacaccagcuauaccucagucccaagcacuucauaaacaucacugugcugacugaauuagacagccccauuaccuauguuuucaaaacaacagggcagaccaaccugccaaaggcccauuucucuacuuuuggggaggacacuguggaguuucuggguacauuggagcccuaaccagugugacacucagcaggcucugacaagaauaaucuuuagcuuugacucuguaccugggggcugacaauuaggaaagguugaaauuuaaguuucucucuauugaccauuacugucagggcuggaacuguagugacaauauaaggucugagcuuuaaugagacuggaaaugauguuauaauauacuuuaauaugcauuagcuccuaaauguaccuacaugccuuaugaguugcugguuaguccuggagauauuauauauacaugugggagaauucuccuuuaauggacaguauuuuuaaguuugcugacugaauguugguugggugggaggugagaagaaggaaaaugauuuacacaggaacuuaucucugguguuaaaaauagucgagggaaucauaugauugauacacaaaugcuguccuaacacauuauuuugggaacgauuugaugcuaacaugagauguggaugaagacuagaagcagcuaguccucugacacuccccugggaucaugccccucaugcagcucuuggaagaacaccagacagcagccaccagcuucgaccuucuagccuugaccuuauccccagaccccaaaggugaggaggugagaggccaauuuuuugagaccuuccccucucucuuuuagucuggcugcucucaauuguuucugcuauuaaaggccaagauaucauuugcuaguagucucccccagcacaggagaggccuaaaacugauaauaguagaaaaaguaugaggaucuggagcuuugagggccaagacagugcaaggagggaucaucucucagcaaguaagucguuaguuccaccaccuacuuggucaggaccuuggcaggaugcacgauggguggaguguuguauggguuggcccugugggaugugacuccaggcccagugugccauguguuugccagccuuggcagcaucauacaguggggcaagguaacaaaaauguguguugcuuaagaacagauguauacuuuggcugcgcucaaauccacagcuuuguagaguacccuagaaucugcucuccaauaguuuuugcucaucuuuuggaaauccauuuagugucuggauucuucucccaccuauguguguacugggcccagaguugcuucagaauauuaguaaacacaaaucuaaacaguuugaaccagaauguuguuuaauucagggcaagagggcuugguuucuagacagguccuguguugcuuaagguguucauaugagaaauccaggauuuccuccagagauuugccauguugauccuggugagcugugccuggugggagacuuuagacauggacuggacaggcugaguacugauugaggcagcacacauccuacccuuugguaaaacccaaauucuuaagcaauaccaaauuuucuguguucguuauacuugucuguuuucuucaguaguguauccugcauccccagcuucuaaucccacuuggcaugggacagauauuugccauguauguuauugaguguuauaacugcuuucuaaagggauagaaguuuagaguuuugaauuacuuaugaaacuuuacaguccuccacagcuugauucaccucuagauggguaagcuauaugugaacucugcugacuucuaggaucugaccauggcagacaggucuguacucaagagcucuuccuguggauguccuugauuguggcugagguaacauuaggcuaacauaggugaaggagaguuuucuaggcaagaugguaugcuauguugcccuacuggagagaagggaagagccguuuuguuauauacuuauuauuucuauacuuuugaauucuccaccucaguuuagaacuauuaacugaguuuuuuuuuauuuaguuuuauuuuaugauuuuuaaagacuggaucauacacucuuuguagcccagccuugccugggaugcacaauccuccuuccuugccuucugaguacuagaaguacaggcauauaacagcauacucagguaucaguugaauuuuaagagucaacauuucuuccuaaaaaauuuccuuaucucaagaguuuuguuuguuuggauuuaaaaaacaacauguauuuuacaauaggacauuauuuuugagaagguaaacuaauaauauguauguguaguauguguguuuauauauguguucacgugugugugugugugcaugacgaugcacaugcauguggagggcaguagucaucacagugcuuccucaacacucuuccacuuuguguuuugagacagggucucuacuaagcaggguacuccaugguacucacugacugguuaaacuggcuggccaaugagcuccaaggauuugccugucuucuugccuuccccaacucucaccacuggagucauggaugcuggcuaccacuuaggacuuuuacuuggggauaugaacuuggguuuuaugguuaccaauugaaccaucucuccaauccccccagugcauuugaauagaauaaaacugcauuucucuguagccauugccuacgaucacuaggcuaggcccuagccucaggcaggccaaggacugucuaccagcggggcaggaaggucuucauccuucagcucacucauguuuaacauguucaaauauguuugguuuuuauaauuauagaaugcuugaauacacaugcucacagcagcauuguucacaucagucaaaagguagagcaaagugucuauuaagagauaaugaggggcuuggagagauggcucagcaguuaagagcacuggcagcucuuccagagguccugaguucaauucccagcaauuacauggugacucacaaccaucuguaaugggaucuagugcccucuucuggauuaucugaagacagcuacaguguacucauauacauaaaauaaauaauuuuuuuaaagaaagagaguuaaugaagaaauagcauauagcauauauacaauagaauauaaacacacaugugcacacacaugugcacacacacacacacacacacacacacacuaaaaugcuaccacacuuugaaaagaaaggaaauugggcugcugaaaccuagaauacgcaaggcucuggguuugauuacuaauaaaaacacacauacauuugcacacacacacaugccccagaaggugagauacaaauagacaaauaguaugauucuaagagacagugaguagaacaguaguuaccagggguuacgggugcuggaguuauugcuuaauagguauguaugauuuccauuagacuuagauguaguagguggagaugaagauacaauaauaugaaaugaauguacuuaaugccauuucucacaauaagaaaguuuuggauaucuccauuugaaaguucugacccuauuuuguaauuacagauucuuucuaauguaucaguaguccuuuaaggacauaggaggaaaaaaaacuaucuguugaaaauuuuguuggugagucuauaauaccggguuauggaucuaccuaccuaccuguccauuugucugucugacuuuggaaaggaaauaaccaaucauaaugaagauauaugaacgccauugcuagaguaugccugugguagccggcucccagugguccucaucuccuaguauucagggcugauuugugggcucuguaggaucugacagaaaugauggcauaguacuucaaagauuagauuauagaugcuaugcuggcuucugccuuggugccuguuccuugucucccauugugagcccagcccuguaaaagcccacauaaggaagaacugagaucuucagccaacggcuguguuagugaacuuggaaagggagcaucuugauuauagcuucuugacagacccugacccauaucgcccagcuaggccacugcugaaucucuaaccuacagaacuacuauuuuaagcuaugauggugauugguuauguggcaguagauaauuaacacagaucuuucuguaucuucauucuaaaacauaaagcauauaugugucagaaagaccauaaagaaggucaaagccuggacucuaucugaaacuacaggccuuugggaaaugcuaaauauuguauagccuuguuuucauugcuagccagugcaaguuguuagugagcucguggugugaaaaugucucaucucuggaaugaaagggcaucuuccuuucccugcauugccuugauauuucaucaaaaaagaugggacuucugcucgccuuccccaucugugacucugugaugcugaauagccucaggaagggaccgucaccauucaaaagguaagggaugaggcuagagaggggagcaaaagcuuuggggaguacagagcuucuuuguagcuuggcaggucuagcguucagaggcccugccuuugucuucuaggucuucagaggaaaugggugugugugggcuuucaguacaguacucagaaggucucacuucugugguuuaccauugaauauacuuggaacaacaguaaacauuugcgagcacugacacaugccagagaggauguuagguacaguaggggcucagagaugaggggaaaguggcagauccugcugugaaggaacacagauucuuguggaggcaagagccuugcaugucccuguucagcuaagggaccuagaggcuggggcagacacaucugagaugacuaggggaagcuucuaugagaaguagcagccuagguagauccuguaggaggcagaauuggcaugccuguccuguaccccagcaggacccucauugcuaacaucugcucacauaauuucauguuuaucuggucuugaucaaauagaagucucuugagccucgguguggaucuuacgcagugcccugguagcaguacagugcuuauuguagguccucaguggaagauaugaguaaauaaaugaguguaugugugagugaaggaggguauguggugggugauaacacugcugacaucauuuaggacugaacucuaaaaggucuccacuccauagcaaguaaaauuagaaucuggaguaguagccacauuguaccugacccugaacacuggcucugcccuaaauccaaagucucaucagguaggggcugagacaggaaagucaagagcaauugagcaucuccaagagaggcuccuagaagcauccucagcucggaaugaagaaggaaugcuggaagacuacacacagggaacucuagucuccuccccauaagaaaagagcuuaccauagcauacucagcuuggcacauaaacauccaggcuacaucccguaugcuucuuggaaagucagaaauuuucuaaaguaugggagcuuuuauuguagagaucuuuaaagguguucucuggugguggcaacuacauccuuaauuuucguauaaagcaaacaaguugaaucugaauucccagaaacagagauacuuccuuucauaguguucagcauucaauagagaugucuuucaguccugccuuguuuacacacauuuuggugagagaggaacuaagggaagaagggguguauaccacuggguuuucccaguacauuuuuuggcuuuaaaauccagcauccuuuggcuuuggaaguagauuugugguuugguuuaauugugggguguugagcauuuugaaaauguaccgcaaacuuucaaaaucagcuaauaaagccauuuggagggaccagaaaaacagggccaccuccucccuccuccuuccacccuccucccuccucccucuucucucccucccuccucucuccuccccacucuguccacccuccuuccuccaccuccacuuagccuguccucaguuuugcagcacaaaauuuuaucaucaaaauuggcccaaacaaaaacuaaauuuaaauaaaguuucaaguaagucaaauaaugcagcaagacugacccaguugaaauuugcaggccgucagagcuguguuuauaucaggaaagguguguugccagcuccuguguguaaaaugugccuaaaauagagauggagauuggcugugucaugcugugacucagcgugauuuuauucuacagugaguuagugccaaaaaaaggagagaugaauacaguaugaccaugcucuuuacaggaaguucauggggcaggaaaaacuagaugcaguuccuguguaacuuaguggcccccugguccggugacaguccuaugggaguagacuuaaaaugauauauucaggucauucugcggagccuugucuggcagguggccacacacccaaaugcgaaguuaccuguaagauauaccuuguucugggagcggggaauauaggaagcucagguaaauguguacauauuaaaugagacaggauucugucuucugaaaaauucuggaccauuuuaucccgagagguuuggguucuuuuggguuuuuuguuuguuuguuuaugacuuugcuacauuugaaccauuuagcaaagccauuuugguuaccaucacugaccacucuuguuccugggggcaucggacacucauaucugucaagcucuguaguuuucagaacacauccagcaaccccuuauaaaugucauccucucaaaacucaaggcacuguguaaggaaggagugaagucagcaaaagaaacuuaauaaauggucccuaccaggggaugaccagacuucuuauggcuugcugcccugucugugccccaggaguguuugguagcucuccuaucaagaucuacgucuugcuugagcuuccugggcaauaaggugccuuggguguaaaucaggauccaugugugaaauagcuauggggguggagcaggguagggcagcagccaggcaggcacacaacaaaaacauugcuggggcagaagaggcauugccugggacuacuucccuaugagacuucaaaaugcuaagccuauguucaauucagauuaaugauuuuuggagggaggagcauuucuggagauugguuuuccuuugaaaauucuagauucaccuuuucuuuucaaucaacuuuuuccaguagacuuuguucccuggggaacauguccaugucaaaacgagucuugauaaaagcaccaagauguuaaauauuuauuuuaaguuaacugcucugcuucugagagguuaaaacgcaaauguguuuucaugcagagccuuucacuagucggcuuaagcuucccaagcuuucucuuuggcacugcaguaagccagcuaacaaacugcauuccugagaugagcugacaagggugcagaaaugaagaaauaaacaaaaagccauguuaauuucaagcuucacuaagaauacaaaaaguaauauuaacaguugcugaaugacaaauaaugaaauggcuggaaauuuuuaaugcuucuagcaagcuuuuauaaucuuucauggaauuuucucccugucagguauagcacauuuauagccagcaguguguuagacaguuuugauaggcuguuuaaagauggauacauccgagcaugugaguguaucuauauauaauucuuucgcuccauuccauaugcuaaaaguagcccuuucuccuuagccuaaaaucuucauaauugcuuaucuguuuaaauaaaagguauuuuauucagccggaggguggucauacuguugucauuucauuguuacuauuggcuaauaaauacauacaaauauauauguguguguaccucaggcuuguguuuauuucugguuucccuuaugggcauagaccuuagaagucuacccuuacauccuaauguaguaauguauacauuaaaaaauaguaaggagcugggcagugguggagcacuccuuuaaucccagcacucgggaggcagaggccagccuggucuacagaguuccaagauugccagaacuacacagagaaacccccugucucaaaaaacgaaaaaguaagauuuugaaauguguacuuacauaucaauuaauagggcaugaauaauuuagauuucucucaguucaauguagcacgugugcuuagaguaugcaguguacaaggagcugugggaggcauuuccuggcacugugcugcucacccuuucuuccugguguuugauuguagagagaaggaauagugguggcugaaaggaaggggaacuuggcaucaguccugaaccaaacagcaggucuucuaccuuccugucacccugccucugucauaaugcccacaaacccagaaaaaaaugccugucauccacucugagaaaccagcauuaguccuuagcauacaggaggucccuggcagauaucucuugaagagcagcagggcaaacaggaagauguagugggugcugagaucuggugagagucaguaaugaugaugaagacugcuuaaggacgcaaggcagggaguaggcagccaaggaaauugacaugggugagccuagaauuccaugccaggggaaguaaaguaaggccugcagaaugaccauauauccauuccuuuaucuacugucucggugcccuuuuuuugguggugauaggguagaguugacaggguuggccuggaaucuacaguccuucuucuaagccuccuaagcccuuuguacuguguaggcagagaugaauaguuggccacagaaaggaguuacagcauauacagccugcugagcugaguugcuuuuuacuuuucagacaguuugcuggauuccgcuguagaggaauaaggcaacgacgacgagugcagcuaccuccgggcgguguucuaaagcaccagugcuuacucggugcucuguugaccaaggacuggccuaauugggaaaguuaauaugagaguaauugaguagaauagagcugugggaagggucuggacauaagaaaccuccuauaaagauauugcagccaucaguugagguaucuuugaacacagaauauccuuuaagucguaucugaaacagccuggcucaaugucccaguucaugucacccacaucgggguccaccugcaagcucuuucucacacccuugcuuuguccuuguggucucugaguuaaacagucagguuuaacucaguguguugcuugcuuccuggugacauugccuuuauaacuguucuugggccccaagugacaguaccugagcccaccuuugcuauucuucuccugccaucuguguguaaauguguuuuuuugucucccucccgaagguuccuugaaggcugggacugcgcucacacuccugugcucucagggauuagcauaaugcuuuucacauagcugguccuuucugaauguuugaugaugguacagccacugagcaggauggauguguaggagaaaacauacccucucucguucuauaaauuagucagaauacaucaggcuaauaacaguaagagugagcaucugucagucugaugcaccaacaucuaucagacaaagcaguuaaacccaugucagucauuuugauacaauaaaacuaaaauuagacacaggauaaauacacucaagaugagagcguuuaucccaguguugguuucaagacugauagaagcagaagcugaagcauccuggcucugaaaucuggucaguagacagcuguucaguggggagccagucuggguggcaggaaguagagggcuggggcuggaaccccgagaccaugucuaagggcugugaaauauagaaguuucaggaaugcaaauagaguuuuguuuaguaauauucuuuagugguuuuaaauguuaaaaaucucagugaaauaguuaauuagcucuagcaacugaaguuuaaaacagaagauuaauugauuauuauggcugugcuuauuuuucuuccauuuguuccagaaaaccaauguugguacaccaaguuugcuucuuaagccugacuagaaccauucugccuggaguccauucuucuuucaucuucuuguagcuugugcaguuucgccucugaaauccuuuggcagugcuuucucuaaacuccugcuaucccaggcucauccugccccaggacugugccgguucuuagggcucucucuucccuuaacccaccuaggcaauaccauauagacaaggguuuaacuuuucuuuuuuuuuuccauuuuuuauuagguauuuagcucauuuacauuuccaaugcuauaccaaaaguccccuauacccacccacccucacuccccuacccacccacuuccccuuuuuggcccuggcguuccccuguacuggggcauauaaaguuugcguguccaauggaccucucuuuccagugauggccgacuaggccaucuuuugguacauaugcagcuagagucaagagcuccgggguacugguuaguucauaauguuguuccaccuauaggguugcagaucccuuuagcuccuuggguacuuucucuagcuccuccauugggagcccugugauccauccauuagcugacugugagcauccacuucuguguuugcuaggccccggcauagucucacaagagacaccuacaucuggguccuuucgauaaaaucuugcuaguguaugcaauggugucagcguuuggaugcugauuaugggguggaucggguuuaacuuuucuuacuguuuaaagaaauaaaaaauuggggcuuuagagaugguucagugggcacaguacaugccacaccagucaggauuccuagcacccauguaaaagccagguacagcggacacaccuguaaccuagcacuaggacuuuggagacaggugaaucucuagaacuuucuggccagccaggauggcuagaucauugaguuccagguucacugaagagauucugucucaaaaaagaaagaaaagaaaagaaaaaaaaaguggggaaugauagaggaaaauauccaguguaagccucugauuuccacaugugugcucauaucuaugcacauacuccagcccccaaaauuaaagauugaaaagacccaagcauuugauuuccugcauuaguuguuuggaaucuggccucauuuuagauuuaaaaaaaaaaaaaaaaaaaaaaaaagaggacaucuccaauagguaugaguaucuaaagcagaggaagacccaauaaaacuguaacaugccacguuaauuuaguuauuggcaucauuauuauccauauuauguucaaauaaauuaaucuuaacuucucuauucuauuuacgcuuaagaucaccaaaccaaaagucagcauguuuuuagccccuuucuggcaacuuccuagaaacaacagaaaugaaauaaaucagaaaaagccaggcuuccccaaacucccugccacacuggaggccccauauguggaaggucccacaggaagcagacgcacuugguaacagguccacccagccacagagacccucacacauguccugucccagaccucagucuccaggagcuucuucaacccccaugcuuucuccacuuagucuuacaaaagcaguggaagaugacaggggagcuaggaguggagaugguggcagaaccucuuuucccagaaaaccugguuuacucugaagaagaggagaugggcagagcacgaaaaagagcaagacaccauuaccaguaucaccaugacuuucauguuaccagccaacucccuugacuuuguuugcagccagcaucuuucugcucaugcucagugcacugucuauguucuuuuccccaugggcuccagagcagguggguuucagguauaacuuaggaugguuccccccuuuuucucagggaaaaaaaaaguuucaaacaucacuuuuuaggucaucuugggucuaaucacugggacuuccuguucuaacaaauugccauuaauauauuuguuuuaaugauugaagcaguguuaaaccuuauuuuugccugugggcuuuguuccaacuuauuauuguuuugcaaggacacugaguaaauuacagaacacucaaucauaccauggucagaacaguaaaaguauaaauucuuuaugauuuaacuugaaaauggguggucaaguugaagacaguucacaauguuaaauaaauugugauucugguuuacugaucuuaaucaucaaaguuaauaaaaaauguuacuuuuaaugucuguugaaaugcucccauucugaagucugcaaaaauugacuuuugcuuuucuccuuuccuuucuuucucucuuucucuuucucuucuucuuucuuccuuucguucuuuuguucuuucuuuccuuccuucccucuuccuuccuuucucucuucucuuucuuucuuccuuccuuccuuccuuccuuucuuucuuucuuucuuucuuucuuuuguuuguucuuucuuuccuuccuucuuccuuccuuucucucuccuucuuccuuccuuccuuccuuucuuuuucuuucuuucuuucuuucuuucuuucuuucuuucuuucuuucuuucuuucuuucuuucaguucuugguuaauauauuuagaauuucuccaguuuuuauaaucuugacagguguuucauacccaagauacuuuauaauuucaugccaacuuaaauaaaaacagcauuugauuuuuaaauuaguaaacuaggaaucaagucuauaagugcucguguuggaauguagauuccaugaggguaagagagugcacuccuuucucucuaugcucuauacugucucuaguaucuaaaucaaugcauaccacacaucauaucuacuaggggaaucuuuuuuuuuuuucuguuuuuuuuguuuuuuugagacaggguuucucuguguagcccuggcuguccuggaacucacucuguagaccaggcuggccucgaacucagaaauccgccugccucugccucccaagugcugggauuaaaggcgugcaccaccacgccuggcuuuauuaggggaaucuugaaugagugaaugaauagauaaacuauagacacaaacuagaagaaauuaaccaaggagccaguggcauggcucagcagguaaaggauuuguugccaugucugaggacaugaguuaaaucccugggacccacauggagaaaggagagaacugacuuuuauaaguuaucuucugaccuccacaucugcacuguaguauuaugcaccucuucuugugcaugcuuacacacacacacagaguaaaugauuaaauguaacuuaaaauguaaguaaauuaauaaaaaucgagaccacucuaauaaaccuuggauguacacaaaccacagaguacacaaauggcaguagcuagcaguucuuuauguuuccaugugaaugauagcauuccaugccuagauuuugcuuaugauuauuuccaauaaaugcacuggucacuuccuuaaaacuuuauuaucagcuguaguccuggaauaggcacagauuauauagauaguuuuuaacaacuuuaauuuucugaucuacauucagcaguauuuauagagucuggcauacagaucagugcagggcaaucaccauuguuugagaaaaugucauguuaacaguucuguuagaguaaaucuguaaauacagaguuuaucagugauguuuucuggaaaccugucuguggcauaauuacuauuuuaaauuuucuucuucuucuuguucuuuuuuuguuuuguuuuguuuuguuuuguuuuguuuuuguguuuuugguuuuucaagacaggguuuuucugugcagcccuggcuguccuggaacuugcucuguagaccaggcuggccuugaacucagagauccgccugcucugccuccagagugcuaggauucugaugcuuacuuuauaucucaugcuacuguuugagaagccaggguccguuugcugaaugcuuguuguaaugcuuuguucucaaguauuauaaaaaucuauuaauuuuuuucuagagaaaaaucccucuuucaguucauuauuucaagcuaugguuuuaaaaaguuuuauuuuucaaguuguacuccaaacuaaaagauacuuagacucagccuuaacgacucuguucugaauaucaggaaugcagauguggcagccagaugcuccuugcugcagacaacagcaguggucaacaauugcaugauguuucuugugcuucaugaauagcugagcaggacauuuguguucuuaacuuggagugcagauuuggaggaacuucacaggucuacagcccucagcuagcaguguauagcauucauuguguggugaagcagccuucgaagccaaccucucaaaccaauagggagagagggaaaugucuagcuuuuguuguaucaguucucacuuugccaaaugucugaaagcaauuuaagagauguuucagccaaacccucuuguagaccuaggaaagaauacaguuagccuguucauugugcuccacuuggcugucuuggcaucucugcaaauaaaacauuaaaaauaggguggcccaggaaggagauaaagcuauugucuuuggauguagguguaggugcuucucccagcccacgaagcaggguuucucuguguagcccuagcuguccuggaaccaggcugaccucagcagccucugccuccugagugcugggauuaaagguguggaccacugcugccaccuggcagugugugcaccugugcuugaucgcaccuucauaugacuggcaucaguagcaaguccucuaacacacuaauguuuguagacuuuuauuucuauuagcauugugucauaggggugugugugugugugcgcgugcguguacgagcgcacauacauuugauuacacugggcuucaguacucuuauuccaucacuuuccgucuacugcaacaguauuauuguaaggaaacagugcagugagacaggaauuucccucugcauuuaugugcucauauggucagccaggugucguccaugugaaagccaugcacaacagauaauuuguguaaaauuuauuucacucucauuucccauccacauauggaucuuuaaaggcuaaauuuaaguuguuguuuuaugaucucugaguguaccaaagaagaauagucuuauuaaaaugucaccucugucuuuacucauguacagucacaauaugcuuaucucccuuccugguuuaucuccccugccagaucacuccucagagugagagaguggcuucuguuuaugucaaccuuugaaauggcuaagagcaggcuguauacacaucagcccccuggccaacagggcugagcuuggcuucuggaaggaaagaagguuccaugauccuucuggaaaggccacucuccacuggaaucauaagcccugaauucugagaagguaguugugggcuaaagagauuaacucagagaaagagcuuuguaagaccaugucauugguuuuuuuuuuuuuuugguuuugauaggaaaauugaacuggcccuuccuucaguaaauugacugcauuacauaaggcacagguugaagcagugcaguagcaugaauucuucugcgguuauuugauuauuuuuaaaauaccauugacauuugaaaggcccauagacaaaggccaacccuauaaguggcuguguuuagaaaaguaaaauaaaauccauucauuggccuuuuuaccuuaaccauguggauacaaagcaggguuuuauuucaacuaaauagaauagccaacauguaguuuuaagaaagauuucauuguauauauucauugugcauggugcaguauuaaaauauaugguucacaguuuuaauaauuaguaccauucaguucaagcagcucugacuaauauuuguguaacuuuucaucacaaaaugaguaauauuaaacucuaauaggauugauuuuauuuguuaauuucuucuaaucagucuuaaguuauuuaacagaacuugaaguaaagaaugucagacuagacacccaguuaaauaacuguuuaacuguuauucaugacuguuuccaauauugcacauuaaucaaacuucuuugguuugcauaucuauuauuguaugauacuguugauucuaauuaauauuugucacuuguuaauaaauggucucuucacucucaccuaaaagauaauuccaaguaaaauacaguauguccacuacuugcuaccuaugaaacuagguuguucuagugugaggaagcuaacuaauauguuuuggguguuauauacaugaauaaaggcuuuccuaggaaucuggcaauucguuuuuaaaacagcucauucuuugucuccuaauuacaaaagccauuaagucaaggcuguuucugaagcaucagccacuaucuaaacauccuaaagcagugacugagcacaguuuagugucacuuuucaguuugacuaguugucacaaggaguagaucaaaaauuguuaaauugauuuuaaaauaaugugauccuuguaaaagucagaucagcaaaucuuacuggcagcuguaaguaguuugugccauuuuaccugauaaucucauaacacuguaaauauuauaaauuucuuaaaccaugugaauaucuggguagugguggcauauaccuuuaauccuagcagaggcaggcaaaucuuuugaguucaaggccagcuuggucuacaaagugaguuccaggacagccagggcuacaaagaggaugaccccuaucuuaaagaaagaaagaaagaaagaaagaaagaaagaaagaaagaaagaaagaaagaaagaaaaagucaagaaauaaagaagaaaagaaagagaaaagaaaagaaaggaaaacagaaaaauguggguauauauaauuucuucuauuuuuaguaaaaauugaauguugaaggcaaacagcaauugacagauaaaguuagaaaauuaagauguuaacaauugauaggcucuggauugagaguguaaagacuagcaaaaauaagugcaggcuaucacauaaaaccgaaaacccguacaaaugcugugauuauagcuguauauuuaaagacuugagggaaacacaucugugugaugcuugcauuuuagcuuuuguauauauugguuuuccuaagcuuuagucuuaguuuuuauuaggaaguuguuugcuaccuuuucuaacauguuuuaugugagcacacacaugugcacuagaagggguuggucaauaauuacaugcaagaucaccaaaaauaaggucuauuaugguauuuuuguggcacuuuacaaguggcgguggccauguaugacguccuuaucuguguuccuuaccuaccccaggugaggaucuccucaggaggacaguugcuccaugcugcuuuaucugcucaguuaaaaccuuaaggaagaagaugguauuugccaacauguaaacuaacauuugcucccggccuuuggcucuugagaagaugauccuucaguggaucucaacacucgccauucuugcauuucuguuuuagaggacacacaccgugccaguccugccuuuucaagucucuugaagaccuaaaguugaaugguggcugggacuagagaacagccuggcauccuaccgacucuagacucucugucuuuguuuauuuuuguuuuguccuuuuuuucuauuguuguugguuuuuuuccucauuuugauuuuuuuuucccccuaaaggagggaagauuaaaaaacaaaaucacugcuuuucagggaugccaugacauuauuguaaaaauggcaaucuacaaaaauaugcuuaccauaacaucuuuucuaggauauaguuuuuaguguauguaauuacugauccuucuagaaacuggcuucuggcuaccaagaaacugcccauccccagagccuauugcaccaucuggacaggccugggauuuuauacacacacacauacacucaugcacagacacacacacacacacacacacacacacacacacaggguggggguggaaggcgagagagagagagagagagagagagagggaaagagagagagauccuuuuuacuaguuagaagagcuuauagcuggauacagaagacucaacaagugaagaccaucugcgaagcugcaggugaccaggucacauggcagauauucacagugcacaaacagcaugcugaauggauauucucaccagaaggucaucuggguaggguuuacuaagcaggugaccccacacaggaaaacauuaucucaguacucacuugaaaaugugaggagacuaaagaacacuugcaguucuaaguaagucaauacuggaaucagaugguuuaguagaaguaggugggugguguuggcacauaccacaucucucaucugaaagugaauaagagauagcuuauuuugggguccuuuugagugaccauggcccaggaacacaaccuuagauuuccccaaauuccauguuccaacauggaaacaguuucaugaaauuuuauaguuuuacagaacaaaaaaaagucauacauaaaugaaggcaaguugguggcuacaucaguuauggcaagauggaggagguuuuucuuuagaccucagaugcuaucugauggcauccuuagcuuucggguuggugaaagccaguggucugcuaaguuaauagauuccaaaugguuuuuguuagucacaagauguuaguucagacacagcgguaggcaaggaauggcuguucuggaaggcuaaaaguagcccaagauaaagucucuggaccugcagccuuucaguacuggaauucuaaucaaucaaucaaucaaucucugcaagugcagcuucucuucagguguguguguguguguguguguguguguguguguguguguguguguucacaggguaggcagguggauaaguggacugggaauugacaggagucugagugugagggcagccugcaguagcggguuagugcaugcauagcuaaggcggcaacuaagaaaugggggggggggggcacuguaaauuaagauauuuuacauaaaacaaaccugcugggcuuugauuuuaaaagauuuaagccagacaggugcauaccuggaaucucaguagcccuagcauuuaguggaugaaaaaguaaauucacaaggaaaggacauggcugcuccuagggauggugggaaagaaaguuuauuguggauaugugggagagugcagccacaggcagacaccagggagagucuagagccugacccugugagggggaggugaagggagaggggggagccagaccaaaggccucgaugguaaagggcagacagagggccagguaaccaaaaugguuggauuauacagggaagggcagcuggggguggggggaguggggagcccagcccaauuccugggcuguagaaguuuacauuaggagguggguguggcagccaggaggacccuguaauggaguagggacuguggggagaaccugguggcaaagguugggaagcaagcacugggugugagauaaggaagaagaccaacugcugggaaauagccagacgcauuuuuaagucuuugcaaaccauuguuacaauggugugugugugcgugugugugugugugugugugugugugugugugcgugcgugcgugcgugcgugcgugcgugcguguguguguguguguguguguguguguguguguugggguggggggagugucaacaggccaucuaugacaagaucagagggggauucugggcugcuuguguuguuacauugugaauguuuauuaggcuguccuugcauccuagaguuagggaggauuuaggaccagaaaguacauuucagucauuuaugcuuugagcaaaggaaacagugcucugaaaucaaaggacuacugguagagagagagcgaagacaacagaaaaacuuauuaggauggcaguauaaccugagauuacugaucagagaccagcagagguguagcucuuuguauccucuaaagagaaguacugaaaaaaaaaaaaaaagggggagccaugcugugcugugaagauaaagggaaauuauaguaaaacaaugcucuggaauaguuggaaagaaaggugaaggugccauuggagagggagaagaugaaggcagcaugagauuacuaacugcugagacugucuucauuuagacaagcuagaagggacggaacugaggggaggguccucauggaauccaaugaccuguaugagggaagggccucaugggaugaacauaccuuguagaaacagguaggcaaguguaagagcaggguccucacggaagcaaguuuacaggaagauccccuuggaaacagguggccugaugugaaaggaggauccucugggaacagucugcuuggagccagguagcuaagugaaaagaaaacauuaguuuacagaggcucugaguccacuucugggauuucugaaggacagcucuggggaaggacucaggguaagcuuuagaggaagugagagguagauuuaggaagcucuggacuaguuaguuccugagucuggcucuggacuucaaaggugggaaguguacagguagcaauguccuaagguuagauucuuacaccuuguguuuguuccugcugggcccacuuccccagccccagcuauuuaaaauguuuuguuuuauugguugguccucaguuauaaaugccauuguuuacaguggccuuuccuaaagucccucccagcuucacugcucagacagccuuuugccccuucuucacuucuaaagaacuuuuaguauaguuucaaacccaagccucaugucaguugagaaagcccauagguugcccagcugauaacggcagagcuguccuucauacucaggccuggugccuuuucugcccugccauuccucauccguggauguaaauuucuuuuuaggcagaaggagcagaauuggguaaucgucaauccaguuuacugaguuguaaaacccaugacuguaaacagugaagugaaugcuguaugaaguagauggggucuggaguggagaguaaacuuuauggagaggagacuuggaaugcacuuuggagugccagugggaaauuuaaauggcagaaagcaaaaggaguuucuggguggagggagguggauguagggauugguauaacugauaguagauagaguuggacucccgaaagcagagccaaauguuuaagguagccauaagugagcuagggccccaaaguaacaugaaagucagagucaagacuuaggguaucaggaauguugggaagaaaggguguguaaagaaaguggcauuucaggaacgucugacuagccuaaggagggaaaugaggggaaagcuucccauguagaaggaccuaggcaugccacugguucccaggaaucuucaguggggauuguuggcaggaaguuuauaagugacuauagaaauaucgcagcggcuugccugaccacacugaaauaggcaugcugcaugaaucccacuuauuucccucacaaucuucuugagggauaggccuggcaggaaaauacuaggcaaauccuugagguuauauguuacuucccagcugaaggcauauuguaaauuccagugaggcaccugccaggugcuugaaauccuaugagugagauggagacauggagacugaacauggguuggagaauuguuaggucuggagccuuguaguguaccacaggauccugccuuuaggaguugcuugaacaaggcaguaaaagguuguucuucagguuuguagguuuuaaaaccuucgggaagauaacuaagauccuugucgauagagucaaggcugaaaacguucucaguggcucaggagccaggcuaaccuuguaacauuuaaugagaacaguagagucuuugcauguuuuccuuuuaaucaguuaacgggagagaccugaugaauuaugaagcacauuauaagauucgggaagaggagcugaggaagucaguuauguaagaacaaaugauuacuaucaaaugguugucaagugacugugauaacgcaagcucaggaccaagugcgggaaacagucugugucacuuacugaugggaauacuuucugagaaacguguccuuaggugauuuugugaguaccauagggugugcuuuaguaaacgaagacagcaucacuagacaauauaaccccaagggauuucugucacauguuaucuguuuaucacuauugaaacauccuaauauggcccaugacugaauuuagagcaaguaauaaguauuguauguuacacauggagcaucuuauauucacuugaucuggcacagucauauuuuugaugugaaggguaguuaagaaagugggaagaggagauguuugucuagaaugcaguuaagaagauacaaguuuguggcaacuaucuuaaaauacauagaaagcugucaugugacagacaccagguagauuuagucuacaucccuccaauggacucagugaacuccucagggaaggaugaaacagguuugaaguguggugagccaggaugcuguagugaggacucuugugauggaucuaaagcgaguauccaggguuucuaggguauaaauacuuuacagacugaacuaggccugauauuuaccaguuugcaggagcuagguauaagauaaucagaaacuuugugagcuagcaauuaaauuauuggucccuugaaguugaccauagaggugguauuugugccuaagaagucagcaaacauuaauggugacuucaccucaccccuccaggaucagccucucagcauaccaccaguagccccaaccaaaggaugucuguuagagcaaggauccucuggaauguggaagggcaagcuaggggaggagacacuaguguuugugugcucuggucuuuuuagcuucuguuucccuucuaaacugggcggagcuuuccugauagagcacauaccauuucccaucuccugccaagaucugaggcccaugaguuucucugucacuggaucugccagagaaacucuguuucucaaaauaauucuuuccuuguuuuaugucguguuuggcuaacccucuguaggugcuuccuaccccauucuuaucucgagcugaaaggacugugaacagggaaugaacgcagccagagaaaggggauuuggaaacacuuggcugcugagaacaagugauugcaggguuggagucugacccacagauagaagaaggccuugcaguacuaacaucccaaagauggacucuuggguuaaccccagaugaacuagccugucucugcuaccugggcaggggguaaacuuguguuguuuaucucccucauuuccuuuugaaaagaggacuuaaagucuccgagauguacacgauguacauggaagacacaaaggccuugugcugaacacaguaggcaaacucuacccugcucauguaacucuuacuuauuuuuaggcucuaaacaaaaaaacaaaaacaaccagaaacugucuacguuuacuuuucuaggaugccugcagcauuugaaaccccaaaggccuugccauuuuucccagggccuccuccuucccaaccguccccuuuucaauuuccuaagagacagacaauccccaugaccauuugggcuacaaccagcuccaaguuucuaaaacuguggaaaccccuaauuaagaaaagagcaccaucccagccaguggacuuggucggcuuuuauagaaaagcagcccacccaaaagugaugaauuggagcaguucaguauucaagcuguaagugcggggaaguauaguucuuacuuuaaauauacagguauacauguaaagcugcauauggaucuguuauaagggagaucaauccuaaggaaagaugcguuauaccccucucaaaccuccgaagaguuuuccuucccauauuuaagguggucaguuugaagaaagccaggauuuguuuguuuguuuguuuuugguggcuuagaaauguuguguuacauguccuugaacucagugagccagcccaucaacagggccugcuagugggagacaaaagccuacaaggccuuuguuucaagcuaccaagcuuuugucucaagucaagaggguaaggaacaggcuggcuaccuuuacuacuagucauggccccucucccuaucugccugcuagggagucugucucacgccuagugucucauuaccacaagguacuagcaugcaugucagcauccagccuuccucagccagggaaacuuccaggagagagcaaaccccuaccucucgaaggcagccauggugaacuuccuaucaugcgcccaaagaccacaggucccuagcuuauuuugugugccuacaguguguacaguaagccuaggcugaggcaggcuguuagucuggcccaccaguguacaaucaacaaacaguucagcccuuccugagguucugccugaaggaagugguaggaaauggguguaacaaugacuacuugggauuagaaaugugcaaagaagaucuccccauccacuguuccaaccagaccugcuccauccacuggagcucugccaucucuucccaggaaugaagccuuucguaagccaaaguucuuggaaaacuuaacguuuggcugauaaaauuuuauauguauauguguguguguguguguguguguguguguacuguugucauuauauuaauuucuaugaaaaaauuuuaaguuugcuuucccauuucacauagaaauuauuccaugaacagaauucagugaaguugaaaauguuuggcuuaucaucacuuacuuucuagccuggcuauucgcauauuuuuuuugcaugagcaagugagcuagacuuggagcuagacugcuccaauucaucacuuuugggugggcugcuuuucuauaaaagccgaccaaguccacuggcugggauggugcucuuuucuuaauuagggguuuccacaguuuuagaaacuuggagcugguuguagcccaaauggucauggggauugucugucucuuaguuucucacacauacaauaugcauacacaucuuacaauauguaaggucagugguucugagcaccuugcacuagagaaaacucagaccuucagauagaggacaaaaguugccguugagaaugagaaaugccucucauaguccuggauagcugagcacuuggucaccaguuggcucuauuuggggggacucagaagcugcugccuuuugggaagaaguauguccgcuagaggccuugagaguuuaaagcugucucagcuuccugcuccagcaagagacugacacuugcugggugccaccccaccacauugauucaucuagaacccuaagccaaaauaaacuuccaugaguugcuuauuggcaugguguuucaucucaacagaauuguggaauacaagcacaaaguagguaaguuagagcuugcuuuggaagccagcucuuugaacacugauguagaccucuugaggaacaucuaggaaaaugguagccaauagagggauauaaggcaaguaaguggguuuuggugaggcccuaugauagugccauggauuuucauagagaagcuugcagcuuagcuggagagaccaacuccugcaccuagaaacaguggagugcccacgacaguguuagguuaauuggaaagugagcugaaggaaagagaggagacuugaaacagaaguuuggauagagaggggcaagacugcauagaucuacuggccaacaagccagaaggauccauucaagugagaauaucaccagggauguugaguggcaggcagaaugcauagagcucguccauacucagagaaaagccaccuucaccuguaggugcagucuggacuugaggaaccaguaaagugaaaaaucaugccagccaugucugaaaggccauuggagccaacauaagccauucccacagcaggaucacaacgcguggagcugaaacagucuuaacagacggcacuugggaauccuguggaguaucggcauuaaggcagcagaguucacugugaggcucucauugagggcacaagccuagaaugaggccaugcagugacugcuagaaggaaauguaaaauucugucauuagaggaagggagagagagagaacucacacaaagguggagugagaagguagcaccagaguauauaacaaucacagugaagaucagauucaaagacgacauuggaaauugaacccagagggaaacuugguaggcuaagagaacaguuguuugagggacuuucaaguaaauagaacuuggauuuccugugauaagcaaguugaugcuugaggaaggaaguagggcagugaaaacccuuuuaggaaaacaagucuagggacaggcaauaauugauuggaaauggggaaggcuggaaacagaaguccccagggguuaucucuaagaucugucgaggccaugagagcagauggggagccaguaucuuugagggauguuucaaaagcaaagggguacagaugaaguucaguugguagagugcuugccugguguacagaaagcccuggguuugguccccaguacuaccuuaguauuuuaaaaacaucuuagacaguguggugcaugcauauaaucccagugugucuauauauaaucucagcacuuuggagguggguaggaugaucagaaguucaaugucacuaaaaaaggaagaugaaaaaaggaagaaagcagagucucaugauacaggggagacaaaugugauagugcggaucacugucgaucuuacugacuucagauggggagaccaucaugguuccuuuaggagaaauguggugaggggagggggauguugaguucacuuuaagacuccaguagagacuggacccauggcacuugccagcugagggugacauguaccauggcggguggaacaggauccacaagaaggagccagagaaaaggagaguagcaggaggaggcaguagagagccagcuugcucaauuacaaaccuugaagguuuugagagaauguugaagacagcaggccaguuaaucaaagaagggggcauggcaaagcuauaggccagaaacagugugugguccuaaggggagggguggauagugacagccauguagcuucucaaguguguagucagcguggguguccuuacacuaccucuguagcacccagcuagccuccggaccugucuccccgcucuaccuucaauucucauccuucucuguaacugggacaauggagucucugccuuuaagauuauaauaacauuaaacagugguaagguccccaguaacacacuuccccucaugccuccaguuggauuugugggguuccuucaaagaugaaggaaggcuaaagcagugugucagaagagcagagcagaaacagcgcaagcagugcuaucucaacuggaagaaccagagaagggagagagaaaagugagcacguuuaagugauaagaugaagcccugcaauguaggguaaacugaugcuacuggcaaggacgacagacucacucugcaaauucgcaugcaccugccacccacagacaccuggaagaagaggcagugaaguccuuccccgggcuccugaccagcuuccuuugcccuggggcuaaugucuucaauccaaguggaagguggaccuggcucgaucuggcguguuacaaaguuuguucucgcagugcugacuucuccucuguucuccugguuugcauuuuaccguagaugucacuacuuaacugaacggugggugcuguuaacagcaucauagguccugagaccucaacgacuugcucaucagcaucuuagcuccagacuuaggacucugguuccuagagagacuuuguaauccaagugagugccucccaagcauaggugucucugugugaagagacuguugucacugcucucuguagccuguggauaggaagcugcaugggaucagagggaagcaucgccugaccccaagaacucugcuguuggcaaggacauuaaaaagcacccuguuuaacuuuccacucagagggaucucaacagcagcacuuauuaauagcuguucucuugauguaaacugccccccaaaacacugagugggugauccaaguagguuuggaguugauauugcuagggauaucaaaaugaacacagggguuuuugggggagagguguugucauugcuaauuagaauuucuuggacuuauaaauuugcacauggcaccccagcucucugcucuuucuggauuuucaguauuucuugaugauaucugccccaccuggaaguaagccuggaugacuucauaaauauggaaagcagagacaaugagaccaggugacaggcuccaaacacgcagggggucacaucaaagccauucuaagugcaugaacacacccagagauuugcuuguaaucauauuuaacuugaagagucacauuuguaucacagaaacuuucauguguagcuugugcaguuaggccuguaggagugugagccugucuggagugcaauuaaaaucauucuugguuucugugacuuugucaucuggccaacucagcuacauaggcacugcuccugcaaaaaaaaucccagaggugcagcagguguauucccuaccccuaccucccuaccccuaccacccuuagaaagagaaacaaacuucccuugucccauguguaaugugucauaaaacagaucucaucggacagagcaggcaaucucgggcugguucugaagcacugaagaucguguccuuggucacuugucaucugggcuuuucaguggccugucuuuacaaagaggccacucacugcuucuguagucugcuggucagacugcucugugugcugguacaggaggcuugcgcuugcucugccucaucaagucuccgugguacagcuuuaggaagccucagcucuguguuuuccagcagugcuuacuccuuccugcuuggagaagaugcccuggggccuuuuuuccuaaguguggaaacaaauagaagcuguuguccacccaggacuguggugcuaauaaccaagauaguuuccacccugguaucacuugccuuugcacugcccuggcccccacgcccuuccuuguccucuuaaacauucuuuuuguuuccccaccucuaccuuugcuuaggcuacuuucucaccagcagcucuguucucuuucagcacugaagucugccuaccuaauccugaccccuuaaguucuguguucucucuagucaguggcagcauucccugguggccucuggaguguaagcaccacaggaacaaagacuuucuuguggaugcccaaauacuaagugccuagugccuaguggauguuugguaauugcuuauugaguggaaaaagagaucacuccuucuggccuuccuccauguaucacuugcuaugugcacuccaauugcaaaaauccaugaaaacagaaaccauugcuuaguaccaccucuaacagagagucucaaauguacuggaagcucaguagauaugggcaguugagguuaccacaaugcucacugugcuuaggggaacaggguaacucauucuguccuugcucccacucuuauagaaaacuacccuugagugacuuguaagcaacccaaggucuucucuuuucuuuuccccguugagcucucggccacuuggacaugguuuucuuaagagcaugauauauauguuagccacauucuccuuccagaguuuuguaaaagcuacagaggauuguucacaucaguuauccaguggcuggcuaguuaauucccgaguaagcuacucuaagaacugauuauaauucuuuaucaaauacauaacugggagaaggccagaaaagaauuauucugucuuguaggagggaagaauccagcagauagucacagagcuguggcaccagagccuuucuuucuucuguuauuguaaauuauuguuguaguagaaagccagauugucgcaagauggaacaucauacuuccucucagcagaggccuuacauaagaaaaccuucaugaauaaacguugcuauuaaaaugcaugcuacuuaauguaaagugcaguaguuguuuuacauacuuucuaaauuuuaaauggccucuugccucugggcagcuuuuugucuagucaaagaaaaauaauuuugaaaguacagggcaugguggcacauaucuaaucccagaacucaugaggcuaaagcaagaagaucaagaauuuaaagacugccugaaguauauagcagaguucuaggucagccuagcuacagggguggaggggaggggagauagcagcuauggggugcaggugggggguagcaaagaaaacuaauuuuguaacucucuaaagugccaaucaaaaauaaaaacuuuuauuuuuagacauuuuacuugucucccuacaucuagucucucuccuauccaucugagaauucaagugccaguagagccagauggugccgcuguaagcugaugcagcuacagcaaguggcacacaggggucuaugaaagggcagcaccaccauccucagaucaucauugcugucaauaaauaugggcccuagaauugccugagcuuuuaauuuucaugagaagcuggaagucccuacccuuagguaguaccaccugaguucucaaugcuaaaaaguuuagauucuuuacucugagcacucaggaggcagaggcaggcagaucucugugaguucaagguagccugcucuacagguaaguucuagacaagccagggcuguacagagaaacacuaucuaaaaaaauaaaauaagucgaauuaaaucuugaauauggucaaaauauguacauguauggaaaugccacaaugaaacccauuauuauauguaacuaguauaugcuaauacuuuucucauuaaaaaauauaaauaguuuaaguuuuaugcaggucaauuuguuaauaucucuguuggcuccuuccuguaggauagcaaguugcagccuucuuccuacaaguuugguccugccagcuuuaaaguguuuggaaagccucuagcaucauuguucuccuuaggagaagauauuuaaguaaguccagucagaauagggacugaguggagcacagcacauguguccaggcuguuccauugaagcugaccagagaguaaucuagaguugcuuuuguacagggucugcucuccuaggagcauagcauuccuucacauggacaugagccauaacugugggacaaauugccuuaaaacuuaguggcuugugcacuaagugguuaucaucucaguuucugggggucaguaacuugagagcaacuuggcucagauaguccuggcccagucuugggagacuguacucacugagcccuuagcuagggcuauaaacacuugacacuugcgggagucuaaggaggcucacucuugugacuggcaagcuggcgcugccugcuagcaggcacucauuauccucucaauauggccacugcuugcuccaauagcaggugauucaaaacucaacaggcuagaagccagugccuuuuuacgacuaaucucacaagucacacaucauuauuucugugauaucuuaucgauuccacacauuuaccccacuugauauaauggaacaccagauaaggggauguagacuaucacaggccaucucagaggcugccugucaccacuguguucccagaagucccuccguaaaaccuuuauaaacacaauccaacacuaaaagggguuuuccaaagagaccuaagagaauaacacacacaucacagugauuuguguuucauuuacuaacguuucugggaccacccgcugauguuaaauccccugaauguauagcucauucccacaaaugccuucucuggaacauucuaaaguacuuuuuuuuuuuuaaauuaaaauccugcucauaccaucacuuagagcacugguucucaaccuuccuaaugcugugacccuuuaauauaguucuucauguuguaguaacccaaaccauaaaauuauuuuguugcuacuuucaaaacuguaauuuugcuacgguuaugaauuauaauauaaauauuugaugugcaaguccuguggaauggugauuuggccaucaaaaggucucgacccacagguugagaaccacugcuuuagcgugacagcuuggggucuacccucugcucccagauggagugcuaauuagcucaccccugucuguucuauggggguguuccucgacuauucuuuguuagcgugcagccagcagagcaagcggaacgaccaguuugggagcuguaauccaaagucuccuacacaaagcuucagugccaucuuaugugaguuagaugaaggaguaggguucccccagggucugccauggcauccauuucugguacucccuuucugauccacccaccaacucaaagaacauggcaaguggguguugcugaugcucucaaacaccuacaccucaggccccaugcugcuauagccucuuucaagaccaccuuuuguauccuuaaacaagguuuggcuugaacgaaacuguuaaggggaagaaaagguaucccaauaugguuucccccaggaaaacccacaacugauaccuaguucuuguuuguucaauaaacaaaaccaaaaguugaugauugaaggucaccauuagcaacauguauggauucuguaacauuuguauauguaacugagagggaacauuguaugggcccacccuggcaguggccaccaagucccaguguuaguaaauggaaaugaaauauauaauuaaggaggccaugguggcgagcauucuguagcggagauggggaugggguggggggugguauaauuauagaauugaaaucugagacugcaguguguaagggaccguucuaggggagaggcugugugauagauggucugcauuguucuccuucugaccuucuccugaacuucccuuuagaagaacagaggaaauacaauucugccauuucccacauuguuucugaguaauacuuuaagaugcccacccuuagcauuuuuuaucuuccacugggguuuacuuucucuccaaugcuuugcuguuucccauagaaaaaucuaaucacuaaugauucuguccuuguguuaaugcacaauacugaggcuacacaaauauuugcccauauugaacacaaugccuacagggaaaggaaaacucccagugucauccauucacucugccaagcagaacagucagggaauagcauacagugaugaugccaaacccaggaggagggggcagccccaaaccuggaaccaaacaauagggucuuuugaagcagaugagaaggagcgauggggacuuagaucagagacagugcuacaagccuggaggauagugaccagugugaggacugugcccaaaggaagagaucgaucguaagggcuccaaagcucaccacagaaacccuuucuaccuauaguacaaauggacuuaggaacaggaaacucuccaaggccaaaaauggguucucacaacgacuugaaacucuuaucuuuaaaaaaugagggauauuuaagaccccauuuuccucaaucuguacuugcauaaaauauucuuagaguaauauggaggccaucuggagccaaacccucuuuuccccuagagaggggcuuguuaacuucucucacagcuaaauuugcauauguucuaaccuuuggcuuauggcuuuguaaaaauuguaagauggcuacuggcauggugggaggacauugggcacacacacccauugagcaaacuguaaaucaacccauuuucuguuuccuacuuucuucagaguccagggaaacuuaaugugucugagugccuccuaacagcgcugguccugaguuggguuucuguugcuugacaugaugaucuccaguuccguccauuuuccuacagugacauaauuucauugcuuccgacugaguaaacauccauuguguaugugcaccagggcuucuucaugcguguguuugcugagagagcacuuagguuaaucaaccacgaacacuucugugggauuuuuauccaagccaaauuucuaacaaggcaagguuuuacuuagcuucagaaucaacucucagucgaauccuuggaggauuaggggguuguuauuuuucuuucucuuuuugucaguuguugaggcuaaaugaaaaagaacuacacaguccuggguuagagcuuuucaacugcagccucugaguuuggcuccuuuugucaguugguacuaaguaccugcugugcacagugcuaaucccagcagaacauugccaggacuuccuuaggaaaccaguguggguucugucucccucaggaauuucuggucucuugggaguccaaaacaggccugaauacaugcaugcagacacuuccuucuauucucaggagacaggugacaggccaccacuugcuggugcagaugcuauugcaaacucuuauucuuugguagcaagaaaacugaguuccucauacuaggauuuuggccauuccuucaaaucuaucaaauugccuggaaaaguaguuaggugauccuuuuuaaucuuccauuuagucuucucccucugucuuuguuacuguuucuucaucuuuagauguguauguguggugugcacacauguucacauauguucuuucuuccuaccaccccaucaguuuaugcauauguuuuuaacuguacaaauucccuuggucagauuuuugcuaaaagcaggauuuuuguuuguuuguuucuccugaaauuucccucauugaaaugcccauuaucacucccucucccuucuguccucaaaaauaaucagaaugugcauucucacuccauccucucauaaucacuuuagugugauagaacaauuucuagguuuuuaugguaggagagaggugcugaccugaaccaucaccaucacaaccaucacgugagcaaagucaagcgguucuguucacaccucccacuuccuguguguaaggcucugcggggugcugcaaggugcacugacaccaggauguggagccuguggccccaaggugcuuccagucuaggugcagagcugacuagcuaacccuaccagugaaaguggguacaguucuaaugugagugggaggacagaggaaagcacauccccuuggugaggggauuguccuggagggaacaaaaaaccauuuuccaaagacacaaaacugugcuggaggugaugaaggaagugacaggaaaugggaggcuuucguggagagcacagccuuucagcccuccauauugccuugccauacaaucccuuucucccuccucucuacuucuuauccccaaguguagcaacuccuuaguuccaguacccaccaguuagcucacucugcuagaggaauguuugguguucaugagaacaaaaugaacauucuaaucucuugccgaguguugcuccuuuccaaaggccugcagucccagcucuuagauuacaaaagaggcccaauuguuaaaauaaaaccugcaguuuauggggaaaaggggcaaugguauuuccaccugggggaauaguucagcaucuugccccaacagaaagaucugcuguguucugcuuaguuuucugugggugucucaggauucagcagcugucaccaggggacagcaaugccauccaucccuguaugaggugaugguucagaugacauucagauuaccugccugcgacacuucugcaugcccuaguggcagauuuaaagagacagcugagccuuucuuguggaacuaagauauaagcaagcaaauuuggguuuaguuuuauuucccuagcacaugaauauugaaaguuaucucuuaaauaaguugcccuuggcuugaguuuguacccaccuuauucagcagaauaccccuguuccuaacuucuguugaggcaaccagccuauagcugcaagagcucuucccuuguccuggcccugggcaaaucccaggagagcauacuuauaagacagugggccauagugaaaccuguucuauggguguuuacugcuguagucuugaaggacaugcucuugagaguccccuuugcagguuugguuuucuggcaaaaccaggaucauuugcacuuucccuagagagcuggccucaucuccaugucccaucuaggcccacacaugccugcuugcuuggagauagccacauccuacuuuuacugggucaauauauacccuaucagcuagcuccaaguuucugcugagaacucgcucugcagggugcuagcuagcuuuggcccuugguucugguaauccuccacucacuauacagugaucagaaggaaaucucugaugcucucccugccacugcaguggaaauucacccucuagagugcaugccaucaugcucaguggggucuuuuucauagcucagguuucuggcuucuguucucugaauuggucugguuccagucagugacaccaaauguaccuccuuuucaaagaauaaguuucuagugucagaacccucucuuuuaucccuaaucagcagcaauaaauaguggcuuugccauuuaaccuuacaaaucacaugaccagauaagggugggagaaaugagccuugucuauggugcagucccuugucuaugaauuggagugcagaggucucuccagcccaggcacagggcacugugggaagggaagcacugacacuccggcucauguucauuuacccaacaaacauuuacugaguacucagaaugaaucagucaaagcuaaaugucagagcagugugaauguugauguuuaaaucagcaaagcgacacauagguaauaucacugucuugguagagagugagccuugacuacuagguugacauggaaaaagcuagccccuccaugccaugacaucagauuuucacucuguugguagcuuugauaugucaccaggccaaauauagagaugcugcuguaugugcaguugauccucagaaauugaaauuucaaauucccuuucaggguagaggaaugagggauugcccucagaaagccauggcagaugacagagauguuugaguuggcccuuuccagaaucagcagguguccccuuagaaucuauaacugcacaaauuuagcccucagcuucagucaacauaguuaacaaagcagaaggaaaccauugagcagaagaaacuguaagacgcaugucacccaugugcauguucuguccacuugcuuugucucuuaguucugcccuuuccaguucugucagaccuaccuuaucuugacuuucaugcgacgggggacagcugaggccggagguccauuucaccaaugugacucacacccauuuuuugugugccuuuggcauacaggcacagguuucaaggcccuuugaggagaaaggacaguauguagaagacaagagggguuugacauucuggggugcucuuugcuguaguugucuuugcuuucuaauauuuuuuguuucucucucucucucucucucucucucucuguguguguguguguguguguguguguguguguguguguguguauguguguaugcaguugugugggauagguagguguacaaugggaugaacauacccacauuuaugcauucucucuuccucucuugccucccucccucucuuucuuuuugugugugcauguggaggccagaaaucaacuucaaauaucaugccugccuuuuuuuuuugagacagagccuggaaaucccugguuaauuagaaaaccccaggauccuccucucuccucccacaugcacugggcacugggauugcaaaugaggauuaccacuucuggguuuuuaucuggguaguagggaucaaacaugaagggggguauagaacccugcauguuuugagacaucuuccuaggcauuguuguauacuucuuugugucugucuuucucaaugaaauaaguauucuuuacuuguugaaagcaccugaaguuauaaguguaaaacaaagcacuauguggauacuagcagaccucagaauucaauuccuugggcugacuaguaacuaucuacuaacugacuaguagcuaucuacuaacugacuaguaacuaucuacuaacauuuccuugggcuggcuaguaacuaucuacuaacauuuguugagcguauacuuuggcaaaaggcaccaacauaaagcccauccagguggcucuguagcccugcaugggcucucuccugcaaccuuugacaacaccagagacaggauuggaaaacguaggccacccaggccagaaacaggcaaugaaagcuuagcccagccagggaggugaggauucuaggaauuccaggggugcugagugcuucugagaugagccuugguggcucuuccuagaaaagaucuaagcuaguucuuccuaggaacauucucagugagauacacacagaguggggaguuugucuuuauuuuuacuucuuucucuguuuaucaaaugucaagccaauuuagcuuuauuuaagugacuuuaugucucuguuuguguauucuuuuuuguuuguuuguuugguugguugguuugguuuguuuguuuguuaguuuugagacagaguuuuucuguguaucccuggcuuuccuagaacuagauuuguaaaccagacuaagccuucaacucagagauccaccugccuuugccucccaaguguugucauuaaaggaaugugccaccaccaccaagcuguauucuuugcuuuguuuuaccuacccuaguacauacaaacaaacugcaaggcuaaugucagaaucuaccuuagaaaucugagagcuggcuucaguccaccaauacuacugccuuuguguuauauucaguuugugucccagagucaacuuuuucuuccauauguaagcaacagaacuagaguuugauuuugaugguguccuuggcagaaguguaguagcccuaggaaucaaggauuagcauagaaaauacauguguauuagugcacacuuggaaaaaaucucauucagagcuaagaggcucacugccaauacaaauaaaaauagcuaccccucugguccuaacauugugcuggaaauggccagugagaucaagaaagccagcguccuuuggagacugucccaguguggcaugagacagaugucaacauguagaccaaacugugauuaagucaccuucccauauggacacaaggcuguuucaaugucuugagcauuuuuauuggugauagccaaaaccaguuuucagcgagggucucgaaggucuuaauccucaucaucacaguuuuaugagcauugagcaguggccccagauccuacauggagaucucugcuuuguguuuucucugucugcuguaucaagcuguuaccuaaaggcuaaguaggguuuccucagcuucccuucuggacucaaaaccuacuaucaaucucugcugugaugguucuucagcucauuagagcuggagagugaggccaaaguucaagguuuccagcaguugaguugguuccaggcauggcuccuuauaaacucacauaacgggagguccagguggauaucugccaguguuuagaucuuagacccucacccauggguuccucuuaccuucuacucauccccuuaaucaaagacaaaucaguuccuccccuaccugguuugcugaagaaguuguaucuuuuucaaaacuaaaucccugguuggccugagacuacccaggccugcaucacuguuuaaauccccaguugggccgcccugugacuuccuggacacaguuugaacucauuucuacggaugcuggacaguucuccuggcagccuuaccugugauccaagaauauucauccugagugguacccuaagguguucucuagucuuuacccugaaggcuguuuucuacaugagcucucguuccucucagauuugccuucuccuucagauuucuguugcuauuuuuugggcccuauguggcuuugauggagucccaugccuccauuccaggccaccagucucagcaguggcucagaacucauggcagcauugccaagucuccuuaguauugcaauagaaacauaagauuuaacaacccaucugaaauacaauuuuacauuuugauugcuucugccccagccauaucgagguuacuuucaaucugcauauauuugugggaacagacuucuucacugcaguucaauuugaguacaccuuauaauaucagugauuauaaaauaccagggacuaauagaguuucuugcuuccaaggaguucaaacugcuuuauaauucuacuggccauaauuuaucuucauaaguuacuauacagacaagaggaaaaagugagauuaauaaucacauuuuauagaggguaaaauaaaacuuggagaaauugaguagcauuuucccagacgugcucagcucuccccaggcucucugaauggucugcaggcugaacacuuacaucagaaaugcaugugaaccuugcccuugcucugucauagacugugggcaagagcaagauacuugacucugggccagugguuagccaaggacacuggaaugagcagggugugugcccagcuccugcagcacagaccucugcuacaaugaauguugugaguacacacagggucagcuccucgauuagauccucagaccucuucccuggguuuuguucccaggguaucacucuggcaucucaacuaccauauugauaggaagacuacccgaagggcagagcagggcagggcagggcagggcaagugcugccuucagucccugccuuguagcucugugaaugcuauugccaucugcauuagaccaaauaaguagaagacggguuauaggagggagcucugcuucuacagugagaugagaggucuguggcugugacuucuaaugugaagaaaaaagggugucuuucacaugaggagaaggaacgauggguuggauccagagcaccaaaaaagaacaccagaaaaaggguauucuuuuuguuugauuacugccauauagauuaagucagauaauagguaaguuauuuagaauugcuugauuguccuagaacuuuugugagguacuuccugccaugcucuauuuaaccuucuuucuggccccuccuucuagaaugagguauauggccaguacuuaaaaaauacuaggauuggacccaugugcacugggcuccuggcugcagucuucacaccucucuuggaagccagccucugcagggucacguggucuagacugaucgaagaauaacuuauuccuuaugugcacugucaagagagcaguggagcuaauaacaaagcuucagucacugauguguugaaagugacaguuguuuuucuaaccuccccuagaaaauggaauguaugguaucuuaugagggucacauuggaaaggaauaaucacucucuuucuuaggugcaauuuugucugacacuucauguauguguuuaaaguauuuuugaugccccaaaauaguagugagagucuuuaaaaugguugcaugagguggcaccauggcaguguaaguauagagcagcugucagcugagugaucugcagaacagagauccguguacccaggguccuucuuguacuggcacaacucugaggacagaaacaaccuccauggaaugugcccucaagccuccuaaaucuggaagagccaaagcagagugucucuugucacaguguugccaaggugaugucgccagccuccagagggagcugcugggugcugcuguuggcacaguugucccuucuagaaagguauaugggaccguccacagccuaagcacuggugcuacagcagugacaugggggaggaguacucacugccuugugcguggaggcuaccccugccuugccagguacaagguuagcucagaccucucagcucuugucuuuccucgcccagcuugcccuucuucauguaauauguacacguuccauguaguauaccugcgcugucugcaugaagcugccucuaacuagauagugaccuccaagggcccccaggcuuugcuuuauuguuugcuccugagccccagcauagugccuggcacauagugacacugaauggcuaaacauuugaauaagagaccaagugcagcugaagccaaagcccaguguggagugaccuggucaaauaugccucaggaaagagugggcacuucugcagcuacugacagggaagcuaaacacacacacacacacacacacacacacacacacacacaaaagaacuuuagaauugaguuuugagugagccuucaugaacucagagccugggagucuagcaucauaggaacaagguauguacaaaaucacagcagaguacacauauuuccccagauugcaggcauccaaagagagaaguggguucuuuucaaauaaaguuuaucuauuauuauuagugcugcgugugcacauauauacaccauaccaugcacauggagucagaggacaacuuaguguaaauucccuccucucaccuuuaccuagauucuagggaucaaacucagguugcuauaaauacagauaccuucacugcugagccuccucacuagccugacaaguaucuuucuuuccuggggccucaaacagcuacugaaagagcagcgccaguguaccuagcuuggaaucuaagauaaaugagacccagaccauauucuuagagauuuaaaaagagacagauaggcaaauguguuguugaugggucaaaaaugacagagguguuguuguuguuguuauuguuauuguuauuauuauuauuauuauuauuauuauuauuauuauuauuauuauuauaaacuacaacuuaaccaggcauguggugcacacuuuuaauccuagcacucaagagguacaggcaggcagaugucugugaguuucagagacagaguacacagccagccagagcuguauagugagcuagccaaugagacgucucucccugccaugaauaaaaggaaggaaaacaagaagaacuuuuagugccauguuaggauauaagaagguauuuucucugucuuggguguaauuauuugacacuucaugaauguucaaaggguuuuuaguguccuaaauaaucuaaucagagagauuuuuuaagauaguccuuugggggcagcagaugcuuagugaauaucucuugcaccagucuuucguucauguuuacaucuugaucuacugguguagauaguagaugcaaagggagcagcauauauuugaguaaggaagacuggaagggauaggaagggaaaaaaauaguucaaaaauagguuucauaugcacagagaaaaggaacuuauccuuugagacaugaaagggaaggcugagaccaaaagcaagagcugaguuaguaacuauaauagaagcaugaauugaggacuacuucauuuaccuaguaccagugaaagccgagcuugguacaacuucaugguauauuuuagcgaucuacuuuagagguacagugacaccccaccccaccccaaaauaaaaaagaggggugaaaucguaacugugagagaccuuggcaccaauuucagguuuccacacuucaccuuucuugcugucagucuuuggugaaccaucugcagauaaacacacaggcucuccucccaucucccuugcucaggugucugugcaacugagcaugggcuggcacacacaugccccuuugggccucagugccugcuaucuguagcugaguccuccuguaccagggcccagacuuaguuccuugugaagacuuaccccuucccucuccuuugucugcacugcacagaacucccacccuaacucguguuucacacuucuuauauuuaauaugguguauucgaucaacauguauguauugaccaaguggcaacuaaaugccaggcacugggcugcccucacgggcuucguagaggaagagagacaguaaggauguuauuggggagagugcuauaaggugacauuuauggugcuggagauggcaacuaacuggugucagaggagaugucuaugguggggacaauuaagccgagcugugaaagaugaggaggaagcuguuugagagccauggggcgagcacagagguggaagcaacuacaucaccugaagccuacugguccaggaggugcucaagguauucuggaaguugaaaagacacugcuggcaccagagccuguugcaguagaaaagugacuugaaaugacaguggaaaggcaaacugggucccuaacuggggaaacguugaugccugagccaugggagagauucauagauucugaguacagcgagagccacugagggcuuugaaacacaagcugauuggaagguuauugagggaagggaaaacaggaagcaccgggugaagaguugcugaggccaaaguuauaccaggggagagggagaagagggacucauuugagguagacuuuggaccggggcacguggauggucggguggcagggggauugaagggauuggaccuggaucucuugcaaagagaucuagggagccuagaacugaaaagacaguuuuaagaugagacugagguuuagaugucaaaucuaaaccugugaggguuggcaugauugcugugcaaaguuuccuagagcugcaaacaaggaccacaaaauguacugcuugaaacagcagcuacucuguugauguucaggagcccagaggaccaaagucaagauguuagcugggccuuaaggauggaggagaggauauuucccugccuucucuagcuuuuuguggauguagguacuccuugguuuguggcacauaaaugcagucuccaccucugucaucauauggcuaucuugucagugucugaggccaaauuucccuguccuaauaaagacaccugucauauuguacuaggacccaccuucuaugauacagcuucaucuuaacuaauuaaaccuacaacaacccuauuucuaaguaagaguccaacauaccugcuuuauaauacuggagauugagcucaggacugugugcauacuaggcaaguacacuaccccugagcuauaucccccaacccaguguuucauucaggauaaacacaaaaccaugauagucauguaggggaagaauagaaagaaaagaagaugguacauagagcauuuggacaaagaaggaggaugcucuaguaaaggguauggacaggaaaggauauggagaggcaagaaauuuggguaugggaaaguggcaccuaggaagccaggccuaacaaagcaggagcagugggcaguuguauagaagagaggcagcucucaagacacagagcugagaugcugaccaagacuacgacagugcacaggccauccugaucccucuaguguggcacaugaguguaggagcaucucagacaagguuaagaggcgggaacauuuaggaggccauugcucugagaaaugagguauggaggaagcagauagucuugguaacacuuggagaggauuaaggaaagaugugugcuugaggcuugcuucuguuuauuagcuuuguccuugcauacuguuuuguuuuuccaaagugguagcugcugaaguauggugugugcugugguacaugccuucucaugguuguguuuauaucacacauguuuguaaucuuuugucccuugauuuaguguugccuuaacuccaguuccaagggacuuagugcccucuugccccacauuugugacauuccuucacacagaugcacaugaauaaaacuuaaaagaaagacuuuguggucugaucuugguuaccaaauacauguguacuuucucuuuaaaaugccuuugaaauuucuauguggccuugucugucaauuacagagacauuagcuccuacaaccaggaguggacuguuuauaauagaauucugguugacucucaggaugaucuaucuauucaugaaugggguucuauaguuguaacauuaaagaacuuuuauagagaucaaccuuuuagacacagaugggaaaaguaauagcaguguuuccuugaagaaauguaauacaaaugccuaggacaaagaucauugggaugaguggauuuuggacuuaauugccuuauuuuaagugagagcagcuauuuuuacauauuccugaaaguagaguuuaggaauuccuuccuaaauauuaggcaaucuuuauaacgaauuccagauguucagcuacaaaagcuaacuuccuaccauuuguggugugguuaucaggucaugagcucauguggucagaaugugaugguggugaugcccacagacaugcuucacuguaggucuguuguacugccacccaccgacccuuacucgaucggcacuugcaagcuaacuacauccucuucuaacuagauaacaaagccaaagaauggagagucucugcaaugcagaccucucucaagaccaaagaccccacacagguaccccagaauucauucuuccauucuuucucuccagggccccugagaucauccuugguuugccauucugugaggcaauugacauguggucccuugguugugucauugcugaacuguuccugggcuggccauuauacccaggugcuucugaguaugaucagguaggucugggugacacaggaauucucuaugugacuucacucuccauccagaaaaccuuagauuaccauuuacuuagaaccugccuuauucacuuauuaaacuuauccugacuuccucucucucucucucucucucucucucucucucucuguguguguguguguguguguguguguguguguguguuucuucuuucuuuuuacuucuuguuucucuaaaauuaauuccauuuuucucaaagccaucaguauaccauauguaccaugacaggaaaagcccugaccucuuucucaucuuuucuugcagauucgguauauuucacaaacacaggguuuaccagcugaauauuuauuaagugcagggacaaagacaacuagguuuuucaaccgugacacagacucaccguauccuuuguggaggcuaaagguaggaaaaacacucccucacuucuacugauggccuaauagugaaagaaggaaagacaaaaaugagcuuuugguauuuacaaauugaugacuuuaaucuagccagcaaaauggggauguaggauagaguugugaauacaagguguugcaggaucugaaugauugaaaacaccugcuuccuugccucacugcugugugagagacugugucccaugggaagaccgcugaauuucugggauuuaaucucaugauccuucaugucugcuucgugcuaaacagaugaagcagccacacucugcucuuaaggaacccacuguccauggagaaacaggaccagugccccaagcucuaggcuaccauauggacuauccucuuccuaaaaggaaagaacaugggaaauagcgugaccuaagugagccaagaaaaagccaggccagggccaagggcagggagcaauauuugugcugggcccuguaggguacagagggauuuuuccaaggcagggaaaguagccugcaaugcaaaugucacaaaccccugggaagacagcagaucuucauccaggacaauggauaccauaaacucuuggugacuucaccuuaauugaaacauauuuugcuuuuacuuuaacugugucuuguaauuaaaauugacauacuuuuccugggaaggagauaguaauaaagacuuaagucuguaguaaauucauuuuugcaguuuugcaauuggguuuuacuaaguuugguuugguuugguuugguuugguuugguuugguuugguuugacaggaccccaaucaaauccuaauacagcuuaaauauaauauguacuaucaaagcacugggauuuggaagcuaagcaggcucuuaggcuagaaauagagcaccugacauucaguaaguaugagaguugccaagguccaguaacaagucuucagguagaagacagacaacccaaguugauagugggggguagcuacuucgguguuuuaccaggacccucaucaccuguuccuugggguugaacugcuuaaagugugcuggccuuuauccagaauuaauugccuuagauccauugaugaguccaaaccaccuagcaaguagaaaaaguaguuuccuagccaauagcugauaaaugucuuugaaagagcagcauagaauacaagcucuggaaacagcugccacuuguaagcugggaauguuggucgucccccagaacuuuauauuuuuguguuuccauguaguaaaagaggagagcagucauccuaaugccugugguuauggaaaacauuuagugaguuagugugccuugaaacagcauaggagcuguagguguaagggauugcuaaguaaaauaaaauguuaaggugucacaaagggcucuggucuucccagguggaaucuuaccuucagcuuauggaaagcugcagaguaggaaggguguggucucauguucucuuuagagucuuugguaacuguaccagagugggcaugagugggagccuggggcggaaggaaggugagcuaguguggauggacagagaaaggagcucuuguguaggacacuuuccgagaaaccaaagucuccuccucugcaaagugagaaaggaccauggguggaagcagcagcccaggagcuugagauucagugaccugagcggugcugucugacugaccagguuucgcuuucuccgauagacaccagaugaccaugaagcagagacgggaauuaagucaaaggaagcaagaaaguacauuuucaacuguuuggaugauauggcccagguaagcucugugagugaauaugcagcacaggcccuuuaaaaaacaaagcaaaacaaaaaacagcugcagggcagggcaugccuucagacccaccacucugggacgcaaagcaaguggaaucucugagguugaggcuugccuagucuacauagugaguuucaggacugcuagagauauguagagaaacccuguuuuuuguuuaaagccaauaaaugaaaauaaaaaauaaaacccaccagcagugauauacuuaacuaugcucauugccuuugcuuaugaacaaucauaugacaggcuuaguaagaaaccauuuggucucagaaaccaacucuuuagaaaaaauagcuccauuguauugcuucuuguuuguaagguaguggccaaccuuacuggugcuaaaagggccugaauccuauacaguuuaaauauaauauguacuaucaaagcauugggauuuggaagcuaagcaggcucuuaggcuagaaauagagcacaugacauucaauaacuaugagaguugccaagguccaguaacaagucuucagguagaagacagacaacccaaguugguggugggggguagcuacuucgguguuuuaccaggaaccucacguucaccuguuccuagggccuugugugugcuaggcaggcacuggcuccagagcugagaccuacagcccauuggcauauuggaguugaugcucauggcucaguguguccauuuccuagggccuacauaacaagauagggugaacuggaggguauaagacaacacaauguauucucucauaguucuggaggcuaaaaccgucuggugucaguguccucaaggccacaguccuuuugaaggcccuaggggacagcauccauguguugggcuccccguggcucuggcagccucagaauuccuuacuugcagcugcaucacucuaauccggcuuuacccuccacauggcuguuaucccugugucaucccugcucccacugucagaucucugcuauaaaagcacugauuauuguguucaggaccauccuaauccaauauggccucauccuaacgugauuauaucugcaaagacccuauuucuaaacaaggucacauucauagcuuccacagauuaggacuuggauucagccuuuagggaagcccaauucagaccauuacacucagucacugucagcucacuagcagcgacuacagaccuuccuuaccuuuccaucacagauaauucgagaucuucagguacuuuuaguuagagacuaauccaaacucugagcaauccagaaugacuguuccuuuuaaacacugagaaacaaagcuguagcccaauaaacacuuagcacaccucuuagcacagaugaguguagccugguucugaguaaaguacacuugucagcugauuaguagcuuagauggucuguggaaacugaaauugcuuuccagagccccucuugaaaaaaaacaagaaagaaagaaagaaagagggggggggagaaggaaagagagagagagagagagagagagagagagagagagagagagagagagagagagagaaagaaagaaagaaagaaagaaagaaagaaagaaagaaaagaaaagaaaagaaagaaaagaaagaaagggaaggaagaaagcaagcaaacauugaaagcaaagccuuucagaggccaugcuaguagagaccugccuuugggagaaaaguccuguguucagcugcacucucuucccuggccagaggcaacugcagggaacacagggaccgaaaucauucuagucacagucagggaccaagggaagggugaugucauaaagaugaaggaagagggaacccaggcucuuuucuucuccagagguuguauacacuuuuccccaucuuuucuuuuucuacugcuuuaucuuagagcuuucuguguguguguguguguguguguguguguguguguguguguguguguauuguuguugugugcuugugacaaaacacauauagcauaaaaugucucaucuuagucuuuuuuuaaaguaaggcugaggagaauuaagugcaugcgcacuguuaugcaaucggccuccagaacccuucaucccgugguuauuuuuaauaaggugugaugaaagcugcacuucaccguggccaguuaaaacaggagcagcuuugugccuugacacugggauguaugugcaggugucaaccaugguggccucuuucugccccaaccccuaccugguaccugacucccgcagccauucuguuccuagcguauaagaggccaucacccguggacaguagcagcacacaggaccauggcgggcagucuacccucuggcaccugagauggggagcuugagaucagacgauauccuauggcucuuacucaccuguccccgcuuacuuccaggugaacaugacaacagauuuggaagggagugacauguuaguagagaaggcagaccgacgggaguucauugaccuguuaaagaagaugcugaccaucgaugcugauaagagagucacucccauugaaacucugaaccaccccuuugucaccaugacacaccugcuugacuucccccauagugcccaguaagugccuacuaugcuuguaccaagggcaacacuuaaaggcccagacaggaaauauuugaggcuuuguggcccucugguuccuacgcugcaucuccguucucaguuauagcugaaagcagcuauagauacagcacauaagcaaaaucaggaucuccuugucaucaaagcacuuagagcacuuguggggcgagguugggcugaagacuacaguuuguaccaaaaagaagggaaugguggaacauggggacuuuggggccagaugaacuuggauaucaacgcacaaagggaagugggcaaaacagcagugcucuaaagcaaucuagcaucagugccaaagguuagucccaaaacugucccagagugaacugucuaguuugcuucauuucuuuggcauacugugggcuguaccaggcacuggaguacaaugaggaacaaaguagacuguguacuuucgagcuaagccauggucuucagggaagaagauagaagacaauggcuguuaccaagaaaggaaugcgguaugaugaguccauccaacaaggagcuugcucaauaggccagaagacccaagaauauaaccugugaagggugagggaaaagaugggugugagaagucagggcacugccugugugaacucugcagcaugacugaacaccagaccuaggaaugggggcaacaugcugaggcugcagaagucagcgcucgagcaagccgugcucagggaggguuuugccuuuuaucagaagcucgaugcagcaguuaaaggacugagaagcaggugaauggcugguuggacucguguugaaugcagaucuaaccugcugcuguaucaguaaucuagaaaaaagugucugagaucuugcaguucucuuacuuagugacagccauuuccaagcagaaacuuguugggcagguugaaagauaaagugagagcagagaaauagacuacaggaagugagacugugaaaaggaaggaagaaaugagggcuguggagagaucagagcuugagaauggcugcucugauccauucuuagccugacugggaacccuuuuggggcucaaaugauccuuucccaggggucacuuaagaccaucuugcauaucagauaucaucaugauucauaacuauagcaaaguuacaguuaugaaguagcaaugaaaauaauuuuaugguugggggucacuacaacaugaggaacuguauuaaagggucauagcauuaggaagguugagaaccauuggacuaaaggaaauuuuugaagaaugaggaaauuuaagcaaauacuaaugggaagaaucugguagcaaaugagagauucaaggcaaaagguacuuacuugugaguaguuucuguugaguugguguuuauugcugaguggagagauggacccugucacuaaaagaugauauggugggagagacgugggugucagcaggugcacaggauagcagaggaaaguugagggaguuccugucagacagcuucugucucagaaguagaugaugacaucaucuguugagaacaagguggcuuuacaaugcagaacaugauaacugugguuggagagguggcucaguggauaaagcauuugucauacagcugugaggacugcuguuggauccccaucggucuguaaaugucagguggucuaccuguaaacagagcucaagagguaaagauagaggaucccaguggcaaacacgcuagcuagacuacgugaaggguaaucaggcaaggcacucagggaagccacagaaauggcuccaugguagcucugcuuucccagaagaucuggguucuagucccuacaccuacauggcaguuguccauaacuaccauaacuuuugucucggaauccagugcccucuucuggccugucugaacaccaggcaaauaugcaguacacagacaaacacauagcaaaacacacauacacauaauagacuuuuaaaaauuaaguuaaagcaaggaaagauuugggggcuagagagaugacucaacaauucagagcacuugcugcucuugcagaggaccuggguucagcucccaguauccaccucaugcagcucacagccaucugcagcucuagcuccagaggcuucaguggccuguggccuucucagacaccugcacacacaugaugcacauaaauucaugcaggcagaaacacauacauaauaaaccuuuuuaggaauaaaaaaaaaucaugucaaccuuugacuucuacaugcacgcccacguauccacaaacacgaauaugcucccacacauauacacaugcaaaaaggaauguuaagaaagaaacagagagaaauaagaaaagcgauaugugagggagggagagaggaaggcagagagagggagaggggaagagagaguguguugguccugguaacuggagcagagcaugauagcaaacuaaccagagaaauauaggagaaaggugggugugcgggaauacacaagugcuguaauccuaggagagggaaggaagcggguagagcuuugaacauuuggguccgagcauaaauugaugguguaagugaaggcauagagaaaacaguugaguuuguccagguugaauugcugccaaguugcucagagagaaugacaaauggaugaggaaguugaagaugcuggugauauaguaauuauaaucccaaauggaagcuacugaagguucaccuaagagaaaggaaacucaauagaucccaaugaguguccucugcucaacucuagagagaguuaugauaauaguuauagucaaaugcaccagaaggguagggaaugaggccagggaaacagggugcuugagcuugucuuaagaaacagguccagggcugacagcccaaggaaggaaugauaagggugagagcaaggucaugagguaggaaauguagguuuugacagguuaucaggauggcuacugaaguagucaugguacucagaaaauagcuuggagagaaagaccaaccugguggaaaggccucugggaaugagagaaagagaauggguuuucugugaacgggaagugggugauaucaccuuaaccuuagcugugaugcacugggacaugagagaauagaucacauccucacauuucugcagggacagcagcaugcucaggaaaggcucuuucaggaccugggguaaggacugcugugaggccacagucagcaacguuaugaccaaaauuagauuugacugaguuuccaggcuggacccaaccucucccagcuuaacaagugggccacaaccaccauaaaguguaucuuuuaagucaguucuuuuccauagcaguuagugaaguaagucaacuugcacggcaagaccagacaguaucucuuuaauucagggaacauuugaaacagucaaguccuagugcaaagagggacugugcacacaguccuuccaaacucaaaguauaacaccuaugcuguuucucagcaggaggcaguuaagaaggugucagucugucccccgggaagaaaggcaaauccccacaaagccagccuuucuaacuuuaggaauaaagaaagaugauagggaaacagugaggugggggauuagggaggcagaugcuucagagagcuccuauuggccuucugcccugucagucacccaaaaccugggcacuuagauaagcagggcucuguucuuuguuuaguaaggaagcuuccguaguguguuucacuaggagcaauggcaauuuagaacuuagaaggucagcccucgggaaaggcagguuaccccuaggccuaccuaagagugggcugaauauuuguagguucccagaagaccuugaagcgcucuagagugggaccgagccuucaggccuacccagccugcuuugggccccacccgcgggccugggcuuaagcugcucuagcauaagguuuugcagguaaaagcaaaaccacucauuucucuacaccaauauuuugguguacauauuuguaaaagccaauuguuuuauaaacuaacccaaaguaaaaauguuugucuuaucccaacagucaaauuuuagcccaguguagggaggaaaaaaaaaaaaaagcucuauagccugaaaacuauacauugaaccaucauaaaaucacugaaugcuuuaaaugcaucccaaaaaaaaaaugcauccacaucauuuuaucaucuucagcucaauguaaaagcaugcagcaugcacuugguacucaccaggaccuucaggcaugcuguuguuuaccaaugagcauguuuucucuucucucuaggacuaccaguuuacucaccaugcguuguguaucgagcggccaguguaaauagucauuaacuuagaaagaaguaggacucucugggucaugaccagauucaauuucugaaauuuggaauguaucuuucaugaaaauaauauucugggauagccuacaaacauccauuuuguccaaaauagagcauaccuguaguauacagugauagauaaguguuaccuuguuuuauccaguuauugcaacagacauuuuaaaucauagauuaaaugaggcuuugucuuaaauauuagcacuugagcaaaaguggccauagaaacagaagaggcagaagcgcaugaggagcagcauaugaagugaguagaacacaguggaugcuuaggagcuggaauggcagaugccacuaaaggccuucaagaggccacuaaaggccuucaugccgggaccuguacuccuuuaaugccuguguaauuagggguuaguuuugauucaggaagaaaauggaggagagaauucuacuucauggaacuagacaagaauuaggacaagaaaggaauaaggaaguuaggaauguguaaaagagaaggaggggugugaauugccaauuagugauuauuugucuggcacauuaucugucuuagaccuuuggcuucacuuguaaaaauggaacaaugauuuuaauucugucuuguggaugguacaagacugaauaggagacugcaaacacauaucacugcucucaguaaaaauuaguaaccacuuucauuguuuucauuucgugacagguuccagugagacaagucagccuaaguucaugacccugggugggagaauuauuuggcugacccauagauggugcuaguagcacaugggaugcuagaauggugagaggcuagacauguugucccuaaggaagacagaaguagguuguagcagcuccuaauguccuugguuggagaguuaaucucguuggucaagcacuacacuuagaaugagcagugagaaaagguaaugggggggugggagggggguagaugcagugaagcaugugugugauaagggagucuguccauccagggcagauaaaggacaagaagacaaugggaaauuugcucacacagugcugacaguucagcagcacacuuggggaaagcugggcuauuugacgcuaauguggauauuuacugauuguuuugcuuacuggauuaaccauucugucuuuuucuuucucuuuucucuccuuccuccaccucacccucuuucuuguccaugugucucugccuccaccuuuugcauauauagugucaaaucuuguuuccaaaacauggagauuugcaagcgccgggugaauauguaugacacagugaaccagagcaaaacaccuuucaucacucacguggcccccagcacauccaccaacuugaccaugaccuuuaacaaccagcugaccacuguccacaaccaggugaguggcaggcaccagggaaagguggguggggcuaaccaucaggacucagauaucccagauaucccccuccaaaccccagcagucuucccauguuguccuuuugggccuggaagcuaaagugccugcuuccucagccuuuuuuuuuuuuuuuaaagaagccaaggggagacguuucuguuuugacucugggacugagauggugccucuucccguuuuccucugagcaaauguggggaaaaaagccugcuaagaaauuguagaaccagagcuagaggagucccuccuugcacccuguguccaugcugucuguauucaggagaggaaaaaccuguucauucucuaugucauagaaaagccagcucauaggucugucaccggaguccuagcagcucuucccaagggauacaggaagcugagcuucccuucacguggauuuucaaccuucugcagauuggcaggcucagcaacauaggacgaugucugaaauacagacagaaaauacacucagaaaagagcuacugaaugaagacucuccacaaccugauucacccaccucuagacucagaggcuugaaccguuacucccaucuuccagucuuauaaguccccaaagaagcauucccagacucuccagcccuaauaccaaucuguaaugacaacaguguccuuuguguuguucauaccucugcauaaggacauacaccuucagagcagaggaauaaguauggaaaccuacugugugaaugcagcagcuggcuguccacuuuuguuggcugguccucucccaucacugaggagucacuggccccugccuucagcacugcucuuauucgccgggcuuuauuggccuguucccucuuagcuugaauucuaguugcuaacucucucugcuaacucucucugcuuagacugagugccaucuggaaucugcugcccccuggaggccaucaguguuccugacgcuaucuguccagugaaaagcucacacuuagugcuuagggucaaagacuuuucuuaccagcccuucaacuagcccucaaguuaaggccuuuccaucuagagcuucucaaagcaaccacuggcgcuuucuucauuaccuugaggcuuguuuucccaucaguccuuaggagacucuuaauccuaacgcucuaaccucaaauucuucguucccaucugccaucugucccuuccaauaccaaucuauguaagacagcacacaggaacgggcacuccucagaucauguaugaggucagcugacucccccuaccccaccagcccuucuauagaucucuuuauagccaucagacugaggucuacaucagagcagcccaccuccauguuuccugugauaugauagccucacauccgucccaaagaguaucaccaaaacugaaaaucacaauggcaggucccaaguaagggcaccucccuucuccaugacacugagacugcaagguugcuagguaggaccagagugaaaaaaaacggcugugaacuuagugugauguaggccuaagcauugagaagaugaagugcuguccuacaaaacuaagauccagagagcaaaacucuccaucaucugaacuuggaaguguuaggcccuaauuagauauaucagaaaaacaaauuauuuggauuauaaccuagacuuaagcacuaaggcaugcuuccccuccucugauacuauuacaaaguggccacacuucuggcaggaagcauugggucagacuuuucucggcauggcaccauucaguccucccggcauccauguggaaugcauauugucacuguccuuuagaggaagacacugagauaaagugguuaauccucuuaacaaaggcuauguuaguacauaugagguaguuuggguuuggacugcagcagccuggugucagggucuguacccuugaagcacacacacugacucacagaugaauccuguggagauccucagccaguaccuccuagacagccucugcucucuaagugcaacaaaacucccuuuguacacuaguaacccagugcuguguuuacuccacgggacccuggaguuuugcucauccugaacacugaauguuuaaaacaacaaaauucaccuacagauugauguuaguggaaggauacagaaugaguucuuuguugcucuuaacauauauccaguagacuagcacuuuucaaagugcucacuaaucuguaauuguuuaugucucaagaaagcugggccaauacaucauaauuucuauguacuuucaaaaaauauuaguaacauugaguagggaguccuuccugcguguucuugguuuaauucuuaaggucagccucguuauuaacauuuccaaggugucuucuuuuagggauauauccuucuaccaagaauuuuaacugaacuuauagguuaggcuuacauccuguucuuagagaugucaacaauugaaaugucuauuacaacuguauccaagaaccacuugggccuaucuuugcaacauaaguuaccagugaacuuauuuuuuucuucuuauuucucuuuguuauccaaaacagcucuuagaaccacagaggacaggguaaaagucacccacaccaucauacauacuuucaucagcugaucccuaagcaggaucagaaacugagggaaacggucaucaugccuacuggucacucuggggacuggcacucauaucaugacaugaguuccacuccuagagaagcaguacaugagcugaaaacagauccagauccagguuacacacauaaagucagucaggcagacaagcagaggaccacaaguccuccccuacgaguccuucucccaaggaggcaucaguuagggugcugaccacacugcccagcacacuguggcaggcguugagccacacagucacagauuacuguacaagaacacacaggaauagcucaacucuacugucugggaaaguucugcuuuggagcccuggugccaaggcugaccccaaagcacagaggcucagagauaacucugugggccacaggauuccuaugagaugaauagccuauauucacaguaggcuaggaaaacaacuagacuaggaagguaccuaagggucuauagaaaacaaacgguaccaggucaagaugcauacacugcacucaugaggcuguuacuggaauuuuuacccccauuuuuuauuagauauuuucuuuauauacauuucaaauuucaaaugcuaucccgaaaguucccuauacccccccccccugcugccgcccugcuccccuacccacccacucccgcuucuuggcccuggcauuccccuguacugaggcauauaaaguuugcaauaccaaggggccucucuucccaguucuggucacuaggccaucuucugcuacauaugcagcuagagacaugagcuccagggguacugguuaguucauauuguuguuccaccuauaggguuguagaccccuucagcuccuugguuacuuucucuagcucccccauugggggcccaguguuccauccaauagcugacugugagcaaccacuucuguauuugccaggcacuggcauagccucauacaagacagcuauaccagggucccuucaucaaaaacagaugcuuauguacaaagcagggugcuaaugcguaaaguggucuuuaagagagaaugauucaaggcuggagagauggcuuagugguuaagaacacuggcugcucuuccaaaggaccuggguucaauucccagacccauguuguggcucauacauaaccuguuguaguaacccacaaguacuauauuuacuggcuaaaaaaaaugugucccuguguucucacuugucaguugcugggucagcacaggcuagaaggauauguaaaugucugucucuuccucaccugccuaaaacagaaaggcaggcugcuguggggauagucacacagaccucagugcugagaggcaacccagaaagugggcuggguaucguccugcugcugacugauuccaacuggaggaguaaagaguguggccuucugcagaaugaagagcugguagagcuggggcagacugaccaggcagaaggacagacacaggagacagaaggaagagcaggagcaggcagggagguagagcagagagagccacacggagacagacacaaugcagagaaguuggcuuaagugagaggcuaacccaacugccccaacaaacaggccaguuaaaccucaagcgggacccccgaguuccccucaguaauaaccaucaguaauuccaguuccaggaaaugcaauguccuuuccuagcuucugugagcacuaggcacauacaugguacacagacaaacaugcaggcaaaacacccauacauguuuuuuaaaaauuaaaagagagaaaaugauccugugcccaacuacugaaagagaaguagagagcagggacucacuggccaggggcuuacagguccugggcgccagagaacaagaagaaacagcccauuguucuagggauguuggaaggcagaggcauggggaacagugacugaucagaggaugggaaagcccagucagaugggaagagauuggugccauggccuccagcgggagacccucggggccugagcucauagugucugagaugacaguggaaaugugguaagggagcugccaggaagaauaaugguggggaaaacuggagcuggguguugucaucaguauagacaccggcuccuacgugugcaugcauguccccaccauacuuccaggaggcacuacagggacugcugaaaaugcacacacaguuaaauaugcagcucaaaaucuaaaaaaguaugccauaggaauugguaauaauuuucaaauaaauguguugucuuaaaccaaaauccagcacaaaaucuaaguauaaaaagcaaaguaggacuagagacauagcucaguaguggaagugccuaguguacgaaaggcucuggguuuguuugauuucugcagcaccacaaaaaaauaaaaagaaaaagagggcuugacauuuuuaugaaauuugauguuaacuccacuugaaauucucuuuacauuuguguucuuuuacaugggacacuuuccuuuuaguuucuaacaaguuaaaaguaguucccuacucccacaagcacccccccccaaauauuaaaguguauguggccaaacauaugugaacauuuacucagagcccaccugcuccuuuaacccuuaguccuuacaaccucuaaagguacaacuccuucuagacagcuucagucugaagccauugcuaacuucugccucucuuugcgugaagaaggcuaaggagaaaaacaaaugaauucccaacaaagaguuugcuuuccuucuacagcuuuguuuucauuagaaguucaguuucaaaagauagauccugauauuugccaucuacugcuuuuacaguggcagcuccuaccgugggcuuagggugucugcacacagcacugcccuuagucugagcaagaggcuccuugcagacugccugggcuucccuucugcuacauaggcuuccaugcuaagaucuguuuacauaggacccaggccugaggaccaucuucaaugauuuguccuaccaagcauagacuacuuuacccaagggagaggagacugagcaggguuugugggcuggcugcauaguauaagugcaucugaaaccccucaaguuggaggagccaagcuaagacauggagaaggaggaggggcuuagcuuuuccugcccuccccagcaucacauuccacugucaaaucaaaggaauauaaaggcucucaaaccaaaccuacccagcugggaugaaaagagacguucauuaaacaauuuuguucuguuguuguuguuguuguuguuguuguuguuguuuguagcccugguaagccucaacucaguauauagccaaagaaaaccuuaaacuucugaaucuuccagccucagccucuugagugcugagguuacaggaauuugccaccauggcuguuuuuaugcauugaacccaggguaccaugcaugcuaggcaaacacucuacugagcuacauucgagcccccaaccagaugguuuccuagacuaagcuaacuucucagaagugaggggugugggucccacagacaugaggguucagcuggauuccugccccucuuuuugcuuuuuuugcucuuugguuuguuuaacucuccuuuaaauucauuuguuugcuuuagauucgugucucccaacauaccgccucccucauuuuuuauuuuuguuuauuuuuguuuaauccccaucauuccuuuaggcucccaccaccuccagugccacucuuuccuuagccaaucccgaagucuccauacuaaacuaccaaucugcacucuaccagcccucagcggcauccauggccgcgguggccccgcggagcaugccccugcagacgggaacagcccaaauuugugcccgaccugaucccuuccagcaagcucucaucgugugucccccuggcuuccaagguaaggcuaaacugcuucuugcaggaccaccuuuagggcucuaacuccugcuucuuccuggagugcuccugucagggaagaaagcccuuccuaagaaugcugcuauugcugacuuuggaggcuggacucguauugccaccaaccuagaaacaaugcggcuuaugcuccaguaccaaguccauuuguuguuguucucagcaccugccagcacuguggcucuagccagcugccuguaaagaggcgcauugucuaguccauuguuaugcugaugucagcuccagcuuuccucacaugaaaugcucucuguacgguaucuguagaaaauugccagucucugacagccagcauaggcucacuucauguagagaauauaaauuugucugaauggugccucccaaggccaugaucacagagcuccuuuccuguggaccugaagcagcuagagaugacuguguaccuugucacacuuuacacagaaagcucaaggucacauaugcucagauaccagccauacaaccuagagggagcccuccaagggacacgauguccccagcacccuuugcugugacacucaguuaucuccauugggcagcaaccauuguuuuccucuuguaauuugucauuuuaacuguccugguuuuggccccacaugcuuugcuuuuggggaggggggagggguccuggguaguaggggacuccuuuuaacuuguuagaaacuaaaaggcaaacgccccaagacuaaguuguaaagcuagcuagcugccuggaagggucucaguguuucugucauucaccucccuccuguuccucgcgguguacugaacaggccugcaggccucucccuccaagcacgcuggcuacucagugcggauggaaaaugcuguccccaucgucacccaggcgccaggagcucagccucuucagauccaaccaggccugcuugcucagguaauucucuucuguguugcucauuuuccaucauccguguuaaugcuuucccaaaagacauauaucuuuacugacucccuggugaggagcagguggaauuugucaggacauuggaauaugucaguaauguucuaaaugauccccaagugaauuaccucccuaagugucuagugacaauuccaagaagaaauuuagauagucucagagucuagggaaauuauuauuguacguuuguaaagcaaauucaucuaggaaaccuagguuuuaauccuaaaucugcuagcaauucucaaugaccuaaggcaagucaguuaacaucucuuugccucaaauuucuuccuuguaaaauagaaguggcucuuagagucaaagagcccuggagacuaugcccucauuuguagagcugggaaaaccagacaugcagaagcugugggcugggaccuuccucuuuuauccauauagauggucugacuguagaauaagaucacaaagauaaaaaaugaaaauguagccaggcagugguggcgcaugccuuuaaucccagcacuugggaggcagaugcaggcggauuucugaguuugaggccagccuggucuacagagugaguuacaggacagccaggguuacacagagaaacccugucucaaaaaaaaaaaaagaaaaggaaaggaaaggaaaggaaaggaaaggaaaggaaaggaaaggaaaggaaaggaaaggaaaggaaaggaaaggaaaggggaaggaaggaagaaaaagaaagaaagaaagaaaggaaggaaggaaggaaggaagaaagaaagaaagaaagaaagaaagaaagaaagaaagaaaaagaaagaaaauguauaaaguauuacaauuuauacuaacaguacuggugcaauaccagaagucaguccuuaaagacacuugauccaauggcaaguguauuuucuuuaugccaggcacuuuacaguuaauuuguuuaauccucacaacauuuuugccauauauuugucacuacuugaccaacauagggacuugcugagagccauauagcagccaggugugguggcacauacuugucauaccauacacagcuuggcugaggcaggaggauugugaguucuagaccaggcuaggcuauauagugagucuaggccauccuacaccaaacaguaagaccugucuuaaaacaaaaccaauaacuagaugucagaaccaucagaaccaagacauauucuaaacauaugacacagauguccauauuuucccaccaucuuagaccacuucugugucaucuuucugcucucgggcaucaagauggcuugcccuguuagugucggcuuuauguuuaagugagggaguuucccaaaagacuuccccaaauuguucucagaauaguuuguuuauagaaguguuuuuccucguuuuaaguuauaggacgucaaauugcauaggucuguccuuggcucucuuguaguucauuggccucucuaauauccagucuucacuaacugugucaugguaucugguagggaauguucuuuuaaguucuucaauuuuuccuuagguauucuggucucuuuuaauuucuauaugcauuuuauuuuauuccauaauuuauccauaaaaagaaaaagagaaaaagagagaaagaaaagaaagaaaaggaaaggaggcaggcaggcaggugggcaagcgaacuuguggggcuagaaagauggugcaguaauuaagagcacugucucuuccagaggccccaggcucaauucccagcacccacaggguuguucacaacuccuacucuaggggauccaaugacugccucuucugguuucugugggcacagccacacacauauugcacagaaauauaugcaggcaaaauacccauauacauaaaaauaaauaauaaaugcuuuacauuuuguuauauugauuuuauuaauuguacucauuuuuugcuuuuagucuauaggaauauagcuaauuugggucuauuaggauuguuauguaguuagccuucuguuuuugugaauccuuuugaauuugccuuguagacaagucuuuguaguuccaaauaauaguuuuauuucuuaaucuuggauccuuguacuuuuuucuauuguuuauauauccugggccaaguagggcagucuaaaugauguuuaauaacagagaaaaucagggaucuuuuacuucugucuaguuugcuuucuaaaugaaguuguuaaagcuauuuccuacuacacauuuuauuuccucuaaguaguuaauagagacaguuugucauauuuuaauuuuaaguaaauauucuauauaucaaauguacuuucucaucuauuugaauaaccaugugguuucauucccuaaucuguugauagauuuuguaguguuaaauuauccuuauacuugugagacacauuauuugaucaugugcuucauaugauggcaugccuuucugagcucaguuugcuacuacugugauuaguaguuuuucaucuguguucauaaaugcaaaauagcaugauuugccuuucuuagggagcccuuaucugauuugagaacacuuugggacaaccuuuugggaaacuaccuuaacaguuaaguugacacuuauaggucaagccauccuugacaccugacaggagagagaugauauggaaguugucuaagauggagggauucuagacaugugucucuuuauucuuauaucuaaacugccucugcuuaaguggcagcaacacuagcaacugguggcacacaaaguugugugugccuuguugaaaggguaucaacagagaaccugucuuuaaaacaggcuugucuuuuuaaaguccauuguuauuguuguuauugcugcugcugcugcuguauaguucuguggugaggaguucagaaaagaccacuauaaaucaaagaagagaccugcauacagaucaguugagggucaagacauuugcucacccuuuaucugagugucagaaguccagaccagccucccagugagccuggaaucuguagauuucccuguauauuuucaaagauuauuagagaacuacacacacacacacacacacacacuuuuuuuuuuuuguauuuacacacuggauccaaguaagccaggagcagcucuguuagaaauacuaagcauggcuugcuagcuaacagagacaucccccauuguucaguugaguggaaccaacaggcucagcauuuccaaauuugucucaguccuuuaaucauaguguggagagcccuaccuccgacuuacaggaaaagaaucucuaguguuagaaaccuucaaguugauuuaaccuaaaucuguaauuggaaaagugaacaacugaaaaauuauguguauaggauuuuaauuggcauaguguuuauaaaaaggaacccuuagaagcaaguugaauauucuccacuagggaauuuguugaaucaacauagaguggagcagaacaaagaacacacccauaaauggacacaguagaccugugugucuucaacugcuaagacauguuucuuauuuuugaaaaaugaacgaauccuauccuguauugcacuggcuaaugguuggcuaccuuuuucuuucugucauuucaucugccccagcgugcuagccugugaaaauggaaucauugucuuuauguacuccuuguaaaggacaaaauuacaguaacucaucaaacuaaguggugguuauuuuuagaauaauaauuaaauauugaaauuuaggccuucauuuuucugugaguagauuucuaggcucucagacaugaaauuucugaauacuguuaugugcuuuaaauguuguccccaaauuugacauuguuuucuucuucugagcauuuaaagcacuuugaggacugugugaagguuuagagguggcccuuuaaauguaucccacccguuacuuucagucucuuccccccuuucucucagcagcagguuguguccucuacagagaaacaagccucugacacacccuaagaaugugcauauggcagagggcacaguuagggacauaugagcgaccuuuuacagaaacccuuacaaaggaaacccuugauacuuccagaaaagucugugaccuccacauuuccaagucccaaaccccaguuagcacgcaaaaguggggagauggguggaacaguucuugacucauuuuuuuucaaggagcaggauccaaaacucccucucacugucagaaucaagucagaaacuuucuuaauguuugauuggagaaggucaagguccauuguggaugcugucagcacuggccuggagguucaggauucuguuauauauugaggcgagaucugucucucuugugaaucuagaccugucuuguuauuguagucuagcuagguauuugcuacaaaaauccuaucuucaucucccaaaugcugaugccugccugacauuuacauggguauuagguauccaaacucuggucguuacacuuucaugguaaacacuuuacccacuaauccaucucccuagccuggauguuaauacuucuaaauuacucuuuaaauguaucucuuccccccccugcccccagcccucuguguguguguguguguguguguguucugucuacacugcuuccugagaaauuucauuuuacuuuuuuuuaaacuguaguuuugaauucuccauuuaugggagcuccuuaucuuguuccauauguacauaucuauaugaaguaaaaugcauauuuuuuaacucuauggaucuuaauuauagaccauuauagaucuugcuuuuguuucaugugaguuucauuuuauuuuugcuuuaaucucuuccacguuagauggaagcuccuguaaagcuccuuuaacugcuuguguauaguuaagacugaaacacuaaggcuggagagauagcucagugguuaagagcccugacuauucuuccagagguccuaaguucaauucccagcaaccacaugguggcucacaaccaucuguaaugggauuugaugcccucuucuggugugacugaagacagcuacaguguacucaugugcaugaaagaaagaaagaaagaaagaaagaaagaaagaaagaaagaaagaaagaaagaaaagaaagaaagaaagaaagaaagaaagaaagaaagaaagaaagaaagaaagaaaagaaaagaaagaaaggggggagagaaagagagagagaaaggaaggaaggaaggaaggaaggaaggagggagggagggagggagggaaggaaggaaggaaggaaggaaggaaggaaggaaggaaggaaggaagaaaggacugaaacacuaaaguacucaguacacugagaaagcugaggcugggaugagcuacugaccguggggcuccuuguggagugacuagaggcaagcccagcgucuuuacuggcagaguccuuauccucaaaugucauuucuguagcuccuuucucuugaacuucuccauuucccuggagaaucgccuagcuucuggaucuggggacaguagacaccugcauaccagggaucuggccugguuucauauguggauuuaucuuggaguaauucaaucugcuaacuuucuugguaauuguucauauguuguuacaccucuagaauauuuuuaacugucuguuccucauucuucuugcuuuuacaaagugauacguuuuauuucuuuacugacauguuagguucagagaaaacaauaauuugccauauuuucuagaccucucugucucaguuuacucacuuaagaaaugggaagaaauaguaguccuuacccuaccugcccaauauuaaguccaaaaauccauuccugacuuaauacugcuugacacacagcaugcuccagccagcauaguggcgcauacccaugguccuggcacuugguaggcugaggcuaggaggaucuuaaguucaagugcagucugcauacauagcaagauucugucucaaacaaggaggggcgggaagcaauauggcuuagcggcuaaaagugcuugccucaaaagccugaugaccugaauucgguucuugaacuguaaaauaggaggcgagaaccagaaucugacucucaaaaguugucuccggaaucugcaugcuuguaugcauucacacaucagacagacauccacaauaguaguauuuguaaaagaaauacuaguuucauuccuaguaguaguaauaaauuauagaugugugguguaauaucaacugaaugagcugauuguauuuguaagcaccacuuucacaguaaguaaaagagguuuuuuuaaaaaaaaaaaaaaaaaaaguuuuucucucauagccuugagguaaaaugcuaauagucaggaauauaggggagaaaaaagaugaccuugucuuaguaucaacauacauuuuuuaaugacauuagccaagacacaugcuuuuuauagaauugcaaaugaguuccagaucacuaagcaguaacaaucuuaacugaaacuguuaaauauaggcuuccaccaugaacccugacuagccuagaacuuacuguguagaccaaguuggccuugaacucauagaaaaccaccuguuucugccaccugaguguugggacuaaagguuugcaccauucauuguaccuagcucauuuaauauuuugaauuuauagugguuuacuaguuagauuauauuucccuucagugagcucaguaaacuuuuuuuuuucuuuugguuuuucgagacacgguuucucuguguagcccuggcuguccuggaacucacucuguagaccaagcuagccucgaacucagaaauuugccugucucugccucccaagugcugggauuaaaggcauggaccaccacgcccagcaugagcucaguaaacuugaaaugcaauuugcuauuauuaauaaacguauagacuuaaugcuuucauuuugucagaugacauuaaauauuaugguaugaucagcagucucuggcuuucugccuauaucacaacagaucaguaagcaaacaagcaauaucaaaauguguaugagauuucacaggccacacugauauccugagaaugaugaacugggaaauggggcagaucugaaauaugcauuuuuauaagcauuaugcuugguaagucuugacuggaaauguagucuuuuauagaacuguuuauuuauacagaaguuaaaacaugcauauuaaacacaugcccagucauuggaacccugaguuagaaaauguuaguuaugucuggcuucauggacagagagaaguauaacuaagaguucaaaccuauugacccauccaagaagcauuucaugauggcccucuguauguccaccauuggucagauguguucaaugagaaucaauuaaugaccaaaacaagcagagaagagagggaggcacagagaauuuaaagcauucugcacauaugcaugcccaccaauuggucuauuaaaggaaaaaggcauaaagguucuucauauugagagguggcagcaguggguuccuccuagucucuuucuugucucugccuugaggaauugaaguuauuuguuauuuaagcugaaugucacaacuaaguuugguacucuuaccacuuucucucacauguaagccaguacuacauagucucuggguuguaaaaagugagaaucaaauccagaagauaaaacucuacaugauaauugauaaacagaagaacugaaucucugaguucaaggccauccuggucuacagagugagugccaggacauccagggcuacacagagaaacccugucuaaaaaagaaagaaagaaagaaagaaagaaagaaagaaagaaagagagagagagagagggagggagggagggagggaaaggaaaggaaaggaaaggaaaggaaaggaaaggaaaggaaaggaaaggaaaggaaaggaaaggaaaggaaaggaaaagaaaagaaaagaaaagaaaagaaaagaaaagaaaagaaaagaaaagaaaagaaaagaaaagaaaagaaaaaccaacaaaugagucaagugugaaaucuaggacacuugauagaaggcuuuccucaucugacccaguuagcucagucuuuugcacauaguuuauaggacaagucaaugaauggauuuuuagacagcuucaagaauaauagaacagauucauaaggaaaccauuuguaagaugaccuaauuccuuccagauuguucuguagcccuaugccuuuuguugccucccuuggguuuuuugaagccaacaagcaguccacacuuuuacacccaucauaagauccagcacagccccccauggauuaaguucuggacucauguaaaccaauuaaguaauuaauaaagugugaugguauggauauccucugucuuacagcaggccuggccagguggggcccaacagauccuacuuccuccagcauggcagcagcugacuggcguggccacccacacaucuguacagcaugcagcugugauuccugagaccauggcaggcacucagcaacuggcugacuggagguaaacagucaaucuuucugggucagcagaguuucugggaugagaguuguguucaccacugacagagaacaucaugugggcuauggcuacuguguaaugggaggugguuuaaacacuauaccaagacagccaaaauucaguuugauuaauuuucuacccaaaacucaguuacaucuuuuaaacaccaguguaauucacaaaacccugcuagguuuuucucagaauuaagucccuuucagaaagcaaacauuugucaccagugaaggaauacagaagagaguccccaaagcccuaagcaauucuagaaaguguucucaugaaguuuugagacauaggugccugucugucugagcuccccagggaaagcuuaacagauaagauagauuuggaaggaugagcucuggcgugcuuauuaagugugccuuuucaguuaacagccugucuuauagaugagagaguucaccuccacagaccccagggacuccagccaccaccugccagcacucggcaucugucuccaacacugcccaugcaccucagcggcuuccucauggacaccugcucugcuguuuucauaggcacuugucauuuucccucuggcccucaucccaacacugucacaaugcccuccuugaccaguacagagccauaugacagcccuccaguuguccccagcucuguggccccugugggauguaccuccugcagaaaguacucccugcuaccuucugauagucugcuuaccccucugagagccucccuaguuccuuuuuggaauauagagcucuuggguucgguguggcaauauauauauaucugaaaucuuaacacuuuggcugagguagaaggaucacaaguuugaggccagucugagguauauagugaaacuaucuuaaauaacuaacucacucucaggaaaagguaggcaaguggcuaguuaguucucugagucaggugucuaguacagcuuucuccuccauguaaaucuacuuucugacaggaggaaaaucccugguuguccucacagcugcgcucugcauccaguggaagcaguuucaaaccagaccaaacugguuuccagucuggcuguguaagaccuggggcagguuauuuaacuuucauggccucaguuuguuuuucaauaaaguggggccaugaugcuuaccucacaggauugugggguaggggauagaggguugucaauuaaaaggcacagaaaagguuuggccugucugucacaugcaguguagcagugccuggauguggcagaaugagcucggcauccucccuucacccagucaugacagcccacaccccacccagacuuuccagggagaccccaccacagcaucuuuuccuuugucuucggcaguuagagcucacuucauuucugcaguauaugugcccuguucaugcaucuuuucuguucugccuucuuucaccucucuuccaucuccacauccucccgaucucuguaucucauugugggucaaagagcauccauaaccgugacuaggaaacaaacaagagaggagcgccagcgccgcccucauuuccaaggaaaaggguccaucuguagggaaauaaagaacagaaagucagcgccacguuccuuuccaaaggccaaccacgucucaaagaccaucaaaaguacuaugaaaugcuugucuuuuuuuccuauuuauccuuucaaguuacaaagauggaaucuaaugauuuuuuuaaaguucaaauaaauaauucuuuagcuuuuaauuuuauuacauguuaagugggcuuuuacagacagaucuuugaauuaaucaccacuuuaaacauuucuguuggaaaacaaggcuuuuucuuaagauucauccaacccauauaguaagacuuuaaaauguaacccaacuccaggaugcaagcugccugcauaucucugugagcauauguaugacuguuaguaauuuugauuuaauacaaacucuauacgagucuagucacccuucaguuaaucuaauuguucauucagcaagcguguaauuaacugaucagcugcuacaugccugagcauuguguuagcuacugagggaauucaaaagaacgcuaaugauuccuaacgccagaaacauauggcucccagucgccaaaguuuguuuuucacauuaacuacaauuuccucauuaauaaaaugguguaucuacgacauccugccuaccucacaaaguggaauaaaagaacccauugaaguugcuuuguaaauucuaaaacaaaagguauguauuacuguucagcauaagcaccugcucagggauuuuacaggucagaggcuacucaucccaucucucuagagcuuacagacucugacucuacacacuugacauucuuuccccuugaaagucuugguucuaacucaucagccaguacuccuacuucaacacaggccuuccagucgacaggucugccggagaagcgucgucuuauuaaagaguugaguucuauaaaaccacugaggugccuuuuguucucguuucucguucaggaacacgcaugcucauggaagucauuacaaucccaucaugcagcagccugcacucuugacuggucaugugacccuuccagcugcccagcccuuaaauguggguguagcccaugugaugaggcaacaaccaaccagcaccaccuccuccaggaagaguaagcagcaccagucaucugugagguaggugaugagagccagcaagaaacaccagaagauugaaaugcuaaacaccacuuggaaguagggcuugccagugcacugcccuggccuggugcagggagcagcucuuccuacaagagcugggaacaucuggcagcacauggaacacucuggaauuugcuaaaagcacucucucugggcucugugccucuugacucuuccuagugccugucccucuggcacucuaagguggaggccuagagucauggugcaccuaaugucuugagugcuucagucauuuuaccaaagaaaaaguaguuaaagcacaguaaggaagauuuuauuugagaccacagggauggauacaaagaugcugcaguggaggagaaagagugggcucagcucuacacauagcaugggcaucgagaguuuguacccagggaguagugucuaggucacauagggaaaauagcagauaggagauggcagaaacuggaggauuguagcuaaacaacccuaacaagauucucugaaggugauuagccaucaccuaagggagagugggggaggaggaaucuggucagacauuaggucuaguauucuagauaucaagagaugggaagaguguccucuagcuaaaaugaauuagcaagguucuuagcuaaaacuagauuuuauaaagaagugcacaguugagccuaugaaaagguucaaaguccugccuaaauuuggccacacagucucugucgucuuuucuagaaacagcaaaccuuugaaguuuccauuugauuacaaauuaucaagauauauuuuuaaaaaucacuaaaaaauguacuuuuuugaaauuucaggucagaaacauaacucauuaacuuaaaaauauguucuauaguuaugcuuaucuuacuucgaccucuuuacuuaaaaggugcuagacucucuaaggacauagcagagccaaagguguauucucucuugccuuuggucuuuacugcaugggcacuaaccaggaucagcaaaggguuugaugggaagaaaagaagguaauuguucccuagaguuaccagaacuuaauauagaauuucaggucaaucagugaaguucucuuugaugggcuagaaagauggcucacugguuaagagcacugacuacucuucuggaggauccagguuuaauucccaaacccuaugguagcucacaaccaucuguaacuccagucccaggggaccugauaccgucuuccuaaccuccuagggcaccagggugcacauaaugcagacaaaacacucauacacaugaaaugaugaauaaaucuaaaacuaauaauuaauuuuaaaagaguuaaacuauguaugcuacaauacucagauuuggcuuauccauuuuuuuuuuaaauuuuucgagacaggguuucucuguguagcccuggcuguccugaaacucacucuguagaccaggcuggccucgaacucagaaaucugccugucucugccucccaagugcugugauuaaaggcaugcaccaguguaccuucuuccucuuacauuuguccuaauuuuuuauugcaauacaaauuaauugauaagccugccaugaggcuuagguuaagauccaaaaaguuuuguuuuucuuuguuucccauugcacauccccaaaucugaauagcuauggccuuaccagaagagaaagaagggaacgcugagccaaggggcaguggagaucacuccaucuguaaaugcuuucuacacaagcacaaagaccuacguuuagucacuagaaccugcauaaaaaagcugagcauggcaguacacaccugugccgagugcugagguuagagacaagcagacccuggggaacuugggcaaucagcuaaaucagugggcuccaguaagggaacugucuucucucaaaaaacaagaugaacagcucuuaaggaacauacaccugagguugaccucuggcaugcgcguguacacacauacacacacacacacacacacacacacacacacacacacacacacaccuguucauuagucuagaaacucuuacaagugucuuaagguagcaguguggcuccauggcuccaggcuagacuaucuaauucaaucccagcacagaauugggggcuaguaauuaaauaauaaaccaaccaucaggaagaaaauucucaccacuccuaaaacaaauaccauugagggagggcuagaugaagccaaagucugggcuuuaguccugaagauugucuuaugcagcuguguuggaucugacagcuaaaauccugaucaggacagcugucucuaaaagaccagcucucaaaaacagguauauggacccaaaccagagcccagagaaggcccagcagagguccuaaccucaguccugaaugaaggccucuagaagcacuguauuuucugucacaagggaggucaacugucaugggcuucagauuuucuccuguggagaugugguaacguugguguuuuauuuuaaaguuagauggagauguagggccagacccuccuuguaaaucguguuguuuugucauuacagaaaugucuccaccugugaggugaccucuucacaggcuaucagcuccccucagcgauccaagcgugucaaggagaacacucccccacggugcgccaugguacacagcagcccagcuugcagcaccucagucaccuguggguggggcgacguggccuccagcaccacccgggagcgacagcggcagacgauugucauccccgacaccccgagccccacagucagugucaucaccaucagcagugacaccgaugaagaagaggagcagaagcacgcccccaccaggugaggcugugcacauagacucugaggacagagcugagauuccaucauucccccgcugaccccugcaucuucauuuucccauguucuuggacccuaagcuuauuucaggagagcagcaaacaauuuugccauacauuuaaaaaccaaaauaauuuugagugaguuuggccuuaaaaaauaguuacaaucccuaaacauuuaggaauaugagacuauaaaaacuaggcucccagucccagcuuaguuuuaacacuuacaagcuuuagccuccggcuauugaauauauucccagcuggucaggaugucucucuuaacauugccuuggcucacucagaauuugaaguaauuauccaauuaaucagaaauuucccuaugucugauuaacccaauccuucaaacugccaguuggcucuauacccagagagcacuacuguuuauuccaaaguagcaauaauuuauuuuacucugugugugcuuccugggucuagggaagaaauauuuauuauauuugugagagugcuaacucugacaccagagccucuuuucuacacuuugcaaccagacucagcaaacaugccuccuuccugagccgccagcucagguggcccagaccguguacagucaccuucugugccccgaggacguuaggccucacagaacccacagucacacagccauacccugccaggaccuuugcauuaggagcgaaaccagggaagaggccccugccaccccaagccagagcuuccagucacccuagugucucccacaacuaggugcagaguuccuuguucauaguuaggcccaaauuguuuauuccugauuagauguaaugcuguucauuauucaucacaagugguuuugaugaugauaauuuucaugcuugcagucauuacuaaauguucagcuaaagccuagucucgcaugcagcccguuccuacggcgugcagcccguucaccuucagguuaaucucaccauagccauuccuacggcgugcagccuguucaccuucagguuaaucucaccauagccguuccuacagcgugcagcccguucaccuucagguuaauucucaccauagccguuccuacggcaugcaguccguucaccuuccagguuaaggcaaggagucugaguuuucagcagugggacuaguauguguguuguuuuucuugcugaguggcucagugugguuaucaguguaauuugauauugcacuguuguguuucugucccugccaucugcuaucugucugagggacagaggguuggugaggccaggcacaugguuuugcaccguaauauuacuuuacauucuuccgccuguuccagaacuggccucacuuuguuuugugacuauagcccccaaauugaguccguguuccauccguccaaaccugagaauguuaagggcuuggucuccuuccagagaggaagacucuucuugccccagacuggccccuggcuuggggaagccugugcauauauuuguagcgcuguuuaagaaaagcugagcaguccugagcacagcuggagaaacgcaaaagcaauuuaaagaccuggcugucaacuagauugcaaugucgcuuuugaagucugagaugugaauugacagcaguucugaacacgaguggcucaggagaggcuugacuagagaguaggagggcaggacagcgagugccaucucugcagcggccagagagccaggaggacugaaagcggaaggaagugcaauguggaacugugucccuuggaggaaaccuaaugaaaugcguggcagcuugugagaacugugauaaaaaugacuccgaggcccagaguaaagguggacagcaaccagggguaggugacaugugaggaaccacacccugaacacaggggcaugauacauaggaaauacaggggacugcacugcagacuaaaccacaaagcgaugguaaagggccucaaccacccacccuggugacagggagcuugcagaggaagaugcaguagugauacuuacugcagagauaugauuguugccuuagaaaauaguucaggacccaaaaagauagaaaagucuaguugaagccaauagcucuuaauagaaaaaccacuguguaauuguaucacguaaccaugacuguauuuaacaacuagaaaguaaaggaacuuacgauuauguguucuggaaauuguaauuaccaugaaauuuaacacagugacuauuuaccgccccaccauuguaagacaguauggcuggaacuucaaguaguauacaaauaaggggacagacucucucuucuugaggcuugcagauaauaagcgugacaagacacguacaaaucacucugacaggaaguagaacaucuccuccagagaagcuagcgaagucucaggagaguuuaggagagaguugcagacuuaagugaggugacugauguggcagagugccaaaggggagcaaacagagugucccagaagcaagccuuauccaagagaaggaagaauguuggaggaaauggggugggcaugggaaugguuuuugaggcauuuccccuuagauggaaaugagggauuugucagaaggcucgaagaaguucaaggaaaagcaucaggccuagaaaaccaagacuauacuguuugcaccuaaacaaaaaagcacuuggccaugggcuccaaagcugaacagcauccccuauccucccgcuuucuguucaagcuuuggagacacucugaccaguuacuuuucuacuaugguaaaauaccauggccaaggcaacucacagaugaguugauuuggggcuaugguucuagaggguuagaauccagauggcagagcuaaauccgucagcaacaggaagagcugagagucuacaucucaaaccacaggggagacaaagagcacuaauucaaaaccauaaauccucugaaaccucagagccuuccuucagcaacacacuuccuccaucaagguuucgccuccuuauucuccaaaacagacaacuggggaucaaguauucauaugcccaagacuuacuggggacaucuuauucaaagcaccagucucuaacucuggucauccuugccagcaaaccacauuucuccugggaggugagcaucuugauuguucugucugaaccccuccuugcugcuuaccccagaucuagcauuugaggcgcccagugugguccucaaaugcugcuuguuucccaguguggcucaguccagugugguccucaaaugcugcuuguuucccaguguggcucagucucugcacaacagcuaaagcaucaagggucacgaacacucacagggugaccacagagugacuuuuagcaucaacauaagauaaaugauaagccacauauuuaggccucacugacaaugucacucaaucuccaaaacuagauggcauugccuagaauuguuaaaagaauaucaagggaagaucuugaccacaaauaugggcacuguuaguugccgaagcaaauggccgggcaggagaauccacagcauguagagacauggggcaggaugaacugaagggaaccguagcagaccgcacacaguuuacugcaguuugcuugucacuucuauuuccacucaauaaaugaggaaacuacggcccaagaaagccaagugaugaggucagauuaauaaaggcucaagaaagggaauuuggauucauuccggaaguauuacaccauugaugaaauuuuuuuaauaauuauuucucuuuagucauuaacuuuacaguuauuaagucucuccuucaccuucuguaaccaguccccugauagcauccaauauaugcagggagcugugacagggccaugaggagcugaaggcauagguaccagguacucuagagugcuguggcagucucaggagaugggcagaaguuuaaaauuugccaguguugcguaacauuuuaauaaauguguuuucucuauuucagugguucacuaguagacuaggggacuuuucuaaucauggcuagagaguagacauaaaaacagaaacacuaaacaauaagcauucuguuuccuauauuucccagaauuaaguagaaccugccuauuuuaaguguuuuugaugagggaagcauuucaucaucucugucuccuuuaacauggaaucuuguugaucaguguuuacaaagauguaucuguuuaucaagauccucauaccuaacucaccuaugcagacgcagucuuagagaagccaugacgugcaaacgccugucauaaggaaaacuuuuaaguaucugaucaaagugauucauugagcugauuagcauaagacuuuuucuccaggguccguuauucccaugccuaucacugacucacugggugucccucucuaguagaaaaggugggucacaggguacuucuacauuccacacuucauaacacacaagcagauucgugagggcuguucagcuaauguugccaguagugucaccucuaagaaaaugggaucauaaauaucacaggaggcuuuagauaagaaagcaauguccuaagucacucuuaaaauauuuauauauauuuauaaauggagggcuaggccuguaguucaguugcuuauccagaauacaugaggcucuggauuuaguucccacccccaaaagaguugacacaagauauuuugcuucuuuguacuaaauuuaaaaggugguaaaauuauuucagauaagucacagucugaaacuauuguucaaaugacuucugccugaaaaauggacaaccagagaaagaaaaacgacauuuauuauuaccugagcaaagaggucagccugaauuggaaucucuuugcacugacaccuacaacaguggaaccucacugcccuccuauccugguuaagaagccccgcacaaccagcaucagaaugugcuccuggccagugacugccaacuagagggagggaacccagaagccagacucacagcgccauguaagggacguuugugcucuaacacaugccuaaguuggaaccuguuuguccugugacucagccccagcaaugggagccguacacucagccauccucagugcaucuucaucacaggcuuccauucaaggcugaagggcugcauccugaaaaggcagcacugcaaccugucuguccccagcaucguauccucaugcucuaguauaccacugccacacugauguguggcagccuccucuuuacuccucaccuuccauagcuggggcuaugggcaccagagaggaauuggaucugcucuggcacgugcucaacacaugggcuuaauguaccgcagcccaagccagcugagucagacugguugaggaagagagagcugaacuaacuacugaagaaaggggaaggaaaaccagcaccuccuuccaggccccuuucugauguccuacagaguggucaugugaaggcugaccuuaauguagacagaugugcaagugaauacauacagauauagauaacagagaauaccauuugaauaaaauauauggaccauacuaaaguuguggugaauggaagauagcuuaguuggcaaagugcuugccaugcacgcauaaggagcugaacaugaaccccagaacccacaugaaaaacuugagcaugguagugcaugcuuguaaauccagcccugggguuacaaagacaggcagauucccugagacacaguggcugacuagccuagcuuagccuacuuggcaagcugcaggccagagggaaaccuugucucaggaaagaagauggacaucuccugaggacacugugcuccucaugccucagcacacacacacaaacacacauacgugaacaguaaacaaacacauuuaagguaccguuucucaaccugauagcuaaauuaaaagcuauagaacaucaaaaggaggacuuuagucugcaggcucugcugcuuauccuccucaguaggagcagguuaaaaguaauccacugguauuucugcucauggggaucaaagcaguaaggcuggcugaacccucaugucuuauuuccuucagcugggaaacucuccauggaaaucaccccaugccccagaaagccacucuuaacaaaugggcccuggagacaccagaaaggagcguuugccucauuuuacuguugcagcauuugcuaggacugucacuggggaggcagagggccaugucgcguagugauuaagacugcagauggcuugaucuaggacaagcgaaggaccgaaacccuccuuaucugcagucauccucuacaagaggaaaguaaucacugucuuuaccguguaguccuguucuaaggacugaaggaaauaacacaaacgcagcacuuugaaugguauguauuugaugugugucccguguaugccaucgguguuggaauggaagagcaggagguugggguuuguuuucacauaugguauuuucucugaagucaguggagauagaggagucacggaaaguuuauuggaggagaugaguuuugaccuuggucuugaaggaugaaauugacugagauuagcaaauagaaaucagaacuacauuccagaagggacccuacagggauggaggggucagaggcuugcaccugcuccugugccugucuuuccuccucugcgguucauuucuauacuucuuagcuccuuauuucccuucaucauuuuaaaaugaugaaaaucaucuauugccaugacaacacaauggagucucgagcucuugcagcuuugcuucuuauucagaaguggugucugucaaggccauuugagcaaauaugucucguuccccuccucccucccuccccccccccucucucucucucucuuccauuaaccagcucagaaugggauugauaaacugucaauaauaaucacagacaaugguggaacgaguccccgugguacugacauguaggagccugaagaaccagcagugccaaucucagaggugugguugguuuuuaaagggagcuguuuagcagcuccccacuguucucuaaucuggguaguauguuuaccuaguacgcagauauuucuagcaauagacaagaauagaaacagagcuaucacacuaauucaccuuucccaaaccuaucagauacaaaacuguauaaaaagauacaauguuaagcugccgugugauuuugcuuguuagucacgggacuucccagccacagagaaaaguaugaaccucaggaggaguuuggggagcuucucugcccccaccucauuccagauaacaagacagcgacagguagcacccaguuacagccacgcuucccgcucccacgggacucugcagaaagccuuccuucauuggcagugugcuaguucaugagguaguguagugugccuucagaaaguucccgcaguuaggaaguuuuaucugcauuaaacgggagcuucuucgggcuggagagauggcucagugguuaagagcacugacugcucuuccaaagguccugaguucaaaucccagcaaccacaugagaauucacaaccaucuguaaugauggaugacgcccucuucuggugugccuucagcuucaguguacuuacauauaauaauaaauaaaucuuuaggccagccagagcgagcggggcuggcuggagugagcaaccuucguucccagcaaccacaugauagcucacaaccaucaguacagcuacccauauagacuaaauaaauaaauacauacauauauaaaaucugggggggggaccaacuacagccucuccauaauuagcaaaucaggguuacaaauuccaaaugggcacaauuuaaauugugucugaggucagauuacaguuuggucaaaauuaguauuguauguuguugcuuugcuugcucgcuuucuaaauaauggauaugaugagggaagggaggcucagcaggaaauggccaggaccccgugcauguguaagucccucucgcugaagagauuuguuuucucuugacaugaacaguagacuggauuuuaucuugaaugucuuucauaauaaaucucugugggauauucaaaaugggcccuuucauacugcaaauacucucucccacuuucccuaguaauuucagagugggucagggcuagguggaugguacagggcugugguugcccagggucccaccuggcaagggacagcagagccaaaacuagaacaccauuugcagggacacauugggagccaaccucuaucuucacauggguccuugacuuacagaucauggcccugcagcagaacauauucccauuucaggagacuguaaaaggagccacuguguuugggucauuuaaucaaguacaagugacagugacagaagucuugagugaagaacagaguagcacgccuucugcaucccccuugggaacuuucccggaaugaauucccagcuccaucccuggucccagaagcacuauguaccugugcaggugggagggauacuccacagccaaccacaggacaucaaacaguucugcucaggaccagcgacuacucccgacacacagcaaagagcagcaggcccuccccacuccccagcuuucacauuggcuccacaucgccauugcuuuuccugcuauccagguucaugaacuuguuccuggggacucgcucucuaauucuuggcacagauacaguuaccuguagccccugagaucugcugaggcagugcuacuacagcgcccaaggcaauaucuaucgggggagcuuuuuauuguggauaaacccaugggcuuuuuaaaauuagaaauaauucauguauuguauaauccaccaauuuacuguguacaguucacuagggagauugcacauuaguuuuuuaaauuaugguaaagcaugaaauuuaacauuuuagccauucgguggcacugauugucaccauuaucuauucuaaaacuuuucugucauucaaacccaauauucuguauccacuaaauaauuuuauauuuuucucugccuacccuauucuccagaccucugauaucuguaaccuuuuuucccuuuugaaugaguuugccuauucuacauguuucuuguguugacucaugcagaauuugugucuggcuuauuuuaagugauacauaggguucauauaagaacuucacucaaagguuuggagagauggcuggagaguucagagcacauaauacccuucaggagaccuaggcccauaucaggaggcucauaacugccuguaacuccaggucaagggcaucccguugucucuggcuucuguaggcacuugcacacgugcgcacacacucacucucucacacacacauauacacaacaauuaauaaguacguaaauaugaagagcuguaaaucuaugugaccaguucauuccucaccuucuuuuggguucuuaacaauugucaucuggaagaguccuuugacaguucaucgugggaggcugugugacauccguuauucuaacugguuacuuuagagcuuuuaccguuuaacuugucauguuguaauacagucucccaccgagcuuuucaucuucaaggacagaggcgugcuucuguuucucugcauagcuauucccuguggcacugacuguagaucuccaagaucccaaacuaaugacuugucuuuuucuucccuaucaaucuucgggcuuaacauagaguagacaagaagcuuccucaguaaguccugguaagguuucaugcagagcugcuuucccguguuauaaaagaguacaaguugaauagccuuuaucuaaaaggguugacuugagaugccagguaugauggcacacgccuuuaauccuagcacuuaagaggcagaggcaggcggaucucuaaauuugaggcuagucuagacuacguaguggaauccugucuuugauaaggcuuggaugggggccugcacaggucugagcuagauggggucccagcccugagaggggaagugagcacauggcccugucccuaacacagaagcuguuuucaagugauaaccacuuaggaagaauuagcuccccagaggaaucucacuggugugcgaaccacacguaugggcaggcccgugcccagcaccaaacagccaacacaaaaugaacucaguggcauuuuuggaggacuuuuguuuccuagugauuucucugagcaucuuuuuguauauacuuuacaagucauuugcuuauauauugugguuucugacuguuuuuguaggacuucucuguguggaugagggagugucugcuucuacauuuccucacuccuuucugcuuccuuguuuuguccuaugcugauuuguuuguauauuuuugugggguuuugguggugcaugugugugugugucugugugugugugugugugugugugugagagagagagagagagagagagagcauggguaaugagagagagagaaaagguguggauugagguagagaggaucuggaagaaguugagggagaaggaaccaugaccagaacacauuauuugaaaaaaaucuagacacaugccuuuaaucccagcacuugggaggcugaggcaggcagaauuucugaguucgaggccagccuggucuacagagugaguuccagagcagccagggcuacacagagaaacucugucucgaaaaaaaaaaaaaaaaaaaaaaaaaaacaacaaauauauauauauauauauucucaauaaaaauuuaaauuauuuuuaaaggcuucgaaccaaaaauguuuugaauuucaaauuuuuccauguacuuaucuccugaaggaaauuuuacaguuaauuuuaguaggccuucuuauugacuaccauaucaggucagacacaggucuuccuacuaacacuaccaugucacaacucaaaaaguuuuagaguugggggccuuugggguuugggguuagagacgcuccuccucuauaacacuagugauacuuuaucuggugcucugcuucacaugugcuguacaguaugauacugguucugccauuaccuguaucaucauuguguagacaaccaauucccaaggcccuaucaucccggguucuaacccacagacccagcuagagucuucugcccuaaaucagcaagaacagggagccuggccaccucaggaaugguccagcccuggugucacuagugcuggcugucaggagcagggccaggucccccagagcuuucaccuuccugccucuggagguccacagcccuacugaccuucugcuggccuccugccaagcugccuuuggaagugcccacuuccccacucucuccugagugauaaaaauagcucaccuugaaaagagcccggccugggucugugguguuagguaacacuccugggguacgagggccacuggaaaccccaucagauucuauaaauacuagcuuuuucccauauuggauuagcuggaaagcggcccuccuugccuaggcaauuguuauuucuuaaaaauaaaugaucaguguacaaaaauagaugaacauccauuuuuaaaaccuugcauaauacaccauagguuccacaucugccaucccagcagccugucaccaagccacaggcagauagaacugguucccagaguaaccgcaggagcauaaagcucuaugaaaagcaagugcuagccaagagcuacuccacgcuggcucuucccuguuucuagguaaaguucuaguuagaaaugaagaccaggguuugggagccacuccuugguggcauuagcacacaggagacuugccguuagagcucaagacaguacugucuccugaccuuggcccaggggaugggaacucugcaggaaggcuaggucaucccuaaaaaugaauacccagcggucgguccugggaggucugaacauaaucacucaaauccaacucaauuucuguuucucaacguuucugaaugaugaggucuucagccccucgcccauccucugccccuccagcagcgucccgaaucacugggcaccucuuccuuucucugcugauucucauaggcucagagcccaaacucagggccauucccuccaauuccagcucuccaucuaccugauucacucagacagacuccuguucuaguggucggagggcuuggcacccagcuccacuaacucugccacauggggacagccuagacccaccgcugauugucucacauguuaguuuccagaaguaucagugugccccaggcccagcccagcccagccugcucugccugucuucccaaguacucuggugcagggcccagccaagggcucuucccagaacagguucucuuaccucccagccagccugcaguccuaacuucuuccuuuaacuuugcagcacagucuccaagcaaagaaaaaaugucaucagcugugucaccguccacgacucucccuacucugacuccuccagcaacaccagccccuacucggugcagcagcgcacagggcacaacggcaccaacaccuuggacaccaaggggggccuagagaaucacugcacuggcaacccccgcaccaucaucguacccccacugaagacccaggccagugaaguguugguagaaugugacagccuagggccagguaaccugggaccacagcacagccaugccauuucucugcuuuucucuuucucugcuauuagaaauguuaguacuagugaaacagagcauaccuaauuauuucaggucaucuacauuguacacuugauuuuucuucaagcagccacagugggauucugcuauaucauacauuaucaucauauucuauacagaauauuuauuuuccuuuugaaauucugagagcucagcuguccucuagguggcucugcuuccgucaugguugauaaacaauggaagcaccccacuuucuuaucaaccgguuugaacauuccugacaucuuucuaggguagagcaagugucuggagaggaagcacaugaucugaccuugccgugugagggucaggacuuugccuugggcacagaaaucugagcugagcacauuucucucugccuuacuuaacugacauugcaugaggcuuguccugaaaacggggcccuggcagaaagccagugaccuuagccuuugaagucaggcagcggcucuccgugcucuuccucaacagcagcuccucagggucuccuucacuccugcucacauacaagaacugggaggcuaugccaaagaaucugcaaguuuguucuucugcuacgugcugucaucagccgcagccaggccagguagcaucuuugugacgucagaaagggaccuucuguuugucaugugacauggccaaggugaugccugaaguuacccuggagaauaaggauucuugucuggugguuaccaaguugcugaggugcuguugcucgaggagcuggauaugauuaagaugagaacuguggagacuuuuccagguccccuucugcggccagcuggcaauacuuucccaauauucacagcaagccugggauugggcccuuuuuacaccaggcaacucugccagagaggaaauggaaaggggcuuagacuccuuucucccuuauugucugacugggggugacccaugugggguggguaugcucacaggccucuuucaggcaccccagcuacucucuucagacaucugcccugcacccacugcugcucaucuucaugucccagcugcccacaguccggggaguugaugcugguuuucagagucaguacucggggugagaagcagagugugggcccacagugcccugacuaagaaauaacaugaggcugcugagcugcucaguaaggcggugugcauguggaaugaaccccacgguuauagcucuaauauaaguaguguuccuagaaacacguagcuacugugcuuaccaaacaaaagaacugcaagagcacagagguucucaguggccucucagggugugcuguacagauuaccugugccuaagcacauuugcaugcacacagugcaugacugcgcaucugucccccaggcccacagaagcugcauugggauagugaaggcucauugcaggcccauugccaccucauucaccccaguaagagaaaucacuaccuggaucucuugaccccuucaggcccuuccuacauccaggcucuuccacucugacaguuugaucagcuuaucuugucaccacaauaaugccauagguaggacacugggcucuuucuaacauugccauuuggcaggcacaagcuguaaucccuugaacugauuguucuucuaacaucaucccuacaaaguuucuaggaugcuggacuaaagcagagaucuguugauggucugucaccaagcagggaggagcucaaccccagcacacaagcuccuggugccuagagagacagggaagcucugcugacagccuagacgugcagcuuucuguuugaccucauagcucguccucaaagguccaggguuuggcugagcucugagaaucuaacuggcuuagucugggcacugaguccuaaacauagucugcuucacuggcaccaggaugccucuggacuccugggaaguucaauacaccaauucccaggcaccuccugagagaauucagugcaggggguaguggaagaggccuugggugccagugcacauuuagauucagggacccaccaucuccccccucccagcaaucaaucuuccuagacuugggguugagaguuucuuaagaggugggauguuccccucugucuucugcccacccccccacccccaccccccaccccccacccccgagguauccaguuucccuuuguucuggacccaauaccuuugcuggaacacuucucccauugucagggcuugucuugggcuuuacaaccccgacuucauaacccuggaacuugucaaaaaguugaucuaucccaaaucauucaaagucuuuuauuauacaugguuccuuaguguguagugccaccugucccaagauaagauuuagaccuuauuuagucaauuccagaaacucaaugaaggaaaugaaucauuagcugcaugacacaaugugagaguguucagauauccuugugcugguggagaugagggacuuacugcuuccuuaaagcaugcugucuccccuugggcaaagcucuuagagaaucgccaccaccucgagcuccugucucccaucuggcauuucguuccugccuaggcuggcaccuggggcaaugggaggcagcuguccuuccacuccaaaccaaagccauuuucuucucaacuaauucuucuuuguucuuuagcuuuuacagaguagaaugaauauauuaacuguggcuuuuaaagcauacaacaccaauaauacaauucauaggccucuuguguuccuucaggcauuugaaccauagagcacagaggaggugccuggggccuucucccucacauguuugccuaggcucuugugcagguucuagggacaugcaguaucuccucaacugugugccugcuuguugcuugccuauuguuggcucuuggguauuguucaguaaagagccuauagcuuacacaggucuggugaucuauaauaccaucccagaagaagcagagacaggaggguugcaaguuugagggcagccuggguuacaugugagacccuaucacaaauaaaagggaggaggguuguggccuguacaguuagaugcuuuucucugcaaaguaucacucuuacuuuacucggggugauggucucacccugcccacuggacagucagagccuguccugaccaaccauuagcaucucccuguauccucuaccucugccucuugccuuuaugcuuugagaugcuuccuaguugccacucucaccccaucuguuucccaggugguacauguuacagugucaggcaaacaguaggcucuaauaaagcucugggcucccuuggccagguacuuaaagccaucugauguagguauugcccuuccucaaucuccuacccauuaggcuguggucuucucacccaggagcaccaaucaacucucagaauguguuaugaugcagacucuuaugccacccccagcuacaggucuggaaucacagugaccaaaguguagagcaaccuccuggcugggcagagucucuacauugccaguaacauaggaacagcaguuauguuaugucaggccguucccugggagaguuagucucauccugucugaggucaggagaaccgcagccuucuuguaacuucugcugugugcuagguccagccauuagcaugaucacaucugauccucugggaggaaaccaggcaggccuccucccuuccacacaccucccagguauugcuauaacacuucccccagaggaccagugagugugggacuagcguaggccugcaccuuuacccuugauuuugcuucuccucucucccucauuugcagcucaaauauaccaugcagccaagggccagagcccagcugccucucuagagucaaggugaaugcccaacuaggucugggggcuaagugguuuaugccuggacagucuuaggaacauguccuuccuggaaggcugcuguugggaaagggagggagcacaucuagacagccaagggcaugcgacugaccuguauggcuggucuuccucccucagcgaucagugccagucaccauucguccuccuucaaguccaaguccuccagcaccgugaccuccaccaguggacacucuucagggagcucuucaggagccaucgccuaccgucagcagcggccaggcccccacuuccagcagcagcagccccucaaucucagccagguaaaccccaguggccacaggagacagugcccuuaacgggccucauuggcuuauugcuacccuagaccaacccugggaaaggcgguaucuuguucgcagagagccaggccaaagcuaagugacaguacuuaguaacguggugguaggacagaccugcuguuaggagggcccacauggugcugugucagcccagcaaaagguggacaugcuggcaugcuguugcccuggcccgccaggcuaucccugaaguugccuugcugcagagguccucacagccagcacccagacccauggagggagcacccggagacuugcacgcaugccccgaaaugcgggaucuuuacaggagagagaguuacugcuugaacucuuucuagaagacccaguucuagagugagaucucccaugaugugggaaggcagucagugagagagaguccuucucccccuucagccaagugucccagcuuugcucugagccugcugaguagcacccuagccuggugauuggccaaacagacauuacuuucucaauccaaacaaaucuucaagcucucugcuuuugaagggaagcaucuguugucacuccugcuucuccuucuguccuuccucccccuccucccccuaaugcugucucugcugcuuuuccuucucaggcccagcagcacauggcugcggaccgcaccgggagucaccgucgacagcaggccuacaucacuccgaccauggcgcaagcuccguacaccuucccgcacaacagccccagccauggcacuguucacccccaccuggcugcggcugcccaccuccccacccagccucaccucuacaccuauacagcgcccacagcccuaggcuccaccggcacuguagcccaccugguggcaucccaaggcucagcacgccacaccgugcagcacacugccuauccggccagcaucguccaccaggucccugugagcauggggccccggguccugcccucgcccaccauccaccccagucaguauccagcccaguuugcccaccagaccuauaucagcgccucgccagccuccaccgucuacacuggauacccacugaguccugccaaggucaaccaauacccuuacauauaaacacuggaggaggcccgccagggaggaggguggaggagcucccagaccgaccuggagagcugggauuuucuacugcaggugccgcacacaaacaaugcaauggggcagggaggggggcagucggggcacaaaugaaacuugaacuaggaagugggaggacuuagagcggagaagagaccauuguaaaaggagggguaaggaggggaaaucuaugcuuuuuauuuuaaaaaagaaaaaggaaaaaaagaaaaagaaaaauguuaguaacaaaagaggacaaaaagaaaaaaacacag

SEQ ID NO: 12361 - RNA, 71817 nt, Mus musculus
ggccggcaggcgggcaggggaggaggaggaggagcgggcgccgugucgcacgcagcuccaggcggggcagcccgggcgcugagggacgcggccagaccucggcgggccccgcgagcacuacacgccgucgcccgagcgucggggggcgcccggagaugcgggugaguagcggcucgggccgcgguggcgggaggcagcgcaggccacggcggagccgcggcgucgcagugacucgggccgcggcguccgagcccgggcugccggcgaggccugaggcgccgcgccgcggcuaggcggaauggcggccgggccggagaagucgugggcguaggacgccgagggcggagcggagcggccaggcccggccugagucacccggccggccaggcucggccugggccgggacucgcagggccaggcccuggcuacgcacugggaaaaagccggacucaccgcggccuguggcgccgaccucggcgccucacgcgccaccccucccuuccccucggcccuggggguuccgcuuggccgggguggcucagggccgggggacucgugcucucggggauccgggggcacucauuguugcgacggugcggggcaugauuauuggguaacaguggugccgggcuccguucucucugggagcguggccgagcaaggcgcgccgggaugcggugugcuuuuccaaaggaacggagcccccgggcguccgccagcucuccucagucgaacugggcccucccugugcggcggccucggcgcguccccggucccggcgggagcgcgcgcucugaccccaaagguaacccggcaccgggccaggaggacugagucgggggcuguagacucugcgggccucuauucuuaaaucccgcguggcccugagaacccccucuuucugucaccugugcacuguguuguuacucaggagauaacuaagaaagcaaggaacacuugcacucucauuccuugagccuaagccccaaaguuaagggagcuagguaugccaaaaaaggaggauuccccuuuucugagaggucacuguugauacuugugguuaguucacagucguuggggguuugugggacgggcacgcaugccgaaaugcagucaaguuguucaagugcuuuuaguugcccuguguguacuugcucuuugcuggaguagcauuaaaacagccaaaagcuaagaauggaauaaaugauuacuguuuuagaaaggcacuggggugacaaaagaggaacuaagcuccuuuuacuucaauuuuuaggaccuaaaccuaacacucugaagaagccaguguaguugaggaaaauaaggauaugaggucuuucuuuguuugagaaggcuuuaagauuucucuuuuuacuuaaaacuuguauuuguugcuucccauaguaaguugaaacaguuauagcucauuuuaaauucugaguaugcaacacaacacuggcuuguuuuaucuucuauucugcccauuuuuggagguuuuggggagcauuuacuaagccuuaagccugggagaaaagaccaaagugcuuucuaaaaaugcuaaccuuucucuuuccucccuguuggcaucaucuuuaaaaaacuguuuugcccaaaagacaaccaauuuuagauaggcuaggguguuuguaagauacaucuuuccugagucuuauggucaggcccuggaagguguggcccaaauuccuaguaugucacauacaucugaagucugagcuaauuuggccaggugucuuuagauauuacauagacucuguuguucagggaacuccaccuucuugcgcuaauuaauuuugucagugcaggcuuauuucccauacaugugacuaugaaaucauugaagacacagacuaaguccuuuacuuuguaacccucagauaacagaacaugaucuugcugguaccaugaaugauuuuuuuuuucuuuuuuggacuaauccuaggguuuuacuacuccccuucauuuuggcugcagaaaacauagucacuguugcugcugagcuuguuaaaagugcaaguuuacuauuauguugcaugcuucccuagagugaaaacuguuauuuuucuugugucccccuuccaccugcauaacuacauacuguauccuagggaaaaaaugguugaggguuucuuuaguuguggaaaucuaaacaguuuguaaaauuaaaauuaaucauucuaauuuaaggagucaguauuuuuuuaaaaaacaaguuuguuuaccccuuugccuuugaaguaaagccgguuaguauuuaaggcuguuaccugcugggaagauaguccagcccaguuguaccaaaaguuucugugggaggauaagggaccuucauuucagcaaggaaaauuauguuuaaaugaacaaaccuuaagucaaacaauaguuacuuggcauucuuaagauuuaauuuguuagggccccucaaaguuauaacugucuugaaguuugagcacuucauaagucccaaagccuagucuuuuuuaccuuucccaugaagucaugggauaaauugauuuuugagaaucagugguuucauuuugaacucaucuuuuagguaugcuuggaggaaaaagcuguuaaccaucuauuuuaaaggacaguucuaaauucaucuuuuaaaaaagcauguaugugcaugcaccacagugcacgugugaaagccagaagacaaacuucauagucucuucucuaucuugugggucucagggauuccguaaacuuggcagcaguuccugagucuuggcagcaagcaccuaagguaguuuuuaagugauaccaucuaacuucuaaguucuuaaaaugaguggauuccaugggaacauaaccaaugagacauuggagaacuaccuuauagagcauaguauaucauuucauguuugaucaccaggguuauguaaagucuugauaguauuuuuuuuuucccuugggaaaccuggacagaaggaagauucugcucucuggcuuccacucacgcuucagcuugauuguacuucugaucuguucugggucuuuuucuuaucacuuuagcucaggcaucuucauuuuaggaaagcuggucuugccauccugucuaggaccuuucccuagguccucauguugucuauguuguuuaugucauguugucuauggaucuaucccagugcuuaacauucugaugacacuuggugguuucuucuauuagacugacuuuaccuaggggcagguggaacaaaucugacucuaauaccuagcacaaugcucaugucaaaaucuauguacauccucccacuucagaucuuuacaaagccacgugaaguguaaguacugacauuuagcucuccuuguagaaaauagaaggguccuggacuuuggguaguuuucaucaagacuaugaagguguaaagccucagguaggagguuagagcaagauggucaucccagaguuugaacuuuuaaacaagggacucaccuugaaagugauguauaugaaauuaaaggaagauuagcagagauuaaaaugaaagagucuuuaaggauugaugucugaccauuacaacagaauucaucauacauaauaaguaugguugguucccaagaaugaguuucuucuuccugguccuucagaaaacacuagagaguagacagugaugguauaagcauaaacauuuguagaacuuuggggcuauuguuaaauuggguguaauguuaugauucauuggccuugcaaaaaaucuuaaauccauuuaauaagcuaauuuuuuaaaggccugugucagaaaauacuuaagaaaacagacuaccaauuuaaguauguguaaaguaugcaguggcuuaaguaauuaaaccacuguaaaauaguagugauuuuaggugaacuugugucuuuuaaaagauuuuuauaaaaaaauuaguaacaaagaaaguaucaauuucaagucucagguuugagaaacuuaauaccaaaaauagacuuuaaagaagaacugauuacuucagacuuguaaaacuuccuuaugguaaaaucuuguaaacaaaauaaaaggcaaaugacaaacuaagaaaaugguuuuacaugcaaauuuauuuuuuauacuaucaaagggggcuuguagacuaaugggaaaaagauuuccuccuaugguaaaaaaaugggaaaauuggaauaggaaacaugaaaaauccugagcuaaacuagcaguauucccagaaguggagaucuguaauguuuuaaaauaagucacuuuguugagaagauggagaaguaugccuacucauugcuaaaaagaauauaaguaaauauaguuuuuuagaguacauuuuuuuuaaagguuuguuuuauauaaguacacugucaccgucuucaggcacaccagaagagggcuuuagaacccauuauagaugguugugaaccagcaugugauugcugggaauugaacucagaacuucuagaagagcagucagugcucuuaaccacugagccaucucuccagcccauaaauacagguuuuuaaagaauuugguuuuguguguaugaguuuuugcaugcacauguguauacauuccauaugugugccugggcccagagaccuugugaccucagaggguagaagacaacauuagaucuccuguaacuggaguuaaggacugccauguuggugcugggaacugauccuggcuucucaggaaaugcucuuaacugcugagccaucucuucagccccaauuaaauauuuuucaagagcaaaaaguguagcagagacuuucaaaaugauguguaguuugaaauagcucaccugcuuuuaaggaauuuguuaacaauauaaaaaggugaucaauagauuagugauuuuuuuucccuccuguauucuuaucauucauuuucagcuugggguuauuauggaugacuauuccagcauuguuuagguaaauccuugcauuuguguaauacuauauugaauauuaaaguacaaagauacuaaaaauuaauauguauaaaacuuuuuacaagugugaguguaugcauuuuggaaaguaaguacauguuagugauuaucuuuaagaagugguucauuuuaggguuuuuugugcuaauuuuacuauacugcauauguuuuuauagauagacaacugggaauaaaauauagugaguugguuuuucuuuggacaguuuuuggagcaagauguuggggauugaacccggggaagcuucaaagucuuuguauguuaggcaaguccucuacuacuauuucccaggacagugagauaauuuucaaaagcauaaauccuaagaaaauaguaauagaagaaucacugucaaggaagaucauucugcuuauucaaugcagaguuacuugguuuuugauuuccuuuccauguguuaauagguggguuaaaugucugacuugguagccugauuccaguggucaaguucuccuuugucuucuguucucauucauucuugugucauccuucacauuccugccauuaaacagucuuaaucucaugacgcucaauauguuuugauauuuuauuauuuauuuaaaauaaccuucauaggggaaguuuccuuuuccuuuaaaaaaagguguguguguguguguguguguguguguguauguguguacacauauauguacacaggcaugccaccacacaguuguggagggcagaggacaaacuuguagcauucaguucuugagauuaaacuuguaaagucaccaagccugcaggcaggugccuuucccugaugagccaucugggcagccgaguauuccuuuucuuggugauaauugaacuucccaauuuguuuugcuuaguucauaacuccuaauaauaggagauacauuuuaaguugaauguuuaaauuaugaugccuccauuuauagcaauaaaacuuacuaaaaauuaauuacuugacacaguugcucgguuuguuuaaucaguuuucugugaaagauccuuuaaauuagaaauacuaugggaguuaggagaagagagauauauagaaaugugcauaaaauguacagaaacugucaccagauaucaauggagaaauaccuuugguauacaaaauacacuagagucucacuaaaauagcuaaaauagcugugccugauaggcaucuuaaagucacaaaguggagaaaagauacaagaacuuagaucuuccuuccugggguuuggaaaaaggccugcucuggucauacuagaaggggagguuugggauccugcaugagcaugagguugguaagccauggagcagacuccccaguuccaaguggaaucagaucccaggcuuaccuuuaggaaguaugagacugguuugggagagagauggaagaggguacaggguaaugaacuucucccaucuuaaggauugagucuuuaaguuuugcuuauggguuaauguuaaaggaacacugauguucagcauuaaguuugugccacagacuuuuuugacuacaugccuuugacuuacuggcugcugcuccucagcuuucuccuucuuguaauuaaaugccuuauacuggaagaaguccaucuuuguuguccugguuuugacaugugccacaaaaauguauaaugcuaaucaucauauagucuauugaggugaaaagaucuuauuuggugaaagaaauuaugcagaaagaaguaggucacuauuaucaggggccccaaaacauacagaaagaagaaaacucauaaccgguggaguaguuuugccuguuagcauuucaguguuagcuuuguacauguuuuguacauaauugacuuugccuuguacagagauuuuguuuuguuuuuuuuguuuuuguuuuuuuaaaaaauguauauggguguuuuacugcauguauguggugguuugaauaagagugacucccauaggcucauguauuugaaugcuuagucacuggguuguggcacuauuugaaaaggauuagaaggauugugagguauggcuuggaguagguguggccuuggaggaaauguguccauacugggggugaacuuugagguuucagaagcccacaccaggcccaggcacccagcuccagcaugcucucucuccuccuuacucccccaccucuguuuguggaucaggauguagcucucaauacuucugcaccugccuguauaugcucccuaccauaaugauaauggacugagccuggacacuaaaccagcccuuaguuaaaugcuuuccuuugauaacgguugccuugguuuuggugucucuucagaacaauagaacaggaacuaagaaaauaugugcaccguguacaugccugguguuaaggaggccaggagaggguguuaaauccucuggaacuggaguuaacagcuccaccauguggguucuggggaccaaacuuugguccucuggaagagcaacaaguguucuuaaccagugagcuagcccauuuuguuuuguuuuuaauaaaagagaucacuuuggauauuccaaaguuuugauuuguuuguuuugauucuaauacuuuauaaugaauagacucaucaaccuguuaacugcuuuuucagaauuaaaauuuuuuuuccuugucaguacacaugcaaaggucagaggacacuuugaggaguuguuuuucucuuuccaccauguggacuugaaaaucuaagaucaugaggcaaguaccuucaucugcucagcuaucucaccaaccccuugugaauacauucuuagugcugcuaaaacuaugggggaagucuggauuuuguaguuuuauuauucuuuaucuuuaaaaaaauaaguguauuuucacauggaaacauggauaauggauuuuuaaagcuacuugaagaugagcuugaaagccuuucuugagcaauacccaaguaagugaagcaaguuacgugacagcaaaaauacugaaauuguugcaguuugauuguuagauguacuagggccuugguaaugguaggaaaguaacuauugagcuauaauuuaccuccagcccuuuuuauuucuuuguuuuuuuccaacaugcucccugccaaaaugucucuagaaauuauauguguuggccuugaacuaucucugcagcuuagguuguccuuaggcugcagcuuagguuagguaagcuuucuuagcuuccauaguagcuggaauuaauaggucuaugccauuaguccagucaccagcaugguuuaaguuuaguccccuacuuuaaaguacagcaguaaagacaguguguggcuuuguguaacacuaguuaaaacugguauaagaauagagaacaugaacaccuuugcagggagagugugcuuuauguuuauuuaaaauauagacaucaguguuguuuaguuugguuuuugguauugggcauugaaucuagggucagacuucaauuauugcagaugagacuuuagugugucucuucugccucucaacaguacuugcaauccuagcuugaggugggaggaucacuggagcccaggagugugaggucauccuggauccaguuaucgcuaggaacugguaacuagaaauccuaguuaccuuauauuucgacagauaaaaguaagcuaaaaaugauuuguaauagaaaaggaagacaugaaucuugauuaggaacagguacaguucaagaaaaaucuccagcuuuuacaaaauguuacaagcuuauuuguuugaaaaacauuuucuaaggggaaguugauauugcaagauguuagucuccaaaacaaaacccaaagcagguugauggcaucugaggggcacuuaagguuggccucuagcuuccacauacgcauggacaugauggcuuuuuguaaauguagcaugaccacaugcccaaaacugggugacagaagaagguacaccaaacuuacuaugaacucuugggugcuuuuaagauuuacuauccaaggugcucaucagaaugggccaagauuggugugcuugaccucucauuucuuuacuugaggucaauacaauaguaaguugucuucaaaucaaacgauguagaacuccuuaaaggugguucuggugugaagaucuauaaccucagcuacacagcaggccaaggcaagaagaucacaggucagguuaagccccagcaacuuagugaccugccucaaagugaaaaaugugaacuauguuaaggcugcagccaugugcaauguacaaugcuugccuaguguuucaugaugacuccugccacaaaaaaggaaagagaaaaauaaaaaccaaauaaaaaaguguauucucuucagcuaauuuguaguggaguaggaagauugcuugaaugauggccuaaguaaggagaauggcugaugaguuuucagaccagaguuagaugaguucuuuuagcaaaauaaaaaaaagagugaguuguuugguuuuuuuuuuauuuuuguuuuuuuuuuuuuuuuguuuuuuguuuugucuuuaauugaaaaccuugaagaggugaugaauagcuggauguuuucaucaugaugugccacuuuaaaaaucuuauucagcagguaguuucucggaccuuguauccacuggccacagaacaaaguggucacugcacaugagaccuuuggaaauugaguaggauuuguggggacuaugaguugaaguagaguccauugcugcagucaucacaugcuuguacuucuuagcugaagcaguuuucauggacaagccuaagugacagaaggagagagacaagggaucauuacaagggaccaguacaacucuacugggaacauuuugguguggauuugggggcaguauugacucuguaccaucauaucaaaauauuguggaauuuaauggcagcauuuauuuacuucauuuugccuggaaagccaguauuguccccuacaguaaaagcucagcagugaagagaucuacuagugaguuguggugaggauuuaaaguuccauaaacacauuugucuuugaaauacucuuguguuucuaauaaauaguacuggagacaucugcaucugaaaugcuuagugcucuggguacaucuuugacugucuagaauagcuugggaugggcaguccuuuccaccagcuagauuccugaacucaauaaaaaggagaaaguuagcuaaguauagacuuucaucugccuuuguuuccuaacuguggcuucagugugaacagcugccucauaccugccaccaugccuuccucuucaugauagacuguuccuuuaaaagauucagaguaaagccuucuuuccuugggcugcuuuugugagaauauuuuauaacagcaauagaaaaaaauaacaagugcaauacauuuucauaauaaccaaaaauaauacagguauaauguaaacccuacuuaauaaaacauugauuacccaaauagcaauaauuauuaauaaauaaaacauuuaauauuaguaucuuuuguuuacuaauuuuucuguccuguagaauacaaguguguuucagaaguacgauaaagaaacuuaacagugaacuucuaauuuccuuuuuaaggaaaauuuuacaaacacaagaauaaguucacccuaggacugcucuuguguuuaauggauuauaagcauuuucuaguaaaugcacaugaguagaaguuuauggguuuuaaggaacaucuucuaccacucuuaaguuuuagaaggaagaaagcaaucaauuguggggaggguuccuacuauguccaagcuguauuuuuacccacaggguuguaucuaaucuuuacauuaauucugagaauuugauguuuacuuucccucccccaaucuuucuuaagaugaaacuuguuuauauuucugauauacagcaugauaauuuuuucuuuguuuugugguagugggguugagaccuagggccucaauauaugccagaccagagccccuaucucugagauguuauacuucagauccccuaaaaguggcuaaauaaugaaaucaaguuauaaauaauuuuaauaaccacauauuuauccuuuuguaagaauuuucaggauuuccuuuuagcacuuuucuuguuucucaguauguauccaguauguuauuaacuacaaucacuaugcuauguaguagcucuguagagcuuauucaugugcuaugacugaaacugaaucccuugaacaaucccugcacuucucccuuccuguacgcuccacacccuguguuuaguuuuuaaggauuccuuuaaaaugaagucaauaagaacuguucacuauggaaggacccaaccguuuugacuucuaggugaaucugcuagucacacuugccauguuuaucuaaucagcacuugguguguauguucaaugccaucugguggugagcugaguugggggucacaguguugagguugccaaaaggacuuauuuaagugaauggaaagcagaaaaagaaacaugcugcagcagaauauacuguuuuguaucaggcugugaaaucauagucacauaaauucagcaaggagaugcacagaaaggacuaauuauuucugaauaaaguaugugguuuauuuuugguaauugaggcaugauaguuaucauagcuacccauuuauuuguaaguuacacuugcauucuagcuucagaacucaaaacucacaucucauucuagugcucuaguggaguaagcucucacaucugagauguucuggggauccuacugugacaauggucucaggaggggcagugucugcuucuguuagcaucaggaauccaccauccucuucuuagaauuguuuggagugggcugguuuccauuuuuaccugccccaugaguauuggagauugaaccuagggccugugcacacagcacucuaccacuggcuauuaauucaucugaaguaauauucuuuuuuucuuucuuuuugguuuuucgacacaggguuucucuguauagcccuggcuguccuggaacucacucuguagaccaggcuggccacaaacucagaaauccgccugccucugccucccgagugcugggauuaaaggcaugagccaccacgcccagcuugaaguaauauucuuuaaggucaccuaucuccagacacuuacuuuagucaaugacuuuuuccaaacagaucuuuuuguugauagguggucaaccuuagugcuguugcgcucaucacacuguaucuggcacagcacaggaaauccuauggccugguggcuuauauugugaguaccaguccucauaucuauucuuuuuuauauacuuugagaauauuguccaggcugaugccuguacuugugcaguuuugcuuauuucuugaggugugguuuccuuucggcuucaguuuuauguuuuacucuuuuacacauauuuauuuugacauuuaucaugacacaccuauggaggucaguggacaacuuucaggaauugauucucuccuuuuaccauaagagcacaggaugaacaaacucaggucaucagggucagggcaaggaccuuugcccacugagccauuucacuggcccaguuuuauauuuuuaaaaccuguuugcuugggcauuuucauuuuguuguucuucuccaaguuaauauauguaaaauuaagacccuuuaucuccauucuugcaucaugccucuucacguaacuuauuguucauacaugagaacuuucaaaucaaguguucaguuuaguacugcaggaaguuucacagaaacuaacagaccacuaacaggugucuaaaugaucauuuagccggucuagaauuguuaugaaguagcauacuuuugaaugccauguuuguuuauaaugugguauuguuaggugauugccuaaacagggcacaguugguugagauaauacugguagcuguggucugaaccuguuucuauaacucuuaauaauuuuuugaauuuuuaaaauuuuauuuguguguuuugccuguauguaugugcaugcaucacaaucaugcaugguaccugaggaggucagaaaggauguuagcuuuccugggacuggaguuucagaugguugucagucaucauaugaguacugggaauggaaacuguucucugaaagaauagucaguguucuucugagccuuugcaccaugagaaauguucaaguguaacagaccuguccaccagagacuuaauauuuacuucccacuuaaaagguaaugaguggauucuccuguaaucucaauauugguggguauaaaugauacuggaaauaacuguagcuagccaagaaaaucacaaguuucuuuuuuccuuauacugccugccugucugugccugucugucugucuuucucucucuucccccugccccaacccccuucucuuucaagacaggguuucucuguguagcccuggcugucuucaaacucaaaaagaucagucugccucugccuccugagugcuggaauuaaaggugugccccauuacugcuuggcugugucuguggccagcauucauaaucagggaacugucacauuucagacagguuaaugaaaaucaggauguuguuuucuucuucauucacaaugucccugaauuuaucuauauaugagugugaaaggaugcauguggguucauauggaaaucagaggauaauuuucaggagucaguucucuccuucccugcaaaagacuaucaauuugucaaaaacaaacaaacaaacuaaaacaaaacaaaaccacccccccacacaaaaaaaaaacaaaaaacaaacaaacaaaaaagacccugaauucaggccaucaggcuuucaguacuuuacuucugagcuccuuuaccagucucaugccuaugaguucuauccauggaccccacugaaguuucuuucacuugaccuaguuugccaagcuuccuccucugaagcuggcuuuuuuuuuuuuuuuuuaaaucuuucuagaaacaaaaauauacucguguccguauguugguauuuguucuucccuauacauagaaggucuccugcuuugaucagcuaaugucuacugagaaaugcuuguguggucaguacccagaggcccuccucauuccuuugcauaauugcauaggacaccaagguguggacaggucuucuuguccccugcugauggaauuuuuuuuuuuuuuuuuugauaaauuacuaguguuuugcagugacuaaacuugaauuuacaacuucuuggaauuuuggccuguuuauuugggggagagauuccuacaaauggauuucugggccaaagguaaaauguuuccguuuuaggaagaaaaaaagccaacuuuucuaucauugaacauuucuacuaguuagaacaaaguugcacuuuuaaaaaagauuuacuuuuauuuauuucaaauuauguguguguaggggagagguaugugugcauauuuacauacaggugcccuccaaaucuagacgaggcauugucaaaacccugauugugcuagaaacuuuggaccucugcaagagccccaaacacuguuuauagcugaacccucucuccagccccuugaauguuaauuguuauugucuguucuggaauugaaagagaaauuguuggagguuugaaaguaccaaucugcgauagccauuguugucuuucagucuuuaucugugcuacuauuacacaguuuauuuaccauaauucuuacuuuauguuucucaucuggucuuuguuuuucauugcugauguggguauugagacaguaucucaauugucuuguuaaaguuccuguuaguuuuacugccugugucugcucuuaggucaaacuucacaaaguugucagacuaaaaaaaaauuuuuuuuuuuuuguuuugguuuuucgagacaggguuucucuguauagcccuggcuguccuggagcucacuuuguagaccaggcuggccucgaacucagaaacccgccugcuucugccucccgagugcugggauuaaaggugugcgccaccacacccggcaaagccuuucuucuugaucuuugugcccagacaagacuucuuucccuucugaacuuguauucaacuacuaucacuaugucuuuaggucuuuaguaggaugaugaacacauacacacacacacacacacacacacacacacacacacacacacauauauaugaccagugaguuuggguaauucuuggaaauuguauuuuugcuuguuuguuacagggcaagguuuuaaguuggagggcucaguaauuugacuuuuagugguagguuaaagcauguauauauguagaaccaaagucagcuuauagagauguucuuguuucuguaaaugaacaaaacaacucauaaaaauuuaaagcuagaguguuuaaguuuagucucauccgcacccccaagaauucauuuuuauucuaauguguagcaauuaaaauuaauacaaauguuugucguaaauuaauacagugacuuuuuuuuuuccuuuauccuagcuaguuccucaguaaugacacagaccaagauuuacucaaucaagcuguaucacauaaaaccugggcagucauugaucuauuuuaauccucuaagcaaaucccugagauacuuguauuuuaguacuggucuggcccucuuggcucuagauguauuuucccauaaugucuccucucucuuacucuucucucuccccccuuacccuggcuagcugaaauccugcccuauucucucuauugccuaguuauuugcuuuuccagcuucuguugauaaggcagagaauaaaugaugaacauuguuuacacaaacuugagacaggagauucuugacuuaagcaauacaaugcucuauccagauugcagcuagauaugagggcagagaaaucagcauuugaguaacucaaagauaaacuuuacagagugcacaauaacauuauggcuacacuaguguaugaauauuuugccuguaugugggucuggugcccaagaauuccagaaaagggcauuggaucccuuggaauuagaguuaagagugguugugagagcuauuugggugcugagaaccaaacccagguccuaugaaugaacagccagugcucuuuacugcugagccaucucuuuaguccuucuuuccuccuuaauaacuuuguuuaggucuuguauaucuuaaagcacaccuguuuaaauuuauaauuagauuaucucuagggaaguuaagaguuaugcagccaaggcuacaucuaauuuagaauguuucuacaaccuaaaagauuucugugccuauuugcagucauucccacccuggaccuaggcaaacacucaucuacuuuuaaugucuagagaugcuuuuauuuaaaauugguagcacgggggauaaaacaguauucuaccguugagucacugugucaguccugauuuaauuuuuaugugcuucauaucauaguuguuugaauagaaguuuccuuucauuuguauuuaagagagauaauuuaaguuuuaagugagaguuucaugagccuugaauuucaguacuuuacaaaaagaaugcugauuuucaaauacacagguaguauuuacaacauaccaguuucuguucuggugugcuuaaauggauuuacaaaauaguaaaaauuacaaauaauuacuaaagagucaaacaaaaguuuugaauagauuuggaaguaugaguaaaagucaaggcuguguaaugaccugcucacuugguagcaguguagacuugucugcaccuguaccaugaaccuucucaacuguauuuuugcaugguucuuuugggagcacccaaugcuaguuguaauauugacuuauaaguaacucuuggauacaggcuccuuuagguagugaagaggcccaccuucauaaugaagcaacauguggcaggggauagaauauagauuccagaauuucaauuuuuagguuggaaucuuugacauucaguaauacugaguuugagcaaauuauuugaugucgcugaaccugagguuuuuuuguaagauguagauggugucaucucugggggcucuugaguuuggggcagcaaagugagauccugccucuaaaacaaaacaaaaagugcuguauaggcaguccaguguaauaaccuauaguggauuuuaguuucuuuccuucugugggauaguucuuuaugguggagugguuugagaaugguuggggaggugguacaucaaaagcagguguagaagauuaggauuaaaucauuuaacaaaguguauauuucucuacuguggagauuuucuggggcagcaguuuagaaaguugauuagaagggcaagaugucagugagagcaaugaagacccucaauccagguggagguagugcccaaccucuaguagucaugggugugaagagacugaauggauuuaagagauaacugaaaaagcuaagauuaauaaaacugacuuuauguuucgauaagaacaauaagaaucaaaaugacuucucuuaccagggugggaaauauaaaaauaauauuuauuugauggaugggagaugaaucaggagguuggacuuggccuguaaaagauacccuucucagagggcccaggggaaaagggugugguguauaaguggccuuaaggaaaaaguggugcucucucaguuuugaguugaccaacagagcuuuccuuuauaaccugggaagucagggagaaagaaggaaggaaagacugccaaggaguuuucagaugagauuuugcaaugaacuucccuucauuuuuguuuguguccugagauugggagaguuuaaguauaauggugaaugacuaauuggcagaggaacuugagggcaggccagcauucaggcucuauggcugagguauugcuggcuucuuugagccaaguauacagagaacugucaguaaaaaguagagugcaaauguuuagaaauuuuauaguuuuuaguuuauaguuuaaauguuuuauaaauuuuauagaaaagaaaugaagguagaggccaagggaauauggcuuuugaagagauuggagcauuaaaaauagugcucaacauggcacaauaggaaaaaaguuugaaggcauaagaauuagucaaauaccaccaucacaagcucaaggguaaggaagagugaauucaguuaacuuucccuugaggaguacguuuagggguacccugcuccauagggacaccuuagaguuuuaucucaccaugcuuaacuauguaguacucaaagccaaugugauuuuuauccuaaaggccccagucugacaaauuuugaaugcaugauguguacuuuucuuguguggaaaaaugccugaguaugagauuuuugagcauacacccagacuucaaaggaaaucuuggaaggccaggcaaucagugagagaaugagaagauccuucaguuagcaccugcagugcauaaaacuggaaagucaaguguaacccuguuguuggagaugccaagaacuuggcacauugccaaggaaagcagaggccacagauaaaaucauguuaacauggagcccagguggacuacaguaggaagaucauccagaugugggugcugaagcccuuugacaaagcucuagauacuauacagcucucugagaauugcuuucccuucuagauaacagucuucuugugguccuauccuuuuuugucucuauuuucuuuuugaauaggauuguuaaaaguucugugccauuguauccuagaauuguauaauuuguuuuugguuuuauaggggcuuacagccgaguuugccuugagggucaaaggaaauugagcuuggacuuugaacaguguaggaacugugaagacucuggagaauccuggugaacugaaugcauuuugcauuauuagaugggugcgagcacuuugagugccaaggaagauauguuugggugucagguugaugagaaguagacuugugauggcuagucuugauugucagcuuaauuggauugagaagagcuugugacauuaguaaaccacaccucugagugcauuugugaggaccuuucuaggaaggauuaaucaaggagagaaaacuacuccugaaggugauugguauucagccuugccuagccaggaugcccaauagaccucugaaacuaugacuagcauucuuguucuuuuaaauuaugucagguauuuugucauagcagugaaauagguaacuaauucauuagcuaucacauagcuuauuugugaauucugcuaguagauaugugaacugucuucccuauucauauaaauauucuuauaaauagccaaagucugguauacacauguagaaguuucucuaggucugaauaacuuuacaguacauuuuuuuauguucacuucauuuuuuuuuuuuuuuuuuuuuugaaacaggguuucucuauaagcccuggcuguccuggaacucacuuuguagaccaggcuggccuugaacucaagaaauccgccugccuuuuccucccuaguacugagauuaaaggcgugugucaccacgcccagcgaacuuaucauuucuuuuuuuuuuuuaagauuuacuuuuauuauuauauguaaguacacuguagcugucuucagacacuccagaagagggcaucagaucucauuacagaugguugugagccaucaugugguugcugggauuuggacucaggaccuuuggaagagcagucagugcucuuaaccacugagccaucucuccagccccacuucacuguuuuaaauaauuuuuuuauuagauauuuucuucauuuacauuucaaaugcuaucccgaaaguccccuguacacucccccggcccuacucccgaauccuggcccugguauuccccuguacugggucauauaaucuuugcaagaccaagggccucuucucccaaugauggcugacuaggccaucuucugcuacacgugcagcuagagacacgagcucuggggguaccgguuaguucauauuguuguuccuccuauaggguuacagaccccuucaacuccuuggguacuuucucuagcuccucuauugggggcccuguguuccauccaauagaugacugugagcauccacuuauguguuugccaagcauuggcauagccucacaagagacagcuguaucaggguccugucagcaaaaucuugcuggcauaugcaauagugucugcauuugguggcugauuauggaauggaucccuggguggggcagucucuggauuguccuuccucagcuccaacuuugucuuuguaacuccuuccauggguauuuuguuccccauucuaaguaggaaugaaguauccacacuuuggucuuccuucuucuugguuuucauguguuuugcaaauuguaucuuggguauucuaaguuucugggcuaauauccacuuaucggugagugcauaucauguguguucuuuugugauuggguuaccucacucaggaugauaucuaccagguccauccauuuggcuaagaauuuuauaaauucauuguuuuuaauaacugaguaguaguacuccauaguguaaaugcaccacauuuucuauauccauuccucuguugaaggacaucuggguguucuccagcuucuggcuauuauaaauaaggcugcuaugaacauagugaagcauguguccuuauuaccaucuggauuauaugcccaggagagguauugcuggauccucugguaguacuauguccaguuuucugaggaaccgccagacugauauccagagugguugcacaagcuugcaaucccaccaacaauggaggauuguuccucuuucuccacaucuucgccagcaucugcugucaccugaauuuuuuaucuuagccauucugacuggugugagguggaaucucaggguuguuuugauuugcauuucccugaugauuaaggauguugaacauuuuaccaggugcuucucagccauucgguauuccucaguugagaauucuuuguuuagcucuguacccaauuuuuaaaugggguuauuugauuguucuggaguccaucuucuugaguucuuuguauauauuggauauuaguccccuauuggauuuaggauugguaaagauucuuucccaaucuguugguggccuuucugucuuauugacagugucuuuugccuuauauaagcuuugcaauuuuaugaggucccauuugucacuucucgaucuuacagcacaaaccauugcuguucuguucaggaauuuuuccccugugcccauaucuucgaggcuuucccccacuuucuccucuauaaguuuuagugucucugguuuuauguggaguuccuugauccacuuagacuuuagcuuuguacaaggaaauaagaauggauuaauucacauucuucuacaugauaaccuccaguugaguaagcaccauuuguugaaaauacuaucuuuuuuccacuggaugguuuuagaucccuugucaaagaucaagugaccauagguguguggguucauuucugggucuucaauucuauuccauugaucuaccugucugucacuguaccaguaccacgcaguuuuuaucacaauugaggucaggcauggugauuccaccagacguucuuuuauuguugagaauaguuuuugcuauccuagguuuuuuguuuguuuguuugguuuuguuuuucgagacaggguuucucuguguagcccuggcuguccuggaacuuacucuguagaccaggcuggccuugaacucagaaauuugccugccucugcugggauuaaaggcgugugccgccaugcccgguugcuauccuagguuuuuuguuauuccagaugaauuugcaaauugcccuuucuaauucuaugaagaauugaguuggaauuuugauggggauuacauugaaucuguagauugcuuucggcaaaauagccauuuuuacuauauuaaucuugccaaucugcgcauuccuuuaauccccacacuugggagguagaagcaggcgaauuucugaguucuaggccagccuggucugcagagugaguuccaggacagccggggcuacacagaaaaacccugucuggaaaaaacaaaaacaaaacaaacaaacaaaaauccugccaauccaugagcaugggagaucuuuccaucuucugggaucuucgauuucuuucuucagagacuugaaguucuuaucauauagaucuuucacuuccguaguuagagucacaccaagguauuuuauauuauuugugacuauugugaagggugguguuucccuaauuucuuucucauccuguuuaucuuuguguagagaaaggccacugauuuguuuaauuuuauaucgagcuacuacacugaagcuguuuaucagguuuaggagaucuuugguagaauuuuuagggucauuuauauauacugucauaucaucugcaaauagugauauuuugacuucuuccuuuccaauuuguauccccuugaucuccuuuuguugucgaauugcucuggcuaggaucuucaaguacuauauugaauagguagggagaaagugggcauccuugucuagucccugauuuuagugggauugcuucaaguuucucuccacuuaguuugauguuggcuacuaguuuaguguguauugcuuuuauuauguuuagguaugggccuugaauuccugaucuucccaaacuuuuaucaugaagggguguuggauuuugucaaaugcuuucucugcaucuaacgagaugaucauguguuuuuugucuuugcguuuguuuauauaguggguuauguugauggauuuccauacauuaaaccaucucugcaucccugggaugaagccuacuugaucaugauggaugauuguuuugauguguucuaggauuagguuugugaggauuuuauuauuuuugcaucuauauucauaagggaaauuguucugaaguucucuuucuuuguugggucuuuaugugguuuaugugucagaguaauuguggcuucauagaaugaauuggguagagugccuuugaauaguuugaggagaacuggaauuaggucuucuuugaaggucugauagaauucuguacuaaacccaucugguccugugcuuuuuuuuuuuuuuuuuuuuuuuuugguugggagacuauuaaugacuacuucuauuucuuuaggggaaauuggacuguuuagaucguuaaucugauccugauuuaacuuuggcaccuggaaucugccuaggaaauuguccauuucauccagguuuuccaguuuuguugaguauagccuuuuguaguaggaucugaugauguuuuguauuuccucagguucuguuguuaugucuccuuuuucauuuuugauuuuguuaauuaggauacuguccugugcccucuaguuagucuggcuaaggguuucucugucuuguugauuuuucucaaagaaccagcuccugauuugguugauucuuuguauaguucuuuuuguuuccacuugguugauuucagcccuaaguuugauuauuuccugccuucuacuccucuugggugaauuugcuuccuuuuuuccuagagcuuuuuggguguguuguaaggcugcuagugugugcucucucuaguuucuuuuuggcgacauucagagcuaugaguuuuccucuuaggaauacuuucauugugucccauaaguuuggguaugcuguggcuucguuuucauuaaauucuaaaaagucuuuaaucucuuucuuuauuucuuccuugaccaagguaucauugaguagaguguuguucagcuuccccaugaauguugccuauuauuuauguuguuauuaaagaucagcauuaguccaugaugaucugauaggaugcaugggacaauuucaauauuuuuguuuuuguugaaggccuguuuugugacugauuauauggucaguuuuggaggagguaccaugaggugcugagaagaagguauaucauuuuguuuuaggauaaaauguucuguagacaucuguuacauucauuuguuucauaacuucuguuaguuucacuguguuaaguuucuguuuccauugaugagagugggguguuaaaguauccuacuauuauugugugaggugcaaugugugcuuugagcuuuacuaaaguuuccuuaaugaauguggcugaccuugcauuuggagcauagauauucagaauugagaguucaucuuggaagauuuuaccuuugaugaguaugaagugccccuccuugucuuuuuugauaacuuuggguuggaagucgauuuuauucgauauuagaauggcuacuccagcuuguuucuucggaccguuugcuuggaaacuuguuuuccagccuuuuacucugagguagugucuaucuuuguccccgagguggguuuccuguaagcagcaacauguuggguacuguuuacauagccagucuguuagucugucuuuuuauuggggaauugaguuuauugauauuaagagauauuaaggaaaaguaauuguugcuuccuguuauuuuuguuguuaagaguugggauucuguucgugaggcuaucuccuuuuagguuuguugaaagauugcuuucuugcuuuuucuagggcauaauuuuucucuuuguguuggauuuucccuuuauuauccuuugaaggguuggauucuugggaagauauugugugaauuugguuuuaucauggaauacuuugguuucuccaucuaugguaauugagaguuuugcuggguauuguaggccuggcuggcauuuguguucucuuagagucuguauaacaucuguccaggaucuucuggcuuucauagucucuggugagaagucugguguaauucuaauaggucugccuuuauauguuaauugacccuuuucccuuccuuacugcuuuuaacauucugucuuuauuuagugcauuuguucugauuauuauguaucgggagaaauuucuuuccugguccagucuauuuggaguucuguaggcuucuuguauguucauggucaucucuuucuuuaggaaaguuuucuucuauaauuuuguugaagauauuuacuggcccuuuacguugggaaucuuuacucuauucuauaccuauuauucuuagguuuggccuucucauuguguccuggauuuccuggcuguuuuggguuaggagcuuuuugcuuuuuuguuuucuuugacuguuguguccauguuuucuauggaaucuucugcuccugagauucucucuuccaucucuuguauucuguugcugauucucgaaucuauguuuucugauuuuauucccccuaggauuucuaucuccagaguugccucccuuuggguuuucuuuaauuauuucuacuuccauuuuuagaucuuggaugguuuuguuuaacuccaucaccuguuugguuguguuuuccuguaauucuuuaaggacuucuaccuguuuagcaguguucuccucuauuucuuucuuuaagugaguuauuaaugcccuucuuaaaauccucuaccagcaucaugagacaugauuuuaaauccgaaucuugcuuuucagguguguugggguauccaggacucgcuguggugggcguacuggguucugaugaugccuaguggucuugguuucuguuaguaagauucuuauguuugccuuucaccaucugguagucucugguguuagauguucuagcuaucucugccuggagauuguuccuccugugauucuguuagucucugucagcacuccugggaguccaacucucuacugagucccaguggucagaguauucucugcaggcaagcucuucucuugcagggaaaguacacagaagucuggagcucagauccaccuccucaguuccuggggucagagcacucccuguaggccaacucuccucugguggggaaggugcccaggggucuuggucucagcuccgccuccuagcugaggaugaaggccagaagguacccuguccaagaagcucaguugcuucugcugcucacaugcuuuccugcauacacugaucucagugaucccaagauccuggguguguuagggugcuugcggcauguagagaccuguggggacuuugggaccgucggcugaguuugcaccuaagauggcacggagcucuacaguucauuucuuaaguaugugccacauugcaaguaaaagccaggguauuguguauacuuuugaccaagagauagaaaauaauuuaucgaguaaugcccaggaucauuuaaguuuuuaaucguauuaaaauguuacguacuaaggcugcagagauggcucauuggguaaaucacuugucgcacaguuuuuagaaccagaauuuauguucuuacucccaaguaaacacugguggacuguaauucuaacauucagaagacagacaugauucugagaacaagcuagcuggcuacacuagaagaauuggcaaacuuuggguuuaagugagugagaaacugugccuguuugagguauaugguagagagcaguuaaggaagauauaccacaucaaccuccugccuucauccauauaugugugaacaccauacccaugaauaaauaauaagggaccaaacuaaagcuaaauuuagucuuauuuaaauuuaaaagcaaaauuuagauguacuuuucauuaacucuaggcuuuugucuugcuagguuuuuuuuuuuuuuuuuuccagcagcaaucaaccaaagcaguuguagucuuuuucuugaaaaccccuaauucuuguguuccuguuacaacucugauuugaaucaucucacuuuaacacuucucagcuuuggcuucagcaacagcaucugguaaauguuuuuagucucaguuuauagaaaugaagucagguaugacacauucuagagggcuggaggaagaauugagaugaacacacaguuguuuacccuuaagguuaauggauucugccuuugaguagagauguauuuaaagguguuaagaauuuauauucuuuggugcucagcuuucaggagaaugaugcuugaagagacacauuaaaguuucugaccuuuaaguucaugcaguugguggcucugagauagccaggucuugcagaguagaggcuguccucuuugaguauacagccacuucuccuaggccuguuuauuuugacuguuguguucuauucuuuuuaagacaaaagcaaagacuggaagcuauuguaauucacauaggcuucaugagccaauggguacaacugaguguggggguacaacugauucuuccaucugugacuuguggcaguacuugguuggugauguuuugugccuuagucgccuaucaggaauuugugaccuaugcaucuuccauuggaauuggaaggagccuuuauggcuaggguucccgaagaacacugacuugguguaaggagaucuauauagcugccuuaggugucauuacuucucucacuggcaaccuaaucuacaggcuguugggacuacacucucaaauuauguugcagaugauguguucucaaaaacuuguggaguuuugccacccagcuugguaauccuguaaugccaacagcacuugaaaacagcccgauuuccuaaguguaucuugcuaagauuuuguugaaauuaacuguaaguuggagagcucccaagccuucuggauguguaauaagaaaagaggaaacuuuacuucuuaaacuaucugaacucugacuuaggaaaucugcugaaauuuucagguuuuuaaugacuuagauguuagaauauagaggaugucuaguguuaaaaucaagagugauaauaagccagucauuuguggguaccaguauucugcuuuacugcucgaguuuugcagucaguucaucucaccagcauugggcaguaauaaaggcagauuaagcacacauacuuguauuuucgcacacauaaccuaggcuggcagauuccaaagccacagccuauauggcuguuggcauggucugaugacuauuccuaacuugcugaggugcccuguguggagagacugcucagagauaaauaaauacaggucagcuuuagcuacaggcugcccugcucuccuggucccugcaaguuugaaggcccugugaagcaaggacagagguguaacugguugguuugccuuggguuuuaugaccugaauuacaaaucaccucagcgcaauuggcuuucugaucuuuauuucacaaaugccuauaaguuaagauuauuugccuacauuggugacuguaccagcuugugaucugcccuugagauguuucugcagugugcuuauguuuaacaguuccuuucagucuuagauuuggguuccucugcuauauuaauuacaacauacuagggugaggcuaucuaggagauauuacaaaugguaagauaagguuguucuuuacacuugcccucuuauauagauacugacuuggaagucuuugaggaccucagauugguugauugugaauuucaauacucaguauggauaacuagagagaaggcacagaauacaaaagggagggaggacagugcauagaguauguaucaagcauauuguuuaugcuaggauggaaaauauuuuguguaugcauaugccaggcaaguggguaaauauuaagaggacagcuugcaggacaguaugguccuggggauugaccauuuacuuggaauuaggcugacaguuucaagucugcuacuuuaagaagggacaagggcugguugcagauggauagauguaugagaguccaguuuauaaaaaugauggccacuggaagcaguagggauucaauucaaugugaaguguccuuggcaguaucaauagcacucuaucagaaucuccccaagaguacuaaaagguggguaaagugauguucccgauucugaguugggcugcucauggagaauguacucaggugcuggagaauauuuuucuccauuguugguaggaauuagaaguuacugcacaguugauucuaguuuagacaaaucuaaguucuccauggagaaaugguaaagaacuggugggagauuuaggaguaaaagcugauccuauagcaucagucuaaaggcugauuauuaucaagugggguaguguacuauauuucccccaaggugaguaaaaaaaguugaaacuguguaggaaacauuuuaucuuuaucuugcauuguauugguuauguuucacauuugaacacacauuugaauauaugaaauacauuuaggauaggaaugaugguauaguuucauaaaauaucuaguccuauuaaucacauuauaaauguuagagaugauugaacuuucaguagucaaaaguuaaauuaugggcuggagagauggcucaguggguaagagcaccgacugcccuuccaaagguccugaguucaaaucccagcaaccacaugguggcucacaaccauccguaacaagaucugaugcccucuucuggagugucugaagacagcuacacuguacuuacauauaauaaauaaauaaaucuuuuuuaaaaaguuaaauuauaugcaugaccuacaagggccuuaaaugggccuaguauuguguggaauuuugucauguuagugaaaagauauggugugcugaaugacuugagguaucccaugcguugauuuguagacuagcaaccugugcugacaucucucauuccauuuucuucauuuacauuuuguaaagucauuaaaaaauuggcaauuuuugauuuguacuuagaaacacuuauguaaaauuucuacauuuuaaugugauauguauaaacaauucuauagaaugugcacacugugaaguaccaacuaaauacagaaugguauuccauagaguccuugauuggugacuccaacaucagaagcauuacaaauuguguuuugaaguagcaccauacacuuauaaauaauaaucauauuaucacauuauuuccauauuaacaauaccauaacgauuugguaagcauuuacugucaaauauucuauuuauuuucuauauauuuuauuaucuuuaaauuuuacagcagccaugucaggaaaguaauuugccuccauuuugcaggcuaggaaauucaagauuaguaaggaagguaugagcugagcuucaaggcuuggaacccgggguacuuuguaaauuuagauaauucuucccaaauucccuuguaaaaagaaaguccuauguccuuuuaucuucacacuuaccaguguuagcuuuuccaaguguuaagugaagaauuucuaaaacuuacaggcaacuagugagauugcauugcuuuucuuaccuuuuagcuaaacucuucucauuuuucugggaauuuccuaagcuuguucucugcugugucuucuuuugaguuugucugacuauuauguagguccaaugcucuguuucaaccuuugaugacuuuagaagguaaagaacgacaacagucucuuauacuuguuuuucucaacguuuuuucaagaacaauaauaguugaaugauuuuggaugaaaugucuaaauauauuuuacauacauaccauagagugaguuuauuuccauguagaaagugagaaugugugaaauaccuauagacacccacagauuguuucugucagugucuuguccuguuaccaaccccagaaaguagaauugaccaguucucucuuauuucaucuucagguuugccugcaaugagacuuuacucucuacacuuaaagaacauucuuucugagcugcugugaauaaauuuggaaugauuuugucuauuuucaacuaauggagaacuagcuguaacuugaacaaggauuacuguacuggacaacuucagaacauugcucacaaugucaucaaacaggagucagaauccucauggacugaagcagauuggucuugaccagaucugggaugaccucagagcuggaauucagcagguguauaccagacaaagcauggcaaaguccagauacauggaacucuacacguauccucuugcuugagcuguaguuggugugucuaggguuggauuauuuuguguuaugguguuugaauuauuaggaauguuaugucauauuuccuucuuuguuuaccuauaauaaaauucuaaguucauuuuuauaucucuuuuucagcagagguauuuuggcuagauagauauuuaagguggugcuggcuaguaaccccagauguuuguguguguguguguguguauguguguguagcacucauggaggacaauuugaaagaaucacuuccuccugacaucacauugugggucucaggguugaacuuaggucuuuaggcuuggcagcaagcacuucuaccugcugagguucuuaccaacauuauccuccccccacucccgccccaccauaucauuagcuucuauguauguagauuuagccaacuauagauugaaaauauuugaacaaaaaagucucuuuauuaaacauguagacccuuuuggucauuauucucugagcuuguaacaguuguuguguagcauuuguguagaauuaagcauuuuaaguaauccagagaugguuuaaaguauagugugaagaugcagguaaauuauauacaaauucauuguuauauuuuaucauguaauaguuuagauuucccuugggagguccuguaaugauuuacaccauuguuuaguuacuuuucacuguucuguugccacuaugagaaaccaugaccaaggcaacucagaaaagacauuuaauugggagcuuucuuagaguuaguuucagagggugcguccagcaggcaggcaggcagguaucuugcuggagcaguaacugagagcuuacaucucauacacaucuugggggcagaggggcuaauggggagaacauugagcucuugaaaccucagagcccauuauucccagugacuaaucuccaaauaggccacaucuucuaauuggaaacaguucuuccaacugugaaucaaauaugagccuaugauagccauucucauucaaacuaccacaccuguaaacacgaagaaguaacuauauaaaauuuagguccuuagcaauaauacccauauuucaaagugcucaguggcuaaauaauaaaauauauuguagaaaguucugugggcaguauuguccuaaguggguuuaaaugcucauuguggcugcuaucauguuacaggagaauaagguaguuguaucacagucugguccacaaaguccuaaaauauuuucuauccauccuuaccuaugcaaaaacugcuuaccaguucagaaugacacaccuagaacaaaagcuugaauauuaugauccuauuugcauuacucaguucuaagagaauaugguaauuaacuuuucuguuugcucuaacaaagcagcuuaaggaaauaagaguuuauauguguuuauaguucacagguacaguucaucacagcagggaagauguggagguagagucagggugauuaggaguucaaggacauccuuaacauagcaaggucaaggccagccuaaacuucuugagaccuucuuuuuauuuuauuuuauuuuuuuaaaaaugaagaucuaaagcucagcuaacugaauggagcagauugauacugauccgagaagcagcucuacugugggcacugugauggcaggagugugcggcugcuggcagcaguguccacaggaagcagugugaugaguguucgugcuucucuugcuccucacucuucugucuaaaggugcuaugcugcccaugagcugguacugcucauccaaaguggaucuuccuccucagcuaauccccuuuuagaauucucccacagguacccaccagagaugcuucuuguagguaauccugaguccucuggccacaguggagauuaaccaucacaaaaagcaauuuuauuggguuuugguucauaauguauaugaaggacuaugcuagcucuuguaaaaguuauaagguuuuaaaaggcauaauuccugcuauuauaacauucuuuaagauuuauuuuuauauacuguguauuuguguuuuaccuacauguauguaaugugcaccacaucugugcuuccugaggaggccuaaagagagcaccuguucuccuggaacuggaauuauggauacagugcuagaaacuaaaacacugguccucugcaggagcuacaaguauucuauaccacugagcugucuagccucuaauuuguaguuucuugauucuguacaaauauaaaauuaaaauuagaauuuaccagucaggcuuggugacucaggucuaugauuccaucagcucuaaggaggaagagucagggucaucaggaggucaagaacauccucaacauagcgagguccagacaggccuaaacucuuugagaccuucuuuaaaaaaggaggaggaggaggaggaagaagaggaagaagaagaggaggaggaggaagaagaggaagaagaggaggaggaagaagaggaggaggaagaggaagaagaugaagaagaagaggaggaggaagaagaggaggagaaggaagaagaagaagaggcggaagaggaagaagaggaagaagaaggaagaggaggaaaagaagaagaagaaauaauaauaauaaagcucagcuaacuuaauggagcaaauugauacugauccagaacguuuaguugcucauuuaauugguaugugaguuuaaaacuuuaguauauaucaguacuuaucaaaacagguuauauaacauuuaaaauacuuuaauuuuagaauacuuaaauuaacuuauaaauaaaugucuauuauauaucuaauauaugugucuaauaugcauccauaauauaaauguauuuuuauacuuaaaugcauuuauucuguuuacaaccaccuguaaccagcuccagagaauuggauaucccuauccuucucagguaaucccacacauacacacacauacucacacacacagacauaaucaaaaauaaaaaaaaaaaagcuuaaaagcaaaaacaacuuuggguugacaagauaguucaguuaauaaaggcccuugcuaccaagccucacaaccugcguuaagucccuggauccuacaugguggaaguuaagaacuaagcuugccucugaccucuacaggcaugcuggggcaugugugccaucucuccaucaccuccacuaaaacaaacaaacaauuaaaauaugggucuaccaguaugaugguguaauaccuuuaaucucagcauagaggcagaggcaggcggaucucucuugaguucaaggccaaccuggucagguuuauacaguguuacacagagaaacccugucucagaaaauaaaaagcaaaaacaaaaaauuaaagcuuggggcuagagaaaugacuuagugguuaagagcacuuuuugcacuucagauaaccugaguucaguuccaagcacauauauugggcagcucacacagccuguauauccagcuucaggggaccccagcaccuuccucuuaccuucuuggucacacacauaaaaauaaugcagucuuuaaaagaaaauucgaaaguaguaacagcuuaguugaaguauuaacacacuuaaaauuuuucagcauauuuaguuuuauaacuaucagugucugcauuuaguguguguauauaaaauuuuuguuuaguuauaugaguaaggguuuuaggguguuuuacuugcauguauuguguuagaugcccuggagguggaauuacagucaccugugaagugccauggauguuggagauuaaauccagguccgauuacagaaaguguguuuaaccacugaacuaacucuccagugcccuuaggauauuuuccuuaccccugaaagauucaauuaggaauugaaucuccacacccccaugccccuucucuggcagucacugaucuaguuucuuugaauuuguguguucuagacuuauccuguaaacauuuauacaguauauggcuuugugucugguaucuuucacuuagcauaaugguuguaagcgucuuccuuucuuucaugacugguuuguauggacguuuuacauugugcauauccauucgucagugauguaugucuuuuguuauuuccuuguauuuguguuagauacuuuguuaugaacaucguguacuaguuguugagugaccguauguucacucauucucuugaguagguagguaccugugagagaaauugcugagucauagauagauauguuggguacuuuuaaggaaaaugggaguuuuugccaaaugaguggauagaguaucucccaggcuuuugcuugcuaugacugacuuguggcuggcuugcuuguaauagaacuaaaaggcugauuucagugguaaagcaguuuucaguugguaacauuuucagaaacccaugugguugaguuuuuguuauucuucacaaaagcagaccagcauuacuuuggugaccaaggacacuucauuacuaaucuaucuauuuuuuuguuuguuugcuugcuuguuuuaauuuaaaaauacuuuguuuuuugagauggacucauuauaauagcccagacuagcuuuaaacaugauucuccugccucagccuaccaagugcuaggauuugucuuacagguuauuauagguaccuggcccuaggaaauuauuuuaguugguuguuuaauuuguguaaguaugugcgugcaugauauggggaagagaacuucaugaagauacuucuuuccgucuacacucauguggguucucaggucaaauucagguugacaggcuuuuguguaagcuucagcagcccaaaauuucuuaguauguaauuuucacuaaauuagauagguuuuuuuuuuuuuuuggcagauuauuuuugcuuugguagggcugugaggaaguagaaacuuucuaugcuuaagaaauuacugaauucucuuauucuguagauaauuuauugcuauuuugauaucugaaaaguuuuagcuuugggcccuuguuuucaccuugagugucauguguguguguguguauucacaauagucacaauggaguacuuuuuuauagaaaacuaugaagucuuuucuagguagugaguaaauaauacuuauuacauaauguaaucuugguucucuucuuaggguuauuucauauaaugcccuauacugggcugaagaaauuuuuaguuuuaaaaaauccuaauguaaagaauuuaaaaagcauucaaaguuuauuuuccaacaaagaacaucagcaggcacugggcuuauaaaagugcuuauccauagaacauauucccagaaggagccacugcucuguacuuggcugcuucagguugaacagauacuguuguguacacuuuccauucuagaagaaagaggguagcuuagcaaagaguuguuuuuaauacuagagucagguggaacaaucaagaagcuugaguaacauccacauuucaagaaaguccuuugauagagaggagaaagaucccucacucaugaguugggccuuucuucaugagacccucagcaacauuucauugucuacuuaauacuacauguacaaaagguaauuaaaauaaaggaaucaaaagaacaucuugacuaucugcuguuucugucagcccagcaacucuuagguuucagacuggccuggggcuugguagagugcuugcuugucuaggugcacacacuucugauuuugaggugcacacgcugcuuuuuuugaggcaggguuuuucuguguagcccuggcuguccuggaacucacuguuguuuuuguuuuuuuaaaaaaaacaguugucuuccuuucuuuguauguuuucaguauaaacaugcacuuaaagauauauauauauauauauauauauauauauauauauauauauauauuugguaucaguauacuccacagaaauuacugacauguaaaugauuaauugagugguucaguuuguuuguucuuuauuaguauauguaugguauauuucuacuuucuuuuaaaacuuaaaugcauggucuauauauucagauuaaacauuauaaaauggguuuugguaugaugcucagagguuaagaacacuggccacucuugugagcaccacaugguagcucacaaccaccuggagcucuaguucuagagaccaaguaccaucuucugucuucuucagacacgaggcagagacuuguugggcauauaaaccuucagguacucagaacuaccuucaaauagcuguugcugaggaugacccuaacuuuccaagugaugcugacauuccagguguucaggaccauugcuguugcuuuaagaggcaguucucugaugaggaaauacugcuguuggguguuuuauuaguuguuugaccuucugucuguaguauacuucggucauguuuguuuacaguuuuuaccuuguguugauuuaaauuauguuuuuagggugcuagguauuaaccuaggaccuugauaggcaagcaagugcucuaccacugagcuacauauaucuccccagcccaaauaaauuugcucaagauaguaacucuccuugaagguaguuuuacuuuaacauguucagauuuucagcuuagauauuggugauuuuguuuggaaaggugaucuccagcuugagaacagguaagugacaauuucugcaucuucauuuuauucuuuuaguuuauauauuuuuguugauucauuugugauauauauuugaauuauccuuaaugucauuuauuaaguaaucuuuuacgcacugauuuuggaagaaucuauacaguauguccuuaaauacaguagaagaguaugucuucauuguguguccuguuuaaugcucccccugucugacagcaguaguugucauaaagguuauaacagaggcagugcucucuuugccuuugucuuccccauccucaaguucuaucaugcuaauacguagaggcagcugguucagcuuuucauuucuguuccuguaauuucuaugccucuguuucacagugguguauugacccgaugcuguuguccaguuguauacaucugugacucuauuguuguaucaagcuaucacuguucugcaugcccuuugcuuuguauuuuugaguaagucuacuucugagucaucugaaaauaauguuucaguuauuucgguauuuauaguguguacuucuggcuauguuauuuguugccaaguaucauugacuuugauuaguacuggcuuuuguuuuuccaaaaccaaauacugcaauugcuuuuuuccuugaaauuugcaaccuuucuaaccuguuggaauuuuuaggacuguuucuacaaaaucagucauguuaggcaaucuuauaggucugggguuuuucuugauauucuuucaagaauguuccaucuguuuuucaggcuugugggcauccuugugaauggacuugcugucuuuuuuuuuuucuuucuuucaauugagcuaauuuuuauuauauucaacacaauauauauuuuuauaccaaucauaaaaauggcggacauauuauuagaugaacauaaauagauaaagucuuuuuguuuguuuuguuuuuaguagagcuuuaaaaucuuggcucuuacugugguacaaacccaaaauaagaacaauuuuuagacauuggaguucauuguaauaaggcuguacuucagugccccucacaucaccaaagaauuuuacuuccauaguagcuaagcuaagaguugacaguccugcugcaccaaggaauguauuguaggcaugauuacuuggcuacauauuuccugcuauggucaaagcuauuugacuugagugauugucaucauucucagccuacagggaacagguuacauucauuuaagaaaugguguguguauuaagauggucuauccaugaagucauucaucaacugcuucaaugaacaaugguucugcuuggagggaggcauagacauuaggugaggguaagauucugcuucauuggcugugaugauuuuaaaagcauucaucucagaaaaagaguaacuuauaagguccucuacuucaaaauugauacaacaauuauaaauaucaagcaaaacauucagucucacucuuaauuuguucucuuacaagccaccucccaaauuaauugucuacauuucuuuuggcuguauaaauaauuuugaaauaagcuguucugaaaaccauaguauacuguaaaaacaucaaacaauccuacuaauagagaggcugagauaggaaaagcaugauuucaagaccauucuauggucuacagcaagaaacugucacauacaaacaaacaaaguguauauggguuguacaauauuggaccuauuucuacaauuaccaaauuagagagaccacuggaugacagccaacaaauuucuaauucuucauauuuuugaauuucaauugauuaggauauguugguaauauuaacuuucuuauuaagagauauuaaggaaaagugauuguuacuuucugauauuuuguugauagagguggaauuauguuuguguggguuuguugaaagaugacuuuucuugcuuuuucuaggguguaguuucacuccuuguguugguguuuuccaucuauuauccuuugcagggcuggauuuguggaaagauauuauguaaauuugguuuugucauggaauaucuugguuucuccaucuaugguaauugagaguuuugcuagguauaguagucuggguuggcauuuguguucucuuagagucuguacaagauuugcccaggaucuucuaucuuucauagucucuggugagaagucugguguaauucugauaggccugccuuuguauguuucuugaccuuuuuuccuuacugcuuuuaaaauuuuguuuaguacauuugguguuuugauuauuaugugaaaggaggaauuucuuuucugguccagucuauuuggaguucuguaggcuucuuguauguucauggucaucucucucuuuagguuagggaaguuuucaucuauaaucuuguugaagauauuuacuggcccuuuaaguugggaaucuuuauucuauaccuauuauccuuagguuuggucuucucauuguguccuggauuuccuggauguuuuggguuaggagcuuuuugcuuuuuguguuuugacuguugugucaauguuuucuaugguaucuuuugcaccuuagauucucucuucugucucuuguauucuguuggugaugcuugcaucuaugacuacugaucucuuuccuaaguuuucugacucacgggcugucucccuuugauuucuuuauugguucuaguuccauuuuuagagugaagauucccaacuuuaggugguuuuguucguguccuuugccuguuugauuguguuuuccuguaauucuuuaagggauuuuuguguuuccuuuuuaagggcuucagguuauuuaucuuuguucuccuguauuucuuugagggaguuauuuaugucugucuuaaaguccucuaucaccagcaugaucuuuucugcugugaugauguauccaggacuugcuauggugggagaauuggguucugaugaugccaaguaaccuugguuucuguugcuuauguuaugcuugcuucccaccaucugguuaucucuagugcuaccugcccuggcuaugucugacuggagcuuguccuuccugugacccugguuaugucagaacuccucagagucaagcugucucugggauccugagauccuggugugacuaagcuccugggcuccugggaucuuuggagcgccugggaguggagcuugcucuggguguugugggacuggcuguggaguuugcacccaaggucugcacagggaaccagcccagaccagaaggaaccugugccacuggucugguggaguuccugcgugcgggguccagcuggucccaguuguucccuguguugggacagauccuccucaccucugauccugugcucgggcuugcugucuuuuaacuuuaccagcauuuuccacuuuaguuuuauugggaaucuauugcuauauaaacagaaggaaauauguuuauguuaauuacuguuacgucuaugguauguguuacuuuccuuaacuuucuccaagucauguuuauaacuacuguacuagugugcaucaguccaaccaagcccggggugcuggagucccuccuuccaagucaaaaaaggggcagacuccugggggagcucaguuuguuggcuuggaguuauacaagcgauugaaggaauuuuugaagaauuauuugacaaaucuucuuaagguaagaugucucgaugguauaagcauauaaaaauguccauuuuguucacuuuuuucuuacgugcaaugauuuuuuugugacugccaucucugucauauuugcugcuuuagauuaaaauugugcuuacacuggguuagcucuugcuagauccauauccuaugaguuaggggcucauuagcucaaaccauugcuuaggcaaaggugagucuuuuuccuuucauuuuuuuucaaaauaggguuucucuaugcagccuuggcuguccuggaacucaauuugucuuggaacucagacccaccugccuccugaguguugugauuuaaggcguacaccaccacuaauggugaaaucuuuuaccuuagcuucugccuuugguuuuuaguaguuuguucuguaacaaaggaaguggguugccuuacacucagccaucaggugaucagguagcuuccucaccugguauuguguauaugaugucuucagucuacaaagguauuuuuacuccuaccugggaaaguucucagucucuucuauguauacaguucauuuuucuuuuaaaauuuauauagcuguuauacaauauuuucugcaugauauaaaacucuuguuuucuuaauuauuuuacaagcuaaguggaaacacauucuaacagacuguaguugacucauaacuaauguaucaguuucauguucuuaaacauguguccuuugacuuuacagcacuugguaaauaaauaagucuuguaagcaaagucuguucuguuuuuaguagcuacuucaucagcaacauacuuguuuuuuauaucaaaaauagaccaauuuauguuuucaaauucauuucauuuaaauacacaaaacauuugguugucucugggugugaccagguauuuacauagaugguugggucacuugaauguuauugcuuguagaauuacaagucugcuggacuuuggcuuuccacaugaagacaacuucuugguauacuuagcacagcaucuaugaauaguagugcagugucuuuaaaggguaggacacacuuuggaauugucauuaauaucuaagaacuuuuuucaagucaauccuauucaaauaaaaacuagugaguuuuaaaguaggaauaauuuggauaacuuccaguuuucuuucugaggcuuuguuaaagaagaaauguuguauuguuguuauguuguuuuuguuacaaaaauacaacaaauacuaaaauuaagaugaauaguuuuguaaucuuacaaauuugugaaacacuucauauuuuuaaaaaaugaguauacuuuuauuauaauuuguuaaucagauagauugauuuaaaauaaaaaacugggaagauaucaaacagagaugcuuuggagguagauucccuaauaagaagaaauugcuuaaaaacuuaaaaaaaaaaaaaaaaacaggacauggaaguacauacccuggaauuccagcacuggccuguaaucuuagcuuucuggauguggaggaacagaaguuacaggucauccucagcuacacugugaguguaaggcuagccuuggaaagcaugagauccaaggaguggguggguaugugcuugggcuacacaacugaguuuaaggccagccugagcaacuuauugagacccugucuuaaauuaaaaguagaguauugagcauuugacccuagcacccuucagucacuaguacugaagaaaaagcauaaaagaaaguaaaagcaccuucccauuuugaaagcuuaggguacacucuacgacugcauauaccuauucaacccaugaaaaguucugguuuaauuggauaaugaaagaccuuuuuaguguucuugugagaauuuuccauuagcuuguuucuguacauagcaauugacccaucuguaacugcaugcauuuguacauuuugaugcaguagcuuuuccaguaaguuuuagcuugauuaugugacaaacuauucauauuaaagucuuagugaacuuguuuuuaggauggagaagauuuaauggaugagaguguccugaaguucuacacucagcagugggaagauuaccgauucuccagcaaagugcugaauggaaucugugccuaccucaauagacauuggguucgccgugaaugugaugaaggacgaaaaggaauauaugaaaucuauucaguaagauuuuuuuuuaagaauaaauaaauaaccucuaaaaauguugugacaagaaaguagagaggugagaaauuagaacuauaaaauaaacauaguuaaauaguuuuguguuuacuuuuaaagugucuccaauuaauugggcaauuauuacgcuuugcaucgaacugcuugaguuuuagcacuagaauccuagaugcuggcaguugcuagcaaaucagguaccuuaucugaggauuaagcuccuaaccugggcauucauauacuuuuuuggucugagaguucuguauuugagagaggaccuugaauuaauuuuuuucuuaguccucaagguuuuuguuuuaggcuuucugguuucucaaaaguaugacugcuaaauguguauuaucagugucaccugggaacaugauagagauguauauucuuagaccaccuucuagacuuggagacuuuagagaugagccaauggugggggcagguagcucaguuaacacaguacuuuucuagugucuaugaaguccuggguccagucuucuguuuuguuuauguuaaguauuaugguacacauaccuguaaucccagcacuuggaugucaaggcaagggaauaauagguuuacauauuagccaacuugggcuaaaugagcccugucuaaauaaauaaauaguccacagaguuggggguguuagcuuagucaauaaaguauuugcuuuguaaacaagaaccuaagucccccaggaccuguguaaaaaagcaugauauugauguuuguaaucacagugcugggaggcagacacaaacagauacuuggagcucauuggccacacagcauaucauucugacaaguacaggccuauagguagaugguuccugacagcaaagguuguccccugggugcuauaugcacacacacauacauucaugcucacacacauuaaauaaaugagcaaacaaacacuucuccagguaaggagagucaguucuagagaaguugagggaggauuaauugaaaacauuauagucugcucauggaugugugucagauuaaaaucuuuuggggucaguuuuauuaaaaugucaguuucuaauguugugccauaauagcauuauuuuuguugcuuugcuuuuacaaaauuagagaaaaacuagcccagguucaagacuucuagcacucacggagcucaguuucuguaccccaguuguacuuuauaguacuguauaguuauauagguuuuuauuuuggcuuuuguuuguuugaaacaagguagcuucugaccuggaacuucacuuuguagaccagccucauaccugucucugacucucaagugcuaggauucaugguguguaccauugugcccaguuaguuacaugguuucuaauaguucuuugaaguuuuuguauuuuucuuuucuuuaauauauuuuaacugacaauuauauguuuauucuguugaacauguuuugaauucuguccaucauagaaugguuggugugcuucccuugugucagaauuugcagaauggcacucagugugguagauuuccuuuuggaaacugcuugaccugauguuccguguguaucucuauagugguaucacagcuccuaaaggccaucccugcuuuuucacuuuccauguucuugguucaacaguuaaacaaguuuaguaaaaaguaccaagauacuuuguuucucaagauugagcaagacauaaggcacaggucuuuuaaucccaguuccggggaggcagaggcagaggcagggauguaucugaguucaaggccagccuguacuauauaaugacacuuugucucaaauacauaaguaaauaguagacaagagucagccacuuucauuacuuuuaaauuuuacuuucaaauccuacacuuucuguuaucaaauaguguagccacuguuuggaaaugcagccauaaauucuagcagaggaaacccugaucaagucauuugcuaguuugugucaaaguucgguggaaacaugugguuuuuguuaauagcccagugucuagcaaaugauacuguuuugucauguaguucaaggucaagacaaaugauaaggcuuuuacuuuaaaaaaaaaaacaaaaaaaaaacaaaaaaaaaaaacaaaaacucuuuucuaaauuguuuuuccccuuuuuaauuagagaaagauguugguuugcuuccaagucucccagaggauaaaagcugauuucauuguauguugaagugcuacuggcaaaacuuguuucuguuacccuauugugagguuucuuugcuuugccuucuauagcuucugucuucuuuugcuuguugguuuuauuccuuugaagugauaaaucauccagagucagccuagguccauccaaaggugggguugcuaauuuagaaaguagguacaacaaaauaauuuuuuaaaguagggauucuguuagaagcugauacuauagccugauguuuucacugcugccuuacuccaguuuugagggcugaagaggcagggaggaaaguuugcuuuucucuagacagugagguugagucgucaguaccuuugcacaccacaaagcaagagucuuaauaaugcugggccuagugcugcaccccuuuaaccccagcucuuggauacagaagcagguagaucucagugaaucuaugcugguuuuuaagcugauacaaaugucagaacuacagagggaaaaacagacccaaaaaaugccuuaaauauugauuuuuauaguauuuauuuuauuggagacacuacuuggaaaacacuuuccauagacuaaauuugcauauuuuuuacaagcuuaauuuuauuucuaguuggagaggagauuggagaggaaguaaaauaagacuaagacauuuauguuuaauuucuugacaguuuauguguuaaagugccguaaauuucaauuguguuuuauuuaacuuucuaauaccucucccaacagacgucuaaaaaucauacauaaauucuaacuuuuuucuuucagagaucauuuuuacaguaauuaaucaguauaacacuugaaagaaguuuagaaauggaaacgagagcaugauaauuauacauucgagugaaaaugcaucucccgggcuggggaagauagcuuaguaagaaugcuugaguucagauaccuagcaccuauauaaaagccaugagcuugagcuuacugcugcuggucucucagugagagaguuugucucaagggaauaggguggagagugauagacacaggaaguucucaccuugucuccagccaccuguuugugcaucuucacaugcucaugugagcauguaccauguacacacaaaugugcguuucacacauagucuccugaagacacaaaggacaguggguguucuuaauuuauguacaagaaacugcauuuaaaaugcacaaucaagauuggaagauuuuuauaauuucuaaaauguaucuugauauguuaggaaacugagaguaacuagaauuaguuuuagcagguguuucuggucaaaacugauuggauccagggaauucauuuauagauagaaucuaugcugguuuuuaagcugauacaaaugucagccuuaacagcauuuucuuucugaacuuuguuguuaaauugugagaagguaaacaucuauacaaagugauuaacuuaagagagcagcucugacuucauugugauauuauguuuuuacuaaguuaucuaaagauuuugguaaaauaaagaauucagguuauugucugugacaaguuucaaggauauucaauacaucuuuuccccuuuuucauccagcuugcauuggugacauggagagauuguuuguucaggccauugaauaaacagguaucuacuaugggauauguguguguuuccuuaaaaaaaaaaaaagcuuuccauuuugaucuugucuccucaagccuuuugacuaucucaagaguauuuguugggcuuagucuguaaagugcuugcuauguaagcaugaggacaugggguagauccccagugccacguauagugcguauagugaugcccacuagugauccuagcacugcaaagguagggucagguagauccuuagugcuuccugaccagggccaagcuugccaccugaaugagcuccaugccagugagagacugucuuaaagacacagugaauucuuccuggcaaacaguucuugaaggugcccuuggucuaugucuacacaugcauguacccaucccccuaaaauauuuguuacuuuguauuauuuaguggcuuuaaauguuuaaaggauauauaagauacauugugagcuauaauauaccuuuuguguguucuuaaagguaacaaaugcuguuuuaaaguugauugaaaaggaaagaaauggagaaaccaucaauacaagacugauuaguggaguuguacaaucuuaugguaaauaauuugccuuuauuauaauagugcucuaauauucauuuuaaaauauuuauuaaagauucucaggaauguuaguucaucuuuaagguacuuuuaaauaguaauuuuacaaaucguaaaaaauauuuaaucuuuguacuuuaaggaaauuuugugaaaaaaauuuaauuauauuucuuuugcuguuuucaugaggaauuacuaauauauaauuguuuuuugagcuaaauaauaaccagaaaacuauaucaacuugaaaaauuugagauugagacacugauuaaaugaugcguuauugaagcuuaggugaguuggcauuucugugaaaguuuacaaugcaauauuuauaucacuuuuggaaauguaaacuuucucuaacuaaacuuguaauuuugaaguguuccuggcacaaguaaggauuauuugcugcuauacaucuuggaguuuauucuuuuuguguuuucauuuauuggcacaagcauacuucaauacuaguaaauaauaguuaccuuacaacccaccauuucacauugaucuuuuaaguguaacuuaaacugacugcuacaucaaaguauugucuguaaaauauaacaagaaauacgguaauugaaauauaguucauauuuauuucuaguggaauuggggcugaaugaagaugaugcauuugcaaagggcccuacguuaacaguguauaaagaauccuuugaaucucaauuuuuggcugacacagagagauuuuauaccagagaaaguacugaauucuuacagcagaacccaguuacugaauauaugaaaaagguaagcuuaaacauaguauguaaaguggauauaaguuaaauaguugucacucuuccagugaguucuuggcauuucagugcuccucaccagucaggcuugucacugcugucacaccaugucagcaggccuagcucauagaacucuccaggggacuuuuauacauugagaaucaugagugaguguuccccugcacauccaaagagauguauucauagcugcaugccuuccagguuuuugcauugucuucccuugaaguguggcccucaggauuuuaugucagugagaaaauaagcaaauaguccuagauuugcuauuuuuugcuuuugcuguuuuucuccuaaaauauucccuaagagucauaguuuaacccuucaaguuuauauuaggaagaaggauauaaaucugacuuaggagaagauccaagguggaggcaaggauucuaacuugcucuuuacuacaugaugcuuccaugaacuucuaauaggauuuuucuuugcucucuuucuuagaaauucaggaauucuggauauugggucugaggaaugacuaugucaagagauggcaagcuuucugcuauauaguaccagccaguaaauaaucuuuaggcuuuucauccuaagauuucuucugucauuguucaccucuaauguuaagaaacaaaagcagucauggagauauagaaauaagcaggaaacaggugcagcaggauuuugccagcagauuguauauauaguuugguaacccucucaucuguauguguacacacacacacacacacacacacacacacacacacacauauauauauauauauauuuuuuuuuacuuuuggguuuuuugagacaggguuuaucuguauagcucuggcuguccuggaacucacuguguagaccaggcuggccucaaacucagaaauccaccugccucugccucccaagugcuggaauuaaaggcaugcaccaccacugcccagcuuguauuaaauuuuuaagagucgaggucauaccaagucuaauaccuacuuugcccucucuuaggcaggaaauggacugccaagucauuuccguguuuaaagaaagaaaauauaagcucaaccacucugcuucugacauauagagagaaagccaugcccagcuugugguguucacagugcauuuucguauggugcacugaauauaagugggccuucuaaguuugaaauugaaagucaguuacacauuuuugauaucucaaaauucaacagaaguagaacuagucgguuguauaugcgggauagugguaguucuuuauaguagaucuuugugucuguuuuguauaugacugagaccuaaccagcuccuuaaggguauuugaaacauaaucuguuuugaauccugguauuguucauuacuuaauuuuguaguaugacuguaggcuuuauaagcaggucuuuuacugaacucuuuuaaaacuuuuuuuuuugcacuuauuuuguaugaguguguacauauaugugugucuuuguguguacauguacaauguaugugugccauguuagcauauguauguguauauguucuuuuaccauauaggcaccagggauugaguuuaggucaucaggguuagcaguaaauauccuuaacacuacugagccauuuugccaguccaguagagauuuuuuucuuaaauuauaucuuuaaaguggaaucuuccccaacauugcacaccacuauggugccagccugcccuuuguagacaacguuaugauuuguugugguguaugcugcccauggagauaggaggaguaguaguaguaccucaacauaaggagaacaacuuuuaggacagagcugcaugcacacucuaaacacagaaaucugauuuuuaaaguuuuacaacuucgaaaauaauagugucugguggguggguguuugcaaucuaaccucuccucagccuccaggaagcucucuaaaagcauuaaaaguuugguccugaccaacuuagaagucuuaucaaacaugacuucucaucuuauucaggaaauccacaauucaggcucuaaaaaccaaacaauauagagauaaucuuauaucgcuguaucuugaacugggccaccaguuuucaagguuaaagaaugaccuuaagccaggcaugguggcacacaacuuuaaucccagcacuugggaggcagagacagguggauuucugaguucgaggccagccuggucuacaaagugaguuccaggacagccagagcuacaacacagagaaauccugucucgaaaaacaaacaaacaaaaacaacaacaacaaaaaagaaugaccuuaaccguuccguuccuuaguuuccucaccugugaaaggagaauaauaauaucaggugauagugagaauuuagugagcuuuacuuuuaaaaaacuauauaagcauugaaugucuguauuaaaggcuuuauaaaaaguguagcaaagcaaacauaauggagggcuuugaccuuacaugugcauaccucauagucuccagccugugccugggcagguauaggaccaccagaaaaaaguugacaauuucaguaacuugaggaaaaauuacauuuauauuaaaacaaucaaguagaauucaacaucucaggaaugauuuugagguaaagauuagcuuucaggaaauauugugcuuuuaauggccaauuugggcuagauauuacaauccccagaggucucuuuugaguuuacugucaucaggugggaguauuuuagucuaaacaguugauaaugguuggcccauacaaaaaugcuuuugauaacugaauagcuacaaacacuuuauuaacagcuauaucaacacuuuaaaaaucaaugucaugugauugagacuaaucugacuuaaaaacaacaaacaaaaaugaacauguuugaauauuuuaaauuccuaaucuuuuuauuauuuaaaaauaaaacaugagcucaaaagauugcucagcaguuaagaguggguguuacucuugcagaggaccugggguugauuuccaauguuagaucagucaucuguaaucacaguucugaaagacccacaauccuccucuugucucugugugacuucaugcacauacuguacaugcagucaaaacauucacauaaaaaaaagagagaaagaaaauaccucauuucauuaauuuuuaccaaccuuucaguucugauuuuuuauuccuuuuuguuucuaauggaguuaaucagggucauuuucaagaaccuuaggguacuuagucauuuaaauaugguccugguguuccauggucuacaugagacagcaaugguaaagauaccugcugucacaaauuaguucccaguuacuacuuguuuuuuuuuugcuacuuuuuuuuuuuuuuuuuuuuugguuuuuuugagacaggguuucucuguauagcucuggcuguccuggaauucacuuuguagaccaggcuggccuugaacucagaaauccaccugccucugccucccgagugcuaggaucaaaggugugcgccaccacgcccggugggaccugcuacuucuuuucugcuuggccccugcaaggaagcucuguaaacucacuauaguccgcaucccuguggagaauucacaaggacaucaaagccuacccucucuucugagaaggaguaguuuuguuuuccugaccaagaugauauauguucucccaaaaacagauugacuuaaaagaagaagaaugauaguaucuuggguauucuaagaaagaagaccaacauguggacacuucauuccuccuuagaauagggaacaaaauacccauggaaggaguuacagagacauaguuuggagcuaagaugaaaggauccagagacuaccgcacccggggauccaucccauaaucagccaccaaccccagacacuauugcagggacccugacauagcucucucguaggaggcuaugccagugccuggcaaauacagaaguggauacucacagucaucuauaggaugaaacacagggccccccaauggaggagcuagagaaaucacccaaggaacugaagggaucugcaacccuacagguggaacaacaauaugaacuaaccaguaccccuagagcuccuaucucuagcugcauauguagcagaagauggccuagucugccaucauugggaagagaggucccuaguucuuacaaacuuuauaugccccaauacaggggaacaccagggccaagaagugggagugaguggguaggggagcaggguggggggaggguauagggaacuuucaggauagcauuuaaaauguaaauaaagaaaauaucuaauaaaauaaaauaaaaauaaacagcuacuaaacagaaaaaaagaagaaugauaguucauuaucugauuuuacuuaccagaccagaauguugcuguggguuuuuggggggcgugggggcuuguuuugcuuuguuuuguuuaaacuuacacauuaaugauuuggaauauuuuaguggauaauauuuuguuuaucaaguguacuaugaauuaccuugauauuugaguuucuuacuagaaauauauuaacuucuaacauuuugugguuuuuuugugacuuaucuguuccucauuccagcuuuuuuggauauacuuacugcuuuguuagaggucauucuguguuuaggauauggacuuggugauuaauacacaguuuacuguuuaagcuuacuuugcaugauaagcuuucugcugaguaugagugugcuauggcucaagcugcuuuccugugauugaauaaccacucgugaucacauuuaaugguccaagcucuccuagucgguuuucuggguauugaauguuuauuuaauucuaauaguaauucuccaaauuugaaaagucuguguggagaguaaauacaacucuugucuucucuuauucagaucaucugaguaauucaagacuuaacugcaguuucuuccuuguucugaugucugcagugacccuacccccacauguuucuggugacagauucuaaaauauacugucuuucuugaguuucuguuguguuaaauugucuguuagccccucuuucuuggaaagaaauucaagaaguugagacucugcgguguccaagugggcuuuagaaguguguuuuuagugcuugacaagggaaggcugcuguguucgaccauccuuccuuuuuuuccuuuuuuuuuuuuuuacuccuuauuacugauuauuauuucugaauggucauuucuaggaucauauugguaugacccuugacuucaaacagcuuucagaccaaaguagagcguccuaauccaguguucgcaugcugaagaagaccuguagguuuuucccacagggguggggaauauugccuucaagaugugaaauaccauuuacccaaagaaaaaugauaggaagacauuugaacuguuaauuaugauaauguucuuaaggcacuuaaaggacuagagcuuguauuucagaaagaguagaauagaccagugacuuuauaauaugguuggcagucacccuacagucuaaaguccuauuucucuuuucuuaaucaugcuuuacuggaauauuugugaauuuaauuuguuguucacauacuaguucuuuaaaagugaagcaagccauucauugguuuacuuugauugaauuuucuacaggcugaagcucguuugcuugaggaacagcggagaguucagguuuaccuccacgagagcacacaagaugaacuagcacggaaaugugagcagguccucauugaaaaacacuuggaaauuuuucacacagaguuucagaauuuauuggaugcugacaagaaugaaggugaauauaauuuguuccauacacuucuguugguauuaccaauggugggcagauuguuuuguuuuuuauguuugaguauuccuccuucuauccuuuuaaaagaugaaaagauguuuuuguuuuguuuuuaguucccuuauuuguuccucggugcuggugggagcuguuagugauucagucacauuguuuugggauuuaggacuuuccaucuuuaccauaaauugaaaacauaugaaaugaaaaauuugaggauuccuuuugugacuuauaguugaaagagguaucuauauuaaguuuauuuuuuaggcaaauauuuuaguaccuuuugggggcauaaauagcuuaucaagauuuuagaaagcauucagugcuuuuccucaaugguacauuagcagauucuugugguaaaggggaaauauaauuuuaauaaccugaccccguuguugauuuuaacaaaguacaccagaucuagaagaugguuuccuauuucacaguguuuuucacuugauauaaguacuuaaugaacagaauaaguaugcacaguugguuuccaugcauacaauugguuccuuuuuuucuuucagauuugggccgcauguauaaucuuguaucuagaauucaggauggccuaggagaauugaaaaaacuacuagagacacauauucauaaucagggucuugcagcaauugagaaguguggagaagcugcucuaaauguaaguaggaccugacugaaaagcaauugagcccauuauuuucacaugccaacugcagguguguguggugaaucuuuguacaguuuuaccgauacagagaaccuguuuugacuuuuuuuuguuuuuguuuuuuuuuuguuuuuuucaagacaggguuucucuguauagcccuggcuguccuggaauucacuuuguagaccaggcuggccuugaacucagaaaucccccugccucugccucccgagugcugggauuaaaggcauguggcaccacgccuggcucuguuuugacuuuugaaaguagaauguugacaaaauccuuaaauuauucuagcauugccucccuuccagcccccuuuaagauggauuucauuauguagcccaugcuugaauuuacagagauccaucuacugccucuuuacuucugccuccuuaaagauuugcaccaccacaccuagcucucuccagcaccuuuuuaaguauugauagucuccuuuuuaauuuuugucuucuuuuaguguuucugucugaaugcauguaugucugaggaggucagaauagagagggucucagcgcuccuggaaccggaguuaugaaugguugugagccauuguuuaggugcuggggacugaacccugacacucuggaagagcauccagugaucuuaacugccucuagccucucuguuuuuguuuuguuuuguuuuaauguuuuuuuacuuuguuuguucauuuauauuuuuucacuauguuaaaaaauggcuuuguguuuauggguguggugcccacagaagccagauuuguugugagucacccaauuugcaugcugagaaauaaacucuggucuucugcaagaacaauacauguucuuaacugaugagccaucacuuaaccuaaauuugugaaugauaggucuguaaccuugggagaacaagaauaguuuagauuuuucuuguagaacaaaacuacacacaagcacagaaaaacauacaauaaucuuuuaaaucuagcaugacaaaacucauuuuauauccaggauacucuuuuuuuuuuuuuuuuuuuuuuuuuuuuugcaacaaaaggaagaguuuaauuauucuauaagggaacuccuuauggaagcaauucauucccaaauuaguuuuuauuccacaucaaacuaaauucuuauguaaacuguguuguacagugacaagaacuaaagugaccccccuguugguucaaccuugucucucacuguccauccuuugucagaugggccaugaauucaaggccauccuggacuaccuagugcauucuagaccuagugaguucuagguuagagaguaagacccuaucccaaaaaacaaacuacaaaccuagaucuuagaucuuaggcaaagcaaguguuuggagcuaaaaggagcagaaauugcaauaaggagaauagauagugucucucucucuuuuuuuuuaaaaaaaaaaaacaguuuauauuuauuagguuggccgggauauuuggcauaggauagugucucuuaaauuacugguguuugucucugcuuuucaugcuuuaagcuacaugcauucuuauuucugcuaauugacagagaagaaaaggucuauuaaacguguaaaucuguacuauguagugugugggaccuuauguuuauuucccuuuucuccucccccccccccauuuaauaucaaaguuaguuuuauagcuaggcaugguaguaaucgccuuuauaucuagcacccaggaggccaagacagguggaucucugugaguuugagaccagccugguccacauagugagucacaagaaagccaggucuguguagacccuauuuguaccaaugaaugauuuuuauauuccugaacacacaugggguggcuugguggcugauaaaggaauuucaggauuaaacauuuagugggugugcuacaaacaguugucucuuuuucugcaguugaugguuuguggucaaggcauguguuucugaaacuuuggcuuuauguugagguagaugauuuauauggacacaaaguuacucaaauggccaaguacuuaaggaaagcagucauacuuuugucccuagaugauuguaugauguguuuucuucuuccugggaacaaacuauaauuucuuuucccuaauuuccaaaaaguuaauuauccagaguguucaggaagaaccuauguauccuguaguaguuguguugauaaugguuaacuguuucauuacagaguuuaacaaguuaacaguuaaacaaacuuaacaauuggcucucguugucccugacccaaugaaaaauacagauucaaacuuugcucuucaagguggcuccaggcuuagguugaaagcauuguuuagaucuauuagaggcccauuuuacacacaugaagaguaagauguuucuuuaaaagccuaaagaaucccaauuuaucucuuuugacaguauucuugaaaaguacugggucagaauuugggaucacagcugauccucagaaguggugucuaagucuuacuauacagcuccucuuaucucagccucccacgucauccuacuauaugggcauaugccucacugccucaaucaggccuuuuugaagaccaguguugguuuucuugugugugcauuggaacuggggguguguacauauguguguaccagugcauguagaggucauaauucauuguugaauguagucuucaguuacuuuccaccuaggcaaagagagaucccacauagcccuucagugacuaugaauaagcacagucuaaagaaauaagucaggauuuaaggagauacuagaaagauuggagauagcugagcagauguugugagaacuuggaagcauguuaauuaugucaacucuacuugacggacacaaggaaagcugcuaagcauauuauuauuaauaaccauguaauugacaagacuagauuuuuauucaaaacauugcuacaguauagaaagugaaacuaaugagaggcuguaagcacuuuguuaaaacaagaugaaaugauagugaggggaauugaucacuuuguggcuuaggaaguauggauccccaugauuucugaaggucaggccgugcaagcuugcugggauuuuugucuagauuguuaaaagugucagucauggaugguauaacagcuucagaaucacggacauggaaugagagagaucccuugggaacugagaggagcuguguuucuaaugcacaaaaacaaaaaccucucauauguuguuauggguguggaccagauuuaacacuauuauguucauuuuguuuuaaaccucaacuuuuuuucucaaagccaggcauaguugcgcauauuuguaacucuaccauucaggaggcagaggcagagugaggaagaucagaccuaaggccacccuugacuauauaguacauaggagacuagccugggccaugagacccugccucaaaacaaagaaaaauauguuugauuuggaggacccauaguggaaugaagaaacugaccccccaaaauugucugagcuccauacugguguuguggcacuccucuuccauaccuacgcaugucauaaauacacacuguaauaaggagcuuucuaaaucuacuuuucuggggcuugauaucugguacauuguucuugucaaccauacucuacugggucuuuauuaugaggaaucuagaaucaaucugaaggcuacuuuauucuuugcuaagcauugcaucuccacgugggaauuuuuucuaggcauuuacugagaaauuugauuccaaauccugaaucugagggaaauuuuaaaaagccagagaaacgguuacaauucuucuagcacauaacaauaaauauagagucaauacugauauccaagacucuguaaauugccacaaagagcaagcgaacaggugugugggggugaagcuaaggucaguacuuuaggagccacagagagaggugggaacacgugguaagggaucucaccucucaauaaaugggaguuuaucgccucucuacugcuaagcuugagucacuguaaaauaaaaaaaaguaccggaauguuuguguguguguguguguguguguguguguguguguguguguacgcgcgcgcgcgccucugucugucuaucucuauaucuauauauauauuuaccuuguaugaauccucugagucauaguccaaaauaacaggcuuuauaaguaaugugaguguuuaaaguugacaagcaguugguuccuuucaaggaugcuaacgucccuaugggagcuggugacccuagugcuuaugcauuuccugugguuggacgcucacuguugcuagaacccuuuguaaacccaaugaccauggaagucauaagggaagagaauaugaaugguugcagugauuugaugugagaucagaaaugaguuuaaaaccugaguuugccaaaguaauaugggcuuuaauggcaaaccaaaauuaagucaagcaaagggaaaaaaugcauuucuuaaaaaagaagagcccauaugaagcaaggugcaugcuugacuuguaggugcucucggaugcuuucuuuagaguggugccaucucugcaacauacaggaguaguugucaggagacagggaccagauuaucugauuguaucagguaaagaccaucuuuccaucucagugaaauuauaucaucauacuauauacuuuuucauaauaauuuugcaucuauuuauuauauuuuuaaacaaggcaucccugaguguauagaaaauuauuauaucauaaaauucugguuuuauucauuguuaauuuaaaaaauuuuaccaaaaauacgaaguaauuaguauuuaggguuucuguuuucucauuccugaguugugcaagacagugugucaggaacuggggucuggacacagugguggcagcaggggaaggucauaaguuuaugguaagcuuggacuauauugaggaaugcuguuucaaaaauaucagcagugaaauugucaggaauuuagaggcauugccagaauauuugcuuucugugcaccugaagcuccugguuuaggaagggcuagucaagcgccuuccugccucucuguguccauuggcugggucuuucuauuuugaaagcugaagagaacaugccagacucaggagucaucucccugaguccuuucuugacucagcugccacaacuuuaguaagaaguguaacuuaaguuuaauuauauaaaauggacauuaaaaauuauaccugccacacauuauggguccuuggcuggcaaauagugacugcuacuugaccauugauauugauuccuucuccauccauuuccuguaucuaccaguacuguccccuuuagcaucuuccgauauuuucuuuugucugaagggucccugucgcccacaccccgaguucccagugcuugucccugaccuuggccacacaguuuccauuguguguccccaucuguguucagaccugucguuugauaaaaacuaauuucaugaucuuuucaaguuuuuuuuuaaggaauuuaauuuuuaauuugaagaauuauuuuguuuuacauggaaacauaauguccuguguguuuuagugauggaaccaaaaguauuucugaucauauuaacuucuuugaagauguaguuaaaacuuguagaacguuuuacagcagcaugaaauguguguuuuuaauuguuuguuuuggcuuucccucuaccuaaggaccccaagauguaugugcagacagugcuggauguucauaaaaaauacaaugcccuggugaugucagcauucaacaacgaugcuggcuucguagcugcucuugauaagguaaguaugucacugagaugccuauugaguauguagguacaggacaccuuuaacuaacugucuuuuauauacacaggcuuguggucgcuucauaaacaacaaugcgguuaccaaaauggcccagucauccaguaaauccccugagcugcuugcucgguacugugacuccuugcugaagaaaagguacugaccugguauuauauuuuccuaggacccuauuuaaacuugaguuuaauacaaggggucaguaguugcauuacauuuacuuguauugcacuacauuguugaaaccugcaucaacucccacuggcuuucugaacagucggagaaaacugaauacuacaauauggauuauguguuggucuacauuugacagagcuguuguguagcucaggcuagccucaaaacucccagcaguccuccuacccacagcuuuccacauacuggguauauagagcacaccaccaaauucagccaugugacuauuuuaaaguuuuguucuuauuuggucauuuguuggugcuacauacacuucauuuucaagucaccaucuacucaccugacauuuuccuaaucuucuuagcuguauucagagcuagaagcaagcuguauaauuaggcuuggcugccuccucuucguuauguucccuuagcuucucuccccgucacaguuucauuccugcaauguucaagguuugccucugucccacaaaccacaucaccaaaugcuaugaagggggcauagguccccaaauuuuacugauucugaugucaauauauuuuauaaagcucucuaaggcuaagaaaauacccacaauguaaacaaugacaguuuaacucucagagccugagcaauggaucagcuguuaaagacacuugcuguuccuguagaggaccuggguuuacuuccuaguauccaauugggcagcucacaaacaucuguaauuccaguuccagggaaucugaugccuucuauuggccugcauagguuccuguguguauauguggugcucauacagacaagcaggcauacacacauacacauaaacccuuuuuauuuuuuaaguuaacaagucaucaucagugagcuggaaaauaauuguacaaaagguaggccaugcagcaucuucagacugugggcguagaucaguagcaaaaccgaaacagcucacuauugggagaauuguguuaccugcuuuguacgugguggggaaacauuggguaaggucacuugcuaucucagauuguagggagcaauuguaagaaugcagcucacuuacugauauuuaaauggguugucuugaagggaaacuucauaauauuauaauuaacuucugucaguuuucaucuuagauauccuaguggcuauuuuguaaucucuuccaugaugggguacaaugugaggcugccagauugccuuaggagaggaaagugaccuccccuagcucaccagcugaucugagaacucauuauuaaauacuugaagccacgugggauacugcuaguuuggcagagugguaugugugcaugucugcuugcuuguuuguaaacaccuugcccuuuuaaauuucaguuccaagaacccagaagaggcagaacuagaagacacccucaaucaagugguaagguguuucauggccacacccauugcccuuuguaaggcucuuuuuauauugggccugaaauaugcaaagucauaaguauuuugauuucgaauuuaugguuuuacuccuaaauuuuacuuuuaauguugguacuucgcuucuuuuuuguuuuaaauuuucaaagauuauuuuauuguaugcauaugaguguuuugccuguguacauguauguauauguacuacaugugugcuugugccugaggaagucagaaggguguucuaucuccuggaacuagagaugguugugagccaccaugugcuaggaauggaacucagguccucugcaagaacagcaaguacccuaauccucugagccauuucuccagccuuaguacuuugcuucuugcuacuaagucuaguccagucaacugggauuuaaggaauggauggcgcuauuuauugugaacauuucagggugaguuugugccagguuagaacauaggcccacccaaaaccaagcagcuccuggagguagcuagagacaaaugggcuugugaguuaguuucacuaagguguucuuucccuggcuuugccagaugguggucuucaaguacaucgaggacaaagauguauuucagaaguucuaugcaaagaugcuugccaagagacugguacaucaaaacagugcgagugacgaugcugaagcaagcaugaucuccaaguuaaagguacuauucuuuuccuggagaaucccaauuuccucaggguuuauugacuugguucgugcagugugagaccugcuuuccagccaggccuccggugcuuuccuuccucugccacccuguuuaggguucuucuguuccauguagcccuuccuuggccaggcucugcucaccuuugccacauccucaccugcuucccacacauccagccuuguuggcucugugugaaugcuuagugguuuucuuagcucagacugccaaaacaaaauaccaugggccaggaaacuuaggcaaagaaaugaacucuccauucuggggacucagaagucuuaaaaaucuagaucuuguuuuugaagcaggcucuccuggcucucagucaaccacuguuuggcccauuacucacaggguaacauccucuuaaagaggcacccuacacucaugaacgcacaaggacucaucuucagauaccuccacaccagagguuuaaacuucagcaggcacauucuaaaaaaagacaguuuagugguagaauaagggacuagcagauuauuugggcuauuggaaggguuuggcuugagggucauugacagcccaggcuagccucuuccugcugaguacggugcuuucagaugugcaacauuccaccuguuucuaaauuauuuccuaucguaaucucuuuaaauugcagcuuuaaaugcugcaauauguuuacugcauauugaagacccaauuguccaacuuuuaauggucuuuuagaacauaaaacuuuaaucuguauauauuuaugccauaagauaugacuaaaucuuaguaauagcuucaaagaacuuaagaaaaaauauauuguauugugauuucucuaaaaaucccuuauaugcauugcauacauucauguuucuauacaaauuaaugagacaguugccuggguuuauuucagcaagcuugugguuuugaguacacuuccaaacuucagcgaauguuucaagacauugguguaagcaaagaucugaaugaacaguucaaaaaacaccugacgaauucagaaccgcuggacugugaguacugagugcucauagcagggcucuuugggcucuugguagcagaugagagaagugacauaauacggagugagggugguaaauggggucagaguuuccaagacuuagaagcaggcguuuccuuccaagugcucucuccuccuccugacacccagaugggaugguggcagcuuugcugagugagaccagucaggucugccucgcucugugcugauccaugggcuuguugugccuuugaaccugaguuugaauacauuucuuucuucucucucuuacuuguuuuugaagaaaguuggagaauuuuauucuucccaaaucaaaauugcugucaucauuaagcuuguauugcuaauggacaucuacguuaucugugaaaaugaaaguguccuaauuaauagguuccagaagucucuacugucggucuugacaguaguacaugguacacaaguugugguggagguagugcuuugcucuugugcuuuccauuuucuuguauuugggucuguuaaaucaaucauuccuggucaccauccauugcuugugcaugcugaacuucauauccagaaggggaaaaaauaaaauugaucaaggcagaucagcuuagaaacucuauauugacaguaaaguggaaaaccauugcccuggaggacaacaguugcuagguucuucaaccuuugguuugaaguuuugaucuaggacaucucacuguguauguguagccuacuagacuuguaaugaauuuuuaaaucuuuugacuauuucuuguguguguguguguguguguguguguguguguguaacaauagaauuuuaaaauuuguagaguaauuaaauguguuccuucccacaguggacuucaguauucagguccugaguucuggaucguggcccuuucagcagucuugcacguuugccuugccgucagagguaaggauaguuuugguuuuguuucuuggucucuuucagcuggcaagagggaaaagggcugccugaccuuagugugcugaccgaagugcuguguaagcagucagugcacuguuuguggggaaugugaaaugggccuguguuaaauagcgaaaggcucucuguugcagcaaacaguguugacuuauucccgacaagcagagucucacugguuacaugguaaacucuugauguaccuacugggcaugagguagaaaccugcuuugguacucacucugcagucuuaaaguguucacgagacgguccccggcauuuguaguucacuucucuguaagcacugauuuuguucucagaacuuggggcagggacuuuuauuuagaaaugcugacuguagaauggaaagccauggaugccgcauagugcuguucuuucaucuaguuggagcgcaguuaucagcgauuuacagcuuucuacgccagccgucacaguggcagaaaauugacaugguuguaucaacuguccaaaggggaacuagucacuaacugcuucaaaaacagauacacuuugcagguaaaaucuuuuuauuuggguaaaauauuugaguacuaauugaugauaagacaacuuauagaaacccaauuagauagcucaugcagugggaugcaguucauucucugacaaagccauguagggaguaaagcaugcuugucaugggcaggugagcugaacucauuuucucugacuauagaugcaagucacuuccuuacucugagccucagguuucuccuccacugaguuagcaguguuugcuuacaccauagaagugaucuuugauagguuugguagguuugcaugacaugcuggggugacaaauuuaaaagaugacauuucacucucuaguuccagucagagcucucugcagccucacagugauaagacucccuagcacgucuagcagugugcagugccuaguaauaacagcuaugggcugauugcauuucuacaaaagcugggguccaguuaacugugguucaaagucuagguuccuucuacucucacuucuguacucaguguguuucacaaguaaaacuuacuucauuccuugaaaaggucucaguagugagcugguaaugguaauuaaacuguagaguaugugacgaaaacuacucacuaguuuaaccuuuguacuuccacauugauaaguuaauuaaguaaccauuauaccugguguggaggucucuggcaacuuaaacauacacauaauguauaaaugguaugcauccccaaaauaauuuuuguucuacuaugcauaaaaauuaaacuuauaauuaaugucucuauaccugguguauguuuauauuauagguaugcucauauauuuaugcuuauauaggguacauuucaggagaaaaaugagucuuuucaguguuugaaagguaucuuuaagaaaaauguccauuccccugguugugacauuuuguauucccucuccuuuuuugccucugaagaaugcuuuucaugaaagcagguuguaccuuucccauguuuucacauuuccucuuucuuuccucuggaccacgaaggcguccacauuucagauggcaauccugcuucaguauaacacagaagacgccuauacugugcagcaguugacugacagcacucagauuaaaaugguauuuccacuguuugguacucacgcuauacucucaagcugccucuucuuuguucauugggauguuguggaaagggggagaggacauggguuucuuuggcuuacuagauguuagcagcauggagaaaaaaguaaaagcaguaaacucugaccaaggcaccagaagaccaggccagauagauccacagagagcauuucacuggggugucugacaccuuggaugccaacaggaccacugaguucucaugguugagucagagaaguuuauauaaugggcaagguucacuugagccaaaaguuaaccugacuagucucaaacuugugugaggagcauccagcacauuccugguacuggugguacuaaggucuaggguguaaagcuccaugugccacuaucacgacuuuauaacuuuauaguauuuaagcaaauuguuuuggagaaaacauggguucucaggcaggcaugguggccagcaccugugauggugguggccaguuccagcuguguccuuauaaaccuuuaugccaguuucauaaggguguuaagaaaugcucucuuuugucagcauuauaaggacagugugagaugcucuauuuuuuuuaaggguuucucuguguagcccuggcuauccaggaacucucuuuguaauccaugcuggcuaugaacucagagagaucugccugacucuaccucccaugugcuaggcuuaauggugugugcuaccaccacugucccuugaaaugcuguuuuaaacccagucagucacugucugucucugucucuaucucuguguguguguguguguguguguguguguguguguguguguguguguguguagauauauguacuuguuuguauucacguguuggagacuagaaguagaugucacuguggugcacaugucauucuuucuuugaagcagcgucugucagugaaucuggagcuuauccauucagcuaggcugcacagcaguaagacuuggggauucacucauuuauuccccauagcacuccagacaaggcugagcuuucacgugagugcugggaagcagauaaaagauuuuuuaacuuuccucauucacuuuauuuuuuguuugguugggauuuucuguugcuguuguugaaauagucaccuguacucuaggaugaccucagauucacugaguagguagagaaugccuuaaacuaacuuacuguccugucuuuguacauacaucuguguaucugugauagauuacuggcaugcuccacacccguuuuuaugcagugcaggagauugaauccagggccuugggcaugcuagccaaguacuccaccaguuaagaaguggucccugcccccauuuaauuuuuuaguugacauguguacuuacugauggguacacugcuguacaugcauuuuuuuuuuuuaaauuucaaugaaaccuacuuuuuuuuuuuuuuuuuugcuggcugguuggaaggguugacaggucugccucucuagucucugcuuggccuucuccucgaugccacaccaaucuuucuacuucuuuguauuacuagaauuaccuuaugggucuuuagcugcccuccuccagaccccagugcauagcugucacuucucugacagcaugggagccuugguuaagagugcaggugagaaaguuaaguccccaugccaugaggcuugaugguucuggaaaucaccagagcagcuaauaacuacagaggucauaugaugcacugaauugccaacuaaagccaaguuggcagcaagucagcugccuccaagucucagcauguucaugaaugcagugcaacuuugguucugcugaagcuccuuacugcuucguucgcauguucagggguguaguuuacugguagaacacuugccuggcacacaaagccuuggguuugauccacagcaccacauaaaugucuuaugaaccuucagacaucgaagaagugaaucauuuccuguagguuucauugaagaagcaggccauauauuguguccaguguuugugggaaacugcauuauuauugccuuugaauagugggugcuucaggccauaaagaacaagccaugucacuuucucugacuaguucugcuuugaggugaugaccauuucugugaggcugggccucugggacaggcacuguaaagaaguauucuuccuccuugcuuaccaucuuucucugauugcaggacauuuuggcacaaguccuacagauuuuacugaagucgaaauugcugguauguuuguauacuuuguguugagcuagaagacacccuuucccuaggaugugccuaguaacaguuauuuucuucuaggucuuagaagaugaaaaugccaauguugaugagguggaauugaagccagacaccuuaauaaaguuauaucuugguuauaaaaaguaagaaaaaucuaacauguagcugcuggucuuauccccuggcacuggccuacuucaggaucggcacgagccaggggaacuggacucugcuuuuaaugcugaguuugauuuucuuuaucuugaaaauaagucuugaguggcucauauggcauguuuagaccuuuauaucaaguuauuuugguguuauuacaauucacuaaauugaggggucaagugucacuucagucaucccucugugguaaaauuacauagcauugguggaggggcaguucgcagguagcaguagaaaugaugagaaaugauauagaagagaugggugugaaccaccugcccaguccagggaugcaaaacguguaguugaaagacaggaagcagacuuuucaaugaccuguuuccucuguuaucuugacaguaagaaauugaggguuaauaucaauguaccaaugaaaacugaacagaagcaggaacaagaaacuacacacaaaaauauagaggaagaccgcaaacuacugauucaggugacugaaccaugucugcacuguacacuuagggaaacgugcuggccuuguaugugcucaaacgcugccagaaugacaguucggugauggccaaagaugacaaugccugaagccagcacuuggugucugagggaugaaguauuuuauguuccaaacaaaaguagucuaaucuucuugccuaaguauugggaagcagguaauauguggcagauuaaagaaacaggagauuggggggaaggggaccuucuauuccuuuagagauccauuuuuucuuuauucuuuagugcuuuauaguuggccaaaauuagccccuccaaaauauuuaagauuuacauuuaguguauaugcauguuuugucuauauguagucacauauagauaggguucauguaugcuacugguguccccagaggccaggaaaggaugcugcaucucuuugguugugagcuacuccauagguccugggaacugaaaccagguccucuggaagaccucagugcucuuaaaccacugcaccaucaaucuagccccuuagacaaaacauuuuaauggauaaagcugauggauagagcugauugcuuguacccucccugaccuguaggauaguuguuacccuagcauggaaguugaguaugaggugguacaggcugccuugaacuuucaugcucagcuguuaaaccucuaagcauguguuuuucuuguugauugcauaggcggccaucgugagaaucaugaaaaugaggaagguccugaaacaccagcaguuacuuggugaaguccucacucagcucuccuccagguucaaaccucgggucccggugaucaagguacaggaauuacagagcaugguuaggaaacuuguagcagaaggauuaauggcuguuucaugaaaaugggaacuggcuuacucauucauacaaaaaacuucaacaaaggaaagucagcuaacuucauucuugaaguaaauauaagaggcauaugugucauaaauauacuuuuauaauugauauucugaugaggaguacgucacaggcauccaagaagucacauguuccuccccuauccuauguuucucuggcaaugagcuagcuguccugcagccuuggcugauuuugccuggugggaagugguguacaguguucucuauugagaacccaccuggcaguaugaggggacucauuggggcugcauuguugggaaauacuuguccauuucugcuuccgagcaggaacauacuccccuguaucuaggggacuaaugaucucauuugccaaguuuucugauggcaauaacucagcagaccuuuccuuuucugaaacgacuuggguaagccacagccauuggagaacccagggauggcgaugcauggugaguccucaguggucaggagcuauuagcaccaugcuagcauguucuucaaguucugacucacccauccugugcuccugaccugugacagcagaguccugcccagaagcagccaggcuuuguuaaaaagggagauuguggccuagaugugcuagagcccuugccuucuuaaugcacagggcaguuuggagugggugggggugcagucacccacagguguugcugaagguucagguggguucaggacaauagacagguugaauuugcuuccugcugagcucaguggaggguaacuguggugagggugacagaccucuuuccugaugguuauuuucauuucucucccccuuuaacucccucuucuuccuaaaacaaugcccagaaaugcauugauauucucaucgaaaaagaauauuuggagcgagucgauggugagaaggacaccuacaguuacuuggcuuaacccaucuagcagggucugcaugacccacaagcagauaguuccagugaauaaaauggaaacaacucaaguucauagcagccagccugccgccauuuggaccuucauuuuuaaagcugagaccacaguucccaccagcugguuucaggcuacagcaggacugcucaggacugacugacacauuucagucuguaaacagacgccaaugccauuuacccuaacucacagacagaggggaaccgaaccuuccaugcugaggcugcaugcuaccgcacuuaaaucaauacauuggcucccugguuaacagcugucgucugaggcagcacacgagagcgagucugaauggacccacguguaaucugcuaugaaaaccauuuguauaguguguuucauuuuuuuaaugugugaaaauaaagaaaauuaaaggauuucuguacaaguugcauuugguuuuguuuuaaguuuuucuaauuucuauauguaaauaaaagauuuaaugauugugcaa

SEQ ID NO: 12362 - RNA, 71817 nt, Mus musculus
uugcacaaucauuaaaucuuuuauuuacauauagaaauuagaaaaacuuaaaacaaaaccaaaugcaacuuguacagaaauccuuuaauuuucuuuauuuucacacauuaaaaaaaugaaacacacuauacaaaugguuuucauagcagauuacacguggguccauucagacucgcucucgugugcugccucagacgacagcuguuaaccagggagccaauguauugauuuaagugcgguagcaugcagccucagcauggaagguucgguuccccucugucugugaguuaggguaaauggcauuggcgucuguuuacagacugaaaugugucagucaguccugagcaguccugcuguagccugaaaccagcuggugggaacuguggucucagcuuuaaaaaugaagguccaaauggcggcaggcuggcugcuaugaacuugaguuguuuccauuuuauucacuggaacuaucugcuugugggucaugcagacccugcuagauggguuaagccaaguaacuguagguguccuucucaccaucgacucgcuccaaauauucuuuuucgaugagaauaucaaugcauuucugggcauuguuuuaggaagaagagggaguuaaagggggagagaaaugaaaauaaccaucaggaaagaggucugucacccucaccacaguuacccuccacugagcucagcaggaagcaaauucaaccugucuauuguccugaacccaccugaaccuucagcaacaccugugggugacugcacccccacccacuccaaacugcccugugcauuaagaaggcaagggcucuagcacaucuaggccacaaucucccuuuuuaacaaagccuggcugcuucugggcaggacucugcugucacaggucaggagcacaggaugggugagucagaacuugaagaacaugcuagcauggugcuaauagcuccugaccacugaggacucaccaugcaucgccaucccuggguucuccaauggcuguggcuuacccaagucguuucagaaaaggaaaggucugcugaguuauugccaucagaaaacuuggcaaaugagaucauuaguccccuagauacaggggaguauguuccugcucggaagcagaaauggacaaguauuucccaacaaugcagccccaaugaguccccucauacugccagguggguucucaauagagaacacuguacaccacuucccaccaggcaaaaucagccaaggcugcaggacagcuagcucauugccagagaaacauaggauaggggaggaacaugugacuucuuggaugccugugacguacuccucaucagaauaucaauuauaaaaguauauuuaugacacauaugccucuuauauuuacuucaagaaugaaguuagcugacuuuccuuuguugaaguuuuuuguaugaaugaguaagccaguucccauuuucaugaaacagccauuaauccuucugcuacaaguuuccuaaccaugcucuguaauuccuguaccuugaucaccgggacccgagguuugaaccuggaggagagcugagugaggacuucaccaaguaacugcugguguuucaggaccuuccucauuuucaugauucucacgauggccgccuaugcaaucaacaagaaaaacacaugcuuagagguuuaacagcugagcaugaaaguucaaggcagccuguaccaccucauacucaacuuccaugcuaggguaacaacuauccuacaggucagggaggguacaagcaaucagcucuauccaucagcuuuauccauuaaaauguuuugucuaaggggcuagauugauggugcagugguuuaagagcacugaggucuuccagaggaccugguuucaguucccaggaccuauggaguagcucacaaccaaagagaugcagcauccuuuccuggccucuggggacaccaguagcauacaugaacccuaucuauaugugacuacauauagacaaaacaugcauauacacuaaauguaaaucuuaaauauuuuggaggggcuaauuuuggccaacuauaaagcacuaaagaauaaagaaaaaauggaucucuaaaggaauagaagguccccuuccccccaaucuccuguuucuuuaaucugccacauauuaccugcuucccaauacuuaggcaagaagauuagacuacuuuuguuuggaacauaaaauacuucaucccucagacaccaagugcuggcuucaggcauugucaucuuuggccaucaccgaacugucauucuggcagcguuugagcacauacaaggccagcacguuucccuaaguguacagugcagacaugguucagucaccugaaucaguaguuugcggucuuccucuauauuuuuguguguaguuucuuguuccugcuucuguucaguuuucauugguacauugauauuaacccucaauuucuuacugucaagauaacagaggaaacaggucauugaaaagucugcuuccugucuuucaacuacacguuuugcaucccuggacugggcaggugguucacacccaucucuucuauaucauuucucaucauuucuacugcuaccugcgaacugccccuccaccaaugcuauguaauuuuaccacagagggaugacugaagugacacuugaccccucaauuuagugaauuguaauaacaccaaaauaacuugauauaaaggucuaaacaugccauaugagccacucaagacuuauuuucaagauaaagaaaaucaaacucagcauuaaaagcagaguccaguuccccuggcucgugccgauccugaaguaggccagugccaggggauaagaccagcagcuacauguuagauuuuucuuacuuuuuauaaccaagauauaacuuuauuaaggugucuggcuucaauuccaccucaucaacauuggcauuuucaucuucuaagaccuagaagaaaauaacuguuacuaggcacauccuagggaaagggugucuucuagcucaacacaaaguauacaaacauaccagcaauuucgacuucaguaaaaucuguaggacuugugccaaaauguccugcaaucagagaaagaugguaagcaaggaggaagaauacuucuuuacagugccugucccagaggcccagccucacagaaauggucaucaccucaaagcagaacuagucagagaaagugacauggcuuguucuuuauggccugaagcacccacuauucaaaggcaauaauaaugcaguuucccacaaacacuggacacaauauauggccugcuucuucaaugaaaccuacaggaaaugauucacuucuucgaugucugaagguucauaagacauuuauguggugcuguggaucaaacccaaggcuuugugugccaggcaaguguucuaccaguaaacuacaccccugaacaugcgaacgaagcaguaaggagcuucagcagaaccaaaguugcacugcauucaugaacaugcugagacuuggaggcagcugacuugcugccaacuuggcuuuaguuggcaauucagugcaucauaugaccucuguaguuauuagcugcucuggugauuuccagaaccaucaagccucauggcauggggacuuaacuuucucaccugcacucuuaaccaaggcucccaugcugucagagaagugacagcuaugcacuggggucuggaggagggcagcuaaagacccauaagguaauucuaguaauacaaagaaguagaaagauugguguggcaucgaggagaaggccaagcagagacuagagaggcagaccugucaacccuuccaaccagccagcaaaaaaaaaaaaaaaaaaguagguuucauugaaauuuaaaaaaaaaaaaugcauguacagcaguguacccaucaguaaguacacaugucaacuaaaaaauuaaaugggggcagggaccacuucuuaacugguggaguacuuggcuagcaugcccaaggcccuggauucaaucuccugcacugcauaaaaacggguguggagcaugccaguaaucuaucacagauacacagauguauguacaaagacaggacaguaaguuaguuuaaggcauucucuaccuacucagugaaucugaggucauccuagaguacaggugacuauuucaacaacagcaacagaaaaucccaaccaaacaaaaaauaaagugaaugaggaaaguuaaaaaaucuuuuaucugcuucccagcacucacgugaaagcucagccuugucuggagugcuauggggaauaaaugagugaauccccaagucuuacugcugugcagccuagcugaauggauaagcuccagauucacugacagacgcugcuucaaagaaagaaugacaugugcaccacagugacaucuacuucuagucuccaacacgugaauacaaacaaguacauauaucuacacacacacacacacacacacacacacacacacacacacacacacacacagagauagagacagagacagacagugacugacuggguuuaaaacagcauuucaagggacaguggugguagcacacaccauuaagccuagcacaugggagguagagucaggcagaucucucugaguucauagccagcauggauuacaaagagaguuccuggauagccagggcuacacagagaaacccuuaaaaaaaauagagcaucucacacuguccuuauaaugcugacaaaagagagcauuucuuaacacccuuaugaaacuggcauaaagguuuauaaggacacagcuggaacuggccaccaccaucacaggugcuggccaccaugccugccugagaacccauguuuucuccaaaacaauuugcuuaaauacuauaaaguuauaaagucgugauaguggcacauggagcuuuacacccuagaccuuaguaccaccaguaccaggaaugugcuggaugcuccucacacaaguuugagacuagucagguuaacuuuuggcucaagugaaccuugcccauuauauaaacuucucugacucaaccaugagaacucagugguccuguuggcauccaaggugucagacaccccagugaaaugcucucuguggaucuaucuggccuggucuucuggugccuuggucagaguuuacugcuuuuacuuuuuucuccaugcugcuaacaucuaguaagccaaagaaacccauguccucucccccuuuccacaacaucccaaugaacaaagaagaggcagcuugagaguauagcgugaguaccaaacaguggaaauaccauuuuaaucugagugcugucagucaacugcugcacaguauaggcgucuucuguguuauacugaagcaggauugccaucugaaauguggacgccuucgugguccagaggaaagaaagaggaaaugugaaaacaugggaaagguacaaccugcuuucaugaaaagcauucuucagaggcaaaaaaggagagggaauacaaaaugucacaaccaggggaauggacauuuuucuuaaagauaccuuucaaacacugaaaagacucauuuuucuccugaaauguacccuauauaagcauaaauauaugagcauaccuauaauauaaacauacaccagguauagagacauuaauuauaaguuuaauuuuuaugcauaguagaacaaaaauuauuuuggggaugcauaccauuuauacauuauguguauguuuaaguugccagagaccuccacaccagguauaaugguuacuuaauuaacuuaucaauguggaaguacaaagguuaaacuagugaguaguuuucgucacauacucuacaguuuaauuaccauuaccagcucacuacugagaccuuuucaaggaaugaaguaaguuuuacuugugaaacacacugaguacagaagugagaguagaaggaaccuagacuuugaaccacaguuaacuggaccccagcuuuuguagaaaugcaaucagcccauagcuguuauuacuaggcacugcacacugcuagacgugcuagggagucuuaucacugugaggcugcagagagcucugacuggaacuagagagugaaaugucaucuuuuaaauuugucaccccagcaugucaugcaaaccuaccaaaccuaucaaagaucacuucuaugguguaagcaaacacugcuaacucaguggaggagaaaccugaggcucagaguaaggaagugacuugcaucuauagucagagaaaaugaguucagcucaccugcccaugacaagcaugcuuuacucccuacauggcuuugucagagaaugaacugcaucccacugcaugagcuaucuaauuggguuucuauaaguugucuuaucaucaauuaguacucaaauauuuuacccaaauaaaaagauuuuaccugcaaaguguaucuguuuuugaagcaguuagugacuaguuccccuuuggacaguugauacaaccaugucaauuuucugccacugugacggcuggcguagaaagcuguaaaucgcugauaacugcgcuccaacuagaugaaagaacagcacuaugcggcauccauggcuuuccauucuacagucagcauuucuaaauaaaagucccugccccaaguucugagaacaaaaucagugcuuacagagaagugaacuacaaaugccggggaccgucucgugaacacuuuaagacugcagagugaguaccaaagcagguuucuaccucaugcccaguagguacaucaagaguuuaccauguaaccagugagacucugcuugucgggaauaagucaacacuguuugcugcaacagagagccuuucgcuauuuaacacaggcccauuucacauuccccacaaacagugcacugacugcuuacacagcacuucggucagcacacuaaggucaggcagcccuuuucccucuugccagcugaaagagaccaagaaacaaaaccaaaacuauccuuaccucugacggcaaggcaaacgugcaagacugcugaaagggccacgauccagaacucaggaccugaauacugaaguccacugugggaaggaacacauuuaauuacucuacaaauuuuaaaauucuauuguuacacacacacacacacacacacacacacacacacaagaaauagucaaaagauuuaaaaauucauuacaagucuaguaggcuacacauacacagugagauguccuagaucaaaacuucaaaccaaagguugaagaaccuagcaacuguuguccuccagggcaaugguuuuccacuuuacugucaauauagaguuucuaagcugaucugccuugaucaauuuuauuuuuuccccuucuggauaugaaguucagcaugcacaagcaauggauggugaccaggaaugauugauuuaacagacccaaauacaagaaaauggaaagcacaagagcaaagcacuaccuccaccacaacuuguguaccauguacuacugucaagaccgacaguagagacuucuggaaccuauuaauuaggacacuuucauuuucacagauaacguagauguccauuagcaauacaagcuuaaugaugacagcaauuuugauuugggaagaauaaaauucuccaacuuucuucaaaaacaaguaagagagagaagaaagaaauguauucaaacucagguucaaaggcacaacaagcccauggaucagcacagagcgaggcagaccugacuggucucacucagcaaagcugccaccaucccaucugggugucaggaggaggagagagcacuuggaaggaaacgccugcuucuaagucuuggaaacucugaccccauuuaccacccucacuccguauuaugucacuucucucaucugcuaccaagagcccaaagagcccugcuaugagcacucaguacucacaguccagcgguucugaauucgucagguguuuuuugaacuguucauucagaucuuugcuuacaccaaugucuugaaacauucgcugaaguuuggaaguguacucaaaaccacaagcuugcugaaauaaacccaggcaacugucucauuaauuuguauagaaacaugaauguaugcaaugcauauaagggauuuuuagagaaaucacaauacaauauauuuuuucuuaaguucuuugaagcuauuacuaagauuuagucauaucuuauggcauaaauauauacagauuaaaguuuuauguucuaaaagaccauuaaaaguuggacaauugggucuucaauaugcaguaaacauauugcagcauuuaaagcugcaauuuaaagagauuacgauaggaaauaauuuagaaacagguggaauguugcacaucugaaagcaccguacucagcaggaagaggcuagccugggcugucaaugacccucaagccaaacccuuccaauagcccaaauaaucugcuagucccuuauucuaccacuaaacugucuuuuuuuagaaugugccugcugaaguuuaaaccucugguguggagguaucugaagaugaguccuugugcguucaugaguguagggugccucuuuaagaggauguuacccugugaguaaugggccaaacagugguugacugagagccaggagagccugcuucaaaaacaagaucuagauuuuuaagacuucugaguccccagaauggagaguucauuucuuugccuaaguuuccuggcccaugguauuuuguuuuggcagucugagcuaagaaaaccacuaagcauucacacagagccaacaaggcuggaugugugggaagcaggugaggauguggcaaaggugagcagagccuggccaaggaagggcuacauggaacagaagaacccuaaacaggguggcagaggaaggaaagcaccggaggccuggcuggaaagcaggucucacacugcacgaaccaagucaauaaacccugaggaaauugggauucuccaggaaaagaauaguaccuuuaacuuggagaucaugcuugcuucagcaucgucacucgcacuguuuugauguaccagucucuuggcaagcaucuuugcauagaacuucugaaauacaucuuuguccucgauguacuugaagaccaccaucuggcaaagccagggaaagaacaccuuagugaaacuaacucacaagcccauuugucucuagcuaccuccaggagcugcuugguuuugggugggccuauguucuaaccuggcacaaacucacccugaaauguucacaauaaauagcgccauccauuccuuaaaucccaguugacuggacuagacuuaguagcaagaagcaaaguacuaaggcuggagaaauggcucagaggauuaggguacuugcuguucuugcagaggaccugaguuccauuccuagcacaugguggcucacaaccaucucuaguuccaggagauagaacacccuucugacuuccucaggcacaagcacacauguaguacauauacauacauguacacaggcaaaacacucauaugcauacaauaaaauaaucuuugaaaauuuaaaacaaaaaagaagcgaaguaccaacauuaaaaguaaaauuuaggaguaaaaccauaaauucgaaaucaaaauacuuaugacuuugcauauuucaggcccaauauaaaaagagccuuacaaagggcaauggguguggccaugaaacaccuuaccacuugauugagggugucuucuaguucugccucuucuggguucuuggaacugaaauuuaaaagggcaagguguuuacaaacaagcaagcagacaugcacacauaccacucugccaaacuagcaguaucccacguggcuucaaguauuuaauaaugaguucucagaucagcuggugagcuaggggaggucacuuuccucuccuaaggcaaucuggcagccucacauuguaccccaucauggaagagauuacaaaauagccacuaggauaucuaagaugaaaacugacagaaguuaauuauaauauuaugaaguuucccuucaagacaacccauuuaaauaucaguaagugagcugcauucuuacaauugcucccuacaaucugagauagcaagugaccuuacccaauguuuccccaccacguacaaagcagguaacacaauucucccaauagugagcuguuucgguuuugcuacugaucuacgcccacagucugaagaugcugcauggccuaccuuuuguacaauuauuuuccagcucacugaugaugacuuguuaacuuaaaaaauaaaaaggguuuauguguauguguguaugccugcuugucuguaugagcaccacauauacacacaggaaccuaugcaggccaauagaaggcaucagauucccuggaacuggaauuacagauguuugugagcugcccaauuggauacuaggaaguaaacccagguccucuacaggaacagcaagugucuuuaacagcugauccauugcucaggcucugagaguuaaacugucauuguuuacauuguggguauuuucuuagccuuagagagcuuuauaaaauauauugacaucagaaucaguaaaauuuggggaccuaugcccccuucauagcauuuggugaugugguuugugggacagaggcaaaccuugaacauugcaggaaugaaacugugacggggagagaagcuaagggaacauaacgaagaggaggcagccaagccuaauuauacagcuugcuucuagcucugaauacagcuaagaagauuaggaaaaugucaggugaguagauggugacuugaaaaugaaguguauguagcaccaacaaaugaccaaauaagaacaaaacuuuaaaauagucacauggcugaauuugguggugugcucuauauacccaguauguggaaagcuguggguaggaggacugcugggaguuuugaggcuagccugagcuacacaacagcucugucaaauguagaccaacacauaauccauauuguaguauucaguuuucuccgacuguucagaaagccagugggaguugaugcagguuucaacaauguagugcaauacaaguaaauguaaugcaacuacugaccccuuguauuaaacucaaguuuaaauaggguccuaggaaaauauaauaccaggucaguaccuuuucuucagcaaggagucacaguaccgagcaagcagcucaggggauuuacuggaugacugggccauuuugguaaccgcauuguuguuuaugaagcgaccacaagccuguguauauaaaagacaguuaguuaaagguguccuguaccuacauacucaauaggcaucucagugacauacuuaccuuaucaagagcagcuacgaagccagcaucguuguugaaugcugacaucaccagggcauuguauuuuuuaugaacauccagcacugucugcacauacaucuugggguccuuagguagagggaaagccaaaacaaacaauuaaaaacacacauuucaugcugcuguaaaacguucuacaaguuuuaacuacaucuucaaagaaguuaauaugaucagaaauacuuuugguuccaucacuaaaacacacaggacauuauguuuccauguaaaacaaaauaauucuucaaauuaaaaauuaaauuccuuaaaaaaaaacuugaaaagaucaugaaauuaguuuuuaucaaacgacaggucugaacacagauggggacacacaauggaaacuguguggccaaggucagggacaagcacugggaacucggggugugggcgacagggacccuucagacaaaagaaaauaucggaagaugcuaaaggggacaguacugguagauacaggaaauggauggagaaggaaucaauaucaauggucaaguagcagucacuauuugccagccaaggacccauaauguguggcagguauaauuuuuaauguccauuuuauauaauuaaacuuaaguuacacuucuuacuaaaguuguggcagcugagucaagaaaggacucagggagaugacuccugagucuggcauguucucuucagcuuucaaaauagaaagacccagccaauggacacagagaggcaggaaggcgcuugacuagcccuuccuaaaccaggagcuucaggugcacagaaagcaaauauucuggcaaugccucuaaauuccugacaauuucacugcugauauuuuugaaacagcauuccucaauauaguccaagcuuaccauaaacuuaugaccuuccccugcugccaccacuguguccagaccccaguuccugacacacugucuugcacaacucaggaaugagaaaacagaaacccuaaauacuaauuacuucguauuuuugguaaaauuuuuuaaauuaacaaugaauaaaaccagaauuuuaugauauaauaauuuucuauacacucagggaugccuuguuuaaaaauauaauaaauagaugcaaaauuauuaugaaaaaguauauaguaugaugauauaauuucacugagauggaaagauggucuuuaccugauacaaucagauaaucuggucccugucuccugacaacuacuccuguauguugcagagauggcaccacucuaaagaaagcauccgagagcaccuacaagucaagcaugcaccuugcuucauaugggcucuucuuuuuuaagaaaugcauuuuuucccuuugcuugacuuaauuuugguuugccauuaaagcccauauuacuuuggcaaacucagguuuuaaacucauuucugaucucacaucaaaucacugcaaccauucauauucucuucccuuaugacuuccauggucauuggguuuacaaaggguucuagcaacagugagcguccaaccacaggaaaugcauaagcacuagggucaccagcucccauagggacguuagcauccuugaaaggaaccaacugcuugucaacuuuaaacacucacauuacuuauaaagccuguuauuuuggacuaugacucagaggauucauacaagguaaauauauauauagauauagagauagacagacagaggcgcgcgcgcgcguacacacacacacacacacacacacacacacacacacacacaaacauuccgguacuuuuuuuuauuuuacagugacucaagcuuagcaguagagaggcgauaaacucccauuuauugagaggugagaucccuuaccacguguucccaccucucucuguggcuccuaaaguacugaccuuagcuucacccccacacaccuguucgcuugcucuuuguggcaauuuacagagucuuggauaucaguauugacucuauauuuauuguuaugugcuagaagaauuguaaccguuucucuggcuuuuuaaaauuucccucagauucaggauuuggaaucaaauuucucaguaaaugccuagaaaaaauucccacguggagaugcaaugcuuagcaaagaauaaaguagccuucagauugauucuagauuccucauaauaaagacccaguagaguaugguugacaagaacaauguaccagauaucaagccccagaaaaguagauuuagaaagcuccuuauuacaguguguauuuaugacaugcguagguauggaagaggagugccacaacaccaguauggagcucagacaauuuuggggggucaguuucuucauuccacuauggguccuccaaaucaaacauauuuuucuuuguuuugaggcagggucucauggcccaggcuagucuccuauguacuauauagucaaggguggccuuaggucugaucuuccucacucugccucugccuccugaaugguagaguuacaaauaugcgcaacuaugccuggcuuugagaaaaaaaguugagguuuaaaacaaaaugaacauaauaguguuaaaucugguccacacccauaacaacauaugagagguuuuuguuuuugugcauuagaaacacagcuccucucaguucccaagggaucucucucauuccauguccgugauucugaagcuguuauaccauccaugacugacacuuuuaacaaucuagacaaaaaucccagcaagcuugcacggccugaccuucagaaaucauggggauccauacuuccuaagccacaaagugaucaauuccccucacuaucauuucaucuuguuuuaacaaagugcuuacagccucucauuaguuucacuuucuauacuguagcaauguuuugaauaaaaaucuagucuugucaauuacaugguuauuaauaauaauaugcuuagcagcuuuccuuguguccgucaaguagaguugacauaauuaacaugcuuccaaguucucacaacaucugcucagcuaucuccaaucuuucuaguaucuccuuaaauccugacuuauuucuuuagacugugcuuauucauagucacugaagggcuaugugggaucucucuuugccuagguggaaaguaacugaagacuacauucaacaaugaauuaugaccucuacaugcacugguacacacauauguacacacccccaguuccaaugcacacacaagaaaaccaacacuggucuucaaaaaggccugauugaggcagugaggcauaugcccauauaguaggaugacgugggaggcugagauaagaggagcuguauaguaagacuuagacaccacuucugaggaucagcugugaucccaaauucugacccaguacuuuucaagaauacugucaaaagagauaaauugggauucuuuaggcuuuuaaagaaacaucuuacucuucauguguguaaaaugggccucuaauagaucuaaacaaugcuuucaaccuaagccuggagccaccuugaagagcaaaguuugaaucuguauuuuucauugggucagggacaacgagagccaauuguuaaguuuguuuaacuguuaacuuguuaaacucuguaaugaaacaguuaaccauuaucaacacaacuacuacaggauacauagguucuuccugaacacucuggauaauuaacuuuuuggaaauuagggaaaagaaauuauaguuuguucccaggaagaagaaaacacaucauacaaucaucuagggacaaaaguaugacugcuuuccuuaaguacuuggccauuugaguaacuuuguguccauauaaaucaucuaccucaacauaaagccaaaguuucagaaacacaugccuugaccacaaaccaucaacugcagaaaaagagacaacuguuuguagcacacccacuaaauguuuaauccugaaauuccuuuaucagccaccaagccaccccauguguguucaggaauauaaaaaucauucauugguacaaauagggucuacacagaccuggcuuucuugugacucacuauguggaccaggcuggucucaaacucacagagauccaccugucuuggccuccugggugcuagauauaaaggcgauuacuaccaugccuagcuauaaaacuaacuuugauauuaaaugggggggggggaggagaaaagggaaauaaacauaaggucccacacacuacauaguacagauuuacacguuuaauagaccuuuucuucucugucaauuagcagaaauaagaaugcauguagcuuaaagcaugaaaagcagagacaaacaccaguaauuuaagagacacuauccuaugccaaauaucccggccaaccuaauaaauauaaacuguuuuuuuuuuuuaaaaaaaaagagagagagacacuaucuauucuccuuauugcaauuucugcuccuuuuagcuccaaacacuugcuuugccuaagaucuaagaucuagguuuguaguuuguuuuuugggauagggucuuacucucuaaccuagaacucacuaggucuagaaugcacuagguaguccaggauggccuugaauucauggcccaucugacaaaggauggacagugagagacaagguugaaccaacaggggggucacuuuaguucuugucacuguacaacacaguuuacauaagaauuuaguuugauguggaauaaaaacuaauuugggaaugaauugcuuccauaaggaguucccuuauagaauaauuaaacucuuccuuuuguugcaaaaaaaaaaaaaaaaaaaaaaaaaaaaagaguauccuggauauaaaaugaguuuugucaugcuagauuuaaaagauuauuguauguuuuucugugcuuguguguaguuuuguucuacaagaaaaaucuaaacuauucuuguucucccaagguuacagaccuaucauucacaaauuuagguuaagugauggcucaucaguuaagaacauguauuguucuugcagaagaccagaguuuauuucucagcaugcaaauugggugacucacaacaaaucuggcuucugugggcaccacacccauaaacacaaagccauuuuuuaacauagugaaaaaauauaaaugaacaaacaaaguaaaaaaacauuaaaacaaaacaaaacaaaaacagagaggcuagaggcaguuaagaucacuggaugcucuuccagagugucaggguucaguccccagcaccuaaacaauggcucacaaccauucauaacuccgguuccaggagcgcugagacccucucuauucugaccuccucagacauacaugcauucagacagaaacacuaaaagaagacaaaaauuaaaaaggagacuaucaauacuuaaaaaggugcuggagagagcuaggugugguggugcaaaucuuuaaggaggcagaaguaaagaggcaguagauggaucucuguaaauucaagcaugggcuacauaaugaaauccaucuuaaagggggcuggaagggaggcaaugcuagaauaauuuaaggauuuugucaacauucuacuuucaaaagucaaaacagagccaggcguggugccacaugccuuuaaucccagcacucgggaggcagaggcagggggauuucugaguucaaggccagccuggucuacaaagugaauuccaggacagccagggcuauacagagaaacccugucuugaaaaaaacaaaaaaaaaacaaaaacaaaaaaaagucaaaacagguucucuguaucgguaaaacuguacaaagauucaccacacacaccugcaguuggcaugugaaaauaaugggcucaauugcuuuucagucagguccuacuuacauuuagagcagcuucuccacacuucucaauugcugcaagacccugauuaugaauaugugucucuaguaguuuuuucaauucuccuaggccauccugaauucuagauacaagauuauacaugcggcccaaaucugaaagaaaaaaaggaaccaauuguaugcauggaaaccaacugugcauacuuauucuguucauuaaguacuuauaucaagugaaaaacacugugaaauaggaaaccaucuucuagaucugguguacuuuguuaaaaucaacaacggggucagguuauuaaaauuauauuuccccuuuaccacaagaaucugcuaauguaccauugaggaaaagcacugaaugcuuucuaaaaucuugauaagcuauuuaugcccccaaaagguacuaaaauauuugccuaaaaaauaaacuuaauauagauaccucuuucaacuauaagucacaaaaggaauccucaaauuuuucauuucauauguuuucaauuuaugguaaagauggaaaguccuaaaucccaaaacaaugugacugaaucacuaacagcucccaccagcaccgaggaacaaauaagggaacuaaaaacaaaacaaaaacaucuuuucaucuuuuaaaaggauagaaggaggaauacucaaacauaaaaaacaaaacaaucugcccaccauugguaauaccaacagaaguguauggaacaaauuauauucaccuucauucuugucagcauccaauaaauucugaaacucugugugaaaaauuuccaaguguuuuucaaugaggaccugcucacauuuccgugcuaguucaucuugugugcucucguggagguaaaccugaacucuccgcuguuccucaagcaaacgagcuucagccuguagaaaauucaaucaaaguaaaccaaugaauggcuugcuucacuuuuaaagaacuaguaugugaacaacaaauuaaauucacaaauauuccaguaaagcaugauuaagaaaagagaaauaggacuuuagacuguagggugacugccaaccauauuauaaagucacuggucuauucuacucuuucugaaauacaagcucuaguccuuuaagugccuuaagaacauuaucauaauuaacaguucaaaugucuuccuaucauuuuucuuuggguaaaugguauuucacaucuugaaggcaauauuccccaccccugugggaaaaaccuacaggucuucuucagcaugcgaacacuggauuaggacgcucuacuuuggucugaaagcuguuugaagucaagggucauaccaauaugauccuagaaaugaccauucagaaauaauaaucaguaauaaggaguaaaaaaaaaaaaaaggaaaaaaaggaaggauggucgaacacagcagccuucccuugucaagcacuaaaaacacacuucuaaagcccacuuggacaccgcagagucucaacuucuugaauuucuuuccaagaaagaggggcuaacagacaauuuaacacaacagaaacucaagaaagacaguauauuuuagaaucugucaccagaaacauguggggguagggucacugcagacaucagaacaaggaagaaacugcaguuaagucuugaauuacucagaugaucugaauaagagaagacaagaguuguauuuacucuccacacagacuuuucaaauuuggagaauuacuauuagaauuaaauaaacauucaauacccagaaaaccgacuaggagagcuuggaccauuaaaugugaucacgagugguuauucaaucacaggaaagcagcuugagccauagcacacucauacucagcagaaagcuuaucaugcaaaguaagcuuaaacaguaaacuguguauuaaucaccaaguccauauccuaaacacagaaugaccucuaacaaagcaguaaguauauccaaaaaagcuggaaugaggaacagauaagucacaaaaaaaccacaaaauguuagaaguuaauauauuucuaguaagaaacucaaauaucaagguaauucauaguacacuugauaaacaaaauauuauccacuaaaauauuccaaaucauuaauguguaaguuuaaacaaaacaaagcaaaacaagcccccacgccccccaaaaacccacagcaacauucuggucugguaaguaaaaucagauaaugaacuaucauucuucuuuuuuucuguuuaguagcuguuuauuuuuauuuuauuuuauuagauauuuucuuuauuuacauuuuaaaugcuauccugaaaguucccuauacccuccccccacccugcuccccuacccacucacucccacuucuuggcccugguguuccccuguauuggggcauauaaaguuuguaagaacuagggaccucucuucccaaugauggcagacuaggccaucuucugcuacauaugcagcuagagauaggagcucuagggguacugguuaguucauauuguuguuccaccuguaggguugcagaucccuucaguuccuugggugauuucucuagcuccuccauuggggggcccuguguuucauccuauagaugacugugaguauccacuucuguauuugccaggcacuggcauagccuccuacgagagagcuaugucagggucccugcaauagugucugggguugguggcugauuaugggauggauccccgggugcgguagucucuggauccuuucaucuuagcuccaaacuaugucucuguaacuccuuccauggguauuuuguucccuauucuaaggaggaaugaaguguccacauguuggucuucuuucuuagaauacccaagauacuaucauucuucuucuuuuaagucaaucuguuuuugggagaacauauaucaucuuggucaggaaaacaaaacuacuccuucucagaagagaggguaggcuuugauguccuugugaauucuccacagggaugcggacuauagugaguuuacagagcuuccuugcaggggccaagcagaaaagaaguagcaggucccaccgggcgugguggcgcacaccuuugauccuagcacucgggaggcagaggcagguggauuucugaguucaaggccagccuggucuacaaagugaauuccaggacagccagagcuauacagagaaacccugucucaaaaaaaccaaaaaaaaaaaaaaaaaaaaaguagcaaaaaaaaaacaaguaguaacugggaacuaauuugugacagcagguaucuuuaccauugcugucucauguagaccauggaacaccaggaccauauuuaaaugacuaaguacccuaagguucuugaaaaugacccugauuaacuccauuagaaacaaaaaggaauaaaaaaucagaacugaaagguugguaaaaauuaaugaaaugagguauuuucuuucucucuuuuuuuuaugugaauguuuugacugcauguacaguaugugcaugaagucacacagagacaagaggaggauugugggucuuucagaacugugauuacagaugacugaucuaacauuggaaaucaaccccagguccucugcaagaguaacacccacucuuaacugcugagcaaucuuuugagcucauguuuuauuuuuaaauaauaaaaagauuaggaauuuaaaauauucaaacauguucauuuuuguuuguuguuuuuaagucagauuagucucaaucacaugacauugauuuuuaaaguguugauauagcuguuaauaaaguguuuguagcuauucaguuaucaaaagcauuuuuguaugggccaaccauuaucaacuguuuagacuaaaauacucccaccugaugacaguaaacucaaaagagaccucuggggauuguaauaucuagcccaaauuggccauuaaaagcacaauauuuccugaaagcuaaucuuuaccucaaaaucauuccugagauguugaauucuacuugauuguuuuaauauaaauguaauuuuuccucaaguuacugaaauugucaacuuuuuucuggugguccuauaccugcccaggcacaggcuggagacuaugagguaugcacauguaaggucaaagcccuccauuauguuugcuuugcuacacuuuuuauaaagccuuuaauacagacauucaaugcuuauauaguuuuuuaaaaguaaagcucacuaaauucucacuaucaccugauauuauuauucuccuuucacaggugaggaaacuaaggaacggaacgguuaaggucauucuuuuuuguuguuguuguuuuuguuuguuuguuuuucgagacaggauuucucuguguuguagcucuggcuguccuggaacucacuuuguagaccaggcuggccucgaacucagaaauccaccugucucugccucccaagugcugggauuaaaguugugugccaccaugccuggcuuaaggucauucuuuaaccuugaaaacugguggcccaguucaagauacagcgauauaagauuaucucuauauuguuugguuuuuagagccugaauuguggauuuccugaauaagaugagaagucauguuugauaagacuucuaaguuggucaggaccaaacuuuuaaugcuuuuagagagcuuccuggaggcugaggagagguuagauugcaaacacccacccaccagacacuauuauuuucgaaguuguaaaacuuuaaaaaucagauuucuguguuuagagugugcaugcagcucuguccuaaaaguuguucuccuuauguugagguacuacuacuacuccuccuaucuccaugggcagcauacaccacaacaaaucauaacguugucuacaaagggcaggcuggcaccauaguggugugcaauguuggggaagauuccacuuuaaagauauaauuuaagaaaaaaaucucuacuggacuggcaaaauggcucaguaguguuaaggauauuuacugcuaacccugaugaccuaaacucaaucccuggugccuauaugguaaaagaacauauacacauacauaugcuaacauggcacacauacauuguacauguacacacaaagacacacauauauguacacacucauacaaaauaagugcaaaaaaaaaaguuuuaaaagaguucaguaaaagaccugcuuauaaagccuacagucauacuacaaaauuaaguaaugaacaauaccaggauucaaaacagauuauguuucaaauacccuuaaggagcugguuaggucucagucauauacaaaacagacacaaagaucuacuauaaagaacuaccacuaucccgcauauacaaccgacuaguucuacuucuguugaauuuugagauaucaaaaauguguaacugacuuucaauuucaaacuuagaaggcccacuuauauucagugcaccauacgaaaaugcacugugaacaccacaagcugggcauggcuuucucucuauaugucagaagcagagugguugagcuuauauuuucuuucuuuaaacacggaaaugacuuggcaguccauuuccugccuaagagagggcaaaguagguauuagacuugguaugaccucgacucuuaaaaauuuaauacaagcugggcagugguggugcaugccuuuaauuccagcacuugggaggcagaggcagguggauuucugaguuugaggccagccuggucuacacagugaguuccaggacagccagagcuauacagauaaacccugucucaaaaaacccaaaaguaaaaaaaaauauauauauauauauauguguguguguguguguguguguguguguguguguguguacacauacagaugagaggguuaccaaacuauauauacaaucugcuggcaaaauccugcugcaccuguuuccugcuuauuucuauaucuccaugacugcuuuuguuucuuaacauuagaggugaacaaugacagaagaaaucuuaggaugaaaagccuaaagauuauuuacuggcugguacuauauagcagaaagcuugccaucucuugacauagucauuccucagacccaauauccagaauuccugaauuucuaagaaagagagcaaagaaaaauccuauuagaaguucauggaagcaucauguaguaaagagcaaguuagaauccuugccuccaccuuggaucuucuccuaagucagauuuauauccuucuuccuaauauaaacuugaaggguuaaacuaugacucuuagggaauauuuuaggagaaaaacagcaaaagcaaaaaauagcaaaucuaggacuauuugcuuauuuucucacugacauaaaauccugagggccacacuucaagggaagacaaugcaaaaaccuggaaggcaugcagcuaugaauacaucucuuuggaugugcaggggaacacucacucaugauucucaauguauaaaaguccccuggagaguucuaugagcuaggccugcugacauggugugacagcagugacaagccugacuggugaggagcacugaaaugccaagaacucacuggaagagugacaacuauuuaacuuauauccacuuuacauacuauguuuaagcuuaccuuuuucauauauucaguaacuggguucugcuguaagaauucaguacuuucucugguauaaaaucucucugugucagccaaaaauugagauucaaaggauucuuuauacacuguuaacguagggcccuuugcaaaugcaucaucuucauucagccccaauuccacuagaaauaaauaugaacuauauuucaauuaccguauuucuuguuauauuuuacagacaauacuuugauguagcagucaguuuaaguuacacuuaaaagaucaaugugaaaugguggguuguaagguaacuauuauuuacuaguauugaaguaugcuugugccaauaaaugaaaacacaaaaagaauaaacuccaagauguauagcagcaaauaauccuuacuugugccaggaacacuucaaaauuacaaguuuaguuagagaaaguuuacauuuccaaaagugauauaaauauugcauuguaaacuuucacagaaaugccaacucaccuaagcuucaauaacgcaucauuuaaucagugucucaaucucaaauuuuucaaguugauauaguuuucugguuauuauuuagcucaaaaaacaauuauauauuaguaauuccucaugaaaacagcaaaagaaauauaauuaaauuuuuuucacaaaauuuccuuaaaguacaaagauuaaauauuuuuuacgauuuguaaaauuacuauuuaaaaguaccuuaaagaugaacuaacauuccugagaaucuuuaauaaauauuuuaaaaugaauauuagagcacuauuauaauaaaggcaaauuauuuaccauaagauuguacaacuccacuaaucagucuuguauugaugguuucuccauuucuuuccuuuucaaucaacuuuaaaacagcauuuguuaccuuuaagaacacacaaaagguauauuauagcucacaauguaucuuauauauccuuuaaacauuuaaagccacuaaauaauacaaaguaacaaauauuuuagggggauggguacaugcauguguagacauagaccaagggcaccuucaagaacuguuugccaggaagaauucacugugucuuuaagacagucucucacuggcauggagcucauucagguggcaagcuuggcccuggucaggaagcacuaaggaucuaccugacccuaccuuugcagugcuaggaucacuagugggcaucacuauacgcacuauacguggcacuggggaucuaccccauguccucaugcuuacauagcaagcacuuuacagacuaagcccaacaaauacucuugagauagucaaaaggcuugaggagacaagaucaaaauggaaagcuuuuuuuuuuuuuaaggaaacacacacauaucccauaguagauaccuguuuauucaauggccugaacaaacaaucucuccaugucaccaaugcaagcuggaugaaaaaggggaaaagauguauugaauauccuugaaacuugucacagacaauaaccugaauucuuuauuuuaccaaaaucuuuagauaacuuaguaaaaacauaauaucacaaugaagucagagcugcucucuuaaguuaaucacuuuguauagauguuuaccuucucacaauuuaacaacaaaguucagaaagaaaaugcuguuaaggcugacauuuguaucagcuuaaaaaccagcauagauucuaucuauaaaugaauucccuggauccaaucaguuuugaccagaaacaccugcuaaaacuaauucuaguuacucucaguuuccuaacauaucaagauacauuuuagaaauuauaaaaaucuuccaaucuugauugugcauuuuaaaugcaguuucuuguacauaaauuaagaacacccacuguccuuugugucuucaggagacuaugugugaaacgcacauuuguguguacaugguacaugcucacaugagcaugugaagaugcacaaacagguggcuggagacaaggugagaacuuccugugucuaucacucuccacccuauucccuugagacaaacucucucacugagagaccagcagcaguaagcucaagcucauggcuuuuauauaggugcuagguaucugaacucaagcauucuuacuaagcuaucuuccccagcccgggagaugcauuuucacucgaauguauaauuaucaugcucucguuuccauuucuaaacuucuuucaaguguuauacugauuaauuacuguaaaaaugaucucugaaagaaaaaaguuagaauuuauguaugauuuuuagacgucuguugggagagguauuagaaaguuaaauaaaacacaauugaaauuuacggcacuuuaacacauaaacugucaagaaauuaaacauaaaugucuuagucuuauuuuacuuccucuccaaucuccucuccaacuagaaauaaaauuaagcuuguaaaaaauaugcaaauuuagucuauggaaaguguuuuccaaguagugucuccaauaaaauaaauacuauaaaaaucaauauuuaaggcauuuuuugggucuguuuuucccucuguaguucugacauuuguaucagcuuaaaaaccagcauagauucacugagaucuaccugcuucuguauccaagagcugggguuaaaggggugcagcacuaggcccagcauuauuaagacucuugcuuuguggugugcaaagguacugacgacucaaccucacugucuagagaaaagcaaacuuuccucccugccucuucagcccucaaaacuggaguaaggcagcagugaaaacaucaggcuauaguaucagcuucuaacagaaucccuacuuuaaaaaauuauuuuguuguaccuacuuucuaaauuagcaaccccaccuuuggauggaccuaggcugacucuggaugauuuaucacuucaaaggaauaaaaccaacaagcaaaagaagacagaagcuauagaaggcaaagcaaagaaaccucacaauaggguaacagaaacaaguuuugccaguagcacuucaacauacaaugaaaucagcuuuuauccucugggagacuuggaagcaaaccaacaucuuucucuaauuaaaaaggggaaaaacaauuuagaaaagaguuuuuguuuuuuuuuuuuguuuuuuuuuuguuuuuuuuuuuaaaguaaaagccuuaucauuugucuugaccuugaacuacaugacaaaacaguaucauuugcuagacacugggcuauuaacaaaaaccacauguuuccaccgaacuuugacacaaacuagcaaaugacuugaucaggguuuccucugcuagaauuuauggcugcauuuccaaacaguggcuacacuauuugauaacagaaaguguaggauuugaaaguaaaauuuaaaaguaaugaaaguggcugacucuugucuacuauuuacuuauguauuugagacaaagugucauuauauaguacaggcuggccuugaacucagauacaucccugccucugccucugccuccccggaacugggauuaaaagaccugugccuuaugucuugcucaaucuugagaaacaaaguaucuugguacuuuuuacuaaacuuguuuaacuguugaaccaagaacauggaaagugaaaaagcagggauggccuuuaggagcugugauaccacuauagagauacacacggaacaucaggucaagcaguuuccaaaaggaaaucuaccacacugagugccauucugcaaauucugacacaagggaagcacaccaaccauucuaugauggacagaauucaaaacauguucaacagaauaaacauauaauugucaguuaaaauauauuaaagaaaagaaaaauacaaaaacuucaaagaacuauuagaaaccauguaacuaacugggcacaaugguacacaccaugaauccuagcacuugagagucagagacagguaugaggcuggucuacaaagugaaguuccaggucagaagcuaccuuguuucaaacaaacaaaagccaaaauaaaaaccuauauaacuauacaguacuauaaaguacaacugggguacagaaacugagcuccgugagugcuagaagucuugaaccugggcuaguuuuucucuaauuuuguaaaagcaaagcaacaaaaauaaugcuauuauggcacaacauuagaaacugacauuuuaauaaaacugaccccaaaagauuuuaaucugacacacauccaugagcagacuauaauguuuucaauuaauccucccucaacuucucuagaacugacucuccuuaccuggagaaguguuuguuugcucauuuauuuaaugugugugagcaugaauguaugugugugugcauauagcacccaggggacaaccuuugcugucaggaaccaucuaccuauaggccuguacuugucagaaugauaugcuguguggccaaugagcuccaaguaucuguuugugucugccucccagcacugugauuacaaacaucaauaucaugcuuuuuuacacagguccugggggacuuagguucuuguuuacaaagcaaauacuuuauugacuaagcuaacacccccaacucuguggacuauuuauuuauuuagacagggcucauuuagcccaaguuggcuaauauguaaaccuauuauucccuugccuugacauccaagugcugggauuacagguauguguaccauaauacuuaacauaaacaaaacagaagacuggacccaggacuucauagacacuagaaaaguacuguguuaacugagcuaccugcccccaccauuggcucaucucuaaagucuccaagucuagaagguggucuaagaauauacaucucuaucauguucccaggugacacugauaauacacauuuagcagucauacuuuugagaaaccagaaagccuaaaacaaaaaccuugaggacuaagaaaaaaauuaauucaagguccucucucaaauacagaacucucagaccaaaaaaguauaugaaugcccagguuaggagcuuaauccucagauaagguaccugauuugcuagcaacugccagcaucuaggauucuagugcuaaaacucaagcaguucgaugcaaagcguaauaauugcccaauuaauuggagacacuuuaaaaguaaacacaaaacuauuuaacuauguuuauuuuauaguucuaauuucucaccucucuacuuucuugucacaacauuuuuagagguuauuuauuuauucuuaaaaaaaaaucuuacugaauagauuucauauauuccuuuucguccuucaucacauucacggcgaacccaaugucuauugagguaggcacagauuccauucagcacuuugcuggagaaucgguaaucuucccacugcugaguguagaacuucaggacacucucauccauuaaaucuucuccauccuaaaaacaaguucacuaagacuuuaauaugaauaguuugucacauaaucaagcuaaaacuuacuggaaaagcuacugcaucaaaauguacaaaugcaugcaguuacagaugggucaauugcuauguacagaaacaagcuaauggaaaauucucacaagaacacuaaaaaggucuuucauuauccaauuaaaccagaacuuuucauggguugaauagguauaugcagucguagaguguacccuaagcuuucaaaaugggaaggugcuuuuacuuucuuuuaugcuuuuucuucaguacuagugacugaagggugcuagggucaaaugcucaauacucuacuuuuaauuuaagacagggucucaauaaguugcucaggcuggccuuaaacucaguuguguagcccaagcacauacccacccacuccuuggaucucaugcuuuccaaggcuagccuuacacucacaguguagcugaggaugaccuguaacuucuguuccuccacauccagaaagcuaagauuacaggccagugcuggaauuccaggguauguacuuccauguccuguuuuuuuuuuuuuuuuuaaguuuuuaagcaauuucuucuuauuagggaaucuaccuccaaagcaucucuguuugauaucuucccaguuuuuuauuuuaaaucaaucuaucugauuaacaaauuauaauaaaaguauacucauuuuuuaaaaauaugaaguguuucacaaauuuguaagauuacaaaacuauucaucuuaauuuuaguauuuguuguauuuuuguaacaaaaacaacauaacaacaauacaacauuucuucuuuaacaaagccucagaaagaaaacuggaaguuauccaaauuauuccuacuuuaaaacucacuaguuuuuauuugaauaggauugacuugaaaaaaguucuuagauauuaaugacaauuccaaaguguguccuacccuuuaaagacacugcacuacuauucauagaugcugugcuaaguauaccaagaaguugucuucauguggaaagccaaaguccagcagacuuguaauucuacaagcaauaacauucaagugacccaaccaucuauguaaauaccuggucacacccagagacaaccaaauguuuuguguauuuaaaugaaaugaauuugaaaacauaaauuggucuauuuuugauauaaaaaacaaguauguugcugaugaaguagcuacuaaaaacagaacagacuuugcuuacaagacuuauuuauuuaccaagugcuguaaagucaaaggacacauguuuaagaacaugaaacugauacauuaguuaugagucaacuacagucuguuagaauguguuuccacuuagcuuguaaaauaauuaagaaaacaagaguuuuauaucaugcagaaaauauuguauaacagcuauauaaauuuuaaaagaaaaaugaacuguauacauagaagagacugagaacuuucccagguaggaguaaaaauaccuuuguagacugaagacaucauauacacaauaccaggugaggaagcuaccugaucaccugauggcugaguguaaggcaacccacuuccuuuguuacagaacaaacuacuaaaaaccaaaggcagaagcuaagguaaaagauuucaccauuaguggugguguacgccuuaaaucacaacacucaggaggcaggugggucugaguuccaagacaaauugaguuccaggacagccaaggcugcauagagaaacccuauuuugaaaaaaaaugaaaggaaaaagacucaccuuugccuaagcaaugguuugagcuaaugagccccuaacucauaggauauggaucuagcaagagcuaacccaguguaagcacaauuuuaaucuaaagcagcaaauaugacagagauggcagucacaaaaaaaucauugcacguaagaaaaaagugaacaaaauggacauuuuuauaugcuuauaccaucgagacaucuuaccuuaagaagauuugucaaauaauucuucaaaaauuccuucaaucgcuuguauaacuccaagccaacaaacugagcucccccaggagucugccccuuuuuugacuuggaaggagggacuccagcaccccgggcuugguuggacugaugcacacuaguacaguaguuauaaacaugacuuggagaaaguuaaggaaaguaacacauaccauagacguaacaguaauuaacauaaacauauuuccuucuguuuauauagcaauagauucccaauaaaacuaaaguggaaaaugcugguaaaguuaaaagacagcaagcccgagcacaggaucagaggugaggaggaucugucccaacacagggaacaacugggaccagcuggaccccgcacgcaggaacuccaccagaccaguggcacagguuccuucuggucugggcugguucccugugcagaccuugggugcaaacuccacagccagucccacaacacccagagcaagcuccacucccaggcgcuccaaagaucccaggagcccaggagcuuagucacaccaggaucucaggaucccagagacagcuugacucugaggaguucugacauaaccagggucacaggaaggacaagcuccagucagacauagccagggcagguagcacuagagauaaccagauggugggaagcaagcauaacauaagcaacagaaaccaagguuacuuggcaucaucagaacccaauucucccaccauagcaaguccuggauacaucaucacagcagaaaagaucaugcuggugauagaggacuuuaagacagacauaaauaacucccucaaagaaauacaggagaacaaagauaaauaaccugaagcccuuaaaaaggaaacacaaaaaucccuuaaagaauuacaggaaaacacaaucaaacaggcaaaggacacgaacaaaaccaccuaaaguugggaaucuucacucuaaaaauggaacuagaaccaauaaagaaaucaaagggagacagcccgugagucagaaaacuuaggaaagagaucaguagucauagaugcaagcaucaccaacagaauacaagagacagaagagagaaucuaaggugcaaaagauaccauagaaaacauugacacaacagucaaaacacaaaaagcaaaaagcuccuaacccaaaacauccaggaaauccaggacacaaugagaagaccaaaccuaaggauaauagguauagaauaaagauucccaacuuaaagggccaguaaauaucuucaacaagauuauagaugaaaacuucccuaaccuaaagagagagaugaccaugaacauacaagaagccuacagaacuccaaauagacuggaccagaaaagaaauuccuccuuucacauaauaaucaaaacaccaaauguacuaaacaaaauuuuaaaagcaguaaggaaaaaaggucaagaaacauacaaaggcaggccuaucagaauuacaccagacuucucaccagagacuaugaaagauagaagauccugggcaaaucuuguacagacucuaagagaacacaaaugccaacccagacuacuauaccuagcaaaacucucaauuaccauagauggagaaaccaagauauuccaugacaaaaccaaauuuacauaauaucuuuccacaaauccagcccugcaaaggauaauagauggaaaacaccaacacaaggagugaaacuacacccuagaaaaagcaagaaaagucaucuuucaacaaacccacacaaacauaauuccaccucuaucaacaaaauaucagaaaguaacaaucacuuuuccuuaauaucucuuaauaagaaaguuaauauuaccaacauauccuaaucaauugaaauucaaaaauaugaagaauuagaaauuuguuggcugucauccaguggucucucuaauuugguaauuguagaaauagguccaauauuguacaacccauauacacuuuguuuguuuguaugugacaguuucuugcuguagaccauagaauggucuugaaaucaugcuuuuccuaucucagccucucuauuaguaggauuguuugauguuuuuacaguauacuaugguuuucagaacagcuuauuucaaaauuauuuauacagccaaaagaaauguagacaauuaauuugggagguggcuuguaagagaacaaauuaagagugagacugaauguuuugcuugauauuuauaauuguuguaucaauuuugaaguagaggaccuuauaaguuacucuuuuucugagaugaaugcuuuuaaaaucaucacagccaaugaagcagaaucuuacccucaccuaaugucuaugccucccuccaagcagaaccauuguucauugaagcaguugaugaaugacuucauggauagaccaucuuaauacacacaccauuucuuaaaugaauguaaccuguucccuguaggcugagaaugaugacaaucacucaagucaaauagcuuugaccauagcaggaaauauguagccaaguaaucaugccuacaauacauuccuuggugcagcaggacugucaacucuuagcuuagcuacuauggaaguaaaauucuuuggugaugugaggggcacugaaguacagccuuauuacaaugaacuccaaugucuaaaaauuguucuuauuuuggguuuguaccacaguaagagccaagauuuuaaagcucuacuaaaaacaaaacaaacaaaaagacuuuaucuauuuauguucaucuaauaauauguccgccauuuuuaugauugguauaaaaauauauauuguguugaauauaauaaaaauuagcucaauugaaagaaagaaaaaaaaaaagacagcaaguccauucacaaggaugcccacaagccugaaaaacagauggaacauucuugaaagaauaucaagaaaaaccccagaccuauaagauugccuaacaugacugauuuuguagaaacaguccuaaaaauuccaacagguuagaaagguugcaaauuucaaggaaaaaagcaauugcaguauuugguuuuggaaaaacaaaagccaguacuaaucaaagucaaugauacuuggcaacaaauaacauagccagaaguacacacuauaaauaccgaaauaacugaaacauuauuuucagaugacucagaaguagacuuacucaaaaauacaaagcaaagggcaugcagaacagugauagcuugauacaacaauagagucacagauguauacaacuggacaacagcaucgggucaauacaccacugugaaacagaggcauagaaauuacaggaacagaaaugaaaagcugaaccagcugccucuacguauuagcaugauagaacuugaggauggggaagacaaaggcaaagagagcacugccucuguuauaaccuuuaugacaacuacugcugucagacagggggagcauuaaacaggacacacaaugaagacauacucuucuacuguauuuaaggacauacuguauagauucuuccaaaaucagugcguaaaagauuacuuaauaaaugacauuaaggauaauucaaauauauaucacaaaugaaucaacaaaaauauauaaacuaaaagaauaaaaugaagaugcagaaauugucacuuaccuguucucaagcuggagaucaccuuuccaaacaaaaucaccaauaucuaagcugaaaaucugaacauguuaaaguaaaacuaccuucaaggagaguuacuaucuugagcaaauuuauuugggcuggggagauauauguagcucagugguagagcacuugcuugccuaucaagguccuagguuaauaccuagcacccuaaaaacauaauuuaaaucaacacaagguaaaaacuguaaacaaacaugaccgaaguauacuacagacagaaggucaaacaacuaauaaaacacccaacagcaguauuuccucaucagagaacugccucuuaaagcaacagcaaugguccugaacaccuggaaugucagcaucacuuggaaaguuagggucauccucagcaacagcuauuugaagguaguucugaguaccugaagguuuauaugcccaacaagucucugccucgugucugaagaagacagaagaugguacuuggucucuagaacuagagcuccaggugguugugagcuaccauguggugcucacaagaguggccaguguucuuaaccucugagcaucauaccaaaacccauuuuauaauguuuaaucugaauauauagaccaugcauuuaaguuuuaaaagaaaguagaaauauaccauacauauacuaauaaagaacaaacaaacugaaccacucaauuaaucauuuacaugucaguaauuucuguggaguauacugauaccaaauauauauauauauauauauauauauauauauauauauauauauaucuuuaagugcauguuuauacugaaaacauacaaagaaaggaagacaacuguuuuuuuuaaaaaaacaaaaacaacagugaguuccaggacagccagggcuacacagaaaaacccugccucaaaaaaagcagcgugugcaccucaaaaucagaagugugugcaccuagacaagcaagcacucuaccaagccccaggccagucugaaaccuaagaguugcugggcugacagaaacagcagauagucaagauguucuuuugauuccuuuauuuuaauuaccuuuuguacauguaguauuaaguagacaaugaaauguugcugagggucucaugaagaaaggcccaacucaugagugagggaucuuucuccucucuaucaaaggacuuucuugaaauguggauguuacucaagcuucuugauuguuccaccugacucuaguauuaaaaacaacucuuugcuaagcuacccucuuucuucuagaauggaaaguguacacaacaguaucuguucaaccugaagcagccaaguacagagcaguggcuccuucugggaauauguucuauggauaagcacuuuuauaagcccagugccugcugauguucuuuguuggaaaauaaacuuugaaugcuuuuuaaauucuuuacauuaggauuuuuuaaaacuaaaaauuucuucagcccaguauagggcauuauaugaaauaacccuaagaagagaaccaagauuacauuauguaauaaguauuauuuacucacuaccuagaaaagacuucauaguuuucuauaaaaaaguacuccauugugacuauugugaauacacacacacacacaugacacucaaggugaaaacaagggcccaaagcuaaaacuuuucagauaucaaaauagcaauaaauuaucuacagaauaagagaauucaguaauuucuuaagcauagaaaguuucuacuuccucacagcccuaccaaagcaaaaauaaucugccaaaaaaaaaaaaaaaccuaucuaauuuagugaaaauuacauacuaagaaauuuugggcugcugaagcuuacacaaaagccugucaaccugaauuugaccugagaacccacaugaguguagacggaaagaaguaucuucaugaaguucucuuccccauaucaugcacgcacauacuuacacaaauuaaacaaccaacuaaaauaauuuccuagggccagguaccuauaauaaccuguaagacaaauccuagcacuugguaggcugaggcaggagaaucauguuuaaagcuagucugggcuauuauaaugaguccaucucaaaaaacaaaguauuuuuaaauuaaaacaagcaagcaaacaaacaaaaaaauagauagauuaguaaugaaguguccuuggucaccaaaguaaugcuggucugcuuuugugaagaauaacaaaaacucaaccacauggguuucugaaaauguuaccaacugaaaacugcuuuaccacugaaaucagccuuuuaguucuauuacaagcaagccagccacaagucagucauagcaagcaaaagccugggagauacucuauccacucauuuggcaaaaacucccauuuuccuuaaaaguacccaacauaucuaucuaugacucagcaauuucucucacagguaccuaccuacucaagagaaugagugaacauacggucacucaacaacuaguacacgauguucauaacaaaguaucuaacacaaauacaaggaaauaacaaaagacauacaucacugacgaauggauaugcacaauguaaaacguccauacaaaccagucaugaaagaaaggaagacgcuuacaaccauuaugcuaagugaaagauaccagacacaaagccauauacuguauaaauguuuacaggauaagucuagaacacacaaauucaaagaaacuagaucagugacugccagagaaggggcauggggguguggagauucaauuccuaauugaaucuuucagggguaaggaaaauauccuaagggcacuggagaguuaguucagugguuaaacacacuuucuguaaucggaccuggauuuaaucuccaacauccauggcacuucacaggugacuguaauuccaccuccagggcaucuaacacaauacaugcaaguaaaacacccuaaaacccuuacucauauaacuaaacaaaaauuuuauauacacacacuaaaugcagacacugauaguuauaaaacuaaauaugcugaaaaauuuuaaguguguuaauacuucaacuaagcuguuacuacuuucgaauuuucuuuuaaagacugcauuauuuuuaugugugugaccaagaagguaagaggaaggugcugggguccccugaagcuggauauacaggcugugugagcugcccaauauaugugcuuggaacugaacucagguuaucugaagugcaaaaagugcucuuaaccacuaagucauuucucuagccccaagcuuuaauuuuuuguuuuugcuuuuuauuuucugagacaggguuucucuguguaacacuguauaaaccugaccagguuggccuugaacucaagagagauccgccugccucugccucuaugcugagauuaaagguauuacaccaucauacugguagacccauauuuuaauuguuuguuuguuuuaguggaggugauggagagauggcacacaugccccagcaugccuguagaggucagaggcaagcuuaguucuuaacuuccaccauguaggauccagggacuuaacgcagguugugaggcuugguagcaagggccuuuauuaacugaacuaucuugucaacccaaaguuguuuuugcuuuuaagcuuuuuuuuuuuuauuuuugauuaugucugugugugugaguauguguguguaugugugggauuaccugagaaggauagggauauccaauucucuggagcugguuacaggugguuguaaacagaauaaaugcauuuaaguauaaaaauacauuuauauuauggaugcauauuagacacauauauuagauauauaauagacauuuauuuauaaguuaauuuaaguauucuaaaauuaaaguauuuuaaauguuauauaaccuguuuugauaaguacugauauauacuaaaguuuuaaacucacauaccaauuaaaugagcaacuaaacguucuggaucaguaucaauuugcuccauuaaguuagcugagcuuuauuauuauuauuucuucuucuucuuuuccuccucuuccuucuucuuccucuucuuccucuuccgccucuucuucuucuuccuucuccuccucuucuuccuccuccucuucuucuucaucuucuuccucuuccuccuccucuucuuccuccuccucuucuuccucuucuuccuccuccuccucuucuucuuccucuucuuccuccuccuccuccuccuuuuuuaaagaaggucucaaagaguuuaggccugucuggaccucgcuauguugaggauguucuugaccuccugaugacccugacucuuccuccuuagagcugauggaaucauagaccugagucaccaagccugacugguaaauucuaauuuuaauuuuauauuuguacagaaucaagaaacuacaaauuagaggcuagacagcucagugguauagaauacuuguagcuccugcagaggaccaguguuuuaguuucuagcacuguauccauaauuccaguuccaggagaacaggugcucucuuuaggccuccucaggaagcacagauguggugcacauuacauacauguagguaaaacacaaauacacaguauauaaaaauaaaucuuaaagaauguuauaauagcaggaauuaugccuuuuaaaaccuuauaacuuuuacaagagcuagcauaguccuucauauacauuaugaaccaaaacccaauaaaauugcuuuuugugaugguuaaucuccacuguggccagaggacucaggauuaccuacaagaagcaucucugguggguaccugugggagaauucuaaaaggggauuagcugaggaggaagauccacuuuggaugagcaguaccagcucaugggcagcauagcaccuuuagacagaagagugaggagcaagagaagcacgaacacucaucacacugcuuccuguggacacugcugccagcagccgcacacuccugccaucacagugcccacaguagagcugcuucucggaucaguaucaaucugcuccauucaguuagcugagcuuuagaucuucauuuuuaaaaaaauaaaauaaaauaaaaagaaggucucaagaaguuuaggcuggccuugaccuugcuauguuaaggauguccuugaacuccuaaucacccugacucuaccuccacaucuucccugcugugaugaacuguaccugugaacuauaaacacauauaaacucuuauuuccuuaagcugcuuuguuagagcaaacagaaaaguuaauuaccauauucucuuagaacugaguaaugcaaauaggaucauaauauucaagcuuuuguucuaggugugucauucugaacugguaagcaguuuuugcauagguaaggauggauagaaaauauuuuaggacuuuguggaccagacugugauacaacuaccuuauucuccuguaacaugauagcagccacaaugagcauuuaaacccacuuaggacaauacugcccacagaacuuucuacaauauauuuuauuauuuagccacugagcacuuugaaauauggguauuauugcuaaggaccuaaauuuuauauaguuacuucuucguguuuacaggugugguaguuugaaugagaauggcuaucauaggcucauauuugauucacaguuggaagaacuguuuccaauuagaagauguggccuauuuggagauuagucacugggaauaaugggcucugagguuucaagagcucaauguucuccccauuagccccucugcccccaagauguguaugagauguaagcucucaguuacugcuccagcaagauaccugccugccugccugcuggacgcacccucugaaacuaacucuaagaaagcucccaauuaaaugucuuuucugaguugccuuggucaugguuucucauaguggcaacagaacagugaaaaguaacuaaacaaugguguaaaucauuacaggaccucccaagggaaaucuaaacuauuacaugauaaaauauaacaaugaauuuguauauaauuuaccugcaucuucacacuauacuuuaaaccaucucuggauuacuuaaaaugcuuaauucuacacaaaugcuacacaacaacuguuacaagcucagagaauaaugaccaaaagggucuacauguuuaauaaagagacuuuuuuguucaaauauuuucaaucuauaguuggcuaaaucuacauacauagaagcuaaugauaugguggggcgggaguggggggaggauaauguugguaagaaccucagcagguagaagugcuugcugccaagccuaaagaccuaaguucaacccugagacccacaaugugaugucaggaggaagugauucuuucaaauuguccuccaugagugcuacacacacauacacacacacacacacacaaacaucugggguuacuagccagcaccaccuuaaauaucuaucuagccaaaauaccucugcugaaaaagagauauaaaaaugaacuuagaauuuuauuauagguaaacaaagaaggaaauaugacauaacauuccuaauaauucaaacaccauaacacaaaauaauccaacccuagacacaccaacuacagcucaagcaagaggauacguguagaguuccauguaucuggacuuugccaugcuuugucugguauacaccugcugaauuccagcucugaggucaucccagaucuggucaagaccaaucugcuucaguccaugaggauucugacuccuguuugaugacauugugagcaauguucugaaguuguccaguacaguaauccuuguucaaguuacagcuaguucuccauuaguugaaaauagacaaaaucauuccaaauuuauucacagcagcucagaaagaauguucuuuaaguguagagaguaaagucucauugcaggcaaaccugaagaugaaauaagagagaacuggucaauucuacuuucugggguugguaacaggacaagacacugacagaaacaaucugugggugucuauagguauuucacacauucucacuuucuacauggaaauaaacucacucuaugguauguauguaaaauauauuuagacauuucauccaaaaucauucaacuauuauuguucuugaaaaaacguugagaaaaacaaguauaagagacuguugucguucuuuaccuucuaaagucaucaaagguugaaacagagcauuggaccuacauaauagucagacaaacucaaaagaagacacagcagagaacaagcuuaggaaauucccagaaaaaugagaagaguuuagcuaaaagguaagaaaagcaaugcaaucucacuaguugccuguaaguuuuagaaauucuucacuuaacacuuggaaaagcuaacacugguaagugugaagauaaaaggacauaggacuuucuuuuuacaagggaauuugggaagaauuaucuaaauuuacaaaguaccccggguuccaagccuugaagcucagcucauaccuuccuuacuaaucuugaauuuccuagccugcaaaauggaggcaaauuacuuuccugacauggcugcuguaaaauuuaaagauaauaaaauauauagaaaauaaauagaauauuugacaguaaaugcuuaccaaaucguuaugguauuguuaauauggaaauaaugugauaauaugauuauuauuuauaaguguauggugcuacuucaaaacacaauuuguaaugcuucugauguuggagucaccaaucaaggacucuauggaauaccauucuguauuuaguugguacuucacagugugcacauucuauagaauuguuuauacauaucacauuaaaauguagaaauuuuacauaaguguuucuaaguacaaaucaaaaauugccaauuuuuuaaugacuuuacaaaauguaaaugaagaaaauggaaugagagaugucagcacagguugcuagucuacaaaucaacgcaugggauaccucaagucauucagcacaccauaucuuuucacuaacaugacaaaauuccacacaauacuaggcccauuuaaggcccuuguaggucaugcauauaauuuaacuuuuuaaaaaagauuuauuuauuuauuauauguaaguacaguguagcugucuucagacacuccagaagagggcaucagaucuuguuacggaugguugugagccaccaugugguugcugggauuugaacucaggaccuuuggaagggcagucggugcucuuacccacugagccaucucuccagcccauaauuuaacuuuugacuacugaaaguucaaucaucucuaacauuuauaaugugauuaauaggacuagauauuuuaugaaacuauaccaucauuccuauccuaaauguauuucauauauucaaauguguguucaaaugugaaacauaaccaauacaaugcaagauaaagauaaaauguuuccuacacaguuucaacuuuuuuuacucaccuugggggaaauauaguacacuaccccacuugauaauaaucagccuuuagacugaugcuauaggaucagcuuuuacuccuaaaucucccaccaguucuuuaccauuucuccauggagaacuuagauuugucuaaacuagaaucaacugugcaguaacuucuaauuccuaccaacaauggagaaaaauauucuccagcaccugaguacauucuccaugagcagcccaacucagaaucgggaacaucacuuuacccaccuuuuaguacucuuggggagauucugauagagugcuauugauacugccaaggacacuucacauugaauugaaucccuacugcuuccaguggccaucauuuuuauaaacuggacucucauacaucuauccaucugcaaccagcccuugucccuucuuaaaguagcagacuugaaacugucagccuaauuccaaguaaauggucaauccccaggaccauacuguccugcaagcuguccucuuaauauuuacccacuugccuggcauaugcauacacaaaauauuuuccauccuagcauaaacaauaugcuugauacauacucuaugcacuguccucccucccuuuuguauucugugccuucucucuaguuauccauacugaguauugaaauucacaaucaaccaaucugagguccucaaagacuuccaagucaguaucuauauaagagggcaaguguaaagaacaaccuuaucuuaccauuuguaauaucuccuagauagccucacccuaguauguuguaauuaauauagcagaggaacccaaaucuaagacugaaaggaacuguuaaacauaagcacacugcagaaacaucucaagggcagaucacaagcugguacagucaccaauguaggcaaauaaucuuaacuuauaggcauuugugaaauaaagaucagaaagccaauugcgcugaggugauuuguaauucaggucauaaaacccaaggcaaaccaaccaguuacaccucuguccuugcuucacagggccuucaaacuugcagggaccaggagagcagggcagccuguagcuaaagcugaccuguauuuauuuaucucugagcagucucuccacacagggcaccucagcaaguuaggaauagucaucagaccaugccaacagccauauaggcuguggcuuuggaaucugccagccuagguuaugugugcgaaaauacaaguaugugugcuuaaucugccuuuauuacugcccaaugcuggugagaugaacugacugcaaaacucgagcaguaaagcagaauacugguacccacaaaugacuggcuuauuaucacucuugauuuuaacacuagacauccucuauauucuaacaucuaagucauuaaaaaccugaaaauuucagcagauuuccuaagucagaguucagauaguuuaagaaguaaaguuuccucuuuucuuauuacacauccagaaggcuugggagcucuccaacuuacaguuaauuucaacaaaaucuuagcaagauacacuuaggaaaucgggcuguuuucaagugcuguuggcauuacaggauuaccaagcuggguggcaaaacuccacaaguuuuugagaacacaucaucugcaacauaauuugagaguguagucccaacagccuguagauuagguugccagugagagaaguaaugacaccuaaggcagcuauauagaucuccuuacaccaagucaguguucuucgggaacccuagccauaaaggcuccuuccaauuccaauggaagaugcauaggucacaaauuccugauaggcgacuaaggcacaaaacaucaccaaccaaguacugccacaagucacagauggaagaaucaguuguacccccacacucaguuguacccauuggcucaugaagccuaugugaauuacaauagcuuccagucuuugcuuuugucuuaaaaagaauagaacacaacagucaaaauaaacaggccuaggagaaguggcuguauacucaaagaggacagccucuacucugcaagaccuggcuaucucagagccaccaacugcaugaacuuaaaggucagaaacuuuaaugugucucuucaagcaucauucuccugaaagcugagcaccaaagaauauaaauucuuaacaccuuuaaauacaucucuacucaaaggcagaauccauuaaccuuaaggguaaacaacuguguguucaucucaauucuuccuccagcccucuagaaugugucauaccugacuucauuucuauaaacugagacuaaaaacauuuaccagaugcuguugcugaagccaaagcugagaaguguuaaagugagaugauucaaaucagaguuguaacaggaacacaagaauuagggguuuucaagaaaaagacuacaacugcuuugguugauugcugcuggaaaaaaaaaaaaaaaaaaccuagcaagacaaaagccuagaguuaaugaaaaguacaucuaaauuuugcuuuuaaauuuaaauaagacuaaauuuagcuuuaguuuggucccuuauuauuuauucauggguaugguguucacacauauauggaugaaggcaggagguugaugugguauaucuuccuuaacugcucucuaccauauaccucaaacaggcacaguuucucacucacuuaaacccaaaguuugccaauucuucuaguguagccagcuagcuuguucucagaaucaugucugucuucugaauguuagaauuacaguccaccaguguuuacuugggaguaagaacauaaauucugguucuaaaaacugugcgacaagugauuuacccaaugagccaucucugcagccuuaguacguaacauuuuaauacgauuaaaaacuuaaaugauccugggcauuacucgauaaauuauuuucuaucucuuggucaaaaguauacacaauacccuggcuuuuacuugcaauguggcacauacuuaagaaaugaacuguagagcuccgugccaucuuaggugcaaacucagccgacggucccaaaguccccacaggucucuacaugccgcaagcacccuaacacacccaggaucuugggaucacugagaucaguguaugcaggaaagcaugugagcagcagaagcaacugagcuucuuggacaggguaccuucuggccuucauccucagcuaggaggcggagcugagaccaagaccccugggcaccuuccccaccagaggagaguuggccuacagggagugcucugaccccaggaacugaggagguggaucugagcuccagacuucuguguacuuucccugcaagagaagagcuugccugcagagaauacucugaccacugggacucaguagagaguuggacucccaggagugcugacagagacuaacagaaucacaggaggaacaaucuccaggcagagauagcuagaacaucuaacaccagagacuaccagauggugaaaggcaaacauaagaaucuuacuaacagaaaccaagaccacuaggcaucaucagaacccaguacgcccaccacagcgaguccuggauaccccaacacaccugaaaagcaagauucggauuuaaaaucaugucucaugaugcugguagaggauuuuaagaagggcauuaauaacucacuuaaagaaagaaauagaggagaacacugcuaaacagguagaaguccuuaaagaauuacaggaaaacacaaccaaacaggugauggaguuaaacaaaaccauccaagaucuaaaaauggaaguagaaauaauuaaagaaaacccaaagggaggcaacucuggagauagaaauccuagggggaauaaaaucagaaaacauagauucgagaaucagcaacagaauacaagagauggaagagagaaucucaggagcagaagauuccauagaaaacauggacacaacagucaaagaaaacaaaaaagcaaaaagcuccuaacccaaaacagccaggaaauccaggacacaaugagaaggccaaaccuaagaauaauagguauagaauagaguaaagauucccaacguaaagggccaguaaauaucuucaacaaaauuauagaagaaaacuuuccuaaagaaagagaugaccaugaacauacaagaagccuacagaacuccaaauagacuggaccaggaaagaaauuucucccgauacauaauaaucagaacaaaugcacuaaauaaagacagaauguuaaaagcaguaaggaagggaaaagggucaauuaacauauaaaggcagaccuauuagaauuacaccagacuucucaccagagacuaugaaagccagaagauccuggacagauguuauacagacucuaagagaacacaaaugccagccaggccuacaauacccagcaaaacucucaauuaccauagauggagaaaccaaaguauuccaugauaaaaccaaauucacacaauaucuucccaagaauccaacccuucaaaggauaauaaagggaaaauccaacacaaagagaaaaauuaugcccuagaaaaagcaagaaagcaaucuuucaacaaaccuaaaaggagauagccucacgaacagaaucccaacucuuaacaacaaaaauaacaggaagcaacaauuacuuuuccuuaauaucucuuaauaucaauaaacucaauuccccaauaaaaagacagacuaacagacuggcuauguaaacaguacccaacauguugcugcuuacaggaaacccaccucggggacaaagauagacacuaccucagaguaaaaggcuggaaaacaaguuuccaagcaaacgguccgaagaaacaagcuggaguagccauucuaauaucgaauaaaaucgacuuccaacccaaaguuaucaaaaaagacaaggaggggcacuucauacucaucaaagguaaaaucuuccaagaugaacucucaauucugaauaucuaugcuccaaaugcaaggucagccacauucauuaaggaaacuuuaguaaagcucaaagcacacauugcaccucacacaauaauaguaggauacuuuaacaccccacucucaucaauggaaacagaaacuuaacacagugaaacuaacagaaguuaugaaacaaaugaauguaacagaugucuacagaacauuuuauccuaaaacaaaaugauauaccuucuucucagcaccucaugguaccuccuccaaaacugaccauauaaucagucacaaaacaggccuucaacaaaaacaaaaauauugaaauugucccaugcauccuaucagaucaucauggacuaaugcugaucuuuaauaacaacauaaauaauaggcaacauucauggggaagcugaacaacacucuacucaaugauaccuuggucaaggaagaaauaaagaaagagauuaaagacuuuuuagaauuuaaugaaaacgaagccacagcauacccaaacuuaugggacacaaugaaaguauuccuaagaggaaaacucauagcucugaaugucgccaaaaagaaacuagagagagcacacacuagcagccuuacaacacacccaaaaagcucuaggaaaaaaggaagcaaauucacccaagaggaguagaaggcaggaaauaaucaaacuuagggcugaaaucaaccaaguggaaacaaaaagaacuauacaaagaaucaaccaaaucaggagcugguucuuugagaaaaaucaacaagacagagaaacccuuagccagacuaacuagagggcacaggacaguauccuaauuaacaaaaucaaaaaugaaaaaggagacauaacaacagaaccugaggaaauacaaaacaucaucagauccuacuacaaaaggcuauacucaacaaaacuggaaaaccuggaugaaauggacaauuuccuaggcagauuccaggugccaaaguuaaaucaggaucagauuaacgaucuaaacaguccaauuuccccuaaagaaauagaaguagucauuaauagucucccaaccaaaaaaaaaaaaaaaaaaaaaaaaagcacaggaccagauggguuuaguacagaauucuaucagaccuucaaagaagaccuaauuccaguucuccucaaacuauucaaaggcacucuacccaauucauucuaugaagccacaauuacucugacacauaaaccacauaaagacccaacaaagaaagagaacuucagaacaauuucccuuaugaauauagaugcaaaaauaauaaaauccucacaaaccuaauccuagaacacaucaaaacaaucauccaucaugaucaaguaggcuucaucccagggaugcagagaugguuuaauguauggaaauccaucaacauaacccacuauauaaacaaacgcaaagacaaaaaacacaugaucaucucguuagaugcagagaaagcauuugacaaaauccaacaccccuucaugauaaaaguuugggaagaucaggaauucaaggcccauaccuaaacauaauaaaagcaauacacacuaaacuaguagccaacaucaaacuaaguggagagaaacuugaagcaaucccacuaaaaucagggacuagacaaggaugcccacuuucucccuaccuauucaauauaguacuugaagauccuagccagagcaauucgacaacaaaaggagaucaaggggauacaaauuggaaaggaagaagucaaaauaucacuauuugcagaugauaugacaguauauauaaaugacccuaaaaauucuaccaaagaucuccuaaaccugauaaacagcuucaguguaguagcucgauauaaaauuaaacaaaucaguggccuuucucuacacaaagauaaacaggaugagaaagaaauuagggaaacaccacccuucacaauagucacaaauaauauaaaauaccuuggugugacucuaacuacggaagugaaagaucuauaugauaagaacuucaagucucugaagaaagaaaucgaagaucccagaagauggaaagaucucccaugcucauggauuggcaggauuuuuguuuguuuguuuuguuuuuguuuuuuccagacaggguuuuucuguguagccccggcuguccuggaacucacucugcagaccaggcuggccuagaacucagaaauucgccugcuucuaccucccaaguguggggauuaaaggaaugcgcagauuggcaagauuaauauaguaaaaauggcuauuuugccgaaagcaaucuacagauucaauguaauccccaucaaaauuccaacucaauucuucauagaauuagaaagggcaauuugcaaauucaucuggaauaacaaaaaaccuaggauagcaaccgggcauggcggcacacgccuuuaaucccagcagaggcaggcaaauuucugaguucaaggccagccuggucuacagaguaaguuccaggacagccagggcuacacagagaaacccugucucgaaaaacaaaaccaaacaaacaaacaaaaaaccuaggauagcaaaaacuauucucaacaauaaaagaacgucugguggaaucaccaugccugaccucaauugugauaaaaacugcgugguacugguacagugacagacagguagaucaauggaauagaauugaagacccagaaaugaacccacacaccuauggucacuugaucuuugacaagggaucuaaaaccauccaguggaaaaaagauaguauuuucaacaaauggugcuuacucaacuggagguuaucauguagaagaaugugaauuaauccauucuuauuuccuuguacaaagcuaaagucuaaguggaucaaggaacuccacauaaaaccagagacacuaaaacuuauagaggagaaagugggggaaagccucgaagauaugggcacaggggaaaaauuccugaacagaacagcaaugguuugugcuguaagaucgagaagugacaaaugggaccucauaaaauugcaaagcuuauauaaggcaaaagacacugucaauaagacagaaaggccaccaacagauugggaaagaaucuuuaccaauccuaaauccaauaggggacuaauauccaauauauacaaagaacucaagaagauggacuccagaacaaucaaauaaccccauuuaaaaauuggguacagagcuaaacaaagaauucucaacugaggaauaccgaauggcugagaagcaccugguaaaauguucaacauccuuaaucaucagggaaaugcaaaucaaaacaacccugagauuccaccucacaccagucagaauggcuaagauaaaaaauucaggugacagcagaugcuggcgaagauguggagaaagaggaacaauccuccauuguuggugggauugcaagcuugugcaaccacucuggauaucagucuggcgguuccucagaaaacuggacauaguacuaccagaggauccagcaauaccucuccugggcauauaauccagaugguaauaaggacacaugcuucacuauguucauagcagccuuauuuauaauagccagaagcuggagaacacccagauguccuucaacagaggaauggauauagaaaauguggugcauuuacacuauggaguacuacuacucaguuauuaaaaacaaugaauuuauaaaauucuuagccaaauggauggaccugguagauaucauccugagugagguaacccaaucacaaaagaacacacaugauaugcacucaccgauaaguggauauuagcccagaaacuuagaauacccaagauacaauuugcaaaacacaugaaaaccaagaagaaggaagaccaaaguguggauacuucauuccuacuuagaauggggaacaaaauacccauggaaggaguuacaaagacaaaguuggagcugaggaaggacaauccagagacugccccacccagggauccauuccauaaucagccaccaaaugcagacacuauugcauaugccagcaagauuuugcugacaggacccugauacagcugucucuugugaggcuaugccaaugcuuggcaaacacauaaguggaugcucacagucaucuauuggauggaacacagggcccccaauagaggagcuagagaaaguacccaaggaguugaaggggucuguaacccuauaggaggaacaacaauaugaacuaaccgguacccccagagcucgugucucuagcugcacguguagcagaagauggccuagucagccaucauugggagaagaggcccuuggucuugcaaagauuauaugacccaguacaggggaauaccagggccaggauucgggaguagggccgggggaguguacaggggacuuucgggauagcauuugaaauguaaaugaagaaaauaucuaauaaaaaaauuauuuaaaacagugaaguggggcuggagagauggcucagugguuaagagcacugacugcucuuccaaagguccugaguccaaaucccagcaaccacaugauggcucacaaccaucuguaaugagaucugaugcccucuucuggagugucugaagacagcuacaguguacuuacauauaauaauaaaaguaaaucuuaaaaaaaaaaaagaaaugauaaguucgcugggcguggugacacacgccuuuaaucucaguacuagggaggaaaaggcaggcggauuucuugaguucaaggccagccuggucuacaaagugaguuccaggacagccagggcuuauagagaaacccuguuucaaaaaaaaaaaaaaaaaaaaaaugaagugaacauaaaaaaauguacuguaaaguuauucagaccuagagaaacuucuacauguguauaccagacuuuggcuauuuauaagaauauuuauaugaauagggaagacaguucacauaucuacuagcagaauucacaaauaagcuaugugauagcuaaugaauuaguuaccuauuucacugcuaugacaaaauaccugacauaauuuaaaagaacaagaaugcuagucauaguuucagaggucuauugggcauccuggcuaggcaaggcugaauaccaaucaccuucaggaguaguuuucucuccuugauuaauccuuccuagaaagguccucacaaaugcacucagaggugugguuuacuaaugucacaagcucuucucaauccaauuaagcugacaaucaagacuagccaucacaagucuacuucucaucaaccugacacccaaacauaucuuccuuggcacucaaagugcucgcacccaucuaauaaugcaaaaugcauucaguucaccaggauucuccagagucuucacaguuccuacacuguucaaaguccaagcucaauuuccuuugacccucaaggcaaacucggcuguaagccccuauaaaaccaaaaacaaauuauacaauucuaggauacaauggcacagaacuuuuaacaauccuauucaaaaagaaaauagagacaaaaaaggauaggaccacaagaagacuguuaucuagaagggaaagcaauucucagagagcuguauaguaucuagagcuuugucaaagggcuucagcacccacaucuggaugaucuuccuacuguaguccaccugggcuccauguuaacaugauuuuaucuguggccucugcuuuccuuggcaaugugccaaguucuuggcaucuccaacaacaggguuacacuugacuuuccaguuuuaugcacugcaggugcuaacugaaggaucuucucauucucucacugauugccuggccuuccaagauuuccuuugaagucuggguguaugcucaaaaaucucauacucaggcauuuuuccacacaagaaaaguacacaucaugcauucaaaauuugucagacuggggccuuuaggauaaaaaucacauuggcuuugaguacuacauaguuaagcauggugagauaaaacucuaaggugucccuauggagcaggguaccccuaaacguacuccucaagggaaaguuaacugaauucacucuuccuuacccuugagcuugugauggugguauuugacuaauucuuaugccuucaaacuuuuuuccuauugugccauguugagcacuauuuuuaaugcuccaaucucuucaaaagccauauucccuuggccucuaccuucauuucuuuucuauaaaauuuauaaaacauuuaaacuauaaacuaaaaacuauaaaauuucuaaacauuugcacucuacuuuuuacugacaguucucuguauacuuggcucaaagaagccagcaauaccucagccauagagccugaaugcuggccugcccucaaguuccucugccaauuagucauucaccauuauacuuaaacucucccaaucucaggacacaaacaaaaaugaagggaaguucauugcaaaaucucaucugaaaacuccuuggcagucuuuccuuccuucuuucucccugacuucccagguuauaaaggaaagcucuguuggucaacucaaaacugagagagcaccacuuuuuccuuaaggccacuuauacaccacacccuuuuccccugggcccucugagaaggguaucuuuuacaggccaaguccaaccuccugauucaucucccauccaucaaauaaauauuauuuuuauauuucccacccugguaagagaagucauuuugauucuuauuguucuuaucgaaacauaaagucaguuuuauuaaucuuagcuuuuucaguuaucucuuaaauccauucagucucuucacacccaugacuacuagagguugggcacuaccuccaccuggauugagggucuucauugcucucacugacaucuugcccuucuaaucaacuuucuaaacugcugccccagaaaaucuccacaguagagaaauauacacuuuguuaaaugauuuaauccuaaucuucuacaccugcuuuugauguaccaccuccccaaccauucucaaaccacuccaccauaaagaacuaucccacagaaggaaagaaacuaaaauccacuauagguuauuacacuggacugccuauacagcacuuuuuguuuuguuuuagaggcaggaucucacuuugcugccccaaacucaagagcccccagagaugacaccaucuacaucuuacaaaaaaaccucagguucagcgacaucaaauaauuugcucaaacucaguauuacugaaugucaaagauuccaaccuaaaaauugaaauucuggaaucuauauucuauccccugccacauguugcuucauuaugaaggugggccucuucacuaccuaaaggagccuguauccaagaguuacuuauaagucaauauuacaacuagcauugggugcucccaaaagaaccaugcaaaaauacaguugagaagguucaugguacaggugcagacaagucuacacugcuaccaagugagcaggucauuacacagccuugacuuuuacucauacuuccaaaucuauucaaaacuuuuguuugacucuuuaguaauuauuuguaauuuuuacuauuuuguaaauccauuuaagcacaccagaacagaaacugguauguuguaaauacuaccuguguauuugaaaaucagcauucuuuuuguaaaguacugaaauucaaggcucaugaaacucucacuuaaaacuuaaauuaucucucuuaaauacaaaugaaaggaaacuucuauucaaacaacuaugauaugaagcacauaaaaauuaaaucaggacugacacagugacucaacgguagaauacuguuuuaucccccgugcuaccaauuuuaaauaaaagcaucucuagacauuaaaaguagaugaguguuugccuagguccagggugggaaugacugcaaauaggcacagaaaucuuuuagguuguagaaacauucuaaauuagauguagccuuggcugcauaacucuuaacuucccuagagauaaucuaauuauaaauuuaaacaggugugcuuuaagauauacaagaccuaaacaaaguuauuaaggaggaaagaaggacuaaagagauggcucagcaguaaagagcacuggcuguucauucauaggaccuggguuugguucucagcacccaaauagcucucacaaccacucuuaacucuaauuccaagggauccaaugcccuuuucuggaauucuugggcaccagacccacauacaggcaaaauauucauacacuaguguagccauaauguuauugugcacucuguaaaguuuaucuuugaguuacucaaaugcugauuucucugcccucauaucuagcugcaaucuggauagagcauuguauugcuuaagucaagaaucuccugucucaaguuuguguaaacaauguucaucauuuauucucugccuuaucaacagaagcuggaaaagcaaauaacuaggcaauagagagaauagggcaggauuucagcuagccaggguaaggggggagagagaagaguaagagagaggagacauuaugggaaaauacaucuagagccaagagggccagaccaguacuaaaauacaaguaucucagggauuugcuuagaggauuaaaauagaucaaugacugcccagguuuuaugugauacagcuugauugaguaaaucuuggucugugucauuacugaggaacuagcuaggauaaaggaaaaaaaaaagucacuguauuaauuuacgacaaacauuuguauuaauuuuaauugcuacacauuagaauaaaaaugaauucuugggggugcggaugagacuaaacuuaaacacucuagcuuuaaauuuuuaugaguuguuuuguucauuuacagaaacaagaacaucucuauaagcugacuuugguucuacauauauacaugcuuuaaccuaccacuaaaagucaaauuacugagcccuccaacuuaaaaccuugcccuguaacaaacaagcaaaaauacaauuuccaagaauuacccaaacucacuggucauauauauguguguguguguguguguguguguguguguguguguguguguauguguucaucauccuacuaaagaccuaaagacauagugauaguaguugaauacaaguucagaagggaaagaagucuugucugggcacaaagaucaagaagaaaggcuuugccgggugugguggcgcacaccuuuaaucccagcacucgggaggcagaagcaggcggguuucugaguucgaggccagccuggucuacaaagugagcuccaggacagccagggcuauacagagaaacccugucucgaaaaaccaaaacaaaaaaaaaaaaauuuuuuuuuagucugacaacuuugugaaguuugaccuaagagcagacacaggcaguaaaacuaacaggaacuuuaacaagacaauugagauacugucucaauacccacaucagcaaugaaaaacaaagaccagaugagaaacauaaaguaagaauuaugguaaauaaacuguguaauaguagcacagauaaagacugaaagacaacaauggcuaucgcagauugguacuuucaaaccuccaacaauuucucuuucaauuccagaacagacaauaacaauuaacauucaaggggcuggagagaggguucagcuauaaacaguguuuggggcucuugcagagguccaaaguuucuagcacaaucaggguuuugacaaugccucgucuagauuuggagggcaccuguauguaaauaugcacacauaccucuccccuacacacacauaauuugaaauaaauaaaaguaaaucuuuuuuaaaagugcaacuuuguucuaacuaguagaaauguucaaugauagaaaaguuggcuuuuuuucuuccuaaaacggaaacauuuuaccuuuggcccagaaauccauuuguaggaaucucucccccaaauaaacaggccaaaauuccaagaaguuguaaauucaaguuuagucacugcaaaacacuaguaauuuaucaaaaaaaaaaaaaaaaaauuccaucagcaggggacaagaagaccuguccacaccuugguguccuaugcaauuaugcaaaggaaugaggagggccucuggguacugaccacacaagcauuucucaguagacauuagcugaucaaagcaggagaccuucuauguauagggaagaacaaauaccaacauacggacacgaguauauuuuuguuucuagaaagauuuaaaaaaaaaaaaaaaaagccagcuucagaggaggaagcuuggcaaacuaggucaagugaaagaaacuucagugggguccauggauagaacucauaggcaugagacugguaaaggagcucagaaguaaaguacugaaagccugauggccugaauucagggucuuuuuuguuuguuuguuuuuuguuuuuuuuuugugugggggggugguuuuguuuuguuuuaguuuguuuguuuguuuuugacaaauugauagucuuuugcagggaaggagagaacugacuccugaaaauuauccucugauuuccauaugaacccacaugcauccuuucacacucauauauagauaaauucagggacauugugaaugaagaagaaaacaacauccugauuuucauuaaccugucugaaaugugacaguucccugauuaugaaugcuggccacagacacagccaagcaguaauggggcacaccuuuaauuccagcacucaggaggcagaggcagacugaucuuuuugaguuugaagacagccagggcuacacagagaaacccugucuugaaagagaaggggguuggggcagggggaagagagagaaagacagacagacaggcacagacaggcaggcaguauaaggaaaaaagaaacuugugauuuucuuggcuagcuacaguuauuuccaguaucauuuauacccaccaauauugagauuacaggagaauccacucauuaccuuuuaagugggaaguaaauauuaagucucugguggacaggucuguuacacuugaacauuucucauggugcaaaggcucagaagaacacugacuauucuuucagagaacaguuuccauucccaguacucauaugaugacugacaaccaucugaaacuccagucccaggaaagcuaacauccuuucugaccuccucagguaccaugcaugauugugaugcaugcacauacauacaggcaaaacacacaaauaaaauuuuaaaaauucaaaaaauuauuaagaguuauagaaacagguucagaccacagcuaccaguauuaucucaaccaacugugcccuguuuaggcaaucaccuaacaauaccacauuauaaacaaacauggcauucaaaaguaugcuacuucauaacaauucuagaccggcuaaaugaucauuuagacaccuguuaguggucuguuaguuucugugaaacuuccugcaguacuaaacugaacacuugauuugaaaguucucauguaugaacaauaaguuacgugaagaggcaugaugcaagaauggagauaaagggucuuaauuuuacauauauuaacuuggagaagaacaacaaaaugaaaaugcccaagcaaacagguuuuaaaaauauaaaacugggccagugaaauggcucagugggcaaagguccuugcccugacccugaugaccugaguuuguucauccugugcucuuaugguaaaaggagagaaucaauuccugaaaguuguccacugaccuccauaggugugucaugauaaaugucaaaauaaauauguguaaaagaguaaaacauaaaacugaagccgaaaggaaaccacaccucaagaaauaagcaaaacugcacaaguacaggcaucagccuggacaauauucucaaaguauauaaaaaagaauagauaugaggacugguacucacaauauaagccaccaggccauaggauuuccugugcugugccagauacagugugaugagcgcaacagcacuaagguugaccaccuaucaacaaaaagaucuguuuggaaaaagucauugacuaaaguaagugucuggagauaggugaccuuaaagaauauuacuucaagcugggcgugguggcucaugccuuuaaucccagcacucgggaggcagaggcaggcggauuucugaguuuguggccagccuggucuacagagugaguuccaggacagccagggcuauacagagaaacccugugucgaaaaaccaaaaagaaagaaaaaaagaauauuacuucagaugaauuaauagccagugguagagugcugugugcacaggcccuagguucaaucuccaauacucauggggcagguaaaaauggaaaccagcccacuccaaacaauucuaagaagaggaugguggauuccugaugcuaacagaagcagacacugccccuccugagaccauugucacaguaggauccccagaacaucucagaugugagagcuuacuccacuagagcacuagaaugagaugugaguuuugaguucugaagcuagaaugcaaguguaacuuacaaauaaauggguagcuaugauaacuaucaugccucaauuaccaaaaauaaaccacauacuuuauucagaaauaauuaguccuuucugugcaucuccuugcugaauuuaugugacuaugauuucacagccugauacaaaacaguauauucugcugcagcauguuucuuuuucugcuuuccauucacuuaaauaaguccuuuuggcaaccucaacacugugacccccaacucagcucaccaccagauggcauugaacauacacaccaagugcugauuagauaaacauggcaagugugacuagcagauucaccuagaagucaaaacgguuggguccuuccauagugaacaguucuuauugacuucauuuuaaaggaauccuuaaaaacuaaacacaggguguggagcguacaggaagggagaagugcagggauuguucaagggauucaguuucagucauagcacaugaauaagcucuacagagcuacuacauagcauagugauuguaguuaauaacauacuggauacauacugagaaacaagaaaagugcuaaaaggaaauccugaaaauucuuacaaaaggauaaauaugugguuauuaaaauuauuuauaacuugauuucauuauuuagccacuuuuaggggaucugaaguauaacaucucagagauaggggcucuggucuggcauauauugaggcccuaggucucaaccccacuaccacaaaacaaagaaaaaauuaucaugcuguauaucagaaauauaaacaaguuucaucuuaagaaagauugggggagggaaaguaaacaucaaauucucagaauuaauguaaagauuagauacaacccuguggguaaaaauacagcuuggacauaguaggaacccuccccacaauugauugcuuucuuccuucuaaaacuuaagagugguagaagauguuccuuaaaacccauaaacuucuacucaugugcauuuacuagaaaaugcuuauaauccauuaaacacaagagcaguccuagggugaacuuauucuuguguuuguaaaauuuuccuuaaaaaggaaauuagaaguucacuguuaaguuucuuuaucguacuucugaaacacacuuguauucuacaggacagaaaaauuaguaaacaaaagauacuaauauuaaauguuuuauuuauuaauaauuauugcuauuuggguaaucaauguuuuauuaaguaggguuuacauuauaccuguauuauuuuugguuauuaugaaaauguauugcacuuguuauuuuuuucuauugcuguuauaaaauauucucacaaaagcagcccaaggaaagaaggcuuuacucugaaucuuuuaaaggaacagucuaucaugaagaggaaggcaugguggcagguaugaggcagcuguucacacugaagccacaguuaggaaacaaaggcagaugaaagucuauacuuagcuaacuuucuccuuuuuauugaguucaggaaucuagcugguggaaaggacugcccaucccaagcuauucuagacagucaaagauguacccagagcacuaagcauuucagaugcagaugucuccaguacuauuuauuagaaacacaagaguauuucaaagacaaauguguuuauggaacuuuaaauccucaccacaacucacuaguagaucucuucacugcugagcuuuuacuguaggggacaauacuggcuuuccaggcaaaaugaaguaaauaaaugcugccauuaaauuccacaauauuuugauaugaugguacagagucaauacugcccccaaauccacaccaaaauguucccaguagaguuguacuggucccuuguaaugaucccuugucucucuccuucugucacuuaggcuuguccaugaaaacugcuucagcuaagaaguacaagcaugugaugacugcagcaauggacucuacuucaacucauaguccccacaaauccuacucaauuuccaaaggucucaugugcagugaccacuuuguucuguggccaguggauacaagguccgagaaacuaccugcugaauaagauuuuuaaaguggcacaucaugaugaaaacauccagcuauucaucaccucuucaagguuuucaauuaaagacaaaacaaaaaacaaaaaaaaaaaaaaaacaaaaauaaaaaaaaaaccaaacaacucacucuuuuuuuuauuuugcuaaaagaacucaucuaacucuggucugaaaacucaucagccauucuccuuacuuaggccaucauucaagcaaucuuccuacuccacuacaaauuagcugaagagaauacacuuuuuuauuugguuuuuauuuuucucuuuccuuuuuuguggcaggagucaucaugaaacacuaggcaagcauuguacauugcacauggcugcagccuuaacauaguucacauuuuucacuuugaggcaggucacuaaguugcuggggcuuaaccugaccugugaucuucuugccuuggccugcuguguagcugagguuauagaucuucacaccagaaccaccuuuaaggaguucuacaucguuugauuugaagacaacuuacuauuguauugaccucaaguaaagaaaugagaggucaagcacaccaaucuuggcccauucugaugagcaccuuggauaguaaaucuuaaaagcacccaagaguucauaguaaguuugguguaccuucuucugucacccaguuuugggcauguggucaugcuacauuuacaaaaagccaucauguccaugcguauguggaagcuagaggccaaccuuaagugccccucagaugccaucaaccugcuuuggguuuuguuuuggagacuaacaucuugcaauaucaacuuccccuuagaaaauguuuuucaaacaaauaagcuuguaacauuuuguaaaagcuggagauuuuucuugaacuguaccuguuccuaaucaagauucaugucuuccuuuucuauuacaaaucauuuuuagcuuacuuuuaucugucgaaauauaagguaacuaggauuucuaguuaccaguuccuagcgauaacuggauccaggaugaccucacacuccugggcuccagugauccucccaccucaagcuaggauugcaaguacuguugagaggcagaagagacacacuaaagucucaucugcaauaauugaagucugacccuagauucaaugcccaauaccaaaaaccaaacuaaacaacacugaugucuauauuuuaaauaaacauaaagcacacucucccugcaaagguguucauguucucuauucuuauaccaguuuuaacuaguguuacacaaagccacacacugucuuuacugcuguacuuuaaaguaggggacuaaacuuaaaccaugcuggugacuggacuaauggcauagaccuauuaauuccagcuacuauggaagcuaagaaagcuuaccuaaccuaagcugcagccuaaggacaaccuaagcugcagagauaguucaaggccaacacauauaauuucuagagacauuuuggcagggagcauguuggaaaaaaacaaagaaauaaaaagggcuggagguaaauuauagcucaauaguuacuuuccuaccauuaccaaggcccuaguacaucuaacaaucaaacugcaacaauuucaguauuuuugcugucacguaacuugcuucacuuacuuggguauugcucaagaaaggcuuucaagcucaucuucaaguagcuuuaaaaauccauuauccauguuuccaugugaaaauacacuuauuuuuuuaaagauaaagaauaauaaaacuacaaaauccagacuucccccauaguuuuagcagcacuaagaauguauucacaagggguuggugagauagcugagcagaugaagguacuugccucaugaucuuagauuuucaaguccacaugguggaaagagaaaaacaacuccucaaaguguccucugaccuuugcauguguacugacaaggaaaaaaaauuuuaauucugaaaaagcaguuaacagguugaugagucuauucauuauaaaguauuagaaucaaaacaaacaaaucaaaacuuuggaauauccaaagugaucucuuuuauuaaaaacaaaacaaaaugggcuagcucacugguuaagaacacuuguugcucuuccagaggaccaaaguuugguccccagaacccacaugguggagcuguuaacuccaguuccagaggauuuaacacccucuccuggccuccuuaacaccaggcauguacacggugcacauauuuucuuaguuccuguucuauuguucugaagagacaccaaaaccaaggcaaccguuaucaaaggaaagcauuuaacuaagggcugguuuaguguccaggcucaguccauuaucauuaugguagggagcauauacaggcaggugcagaaguauugagagcuacauccugauccacaaacagaggugggggaguaaggaggagagagagcaugcuggagcugggugccugggccuggugugggcuucugaaaccucaaaguucacccccaguauggacacauuuccuccaaggccacaccuacuccaagccauaccucacaauccuucuaauccuuuucaaauagugccacaacccagugacuaagcauucaaauacaugagccuaugggagucacucuuauucaaaccaccacauacaugcaguaaaacacccauauacauuuuuuaaaaaaacaaaaacaaaaaaaacaaaacaaaaucucuguacaaggcaaagucaauuauguacaaaacauguacaaagcuaacacugaaaugcuaacaggcaaaacuacuccaccgguuaugaguuuucuucuuucuguauguuuuggggccccugauaauagugaccuacuucuuucugcauaauuucuuucaccaaauaagaucuuuucaccucaauagacuauaugaugauuagcauuauacauuuuuguggcacaugucaaaaccaggacaacaaagauggacuucuuccaguauaaggcauuuaauuacaagaaggagaaagcugaggagcagcagccaguaagucaaaggcauguagucaaaaaagucuguggcacaaacuuaaugcugaacaucaguguuccuuuaacauuaacccauaagcaaaacuuaaagacucaauccuuaagaugggagaaguucauuacccuguacccucuuccaucucucucccaaaccagucucauacuuccuaaagguaagccugggaucugauuccacuuggaacuggggagucugcuccauggcuuaccaaccucaugcucaugcaggaucccaaaccuccccuucuaguaugaccagagcaggccuuuuuccaaaccccaggaaggaagaucuaaguucuuguaucuuuucuccacuuugugacuuuaagaugccuaucaggcacagcuauuuuagcuauuuuagugagacucuaguguauuuuguauaccaaagguauuucuccauugauaucuggugacaguuucuguacauuuuaugcacauuucuauauaucucucuucuccuaacucccauaguauuucuaauuuaaaggaucuuucacagaaaacugauuaaacaaaccgagcaacugugucaaguaauuaauuuuuaguaaguuuuauugcuauaaauggaggcaucauaauuuaaacauucaacuuaaaauguaucuccuauuauuaggaguuaugaacuaagcaaaacaaauugggaaguucaauuaucaccaagaaaaggaauacucggcugcccagauggcucaucagggaaaggcaccugccugcaggcuuggugacuuuacaaguuuaaucucaagaacugaaugcuacaaguuuguccucugcccuccacaacugugugguggcaugccuguguacauauauguguacacacauacacacacacacacacacacacacacacaccuuuuuuuaaaggaaaaggaaacuuccccuaugaagguuauuuuaaauaaauaauaaaauaucaaaacauauugagcgucaugagauuaagacuguuuaauggcaggaaugugaaggaugacacaagaaugaaugagaacagaagacaaaggagaacuugaccacuggaaucaggcuaccaagucagacauuuaacccaccuauuaacacauggaaaggaaaucaaaaaccaaguaacucugcauugaauaagcagaaugaucuuccuugacagugauucuucuauuacuauuuucuuaggauuuaugcuuuugaaaauuaucucacuguccugggaaauaguaguagaggacuugccuaacauacaaagacuuugaagcuuccccggguucaauccccaacaucuugcuccaaaaacuguccaaagaaaaaccaacucacuauauuuuauucccaguugucuaucuauaaaaacauaugcaguauaguaaaauuagcacaaaaaacccuaaaaugaaccacuucuuaaagauaaucacuaacauguacuuacuuuccaaaaugcauacacucacacuuguaaaaaguuuuauacauauuaauuuuuaguaucuuuguacuuuaauauucaauauaguauuacacaaaugcaaggauuuaccuaaacaaugcuggaauagucauccauaauaaccccaagcugaaaaugaaugauaagaauacaggagggaaaaaaaaucacuaaucuauugaucaccuuuuuauauuguuaacaaauuccuuaaaagcaggugagcuauuucaaacuacacaucauuuugaaagucucugcuacacuuuuugcucuugaaaaauauuuaauuggggcugaagagauggcucagcaguuaagagcauuuccugagaagccaggaucaguucccagcaccaacauggcaguccuuaacuccaguuacaggagaucuaauguugucuucuacccucugaggucacaaggucucugggcccaggcacacauauggaauguauacacaugugcaugcaaaaacucauacacacaaaaccaaauucuuuaaaaaccuguauuuaugggcuggagagauggcucagugguuaagagcacugacugcucuucuagaaguucugaguucaauucccagcaaucacaugcugguucacaaccaucuauaauggguucuaaagcccucuucuggugugccugaagacggugacaguguacuuauauaaaacaaaccuuuaaaaaaaauguacucuaaaaaacuauauuuacuuauauucuuuuuagcaaugaguaggcauacuucuccaucuucucaacaaagugacuuauuuuaaaacauuacagaucuccacuucugggaauacugcuaguuuagcucaggauuuuucauguuuccuauuccaauuuucccauuuuuuuaccauaggaggaaaucuuuuucccauuagucuacaagcccccuuugauaguauaaaaaauaaauuugcauguaaaaccauuuucuuaguuugucauuugccuuuuauuuuguuuacaagauuuuaccauaaggaaguuuuacaagucugaaguaaucaguucuucuuuaaagucuauuuuugguauuaaguuucucaaaccugagacuugaaauugauacuuucuuuguuacuaauuuuuuuauaaaaaucuuuuaaaagacacaaguucaccuaaaaucacuacuauuuuacagugguuuaauuacuuaagccacugcauacuuuacacauacuuaaauugguagucuguuuucuuaaguauuuucugacacaggccuuuaaaaaauuagcuuauuaaauggauuuaagauuuuuugcaaggccaaugaaucauaacauuacacccaauuuaacaauagccccaaaguucuacaaauguuuaugcuuauaccaucacugucuacucucuaguguuuucugaaggaccaggaagaagaaacucauucuugggaaccaaccauacuuauuauguaugaugaauucuguuguaauggucagacaucaauccuuaaagacucuuucauuuuaaucucugcuaaucuuccuuuaauuucauauacaucacuuucaaggugagucccuuguuuaaaaguucaaacucugggaugaccaucuugcucuaaccuccuaccugaggcuuuacaccuucauagucuugaugaaaacuacccaaaguccaggacccuucuauuuucuacaaggagagcuaaaugucaguacuuacacuucacguggcuuuguaaagaucugaagugggaggauguacauagauuuugacaugagcauugugcuagguauuagagucagauuuguuccaccugccccuagguaaagucagucuaauagaagaaaccaccaagugucaucagaauguuaagcacugggauagauccauagacaacaugacauaaacaacauagacaacaugaggaccuagggaaagguccuagacaggauggcaagaccagcuuuccuaaaaugaagaugccugagcuaaagugauaagaaaaagacccagaacagaucagaaguacaaucaagcugaagcgugaguggaagccagagagcagaaucuuccuucuguccagguuucccaagggaaaaaaaaaauacuaucaagacuuuacauaacccuggugaucaaacaugaaaugauauacuaugcucuauaagguaguucuccaaugucucauugguuauguucccauggaauccacucauuuuaagaacuuagaaguuagaugguaucacuuaaaaacuaccuuaggugcuugcugccaagacucaggaacugcugccaaguuuacggaaucccugagacccacaagauagagaagagacuaugaaguuugucuucuggcuuucacacgugcacuguggugcaugcacauacaugcuuuuuuaaaagaugaauuuagaacuguccuuuaaaauagaugguuaacagcuuuuuccuccaagcauaccuaaaagaugaguucaaaaugaaaccacugauucucaaaaaucaauuuaucccaugacuucaugggaaagguaaaaaagacuaggcuuugggacuuaugaagugcucaaacuucaagacaguuauaacuuugaggggcccuaacaaauuaaaucuuaagaaugccaaguaacuauuguuugacuuaagguuuguucauuuaaacauaauuuuccuugcugaaaugaaggucccuuauccucccacagaaacuuuugguacaacugggcuggacuaucuucccagcagguaacagccuuaaauacuaaccggcuuuacuucaaaggcaaagggguaaacaaacuuguuuuuuaaaaaaauacugacuccuuaaauuagaaugauuaauuuuaauuuuacaaacuguuuagauuuccacaacuaaagaaacccucaaccauuuuuucccuaggauacaguauguaguuaugcagguggaagggggacacaagaaaaauaacaguuuucacucuagggaagcaugcaacauaauaguaaacuugcacuuuuaacaagcucagcagcaacagugacuauguuuucugcagccaaaaugaaggggaguaguaaaacccuaggauuaguccaaaaaagaaaaaaaaaaucauucaugguaccagcaagaucauguucuguuaucugaggguuacaaaguaaaggacuuagucugugucuucaaugauuucauagucacauguaugggaaauaagccugcacugacaaaauuaauuagcgcaagaagguggaguucccugaacaacagagucuauguaauaucuaaagacaccuggccaaauuagcucagacuucagauguaugugacauacuaggaauuugggccacaccuuccagggccugaccauaagacucaggaaagauguaucuuacaaacacccuagccuaucuaaaauugguugucuuuugggcaaaacaguuuuuuaaagaugaugccaacagggaggaaagagaaagguuagcauuuuuagaaagcacuuuggucuuuucucccaggcuuaaggcuuaguaaaugcuccccaaaaccuccaaaaaugggcagaauagaagauaaaacaagccaguguuguguugcauacucagaauuuaaaaugagcuauaacuguuucaacuuacuaugggaagcaacaaauacaaguuuuaaguaaaaagagaaaucuuaaagccuucucaaacaaagaaagaccucauauccuuauuuuccucaacuacacuggcuucuucagaguguuagguuuagguccuaaaaauugaaguaaaaggagcuuaguuccucuuuugucaccccagugccuuucuaaaacaguaaucauuuauuccauucuuagcuuuuggcuguuuuaaugcuacuccagcaaagagcaaguacacacagggcaacuaaaagcacuugaacaacuugacugcauuucggcaugcgugcccgucccacaaacccccaacgacugugaacuaaccacaaguaucaacagugaccucucagaaaaggggaauccuccuuuuuuggcauaccuagcucccuuaacuuuggggcuuaggcucaaggaaugagagugcaaguguuccuugcuuucuuaguuaucuccugaguaacaacacagugcacaggugacagaaagaggggguucucagggccacgcgggauuuaagaauagaggcccgcagagucuacagcccccgacucaguccuccuggcccggugccggguuaccuuuggggucagagcgcgcgcucccgccgggaccggggacgcgccgaggccgccgcacagggagggcccaguucgacugaggagagcuggcggacgcccgggggcuccguuccuuuggaaaagcacaccgcaucccggcgcgccuugcucggccacgcucccagagagaacggagcccggcaccacuguuacccaauaaucaugccccgcaccgucgcaacaaugagugcccccggauccccgagagcacgagucccccggcccugagccaccccggccaagcggaacccccagggccgaggggaagggagggguggcgcgugaggcgccgaggucggcgccacaggccgcggugaguccggcuuuuucccagugcguagccagggccuggcccugcgagucccggcccaggccgagccuggccggccgggugacucaggccgggccuggccgcuccgcuccgcccucggcguccuacgcccacgacuucuccggcccggccgccauuccgccuagccgcggcgcggcgccucaggccucgccggcagcccgggcucggacgccgcggcccgagucacugcgacgccgcggcuccgccguggccugcgcugccucccgccaccgcggcccgagccgcuacucacccgcaucuccgggcgccccccgacgcucgggcgacggcguguagugcucgcggggcccgccgaggucuggccgcgucccucagcgcccgggcugccccgccuggagcugcgugcgacacggcgcccgcuccuccuccuccuccccugcccgccugccggcc

SEQ ID NO: 12363 - RNA, 162578 nt, Mus musculus
ugcaacuguaauuuuauuuucucuugugaaaauaaacugggaguuuaaauuguuccaaaaaccauaaaaacaaaaugaaauacacacagaaaaagcuugugaggugguggugggggaaggggcagagggucuuggagcuucugcggauuguacuagcacagauggaggugacaggagccagacaucggggacuggggccugccugccacucugauacugcgaggcgggaaagaaaacgugacugggcagcagagaggaacagacuucuugaaggcagugguaggcaccuugagucccuuuaaaugcagggggggggaccauuucagaaggaccccaccccaagcuggaguccaggccauuggggcccgaagagggagaggggaugauggugggaaacuauggucacacguggccacaaccuuacacugggcagaggacagaggggguugaacuggcgcugaacacaggacaaacauuugggcgagggcaacaggacugaccuggagagaagggugucaggcuagaacuccaggccuggucauguugcugauacggugggggagcuagggcaaguggggcuggcagcgacgacggaaaggagggcagagagucaggaagagaagagguagagagauaucucccgcccagguauacccaccacagcgcaaggggagggagcaacacacugcuuuucagugcuuucuugugaaggaugguuuuuuuuggggaggggagaggggcaggcuuuguuuuguuuauguuuucuccuuuuuuuuuuuuuuuuuuuuuuuaaaaaagccugaagaucagcuacugguuauaucuacagugguaaggcacugcuguuaccagucacuuuacagaacaguccagaguggucaaauauugaccaauaaugcuuccuuuguguuucccccuuccucuccucugaaucauuacuacuuggagucccgagacagccugcauagaaccgggggcagcuuagugggcagacuuggugaccaaggaaagaggcugggccuguagcacggggagggccuggugggcauggagcguagcugggaaaguagggggagaggucagcagagcggcgggcauagagcccaagggcaagggccuggauaggagugggggcuggcugcccaucuggcuggaguugcuggcggccgccuuagccgacaggaaggcagcggaguggagagccagcugggcccgggccuccgguuugguggugagcgacaggggcugcgcuugcucggaguggguagccgcaggggcagcuggugaggccaaggcugcggagggcgucgcaggggaguccagcgugcugccaugggaagacgcagggcuaucacaaggcuucucagggggcagguacugaaugcauggcuucuugcucuuagaggccagagcaccuaaagguacaaacacaaggaaauaggauuagcugucuucugacacaccugaagagggcaucugaucccauuacagauggcugugagucacacaccaugugguugcugggauuugaacucaggaccuucggaagagcaggccaugcucuuaccggcugagccaucuugccagcaaacagaaccuaaccgcuauuuccacaacauucauugugagguggguuauacggcaucuagagcugguauacagugauggaagauaugcauaaacuuuaugcaaauauaaggccacucacucaagaggccugagcaccuggggaucagguauuugagaaguaggguauggggacgccuugaaacccauccaaaggacaaccaggugugacugacugcacguuggaaauguaagauuuuaaauaaauaaauuaacaaacaaacaaauaaauaguggugguaggguguguguguguguguguguguuuguguguguguguuugugugugugaguguguguguguguguaugugugagugugagugugugugugugugugugugagugugugugugugugugugugaguguguguguguguguguguguguguguguguguguguguguguguagggcagagguucagacugagugucuucgauuguuuuaccccuuacuuaagaaacguuuguguguauauguauuuugccuaugcguauaucuguguauuaagguacaugccugguaccuguggugguaagaagagggcauuagaaacccuguaauuggaguuacaaaagggugugcgcaagugcuucuaacugcugagccaacuuuccagacucucccucuuggguuuggagacacacucucucccuggauauaaagucuguuguuuuuaguagacuaaugauggacagguugccacuguggcuuuccugugggugcugggcaucugacugaaaguccuuaugcuugcacagacucaacccacugcguuaucgccaguccucacuguguuaucgccaguccuugaguaucccagucaggccucacacagugccaucccuguuuuacuuggugcuggguggguaucaggcucagggcuucacgcaugcuuaggcaaucauuccacccacugagcuauaucuccaggauuuucaaagauuuggggauuaggaaacuauacuucagaacaacacucagugcccagagaaggcacaauccaaagaccaaaugcccaaacugacaaagacccacucagaaucugaacagagagcaaaguucaaagccuaucacuuccucaucucuuccuuaaacccauuaacagcugagcugaaucuacucaguuuauggacuauaguauucuccugauguacaaccaaagaaaaccuuauuccagcgcacuaauugauaaguggcgugauggccaaucuaucuuaccaucaccauguaaacacgccucugaguguaucuguaaaaugcuuucauaaaguuuuaacagagcaaggaggauccagccugaauauagacggaggcccuaggcuaaauggaaaggagaaagcagguaaggaccaacauucaucucucugucugcuggccaagaacacaccgcgaucagcugucaugccuucccaccauaauggacgguguccuccaagcuucgagacaaaacaaaugcucccuuaagucaccuuuugucagguguuuugucaaggcaacgagaaaguaacuaauccgggugauaugucuaucucuagcaugccgccuuuggaagggaacuucagagauaauuccagcuagcuccuguuuuuaccuuagguaucgacuuuaggcgugacucuaaagggacaauucagcugcacugagacaagucugagcuuugaagauuguucccgaacccccuuuaaaacacuugcuaucuuaaagagagggacuaggaaacccugcaaaccuuccaaagcuuuaugugagggagggugcuggggccaaacccaggauugagcggcuguguucucggucucuuacuuggucuucucugaaaggaagugcugccguccugcugaaguugcucaggaacacagagucuucagagacucagguaacauaagcaagaguguccgggacagugggaggggaagcgaggggcaccaaccaacccaggacucacccucugccucuuggauuugcugcugagacugugucugugacagcugcuuuucucucuuccucuucuucuucuuccccugaaaaacauggccacaggacugaugaguaaggacagaauaauacuagcccggcaagaagaccccagacuacccuagaacagagauggcagcccuucuccugaucguuccuggguaaggugcuggagaacuggccugggagacgaggaaaagcgacccugcccucauuucucauaaagucccucuggugggggcaaccaagccucuuggucccgaggaccuucgagcuagucugucucuugcacccuuuacucccuacaagagugguuuuaaaagcuucugucccuccuccucacacaugugugugugugcucaugaauguguguguguguguguguguguguguguguguguguguacaagcauucgaguacaugcaaugcacacggggaccagaggauugcccuggaugucauuccucaggcacuguccaccuuuuuuggagacaaggucucuucacuggccuggaacuugccaaacaggcuaggcuggcuggcuggcuagugaaccccaagauuuguucuguucagggcugagucuagguacacagcaccauggcccaguuuugcauguagguguuaaagauuaacacuugaccuguuggcaggcaggcaguucaccuacugagcuaucacccuggccugcuuacugaccuuuucugagcagucccaggccucucugaaaauuugaugcagcuacuaugagcccccucaccagauuaaaaaaaggagagaaaaagaaaaaaggaaagaaaaggaagagagaauaaaagcauacauagaacaauccaacaagucucacagaaauucuagacacagccccuaaaacuuccaacuuggcuuccuuauuuccaggaaacauggcuucuccucuagaaucaagccgaaguagcuugcucucucgccucugcauccugaagaugcugcucccaaggucugaguuccugcacgcacgcacgcacgcacagcaugaacacuuacauaguugucccgggcugaccagguuggguagagcugcgcgugaagcugccguucuuuccgggcaagcucauaguauuuggccuguucuucucuugacagguugugccacugagggagagagggugaagacacacagagccaucaggguaggcggagacccugaggccccucugccaggacgaguuaacagcagcaggcauuaccuuucuucccaggauuugguuaauggcugcacuuuccuucaggguacacucggccaccaccuuggcccucaucuccuucauauacaacaugaaggcauucaggggcuuuuucacgugagguuucuucuccucuuccuucuucaccguaacuggggauuuccuggggaggcacagggcugaagguuagguaucaccaucuucagacuucccuccugccugccuucacugggaggagaggcuuguuugguggccaugugugacugcuuucaugaucugggcagaggugggggggggggcggugggaggggauggagggaggaaggggaagggaggacaagagaggagaagggaggcagagcguggccucccucagccauaggucuggugguguggguguuucugcuaucuuuccagcacagggauaaugccagggucucucuggcaccagcugucaccaguccuugagagaauuccuuucucccauccuggccuuacauuuuauuggggacgacaggguagggagggaagccaaaagcuuucuuagcuccucacagccacaagaaccugucugaggacagaagcauuaggucuuaaaggaagggccauggcaaaucaaagagaacagcgugcacgggagaagccagggcuuggacugccagcugccagcaggagagaagaccacagggcacaggcugagcagagaguggaucacaccccuccccccagagggaucucacuuacgcacucacugcagggcucaggcugggggcugcuggcuccugcuucacaaugggggagacgauggcagggugggggauuccugaggugggcagaccaggaugggcaggagccaccaugugugggaaccggcuugagaccaggcuguguaacaaggagacacaagugagaacggagaggcaagggcugugugccgcccaccgagaggguggucaccugcagaauuaggcggucaguuuugggggccgcccaaugacacugucccuuccccuaaacacacacagccuuggugcuggaugcaggcagaaugaaaaacuuagaaggacugcaggacuauaggccgccugccacuggugcucccacugucagguagagccaccccugugagaaaucccuauacacuguuuccuuuccuggcauuaccauggaagauacacauuuccuccuagucucuggcuucagugugucauguuuaaaaugacucuguuccauagagucugguaaguagggauguggaaggaggguuuagcugcgcgcgagcgugugugugugugugugugugcauaguagguccuggggugcccauuccaugggguugugguguaaggaguaugaguaagagcuagccccucaucaaagagaaguaaggaucaaggaaaccgugcaguggugacgcacgccuuuaaucccagcacaggaagcagaggcagauggauuucugaguucgaggccagccuggucuacagagugaguuccaggacagccagggcuauacagagaaacccugucucgaaaaaccaaaacaaacaaacaaacaacaacaacaaccccccccaaaacaaacaaaaaaggaucaaggaaccccaccauccugccuaaccuauaggugacugguuagcuuauggccagaaguggcagucacuaauaucccuggacugugacaucauguuggcagccccggccugaggacucaccuggacauugaagcguucauggcgagggcaggguaaggaugccggaaaccacccggagggagagaguacaugggcugcccuugccugugaggggggaggagggaggaagaugaucuggucagccaagucggagggggcuggagaggaugcuaagaaacgggcgggaagacagaggaguugggagcaagcuguccaaggcgggagugaggaugucuaaaucccgaguccagaagggcagagcucaguggagggaggaaggaggguaagaaaggcuuugggguuuccuuacugugggacgagccagccgaggggaugggggauuuguccgacagcuccuggagacaguggguaauacggugacagcucagauggaugagggggccgggggauuccugcuuccaaagagagauacgucaaaugcuucccucacccagccuucguaaccugcguaacaucccauaggagcugccguggaaagcccuugucucucagcaucucugccccuuucaccuucuaguagcccugggcagucaacucaagggcauccaagggagagaggacccagauacagucucucuaguuacccagaagccaucucugcggauguaacuuucuuuuguugacugcacagggauucauacaaggcccaggaaauacccaacagagagcaaauauuacuccaaguccucacuuauugagcuuucuagacaaccagccucauucucaguacaauaaccuuucucugccaacaaaccacccugccucuaaacucuggguuuuuauucgacggucaucucgcccuacccccaaauaaucauuauuucuuuaaacaugggcucugaaaauucuuaguguuacagugacucaguaggaacguuaugaagaccuaggcuuccagguacggacagguguggugggcaguuaauuaucaccuuccacacauuaaagccagcuccgcccccauuguuuuaaaagccauuuugacgucuguccagaaggcucuauuggaaauaugugguguagugggcacacguucugguuauagaggcccaaccucagaugacuaaacaacccuugcauuuacaaugguuccaggcucuauacuuaacccccgaccccauagagccccaccaccgcucuuugggagcccagcuugucacaggggccacucaccugucuuugggucgaucucuggggacagaugcgugggaggggacgcaggggagaaguggucguugcuguaggugaugagaggugucagcgggugcaugugaugagggugcugaacaacaggaacuuuguuggacugcaagagagagaggagauggacuaggcacaguggcaggaagacgguguguccagccagcugccacucaccgguggcuccuuucaguguaacacccuuuccagcccucacaacuggccuagagggaaggaaacgagaagaggaugagagagggccucgaacucccaccccggucucuaacucccacacagccccccuuuauggguacagcggggcgcuugugggcugugccguucugacaggagcucucggguuuauguaaccacguucugacuuuacugacgagaagcccuuugaccucucugucacuuccugcugccccucuuuucauccgauaugcauaccacaaacucuggucugcucaguuccuggggcuuccuggguuuccaagucuuauagcagguaaagugggcagagcagggaugagagcaggaaagcccauccugaucaugaggugugcugcuggccuugguggugcaaaaaggccucaaaccgaguagcuuccuaguuaguccucuguacuuguuagcuguagcagcauaaggugaaacuuaaauacugccuucacauuuucaaagauuuauuuauuuuauguaugugaguacacuguagcuguacagaugguugugagccuucauuugguugcugggaauugaauuuucaggaccucugcucacucuggucaaccccguucgcucggguuggcccugcucgcucagucccugcuugcuugggcccaaaguacacuguagcugacuucagacgcaacagaagagggcgucagaucucauuacgggugguugugagccaccaugugguugcugggauuugaacucaggaccuuuggaagagcagucagugaucuuacccaccagcccauucacuuuuuuggagaauuuuuuuuuuuuuuuuuuaguuuucuagagacaggguuucucuguguaguccuugcuguccuggaacucacucuguagguucucaaacucggagauucgccugccucugucucccaagugcugggacugaaggcgugugucaccuacaccuggcugcuuucacuguauuuccuggccaucacaaugaugaauauacagcacaagaaagaacaugugcaauaacuagcucugacaucagauuucuaggaaccaagugaguguauccaaaugaugaaccuggguuuauaggggccagccugucaaaggguaauuuucggcacuauaaacguaauagggcuauugaauuacagagaauguucagugggucaagguggaugccugauaaccugccaucucuuucuagaucccucaggguagauccucugaccuccacaagaacaccauggcuaaaggaugcccacccacauacacacaaagaaauauaaugaauaaaaauagagagaauugcacaaaccaugauacaauucauaaacaaugauucuaaaacugauugcuacauaaucacacagcuaagccagccccugccaacaacgccccaugucauuuauuuaucuuugacaacaucgcauuauauaguccaggcuaguuucgaacccaugaucauccacuccagccuucacgcuucaguuuuuaauuuauauuuauuuguaucauuuuugucauuuuauagugagaacucuuaggcuggaauauguagcacaguuguuuagcauccuugaagccccacguuugaucuccagcucuguguaaacugggugugguagcauaaaccgguaacgcagacacuugcacucaggaaguaaaaagaucagaggucaaaggucacucuuuguuacauaguaaguuaaaagccagccuggaccaacccccuuccauaaauaaacuaaaaaguuucaguugccugcuuacccuucagucaaagaacacauaaagggaguucaauuugcaaaucuagguauaaaucuaaaugaccugcggguuauaauuuuguaccacuagggggcaucauuguccagaaaaugguccgcgaggggcuggacaggaaguguugcugagcaagaguuguccuagaggcuggccuguccucuuaggaggcuaccucccacucuguccucacccacuucucucuccagcuguccccaggagcuugaugagcacggcaaaggcugaggcuaccgucaggaaugcagagccucaaguggacaaccucaguacaagacguaggagccacacgggcuugcucagcaaggaaugccauccgaaacagagccaaguccuuccagcaaugccccauccgaaacagccaaauccuuccagcaagcuacauaggucgagcaccuucucagcccagguaucuugacaacuccucucccugauccauuuuaaaguuuuguguguauguguguacacagauggagaccugaggagggucuccuugaucuccuuuugacuuacugaggucucuugcugaacccagagcuuguugaucuuggcucaacuccuugcccugucuuuauaaucugcuaaauccaugcgaggcugccacagcugccuggguuuuauguguucugagcaucccaguuccuucugguccccacacuuuaucugcugagccaucuccuuuggcccgcagcuucaccuugcugaggcaggcuguguaacuuagucugcucgaugaccaccacagccugcuucagucuuuucccuuuugaagcucuucaaacucacagcucuuaagaaagcaaagggguccccagggcauauuuuaagcccaaaguaaaaccaaccccuaagggcucgccauggaaaacuguccaccagaggagucccccucccucuuguuguccuucuucuuuuauagauuuauuuauuugcuuauuucauguauaggauugcucagguguucaugcacaccagaagagggaaucagauuccauuaugcaugguugugagccaccuuguggcugcugugaauucaacucagaagagcagccagccucuuaacugcagagccaucucucccuuaaccugaucagaaaccagcugcaugggauugaucgcucaggagaguagacccuucccuucugcugucaaucacgauggaguccuggacuugacaauggcugcccaggaaaucacccaacauuucaguagacaacuaacaacgcuauucagaauaugaguuuugucaaucauccaugaccccuuagcugauagagaagggcagggcucccggggagaauggacacugaaaauguuugcagugacaucaguuucuuugaaacaucccaaaguccauggggagggagcagguccaguagaggucguuccuucagacacacuguggguggugucugccagagcuggucaacuguggggcugguaggggaucccggaggacugagacuccacagcagcacccugccacccuccgacucugccaccugccccggagcagcuaagccaggggucccuccauucuucugucacccgacccagguaaauagaagaaaguaucagcuuugccacaucuccugacucuuaaccucagguugguugcaggaauauccccaagcuccucguguauuuccuaaguguguuccuaaggucugaacggcgacuuagcugggcuccgcuaacugagauguguuacaagaggaaggaccaacaaauaagcaaugugucaaccagaauauagucccaagguccaauucucuugcagcagaucucacauuccacauggcaagaacucauuuccgguuuguuugcuuguuuacuuggguuuucgagacaggguuacucugugcagacccggcuguaugggaacuuacuuuguagaccaggcuggcuucaaagucauaagcccucuugccucugccucucaaaugcugggauuagaguugugcagcaucucaaugggcuagacauuccuaauuuuaaaacauuuaaauguguguguguguguguguucgugcaugcugaugaugucacggugugcuuguggagaucaggcgacaaucugugagaauggguucucuccuucuaucaugugggauucagggcuagacucucagaucuucaggcuuacagguaagcaccuuuaaccacagagcaauuuuacugugcucaaugcaaagauuuuaagaguaaauguauucaugagagugagcaggcccuacugaccaccaccagcccagaucugcuuuuguuugguuuuuguuuuaucuugguaauuuucuggcuuaaaguuuuauggcagagagcaacguucuuugcauccacccuaucacaaacagcuaaagaacucuuccuuaagucaauuccuuagaugauggucuccuuuuuaauuaugcauauuugccuccccccucccucccuccccuucucccuucucccucuccuguccuguccuguucuguccucuccucuccgguaucuaccugucucuaccucccuaguccuggaacuaaaggcugggauaaagccacugugccuggcuuuauuuuucuuuuauaauuuuuuuuauauuuauugacuuuauguguaucaggguuugccugugcguaugaauauguacuauguguaagccuacuuaaguuugauacccacagaggucagaagagggcauuggauuuccuggaacugggguuagggugguuguaagccagcaggcgcugugauccugugcaagagcagcgagugcuuuugacugcuaugcuagcccuugucuccagcccuggucccuuccuugaguggccucuucaugagaacuugacauacaaugucagaagcuacucugcucugcugucucuuacuuuccccagaugccaacuucuggauucuucaccgauuucugguccccuauuucuaauuacgcccaagucuaucuuaaauuuagcagaaaaauauucuggaaggagccagcuggcacagauaguaagggugaaagauuuauaugcaacaagagccaggcaaagaagaaguuaauuaaaauuuggacaagagggacuugcgagauggcucagcugguaagguuuaagucaccaagcaugacaacaugaguuuaaucacaggaauucacaagguggaagaacaaaaugacugcuaaaagguauccuccaccaacacaccaccaggugugugcugcuccuuggcccccaauaaccaggccaggcgugauggcacacaccuuuaaucccagcauuugggaggcagaggcagaggcagguggaucucugaguucgaggccagccuggucuacagagugagucucaggacagccagggcuacacagagaaacccugucuuacaaaauaagaggauuuacauagugacugaaggcagagcaaguuaggcacgcagugagaggaggggcgauccuggcacaggaacacuaguguagaugcuaggcgguacaccuagggcacuaacagaggccauguacugagcaagauaaggaggcagugaggccucgcacaggagcagaacacugggaacggccuggguuucagcucuggugccucgggcacaaacacuccaacuaagcuugguuugauggcacacacccgcuucccgaaggauugagaagcugaaguuagggcagugagcuagcucagcaggcaaggcuucugagucugauggccugauucugacuccuaggacacacaugauggaaagaacugacuuccaugagucacacacacacacacacacacacacacacacacacacacacacacagagguaaaaguaauuuuaaaaaauuaaaaagaaaugucugggcagugguggcgcaugccuuuaaucccagcauuuuggaggcagaggcaggcagauuucugaguucgggccagccuggucuacaaagugaguuccaggacagccagagcuauacagaaaaaccuugucuugaaaaaacucaaaaaaaaaaaaaaaaaaggcugggcagugguggcacaugccuuuaaucccagcauuugggaggcagaggcaggcggauuucugaguuuagggccagccuggucuacagaguggguuucaggacagcagccagggcuauacagagaaacccugucucaaaaacaaacaaacaaacaaacaaacaaacaaccaaaccaaaacaacaacaacaaaaccaaaccaagcaaaaaaccaacaacgaaaaagaaacgaaguugagaccaaucuaaguuauagaaugagaccaugucuuuaagucacagcacaaggccagaauccaaaaugaaacguuccaacccuuaagacagcaaggaccaugcugcaggccaguaaagauguaaagauaaaggcaaggaccugcaggccagggagagaggaugcucugggauuggaaugugcccguggguccuugugugcaaugguccuugugugcaaugguccuugugugcaauggucugucuugaaagcuuugcagguugggccuugacuauaauucuuuagcuaacuccuuccugaucagaggucucaccucccguucucguuaguagggauaccacggggaaccgagggguacuuuaucuuuuugcaguugguacuacuauuccuuccuguguguccagacuggcuucaaacucuuagcacuccucccuggugacaggccucccucagugacccaguccugggagaacauuuaaaaccccugcaauccaaauuguuguuagaauuucaccaaggucaacagaaccgagaguuguuucuugauuaccgagcucaacaucuucgcuucaaguccacuuuagcuggcaugauagaucucagggcuacagagcgagauccuaucucaaaaccaaucaacgacaacaaaaccacaccagcaugguacaccauggcauggaugugggggucagaagacaauuugcauaaguaaauuccguccuuucaccauauggguccugaggacagaaucaggccaccagacuuagugacaagugagguaaaggcccucaccaccaguuuguguaacuguguuaucaauggcacaaauuugcuuugcugcauugucgauucuaucucuguggaggccggagagugggagguguacgaauuucagagaaacuaaaggacaaucacagaaagaaacagaacgaggcuucucaaccuguggguagugaccccucugggagucaaaaauagcuuuucacucgguagccaagggccaucggaaaccacagguguuugcguaaugauucauaacuguagcaaaauuacaguuaugaagcagcaaugaaaauaauuuuacgguuggugguugcagcauuaguaagguaagguugagaaccaccagucgaaggagugaugcaggccuugcccucucgucuugacugccuucucaacccaguggguaaauacucguugagaaagcaucugcacgccuuccaauccucuccccagaaagcacucacuaaggacccaggggcaaacagcagcacuaacauacaauggaaacaccuggcaucagcuaaucccaaagccaacaucucuaacaugggcguguugacacagugggucugcuccugauaggaugaggacaccuaaagcugggcuagcucgugugacguccugggcucccuccugcccacugacuaagcugagccugguggcccaggcguguaaucccagcacucgaggaaggagggucagaaguucauggcaguccaagagaacgaaccaagucugaggccagcccgagcucugugaggucauuuacucaacaaaacaagaacaacagaaaagcccaagaaggaaauggcuggcuuuaugugagagucagggaaaggcaagcugggcugaggcccugggcugacggaagcugaagucacaccaauaaagccuagaggaguggugcagacggaagacacaaccagcacagccguuauuaccgugggcuagagagcugugugaaacgcuaaucuuucuuuccuuuugcuuguguguuauaagcacauggccaugcaugcauugaggacagaggaggacgcaggguguccuaacccauccaucacauuccaccuuacucccacuuauucucacugaagccugagcuaggcuguaaccugggguuacaggaacaugagcgugggcacauccuucugucuuuuuaaugugggggcuggggauuugaacucagguccuccaguuaacacuauacacacucuuaccuacugaaucaacuaucuccccaggcccuacucucucucucucucucuuucuccuucccucccucccucccucccucccucccuccuuccuuccuuccuuccuuccuuccuuccuuccuuccuuccuuccuugauaucucuauuuugguuaccuaggcaaacauuucuguuccuaagaaaccuacaguguucaggucacauuuccaacuaucaggaauggaaaaaagaagaagaacauaaggagggagagagggaaaaccacaggagcuggcuagauuuguagaucuggauaaaaaguaugugggaguuucagguaagaaaguuugaaacuauauucaaauaaaaauuaacauuaaguaaaaaguauagucagugugggagaacaaaugggaggaaccacagacuuaugaauugcagagacuucagagucuacacagguguccugaugagauggagaaauaacacaaauuucauuuauucacuuuuaauuuauuuauaaauaggacuucauauggccauguauaaauuuccucuauagauagauagauugcagagagacaggcagccagagagggccuuacauagcccaggcuguccuuggacucacuauguagauaagaaugaccuuaaacucuucuuggccauccucccccuacgcucuaagugcuaggauuacagacguggaccaccauaugccccugcaauguacaauacuaagggaaaccccagccagugauucggagagcguucacgugcuaagcaaccugaggcuucucugcuuggggcgggggcagcgagacggucguccuuagaaggagagcauccaggcucugauucagccacccaugcuuuggccagaagcucuucaauaugcuucugagagugagccaguggauaauaacaaaauagggcauucgcuauuacaauauuaguguaaguggcugcgggcugcaggcuuggguuuuuguuuuuuuguuuuuuuaacucaugaaccucccccccucccccgccaugcuccagccaagucuugcucuuuuaaaaauguuauuacaguuuuauuuauugacuuuuuugugaguguguguauguguguggaagccagaggccagcuuguaggagucuguucuguucccuccgccaugugggucgucagucaggcuugguggccagcaccuuuacuaacugaauaugcacagggcccugaguucaauccucagagccccuaaaccaacuaugguggugagugccuguaaagacagacagacagacagacagacagacagacagacagacagacacacacacacacacacacaccagugguacauuauguagcaacacauacaugccagcuaucgucccuuaugcucuuuggcacuuucucaagugacauagugaaaugaacauaauacuuuuauuuuuuguaguugcuucuuucuguuuuugaauacuugcuauguagcccagguuggccugaacuucuaagucucagccuccgccuuccaaguacuaggauuacaggcauaugcccacacaccugacucaugcaucacaguuaucauuucugaaugagaagagggaaauggcucucgaguaaggagauguauauaagggcuauccaucuuucucagagaccauuccccacuccugcucacuuaacaaauucuccuugugcauauggaagaugaaauacuugugaacaacgacaauacacugccccccauccuucuccgcgcugcaggaagagacuggugaaagauaggguagggcauggucaguguggggggucaguguaauugucccuaagcacugagaguucggugcucaaacaccacaguuagcugcacaggggacuagagagaggguuaagagcacaggcugcuuuugcaggaaaccuggguucaguucccaguauccagagggcgacucacaaccaucuguaacucaaguuguacacccgugguccucaaccuuccuaacaccgugacccuuuaauacaguucuuuaugcugugcugacccccaaccauaaaauuauuuucauugcuacuuuauagcuauuauuuugcuacuguugugaauuauaauguaaauauccauuuucugauggucuuaggugaccccuauauaaagguuguucgaccccaagggguugcgaaccacuguuccaggggcucgaugcccucuucugguuuccuugggcaucagacaugaacauggugcagucagucaggcaagcacucaugcacauaaaauaaagucuuucuaacaaagcagaacaggaaaaccaaauaguaacaggcgauuuuuuuuucuaucuuucacccccagcuuacuuuagagguguaaauggaaagaauacuaaccgccagcccugcccccaugacacuggguugcgacucacugaagacuccagccacaugacucaccaaaucucugcaaguacgaacccuauuuucuucauuggcccuacucccugggcaaagcuucuucaaauaguuuacuucugaucuaagcuaaguuuucauaaucuaguguuuuuauuucucuaauaaaaaaagaaaaggaaaggaaaggagaggagaggaggggagagaaaagaaaagaaaaggaaagaaaagaaaaggagaggagaggagaggagaggagagaaaaggaaaggaaaggaaaggaaaggaaaggaaaggaaaggaaaggaaaggaaaggaaagaaaagaaaagaaaagaaaagaaaagaaaagaaaagaaaagaaaagaaaagaagagaaaagaaaaaccaacgccccugcuucugugaucuuguccuaagaaacuucagguccagcucacgcccucuggcuuggacaaggagucagguuccgugauuagggagguagggagcaccucucuccccagcuucaugucuuugauuugcaauuacgggaaugauucucaacucuggcugccccuuaaagucgccguggggagcuuaaaaaaaauuaagauaccagccccaccccagcccaauuaaaucauauccuugggggauuaagauguuaaauucuaugggcucauuaucucuauuaccuucgcaaucuguccacuuguuuuggcaccuaauucgggcccucauuaccucuuaguucugcuaauuaaacuugauguuaauuguucauucccucucuuaauuucuuaacaaugacgaccgcagcagcagugguggcgaugagggugaaguguggugacguuuggaaagcuaacccuuagugaagaguuacuuuguguugggcacaaugcugaacucauuacagcacaccagcucauuucugcacaacucuaugaugucagugcuccucuaauccccauuuaauagaugaggaaacugaggcagagagaugacguaauuugcccaaagcuuugagaagagagggaagcaaagccgggaucagaaccugcagguuuccacggcaaccaugaccagcacaucucaaggcagcgcccuccucucuguucuugggaguuuggauaagcugcuguacucuagguugguauuauuuccccuugggcguuauugaaauucuuuauuuuauuuuauuuuauuuggauuuucaagacaggguuucucuguguagcccuggcuguccuggaacucacucuguagaccaggcuggccucgaacucagaaauccgccugccucugccucccaagugcugggauuaaaggugugugccaccacugcccagcgaaauucuuuuuaaacauuggggauuuaauguuugcuuucuauuuaauuuaauauuuuuaaagauuuauuuauuauauuuaugugaguauacuguagcuguuuuuagacacaccagaagagggcaucagauucuauuacagaugguugugagccaccauguaguugcugggaauugaacucaggaccuuuggaagagccgucugugcucuuaauugcugagccaucucucaagcccuuaacuuaauuuuuuaaaaaauacagguucuccuuauguagcccuggcuugccuggaacuuguuauguagaccaggcuggccuaaaauuuacagagaccugccuguuuaugcccuacccauucagguuuuaaaaaauuauauauauauguguguguguguguguguguguguguguauauauauauauauauauauauauuuauauauauauauauauauuuauauauacauacauacauauauauaugaaauauucugugugcgugcguguguguguguguguguguguguguguguaccacagucugguuguggagguuggagggugacuugcaggggucagugcucucuaucaaguaggcccuagggauuauacucaagucacaggcauggaagcaagcaccuucaucugcagagucaccucccggccuguuuauguucugcaguauuagaacagaguaugaugauguggaguccacuggaacaucaccugcuucacuaucuauaaagcaacgugugccaucgguucuugcuuuucuguacucggacaacaugaggccucuguuuucccgcugugcugggaucugguauccagaucacucaucugcauucuucugucucauccacucaucggcaaugucuagaugaucggcagcugcgacugccagaggcuucuugagagguuagggauuucauauacuuuucuguuaccccgagaaagcccugaacagccgguuuacgugaggaaaaaggccaagagccaacaguguccuggagcgaaggagguaggagugcccaacacugucagcugcccccuagauggugccuagaaaucgaggagaugagugaguguggcaguuagagcugggcuaggcugcccuggguugguagggaaggagaugugacugggcguuaguggauguguagggugaugcucacagggagggugagacuuuagauuugagagggaaaugguguccucuaaaaggaacccaugaaaagauagccucuggacaggagagggggcagugagcucugacaucuugggguuuacugugggaggcucugggguaccacagaaugggugggggucagcagagaugguaggcagugaagaagauagcugaaucagggcuaaccauccuucccugggucugauucaagccacuagagggcgccuguaccucaugcuuacaugcaaauaggaccucggagauuagaaccacugccuugacacaaggauucaauaguguggugacaagauacagacccuaccagcaguacauugcaugucuugggacagccuacccuggguggcuggcucugcccccacaugguuauuccugucuaccuccuggcagagggcuguggcagucacccgagagccguacaugacaucauguuguagacgacgaauaagacuagggcucucucacucagagcugguccugugauugcuggaaacgacgaaaguucgucgcaccucuauuuauacucugaguguaucuccucccucacagcugcccuuuaaugagcaaggauuaucaguauaucuuaaaauguccugugugagaaaacaacaugccugggauuggcuguaaaguaagagaggcaggagaggaccaugaguggcggcaggcagcaggggaguuuguuuuguauaauguauucucccuccauagauuuuuaaauuugucucuaguaguuucaaagaucgccauggaacccuaaggcggugaggaagcccucauccccugucuauaaaauggacagguugagacaggugaagagauccucugugccucugagacucgcuagcaagauagucgucaccagauagccuggcaggcauccgcggagccuggcuuuacuuccuggaagacggaaugcgaggguuagauuccagccucaucuuuuauaugcauugugugccagugcugggucaugagaaggcaaggagcccugcugggacuccacugcuccuggcuccccuuuccuccaagacccaguguugccacagcugugcgugcggagcagccguuggccacauuuaaauggaugcuucccugaaacagcugguagagaggagcccccuuaacugcagucuuccagcuccagggagaagaggaggguuucugaaugaaccaacuggacagaaaggaccucuuguucauaggaaguggggaaggauuugaagcagguggccaggaagaaccgggguuaauggucagggccaugugccuucaaucaagccuuccagguggugugugcuuuugugcugagguggacggaaaggugaggaggcugucuaagacagaaccuuugguaaccccuaacugugcccacaccgggugugaggguuaaucuucauugucaaucugccugaauuuacaaucaccauggaaacacccuccaggugugucugucuguaagaguguugccauaaagauuuaacugaggagggggagacucacccugaaugugggaggcaccauccaacgggcaggauccccauacugaacaaaaaggaaaaaaugagcugagcaccagcauccgucacucucugcuuccugacaguggcuuuaccagccgccucacacuccugccaccgggacuuccccaccagauagccggucccaccaaaccgugagccaaaaccaacccuuccuccguuaaggcagauauuuuagcacagccgugagaaaagcgagacaccaaggagacagacucaggaagcuucuggaauggggaaaggagucacagacagggcccaggaagcuaaggcagacucaccaagugugcuggagauggcgaccuuguguccuugacuguagcacuggaggggacaucgaggaggggccauuucaucuguagguacugcaugggggacagaaaacacgaagcggugagaugaacucucuugggcucucagggaggucaccagcuguaagcccacagacccuacagggucagucaccuccacugccacaugguucuaauauggcccagcauacauuuauagcuacuccacgaccgccauucaucaucauggcuggggccaagacauuaaacagcucagguaaaguaguaaguggggaggaaauggauacacucccacgugaccaucuucuccaaagaacccgucauggggcucaagucuucuuuagccccccuguguagcaaggcagauuaucagagaacagauucccaagucuggucugccuuccucuguuaaggcagauauuuuaacacagcacgagaaaaguaaggcaccaaggagacagugccaucaccaauggcacuccccaagaaauguacuugugggaguggaaacaaauggguaaagcaugggacagggcaaggcauagguccaggagguggaguacucagcuaucguaaacgaagcccuauauguaacccucaacuccaaauacgugggugguggugguggccugccugaaauccuagcuuuuguggguagaaguaggaggaucagaaguucaaggucacccucugcuacuuaacaaguuugaggccagucuagaauauauaugaggucugucuaaaaacaaacaaacaaacaaacaaacaaacaaacaacagcaaaacuccuaccugccccacaaucaagugucauaaguaauuaucaucuuccuuucuuuauuugagauagggucuuguuacacagucuugguuggccuggaauuuauuauuuagaccaagcgggccuugaauucucagcguucuuguugcuacuaaaccuggaguacuccgacuauaggugugugcuaccacacccagcaucuguucacagugauggauggugaccuugcuuucauuaguguccuucaaccuuggaacaaucacccagcaccccgucuccugccaugcaucacuggaggggagaaaaagggauucuuuccauacccgugugcauacaacucacgcacgcaugcucuuagagaacaacauuuccuuaacucgggaauggcacucacugucugacaggagggagccuaggggaagcgguggacccugggcuuagaguacagccacagguacagaucuuacucaacccagggagguugugacccaagacaaaugacuuaacaauuuggagucuguuuuaucaccuguggggcaagcuauuaugacuaacuuuacagguuguuagcaggaaccggaccacgucaggcacugaacacugucuuacacaugggagauauuugauaaauggcagcucuuauguucauaagcaaaccauuagucuuugccaggagcaaaagcaagcauguuguccuagagucaacauugacagggugcuucugggcagccgaccagcgaagcagcgugugcaggagucuugaggcugcuuugagaacuacauacaauucuuugagaaguggaggcucgggacgacuuucagagacauaaggaagccuuugaaucauccuuggauuucacaguggguguggggguggaacuggcagaagagcagcgugggcaggacaggggcggaguuuuuaggaagguauucacaaggcuuauggguauagcucgggugggcagagugcuuuuccagcaugcauugaggcacuggguuugauccauaaacugaagguaauaaugcacgccuguauucccaccucaccucaggggagguagaggcagaaggaccagauggucagagucaucccccugaugcauagaauguaugggaccaauccuggcuacacguaaucuugucuggaaaaaaaaaaugggguagggagauggcucaggagguaaaggcaucgaggaauccugaagcccacauaaaaauugggauuugagaguauggaucuauaaauuccaggagucucacugugaggcaggagacagaauuggcugugguacucaaugcagcagcagagacacgaaagaucuugccucaacaaguggaagaugagaaccgacagcccaucaugccccucgccagacccuugccagaguaccagccuccagcaccuccuuuguuuugauguucuccuaugguggugacuugcaacugaguaacacugucuagaauuaacauccaugucucauggugguggccuacaccuuuaauccagcuaccuuggaccuuguuuaaggaaaaaaaaaaaaguaagugaaguaaaaguaaaauacaaaagcaaaccauccagccgugguggcacacaccuuuagucccagcacucgggaggcagaggcaggcggaguucugaguucgaggccagccuggucuacaaagugaguucuaggacagccagggcuauacagagaaacccucucuugaaaacaaaacaaaacaaaaacaaaauaaaaaaacaaacaaaagcaaaacaaaguggggugaugguagcgcauguaacugucccaguaaucgugaggcagaggcagguggaucucugaguuugaggccagucuggucuacagaucaaguuccaggacagccagggcuacagagaaaccuugucuuaaaacaacaacaacaacaacaacaacaacaacaacaaaacaaaacagaaaagcauuagucuccgugaaauccaucugauguugaagggaaaugucuuagauuauaucacccaacaacagacacgucucuaaacccaucagcucuauucugaucugguuuuccuuugugucauaaaaacauaugugcuuauuggucgucccagaaagaucuuuagaugguaucagggugggccaaaacuaucugaauuuugguuuggaacaauguuuggggucuuaaacauggccuuuuucuuaaacaacacguugauggcuucuauccaucaaaugccagcagccucccagucucucuuggcaauuagaaaugucucaaagucagggaugaagagaugucugagccauaagaacaugugcugcaugcucuugcagaagacccagguuugguucccagcaacaauguggcagcguaaaacugagcuuaaaacugcagaucuaagggaucugaugcccuccccugcccuuaacaggcacugcacaaacacaucuaauaagaugccugccuugggcuuccaguaacagagagagaccuuucugccucagugccgcacacaggggucacaggcaugcaccagcgugcucaggucccauacuaauuauaacugagaucgggaagcuaacagucuuuaagccccgcccaccacugaagucuggcuuuuuucugauacaucugagagcaaguggauguggauaguuguccugucacucuggucccaucuggcucuauccacuccuggaggccugaggaauccguuuggaagguagaacuauguuagcgacuuuugucccuugugugugguguacauuugucuguaggcauguucaugugugugggugcacauguguauggauaugcaugcauucaugccuagcacuuucugccuuguucucucucucucucucucucucucucuuucucucucuguuuuuucaagacaggguuucucugcguagcccuggcuguccuggaacucacucuguagaccaggcuacagauuuuugaacucagaaauccuccugccucugcuucccaagugcugugauuaaaggcaugcgccaccaugcccggccccugccuugcucucuuaauacugggugucuaugauugcuuuuuaccuucucuauugagguagggucccacagcugaaucccacccagagcuuacugaaucccaccucugccuccuaaacacugggauuagaacugggccaccagaugggcaugguguuuauguggacgccagggaucugaacucugguacucacacuccugugacaaguguuuuaaccacugagccauguccccagccuccuuuuuaaaaaagauuuuugaagagacuuguggaguggaugucagaacuuuaagacucccugaaucacuuacaaagcucuggauuacagcauaagcaguggggaauucuaagugcuuugcgggaccacgaacuagggcagucggagguaucagugccaggagcaugcaggcaucugcaguucugaaugccuaggucacgccaguggaaagaaacugcuuuuccaaaaagauuuauuuauuuauuuucaguauuaauucggucucuguguguuguguacauguguguggguauccacacaggucagugaguuggaucucuuugggcuacaauugccuacgguuguguaagccaugaacuauggguguugaaacuaaacucgaguccucugcaagaacaguacccacucuuuaaacacugcaacaucucuccagugccaagaaagcucuuuuuggcagugguucccaugagaggccggccgcacaauuauccuggaggucacugcacauggguggagcaugucuguggggauuaggcugagcuaagacucugggcacaauaaugguguguggacaaauuaaaacagguuucgccaagccuuaucuaagcucuguugaacaggcugcgggaggcucaaacuucugaccagcacaucacagccgggcaucagcgcagccgaugugcucacagccugguccagcuaccccgcucuccugggaugaccacugaagaggcaaagcucccuuugucuucaaaguaucaauacaacucuuggagcuucuaugaccaaaggaccccucaggauucagagacagaauagugccaugccaccaaucuucaauauacugcgucaaaaugcuacagucucuugcgacacauacuaugggcugauagacaguuccaauuuucacagaaccuuggaaaauggcuuacccuucugccauucugguuuauaguuaaguacagugaagcuaagguuuaagauguaucuuuuuguugggggccaucaaguuggucaguagguaacggaccuugccaccaagccugacaaguagaguuugauuccugaggccuacaugguggaaggagagaacagacaccuggagccuggaaguuguccucugaccuccacacaugugcuguugugccaaucacuaccccucuagauaaaugaaauaaaugcaauaaaaaucgcucguuuaaaugugugcaugugugacuagguguggugcauacaugugugugugugucccguccuauuauccucugucuuggucucuugagucagguuuacuacaccggaguuagacugguaaccagcaagccccagggguccugcggccucugcccaccacagcacucaggucacagaggcacguguggcuacacccaacuuaacuucuaauaguuauuauuuuauacaugugugugcauguauguaugucaccuguggaggcaagaggugaccuuuguggaguugguucccuucuuccaccuuucuguggguucugggguuagcuccucagguuagagaauuccucuaugugcugagccaucucuccagccuccgggguuucuuuguuuccugguuguugcuaaugugggugcuggggauuugaacucagaucuucaggauuguguagaaagcacucuucccuacgagccacuuccccagcccuaguauucuaguucgucuuguuagggaagggagauuuuaguccuaauuguucucaucggaacagccguugaaucucuuggcguccaccaaaaaaaaaaaaaaaaaaacaacaacaacaaaaaaaacauggccauguggccucuccuauuagacucauucaugagaugcaugcguagcgauugauuuucuucucagcaaguguuuuugcauucccugggugagcucuacugggcuacccuggugugccauuucuuguacuuuacugugguaugcugaucagagcgccaccuuuucuauguaaggcguaugaaagauguuuucuuuugggcgacauuucucacaaguguugcuuuggacgcuacuuuggcuuuauuagaggaguacgguaccucuuuuccuuaaaguucugcaaucucucuuugguucucagcccuucccagagucccccuagggcuaagugcucggccaggugggcugcuuccgcucgcucgccucgggccuggggaagggucccuccgaaggaugcucccuagggguuagaacccgcuuuccugcagcggggcggagaccuguccuacacaauccucacucugcuccgggagacccagcagcagauuaauugcagcugugcccuggaauuuccccaacacacaaaucuuccugauguaaaacagcugggaggaaaucccagcaugcccugggcagaggcagagcugccaaugagcuauagagauuaacccucagacucccggagagcagugagggccccugcuccagagaggcccacauugucucaccccacuccgugugcacgggacccccuggcgugcccacagacucugaaugcucgacaaggaaacccuuucugcaggaccugagcaccagagaaaaaucacggcuucuugucacagaaugcaccaggacaaggcucccaaaugagcuuacucaaguguggggcucggaaaaccacuccuucccccaaaguccagcucccggaagcccuccacuucuuccauggacacuggcaaaggacagaguccuuugcaccuuuucaggcuaggaaagcaacccucccccucugguccccacuggugaacagugacucgccugaccucaagcuaggacuccuuugaauaaaguccaaggauuccuacgccuuacucaaaagaugcuacaacugcugucaccaagagacaagaccaagguaacaaacaccccucaugcccccaccccuggagggcuucaaauacagugagacauugcccucucaaaggacucggucucucuuuguaacccagguuugucuccaacucccagucacaccccuugcucagucuccugagugcugguauuguuauaacagguaugcucuaccacacccagcccugcccucucucugucucuugugugugagcaugcguucaucaaggccaguggccaaccuuggccaacugcuccugaaggagcaguccaccuugauuuuugcgauggggguucucaccgagacugaagcugguuuauugggcaaggguguugaccucgaaccccagagaucgcuggucuucccccgugauuaaagcacgagccacauggcuuagcuuuuauguggguguggagucggguccucgugucugcaugguaaaugugguccucagugacccgucuccgcagccacuccucuucccacguuagcaacaacuaacguggaggcuggugagauggcucagcacauagaggaauuucaaaccucaggggcuggguuugauccccagaauccacggaaagguggaagaagggaaccaacuccacaauggucaccucuugccuccacaggggacaagcagacgguguggaacaauggaugcuuguccucuguggauaagcuaaguguuccucacugcacugcaccuguaccacugaaaaaacaccaguuagucacccuuuccuaagagccuaacugguuguauucagugauucagggauaaaaaaaaccaacaagccaggcccaccaauccucaggcuuccuuccuugcugucucccaacaccagcucacuuuaacuucuugcugggcuguagggucuuauuuuguucugcugguccgcauguuugcaucuucugcuugugagaaacuagcuuugcucagagcccagacucaaagcauucucacgauggaacgguuauugucuguauccuuuguccucuggccuccgcaggggucaugccuguuuaacuaugaugcccaugucuguaacacggaagggauuuauuugggcuuauaguuacagggguguuucaguucaccauggguggggaaggcaggucagaguucugagcagcaggcgguacagcuccuaacaucucccagaggaaggacucggaguacugccuggaacaagaggugcguuuacccuacaaugcccccugcagcgaugagucuacuagguagacaccucgucuuaaacauuucucauucucuccaaacagcaucaccagcuggagcccaaguguucaaacauagucuguagggggacuuuccacauucaacccaugacagcaaucaccaaguacugaaauccuaacccacuuuguucugacaaaugugguaggcccacuucuauaaugggguuggccagucuaucacaguacccuuuggacauaugguccauauggaagggagccuguuucauuuucuucucuuuuuuugaggcagugucuauguuucccaaaugcuggcauuaaaagugugcaccaccauuguccaauuuauucaacuugagugacuggacuuuacugaauaacuccuuuaguacugcgaggauucagaggaacagcacagaguaugugugcccaacucugcugauuccuagaagucuguuuaagacccuauaucuaguaagggauggugacucacaccuguaauuccagcaccuggagccugaaucaaucaguaaggucaccucucccccaccacauggggugggggagcaugguccccuaucucccccagaaacacacauagaucacucuaugucuauaaaugcaccagcucucugggagcuggagagaugccucagugguuaaaagcacccgucuucugcagaggacgcaucuucagguccuggcacccacaagguggcacacaaccaucuguaaauccaguuccuacccccucucugaugucugaggacucacguacauaccuaauacacauaacacagaauaaauauuuuaaagaagaaaauacaggcuagagagauggcucagagguuaagagaacugacugcuuuuccugagguccugaguucaguucuuaaaaaccaucuguaaugagaucuggcgcccucuucuggccuucaggcauacaugcaggcagaacgcuagauacauaauaaauguuuaaaaaagaggaaaauacaccaaccagucuuaguagcauaaagacaaaauaccuccccagauugggguagggguggggggaaacuacuuaaauuucugaaaucacuuuagagagcaaugaaagaaaaagaaaacauuuuauuuugacucuuacuugcgucccuaauuuucuuuauaaagcgaguggcucuaagcguuugcaucaaugcacuggacagcacuaaaucccaaacacaaccucuuuguuccaccucacugucgaugaaggccauguuccuuccugaggcugcuggauaggcgaauccuccgaaauaaauucaauuugcaaguccauagggaucuauaauaagcuacuucuggacuuaauacaauagauaauuuucuguggaaaaguucuuuuuaaaaaaaucauacuuugggggcuggagagaugguucagcagauagacagcguucugcuuuuccggaggacgugcgcucagauaucaccacacacuucaggcagcucacaaccaccuaaacuccaaugccagggcaucugacccuuacuccuggacacugggauggccggauggacagacaggcaggcaggcacacacacacacacacacacacacacacacaaacacacacacaggguagggaggaagagauacauauucaugcaugaauaaaacaugagucuuaaaaaaauaaacagauucuuuuacugcuuuaaaaccagcaacaacaaaaaggcuggauuguuguggcuggcacacgccuuuaaucccagcacuugggaggcagaggcagguggauuucugaguuccaggccagccuggacuauagagcaacaggacagcuagagcugcauacagaaacccugucuuuaaaaaccaaguucuuccccccccccccuuuucauucagaccaagguuuagccaacgaauauuuuggaagcucuggugcacacuccaccuugucccaagcgacuucuagcuguucguaucucuguuccaaagaauccgguuguuucuccuaccagaaguugagcuaagguuugauuuagaaagcuagcucuccaguggauccgcagagcaccagggucucgggcuccauccaacaucucuguucucagucaccucccauauaaaccaggggugcuuagcucuaucaaucuaaagacaaggccuggcccagaaggucuccuagaggaggaaaaacaagcacaaaaccaaagcagaugcagacguuccucuaaaaacaaaggccccaucaaggugcucagcaaagcaggugucccagcugacaccacuaacaaaggguggaucugggaggaaccuuauuucucgggaccuguccucaccgacagagaucaaccaccucgaugguguggcagucacaacagagaggaccaaguggcugcuggacacuuaagaaaauuaggaaguggauuugugagacggcccggcaguuaaaacuaucugccgccaagucccgaugacuuuagaucucaggaaucugccugguagagggauggaaaugacucccacaaguuguccuuugaccuccauguaccccucuccagugaauaaacauuuaaacauauauagauagauagaaagugacaucacuguuuucccucagcuacuaagaugcugaaguaggucaguugagccuagaggcuccagcacagccugugugacguagcaaguuccugucugaguggagaagggacugcacauggacucaucaauuuuaguuaucuuuauuuacgagcaaaaccagggcuagagugagccgaucuuggaagcucuaacagcucaaguguuuucugggggagacgucccacuuggugggugcucuaaucaaaacccuuacuacugcuuucuacgcaccagagucuguuguguagcauuugugguaucuguggugugaauagucccaccacaguugguuuugagguacuauggugagucacugugagaggugggaagagacacucacaguuggccugguaccaacuggcuggccacacaccacugaugcuaggcaggaguggaggggguggggguggggauuuuuagccuguccugacuuguuaggauuauuggcucuauuccuagauggcuggaaagcgguauaugcugugauugguggaugugggccugaggucagacuggagaccuggacaugcagccuugcacaucuuucuggcagcuccaugcuccuucucaaaggagcaggggaaacucuguccucugaacaccgggcauggacagccugauggcauagaccaugggaacacuuggcgcaaagcccuaggcuuaagaugaaaaggccagucgggugugguggcacacgguacggagggcacaaagaacucaaguucagaggcagaucgugagauccuguuucccaaaggaaugaauaacugaacccaccaaagccaaugcugagccugaucuuaugcccucacugaguagccugcaggucucuggguuaaacugccuucgccuggccuugaccuugggcugcuggaccugagcaauuucugcacucagugccugaucaugaaaagagauggagaaagugcacaugggccugaccccacucuugcccuauggcugacaccucucacaccagcucucccuguggcccacacuuggucacccucgcccacagcacaucuuuuucccaguugaggccagcugccucagcccucuggguguagagcccauguucuggcuccggcccuuaaccuucagcucuguucccucagcuucacuuauggcccuugccuuggucuccucaccacacaggagagaacuggguccauaucugcuucuuacccaguugccagguugaggcugacagcuaccugguguccaagaugucagaguaccacacuucacuucaggcucacaguuugugacaagucagcgcguucuugcuccuccucuguaaugaauauaccuggcuuccaugaacacucaucaccggcccuuguguggauacagggaucaugggacauguuucuagguguaaggggaaugaguaguucaguguaugaacauguagaccuauuuagagaacuuagcacuacucucggcaacguaggagagcgcuuacaucuccacacucccgucugcacagguuaguaaccauucugaccuuugcauugaacugguaucucagugaguaucucucuuggauaucuuuguuuuugcuuuugagacaagguuucuuuagguagcccuggcuguucugaaacuugcucugcccaccagguuggcuucaaacucauggagauccaauugucucucugccucccaagugcugggauuaaagggugugccaccacuguccauaagguucaugcaucacacaguagcaacaggaaacaaagcuauuaagguaaccucauauuaauaauuuucacccucacacacacaccuucagcuuacucagccggaaaugucaaguucugccuuagcaucucuugcugcuucccaugggcagcagcauucuccagauucuagacacuucugcaagugugccuucugccugcaccuggagaaccuugggguggcaaccugcuuguuuuguuuuuuguuuuuuguuuuuuucuuaaagguuucuuuuuaauuaugugcaugcacgcgagucugugugcagguaugugcccaugaauguggugccugcggaggucaaaagaggacacuggggcucugacuggggaguuacaggacagugcgaguggcccagcgugggcucugggagcuuaauucuucacacacagucacucucuuaacccacgggugcucucucucucucucucucucucucucucucucucucuuucuccucucccccccccccccccagcaggauuucauacugaccuuaaauuccugauccucuugccucugccucucagggauuacagacauguucuuacagacauguucuaucaggucuggcuuaugugaugcugaggauugaaccguggaggcaagcacucuacccacugagcuacacuucuaguuuaagcgacuugguuugaagggagcugguagaggggcugugaaaugcauuagcagcucccuuugccugagauggaccaaacgccacucccaaggaucagggugguggguaaagccggaaaggucccaaaugcucucuccaccgugucaccucugcugcagcccacauucgccagcccaucuuucacgucccauuagaaacaccuuccaaacuauacaacuaaauaacuggucccgcugaugguucaggagagagaaaccgcaaaauacgaaagcccggugaugacuuggauuugagcgacaaagcucaguagaagucugaugugaaucucuguaaugucaccacugagugauacaggagguggguaccgggccuucuuuucgcucucuagaagugucaacccaauccugcaguccuggaacuuuguccacagggcacagggacaguguaccucuuuccuugcccaugcuaggcauugcuaauauaucgucaaauucuuccuaguucugccuggugcgggcccagagcguucaacauaguauacgagguggcuucuaacagcggguaaaaaucaccgugagaugcucucauacauauuuucucugacucaggacugaugguagauaacagauauuccaucuggaaagaagccggggcaggauccaggcuccacaacccuuucucugacugguucaaucaggaacauucuuggaaggcaucaggggcucacagaaaaggccagugaacagcaaaauccaguccuaacuugcagagcccagugaccaaaagcaggucugggaauucugaaguuuauggauuuucccuugugggaagaggagcuggaaaaugucccagguauugaggagaaaggaaacagggucuguguaaaaucaauggggaacaggaagugcuuaucuggggccaguaaagcacacagcacaaaagaacagccaggcagcagagggcaggcugcaggcuccuagggcuucucagagcugucuccucaucccugacugcaaagccuguccaacgucagcagccccugggugccaagggcaucccuccauaggugagcagucccagcaaggguuuggaucccaugggugggaaaagacugugacuucuacacggagccaucgagucauguguuaaugaauggcuuucacgcuguuagggaagaacaacaugauucugcacucagccugaagggagaguacaggaaaugaggauggcuaagaaaugaacaccagugguggccauacuguaagucagacucucugcgugcauuauaucacagccuacaccacugccuucucauugcaugaaacgaacauucaucucagggaguaucugcaugcaguguuuauuauaauagguaccaaagugcugagcauggcuaaggauauggaguugaucuccaguacuguaauuagcuagcaaagcaaaacaucaaaauaauuacuauauauauauucacacauauuauucuaaaauuuuaguuugcuggacauuucacuuauaaugaaguuacacacacacacacacacacacacacacacacacacacacacacguuuaagagauaagguuuccauauucauauagucuaaccuggaacucacuauuagcccaggcuggccuuaaacuugaaauccuaucuucacuacccgagaccuggguuuauaguacagguaugcacccccacuucacccagcucccugaucuuuguuuuaaaggaaaccaucgaguaaauaguauaggugguggguagacaagauuauacaaauaagugacacuuggagccaggagcugcagcacgugcuugauaaggaaaaccuaaacccuugaaagaagcuccgcacagaaggccggugcacgcaguugcuucucccgaaagcccgagccgucguccccuugugcaugcuaggucaaagcagcagacgcccuccccuccacaggccuccucgcuuuuuaucgguuagcuagccaggaaguccuguccuuugguugcugaaccaucuuuuccacgucucgccuugaccuugagaugagugucgcguguuccugccucaguccuuccuagacuugcauuucuucucucuuccccucugagugucucgggaacaggaaacucaucugugcucuggucaccacagcacuugacauagcacauuguugugauaagugccuggugaccaggagggcauuucaggaauaccugaacgagaggcacaaguaccccuuccuggaaagguuuccaucagccuaggugaaacguauccagaagcaaucaguggcuacuccuguggcugucgcuggaguugggagaacugguggccucacaaucaauaggugacauaccagcugaguuaagacuccuuuaaagauuuacuaagggucuggguauggugggacacaccuuuaauuucagcauucuugcagaggcgaaaggggcuuucuaugaauuugaggcuaaccuggucuauauaguagcuucaagacuagcuccuguccccaaaacaaaaacaacaaacaaaaaacccaaaacaacaagcaucauuuauugagccagaaaccgcagugcauaccuuuagucccagaacuuggguaaagccaggaaacucgggaguuuaccgauacccugggcugccugggauauaggucagcuuuugccaagcacauguaaggcucugguucaaaccccagcaaucuacagcuaauagcgucauaaucuguuucuagguauuuuuacuucccuauauaguuuguauauugacuacaaauuauaaaugaauucgguuagcucuaugcagccaugggcuucauaucucagaauuuaguguuuguggguuuuaucaaccacaagauuucugaccuuggauuuaacuaagugcaaacuguaacacagucagaccuucagugauuguauguauacuaaacacgugucgcuuuccuuauuguuacuuaacuauuuacauagcaucccuguuaaguaauguaaucuagaaaugcuuuaaaguauaggggaggaugugccuagguuacauacaaacgccccauuauuaacuaauuguguguuugacuguagccauccgugugccauggugcguguguggagggugugaggcaggaucucgcuguguucuuccaguuaacuggccugcaagcuucuggcuuuuuucucccucccaucucaaggggaugcucugugauuauagauguccaggcugcugugucuggcuucuuuaugugggugcugggggguccguucucaggucaucugcuuguguggcaagcacuuuacccaccgaacccucugcccacuugagugcuguacuauuuuaaaucagggaucugggcauccaugaguuuuguuaucaacaggggaccugaaaccugcccuccccgcucugaaagagcaagggacaaauguauaucuaaucaucuguagcuggaggcucugaugcuggagcuguaccaggugaccugcuauggaucaccgcaugucuaaaauucacauucuaauauuaauaucauucuaggagagcaauaagcaugcaaaagcaaagggcaggagcaggagagauggcauaguaguuaagaguaguaguuacuuggcagagcugugguggugcaugccuuuaaccccagcacucaggaggcagagaccaguggaucucugaauucaaggucagccuggucuacagaaugagcuccaggucagccagggcuacacagagaaacucaucucaaaacaaaauccccacacaacaacaacaacaagcaaacacuugcuacucuugcagagggcucaggaugacuucuaguacccauauggagcacuucacaacugccuguacuuccaguuccaggggaucugacauucucuucuggccucugaagacaccugccaaguaugugguacucacacagacaaguuggcacauacauauacucauaaauuaaaaaagaaaagaaaagaaaagaaaagaaaagaaagaagggggggcuggcgagauggcucaguggguaagagcaccugacugcucuuccgaagguccagaguucaaaucccagcaaccacaugguggcucacaaccauccccaacaagaucugacccccucuucuagagugucugaagacaacuacaguguacuuacauauaaucaauaaauaaaucuuaaaaaaaaaaaaaagaaggaaggaaggaagggagaaagagaaagaaagaaagaaagaaagaaagaaagaaagaaagaaagaaagaaagaaagaaagcuagcuagcuaauggaaauucauuacagaaccugcauagauagauuucuuuaaaaaagacaucugcaaacucccaagcuauucucauguaucauaucauuucauccucaucuucuaagauggcguguacucccccuauggcacagaaagcugaguaacuaguuaagcccaaaguccuaucucauccaagaccacacuuuuaacucuuuaaguauacuagugccggaaaagagcaacucggaccaugauuccugcagcccaugcuggcuuuccuuagacaaaagggcugagccaucccaccauggucccagaggccacucgccuaaaugaaauuaggaggaacaacccagguguccugggcccgugccguagcugugggagagcuaugauggaccgugauauuugccagaacccacaagagugaacguaaaaacaguuguagggggaugaacuccuaaugcaggcaaaucaauauuaugagcaccgaucugcagaagucauaaaacacucaacaaaagaauaauugugucauucaaauuuuucuuauggcuaaaccagaaggcauucucaauaugcacaacagcucaacacugcccccuggugaucuccguguaaccaccgggaccacacuagcuaauugacuguggggaacaaaagcccccagaucaucaaaccuggucuaugagacagcagagaagucuggaccaggcaccaagccaucuggaaaaaucucuaggcuccacucccauuuguuugcaggaucugagauaaagaagccaugaauucaguaaugaguuaacuacuuuuacucugucaagcuggcaacggccuuuuuuacuccucuuuaauuaccaugggcacuuuucuugaugcccuguuggugggagaauaaauuaguaagccuuuucuugugcaauuuggaggcauguaucaagucuuccaaaggcguaccaccucaaggaauguauccuaaggaaauaauuaaagauucgagcaaacuacagcugcaggaacgcucacugggaccaucuacaagagcugaaagauauuaaauaccucaugcuacaaugauauuugaguuuacggagcaagugaauauuuauaggcaugcgaagguacuuacuagacacucucaaggggaaaagcaggacacccagcaaguaaagaauucacuuuuguaaagcagacaucuuuauaugugaauugaagaucuacgcggacagauaggaggauguggguucuucuacuggaccagcgggcggggucaguuuguuauuccuccgacaucagaguugccuagaggagcuaugaacccacagauuuccaacccuccuccccugccacucaacuguuccagggcagggcccuaaccuucugccucauuuaauggcuccccaggugacgucaaugugaggucagagcugucccuacaugugccaccaugugcucaccacugagcuacaaagcuccccaccaccgcccuccaaucccauacucagcuucuccugcuucucuuuuauccccuagagcaagcauccauccaaccaccgggcacuuuucagugcuacaguauaccagcuucuacagucuuuaccugucuaagucucuccagaguauuagaaggcuugguguagaaguuucugguacauaagggaaaauccauauccccagagcagcccucaccggaucuuauaaauaaacucucagauuaggcagcagacacccacucugggauuccugguggcacauuaggaagaccaucaaaaccaauuauuucuugaacauuccuaauggugucaacacauuccucuuuauuuuggggcugagagaagggcugcagugccuccuccuagcucuccaaccaaauccagggcuaggucuuucuggaauucgagacauccuggcucagcucgaaggguacauuucugaacacacucucaaaagcgcaucucggauuucacauugcuucuugagugacccugguagcccaucaguucuaggugcagccuguguuugagacuggguaugaagcucagucuauaagcagcuauuugggaccaagacugaaaagugaccaugucguucagguaccauaucugcuuauccaaagacguuacaucucugccacuuccuucauggggcuaucguuccuagcuacagacuuugaaauagaacgacugccuuggaugacagcucugccagcaccacacaagaggcuugaagcucacuggccaaauucuccaucugauucccauugauuuuccauguucuguguaaugccccccacacucagucuuugucaaggcucuucauucaguuacaugaaugcaugcugaauuaaauaaacuggaagccauggucaaauggaccguugauuucuucuuccuagauuucccuuuuccagaaguuuuaaguucaugguaaauaggugcucuuggucaguccuacaguggggcaggcugcaguguggcugccaugucuccugcugagcucuuuacaaaaccaaacaacugagguggcucggccuuuaaaguuauuuaccaccaacccugaucccuagaacccacauaguaggagagaaccaaccgcaaguugucuucugacuuuuucacguuuguggugugcacccauccaaagaauuaauuaguuaaucaauaaauaauaauaauuaaucauaaaauaccaucccuucuuucuuucugaccuauuguucucacuaaggccccugcugaccuccuaacuacugaagucuuuucaaggcucugcucuaaaaauucauagcaucauuuucugagacuccuuucugguguucaguaccugcucugggccaguccaagaccuuugcauacucuuggagauguggcuuugagaauccucuucucuguauaacuucaccugugcuagcauaaccagcgcccacacgaugauccugaucuguguguggugaaaccuuuucucuuggagggacuagaggccuagagaggccaagauccagaaagauaaacugacuuagcuaauucacaagaaucaggaaguucagaaagagacaagauucaugaggcccugcaucaaagguuauaugagaaggaaaccauugugggagaccgggagacuuuucgguggcacuaccugcaggcugggcagagaaauccagagaguauguugucaggagcaccacucaugcuggggugagcuuucagugauacaacugccuuagagugagccacaccagcuuuuaagacacccacuggcccaccgcacuacacccgcaaagaaucauucauugguuuauuguguccucucugggcugaguagauguuuguucaugccucucaaggaagagucagggaacaguagacaaucuugaugucucuccucaauuccaguugcuuccucugcuccuggcccacagacucaucaaaagccagcacugaacuaguuucuuaguguccacuaaaccaaggcucuucagaaggggaaagcaacauuggcaugagccaggauucaagucacccugaccacugcacaagcauuggggacaauguugguuccuuuccuuuccuguccuucaccugauagaggaccaagucuuaucacucuaacucuggacugucaguugagccaucuccucuauucucuuuaggguuacccugaaacucuugauaaaaucccuugcuagccaucuccugaaguucuuguccaagucacccuguccuucauacuacugacuggaccaucacccugccagagcucuguucaaucccaugauguggcagaaaaguacccaccuaccccauggacauuaaaaucccagccuacuauacgcauccuaucuccagcgaccucaccagcaacauccuuggaccuuguucuggccacccccaaugucucaccacacagcuuuccuuaucuacaccuguaagauuugucaagaggcugcaugcauuuuccaggggcuggacuaacacuuuggguacuauuuguuauaugccacugagccaaguaaagguggugggcucauggaggaccaugacucuccucuguugcauugggaagguauguagucaucauaacaugagcacacacacacacacacacacacacacacacaccuucuuauauuagcaggaggcaugucuguuguuucuagaguugcagccacuggccuugggggaaggcagggcacaugaagccacuucaguagcugcuaucuagugguacuccacauccguaccuuuggcauaguugcuccugcagucucugcauaguaucccacaguaaucagauguacgacggagagauggcacuaggcaccaaccacagcccacacuuccguucuccgaugacuuccagguuucucaauagauccugugguucucaggagucccuaauuagaucaugguucauucuuccacguggcuggaucucuuucuuuuuggcauuauccugaucacaagucuuccugggagacuucaaucccagaucuuuaacaaguccuuaauaagacucugagagccaccuccucuuuuaccuugguccagaggcucuuacuuccaagcuggcagccucugcgcccugcaagcgcuuucccccuuauuccacuuggcuugucagagccccagggacuagagggaauuccucaggagaggaagcccuaaagccuacauccuguucuuuuuggcugugacacuaucuacuuccacuacucuuguagcuuaggcuggcuuuggguuauaguuaaagcaugccuuccuguccugacaaccucugucaagacacacaagugcuggcagaacuguccacaacggccacuucacggagcacucuuccacgucagcauccagggaacugcugacagcagaucuuccgcaagguggcucccagagcucacgugguugauaaccgaaacuccacccaaaaaugcccuuucuuugcucuuuuggggagugggguggagggagcuuucaacauagcccugacuguucuggaauucaguauguagacacauguuagcuucaacucagaaguccuccugccucuaccucccaaguguugggauuaaaugugugugccaccauguuccucagagguguggaguuagagguuuaccuagauacgggccagaagaguuuauuuguaugaugggcuguaggaaauuaaaguauuuuauuaauaucacuggaaauacuuuugcuaacuuggacuuugacauaccacauauucacauacaagcaaccauucuggaagcaguaaauaacuacacuaauucuuuagcaucccuucugauaccccaaagagauuacuguuagaaauggcacaaaggcuacugacagguagggucccagaggaggugcacaaguccugucaugaguagacacagugccgcaggagagcaaaugcuuagcacuguaggaauauccuggcagcuccuuggaacucauccucagaggagaguugagcaucucuuugggguugcacgucaccagucugauacagaagggacuggggccacacugagcucccugaagggaagggaaguuuggcgcuucgaaaauccuuagcacguguucauuaagaucacugaaacaucuuucacaugggugucaauaaauggucagcucucagcucaaugccccacccucacaucaagaaguguguuguuuuagagacagggucucacuguguagcccagacugguauggaacaacuugugaagaccaggcuggccccaaauucacagagauccgccugccccuacuucuguuauuaaagacaacaugccuagucacagggucuccuuaaaugaugaauuuaaaacaucaguauuucuuuuguuuaaauucuaguccaucagggcuggagagacaagcauuggcugcucuucuagagaacccggguuggauuuccagcauccacacaguagcucacaacugucuguagcucuaguuucaggggagcuauguaugugugaugcacacaugacagacacaacauacaaacaaacaaauauucuaguccguuaucaguaaaacggaaguggcagcucugaguaucaccuuaucuuuuugagacggagugucucagugaacagggauggacaacugggcugcagagccuggccagcaaggcucaagaccuucuuauuccuacccuccucccagccgcaaugcugccaucacaggugcaggggauugaacccagcuccuuaugguuuuguagccagagcuuuacugacugugucaccucccccuccccucagcaguuccuaugcuauugucacauuaugacuggggcagcuuggccugaaugagugacacugagucugcagggccugaccuccaagcgugccuuagguccaguggcugcgacuuagcagucuuggagacagaggaacgagacaguccuguaauuugaugcagacccugagagaagagucucagggagacauuggacaucucuuggaaguuuucagagacuuucucuggacaccuacacagggccugguguuucagcugccaccaucugaaggcuucccgagugacugggaacuucuggggaguccaugcagagccugggacacucagcggacagacccugcccuccuguuccugcaguucauucagccuuuuggaugcuccgugggcacuucucugucuauuguucacaaaaaugaaucaagcuaugacuuggggcuugaauugaacuaaaaaaaaaaaaaaaucuguaugguucuaagggucuucauccaaguuuuucccaaaagauuauucuccaagggaaaaagaaaacaaaauguccaaaucucaaacauuuuucaguccccauuaucccacgccucucuguaccccuugagacacaauuuucaauaguaaacggggcugaaguuugagggcacggccuggagaaguuguuuaauuucuaccacuaaagacaaacuuggauucuuucaggcagcuuuccccucaggccagccuugcuuuauggggccaaaccaccgaaagaauaaaugaaugcaaaaaauuugccucacagcggugaacgcuaagacuuuuuuuuucuacagauacaaauucccaagcaaacuuagcccaaagauaaucaaaaugaaggcuggcuuucuuggcuuguuaagggcuuggcugcccgauuuucuugagggucugaaucuguuuacucgggaggggaugaacaacagggcaguuccagaaaaaucaacacaggccugaggaguauggaucaguuuguaauacacucugccugucauuccacaaauacuuaugguacacccacuguguugggacucugucccuggcugcugugcaagaggaaaggacaauauggcuaggcagguggccuucaucuaaugagggaggacaaagcaucugucccaagugguaaaugucauuaagaauuggagugggugaugggauuugagagagacuuugaauccaggugacaacucacagagagaagaccucuaugcuagacucacugcauuuuuuuuucuuuguugcuguguuuccuuuugagggggagggugugugcagggcagaagacaaccucagcuguccauagucaggagcuguccgcuuuguuuucugagacaaggucucucacuaaaccugaggcucacagaguaggccaggcuggcuggccacgagguuucagggacccauucaucccugcuuucucagugcugggauuacaggcaugugucaccacaccggccuuuaaaaacgagcaagugccgggcgugauggcgcacaccuuuaauuccagcacuugggaggcagaggcaggcgaauuucugaguucgaggccagccuggucuacagagugaguuucaggacagccagggcuacacagagaaacccugucucgaaaaaacaaaacaaaacaaaacaaaacaaaacaaaacaaaaacgcaagcaagcaaacaaacaaacaaacaaacaagcaaacaaacaaaaagcccaaaaaaacauagguucugggguucaaacucaggucuucacguucacauggcagcauuuuguggagugagcugucucuccagccuuugaaccaauaugaauaaauaacacuuugaauaguuaaaaagauccaugacacugguuuccuaaauacaauuaugaaggccaucacugaaacuggcacuggccucagagguccagguggcuacugcuggacaaggagggucuccacugguaucuacgggaucugagaggaugccuacuuauuuacauaauuaaaagcuauaagucaagccaacaagcuguggagcauauuuacucccagccuagcaaaaaacaaaaaaacacaccucccuacgacacaaagggcauggcccaaacggagaauauccuguaguuuucauuuccauaugagauguggcgguggugguagagagccugguccuguagcaucuucugucucuuccaucccugcuucuaucugugucuuaggacaucauagcagcucaguggggaaacacagugccaagaggggccaaggccaaaauggagcuucuaaagccucucucucucucucucucucucucucucucucucucucucucucucucucucuguguaugucuacuuacuuaugucuaggcaugagguugcauucggggagggcaucggggugccggucugugaggcauauugugcugucugguucccguuaggaugaugacagaagccccgucuguaucccaggugacaaguauaucaguacgguuugcccucccuucgcccagugagcuuaacacuacugcugcuacucccguuaccugacaugaggagacugggauuccagacauuuuauuuuuuuuuuuaaagauuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccgauuccagacauuuuaauuuaucaaaggccacacagcuagauaugguaccgacaggauuuuaaaugucagaugccaccuacaugggauggccuaaaaaauucccagaggaaaaucauuugcaaaucccaaaucauggaaaacucaagagcgggaaagaaaugaaauucaguacguuggacucuccggauggcugguggguuccaacagagacagaauccagaguccugucugcugggcaggccggagggguggaguggggggggguggggcgcagaagggugacccacagggucagggcugggcagagccugagcuuuuggaucugggcucccuugaugaauauacaagcuaggugggguuccggaucagcucaauagcuccauggggccuuauggcccuguguucuggaaaggugccuuaugccgaauggggacuuagagaccuuucuauaguugcaaccuucacugcuuucacuuuugugagcaaaaugguagcccggagugaggaagccccagggucuggcugccacgcaauuuccuuccguuucccaauagcagaguggccacuuggacgccuacacucaugguggccuuguacccccauucccugcugcugggcuggccagaaaaggcaugaggcuaggaggacuuacagagaccugcccaccaccuaccuaccucucucucucucucucucucucucucucucucucucucucucucucucucucucucuccccccccccacaaucccuucaauuauguguguguaccuaccuacauugggagcaaggucaauuucaggugucauuuuucaggcauugccuaccuuggguuuguuuauuuauauuuacugccuggugccuacaggagccagaagagggcauuguauccccaggaacuggaguuacagaaaguuuuuaagcugccugauaugggugcuuggaacagaagcggccuccuuugcaagagcagcagaugcuuuuaacugcugggccggcucuccaguccccugagacagggucucucacuugacuggggcucacccagcaggcuaggcuacuuggaagugagccccagggaugcaucugucucuccuucccuaguucucagaugauagggacagcaugcagcuggcaccagaggguguccuguucugucacuguacuuuauggcuuugaaaaagagucccucccugagacuugcguuacucucagccagcaagcuucagcaaucccgucucugcccacuccggaccccauguguuuuaccugggugcugagaucugaggguucucacccacuaucuccaggcucuucagcaugugcucugggacuugaacucagguccuucuaaugacaccaauacuugaacuuacagagcgauugacucaaccuaaaauuuacuucuuaaacguccccaacaaagacucaacggcuauaugaggaagugcaccaauccuguguccagcuggauggauuuuuaauaugcagauauuaugaggcacagcccagaccaacacaagacuguuuuagaguucaacagugaauugcagcagacaugaacacacucucggucaagcaguaaaccaccacuugugagcugacccccgcccgcccugacucccccuuauccagcaacgcacacaggcugcacuguuagcuguuaguguccaggagcagcucuuuccccuaggcaugcauucccagaccuccaggcaguuauacaagccugaccaaacagguuugggggcuuuuucucuaaacauucucucugcuugccccuccgauuccuccauacaaccgccuccccgagcuuccucuguggugcgggcugugagguucuccggguuuuagcagccuccugauguucuggucgggcuccuuuaagaugcuagagacggucaagauagaagggaccccaggacuucagccuuugggaagcuuaggaggcagagaccagacacugggccccugagcaacagggcaauaccaaagccagaaacugcccgaacugguuacauuccaguaagauuaacacaaggcugagccugcucccucgcccaccccuccuccccuccgggccuugaauaggauuuuuaacuauuucccuccuacuugccguccaaccccacacacugacaacgcucccugcuguuugcacauuaaccucccauuugccaggcagcuucucagaggcugcggauuaacaaccaccaacucagacaaugguccccagggagggaugcaaggagcucagacaaaggcuccagacacuaggcccagucaaucacuauacagugaucauuaggcaaaaagugcagagggcucccgcaggacuccagacagggcacaugagcaucaccacaguuggcuuggugccggcuccaggcaccuguccuagguggaacuggggugugggguaaugggggaugcucccaaacucacgcuauagaacuccagaacccugucccacagugucaccugggaagugcuggucuaggaagggccuaaaaucuggagggacagcauggaacacucaacccacuucgcuaggcuucgagcagauggcucuggcuccugcucuagggcuuccugcaaaagcaguuuguagacaggaauccacaggucagguccguuuucuccuccuucugccugcaggugcacacacauccaugaacaaggaaagguggcaccauagucguggagaaggccuggcugcaggagggacaacccuaccagugacuccacugugacugucacagugacugcucaugcaccaucaggugaggagcuuguuuugugccaggguuugggcagacagggcuaggagcaggggacacacuguagcaggagucucuaacaagcccacuacacaagguacuguguagcgccacuccgggcagaauaaggcucuggucccauaucaggugccuggcucugguuuucaccugcuggagaaaggcaacucuuaagucacccaguucugucuguagacaccuuugucacacugagacagcccaccaaggucgucugaaggccccccucccaccugcuaugcuaguucaggaacuccuugaauccuccuugagaggaaccccucaaaauaucucuaccucugccucccaguccuggucaaggaggcucuuacaaaaguuuuugcaugcuuauuuuuuauuuuuucugagcccugguccaguuccggggcugcugccagauggugggggaggggagcagacuucggugccggcuuaugagacuccuggguggaaggaacggugggaggagaggucuacagucuaagcagaaaccagaucuccugcccuagggcaguuagcguacgagaaauuuaaggacaauuaaaaagcaacaaccacaauuaauacgguuuacacaggcaaaacucauuaaguguggguuggggcgcuccauuuaccuuggccgggcagagacagaacacauuaaucgcaaacgagacuccagaggaauauuuguuugcgcugaacccaacuuagagcccuccagugaagggcagaguacucuugaccuaaaauggaugcacaaagggcuucauccagggagccaacugcuagccugguaaaauucagaugccaaaccuugcccauucaucccggcacccaggaggcagagucaggcagaucucugagaguuugaggccagccuggucuacauguggauugaguuccagucuagcuagggcuacauaguauaguccuggagguacugucuggaaaacaaaacaaaacaaaacaaaacaaaacagcacuaaaaaaaaaaaaaaaaaaaggacaaagggauaaaacacaaucccucuugcuugagccaaggacaccuagcuuugugguagagcauacaccaaggccugaccccaucugcagcacuacuacacaaggacuagaaauuccugcuuugaaagguuucauaaacuagccggcucauucauaaccgacauccgcccccagugugaaugaaccagacaacagccagggccuggcacaccgcuaaagcgaucacuaccuugucuggcugcaggggacauuugagcaggggcuuaugguuugaauggcagcaaguccacagaugaugagcaagccaucagaugacgugggaggacccuuaaucaagcucuugcccagcugcccgcccauaccuacagggcacguucuuccaccugcucuagccaugaacaacgugauaggaaauuccacacgcugcacacacaaccccaaagaccccaggguucccgcucaaccuuuuguuugccacucuguggcccucugucagucacggaugucaguggggucugguggagcugacacuccuggcuauauccuucccuaguucauuagaccugaaguacccuucugguucuucacucaguucccauaguguuccaaugacauuagcucaaugcugaugagauagugagcuuuagcacaugccaccaagccucacaccucuaugcccaggacacacaugguagaaaagaaccaccuccugcaagcuguucucugacuuccagagguaugccuccgagggcucccuccuccccucgcacauacacagaaagaugucagcauugagcuguguagcucagucauuauuagagugcuugccuagaacauguuagguccaggcuugaucuccagaacuacauaaacuggguuguaacacacaccaguaaacccaagcacucaauagugugaggccagcccaagcuauacaggaccuuguccaaauaaauaaauaaauaaauaaauaaauaaauaaauaaauaaauaaucuaugaaucuaguuaugguuguggcauaguuuaacugagcaaacacugugccagcagagagcuuagacuggguaagcucuuauaaugguaauaaaaaguagaaagagugugguucuauagugggagacgagggaauuuggggcgagggaguggggugugugugauggucuaauauccuugcuuuauugaggguccaaggcuagcucuccuguugggacacucucuuauucagccuucagaucagaucagucccuuaccucguggcccugcuagcagguucacucacaaggucaccgucuuucucauuuucgccuucugugaugcucagcccaacgcuugcaguuggaaaaacacugaucaauaugugucgaauugacucuccaacauaagccagccagcccaggacaauguaaggaugccaccgugaccaaauggaccaggccagaccuucugcccacaacaagcaggcucuaucucuggauuuagaacaauaggaacugcauuuaggugaagcaggacagcauuucugaccuggugccaaacucucaaugauaucagccaccagcaaaaaccuuuuuauucacacaguaagccauaggucugccacacaaugaguaauuacaaaccaagugauccagcaagguuucccaucuuuagaagcaugaagacccaacauuuccacucaaugugacaugagcucugaacauauuguuccaggucucaccauacuguccacauauccggccuuauuuuacagauaugggucauuaaguccggggccaccuucuuccaggaugagacaugcuuuguugggagugacacgcgucuaauuuuaggccuucuaagacagcagugcacugguuuuccuucaccuuucgccuacagcaggaaacggcgaucacgugcucagguucucuggcuucaaaaucauaaagucccguuuccacauaaugauguaugcauuuagccuagcacugcagccugcccuugggcacagugaagguaggucagcucaugggagguguccuaagaggggccgaauaggaacuggggcugcacuucugaaguagggcgggaugguggagggcaucacagacugauggaagucucacauuuaccuguacagcacuuuuuacauaaagacauuuguagauuguuugaaaacgggcucgaggaagcauuugccccacuaccgauacagcucuuccuuccccugucugccucucuucugcuauucucuccugggagccaggggaauuuuggugaggcccacugaagggucacacugaguuuggaacagaaagcaacaggauacaggacaacaacaguguuugaucauuuugugcuguuaucacaacuagaaguguagaucccuacugcugccaggacuggggcuuaggaccagggacccucagaugaaaacuaccaggaauccagagguuccagcugcugggggagaggguuugauccccgagcuucccacucaugugguaccucauucagaucccuuucugggcgccugacucuuagccacguuccaccucagccagccuguuucucaccacacacauaccaccagccaguugaugccuuggaaagagaagcaucuaaauguuuauuaacugcagucucagucugaauggggcgcugccugcuggucuaaggggcaagugggaggaaacugcgcacuacccuucccugaaccagauguuagauucagaugggcuggagcaggccccaaagaugcacugugauagaagcuuuaccagagccucaccauggaggucauaucccugcuggugcccacucccccaguacugagaaagguagagagagccaggcugaguccagagguguggguucuaagcucugaaccuucuacuagaucccucucaguggcuagaagaggcuuuugugguaauuaacauguauuaaguaccuacuguuugcaccaucuccugugcccauuaaaaagcagagaguuuuuauuucuuccucacaaacucuucuuugugcacgguggaaaugagcacugauuaucauccagacacaauaaaauccggauacaggucauuaaacagggcaaugaccuacccacuugguacgcugaccuguucuugcucauuccaaaacauuauucagacagcaagauaaaucgguuaauuuuuuuuuccacuccuaaaucauuaaauuagucagaaaggaaaagaaagaagaauaacauacaaacauccucaguagaaauuaguaggacccugcucccgccaucugcuuuaccccagggcuggucuugcucccacccccuggugcucugggcuaucuguuccagcauuuggccaguaacaaacugcuuuuuagaacccagcuguuaauuacuucucuaacagcccauugcuuggucuauacagagcauccccuacagacgacaguuucugcuuuucuuuacuuaagguguaccccaaaugcggcagacucugugcucuucucggagggacagaugagauugauggaugcuuagaacacacacacacagaacacacacaauguaacaugaaguuacacgaagugagcaggcuuauaaaaagccaugccauugagcuaggcuauacuuaauauucggucguugauuucuacuuaaaaggaccaaauuaucuauuguugaaaguggugggggagaaggcuuagguggggagagucuuccccucuaacuucacauaggugccacagcugacuucccaggaagguuauuggcaucccucccaaacucagugcucagacgcauuaugguggcaguuugaaagcgaccacaacaggagugcuuccaacaaggaaacuggcaaacaggaaucagggccuucucucccacuguuagagcguguggaaaagcacacgccagugccucucagcucaccauccaucuccucuuuucuuccugccaccaguauaagauaucuuacugacugaccauacagccuuguguuagaccucacaaaagcucagaacuuacuucauguauauauaugcaugagaggugacuguggagggcugaagcaggcagcagacuuccuggaucuaacuggaguuacgggcguuugugagcagcccgaugugggugcugagaaccaaacuugaguucucugaagaucaccaaguguuaauaagugcuaagccaucucucuagccccagaguucauccuuucuacaaaaauacaaauguagggcuggagagauggcucagugguuaagagcauggacaguucuuccagagguccugaguucaauucccagcaaccacaugguggcucacaaccaucugcaaugggaugcaaugcccucuucuggugucucugaagagagugacaggguacucacauacauaaaauaaguaaaucuuuuuuuuuuuuuaaaaauacagauguaguacaacaccaaaaacaggcucccuugcaccgugcccagcacugcccaagugugucuucacaucugcaagcucucucaguccaugugacacaguacaaauguuaucaucuucuucaaagauauagaaacagguauguaugcgcacauguguuuguggaugcguucgugugugugugugugugugugugugugugugugugaaguacucauggucacaaaugagaacugauauuugcagauagaggaccaagggggcugccagcacccccaagaguccauaggcuuacuaccccacaaaagggugaaaacccaaguucaaacuuugagaccaaaugaauuuuuauggaggcuuugugcuagaaaggguacuugguggcaacaaaaguuauuuggguucagagggcagcucaacagacgagaagaggagccgcccaacaucaggcauggugaucccaggacucagaaggcagaggcagguggaccucugugaguuugaggccagccuggucuacagagugaguuccagggcagccagggcuacauggagaaaagcggcugaguggagugagcccagccuuggagcccagccauggaacacaaccauggaacagcaagaaguacuacagauguuugaagaaauauccuuagaggcucauagccgaacaacucaagagccaaccccucaguccaucaaagcuagguugcugccaaaacagacccucagaggucucaccucucacccugacaaguggcaaaacaaagaaugaggccagaacaugcacugaagggggcagggcacuccagguguccugcaugcucagugugugugugugaguggggggauggggguguccuucacgcucacugugaguggguggggggugcugguguggcaauucuuuuaagccuuuuaagcagucuaacagguagaaauuguuggugguuuggagauggcucugacggaccuagcacccaggaaaggcuguaaccuuaguugggguggggacgagaguacgguagcagggaaucagugacagagggaucccuggagcucuggguucaaggagaaacccugucucuaaaggcagagaguguguguaagacaauggacguugaccauuggugucuacuuagaaccacacccaugaacauacuacacaucucugagaaacucugugccuucagcccccagagacacaguggacaucacagugaauaauguuuuuauuucuuauuucuuaagggaagaaagcagucauaucccaccagcagucggacaucaggccuggccuuuccuucugauaccuaagagagaguugaauccacuucccuuugcccgacuuccuuugguuuuugcuuuuccagggaaugaaucaagucagucaacaaguauuuauguagcgcccacauaucgcaggggcggguaggggagccaggggcugcuggaagaagcccaggccagcucucacucgagacaguuaaaggaaaugucuguccucgggcuaggucugaacaggggcugcaaagaacugacugccacccuggguggguuuauucuggaccaaccacucauuucuggcugggcugcuucuguuaucggaaaggccagcgugggcggaucagccaugucugugcacauuuuuggagaauggcaagcacagugcuagugaucuugguacuuggaggaacgggggcuggggcuggcugaaauccucuucuccaaauccccaaagggguuugugugugugugugugugugugugugugugugugugugugugugugugugugugugugugugugguguuccccagcaacaaucagaaucagcuaaacaaauguugucagaaguucaccauuuucuccucugcaaauguaaaugcuccgcagcugucugggagaggcuaggaaaaucugggguccauggaaacagccucugcagguccugcuccucuuacacugagaaacuggguuaccuggcuuuacacccugcuaugcacagcaugcaccaucaaccaguggucugagcaucucguaagugguuaagagcacaggcuguucuuccagaggaccaagauccaauucucaacaccuccauagcagcucacaacugucuguaaauagucccagagaaucugaaacugaacuaggcacgcauuacaaagugcacagacauauaugcugucaaaacacccauauacacauaagcagauggauagauagauagauagauagauagauagauagauagauagaaagaaaugggagggguggaaauugaggcuccaaucugcaauuccuugagcaaccucccaugcaaccaagcacugagaagcacuuccagauaaccaagagaugucaccacuaaccuaagagguuuccuaaggucacauugggauacaccugccuuacacauuguugggaagaagugaacaggcucucuaaaucacaagaugucuagugacuuauaaauauauaacuagucuugauuugaaaauaagucacuggaagagccugauuguuacauguuagguuuucaaauuguuuugcuuuguuuggucucauuagauagcccugacuguccugcaacguucuagagcaggcuggccuuaaauucaccgaaaucugugcaccgugugcuguggucacagguguauaccaccaccccaguuuguuuuuuagagaaggcuuucauauagcccagguuggucuugaacucuugauucucuugcuucuacuuuccaagugcuggaauuauagguuuauagcaccacaccugccccccccccccccgccaauuacauguuauuugaccucaguaagacuuauucuuuuucuuuuaaaugugugaaugcaugugcaugcgugccacggugcacguguggaggccaaaggacaacuuugaggggucauuucuuucucaggucaucaggccugcuuagcaggcaccuucagcucuggcugagagcuaacagaaccacauauuucucaccacaaagcauccuuucauuuccacguuaaggacuggcgaucucuuaaaugcccacgggauguuugaauaaccugcauagcuacaguuagaaucucagcaucuggggaagucaccgcaaaaccccccacauauaaauauggugauuuuaauaacaaauaacacauuuggagacugggauaaguaugcuggcagagggagccaccgaagauguuaauuugcauguugacaaaggaaucgaauccagcugcagcauucaugccugacucuguggggccacaggacacauggacaacuucaucaugggcaugcucuacauuuaaagcuuauuuuuaaacccucaaaauuuuggcaaaaaacccucagauucuacugaagaauggauuugauuguucugugaauccuaaaacagugugaguagaaaaaaaaaguccauguagguuuuacaaauuaaauaaaaaugucuaaaucaauuagaagcaaacuuucuuaaaauacucaccugggggcagaacccaaccuccccccgccccacaacuguuguagaaggcuuugggaacuuaaggaauaggugcuaguauaacucaguauaacugucuaucgcuuucugauuuuucuagauuugucugagcguuuaaagugaaaugugaaaauuguguuagaugaccaaaaaaaaaaaagaggaugaaucuaaacucacuguggugauacaugucuauaaucuaaacacugggagguugaggcaggagggcugcaaguucaagggcaacuucuaucaauugugaggcuuugucucaaaaaacaaaacaagauccaguauuguagugcaugucuuuaaccccaguucucaaaaggcagugucggagcucugugaguucaaggcugaucuguccuaguuaaugagacauugcuucagaaaacaagacucugagcuggagagaucccucaggggucaaagcacuggcugcacccacagauucaaguuccaacaucuacaugguagguuauacugccuguaaguaacuccaguuccagaggauucaacacccucuucuggccucugggaaccaggcauacgugugguacacagacauacgcauauaauauucauaauagacuaaacuucugaugugaccuuauaugaaugacuauauuuguguauagguagauuuuucuuuuugaaaccagaacauuuauguuaugacugauugagauccucaagaugaacuggaugcugcaacagcugcccucuuggguuuagguguuguuccuuccauggaauccacgucugaaucugugauaaacaauuuuuaggugccucaucugaccaguccugguaguauuucaccucuuagccuuggcacuccaguuauauuugccacaggucaacuucugaaggugguaggccuuggagccacaguggcggcacagugugugcaucucauugcgacguuuuccaaaggaugaaguuccuuuugccaucuuacuucuaccggugaggccaaagagacaggaagagguauggguagauuuucguaguaacagugaccaucauaaucacaacaggcuauguacugguuuggacaucucaguuuguuauucugauaagcuugaacucuguucugcuuuccuuucugacaaauaccaugaccaaaagcaaauuggugaaggagaggguccacugccaugucacagaccaucacugaaggaacccagggcaggaaccugaagcagaagccauggaggaccacagcuugcguuucacucccugguucucuuagguucaagauccgcuaguuuccuuagaaggcccagggccuucuauugacaaauggcucugugcauggugagcugggcucuucuacaucucuuaggacagguaagacaaugcugcacccagaccaaccugguaaagauggcuauucacgaggggcuuucugagugguucuaagcugcguccaguugaggccuguugcuaacuagaacaguucaaugucuuccccaauauggauggagucugcugauccauuuaugaaauaaauacucccucaaacauuucugaacacagaaggggccucugguacgcauaccaacucaguaggguaguuaaauaggaccugguaauaaaagugacggcuuguuucauuuuugaaggaaauagccaccaaaccccuccagcucaaauaggauguauuuagucaccacauuugucaacccuucagugcagcuccauguuuaucccugaacucgggggauagggacaguguacuggacaguggcaggauagccaugucccuaucccccgaguucaugagauaaagggaacuguuuugaggguuccaauucuugggagccccgaggauugcaguucuaccagcuuccauggcuaauguguuaguaauaaacgagaggguaugggugugguugcccuuaucaaagagacuacuuccucugccucgaccuugaacagcuagguauagaagacaggaaaccucgggucuacucaauaggaguguccauaccagcugcacucuuaauauucuuaaaauuaugggcagauuuaaugagacaaugggugugagucucaugugugcccaucuggacuauguagguaaggcugugugugugguguggugugugugugugugugugugugugugugugugugugugugugugugugugaguucugggccaucacagauggugugguugcccuugugcuugccuccuuagcucuccaacaagcuugccuuuguggcuuguuugguuuugagguagggucucacuauguagcucuagcuggucugaaauucacuguguugaauaggcuggccucaaacuccuacagaucugcccucucucuccagagugcugggauuagaggcgagagccagcucuugccuuuauaaagcaguagacucuguuguaaucauauugaguuuuuguuugaaggcagcugaagucuccuuaggucugaaugcuuaggagacacuggaagcuaagacaaccccccauacacacacacacacacacacacacacuugaguuacagaugucagguuuuuccuggugcaagaguaagucacaucuggaggccagaucuaugcuaccacugguggcaguaaauaaccaugugaugugaaguccacccugggugccauccuauccgaauccagaagaaacagcagagaccuucugcugguggcuuccauuugaccacaacccuugagaggauggguauucacuggcccauaaauagauccuugggccuaaugcuguaacgugaaauucaccauaugguucuuuuccaguuuucucauuugcacuguagccugccagaagccguuuagucaacuuacacccuucccccaaauggaaguggggauggugugacgccuggcauagaaacucgacuccagcccuucacccccagaagagaagcucgaagcuccuagggccugcagcccuaugccagugguggaccauagccagccugccugcgagccaugggaaccugaaccugaaccagggacuacacuggugucucuagaucaaguuucgggugugcugggacuuugggaaagcaugcgucucugcucccaguuguccuggaacacuaaguccgucuuuuguggagcaauggccugcuuuugccacaacacugucccagcugaagucuccuucugcagcuucugacucggguucuuuuuccuuuucgccauacuccuggaagccaaggaagggguccaguccccagcgcgcgcugacuauucagucagccccgaucggcaguucucauucuuucuucuagcaggagugaaggcugagaugcccgccaggcaacuuugccuuuuuucuucucucauuccccugggaucugcugcucggggcucgugguuuccugguagcuucuucacuuuccucaccggaugcccccaaagcaucucaaucacgccugaccauuuccucaggacucagauucuucuacugccuuuccuacuuccggcaauggcuccuccuuccuuccuguugccaggcaacauuccugacucuuccuucucaggcccucugugcuuaucugcccgcaaguccuguagcccucucccuucuaaacaaaccucuaaucugacuuuuaccuagcuucuauucuacacauccgcauuucuaucgcacuguccacgacuaccugggguuuccaccucgguuccuuucugccuguuuccccgcugucgagagcuccagugagggucagugcacaucacuucuuuacacaagagcccccacaccacccuguccaucucaccacgaggaagccagagucuagcgugcucuguaagagagagucccuugaguggccuccuguccaucuuuucugauugcaccuucuuuagcgccaccaccaagcccacacacucugcuccuugcuacucaaucugccugucauuagcccaccucaggguguuugugcuuugccuggagugccuuucugcuaugagucuauauagcuuguuccuuuucaucuuuaugaaaaaucacuuucaacaacaccuuugagaacuaugcauugagugaaugaacaaauuaaacuuuccccugaacuuucauuggugacuggaacuucacaaugugcuugguugcuguugaguuggguucuuuuugguuuuguguuguuuuuaagaagugugugugugugugugugugugugugugugugugugugcgcgcgcgcgcgugugcgcacaucugccaccucuagggaucgagauucacacuguggucuguaaucggcagcaaugucucucaaaacucauuuaacaaggguacagaaacacauguaacaggaaauaugcaucuggcuccuuaggacacuccgugcguaugaaaagcgauacacuauauaucuagugacucaucaaguguggcaucagcaccucagucuuuauccagaaccagcacccggccuuucagauggccacucccaugccuugggcucaccucuggccaaguagcuucucucacacuccagcucuccccuccuggaccucuucucuccuuuuccagguucucugaugguauucagacccagauuauuucaaaacacucgguccucugugaauaacguguaaacauugcuuucccacgcagagcugcugggcacacccccaguucuuccuuaaacuuuguacagagggggaggugggcacuaugucauacaagacgcuucguggauaaggcaccaaaaugaacgcuuugcaacucaaagccugggagucccggccacauuacuaaaaagcucccuaucaccuaucuguaagcuauaguagcuaggucuccucugcagccucuggguugaugugaccuuaaacacuuaagguucugaguagcuguaacaucuaugcagugguuucuuuuuuauguauguguuauauaacacuggggauuggaccaagggcaaugggcgcucugggcaagugcucuaccacugaauuacauaugcuccaagccuagacuuagcaguuuuauuuauuuacuuauuuguuuuguggguggggagacaccagccucacuauggaaaccaugcuggguuugaacuugcaguauuucuccugcuucugcaaaccccaagugcugcgauuacaagcaugugucaccauguccaguucuagaauuaauauuuaaaacugcaauaaaacuaauuauuaauaacccggggggaagggggauaggggaugaccagaacugaauaauaccaacuuugcuuggucacagucagaagagccuugacuggagggcauagcaguuagucacgcugacaccuucucugguauuuuggugcucugaggucuguggaugggcgggaagccccacugugacagaacuguaaucuaaaugaggaaagggaaggaaaacaugcccuuucgcuuaagaccuucaaaauugcagacugugaggagagucugacguaaaacagccucgucuaacaacagggaggcagaaaugagggagacugaggucuuugggguggggguggggcaauucuugaaugaaucagagaauaaaguuuguaaggaggagaaauagaacauaucacccauugcagggccugagcagaaggggcugcucacagguuggaaaugcaccaaaggcuuaccuucuccagaaaggggaagggagggcccaacagaguccagugacugugccucagagcagaggcugaggaaaggcaggaugggaaauguuggcacauccgcugugaugagggccucaaccaggguggaggggaagguuagcugaucaagccucgagagcugcauaugggauugccccugcuguuauucaggguaucccacagacgaugugugaaugugugugguaugcguguugcgcauuugugucugggugugcaugccuguggagaccagaguggagcaucuggugucuucuucuguaucacucucugcuuuauggcacugugaacaggaaguucacugcaaggcuggcuggcuagcagugaucuguccgaauuuaccagucuuggccccugcaauaaugguguuacaggcacacguggucauguuaguuuguaaguagaugcuuggaauucagccuuggucucacacuucugguauuuuugcccccugagccaucucucuagccucagaaacauagaauucuuuuuuuuucccuccauuaauuaauguauuuauucacuuuacaucccaauuggaacccagaaaccccaccccggggcggggggauucuugagcacaacgugucuacaaguagaaaaguggagacccagacuucauccaauguggagucccuguugcuagccccagaugaacaggaauaucuaggagaagcuggaggcuagaaggucuccagccucguggcacaaugccgugcacauaaaugagggaaguguggaguuugagacagaccuguagaguaacacuuacaacuccuucccucuggggccuucagugaaaaacaguacaguuuucacucaaggcccagguagaagaagaaauucccauugucgucuucugggacgucucuuagaccuaagauuuugcaaagggaaaggaucagggugguucugaaaggaauauucacugagcaacaagaacaggcuauuccuggacacauggaguuauccagucccucagagaguacaaauaacagcaucuuaacagaguuuaguuacaguacuaaaaauaaaugguggcuacauucgaauuauuauuauuuuuaaguuuuaaaccaauaaacuaaaaauauaccuagagccuaaauuaucuuccaugaacaaggacugcauaaaacacauccaguucucugggccaagaaguggaaggaagcccccacccccaccccuguuccuuccacuccuuuccuguagccuuccaucuguaagucaaucagcaaaccucuacagagccccacccuggagaaggcacuggggccagacaaagcacucuuaagaggcaacagucauguuccaauuuuguuuucccacacugugagaagaagccaaaagugcugagcuccaaaaggcuggguaaaacaaaauguugcggaggaagacaaacccuuuuaaagggugaccuugggugugcccuucccaaucaaguuaaaugucacugcucugagaacugguacguucugauuuccugauuuugcagaauuccaaagcuagcagaacaaauucaaacccuccagcuuccuuccuuucuccauuuccuuaaaaacaaaaacaaaaggcacagauuucacauauccauuaagauccaacuuauccccaaaguaucgcuggcuuuuacuguuacuguguuuuaggaagggaaaaaaaaaaucucccccucuuccccucccugcuuacaggcgcugagcugugucccacccaguuuagucuauagucgcuaucuauggaaugucacuguuagcuggcacugucuggggauguuucucagucaguuuuuuuucacaucucagauggcagccaagaggugcgggagagagaugcccccacaucacacccuugccaaccaauggcuccuuggcagccucuagaacuuguaggagaaaggggcuugcaggaugagacccucucuaucaugugauggaaggccaugcauguguaagacugcuggguaccgaaugcauacauaugccaaucuuuccacgaagggcuggggagauggcuccgugggugagggagagagggagagagacugucugagaggaaugaggcagaacgagagcgggacccuaggugccuucuggcuucuguguguaggcggaaacuugcucccucacacuuguguuugugagagagaaacggagaaggagagugauggauuccggguacgggaaaaaaggcucaacugauaaacucaccugccacauaaacacaaggacugagcuuggcucuuuagaacucuuauaaacacagacaguuuaagucugugucccccuagcaucccagccuacccuggggcagaagguguggaagaaacagagccaccaccacuacuacacccccacccccaccccagacagcccucauaggcugugcugaaccacaggcuaaugcugagacuuuggacagggagggaugugcugguggacugcaucauauacacgcguguucacacaugcuacucucuguuuguauuguggugcuagauauuuaacccagaggcucacauaaugcuaggcaagcaccgguacacauuuaaaaacaauuaucugacuacugugcagaagagagguaggaaaaggcuguuuuaaguuuaccuuucuguugugauaaaacauugaucaaaaggaacuugggaaggaaaggguaagucgccuccaucaccgagggaagccgaggcuggcaccgacgcagagaccacagaggaacucugcuuccuggcuuguucccaguuuacuaucucccacagccaggaccaguccuguccagggaaggcccuguccacaggccugggugcucccacaucaaucauuaaucaagagaaugucucacagguauuuccacagaacagucugauggaaacaguuccuaaauugaaauucccucuucccaggugacucuggucuaugucaaguugacauaaguuaaccauccagaagggucccuguuuagaggauugcacacuccauuuuccuuagcugccagauugagauucccuguauaaugcgugugggcuccucucaaauacuuggggacccuucucuggaguccccauacucuuuuccuggcugcugugagguuuccucuagucauccagaguccucagucccugaugugaccacagagagagacagguucucauguccucagcacagugcagacaguuucuuaucugugugcaaaguucuccugauucuccccuccaagaaacaccacgguaccucaauacugcucagaggcaguggacuggguguuuucuccuacccacucugugauuuuuuuuuuuuuugcacaguuuuucuagaaaggugauaaacauauaguaugagcugaagagauacagugaaaucagaguggaaaggaacaucacggaagcacuggaugaggggaggcaucugggugugugcugaguaccacauggaagggaagauacucagugaccagaauaucagugacgggagggaccuggaaagcaagcguccacagccaggcugauguuggaguagcccuccucuggcugcagaaacugcagauacuacccugagguucucucucucucucucucucucucucucucucucucucucucucucucucucucucuuucuuucuuccauacuagcuuaggggaggauuugugucugagucccuagccccucauuggcugccucgggaaggaacaacacucuccugggcauacagcugggaucucgccauuacuuaggucucugccgaccugggacagggaauaagagucuuuccuccuguugaccccagaggcccagagcuguccagggcggaaacaucucucaucuggagugccaucaccugcccuggccugccugucucaucuggcccugucagcccaggcucucagcauuugucauucccaccccaucgcuccagcacuggugagcaugucuuaggagugagaaaccugggaaucuaugugcucgccuuugugccccaugcucuggucccuccccaccccuuacaaucugguacccccacccccuccccgcccucuccuugucucugcauuaucuuuaacuuuguccccugcccccuacuguuuacacagcugcggaaugaggggaugcagcuucuccuguuugcaagcccaggguuaaauauauguguauuuccggcuccccacaacucaggcauugggaaugcuauccggggacccaaccuccuguaaauagaccgugagcugcuaauggcacuuucuggggauggaaaagcauauugaaccacuuacugugcaugaccuuauagaggaugcugguguaggcuuuccugaagcccaaggaaggggcugcuacuccacaaagaugaagcuucugugaagcaagugacagccauagacugccacauugcagaccucggguucaccaaaguuccagccagaaaccacaauuagaauagagaccuuugagugggguaacccggagcccaagacacggcugaguguugugggcacacagauagaaaugaaaacaaagcaagacgaacugucugggaguuccuguaguauuugggguguccugcaguguuugagacagucauuucugggaccacaccccaggguagauaggaaaacuaggccagauacucuagaaagcaucaccuuagcaagagcuggcagaggcaggcucucagguuaauuuggaucuauagagaugagagaauuaacaagagaccuggagacaccgcccuaaucuggagacaccacccuaaggucucaagagcacagcauaggacaagcugguaccuugauggugugguggucaacaggcuuuggauuuggccauuucagucaccacaaaugucccugaaaucccucacuucuuucuugucuacaucauccugcaguccuagaaagccgggagacuuacaaggcaucugagacuaaacgcagaacugucacagccuucauuuugacuuuccucaaggggcugagccuggagccuuagcgaacacacaacccucuuuccuuuucaacaucagaucuaauuuacucaagucuggucuugaacuuaccaaguaucuggggauguccuuaaacguuugacuuccugaauguggggucuacacagugugccaccauaucugauuugguauuaguaauaaaaccuagggcauccuauaugcugagcauguucccucccaguggagccuuaccuccagccucgaaugucuuauguuuaagacuuugccucaccuguccuacucacuggggggccccagcaaaggggcccagaaucuucaaguuacuuuuguuuugaaacagucacuaaaaagaucuggguuuaacacagaaguggaugcucacagucagcuauugaauggaccacagggcccccaauggaggaacuagagaaagcacccaaggaacuaaagggaacugcaacccuauagguggaacaacaauaugaacuaaccaguaccccggagcucuugucucuagcuguauauuuaucaaaagauggccuagucggccaucacugcaaagagaggcccauuggacuugcaaacuuuauaugccccaguacaggggaacgccagggccaaaaagggggagugggaggguaggggaguggugguggguggguggguaugggggacuuuugguauagcauuggaaauguaaaugagcuaaauaccuaauaaaaaauggaaaaaaaaagaucuggguuuuguuaggcaugaagauacaugccugcagucuugaugcugaggcaggaggauugcgcaagucaagugucagccugcuuggccuacauagcaagacccugacgcaaauaaaacaaacaauauaugggucucaaaggaugcacugaaaggagcaucaggugguagagaccaaaccaggacucugaccccggucaggaccccgacccucuacagaagaaccugggaagaccugcuucuaaaaccaagaaucuguccaggagcccacgacaaacgugacccagaucaaagaauggagucaggaaagcucugcuagucugagcagggugcuacagggcaacacagggccacauguucacccacagccacagggccugagcucauuacucuccucaggguugcuaaagucaucccgcccugaccuauguaguaguugcuaggcagccauguuuuguugucaucucuaaaggacgcaugacuaacacuuggguugguagagcacaucacagguauaaggccuagcagccucuuggucucucacaggacagaagacacauugccuauggcaauaccacaaggccuauauuaccggaauagaaaccuccuccuuccugcagugucccuucaaagcccagaggaugaugguaaccaacugagcacaugguaaguucugcccugaaggacauggagacagggcaagaaucuauaaucaaaauaauguuuguuuauuugcuugcuugcuuugcuuugcuuuggguuaauauuggggucuuauuucuacuuaguacacaccugggcuuaaacugaaggcaaaugaaagccacucugacagucauuuccuugcccucucucugaauccaauaggcaccagugguuaacaguaugguggcaacaagugggucaaaggucagccccucagccagggcugguuuccauggagaugaguccuauucaucuagcacacagagccucuucacagccacuuacacacaauugagcuauuacugggagcccaggagagccgugucuggaccacagugcacuagacagggcaggguuuaauggagcugauuaaaugguagucagggaauuacccagagcaggauuugggaauacccuucagaaacaacuuaaauccccaagcuucauccccauuucccucgcacagcucccuugaauagagucuccacgaccaauguccccuuuguguaggacaauggcagugucuacauucugcugcuuaccuccccuuucuucccacaugccuagagcugagaggacaaacccagucugagacccugcaccuugacggccccaccuuuagcaucuuuauccuauucuagguacucaaugguauuuguuucgagauaagagucuuguuauguagcccaggcuggacucaaacuacugucaaacaaagacaggcucuugucucuuguugccuuagccuucccaggagcugggacuauacaggcuuguaccaccacaccagcuuaugauggcaugauuuaauuauauauuuuuuaacuauagagguaucaacucaaggcugagacuauagcucagcugauaagaguuugcccuaguaacauauaaaugagccauaaugguacagggcuguaaucccaacaaucagcggauagaggcaggaagaugagaaauucaagguuacucuuggcuacauggggaguuugagaccagccuagguugcaugugacugccucgcagaaaaauaguuuaauuucuguugcuauaauguaucuuggaaagggagaaaagggaaucaaagggaaaacagaauuuaauucagcuuacaauucuaggguauaguccaugcaccauuaggaaaacaaacaaacaaacaaaacccaucaagacagaaucuugaaacagcuagccacagccaagaucagagagaaacaaaugcauccguggacacuugcuugcuugcuugcuuguuugcuugagucuagggaauagugccacccacagggggcugggcugucucacauuagccaauuaagacaaucccccacaaauaaacucacaggcuaacccaauguugacaauuccucauugagacuuucagauuaggugauucuagguuuugucaaauugacaguuaaggcuaacuaucacagauaaugagcucaaacacuuacaaacugggugguggugaugguacacgccuuuguucccagcguucaggaggcagaggcaggcagauuucugugaggcagaggcaggcagauuucugugaguuugaggccagcauggucuacaaagugaguuccaggacaguuaaggcuacacagagaaacccuauggggucagggagaagaugauauucccucauuaaaaacuaacaugagcgugaaaacuagaaaccgcugaacuauuccucaaugacugaaugauugaauaaacaagcucaauguggaacaccacuuagugauggagaagcacagcuccaggcagucacauggacagauauccugagagaaggaagcaaggcucccaaaacugcacagauacgaaccccgagaggucauccuggaaaaaguccaaacaguagggauaaagacuagaauugccagaauuaaaggcuggcuauaggagaacuacugacuuugaaggaaauggccagaaauauuauuauucuaaaauuuagagcaauuuagaaucuagauggugacacuucuacaauuugaagccaggcauaguggugcaugccuuuaaacccaguaauugggaggcagagacaagcaggucucuugaguuccaggacagccagaguuucauagugagagccugucucaaaaaugaaacaaaaugaaaccaaccaaccaaccaaccaaccaaaauaaaaaacaguuguauaauuugcuaagacuccaaaagcgaauuuucugguauguuuuguguguggugcauguuucugagaguguacauguacacucaaggauguauaugcacauauacacaaggauguauauguauauuauauguauguguauauguuugcacauagguguugaggccauagggcaucuucaggugcugucuaggauuuuuuuuuaauauuuauuuauuuauuauauguaaguacacuguagcuguccucagauacuccagaagaggacaucagauuucguuacggaugguugugagccaccaugugguugcuaggauuugaacucuggaccuucggaagaguagucggcguucuuauccacugagccaucucaccagcccccuaggauguuuuuuugaaacaagguuuuaaccccccuggccuacagcucaccaagaaggcuagguacagcagcaggccuuuggucuacccaucuuccccacuccugaacucagagaucaagucgguggcaccaugccuggcuuuuaagaaaaacugagcucagucagggcuucaucucuggucccugugacuccaugguauuuugugucucuccauccuccgugaugccagaucacagaugcuuggacuugagcucuucaaagagcacggaggaaacagugcugaguccucaggccaggauaacacagacaucugcauugucccccaaguuacagcugcgacccugugagcacagugcaccacuuugaacuauggacugcucucuccagccgggcaaagguaaagaugacgauuaaaagucaaaagaaggaggaggugauggacgcaggcauucacucuaacgucugccagcauugaggaggcgucaucaggaccuauaguuuugaggcuuucugcuaaguaugcuaugggaagaugcuccuuagugagaacagaaaauagcaggaaaggugggccggcaagaaggcucagcaagcaaaggcacuugcuucacaagcuggauggcuuggguucacuccccggaauacacaugaagguuccacaaagcugcucucagacuuccacaguagcaauuaggaucucgagagcuaacacccacgcauuaggcuggagagagcaaaugagucacagaggguccacgcagccuucccaggacacucaugugccugccguggccaguguucagaagagccucaaacucaaagaaguguacaaucaguauuugaugagcaagaaauacuccugaaggcagaagauuguagaaaaucggaugaaggagaaauggagacuaaauccacaggggagacuuauuccaaccguucaucuaggccaaguaucacggagcaguucugagagauauagaauagcaucaaaggcuggagacaaaccgcucuguguuugagcaccucaggaugccugaggccucggguuccauauucagugacacacagacagggcuggagggaugggucuugguuugcuuuccacugccgugauaaagaccaugagcaaaagcagcuuggcaggaaaggguuuucuggcuuacagguuauagugcaucacugagggaagucaggacaggaacucaugcaggagccuggagcaggaacugaggcagagcccacagaggagggcugccuccuggcuuguuccucacggcuugcucuaccucgggguuucuguuuuguuuuguuuuuaauuuuuguuuuuaaauaaccagggccaucugccuagggauagcacugcccucaguggaaugggugcuucuacuucaaucauuaaacaagaaaaugccccacagacuugccucuaggacaaucugauagagucuucuucucaacugagguuccuucucagaugauuuuagcuuguggcaaguuaacaaaaauaacaaaaaacaaaaaguaaaaagcagcugggcgcacgccuuuaaucccagcacuugggaggcagaggcaggugaauuucugaguuugaggccagccuggucuacagggugaguuccaaaacagccagggcuauacagagaaacccugucuuggaaaagcaaagaacaaaacaaaacaaaaaacaaaaaguaaaaagcaaaaagcaaaaacaaccaaaccaacuaaccagcacagcgagagaggaaagguacuugccaucaagacuguuuaccagagaccaauucacggaacauccaugguggaccaccacaaacgaguucucuugucgccacauuugggucaugaccugugcgcacaccuuuaaucccagcacucgggaggcagaggcaggcggauuucugaguucgaggccagccugguccauacagugaguuccaggacagccagggcuauacagagaaacccugucucgaaaaauacaaaaaacaaacaaacaaaacaaaaaaacccaaaacaacaacaacaaaccaaaaaaacaaaacaaacaaacaaaaaaaaaaccaaaaccccacacgugucuuauuugauaguauuaacucacugaaucuggacugaaaacuaacaggugaggguggugguagaagagucucuauugcagacagagaaacugggcgcaaggaaacucucugucuagcccuguaggaggauucgaacuucuguugaccagaguucucacauccaaccccuacacugcucugggaaugagaugaagaccgcagggugaagauuaccagagaugcaacuguagugcccagcuuuccacggcucaggguggauggaaaaguauauggaggcagaauauggcugaauugucagccacaugcaugggugccccccuaccccccaaaauggaggcugcuguuuuccauggugcuugggaauugcuuuggucuggaacacacugucccagauggucuggaauagaaugcaggcuccagauauucaaaguuguguccggggggccucucuaaggagugaagggccaucacguggggggugagggggacgacgggacacagacucaguaugccuuccuaucgcugcagguguuccagcagacgccagacagcaaauuguuggaccagauaacccugagaucucagcucacgauuaauuacucucagaugcaaacaacugcuucuugggccugcggaaaggacacgcggacaagaagcccugucuucuugcucaaagaagaaauaccaacaaggugcuaggagacacagaagacaugccugggaagcugggucauacugcacccccauuuccaggaaaacagacgccccuuaccauucuugcggguuagcucagcacgccuuuccagcaugcgagaucccugcagauguuucaaaggauucuccauguacccuauaacauuuccgggaacauuuauacgcucuuuccccugcaacacggcauuaaaccugaggggacuaaaagucacgggaucuguccaagugcaggaaaguguucggaaagcuuuagacauuuguuccguacugaaaaauggaacagcaaauuagaaggugauaugcaacuguccccucaggcuucccuccuggcaacagugcagaaaaaaacaaaaaaaaaacaaaaaaaaaccagacacugaaacuauuagguuuuuuucuuuuuuuaaggacuuauaauaauaaucagacugguuguuccuaguuaagggcugcccgcaaacauagugugggguaaaggagaaauaggauucccacaguuggcuuggaaacagaaggccucauccagcuuccuuucgaaggccacaggacagagcuuuaaauacucacaguuauacauuuggugagcccaaguaugggaagcuauucuagggaaacaauucuaaaaugcucuauacgggacuggggagacucaguggguuaagugcuuucugugugugaaagaagacccgacuuugaauccucagaacccauguuaguuacaggcaggugggauagcucaugucugcaaucccccugugggaaaacgagaccuagagaagccaauagaagcccugcuguuagccuggccuagucaguaguaaacaagagacgccgucuuggacaagggagaaggcgaggacggacaggugaggaugucuccugaccuccacacaugcuacaugccauggacaugcaagcgagggaggggggacagagggcuguggagauuucaggcuccccauucauuugcuacguugagcuacauaaaacacaccugcccgaguucacaguaaccuccugacucuuccagauacuucuuccauucauuuaguuuuugagacaaggucucgcucugcaguccaggauggacuugaacucaaaaucgucccgucucuauuucuccagugcuuggaauuacaggaauggccuagaucaggcauuccuggacaccuuacaagcacaccucaguuuccuccccgcccccaaucucaauuucuuccuuuuugaaaaaccucauuuauuguucuuauucucagggaugggugggacccauggagcagauguguggaggucacaggacagccuugugaaacugggcuuucucccucaaccuucacugagaugcugggauuccgcuugcguuaucaaguuuacagagcuggugcuuagccugcuggacaucacuaagaacagcaacugauugauugauugauugauugauugauugauugauugauuaagcaagcaugcaugcacaccagcaaugcacaugcauacacaugugcacacacaugcacaaauaaugcaugcacacacaaacacauguacaggaacacacuuuuuuuuuaaagacaaagaagacccugcuaaacucucacccugccacccuguaaacauguugaaagguguguggaucaggaagccuacaacuucagaagcugacagacagacagacagacagacagacagacagacagacagacggaucagagcacaacagcgugaggugggagcuauguguuucugcauggaaguaucucaaagcccucuugagcuaacaacaccuucacucaggcagagaaacugccuuagacugguggguggaaaggaagcaaaggggauaucuggacauggcugcaaccauucuaagcacugacaaaugagacccuguguucauucugugaggaggcuuagacaagguuacaaggacauuaaagagaguggagagauggcuugguaguuauguggacaugacccacuugguugccagcuccuggauucuaugggcaucugaacuuucacacccacacccacaaucaaacaugaauguuauauauguacacacacacguuuuacagucuuagggcuugaauucagggucuugacauagguugguacugagcuacauccccaggacuguauacauauuuacagcuaucagggcaccaguacuguggucuaggcuuaaagcccacaaacuaugcacuguagaacuggugaaagggcggugauagagaaugacggguccccaagaccaaguggcuagcaagggacagaaaggagagagggucuguaacuagagacuucccacaaaaucugccagugacagacacaaaggggaacagcacagccaaugaguggccaaggcuuaucuucaaggaggauuucuucaagcacugguggcacaugccuuuaaucccagcacuuaggggaacagagacaggcagaucucugugggcucaagggcagccugggcuacagagugaauuccaggaaagccaaggcuacauagagaaacccuggcucaaaagaaagaaagaaagaaagaaagaaagaaagaaagaaagaaagaaagaaagaaagaaagaaagaaagaaggaaagacaccaccaccaacaaaaaauacaaaaacaagcaaacaaacaaaacuaaccaauaaauaaaacaaaacaaaaaccuauuucucaaaguugccuuguccuguuuugugcuaauuauuuccaggcuuuugcagcagagcuaggaaacacacacacacacacacacacacacacacacacacacacacacacacauuuauauccaaccuuuaguucucagucagaccuuagauucuuuucucaguuucaaacccuccuuccuuccagcuugagaaaucuguuuguguaccgacaaugcaaucacuuuccuucgacacucaaaaugcagauaacagcucagaguuagcacucacugccuccucaucaagucagcucacggagacacuuuaagggguugaggugucuuuuaauucuuacucucuacuccgcuagggauugacagaucucucucugugucuguacaucuuggucuugcacaggucauugauuuccagccuaaugcaaguccuugggaacucgaagcugagcugugacauccugccuucucuuggcuggacagaugcaaacccagagcagagaucgaucaaccacaccagacaccugacucugggcucugcucugggcagagucaaacaacauccacagcaguacggcugagugcuguucuccacaggggacccggagcggaccucuguuuuacacaggcaagguccagagauugacagacuccccucacaagugauuggccggaaucuauugaagaaacaucuaacacuucacacucugcucgugggugcauaaugcgcucgugcauguguguuuucagagaacugaacccauggcacugaacaugcuaggaacaugugaucacuaagcgacaucccuaguccucauuucuuuuuucagccucucauguaucugagauuacagguauaccacaaaaaccugccaacauucuuucuaagacuacccuuuuuugcauguguagaugugugguguggugugaaugugcccacucgggugguucucuccacugcucucuaccuuacauagcaaggcgagguaccccagcuaaaugcagagcucaccguuuccgcuagucuagcuagcuagcguguuccagagaucccuugucuaugccgccuauggaacgggaccuaggcugggcugcugcacuccucuggcuuuuagguagguucuggaugaacucugguucccacggcagugcaguaagcacuuuacccaccaagcuaucucccuaccccuuaaagauaaccuuuaauucaaaaacaaagacaaaacccuguuucaaacagugagacagguucucucuguggcucuggauggaccggaacucaugcuguagaccaggcugaucuugaacacagagauccacuugcucugcccacagagugcugauaauuaaaguugugcgcaaccacaucuggcccauaauuuuuuaaaaaaugcaauuauuuuaaauuuaggguugguggaugauacuugucuggcaauuacacagcucugaguuuuaccuacaaaacucgcaccaaaaugccaagcgugguaugucugcaaccccagcacuggugaggcugaagcagguggaguccuggggcacauggccaggcaaccuggccuauuuagugagcuccaggccaaagauggccuggucucaaaguggguagccagugucccuaaggaugacccagaguuuguccucuggcuacacgcacacacacacacacacacacacacacacacacacacgguuuuuauuuauaaaaacgaaugggauaucaucuuuuuguaaaaauuauguaugcuuaaauucaaaaugcagagcaaauaacuagccaugcuaacguaccauuaucuagaaugaagacauuuccccaucaccuaaaacgucuuaacuggaguccucagccuuuuccccauacugcccagacauaauuacugucuccaaggcacuguucaucaggccacugcuuguuccuguaauuacaaacccauuacccacaaacuguacauagacuccaacugagugucuuccucaacuugccaugcuaaaagcuccaaauguacaagaaaauaguggaauacugugaacucugaccuucagccagucucaccacgauuaacaugcucccagauuucacucccucugucucgccucuucauauucccacacauauuucugucucaucugaaucaaguguagauaccgucauuaauaaagacgucaccuuuaaguacccagccuccaucuuguaagcacacgcaauucuccuacaggacugaugucaucaucauuauuaucaucaucaucaucauccucuuggaaaguuuguuaccgagaguugugaacugcacccggggcccugcaggaaauucuagcacugagcuacacacugaacccccuccgagagcugaagcguuugugaaaggcucuuuccaaccaacaucagauccccagaacucaugccuguuauuauguguagccaugguugauucugcucuaugacugcaugugugaaguuauuauacugaugaccacgguuuaagcuucagcaggcaaugcaacauuuauuauuauaucuacgcacacuguagcugucuucaggcauaucacaagagggugucagaucucauuauggaugguugugagccaccaugugguugcugggauuugaacucaggaccuucggaagagcagucagugcucuuaaccgcugagccaucucuccagcccccaacaagauacacucuuacucacauccuucauguagagaagacuugcuggggccuaagggcugcacauuuacuaggugcugccaaaccauucuugaaaacaaggacacuauugaaguaucuuuuaugagcuaauauucuuacaaacacaugcgucaugucaagcuuuaauuuuuaucaucauuguuuuccuuugcauucauauggcccuguuucuguuuuagaauuuuaacuuuuuuuuuaauguguaugaguguuuaauaugucuggguaccacauaugcgccuggcaccugagggaggcagaaggugucagggcuccugaaacaggaguuacagagguucugagcugccagguagacacuaggaauugaaccuggauccucugcaagagcagccugugcucuuaaccgcugagccaucucuccagcccuguuguuucuuuuuucaaacagaaacucuuggugaaacaucuuaugucacuauugaggccucuaccacaagacguccuuuggcaugacuaguuaaugcaucucgcugcaugaacuagucuuuccuugggugauauguucaagugagguuuacuuuugcccugucagucacuccuugcgugaaaguaagggcuugugcucuaguaucuuccccgacauuuuaagcuauagagggugggaaccuucucucauuguccuuacaacugcaggaugugugcagcaacuguaacaugaauaggugcacgugugcacacugagugugugugugggcguguuaauaggguugagcugauuaacuucacaacaccauaugcauuccaugagcaaaacaaggcauggugcaugucugugggcuggaauguuuggucuuagguucuuuugcucucugaggcaaaauggagaggguaggaugugaaccggguucacucacuagcuggcucgcucacugggauuuguuuggaauccauaguuuccgaaaaccuuaagcacagcgggacaugggguccccagauggcgaggggcuguuagaucuucacgggccacggaaaugggcaaauugcauuuugcacagucacauaacuucccgacagaacuugacuauuauuuccacagcagucaaguucuucagaguggaggaggggcugaucuaggugccuggagccaggguccaggagaggcugagcuggguagacuaguuggcugaggcuagcuuauucucagagagccuccuuucaucucuuuugaauaaaaucugcauucccuuucugguagaagggcaggucucuguuaauggcccugaguguaguggacucugugcccucaaagccaagcuccucgaggaagcugaacccaggccaacguuaguacaagaagagaaagagggauugucccucucacauagcucaacaucucauucucuucgaggccucaaaacccuaauuugaccacaaaaaccuggccucugguguuucuguuaugaguaucggauuccuucagcugaacuuggcuguucacugccugaacaaauuacauuaacaauacagagaaauguauacagggccuuaaaaacacugcugagcagggaccaaaacaaagacggcuguauccuagcaacaaaccucaccccccaagcaaggcugugggcucugccagggauuguaagccauugagcgccucucuucucugcaaacaauuagggacagagaagucacaauuacagaugggauuuacagccaaaggggcaaucuauaaaucacagagcucccacccccagccauucccagccagauaaucagagccagauguucaccacagcugcuuucgacguggguacacuguuggccaaccugaccacacuccugcucugagccaaacgguccagccaagucagaggggccucugcauccuggagccugcccaaccauaggaaagguuggggcaugugggaacuguuugcuggagcaaucacggaggcacaggcuccccucuggugaggaccuguggcuugcaaguuccugcaaaccuggcacaacuagugaugguggugaccauggcaaucagcaaccacaucuuuagcaucucuugcuaggggcuaggcacuggauggagccuuuuaaggcaugguuguuagggaaguucuucaauuauucacccaauuuggagcugaaaacaggaauugcuugugucagccaauuugcaagcaugaggaccuggguucggauccccagcacccacauagaaaccaggcaugcacugcacaucuggaauuccagcgcugggaagggagugacauucacccccuaaggcccaugggcuagcgagucuagccaaucggugagcucaagguuuggagagaccuugucucaaaagagaaggcagaagccacuggagaacacaccugaugccgaccccaggucuacacacacacuguacauacacugcacaaaggaaguagaaaauaaaguagcuagucacccaauccauagaugaagaaaaugaaccucggagaugccaaggauuuucuagaaugucucagugcugguaaguagugggggaaacaacucaaagcuccgugugugaccucaagauugacuuugagaccccgacaaucucauucagcaguagaacaguggggagacuuugggcgaauagagagaaaggcuuuagaaauuugucucuggacuguauaaaugaaaagaggcuugcgguuguuucaucucgccauaggugacucugucuuagcacucuguugcauuuauuuguuuaucugcucauuuagugcgugugauguguauuggucacacaugccauagagcacacauggaggucagagaacaacuugugagaguugacagcaggcaucuuuacccgaugagccauuuccgucagcuggugacucuauuuuaaaugcccaggcuuuaaccaagccagaauuuuaggaccuagggucaugggauugcaaucgccaaguuuguuaagagcgguauuauucaaguguggccaaggauuucuguucauagaccucuucaauacauuuucuucauuuuuauuuccuaagauauggcauauauaaagugcgcauucguuuuaagggaucaggagauggcucagugaguaagugcacuugccauguacgucagacaaccugaugcuccucagaacccuuguaaaagccuggcacaguacugcagacaccuggaaucccagugcgcaccuacaaggagaugggagguagagagggggggacucucuagaaucuuggggauguguuagcuagcuguaaugcaaugcaauaacgaagagacucugucucauaugggugaaacggcauaaaucugguuucucuauguacaucaauguucauauacaugaagaaaaaaacauauacccaccccacccagugaagaccucaaacucauagagaucugccuaccuugccuccugagugccaggauugaaggcuugcgccaccaugccuggcaaaugcacuugguuuugcagaacugggacugaccucagggucucauguauaguaagaaagcauucggcuguauuccaggucuguuuuauuuuuaauucacuguguagcacaggcaugccuuggaguuucaauuuuccugccuccgccuccuggguaguuagaauuccuagccuaugcccucagauggggcucaaguacacacagcuuaauuguagagcuuaaucgauuuuugugcauauauaaacuaaugucaacaccaccagaucaaaauguggaacauucuagggccggggagauuguagagcaauuaaguguguuugcugcucucccagaggacccgaguucaguucccaguaccuccacuggguggaucccaauagucuguuuccccagcuccagggacccugauuucuaauggccccugcacacacaugccuugacccccuauaguuuaacagugaacucuaagaaggacacggaauauucuagagaccauuuagaagguuguuacuugcuucaccaaagucaauaacaacccugaccuuguuaacauugucagcuucacuagcuuucgaacauuaccaugugcccugccucuguaacuuuccuccaguuuugauuacucucaggguuaaaccgcggcuuccaauucuaaaccaccaauaauaaaaaccagagauaacaccauuagucccgucuaccguucccagguuugugagaauacuguacaacaucugugacugcucgucaccagauccuugccuucaaguggggagaggcccugagucauuugucuucaggcaaugcccgguaaucgaaucugguaguaacaagcuauguuuaccccacuugccacccaucauccugacagccaccaucuuucacugcucagggagugcagcggggcauggaagaugugcuugaggucuuagagggaggaggaggaggaggagggauggcacuggaacgccuaggcuccccugggacaaaacaguucagacuguggaggcaaagccacucucaucgcucaguguccugaggagccaagauaggggcggccaagggugaggacagaggugugagcauccuauuaggacgagagcaguuacccacucuccacgcagcacaaugagggacccacucugguccaauccccuuuuuggaaaucugagcagaaucucuaugcaagauguguuggggcuguaagacuccuugcuuaggauggcacagacagauuccaagcaaagaggagcccaggccugggugcuaggagaggcaggauuuuccuuucccuucccucuagggugcagagccgcccaccuuuuugcuccuggcacugccccagcuucacuucccagaguggcuauuuuuagcugugcuuagcacccguuuguugccaugucuguuuaaaauccuacagcuguuggcauagugugacauaggacacuuccaaaggauguaaugcucccagccggaagugccaaaucucaaggcuaucaaacucucauucaaguguuuccgggugacacaugaacacagcaaucuuacaugcaaauaaagcagagaggcacgagguuccucuuaggcucucuggagguaccgcuucuccaucagagagacagccaaagaggugucacuuggacguggaaacaguacaaacagugaugaggucuacuggaaaccccaaacugaacacuagcagggcgaguuggcaaaugcuugcaaugcaagcaaccacaagaugagaugagagcuuagagagggagaugucucaaaaaauaagggggugaguaauugaggaagauauucaacgcccaccuguggccuacacgugcaaguuuaacacaucacacauaaacacaaaaaauaacauuuuauacguguauauacguguguguguguuguguguguguuuaaacuuuucagacagagccucggguagcagaggguagcguugaacaugcuauacagaugagacuggccugugcuccaccucucaaaggcugagacuaaaagugugcaccauuaugcccagcuacacagcauuuucuaauauuguccaaucacgguucucauccaagccacauuugaaaggggacuaggggcuggugagauggcucaguggguaagagcacccaacugcucuuccgaagguccggcguucaaaucccagcaaccacaugguggcucacaaccauccguaaggagaucugacucccucuucuggagugucugaagacagcuacaguguacuuacauauaaucaauaaauaaaucuuuuaaaaaaaaaaagaaagaaagaaaggggacuagaccagugggcacaagucaugccuacuguaagacacaucaugcacuugaccaggugugaccaugugguggcaguggccucaguaguggugguggugguggugguggagcggucuuccggucuauagucucgaguugugauuuuaauguuuguguuuccaaaacuacaaacagaggccaggucuaucaugcuuuguggaauccuacacgcaaucuggaccuuucuuggaaggauggagacaugucuuucaagcuccccagauaaucucuuauuuaguccuuacacugaucucugaggucaagaacauuguccuagguucauuuuaaacaaauggaagguguggaauuaagucucuuacauagagucacagacucuuccucucuuucucaaguauaugucauguacaugccuguguguauuuauguuugcaugugcgugggugcauguggaagcucagggaugacggugggagucuucccaaucacucuccaccuuauucauugaggcagguucucucgguggaagcuaagcuugccuguaugccuacucuggcuaaccgguuuguucuggggauucuaccuucuuaaugcuggaacccaguacuuacauggccucugcaaagccaaacucugcuucugauguuuguauagcaagagguuuaaccacucaaccauuggcucagcccagcuaaagucagagacauuugcagcaacauuuauaugccuuucagcucacagaauugacacaaagaguuguuaauauuugguggucccagaaaauaauaugagcuccuaaauuaguaaguguugcuucccucucaaaaggccuguaaucugcaucaugaucaaaaacucugaugaagcaagccuuaaagauaacagcuccauccccaaauucaaacccaaauucaaacccaaauaugucucuaugggcaagauucacacacugcugugugcugagaggcaagaauacauggggugggaucuggacuuuuuguuuuguuuugagacaggguuccucuguguagcccugguuguccuggaacucacucuguagaccagccugacuucaaacucugcuucuagagugcaaggauuaaagaugugugccaccauaucuggcaaaaagaguuguuuguuuguuuuauuuuuauauaauuuuuuacauacauuacauccugaccaaaguuuucucuacacuccuccagugccugaaaagagucuuaaugaaggauugccugcaagggcugaccuauaaacauaccuuuggggaauugacuuaauucaauuacuugguggggaaagacucagcccacugugggcagcaucauucccuagguagucccugaggaaauuaagcugaacaaacaaacuagugagcauccacacacucauuucuguucuugacugugagugggaaugugacugcuagaguuuuuucaauguguuuuugugugugccugcagaaguuuuaguggggccaagaaagguuaggaaggggcuugagauccaguucugaugaacuggaguuacagguaguuaugugcaaccugauaucagugcuuggaauggaacccagggccuguacaggagcggugagugcucuuaagcacugagccagcucuuuagccacaugaccaccuguuuuaaguuccugucaccuuacuuuccuuguaagggaucauaaccuggaauucaugacuaaaacaaauauuuucuuccuuaaguugcuuuuugucaggcuauuuugucacagcaacagagaugaaaugaggacagauguuaucuggacuuccuggcuguugccaucuucaugcuggagaugucgguaacuuuuuccucaggcuccuugcacgaggauucacaaucauuuacaaggaucucucuaguugguuccgaggcacuucugggugcucagcaauagcaugcuugcuuucuaucaaccuggacuugugguguuuaucugucccaugcggaggaaacccagaaccagaccaccccauuuuaauguggcgccuuucagaucaagagguacgcaauccuguaauccaaugguccuguaaaauucuucagcaguuggagaagacguacaaauggaguugaaccugccaaacgcagcauauuuuaaaaaguaaucuuguucuuauuaaauucauauugacucuugagggggaagaggaggaaaaucacauuuuuuaugauucaucacuuccucaagauaauaaaacaugaucugaagauauaaaaaaaaaaauauguggcugcaaacaucuuuucucccccuuaagcuguucuuuucccaaaaaagcaguucccaccguuccacagaaccuuguacuccacuucagcuuuguggccaucaccaaaacuucaucgugagacacaaagcagcuugugaaaccagaaacacucuggagucacggagucaagaaugcuguauuccugcagaggaguuguagacacacgcauguccuucaggcaucugcucaagcauugccuucuccuuggagccuuucugacacccaggacaaacgcaacagcacccucaccuccgcuccucucccugccccacucuucuuggcuucuuuccaagcccugagucccugauacaggaugauaggugcccaguagcaggagucuagauugucaaggcacucaguuauuuguugagugaaaguccagucuuccuguccuuccguagccacccgauuaccuugcccuccuugauucaauaccuaaagugcauauaguugaagagucagacaaagcagacaucaacauuugaaaacguuguguccccauagacacuaucaauaaaguuauuugaaaaacaacaaacaaacaaacaaacaaacaaacccaagggccagaagaguauuuauaaauuacauauuuaauaaagaacuaguuuccaaaauacauaaaaucucuuuugaggccaugauaugguuuagagcagcgguucucaaccuguggauagggacccccuuugagggucgaaggaccccuuaacaaggguugccuaagaacaucugcauaucagauauucacaauucauaggcauagcaaaauuacaauuaugaaguagcaacaaacaaaauguuauggcuguaggccaccacaacaugaagaauuacaguaaggggucacagcauuaagaaggaugugagccauugguucaaaggguacaggauccugccaccaggccugaugaugugaauuugauugccaggacucauguugcagaugaugagaagugaguucugcaaacuucucucugacuaacucaaggacacauaugcacgcucuuccauagacaugcacacaaaauaauaaaaugggauaaaaaacuauuauaaaccucuuccuuaacaauaaaaagguaaacaaaaauuuaaaaguugaaugaucuggauauauauuuaucuuaaauagagucaauguacacauaaaaauguguucaaaacucaugcucacuaggauauucauaaugaagagaagagacuucaguaggguugggaaaagaugcagagaaaucggugcccucauccacuaucagagauaggggaaauggugcaucugggauggggcuguggcugucagcagaacacuagcaaugcaagcaggaggauucagguuccaccccaggacccacgugaacaagccaaguguaguggcuugugcuugugaugagaagggggagacaaccagauuccuggggcucaagggcuauguagucuugcuaaacuauggucccaguuaaaagugagacucuuguuucuauguauguagaucaagcuagguuugagcacacagaucugcuggccuuagccuccuaugcuggauuaaaggcuugggccaccauggugagacuuugucuuaauauacaggauggaggaaugacaccugagguagaccucuggccuccacaugaaugugcagacugagcgugcacaugugcacacaaacacuuuugucuaugagugcacguggcagcauuguucauaacagcccugaaguggacagaaggcaaaugucuaugaacugaugaacuaccauagaucaucaucuagccauaaaaagaaaugugagcucuuuuacacuacaauauaaauaaaccuugagaccacugugcuaagcaaaagaaagaagccagugacaaaaggccauguguugaauuauccaauuuacauaaaaguccaggacuacuccagagacucaauuacugguuaccagggaugggaaggaagaaacagggagaguguuaaugaguacagguuucuuugcagaauaguggaaguguucuggaauuugaugguggugguagucauacaauucugaauauacuaaaacuguugaacggcagacuuuaauuugaggguggauuuuguggcauaugaguuaaaucuaaagaaaccaguaaggcacacuuuuugaaucuauuaaggaaauaaaaagaaaacaauuaucuugcauaauaucccgggaaacgaggcucaaucuccguauccaauugguguaucucaaacaacguucccacccugguugccccauggaaucacucaggagacuuuuaaaaacacacagaugcuuggagauccuucucaaagcggucaauaggaccaggguggaguucugggacagugcuuuccagaaacucugaaguugaugcuagugugcagcuggggugaagaaccacagcccuagaccuugaguuguuaggaguccccggugcugguuucaauauguguuauuuuauccuuucuuauaaacacgaagcaacaaaaauguaaaugccucccuguuacuggcuguuaggacucaggaggagauuuuauugcuuugccuacauuuaaaaaaaaauauauaugagcaaaugacuauuuuauagaccaagccuuugggagagaaaauguuuaaagugcauauugacgguggucuuaggguuaucacugcugcgaugaaacacuaaacacaacugugaugaccaaacacaacguggggagugcaggguuuauuuggcuuacccuuccacaucauaguacaucacugaaggaaguuaggacagggacucaaaacagaccaggaaccuggaggcaggagcugauucagaggccaggagaggguacugcuuaguggcuugcuccucauggcuugaucacccugcuuccuuauacaacccaggacuagcagcccagggguggccccacccacaaugggcugggcccuccuccaucaaucaccaacugagaaaaugaccuacugguuugcauacagcccagucuuagggaagaguuuucucaguugaagcuccuuucccucagaugauucuagcgugugccaaguugacauaaaacuacucggcacaauucccauccuaaguuggggcagggaucaaacuccaguuucauccuugggaacuuaauauaguucuuucucuacuuacuccaacccugagucuagccagugucucaccagguagcccccgcuguccuagaauuuauuucauagacuaggcuggucgugaacucugccuccagagugcugggauuaaaggugcaugccaugacacugggcuugucuucuuuuauuuaagacagggucucauagaguucaggcuggccuugaacucuugauuacucuauuucuacauccugagugaugggauuacaggcuggagaccucuuccucacagggcugggaagacaagguuuucuaucccucccucaucuccaaggccucacacacauggagcucgcucaucucaucuccauuaguuucccauacacugguaaaaccaacgucaggucuucauuaggcuccccauuuauucuggagccccaaagcuguuuccaauuggcagagucaggcuggugugggcuauucauuaguauguuggugggaagcugacucgaccccaacccaaccccagccugugggaaaauuuuccccaaucagaaggcucgccaggucccugagacccggaauggaggagccaccaccaccucccaugggcucugcauuccuugcucagagcauuguggcucagcagcagccuuuggggucuaacuuuguugaguaaucacucugugauuucucuaagcuccuugguuccuccaucccucuuucuuguucagcugcuucauaaguugaauucuaaucugaguuucuccacaauguccccuuucacaaaaagcuaauaaaacccuaaacaggaaauucaggaguaguagcaaugccacaugacuguuaacugaaggcuauuggucaacuggaauugguuuucaagcuuguccguccccaccccccaaaaugagggcuccagccccucacccacauuugcagcaauaaagaacgucuuugucucuccaugcaagaacacgagagucccaaccuuucuaggggugccuucaggcagcccacacacagcucgggaccaaagcaugcaucugcguuugccccugcacaacuuccgugugggcugugcugggcagugguacccagcugugcugggcagugguacccagcucugcuccccaagaaccaaccguaggcaagcugucccagagcugcugccauacucgaaaacuggucuggcagguggagcccucugcacacucaagaggcuauucagauucucaacugguaagcaaaaauccccaauauuuuguaaaaagccuagcagugauggagcacuaaucccagcacuugggaggcagaggcaggcagaucucugaguucgaggccagccuggucuacagagugaguucugggacagccagggcuacacagagaaacccugccuugaaaaacaagaacaaaagaaaucaaguuuacaaaauaaaggagcaaagguauuucacugcaucuggagagaccuugucauagaugaaagguuuccaugcagccaagucacuuaggaauuuauucuugaauuucuuuugauugcagagagagagaaaaaaucuugauucccagacaaauggcaguaaauacaaacacauagacugguuucugauccuacagccguguuugauagccuuucuuacauuacuauccuccaagaagccuuuguaaacauuucacccguuuguacaccaccucugaaaccauacuaccacagacagauugccuguguuuggguauaguggcucuuuggagguaacaggcucuugucagagccagacaccauacgcucccuuccaauuaagaauucauaguuuaauaggucccggccuuuaaaaggugguagaacauuuuguuucaggccagaaccuuuaaaauuguaauagagaaagggucuggggauacagcucaauugguaggacgauugccuagcgugaagcaugaagcaaguccccagguccaaaucuccugcacuaccuaaacuaggcauggugguacuugcuguaagcccaacccuccagcccucggagcagugggagugaggggcagaaguucaagguuauccuugaguacaaagcaguuuggaggucagucuugagaaggcgagacucaccucaugguaaguauuuguuagauauuguuugaaacaguuuaccuacuuuuacucauuugagucuuucaauccuuuguucccaucucucccccuuuccccucccccuacucucacucuccuccugagauggcaugaacccagggccucacacaaacuaggugauuuuucucugccccugagcuacaucaccagccccauagucaucuggcucuugacggaauucgguagguaggacuagauggccuacagaaggucaccuaggagccaaguggcucaguugagggguccagccuaagcccuacuaccuucccacggaauagccacuccuguuucccugucaugcacauaaaacacgaugagaagaugcacacacgucugugcugggaugccacccugagccaagcccauugagagcacacacaagcaucuggcugacaccgugagaggagccccgugugcucagcuacaagcucccuaaccaaugccacauuuacaagauauuccacuagagacagaguggcgggcagggauacauacugugugugccucccuggcagugccggguuugagcaccgguggucucuggaaugcugacaucucaugaauacuucaucguguggguuuuauuuuuguuucccauuuguaaaugucaagaauaggauuuaaaaaaaaaauaacccauuccaauguucaagaauuccccccaagcaccagacccacagcagugccgaugaagcaccggagggcagcucagaacugcugcaagucugccugaccgcgcucacaccgcugggccagugccagcuccugccccucccuucccagcuuuucugguccaggucccccaaacuauaccaucuccucccaucaaauacucgagcagggcaccacacuucuccgagccaggccccagggagcaccagcuugcaagcucccuggcuggcuuucuguccugcauucuuagagaaggguguucauccccuggcucucccugagcagaggugcaugucccugccugcuuuccuuucacucauuagccucuuauuuacuuaguaccuacuagguuuagcagcuggagaaucaaaacaaauacaucucccgcugaaggaaaaagaacacaggaguucacaaagacugguuuagaggagagggaacagaacugugggccgaggaaaccccaaagggaaggccugggugcuggggagccuuggagggccauccaggaaggagcaaugcucucugggucugggcccaggccugggcagggaacacaucucccugacaggauggccuacagcaaaggcgggaccaguucuagagugucaggagugaugucacccuucccagguggcagaaguuacaaacacagcuguccuagagaagccaugauccuugaugggcacuaacuacacacuggagucuccuggagcccuuuacaaaguccugaugugugggccccacaugacuugucagaccuccccgagggucuuggcuguaaaggaaggggugagcacugacagagacagaaugccugguacaccccaagugccugaaacccugccgugcuuccugguagcgggccuccccucccccaccgccuccuaccuagcacucaaguucccaaucacaaagaucucuuugcuucucagcccugggucuugugcagaugacuugggugaggaaaugauaaaaucuguuuaaugcucaaauucagagggacaggaaagugaggcguggugguuaguggaaggaguaauuaauggcuguuacuggggccuugacgagagcucugugcuugcagaguuuaaacgcacguggugucucuggacuacaaaugaaaagugguuaagauggaaaggucuacggcucagcaguuaacagcauguguggcucucccauaggacccaaguucaggucccagcauccaccugagaguuaaccacaggccuagggacccaacacccucuuccagccuccaugggcacuaugugcacacggugagcauguugcaggguaggaagggagggaggagcucccgcugaacaagucugaagcagggacuugguauguucagaaagcagagagcaagccagcuagcugcauggggagcgcuggugucaauggagaaacccugucucaaugcuacagcggaaaugaacgcaaaucaagaaacaauccccacuccaaccuugggccuuugugagugaacacacaagcaagcaagcaagcaagcgcgcgcacacacacacacacacacacacacacacacaauuaauaggcagcagggugcaucuauaugaguacagaaagcccaaaauucagggagacacagcccucuggcauuggugcguucauccugaguuuaggaauuccuuuucacuugugugaauccugggggggagcaggucccuccucccauuccagaaauugacaaugcauacuguaaacuccaguuugggaacaauugugacaguggucuaagcugcuacuugacuuuauagguucagccuucucagaaaggaaggcaucuucaugcccucuaaagaacugucuucaccaguagggcggugguggcgcacaccuuuaaucccagcacuugggaggcagaggcaggcggaucucugaguuugagaccagcccggucaacaaagugaguuccaggacagccaagguuacauggagaaacccugucuggagaggagaggagaggagaggagaggagaggagaggagaggagaggagaggagaggagaggagaggagaggagaggagaggagaggugcuauccauaguaggcagaucucaaacucacagguagcuauugacccgcaucucccccuggccugagugcugggauuaaacaagugagccaccauguccagaauuccuuuaauaguugguuuuuauuuuaucuuuuuauuauuuuaggggcuuguuugaugagagagagaaaaaagugugaauugggguguaugagagaguagggaggaucuggggagugagaggaggggaaauguaaucaaaauauaauguauuuuuaaaaguccauuagaaaagauaacacuggaaggggguggagcuaaacagcugggccaauggcuaaaguccguguagcuuuugcagaugacaauuuuaaauaaauuuugcuggacuuaaaguuuugaggaugaaaauaugcacaaaguuccagacaaaacaaguuuuagccaguggaauuagguaucuggaaagaaacagcccugguucugucccuccggcgaaagauuauuguucaguuccuauaaguagggcucccaaccucuguguaugugugugugugugugugugugugugugugugugcgcgcgcgcgcgcgcauaugaaugcguauuucuuggcuuugccucauuuuucuauaaguugcaguacuuccuauaauaaaagccaagacaaacaaaucaaccuccuccuccccuuccuccuccuccuccuccuucuccuccucccccuccucuuccuccuccuucccacauggagggaaucuuuaaaaauccuuuucauuugaaaauguuuuguggggcuggagagauggcucagugguuaguuaagagcgccgaccgcucuucugaaggucaugaguucaaaucccagcaaccacaugauggcucacaaccauccguaaugagaucugaugcccucuucugggguaucugaugacagcuaagaagaaaaaaugucugacaacagcuacaguguauuuacuuacauauaauaaauaaauaaaucuagaaagaaagaaagaaagaaagaaagaaagaaagaaagaaagaaagaaagaaagaaagaaagaaagaaagaaagaaagaaagaaggaaaguguuuuguuugguugguuugacuuuguucucugaggcaggguuucccuaugcagcucuggcugucuuggaacucacucuguagauuaggcuggccucgaacucagagaucgaccugcuuuugucucccaagugcugagauuaaaggcaugaaccauuaccacccaacuuugaaacacuuucacacuacuagagaagauuuaaaaaugguuuaaaaaaaaaaaaucaacucuuauacaacccuucucuccaaaugcccaaaaacuguaacuuaauucuguaucuuuccauauguauuuuuuuccuucccaaccacgggagagcaagauguucuucauuuuuugguguuuccggugugcauucccuaaaagacguucuuuuacauagccaggguaauuacauaaccagggaauuagcaaggauacaauacuaucaucccauuuacagacuauucaaauauugccaguugcccuaauaaugcuguuuaaaccaagagaucauuuagacaaugaucacaaaacaacaacaacaaaacaacaacaaaaaacaaacaaacauccuugguucaggauguccuucaggcugcacaucggcagcccacuggccuugccagcuucugaaccugucugagacucuggcugcccaucugggugaagagcccugaauagagacuugucacugucuguacagacuggacaagagcuuuccucucaggguuccacccucuagcacaugugaggauaaaggacagaggaacuaggaacauuucagucagucaucaacgacuggggucaccgcuaccauagcaaccucugacuguucugggguagggauacgauucaucugagugaagaaauaagaaacgauagcucgacaaucacugggucugccagggcucucccugcuuuguauaaauccuaccauucaaccugcacuugcagauagaagacugagcacagaggggcugagggauucauucugacuuuccaaugugagaacucaggaaugaggaagguagaaaaugcuauuaucacuugcaagaugaggcaucuuuucuaggcugagguuagaaagaaccugaagcuccagagaccacugucuccccccgccagcuguggcugcaccaguaauuggauacagggacgcacagcuggggcacccugaucauacgcagcacagauaguucugggcagugaugaaacaacgucaaaacauggugaaaauaaaaccagaaaaccguguuccaugcugcaaaagugccuuugauagagccugcacucaaauuuguauccccucccagagaaaagcccccccaccucugaccccagugaagaaaccaacuucuacaugagcuaaguggguacacggugcugacgaauagugccagggcuucuucccauccaucccacagcugaggaagcagaagccgggugggcucaguggcuggaagccagcacaggaccagggugcgagguccagcagcauccauccauguuuuacagcguccggaggguuugaaaacacugccaugucaugcaaacucacuccguuccauucgccacugaacacgucuuuugggaaagaaugccagcuuuccugagcccaugaccuccucccagaguacauggccguaggggaugagggugggguggggagggaguuuucugaucuacuuguccugaaugugauacugcccccccacacacacacuccagcuguugucaguuuggaaaguguuccaugcuauacuauacaacuguauguuucuuuaucuaaauuguaaggcucuuaucgacucuugugugugugugugggguguguguguguguguguguguguguguguguguguuuucaugugcaugugaguugugaguucuggcacauaugcagcugugugcgugugaggucagaggacaaucucagaugugggagcucaccuucuacccuuguuuuaucuucccugccgaauaugcccgguuuacagguauucuccuagcuccacuucccacacuggaaaguuaggcucgcacaugugcaugugcuuuacauagguccugaugcuccaaacgcagguccuuauuuguacagcaagcaguacaccacugagcugucuucccaaccucgaggggcucugaaaaauuucuuaaagggcgggcuuggucauccagagaauccgaguuugguuccuagcacaugcaucuagaagcucacaacugggcugugacuccaauaccaggaagaaucuggcaccucugauggcaccugcacacacgugcacacacccccucacagacacaagcuuuaaaauaaaaaaaaaaaauaaggucuuagaaaucauguuuaaggcauccaccaccaaaguggguguggcgacucauguuugcaacguuaguucuacgaggauagcugugaauucgagggcaaccuaggcuaccaagucagccuuggacuauagggagagaacugccuugcaauuaauuccuaaggcugcuguggcugccauccucacaguuucccacuguuucuuugacauuuuggccugugcguuucaaaaaugucuuuguccucagcauggcucuaugaugccuggcccauagcagagaugcaggcuggaacaagggccagagguuuuuaaggauguuggcuagcaaaugacacagaagccagcuaagugugaggccucugaggcacgugcacuaagucauccgcugaguacagcacccccucugcagaggucuggggucccuaagaaggcgccagaacaccccugcaaacaccuuccuaccaaagggcuacacucuggccacguucuaccucgaucguguccucugucucuagaccucaaauucuucucuccuuaacacacaaggugauccccuucucuuccacgggcuugccacaccccaaaagagcagaguugaaggggggacucuugaaaagccaguauguacacaguacacaucagugcucccuagggccaaacggaagcagcaggcgcucaguucauucauucaacaagcacuuauuaagugcuucugguaugcaggccuauaaaaagguuucuccucuucacagaacaacaguggguguauaggaagauaaaaggugaaggucggccugggcuugcucauugcagcuaucccuccuuuugggggguggagggcaaggcacagcaugaaugaaccccaaaugacugacugauguuacucuugugggcucccuccuguaccacaggcuccucggaacaaucgggggguuccuggaagcaggcugaacagucacauucggcggagcccacagagcccucucagcugauugugucccggcagccagggucucggaggcgcaugaaugccccugaaugggcccauucagucugauggacaggagcugaaagcugcaggcacacaaaagccacugggcagccgggagggcuccagccugggcuuugcccacgggaagggaggccacccuaccacaaagaccagugugaagacgucucuguggguuuucaaugacacccccaccccggccgccaacugcagagaagugccccuacccccacaauggcaaccaaaggccuagagcaauccguggagaagcugcagaaauuuacauccaacagacaagccagaagacauugcucuuuaguguguugugagacgagggcuaugcugaaggaugccuuggcgaguuggucuuguacauuuguuagcagcauuccuuacacccacggugaccuuuaaggacugcagcugaccugagacuguuuaacaugucaccaaaaaagaaaaaaaaaaaaaaaaaaagaucuucagagggcauggccaauauuuaaaugaagauuugggagacggccuauucuugugucucucauuuggaauacugauguguguguguguguguguguguguguguguguguguguguguaaucccugagaugacacauauuuuuaaauaagaccaggaaggggagaaccacccaccuggaauucuuuucaccgcuccgggggaaggacagacuccacucugagaagcagagaagucuauucaggccaauauugaaaguucacagucaggugacuccuugggaacggauggcucuagccccagagagcagacagcuuuagaaacagccuccccaaagguaauuaaaaauagugccuccuuauaaugcaauacuauaaugagcaauuaagaugaaauuagugugucacaauaaaaaagaugcauggcauucuuagccucugcaacccagcaucggggacucauuggggggaggcugaugucugggaguggacaagcagcgguuucaucaaggaaagauuaaguguucagaucaauuuugugaacacucuaagauaaugugaaaauaccugaacgccauuguugcuuuuguuuguauucaguuuauuuucaaaauaaaagaaugauccaaacagauuuaugagggcagagaaauauuuauagcaaggcacugauaaaucgaaucaucaaaauucaccagugcuaauauuuagauguaucugcuucaaguccagggugguuucuguucguaaaaaauagaauuguuauggcaucaggugaagccaccucccauccuucugcacaaaacagacacacagccguguuuuuauagguucggcacuguuaucagacaguguaaugcuguuuuguguuuugucuuuguaauuugaagugauugcauagacauaggaaauguaaaagaaacacauaaagucccaggcguccuuuacccagcuugcccaaguugcauaaccaacuucaucacaugcacacaccagaauacugcgggagagauagcucaguugguaaagugcuugcuguaccaacacgaggacccggguucaagcccuagaacccucuugaaaaugccagguguggggcuggagagauccugaguucaagucccaacagccaaauggugguucacaaccaccuguaacgggaucugaugcccucuucuggugugucugaagacagcaacagugaacucauauaacauuaaaaaaaaaaaaucuuaaaaaaaaaaaaaaaaaaggccagguguggcuguggccguguguugguaaucucaggccuugacaggcagagacaggagucagccaagccuaagaaauaagccuaagccuagguccugaggggggagacagacacacacacaaacagagacagagacagauccugucucaagaugcaagaugggcaacuucugaggagugucugcacaugcgacuaugcacacauucccugcacacacaugagcaugcgccagcaaauacagcccuaccacaaaacccaggaugucgaugcugguacaucuacggugcuugcucagauuucauggauuuuaaaagcauuuuuuuaagaaagcacuucuacguauauauauacuucagcacgguuugaucauguguagcacugugccaacuccacaguagagacuugugauggcugaucucaauuguuagcuugacaggcguccuggcaugccugugggggauuauucagaacugguuaauuacgguaggaagacugacccacugugaguagcgccauccucuggacugaggucacagacuggauagaaaggagaaagugggucucuuuuccugauugccauaugaugugaccaguugcuucaagcucuggcuuccuugacucccccaccaugauggacugugaaaccccaaacugugagccaaaaccaacccucuuccccuuaaguuguuguuguggcagaguauuauagcacagcaacagggauagccgauagaaacuauaucaucacaaaacacccucauaugauacccuuuauggcagcaguucucaacauagguugcaaccccuuugggaguugaacaacccuuucauaggggucaucuaagaccauuggaaaacacagauauuuacaauucauagcgguagcaaaauuacaguuauuaaggagcaacaaaaauacuuuuaugguugggggucacaguacuugggagccugagacaggaaagucaugagugccuuaagguuuccacugcugcaaagagauaccaugaccaaggcaacuuuuauaaaggaaaccguuuaacugagguuggcuuacaguuccagaaguuuaguccauuaucacuguggugagcaggcagaccuggugcugggguuggaacuagcaguucuacauccugaucugugagcagcagaagacugugugccacacugcacauaguuugagcauagacgaccuuaaaguccaccuccacagugacacccuuccuccaacaaagccacaccuacugcaacuaggccacaccuuccaauagugccacucccuaugagccaggcauuccaacacauaagucuaagggagccauacauacucaaaccaccacaaugaguuugaagccagucugggcugccuuggaguucugccucaacaaaaaacgaaggaucgguguaauauguagccuuuuuucaugcacuauaauuucccugaaguucaucuauauuggugcauuccuuuuuauugaucagucguauaucauaaauaaccaccugggccuuuuucagguugugauuauuuugaaugaaggugcuauggccauucacagguguaagauucuaggugagcauacgggaagaaaacuuaguauuucagguauggacaguuacgacucucacuucacaaacuaucuagacuuccuauggauucucuguauuagaggaaaacuuggaaaagaacaaaggaaaauuccuuccuauaaaggacuugcuguguacaauauuaauuguaacaacauggcauuagcgaggggaucaauaauacacaacaaagaaaucagaaacaacccaccccuuccccacagcacaauaugcucagguuuaaguguguacgguguaaguguggaaggugugaguguguagguguaaguauguacggcguaaguguguaaggugugaguuguaagguguaagugugccuaagcaauucaauugccuuuucaacaaagaugcuucagccauuggaccaagaaaaggagacguaaucaauuucaaccuuacugacccacauaaaaacucacucaagaugggucaauguagggccaaggcgacuacucacucaguaaaaugcuugucuugcaagcagacagaccugaauuuagccaccccccaaaucuacauuaaaaacauggcaugaugugugcauguugucucagagcugggauggcagagacaagcagauucugagguuuccuggcuagccagccuagccuccucggcaagcucagacuaaugaaagacucugucucaaaaacaagauggggggcuggugaaacugaucugucccuaagagugcuugcugcucuuuuuuuuuaaaaauuauuuauuuacuuuauguaugaguacauugcagcugucuucagacacucagcagaggaaaucagaucccauuacagaugguugugagccaccaugugguugcugggaauugaacucaggaccucuggaagugcucuuaaccacugagccaucucuccagccccgagugcuugcugcucuuacagagaacuuuuacagaguucaggucccagcacuccuaucaggugacaccaaccuccuacagcacccucuucugccccaguauauaugugcauuguaacaugcauacacauacacaggacuaaaaauaaaaguaaauauuuaaaacaaaaaacaagcuggauagcacucacagagugucaguguuauccucuggucuccaugcaugauagcacacauauguacacauacgcuaaugggacaucauaaaacauaaacguaauguaugcagaguggaguugcaaucacagaacgcugaaggagucucuuucuguauccuccuuuuucccugcagccugucccaggugacuggaauuccauaguaggcagucauaucuuuggcuuaaggaaucacgaagacagucucuuugaggagagaaaaagaaucgagagcacucaacccugaggacucaggggauccaguccccuccagccggcagccacggaggcucugagaggaagugccaaacggaaagugagugugcacuagaagcggaggggucagagaggucacaacgcuaacccugccugccgagcuacaccuccuugagggaagcucugcacuguuucagcaucuggugcuggggauuugcuuuugggccuucaaacguuugagaaaucgguuuaucaucuccgcugagucagaagacgcaaugagagccaaaggagguggcaaggacacuuuccaagucauggauuugugucccaugauaugagggaugcccagaacagaaagaacgagaauggauguuuaaaucuaacaagugcggggucccaggagccccacagcugucauggcugacuugucucauggaaggggaagaggauccgauuccaacucugccuggugccccuugacagugaggagaaaucacaacagcucaggugauuguuuuguuuuguuuuguuuuuuguguucuuuggaggggaaggggaauaguccucauaugcauugcugaccaaaaaaaaaaaaaaaaaaucacuuagcagccugggcagggguggugcacaccuuuaaucccagcacucaggaggcagaagcaggaggaucucuguaaauucaaggcuugccuggucuaaaaguuccaggacagguaagguuucacacacgcacgcgcgcgcacacacacacacacacacacacacagacacauuuacugucccaggauaugagccucaugcucaaugaggcacagagaacacaguuugacgaggagacagggccuuaaccaaucuaggcuacagucagccagggaccuaacucccaaaauuaaacuaugaacaaguuuaaacaaacaaacaaacaaacaaacaaacaaacaaacacaccacagggaaaugguuucauagggaaagccuuugucuugcuagcauaagaguccuaguucaauccccagagcccacauaagaacccggccacggugguacuugcaugucauccugggggugacucgaugggagacggaaacaggcagauccccagagcucacuggcuagcuaggccuaccuagccuacuuagcaaaguuccaggucacugacugacuuggucucaaacaaaaagaugaagaggaccccugaggaccaacacccaaacaagacuguucucugauucccaaccuacacugguacacaucuccaccugaacacacauugaacacacacccacacucaacacaccaaacccaccacaggccacaaagcugcuucuuuguaacacccucuaaccccaagccagggacugccagagcauuguaacaccucagguagaaaccucuugauccugucgcucagaggcaaccucuguagaagauccacagcagucaagacgaccuuuccugcagcugguggcucuuucccgcagcucuuuccccagguuuccacuagaaggacucuuugcugaggguucccacguuccuaagcuucuggugcccaagcugguggugacugucaacucucuggcacuggucaccagugcacacuuucuugaaacuggugucucccuuagucucaaccccuauccugccuagaaacaccuagcuucauuucuuaagccgcacagaauucaucaugaagcuauugagauacugaacaacgggcgaucacgugcucugcggguggagucaaggcgcccagauguagacagaacccugcgcugaacuuugcuaagagaacucaaggcaggccgugaccucucugagccugagaguuuguuuccucauuucucaaauaccggagcagauggugagagucuuugccuugcagggguaagacuggaagggcaagaagaggugaguccuuuaagagcccagcgcaccuggccggcccuaagaggaggucacaagccaaaucaaacagaaaggcucugguuuugugcccagugggcucaggaagggcagcagaggccugaagggagcuacagugacaaagggacauggcugaccuccgccaugcugucccgugaggaagcuguccuccaacauccgugcuccgagggccagagaugcagacuucuguaaucaccaugacauacauguuugaacuccuaggggccacuggccuuggccugugaacugacacuuaacauuugccccuuguccucugauuucccugucucugggucaccuugaccacacgugaucccauaggccugucugacaaacuguguuuuccagaacaccaccucugccuaucuccuguugauccucagagacuggguccaugccuuccuccuagcugucagggccucuccugcccaucccaagcucagccucugacuggagcucccacccucgccucccucugcuucugacacucaaaucuucccuggcccucgaggaucggccagagacuuuucagucaggucacuuccucauucuugucaucagauuucuuuccgaaagauaauuccuuaaagcaggacgggcaagcuccacacaaguggcuccaguaggcaccccaagucaaagaccuacucuccccaccaacucuauucccucaaccuacacaggucucgaugggugacacucagggcuccccacacccccagucuuaucucugccuccuucacuuuguucaagccgugaccccugacccuacccccgccaggugagccuggaguucccauagcgaucugagcaguaauaguccaacccucugcccgauacauaccaccuccaugccaacccaaagccaacucgaacccuugcuuuauuuuacucgagacccuuuaguucuucaagcuuagccgugcugggagggaacacaaaaaauaacugaccaugccacagugacgaucccuuaacaucagggcugaacuacaacaugaauaaaagaauaaaccccauuuaggcuaguguuguaagggucuuagggucaggagacaacagugaugagaaaggacaccaagaaggaaccaucagagucaaauccauugugugcaagaacgacaagacuacaacuuacagugugcuuccuuuggcccaggauccgguggcugggccagagcaucagaaccauuucugugccugaggaaccugcuuguuuuaaguuauguguauguaucugccugcauguguauauuuguacaugcuggugaccuggagcuugugcuaugacaacugugagaugccccacggccccgugauggugcuaggaacuaaacucuguucucugcaagagcagcaagugcucucuaagaggggagccaucucuccagcccgagaugccuguugucgaugaccugcacacagaacuggacauucaguaaugguucuagccaugaucuaucuucuuucucuuuuggcaccuguguaugugucucugugugugcauguacauguguaugugucuaugugcaagucgacguccacguguggacauucaugcagaagccauguccagugcugauaucuuccucggguucucuauuuuuuggaggcagggucucucagugaacccucucaauuuggcucaucugaugcccaucaaggcccagggguccuccugucucccccuuuccagaacuaggauuacaggagcauacugcugugccuauuuauauauguggauacugaggauuugaacucagguccucauacuugcauggcaagcacuuucccaaaaaagucaucucccagcuccauuaguaagggaaaaguuggaauuccuuuggagaugaacuggcaagguggagaccauguuagaccugacucugugcugccuuccuaaguguggcagagacagugccaugccgccuuccuucuggacacaugaaaggccugcacugguccaguucccuugggguugaaaguggggucauugcacccacccucccuuugcucuccucccucaucgcuuagcuggaagcagcccuucagggggaacuaacaggcccuagggcaggguuucucaauggguguucucugggccagcugccgcagccacacggaaccuccuagcccugcaauccucgggcuuucuacaaugaaguaggacuucagaaaaauggagguuuuaggcuggagagaugacucaguggucaagagaacuggaugcucuuccagaggaccuggguucaauucccggcacccacauagcagcucacaacugccugccagacaggcacacauguagacaaaacacuaaugcccauaaaauaaaaauaauuuuuuaaaaaauuuaaaaugacauauuuucuuugucauuuuugaggugcacgucuuuuuuaaaaaauuaauuauuuuccugcaauuugcuuuuuuaaaaaaaaaagauuuauuuauuauauauaaguacacuguagcugucuucagacacaccagaagagggcaucagaucucauuacagaugguugugagccaccaugugguugcugggauuuggacucagggccucuggaagagcagucuuaaacacugagccaucucuccagcccugaggugcacaucuuaaauccuaguucuugggaggcaagcagucucugaguucaaggccaaucuggucugcagauugaguuccaggacagccagaccuacacagaaaucaaacaagaaagaagaaaaaaugggacaggggaagagaaagaaauaaauaugggguuuuggaaugugugcccauuuagaggccagagaucaaucaguauagguuguugucuccucggguacucuucaucuugguuuuugagagagucucucagugagcauagagcuuagcaauguggcucgccuagcuggccagcgagcccuaggaacugugcugucucugccucccauggccugugaguacgggcacacgcugcuggggcacacaauugcaugugaguucuggggcauugaacuuggaccuucauacuuacuuauaacaacuacuucugagcuaccuucccagcccaaaauuccucauccugggguaauauggagacuuacucagcgugaguaccacuguucuggaagacaacugaacuugagaaaggcuugagucucuguaccaaugggcaauaugcuugcuccauguuuacauugacuguaccaugcacgaaagauaaacuuuuguuguguuaagaagccuuccggaggaguuaucuuguaaaguggugacucugucccaacaaagccaacaauaaucacugccuuugaaucuaaaacacucauugaggccauuacuuaaacagguuucccggucccaaaaggcaggacaagcuccaagugcuagacaggcaggguuauucuguccaggcugggagagcccaugcagaauccucuauccacuucauucauucauucacagccugcuugguauguuaacaaugguugaagcggaagucacggaaagccaggaucagauaucagccagcugcugguguugacacauuccugccgcccucgucuccuggcgccaguucgggugcccgccacuucucagcuaagaguguucagcucuuccuucaggacuucagcucacaaagaaugaaugccagaguugccaggccugccgcucucgcggguuaguaguuagaacugcaaacccagccaggucccaggcugugcgagaggcuugcgugucuaucugacagucucgcucaguucugacaggacuugucaaacuccaccaucucucccuuuucucuccaccuucuucuuaagucccccucugcacccugccuugcuccucucccccugugacuuagcacucuguaucugaagugccgccaauguagccuuggguuucauggaguccguaggguuaacucacugccaauggcuucuucauugccauuggcagcuugccugccgcccuccccauguuugauucuugaagcuguggccuguguuuggaacacggugcacauacgcccagccuugggacaagaacacaugacauuuauuaaacugaucugccaaauguugccuaaugacaggccagcgggguacagagagcaccccagaagcacacucaggaaguaacugugcauguaucccaacgaccauagaucuuagacuuggcauggagccaacagguugucaucugcuaggacucagcauguucuaggucccucccuucaauauauaugucccuuugcuccagccaggaucuguuccugcugauuauuuguccccaaaaaagaagauucuugaagcuauucucugaauuacuugcuugcuugcuugcuuggugugugugcacgugugugucugugugugcgugcgcgcgcgcguguuguaugaagaagggguuuacacaugugugugcauguauguuaagugucuuuuauuggucucuccuuuuuguuuuuuuaaagacaguguuucuuuuuuuuuaagauuuauuuauuauuauaucuaaauacacuguagcuguauucagaucccauuacagaugguugugagccaccaugugguugcugggauuugagcucacgacccuuggaagagcagucagugcucuuaaccacuaagccaucucuccagcccaagacaguguuucucacugacgacugaucugaagaggcugaccggccaguggacucuggggaucugucguucucaauauccaaauucaggucuucaugcucacuuaauuaucugucuccugaguccaaucuauaucacuauguuagcccagguuagcucagccuccagagugcuaagauugcagauucgagucaccacguccagauagauuucccuggggugguuuauaguuuauugauuuacacuuagucuuuggcacuggccagacugcgcagggaugcuuucguauccuuacguaaauaugcaggccacucugucaguguucaagaacuucgucuuugggaaggcucgucucuagucccaccaaaauuacuaacaagcauagaaacaggacagcuggacccugagaucuguggaaccugaaaucacucaaagccucccuuagaaaccguaggggagaagcaguugaaggcuuugacaaaacuaugggagauggggcaaggggcacugucaaguguucuucucaggcugaggcugagaaucacucauguucagugccgacagugaagaagccauuggcuucuugcuguuuguuggcuguacaugguguugaacaaaucauguggccucaugauaguuccauuuuuccaucugugaaguggggccagcccuucuacggcugcuguacaugaagggguagacagauacuuggagcagugccuggagcccaggaaacaccccacgggucaucuguuacuuccuugcuuuggaggccaccagagggcaaguaugagagacuccugggagccagacgguagagacgaucacgcugagguuucauugagaaucgaaaagauuugcucagaugagagcuauuaggaaucugugagcgaggcuuggggagaccgcccaguccauaaagugauugcucuuuaagcaaugaugagugugaccccuagaacugacacuguuaaaaaagcuuaggauuggagaguggcaucagcauuaaugggcaaaucuggcucugccagaggaccuaaguuuaguucucagcacccaaguugggugcuugcagcugcaguuaacucuaggucuagggauuggaagcccucuucuggccuccacaggcacacaggcauucacauucagucuccacacacccuacccacauaaugaaaaaaaaaaaucauaaaaauaaaccuuaaaaaacaagaaaaaagaaaaaaaggccaggcaugggguagacuuguaaccccagcaguggggagaggaagacagaaggaucugagucaguugcuggccagccaagccuacagaccagugggagacccuaucuccaagaaaaggacaguagagacuggggagauggcucgguuauagugcuuuuuccugucuugcaagcaacaugucugaggacaggagucugcacccccagucccucccaagugcuggguagauguggcagcccaccugucucuccaagagcuuggggucccagcuagacuagucacacaagcaagcucuagggucuggguugugcuaaagacuccuuaugucaaccucaaccacuauaugcacacggacuacauacacaugugcauccacauaccgguacacacacccaugcauaaauaugcacacgcacaccacauauauacacaugugaaaaaacuuacagguguguggccacugaaaaugacacgcuuugacuuccucauggaugugcacacacccgugcgagucuguauccacaugaacauaugcuuacacaaacacacaagaagucuguggguggauucccacauauauaauggcuugguucuguccugccagagcaaauggacacacccaacaggcagcugggcccucggcuaccacacugcuaccccaaagcuaaccacagagcauuuugcaagccaaaagcuucaggacacaacacugaaucauugaacccacauuucugcccccccucucaaaggguggggguccuugacucucucuccaacugaugucuuucugucccuccugccuacucagcccuggagcuguucccgggaccuugcugagccauguccugggugguaacacccacgcaggauagccagacucaccccacacaugcagccauuaaaaauuaacuccagagaucuuuaaaagcagagaaagucaccagagagaaaggguacaaaggacagggcaugacuagagguuugggacauagcaucuaacaaguuuugacugcagacagaagacauuuuccccccuuucuuucagaaaaggaugagaaaucuuuuuuaugcauuugccaugggaaacacucagcucagcacauuccacaagcuaaaaggaggcaaaccaacacgauggcagaacucuccuaccagcccacaggcucucaacaaaccccugcacugccagguaagggagccuuucagccuccggagcaagggcugcacauaggcagaguaagggggcagucugacucugggacguuagccagcaucacuuaaauacucuacgcugcaaagaaaguuccuuuuagacacagggcucgaugccagucuuauuuauucuguuagguuuuuugaaggugaggguaugagggugggggacgggaccagaauccuagcgauaugacaguccagagguuuauuaauucuggcaagcagcagcaccaccuagaaagaguuaggaacucacguuccacccucucucccagcagcccagcacuggaggcugaccacaugugugaggccagucugauucagucuguauagugaguuccaggccagccaggagcugacuuagucagagcuugccucaaaaaguguuggaguggcgcugaagaaauggcuccauugguaaagcgccuguuaugcaagcaagacuuuggaucauaagcacucauguaaaaaauacacuggguaaggugggaguugauggauccccaguguucacuggccaaccaugccagccaaccagugaauucagugauagacccuaccucgaaugauaacgugaagaagaacguuugagggagaugccccguguugaccucugacuucuacacaugugaaggaaggaaggaaggaaggaaggaaggaaggaaggaaggaaggaaggaagagagacggggcaagccaaugagauagcucagcaggugaaggugccugccuggagccuaguaaccugagucaggacccacaugguggaaguagagaaccaacuccugaaaggugugcucugaccucagauggaugccauggugcacgccccugccacacacacguaaauaaacacaugugaugucuagaaaaauacauuaauucuuauguucauacccuuuagaaucaaacacuaggggcuuaaacucaauggcaguggggccaggugaagcugcaaagugagcccuaccuucagaugccuaucacaaccaucucaaagguucugaaaacuagacaggaugggugucaaacacaacgagaccagggcaucagugaaugcugcacuaugcucagguccuggagguaugaaaaacacuagcaugaaaaacacuggcaggucucaggucuuuaugucuaucaaauggacaaacauccgaaggcuggagagacagcucagcaguuaaucguacuugcugcucuuacagaagacccaaguuugguuuucagcauccacagugggcagcucacaacuaacugccucuuauuccagcuuccgggggauccaacacucuccccgggucucuucccacgcucgcaagugugcacucacacacaugcacacguauacacauuaaaaauaaaaaucaaucuuuaaaaaaaaccaacuagacagcuuucugaaaagugcuaaugcuaaaagucagcucucuggaagggagggugagcgaacguccguggacucugagacuuugaccccaccaucucccacacaacagucccuucuccuccaaaccuagccccucuuggaaaccagcacgcaggaaggauuccacagugacucgaggggagagacuaacgccucugucaacggcaagacugaggggugaugguguguggcgaggaaggaaaaggcccacaaaacaaacggcccuggcugccgugagaggaagcuaaaagaacagcccccgccccgcaacauuaggugaaaagacaggaaguucuagaaaggaugcaaagauguuguuuuaagccaggugguggcggugugugagccuuuagucccagaauucgugaggcagaggcagaaagaucccuaagaucgaagcuagccuggucuacagaaugaguuccagaacagccaagacaccacagagaaaccugucuccaaaaaacaaaacaaaacaaaaaaccccaaaaugcuguuuuguuuuguuuuguuuaaucccuucugacggauuaaaaucucgguccuuuccaggauaaacagcauuuugucuggcauauggagauguuucugaggcccccaaaccugguccuaccucaugauacuugaugcccccugcuuuuuccgagagguggggccugcucuccacagucuaugucacugguuaagauaugaauggcagucuacacuuuccacacaauugauugcugcaauccuaaugcccacuguagcuacaggguguccauauuccaggcuucaccuccaauacccggacuuaagaauaccagggaggggaaaccacccccaaauuuguacauauccucugguaauaacuauacaagauauggaugagucagaauauagacaaaggaaguagucaaugaaaguggauuuggggccugacccgcaaguaaucccaguuacucaggaggcuaaggcagagggauuacauaugcaaggccagcaugggcuacaaaguaaugcaaagcccauuuguacaacuuaccaggacucuguuucaaaaguaagagggucagggagauggcucagaggauaaagacaccugagaacaaggcugaccuaugaccuacacacacacacacacacacacacacacacacacacacacacacacacaauguaaggguaugguguugcucaguggcacugcucuugguaagcauguaggagggccgauauucaaucccugguaccacaaacaaaacaaaaagugggaugcuggacuguagguuaaucaucuuuuccucugucacauaaugugacagacacugauuauauuuuaaaaauuuaaauaaagccagaugugguggaccacaccuugaaucuaucacuugggagauagagucagacagccgucugugaggucaaagccagcuacaucuauggucuacguuauaguuuacauagugaauuccagagcagcaacaucuaggcagugagacccagucucacacaaacaagacaaauuaaccauaugguaaauacauuaagaauuaugggcugaauguucaugcuccuaccaccaaauuccuccguugaaaucuaauacgaccggaucuggagguggaaucuuugggaggagauuaagcuauggagguaaauccucauggcugaggccagagagcuaugcugccacgaaggaaugcagcagcagccagcagucugucaccaaugcaaaccauaccaugcugggacccugaccucuggucccccauccacccuucaaaacuguaagaaauaagcagcugguugguaagcuucuacaucuaggucauuaucacagcaagccacaggauuugcuggcuucucugagaguguaaccuacugaaaaagagcauuccgauggguugggaagggugagugagggggcauuacaaccaauuuccccgagacaacaggagcuggaacagugguucucaaccuuccuaaugguuacccuuuaauacaguuccccauguuguggugacccgccccaaccauaaaaucauuuucguugcuacuucauaacuguaaguuugcuaccgucauguaaaugucugauaugcaagauuaucagauaugugaccccugugaaaggaucauucaacccucgucucccaagaugggucuugacccacagguugagaaccacugaggagcgccugcacuguggaaguacagacacaccggggcagcggcggcagguggauccaguugguggauuggagugguuaagagcuaaaaaaaaaaaaaaaaaauugcccauuaguggagcuguccaaccucagaguuaacugccaaggcccaagcuccugaccaggaucugcgguauguggaggagaggaaacuggauggucaucuaucuaucuaucugcaggaugugugugaacucaggggcuuccgaacuuaacagacuacacguuucaaccuggccagaccucccggugcuccggcugagaggagacacacuagagcuucccgugggaacuucuuuuggcucacagagagcuggggugucugaggucuccuccagucucaagugucccuacaaacgucauuauuuuccacuccugcaauuccgccuauaucauagcaaauguaaauaacugggcauguuggugaaugcccguaaucucagucucagugggacaggaucaagauagccugggcuagacaagaagaccuuauuaggggacagggugguaguggaggggagcuaauguuuaugaggugcaagucugucuccaugggaaugaaugccccaaccagccuucuaaucccucccccuaacuuuaagaaaccaucuguuuaucucuuucucugcaggacagaaaagccucugcugaccaugucuggugaugucaggggagaacggcacaggaaucucagccucccucucccaacagucagaaguuccucugucagccuggcucaaguuacaucaccucuccuuugccagacuggggauuugcucuuccugcccuucccagcuuccuauuuuaauuuccuuuuauucucuguucaccacugacucugcagacaauaaacagagacaaccgagaagcagugaaaacacucuauggaguuaccugcuaauggcagaucacccgaucaccaucgggaaaucagagguugacaacuggacaaaggacgaagaggcagcauuguuauccacaggacuuguuaucucaagucccccaacucuaacugccaagccucuaggcugugaccccacagggaggggagcuuuugccccaggggcuccuggcagccugaagacauucaaaaguccuguuuugcagggccgggcaccuguuguucuaagaggaaaggaagucugugguuuauguuuuuaucagaauucagggauuuuuuuuuucuagugaggucagccuugugcuuucagaagcaauaaugggaguaaaccaagcuuggcaaugauuuaaaccugauccccaccaccccgccugcacagaccacugcacacccaagcaggagcucccauucacagcucccauccucuccaguuacauggcaaagggcucccaacucccagacgcugagccagccagcauucacagaaagccacagugaauggugcaggacaggagagaggacauccugacaucacagcagacugaagacaaggcuagaaagaagaggggcuuaaggggacucugcuguuucgugaggaagcucucagguugcaaggucaaccauuuauacuugaucgacacacagaaacacaucauagcagaccagaaagacaaugaccuagguagacguacccgcuaucuccagagcauugcaccaacugucaggguugccuccauuuuuuguaaaacucaccaccaacaccaagcauuucguuacauuucagauggcuugcuggugauugaaagacagaaaaaaagcccacagguucauugacaagugaauagauaaacaagacucgguauauccguccacgcaguggguuaauacuuggucauaagcaagagaugaaugcugaaagaugcuacaacacagauggauguaccuugaaacaucacgccacauggaagaagccgaucacaaagacccugugucuaccugggauaagucuagaacacagagaaaaggucgggggcaggagaaacgggaugugacuaccaaugggcugaugacaaugucauaaaucuagaggguaguaauggcggcacaaccuuucgaaaaccacuuagcugaccucaugaaaagcauggauuuuugugguaugcaaaucucaauaaauuuauuguuuaaaaacugacuuggagcuuuucuaaaugcaaaacugguccccuguuuguguccaguguauauggguuccauuuagucuacauuaacaauuaggagguaguuuugagcugaguaaaacaaugugugaccgcacccauguguacuucucaacccaaccuucucccgaggucucccguggcucucuuugccugucucugucaaucagaaaagaccagcuccugcaaccucaccugugucuuguaaucccauagcucaggcaaagacaggcccaugcauguuccgauggacaauugcaggcaccugggccccuaugcuugagaagagagccuuguuauauuugccuuuugggaggaaaauuugcuggauacguuuaauuuucuccucuggaaucuaagcuuauaaggcacauuuggauccuuuaaaauauugucaguuaggcguaguggcacacuacuuuaaucccagcacuugggagaccaaggcgggcagaucucugugaguuugaggccagccugguuugcagagugaguuccaggacagcuagaacuacacagugagacccuguuucaaaaaaaaaacaaaaacaaaaacaaaaaaaaaaaaaacaaaaaaacaaaaaaacaaaaaacaaacaaaacaauauauagucucugcuuauguauauauuuuaaaaauuccauugcuuagcucacuugguagcaugcuugucuagcacaccuccagcagagccugagcacacuuccagccccgagccugagcacacuuccagcacucagccugagcacacuuccagccccgagccugagcacaccuccagcacucagccugagcacaccuccaucacucagccugagcacaccuccagcacucagccugagcacaccuccagcccucagccugagcacaccuccagcccucagccugagcauacuuccagccccgagccugagcacaccuccagccccgagccugagcacaccuccagcacucagccugagcacaccuccagcccucagccugagcacaccuccagcacucagccugagcacaccuccagccccgagccugagcacaccuccagcacucagccugagcacaccuccagcacucagccugagcacaccuccauccccgagccugagcacaccuccagcaccaagccugaucucuaagcaccucugaaaaacagagcagcgcacaccugaaaccccagguucaaggucaccuuaauuauacaaugaauucaagaacagccugggcuacaugaauacgugaggcccuauuucaaacaaacaaaaaucucuugggcaaccacuaagugccugguccugucugggugcugggguggcacacugaacaagccucaguggaggugacauauagcaaaugaggcaaaagaugaccccugguggcagaagggugcucuaaauaaaagagaggaggaugaagaagguuggggacaguuuuaaguaguguggucaugagggaggagagguuacugagaaggugacuaugaaccacaggaggcaaggagagggagggagcaugcugcuauaaagaagaaugucuuaggggaaggacagacaaguacagaugccugagagagagaaaugugugccaagggagcuugggagcaggagaugggcucagugguuaggaacacuugcacaggagccgaguucaguucccagcagccacauuguauggcuuauaacuaacugucccauaacucgcgcuccaggggaucugauguccucuucuggccucuuuagacagcagcauaaacaugccauauacuuaaacugacauacacacauccauaaauaaaacaaacaauuuaagaaauuaaugauagguugggcacgguagcacauacccuucaucacucaggaugcagaggcaggcagguuucugugaauuugaagccagccuagucuacagagugagcuccaggccagcugaagccaauaaauagaugauagauagauagauagauagauagauagauagauagauggauggauggauggauagauagauagauagauagauagauagauagauagauagauaggucaagcuaaaaaccagugaggaugcagaggacaaaguggggagcagggagcucagacagagugguaagggguaagguccucucuagcucagaugagggaagaaaggcuaucccaugccugcaacaagcuccgaggccugucucaggacugguuugggucagggccucucacugaagaaggagcuuaacugccacgcuggcgggcaguccuggagcuucugccucuuucuaccucugcccucugcccagcaguggcauggcagauguaaggcaugccuggccuuugugggggugcucgacucagcaacucaugguuggaggucagcaaguaaaguggagcaagcacugagccugcugagccaucuccccagaucugccucuuguuguuauuguugcuugagacagggucucaccauguaacacugacagcaaacucacuauagaccaugguggccucuaaggcauagagaucuaccugccucuaccccugggagguggagccacuggcagccacuggcagccacgggcagccacaggcagcucuuugccacagcaggagguugcaacgcugcuuuuugaggcagcucuuccuagcauccugaaacaauccuuccaaugucuauaaaaccuaaaaaugcauucuuuccuugacaagaagacacaaaacucaugacgcgcugucccuaggcaggaaacuccaaggucagucucugucucugaggucacucgaccucuuuccuguaagcaacuccagugcgguagccacagcaggguccaccauaccugcugcucacccggcuucccccggcccagggaagggacaaguuuucagagucacuacuggacgggucaacggguguuacuucucuuucuuggcauacucagaacuaagaccuaucugacacagaggcaacucuagugacagaggaggaggggaagaggaaggagcgcacacacccucgcuucgugauuuagcugcagaaggcaagcugacaggacagacaccacacacucugggaaccacggucguugagauggcgcacgcgcgcgugcucugaagcacaggcauggcccuuugcuccuuaaucuguuuguuuugucuucuauagcccaggcuggccccaaacucauaaaguagaccaugguagccuugaacuccugauacccuuuguguguguguguguguguguguguguguguguguguguguguauaccacaacaccaagaacauuuuuuaaaaagaaaaggaaauaaugagggugggcuuuguggugcacaucuguaaucccagccauuugagaggcacagaauaucuccagguuucaggccagcccgagguacauaaugagccugugacucaagaaagcaaaacagaaauuauagcaacagcaaugacaaaagacuaauaaaaauuaaaauucccaaucgcucaauuucuuucuuucuuccuuucuuucuuauuuacuuauuuauuuggguacaaggucucucuauauagcccuagcuggccuggaacucacucuguagaccaggcuggccccagacucucagagaccugccugccucugccucccaagugcugggauuaaagugugccaccacucccagcucaauuuucuuuugaagaaaaugcuagacuugguacuucugagaaggaagucaaucuguggaagauacugacucugcccaagcccagacagcgcagcagagugaggguaguucccucacaucccaagguggggguggggaggguacaugcaacagacaagucggcucccuguuccauagccuuggcaacaagggcccucaggaucugccauccucacucugaaguguucuagucugucuccucuccaagcucaccaagggcccaaguugcaguugaaaguggacuucaaaguuugcauuugaaggcugcuuucaacugcaucagcucucaguaauaauaccacaccggggggccgcucagcaggccugccacagugguagaguucucucccacagacacacagugaaaguaugaagucuagcaaguuguucucugaccuccaugaguguuaccuccauauguacguguucaugggggcgcgcgcgcacacacacacacacacacacacacacacacacacgaguaaauaaauagcaaauggauaaaugcuuuucuuuuuaauuaaagaacaaacaaacugccccucaugcuggcuggccuaguuccugucuuggggaucacaaaucaccuuugccugccgaguuccucugacccccaccuacccagacuccgucuccuggcucacagucuggcuagauccgguagccgaagaaacuucgguuugcagcagauugaggcaauuaccaaaagccacaacuggucaagcugcacaggacaacugagcuccagaugccagaccccagcagugugugacacugacucugcaacuacaaaaucccaacaaccgcggucaccuaaacaagcccugagcagugauaacacggugacaggcacagaaaugcagaugaaguucucacaaggcugcaugcaccccuagauggagagcugcagguaucaauggcugcccagagcaagaagucagcccuaaaauacaaaggagccaccacacgaaaugaguucagcaggcuguauuauaaacgugugcaugacaauaauuaaggacuagggcaugaacuggaggagagagacaggggugggagggcuugaggaacgggaaugauguaaauacaguacuugcggaauucuuaauaaacaaauuuaagagaaaaaaaccucuggcaacuagggagauggcucccugaguaaugugcuugcuguugcuacaucggugugaggcuaagcaggcaaugguugccuaccuguaauccugaccugaaggaagaggagagaagauccccagagcaaggauacccaagugggcaaacccuuuguucaagugagagagcugccucgcuguggacaugguggagagugacugcaggaagaccccucccccccaaggccaaagccuuucuuccacacacaugcaugcauacacacacaaacaugcaugcauucacaccacacauacaugcauauaaaagagagacacggaguuuuucuuccaauucugaucuuucauuuaggucacaaugaguuuaauugucuaacuauaucacucaagcaaaacccaaaccaccaacuaacauccugauggauggucggugcucuuagcauuccaggcuaaugacucuguaauuauaaaucccagcccucucaggaagagccuggcacucuaggacccaggccagugguguugacauucaaugcagggagcuggcugugucugucacucgaugcagggagcuggcugugucugucacucgacaaguugguggcacaguuaugcagcagaggacagaaagccgcggaacacauagcccuugucccacccugguuauggaaccaagaccuccccaagggacaagcagauaaaugauacauaucuguuauaagcucaaggagaaagaaagccggaugugcgggcugcgaugcccacagaagaacaaucagugguggaggccaacaugguuaggcagggggccagaugcuaaacaagucagaaguuggugcgcagugagcguguggagcgcgugggauaagaagcuacugagugaaggcacuggguagaaucagacagggaaggccugcagaacugguuggcggaaccucagagcuggugggaaaaacuaaaggagcgaccauugguuucaaaauacugggaagguggaccucauccuagagcuccacagaagcucaauggacgaagcagacaggauguucucaggcacacgucuguccuuggggugccgugucuggcuccuugaucacuuuuagcuccauacccuccguugauaaccugcaguugugucuaaacccagcuuugcugggcagaguauggugcucaugcuggggggggggaugcagccccccugccugaugcuaugcuucccucuucacccccgaccguccugucuccuuggcuccguggguccccucggggagccuuagugccaaacucccuugcuauuuuuauuuauuuauuuuucccccuuccuuugucccucuugcuccggcccauagguuuuuuuauuuguuucucauuacagaugguugugagccaccauaugguuguugggauuuuaacucaugcccuccggaagagcagucagugcucuuaaccacugagucaucucaccagcccuuuuauauuucuuuuuaagauuuauuuaaaguaugugaguacacuguugcucucuucagacacaccagaagagggcaucggaucacaucagaucucauuacugauugguggguaagagcacugacugcucuuccaaaggucuggaguucaaaucccagcaaccacaugguggcucacaaccauccauaacgagaucugacucccucuucuggagugucuaaagacagcuacaguguacuuacauauaauaaauaaauaaaucuuuaaaaaaaaaaaaaaaaaaaaggugugugccaccaccgcccggcauaaauuugccuucuuuagacaguuuuaaaaauaacuauuucggggcuggugagaugacucagcagguaagagcacccgacugcucuuccgaagguccagaguucaaaucccagcaaccacaugguggcucacaaccauccauaaugagaucagacucccucuucuggugugucugaagacagcuacaguguacuuacauauaauaaauaaaucuuuaaaaaauuucauauuuguauguaaguucagguguacgcaugccgacggguguuuggagaucagaggacaacuuucagguguggguucuccccuucugccuuguuuguaggcagauuaucuccuguuuuuccugcuacuuccagcaggcuggcuuucaggcgauccucccucucugggccucccaucuuaccuagggguguuggaauuaaaguuauacacuccugcaucuagcugccuucuuucagggucuccagagaucaaacucagggcacuggauaugcaguugagccaucucaccggcccuuagcacauuuguaguuaacaacacauuguuaauuaucaguacaauauuguacaccagauguccacaccuuauccugugugacuguaacuuacaauccauugacuaacaucuccccacagcuuccgcuccuuacucucuggcaacaaucaucugccuacaucucgcuucaaauuuccugauuuaguguccucauacaaguagaaucacacaguauuguuuguaugaggcuaguuugcuuguaauguuucagggucugaucgagagguugaaucguaagagcucuguugugagcggcugaugaugauaguucacugugaguacacaugggccugcuccuccagagacagacaccuacaucauuuccacagcuuggccauugugaauaaggcugcagugcacaugagaacauauaucuuccugggauucagauuugaauauucuuugggacagauaccccguggugggacuguuggauaaugugguagacuuaaugcaugcauuguguuugugucuauguaagcuuaugugcaucacaugcauucagaugcacacaaaggucaaaggucugcuggaacugcaguuacaggagguugugggcugaccagugggugcugggaacggaauuccaugcaagagcagcgggugucaacgaccaucucugaccuccugacuguuuugucuuuccuuuuccaugugucuaucuuguguauaagggagggggaugauguggagggcagaaugagggaggggggaugauguggagggcagaaugagggagggggaugauguggagggcagaaugagggaggggggaugauguggagggcagaaugagggagggggaugauguggagggcagaaugagggagggggaugauguggagggcagaaugagggagggggaugauguggagggcagaaugaggggggaugauguggagggcagaaugagggagggggaugauguggagggcagaaugagggaaggggaugauguggagggcagaaugagggagggggaugauguggagggcagaaugagggagggggaugauguggagggcagaaugagggaggaggaugauguggagggcagaaugagggagggggaugauguggagggcagggaaccgcugacaggauacacauugaugacagucgagaggaaacaugcggcuggagcaggaagcagagagaguagaucuuuuuauugugagcacaaggcugaaaaccacuagggauggcaggaaguacgccaccccaagugacagacuuccuccaggaaagccacaguucccaaaccaacccaaacagcgccaccaacugagaaccaaacauuccugagauuggagggagggagggguauaguccauucaaaccaccaggucuagcucccgggccacuuaagucucuugacuauauuauaaugcaaauggcucugcuccgccuuuaaucuuucuggccauuuaaaaauccaaaaucucuucugcaguucaaggcacugguuuaacuggaauccccuggaaacucaaaaaagcaaauuacauauuuccgauguacagugggacugaauuuacaauaccaucccagaggggaggaacugggggcagaaugaggaaauacugagucaaagcaagaccaaaacccaacaaggcaaacaugaaauucucuagcucugugcccagugucacucagccugacuggcucuauccuccgagcagugcacacaucucucuuugguugguuucacuccccacgugcagcucucuccuucacagacaucccacagcuguaagaucuccaacacaacccaggauucacuuccacagcuuuggggacucuaucagucucucaaggacucuuacccucucacagccuuuggacagggaggacccugccauacccagccugggcaugguggcuuuuugaaaccaugcagggcauuuccauuaucccuuaacuccuacauccaucuugaaucuagagccaagugucaccgccaaguucagcucccaguuugaaauggccccuggucccuugaaccacauuggcaauggcuugcgugcaaucgcuuuucaggagcagaaaagaaaaugccuuaagcccuuucguaagcuggaagcuuagcugggcagggucuugcccuucccaucacuccagcauuugccuccuugucucuuaggacaagcuuuggcugugauauuaacucggugguguccuuguucucuccaaauuuuguauuucuuucugccccuuuuuuccauuguagaccuggggaaaagugguugcugauaaccacaugacagagucaacaugaggcugccuugagaucuccucagucaaagagauuaguugaucacuuuuaaauuuagccucaaacaaguacuuaggccaagggcagaaggcagccaauuugauaagauaucacaaacaagcaugguuucuagcucaguuacuaauacuguucccucagaaacuucuugugcugggccucuauaguccacacuguucucagcacuacuuacugccuucgaggcuucuaauaggcccauuaagcuccugcuuacagcuuuccuaguucaaaaucuuaaaguuuuccacauuuuaccaaaaaacagcauggccgggcagucccagcaauaucccaccuucuacaucuguuauuuucuauuacuaugauaaaagaccauaacuaugauaucauuuagaagaagggauuuauuugggcuuaugguuccaaagaaauaaaagaccaugacaacagagaggaggcuuggcagcuggaacaggaagugggagcugacaucuuuuauguauaagccgagagcacacuaggauuggugggagccuuuggaaccucaaguccuguccccagugaaaacacuuccugcuucaagcauaccuccuaaaccugcccaaacagcgccaccgacugaggacuggauauucaaaagcccuaggguuauaggaaggcaccucauacaaaccacaauucccuaacaaguuggcuuugagaagccaugcccuacugcggagccucaguacacccaaguuuugugcauggccaggauggagcagaaucccuggguaaccaccaggccuaucagccuaucaccuuucuacaacccucacaccggcccacacccugcaggggcacaucucuaugcccaccccuacccccaccgcaaccuccuaucucuguggacccccucccuaaaucccaaagugcuuugcaugugugugaggucacaguggcccccaagauagcuccagguccagacuguagauuucuuagcccagcccggccgccaguuacugucuccagcccgaggccucaagggcagaugacucaggaggcagauguucugagcgccacugaaccuggaggccauaggguaguuuaauggguaugaaaagaauucgcuauacuguuugccucacaaagaaguggguuuuuuuuuuaaagauucauuuugucuuccauuaugcguauauguguaugcaagugugaaggccggcguaugagaguucagaaaaggaagucagaaccccugguguggaaguuacccagugugugugcugggaaccaaacuugggcuuucuucaagagcaguacacaccauuaaccuucagccccacaaacugguucuaaaacagcuuguuucauugacugauuaugauugugauggcuaacuagggugcaugcgugugugcacguacacacaguccuaaggagcccaauugacgaucgagacuguaacuuagaauaaacuccauagaguuauuagcuaacuagggccacagaauaucugauaguucaaaggaagccuggguacucguaucaaaaugguauuagauguauagguuaaaaaucuggcauuaugaaggaaauacgaaagaaacacugugaaauguuguuaauaaaacucucccuguagguagccuaaugugaugugugaaaauguuucuagagucacuugacccagaaaauaaaucaugaaauacauaauauuuguguucgcuuuaagaacacucgugaaacggccuaguccaucaguggggcgcauaucuaaagagccagagucaccaguaucuaaagaccccauuuugucauuccaauaaugaacgggguuggcaggggugacuaggucuaacaguggagcuagacacaaggucagugaccaaaaagaauguagacauuuuuuuggauucuuuggcuuaaucaugaugaagagcgguguugggugcuggagaagguaagagcacuggccgcucucccagagguccagaguucaacuccaagcucccaaguggugguccacaaccaucuguaauugucacuccagcccagggaccugacacccugcucagagcaugcuccugggaccugcgcaggagacacgauaagggacauaggcuuuuggacaaugcaggggcuuuuggaaucuguggauaauggcccccaguucagcuggggaggguuccuuuuuaauccugccauucaaauauucagggaggaccucagcgcuucacgaacuuggcugccuaucagaagccccuagggagcuuuuuaaaaauuccagcgaagccugagccccaccccagcccaacugaaccacggaucuucgggggugggggcugggcacgagcaguucugaaaagcuccccagaugauucuaaugugcaguccgggguugagagccacuggacccucugaccuuugagggcuuuuuucccucagaaucuggagagagugcauuucuuguuuaucuuagugguucucaagcaugccccagggcugccuggagucugguuuccuccagguucaguuuaaggcacccuuuaugggaacuugaguagaggaauagauguaugugugugugugugugugugugugugugugugucugucugucugucugucugucugucuguacauguaugcacagauguguguggaggucagagguugacguguuccuucaguugcuuucaccugauuucauaagacaaagucucucaucauugcugacuuggccauugagcccugaugacccaccccucgccacauuccccugcgugggguuuugcucuuuauggccugagccaucuugaguuccuggaggaacaaaccugaugaccagggcuugggguuugguggcuaaaaaagugaaaaaugcccuacuuucauugaaagcauuaacucaguaaacucuggcuugccaugccaggcuuaccuagcuagauuaucugucugugucccucuguucaucaccaggcugccacuugaacucuaacuggacaugagccuguaacuccaccucuggagacccagcuguguguagcuccgucaucuggcuuaaguguuauagagugaauggaagccaacccuggguccaggguggacagcucauccugcuaucacgggcauacaaaagcacaggucgggaggggcugcuucucugaccccugugcuucuuccagacagaacaugaugccccgagaugucuuccccuuccucuugggcauucauccccaccccagucagucagucggacucuggguucggggaacccaccccucacuccagugcaucucuccucacucagcccagagcccacaucucuccaccuuaaaggaaacuacagagugcgcugacuuuugauguccuccugcaaggacugaaccaaggacccaaauuuaauuuuuacuguuguugucaggauucuauuuguuugagacaucacauuucacugggcuaggcugauuuggaaaucacuauagcucaagcuguucuugaacuuauagcaauucaccugccucaggcucugaagugccauaauuauaguaguaagccauaugccagguuuccagauuguauuuuauacacucuauuuaccuuaagaaauguccuaguucauguauagcuccaaaccaccagguaagcugaauauggcccaggaaaucaguagcaacaaauuaauccuggagacuccacaguccacaccucauucauccgggccuccgucaguaacgcaccugccaccaaagccugaggaccugaguuuagauccccggggcucguguaaaaagcaaggagggcauggaagcccacgccuguaaacacagagccagugcaucaaacuccaggcugcugagauacccugccuccaaaacaaaaaaaaaaaaaaacaaaaaacaaaaaaacaaaagaacaaggcgacgagcccaaaagagggcucacugcuguaaggcgcuuguggcccaagccugauuacccaaguucaaucccuggauccuguguaaaggugagaagagagaacugacuccccagauuguccucugaccucaacaugugugcucuggcaugcauaccuucccccauauuauuauuaugcauaauaauaaacuaauuauaauuguaaaagaaaaagaaggcagagaacaaaugaagauaucacaaugcuggcugauggccuccacuugugcacacaugcaaacaccaugcaugagagacagguagauagauaaauaaauaaguaaauaguggcuuagguguguggucgggaccgguuuuggguuuguccuggaacgugugguaaucaaucaucuugccccgcccccucagucgcugagagaacaggugugcgcaccacaucugcuccugagcguuuuguuuaacucauccuugccccuccggcacucuguagcuguagaaugacugccaggacagcauucacagcauccauuuccuccuacagcacacaguuuugaagcaccgagguagcuccaggaaugugggcuggagccgaaccugcaggugaacgcaguguggacccuggcuggggggcggagaggaggagccccggggccagggcugauugggcuuuaaaaaaaaaaaaguauuguuuuaugugcacagauguuuguuugcuuuaugccuguacaccaccagaagaaggcauuggauaacccccccccaacuggaauuaauuaaugaccauugcuuugacuccagccaggguccucugguagagcaaggaagucagugcucuaaacagcuucuagccucaguuuugucuuuguugaaagaguggcugucacccugcugagagggacuucggggcagaagaguuguaaaguggaaaggaacauggggacuuucaggaacuugggaguuggccuuuacgcuucauccuacacaguagguaccaagggaauuuucaguguagaaacaaaaacuuggguagcuuguuggugaguggugguuacaagcguuuggaucgugauagugacgugaaucuauguuuuguaaaucaaaacccuaucuccuaaaaauguucaauuuucuuuuuacuuuuuucuuuuuuguuguuguucuuuuguuuuguuuuguuuagguuuuuuugguuuuuuguuuguuuguuuaguuuuguuuuguucaagacaagguuucucuguauagccuuggcuaaucuggaacucacucuauauagaccaggcuggccucaaacucagaaauccaccugccucugccucccaagugcugggauuaaaggcaugugccaccacugcccgguuucaauuuucuauauauuaauuuuagaucucuuaaaagaaaaacuagacuuuuaaagacuugacuuuuuuuuuuaaacgggguguguuugucuaccugucuguaaugaaccaccagugcaucgguguccucagaggaaggaaggcgaggguuuagaagcucugcagcaagaguuacaggcgguugugaacccugagcggagcuaggacccgaacauggguccucugggagagcagcaagcgcucuuaaccacucacgcgucucuccagccccugguuuuaaaacuuuaacuuuguauagauaugugagggugcagugucuguggagaccagaagagugcaucuuggagcugggguuacaggugguugcaagcagccucacccacgugggugcugggaaccuaacucggggccucugcaaaagcaggagccacucuuggcugcugagccaugucgccaccacucuguccccagaguuuuuaaaucaagaaaaguguuagcugaaggcaggccauaugacuaacauccccucucuacaugcgugacagugucucagggagcacacgcccuuucccagaaccaaggcugccgucugcccuuauucagguccacaggcucugagcccaaagaaccacgugaccaagucagagaugagggaacugagagcacugggcagcaauggagacucucgaacaggcagcaggagaaagugacagggugcagacccuguacagacagcugcaggauaaggugcucgcucgcuguggggauggacaggaaaaggccagguacuuuacuucccaccaagcagcuccuugaccaagccuucccggaacccugggccaggaaagccugacuaugaccuuuuucaggcaggucaaaagcgaauacgcugaaaaggacagagagcuagucagcauccauggacaaaaggcccaaacucuccucuucacacgccaugcaaagccucugcagggccgacagcaaggaaggcccuucuagaucuccagcacucugucaaaagccaucacucggcaggcaggcaaccacaauguagggaagaccuguaaagccuucagagaggaacagcuggcagccccugggucacucagaguggccaacagcuacucuuguggagacagcaggaggaggccuagacuauagaaggauggaggaccuguugcugaagucaaggguuguccuaggagcugcugggucagagcagcaccugaggaccagagacccaagagcauccaucacagcacagagcacaagaagucgcaggaacaccaggaaguguaucuugcgugaggcuccaacucuugccuuccaggaauccccucuuccugaggccaagcccacuacuauuuauuuagacaagacuggccccaccuuccagggcacuguaaacccuccucaccacaaagcccaauugugcuuccaagggccucucagccaacucugagggaaaaaaaacggcccaaggggaagacaucucguggcacagaugaaaagcacgguuagauuuaaacacacauuucaacaauaagaaaauccuccucauuacaguacagcauaagcuucugaagagggacagacagacagacagacagcguggggugugggaagggcucucgccugugucaugccagaggcucuaugagugagccggcaccacggguauuuuaaagcauguccaaaggaccgggcuccacaagacaccucacugagaggacaaccggcaugcuauuccagucaguuauucacuuacugacaaccacagaaucaguaucuuaaagcaggacauguggauggaagacagagcaagaguagacagugcucgaacuucccuccuagaaaggagacaggaaacuucacuaucccccacucccaaggggaucgagaaaacacuuaaucuaaccuaggcuagauagaguuugguaaccgaaacacaugcuuguccuuaggguagaggugagaacagggcacaucuaaaccgucucauguuuuuaaaaagcaugagaguuuuuccuugcagcguguuacaggcuucagcugcucaggagauaccggauagggaagcucagguuggggguuccaaagaccguucagcuacccucaguccccugggcuugucugugggcucacccacggcccccuugcugcagaauguucuucucugaccucagaacagcguucuacguuuccaggccucucucuaccccagaaguuaccucuaaaauucauguucccucucuucauaaauggcgaguaauuauacuaauuguccucacaguuuacuaaccccaagacugguaaagcuaccaaggucucuccauucugcccugcccaccccccucacuuugcucccucaguccccugagggcaaaugggccauuguuccagcuacugcuccucaacagaagguccagacaccuucuuggcaaguaucacagacacaccagagccacccugugggugagggccaaagcccagcacccccaaagcucagacaugaaugacccauaucggcaauagagccucagcacacaacaacauacuacguguccaguugagcaucuuuucuguauagacuacacugugcagguucacagaagcuaucaugggaugugacaccgcauaguaagagcugaguaagauaagccuggaucugaaugaagucuucucccuuccccugacuugcugugagccuucagguagggaugcugaccucucugagcuuugauuucaucuugaguacaaggauauagccuugguucccacuacaggggucuuucugaggauuaagugaagggaugaauagaauauucucugggccacagaacagagaaaguguuaucacugaaaaaagugcucagagacuugggagauggcucgguugauaacaugcuugcuauauacauagaaugggaacccaaguaaaaagcuagguggagcaucugaaauaccagaguuagggaggcaggggugggacuucccuggagcucacuggcaagcuagccccuaaccccaacccccaaccaauaagcucuacauucagugagagauccuagauccaaaacuaagguggaaggccaaccaggcugcucaguggguaaaggcacuugccaccgaaucugaugaccugaguuccaccccuggaagccacaugguaggaggagagaacagacuccugaaguuguccucugacugccacaaauauugagguaugugugcaugugugcgcacaugugcauacgcacgcacacacaugcgcgcaugcgcauacacacacacacacacacacacgagagaagcucagguccucucaguagaggggucaguagaggaacugacaggcuucucaugagcugccucauuggcuucuugucacuuaaaggucucucccccucgcugucuuaaagauugcuuagcauaagcauccuuggccucucuccuagcuagaugcuacuaauaugucuccuccacaagauucugagcaucccaaaucucuccgacuuuaccaaagucugcuggggcguguccagccaucgaaaacaaugcgagggccgggcgugguggugcaagccuuugaucccagcacuccggaggcagaggcaggcagaucucugaguucaaggcuagccuggccuacagagugaguuccaguacagccagggcuacacacagaaacccugucauaaaaaaaaaaaaaaaaaaaaaaaaaaaacuaugugggacacaagcgcacucgcacagacuaaagugacacacacuaauacagagaagaguaaauaggaugggcuggguuguagcucaguugguagaaugcuuuccucacuugcaugaggcccuggguucaauucccagcagggcaucaaccaggcaagguggcacacacuuguaaucgcagcacgccaagguggaggcaggaggaccaggaaucaggaugauccuuugcuacaggagacucucgucucuaggcgggggugggggucaguagaggaacugaauuuccauguauagaguccuugaaugcacucauggaaacuugcuaggaguugagacuccacacauacacaggccuucugaguuucuuuacaucugccagcacggucgcugggcucguaaagacgccuguagacuucauuuggcauauacauacagagucccauugaaugcagcagcucuccgggcccccagcuccccccaucuggucaagaauguacucaggaacucagccuggaggagaagaaagaacacaggggguuucugugugcucccugcccgguccuugccuucagcagacuggaggaaaaggaagcacgccagggcagcaggcuguggcggucauuccugaggcaaggggcauuuugccaaaugugcgauucccuuugacuugguggacucaacccaacuccucuguuccauuuuccuaguuccaaagaacuaauggcguggugagugaggcucucgugcacacugacaccagaccagcacacgccggcccaccucuccagguuuagguaucaagacaagauuuuugaacccaaaggcucaaaacgguggggaaguggaggaggagacaugaaugucugcuucagggagaagucuguuuacccaguguuauuugaaaacaggaauccugaauucccuuccuaccucauuaugacuucuuuaacauuuguuuuuaauuuaucugagaucauuaucuucacugcgaauugcguaugagccaaaguugaacucgaaaaccaagcuaggccuuuuguucugccugugcuaauuagcguacaaaggagagucugauuucuucccuccccaacagucggaaacacugguucccauugauguaacuaccaguacuggaaggggcugcgggcugccgaacggcccccgcaacagguaucaggaaaugaagguucuaaucccggucggcucaccgugcucuaccgagggaagggagacauguuauuucaagcacagugcuucaucuuuaaauaaacugaccgcuuccugcuggacgugccuuguaccugaacuaaaaugaccagggccucuagcaccccggcugguuguauuugaacaugaagcccaagaguagaagagucaacaaacccaucuauguaugguucucauccugaaaauggcuucuguggaggggugguucccaauuggugcuacuugggggcaggagguauucucuacggcucccucauucauucaaaaaauaccgagugaaggccuucccugugccuggugcuaagaauguaauagcaaugggacauaacagauccacucccuggcaccuucagcaaguuuaggauccaggagacaaguguguuuuggaugaggaggccauguguuugccaacagugcagugugcuuaagaaucugcagcagggagccauaggugaggcugcgaggcggaggcguagaaggcuaagauuucaaacacagcggaaagccuuggccaagcaagcagaggaauccugccgacccacucccuugaagaaguccaaaauggcaugucaaaggccugagaagucuccccagacggaacacagugagugcggccuaccuauuagcaucccaaagaccuaugggaaaacugagagaagccuauuguucucaaagcccauaagaaacuucaguaugaaacaaaagcccuuguucauauaacuggaaaacuaccacguguccucuuaagaggccaaaauaccuugaguuucuaaugugauucuaaaguauuuuccuuggcauggcccuaaaacaacauauggccacaaccgcucacauacaaguccacagacaugaaccaggggaccagguucaaagucccacugccagcucagaccucggcuuuauuuguuuuuagaaggcuguucagccucagcuaugagaggcauggggagggggaaaaaucuaccauaauaagcaaagugaaacgauugggcaccaauaaucgacuuaucaaaacuauacaguggaggauaacagaagcacacaaugauugcucuuguuagcccacaaacguccaggaaggcgggucuuuguauuuauuuuauuacauucugugcacagagagaaauagaaauaaacaauaucaaguauucacacacguaggcagauuuuauaucggaggcagugucucagagucacacugaucaaaauaaaaauuuaauagccaggguccuuuggaauauaaauucaagaaaacuggcagcccaaaauuaaacauuagggaguaaagauaaucacugaaugguagaucacuuaucuggcauucaugaggaccuguguuugaucccuagcaaaaaaaaaaaaaaaaaaaaaaaagguaauuaaaguuaacaggcugguauguaacuugccaggcaugcacaaaggccccagcaucacauaaacugggcaaugaaguacaggacuauaauccaagcauucaggaggcaaaggcaggaggaucagaauuuagggucguccucagcuacauagcaagguuggggcuagccuggguuacaugaaacccauucugacaaacauaagauggaggccucacagacagcucagugauuaaagcauuugcccacacgaaggaggaccagaguuuggaacucuagaaucacguagaugucagauaaauguggcagcccaccuauaauccagccagagagauccugacaaccuugccuugacaaagccucugcugugcgcuggacacuauucucugugcacaccugcaacccuaugccaucuguccagccucggaguagguccuccugccucaggcucagcacugaauaggaagcuguugcugagugguagcuucagucuugguaagaucugaaaguccaccugauccaugagcagacauccucaucagcugacaaauguuuguagucaguguggugauguuagaggcacggaggugaagcagguauugguacccucacuaccugugugugccccuucagaaccaccuggacauccuaugggagaugaaugaaagcccuccagugagcuuguuccuuuauauguauauuuauuuuuaauuacaggcauauguaugugacuaucuagguacgcgcaugcgugagugcauacgucuggauccagaugagagaggaugggagcuccuggaggugaagcugcaggcaguugagagccacuggaagugggugcuggcaaccaagcgugaguccucuacaugagcacccgugcuaggugcgccaucucgccagccacggcuaguaauuguugaaaugcuacugguuggcaggaauauaugugcuuuucaauugggagaacaaaauauaaguacagaagagacuuuacuuacgaaacaauugccguguccaauuacaauuauuaaauaaacagaggaacaugacacagcauugggaguauacugaagcccccacaugggcugcgcaccuuuaacccaggcagaggguuaaccaaaagacagaggcagacugauuucugaguuggaagccagcuuguucuacacagcaaguucuaggccaguaagggcugcagugagacccucuccccaagaguauacuggaaauaauuucuuuuuguuuguuuguuuuuucguuuguuucucuguguagaccgggcugucauggaacucacucuguagaccaggcuggccucgaacucagaaaucccccugccucugccucccaagugcugggauuaaaggcgugcgucaccacgcccagccuggaaauaauuucuuuuagagcaaggauguucugaaaaacaccggacauauuuuauucucuucuagucuccgugguacuguuugguguccuugaguccuuugcauguguacuuuaguauuuacacggagguuucuaaauaccuguucccauuaaaagaagucaacugcuucucaaaaagacuagcuccaggucuggggcaggaacggauagggcagaccuggaauguccugccaugcuccgacuuguccaaagaacucagcagccaauuagaggaaguaccgauuggauaaagaugagauaauuugaguaucagugaggguggcauuugcaaacagaauggaggacagugaguggguuuaaaucgcuaaguucaaugugcauugucauagacaggagacauuaacgcaaaagaguaagguaaagagucaagcacugaaaucaugcuuaacccaugggaaaggucugauuuguuuacucuguuaaaaaccuggccaguagaucuucuaacucuguaagccaauagagccuccaucucaccuaagagacuaggucccuuaccaggcccuaacugugcaaaugaaugaacacaguuguguucuaauaaaacuuuacuuauaaaaguggcagaauggauuuaaucuguagauguuaacuuacugccccugcccuuugaucuaaaggaacaagauauuuggugccagauacuaucauuuuuuaaagaaauacagcuaaugcaugaaaaaggaauaaauaacacagauugcagacaccaggagugacuaaugaguaagagagguaggugugcuaaccccagaaaggggcagcugccugugagcgucuccuugaugaugaugcaucuaacuggaaaagaagaugcuauugguggggaagauccucuuugccuugcuagguguggucccacacacauggugcugcaugccuugaucccaggaggaucgaucucugugaguggaggaggaagaggaggagggggaggaggaggagggggagagggagagggaggaggaggaggagggggaggagggggagggggaagaggaggagggggagggggaggaggagggggaaagggagagggaggaggagggggagagggagggggaggaagaagaauugcggguuggauauaggucaauggcagagugcucagguuaacaaacagaagcagguagaucucuaaguuggaggccagccuggacuaaagugaguuccaggacaaccaggguagacaaagaaacccugucuuuaaaaagggggggaggggguaccuaggcuagcaagauggcucaacacaguaagggcacgugcccaacgacuggaguccagccccagguggaagaaguaaacagacucccacaaguuauccucuggccuucaggagcaugaaguggugcauacguaaugaaauaaauguaguuuaaaaguucuagagaaucuaauuuacagucugccuguaauuccagugcucagaaagcuaaagcaggauugugaguucuaggccaguugaggccccauagcaagaguccacccccaaaacaaacagguaagcgaguaaauacacacacacacagagagagagagagagagagagagagagagagagagagagagagagagagcuguguaaugggacacaaacuugcaauaccagucaauaucuaagaucaggacccaaaaggauuguguucuaggccugaaugggcuacaaaagcaagauccugcccccaccuccccuuaauaacaaaauaaauaucagucuaugacaaacucuacaggagugagauuuaaaaacaaacaaacaaacaaacaaaaacaccccagauucuagcuucaacauucaaauucaacauucuauguugaaugcagacuagaacuucaccuuugcuaguuaaauaucucucuaggaaaaauacaccuccccaaucacuauuaugucauuccuugauaagcccucuggggcagacauaauaaagagcuagagaggcugggcuugcccgcccuguuuuucuucagugcugaguaucaaacucaggucucuguauguaugccaggcaagcccugccuuuauuuuauuuuucuucaggacagaccacaaacaccuugucuuccauuugacuuaggauucacagauacaccagugccuggagaaaucgcuguaccucccacagggucgaggguuagacacuggaccauuguuugccagucaucagagggauagucacucccgcaggaaccccagggggcuaaaaccagcgggaaagcugggugcagaacccaguaccuaagucucuuagguauuuccccauaagguucucauucauggggggcgggcaguaaaauaaaguauuauaguaaacuucuuggggaaacuuggcaaacauaccugggagugagacagggugggugggcucugacuccuaaucuuccuccaucagccaccccacccccacccccaccguaggaggaugcaccuccauguccagcucccuggcagacaugacucuaaaacagugacagacugaaucacucaccagaaagaaaagaaugcacccgaggaugagggagacaguagaccaaagaguugcugcucuaggauggcagagaacaaacgcccauaauaguucaucauagccugccugacauugaacccaucuuggucccagaaggugucuuccacuuuuuaacauccuagucaacaguagcuauuacaguuuugucuuauuuuguuuugucuuuugagacaggguuucucuguguaggcccagcuauccuggaacucucucuguagaucaggcuaccucugucucucccuccacaggucauaggagcaccaccacugccccugcuacaguguuuugguuuguuuuguuuucugacggagcugagauugaacccagggccuugagccugcugggcaugcacgcucccauugagugcuacaucugcugugcgccucuuuuuuuuuuuuuuuuuuuucuuccucgagacaggguuucucugcauacauagcccuggcuguucuggaacucacuuuguagaccaggcuggccucgaacucagaaauccgccugccucugccucugccuccaccacugccuggcuucuuuuuuuuuuuuuuaagugcauguuuuguucuuaaguuucucucugucucugucucucugucucugucucucuguauguguguaucuguaggcaugugcauauguggcagucugaggacagcuuucggaauugguuuucuccuuccaccuucuugaaacagugccuuuaaguuccugugacugcauacuggcuaacugaaccucaaacuuccagggcauuucucccaucucagccucccaucccccuguaggagugcugggauuauagaugcuauugccuccgacuuuuuaccuggguuuuguugauccaacucaggucauuuaguuugcaggcaagcacaauagcggucagugaguagagucuaucucagccccuccccguacuccagagauugggaaccccucugucaggaugaugagccuuucccacugcucucugacaagcauaucguuacacaaacacugaggcuggaaaacauuaauagaagugcaaagaguguucacagugaaacacucccaccagcgcuccucuacguuaccccacuuagaaaacaguuuaagaagauacacgggagccuguagagacagcucagaugauugacugcucuagcagaacaccucgguucaauucccagcacccacaaggccgcucacaacugccugugacuccagcucuagagaauucaaugcacucacucacacagacgugcaugcaggcaaaacaccugcgucaauaaaaauaaacaauuucaaaagaaugcaaccaccuuuaauucacacaacacaaggaugcucacagacagaagaaagcagggcuaggucugaaguaggaaguaggccacaggccaggucaacagauguaggcagaugaaacggggcgcagagcacagaauaaagaaagauuaaggcagcaauuaacaccaucucuggagcuguaacaagaccugcuggaagacuccaaccacccagaaaaggaagcauagauccugugggccaacuucuuuaauccuagcacuaggaaagcaaaagcaggugggucucugugaguuugaagccaacgcggccuacauagagaguuccaggcuaaccggagcaauagagugacaccgacacccugucucagccagcggcgcccgaggaaaagggauagaaauaccacuggggagaaaggaugcagaaguugcucauugcgugcauuccauugcuuuaacuuuugcuccaaauggcaucuucacuuuuugcuuuuuguuuuuuggucgacuuuuccuugggggaaacugaagccuacgggaaccaggucccucccauccccucaaggcucuagcugcuggacuucagggcuccagcucauggcuuccuggaaggauaauaggcgauuauccugcggugccccuggagucuaacagaucccaggaacacugaaggugccuacagggcuacuuuuucuuuuuucuuuuucuuuaaaaaaaaaaaaaaaaaagccggguggugguggugguggcgguggcgugugcuuuuaaucccaguacuugggaggcagaggcaggaggauuucugaguucaaggccagccuggucuacagagugaguuccaggacagacaggguuacacagagaaacccugucucgaaaaacaaaaacaaaagaaaacaaaacaaaauagcgcugauauuuaaauauuuguguugccaugugugggugcuauauuuuaaauacagaaguauuucguggugcacugucucuaggguaugagggucacaucccagugacguaauuccagucuuguguguauucauucccaucuagcuguuugcuuugggcaggucaaucaaugccugaacucacuauggcuaacacaucuggacuuguaaauugaucugauguucacacugcucacuccuaccucuugugugucuuguguauuccuuucuucagauccaccucucucucucugucucuuucucucugucucucucucuuuccuucuuugagacaaggucucucucuauguagcccuggauggucuggaacuuacagagaucugccugccucuguuugccuugcaggcuuuuccacacauuuucugcaguugguucuacaaguccuggcuccauucaccuuaagggauccaagauacuuaaccucacuaauguucaggacgagguggcacuugucuuuaacccuaguacucagaaguaagaggcaagcauaucucugaguucaaagccagccuagucuacagauugaguuccaggaaggccaggcuauuacacagagaaacucuguuuggaaaaauaaaaacaaacaaacaaacaaacaaacaaaaagauugcaccugucaggucuacaacuucauaagaaacaccgaguucuaugaacaguaacucaguaccaaucuuccccuggcacuguggcuuucaaggacaccaccugccaguggucugaaaaguagaggcaaaaaauccuaaacuuugggggccucagagacucuugauagugcguccugcucucccagaggaaccaagcuccauauugaacauauuacaacugccuauaaauccaguucuagaaaaucuaccacgcuccuccuagccuccucgggcaccugcacauacacggcguaauacagucacauagacacaccaucauaaaguaacuaauuuaacuauauucaucuuaaaagaaaaaaacauggagcuggacguggcggcacacgccuuuaaucccagcacuugagaggcaaaggcaggcggauuucugaguucgaggacagccagggcuauacugagaaacccugucugggggggggggggggaccauggaacuucaugauuucuaauuucaaaccauaacacacacauagaaggacacccauuucucuccugugaguccuaaaguaaucacuguguaaauauccaguaccuauuucuuuaauaauugguuagcgcuguaauagucugucauagagacaugagacuggugguuuauuugggcagugcauaaggaaagcaaaggacuuaaccaagcauuuuauaaaaggcaccaccaggaaucacuguguucaagcuugguuucucagggcuugguuuguuaagccaaccauacuguaauccauacuucgcggaaaucaggaaggcuucccccucccgggcugcuccaagccaaagacacaccugcgugcacuuccgacccucacugaccucaacacggagaaagcagucuccagcuuccaaaugucaggagauaauggcuuuuuccgcagguggugaagucccugggcagcagguuaaagguuacugaccccacggcagcaaaguccuggucagacggcuuccagccacagacuuacucaccucugacuagacuagggaugugcccggugcauguauguaaggcugacccuugaaucuaccccaucucgauccaagcugauagucauaucagaauuucugcacugagaagcaagucagugccccuuuccagagagggccagugauaccaggcuugugugucauggggagaaaggaaaaagguccggacuuuggacccaaccucgugcucucucgcaauggccagugguguggucuuguaugacacacuugaccucuagaagucuguuugcacagccgcagaaugggauuaacaaguaccuacuuccuacugggucagaaacuauggaaagcacugagauuuuagaagccauugccaagagcuucccaaauagggugagauuguuuacacccuuucaagaagagcccuuugcuacacauuugccagcaaugaaguuaucaggacaaauguggggguuuuggcauuuguuuguuuguuuguuuguguuacuuugagggugggguuuugagacuggagaguuggcccaguguuaaaaggacuggcugcucuuguagaggaccuggguucaauccccagcacccacacccgcaaccaucuguaacuccagucccaggagaccugacgcccucuucuggucucuacagguacugcacacacauggugcacacaugcauucauauacauuuaaaaaaaaaaucaagaaauuagaagaguuuuuuuuguuuuguuuuguuuuguuuugagacaggguuucucugaauagcccuggcuguccuggaacucacuuuguagaccaggcuggccucgaacucagaaauccgccugccucugccucccaagugcugggauuagaggcgugcaccaccaccgcuccgcuagaagaaucuuaaaguaggcacgauggugugugccuuuagucccaauacucaagaaacagggaggccagucuggucuacaaaguuaguucuaggucagccaggacuacuacagagcuuugucagaacacaaaaucaaaacgaaaacuuuagauuauaaacacaaugaaauggaaagauuuaggauuuugaaauuugcuuuauaaccuuaagguuaucgaguaaaguaacaaaggcuaccuuuaggucacuugaugcauggcaggaagaaaguuaguaccugagaagauguccccugagcagcccagagaaaaagcggagucccuuuccuucccuucguguucuguucauugccaaauggggaagugaacacuuugugcucaucccuaaaucugauccaguauagaagacagaaagauuuuaacuuaaacgcaguuguuuuaguaugugcccacuguggaugaagcccuggguuaucacaacaugacauaaaccaggucuaguagcacaggucuguaaucacaacauucaggagauagaggcaagagggucagaaggcuggccacaggggccugcaagauggcauagaaaggugcuugcuucgaagccucacaaucugaguucaaacccacguaaagguggaaaagaaccacgucuguaaaguuguccucugacuuccauacacacacugggguacuuuccacuccccacaccuaaugcacacaagcaauaauaauuucuaaaaguuuuagugaaauaucagauguguucacuuuaccuuugagaaaaucuccagcgauuggauugcagcauauguggaacguuaauaauaaaauaaaauacuuuuuaaagaaugaaaaaaaaaaaaaaaaaaaagaccaacugaauucuaggacccgcccugcggucaauucucccuugaauuuacugaguauaaaaaggccagccagggacuggggcggcgacucugcuccugcagagggcaaguuuguuccuggcacccaugcuggacugguccugaccuccuacaacgccagcuguaggagggacugucaccucuguccucugugggaaccugcagucaugagcacacauacacacuuaacuuaauuuaaaauuaagacaaaucuuuuuggaaaagucaaucuggugguacagggcaggucucacccugaugccuaucaaggccaucuuuucauuuucuuacauccucaccucuggguggaacuggucuguagaacugagaggaugccuacaacgggcaucugccauccaugagggaagaaauuugucucccugccaaagcccucaucucccuuucuccccgacucaucuuaaguccugucagacuacccacaaaacaagcucugucccagcacccucaacacccuuucuccaauaggcuguagacuguagcucuacccaucccccccuccuccacagccagcccucuuuaauggguugacuaaagccuuguguuucuaucaucuuucagguaacccuggauagaaagugaauugugggacuggagagauggcucagcacuuucgagcacuggcugcucuuccuggauuugguucccagcacacaugggacagcuuacaaacaccuguaacuccagucccaagggacccucuucucaauuuccaggguaccagacaugccuaugguacaccuacauauaaacaaguaaaacauccagacgcauaagaauaaaucuuuaaaaaaaauaaauuaaagaaagaaagaaaagaaaagaaaacgagccgggcaugguggcgcacaccuuuaauugcagcacucgggaagcagaggcaggcagauuucugaguucgaggccagccuggucuacaaagugaguuccaggacagccaggguuauacagagaaacccugucucgaaaaauaaaacaaacaaaacaaaaaacaaacaaacaaacaaaaaaaaacaaaaaagaaaaaagaaagaaagaaaagaaaacaaaguguggaagauccagcacuucuuucccuuucaggcuacucacagucccuugccagugagauccccaucagccacugccuccuccuccucucccacacccuucccaauucucuggaaacauuccccgugaacccacggugucucuccuccgacacggaacaguuucuccuaacgagagccucucacagccuguuugagcucugagguuaccaaaccauucggggugcuuuuguccagagccaggacagcagagagagaaggacagugucccaccugcccaaguaacuucccaacucauccaggcauagacaccagcagugaacugugacagcagcuaccgaagccaucuggggaccacaccucccucuucucacacugaaccuuucuguccucugacaugcaagcccuuuccccucggccuggcuccgaugagucuccugcacagucuagcuccucccugcccuccuaucucagcaucuugguaagcagggguaggagguauauaagccacacuauuuggauguaacuuucuuuguguugcuggaacuggaacucagagccucagggauguuaggcaacaucucucucucggcaggcacauccucagccccgugaauaacuugaggguucucugcugucucuuguguaagaagagauuucuuucuuagcauucaaggcuuaacgugccccuaaucacucuaggcaacuagcacggaguaaguucuauuacagcuauggcuuucucucucuccuugcguuuggucucccuggcuucuaucucaggaucacaguguaaauacaccaaggauauuuaauuuuuuuauauauauaauuaacaagaaucacuuugaacuaaaacaagcuggucaugguagccuaggccuguaaccccagcacucagaaggcugaggcacgaugauuggcuuggguuugaggagagccuagugugagaccaacuagagcuaccuuacaagacacugcccucccuauacgccaccccccaagucacacacaacaacaacagcagcagcagcaacaacaacaacaagagcaacagcaaagcacgaguuccaaggacaaguuuaaagcuaccuccuccacuggccuuccucgaaacacacuacuucaaagcaauucuuccaaacuucuuagucuaaaaggugccucuguaaccaagaccuaccuccuugcauccuuguaaaaugccaauguuacuguuuucuaacucgaguuugacaucuuuuaggcaaaagaucuggccuaaugcaucuuaucugccaccgccccuuagcaccauccaggauaagcgcucaacacacauagggcuaggaagucaaggaguuacagauuaaucuugaguauccccaguguagcaaaugaaagucaucucccagcagaacuagagugcacccuucuuauuacagaagguuuccagugagcugcucauuuuuauuccacaguuccauugauuaaccauuucaagccaggccaggcagugguggcgcaugccuuuaaucccagcauuuaggaggcagaggcaggcauauuacugaguucagauuucugaguucaaggccagccuggucuacagagugaguuccaggacagccagggcuauacagagaaacccugucucaaaaaaacaaaacaaaacaaaaaaaaaaaaaaaaaaaauucaagcugguaggcuguagagauggcucagugaugaaaacuacuggcugcgcuuuagagaacguagguuccauucccagcacccacaugguggcucacaaccaucuguaccuccaguuuuaggugaucuaagagcauugcacauacauggugcgcagacauacauacaggcaaaacaaccacgcacaaacacacaaacacggcaguucuugucaguuuacugcuaaggccgaaaugcuguuaaugguccuacauguguguacacauguguauuuggcuggauguguuuaugugugcgaguacacguaaacaucagacugccuucuccuugagaaguccuagaaaugagaucaauggagaaugagguuaagccauagguuucuaaaauuauaacaaggcaacucagauauucccugccagauccaccuacccaaagacaagucugacaggacucaagcccaccucaagcuuaaaaccaaacgucaccccagcaauccaaaugccaaaauuucaguaacccagcagggcgcucccaacagcccacucuauacaaaaagcccucauuaaacucaagaguuauauuuagcaaaaaauggaacagaaguuauauuuagaggaaaugacuuaaaagaauuuuaccaaaaacagcauguuuagacugaucugcaaaaggaaaaaaaaaaaaaaaaagguuuuagauuggcuagauggcuccgcggguaaaggcgccugcugccaagccuacugaccugagguugauccccaggacacccccccccccaggagggaacugacuccuacauuguccugacaggguacauggcccccucacaaauuaacaaaugaaauguaacaaaguauaugaaucguuuuuuaaaauagaggauagguuucccuugguuguuacauaaauuccccuaaaacaaccuccugugugugcucagaaauuugugugucuggagaacaggagguggcacgcugaggaggucggccauccucaggaagaccacuguagaauacuuacaggucagcacacaccuaaagcccaggacugucucacacagaagugaucuggacagacugacaaagaugcgggcuucaggacagugaucccuacacaucaugcucagggccucuccccagacaugucccuuuccuagccguuauugacauucacgcuguggucacaaaguacucuaucaguaugaaguugucuagcagaacugcauccaauacuguccauuuggcucuucucuaccuaaaugauauauuuuuugacauccaaucuauuuuguuuauauuuguuuuggggacaggcucuuccuagguagcccaggcuguccucagacuugcagugauacuccugucugagucguugauguucagggauuaucaaccaagugccacccuguguggcuucauuuacauuuucguagcaaaauuguagucaacaauuucagaauagucuuguaaccugcaaagucucuccucuagaaugaagguagagucagagcguggugguuuaugccugugauguccuaagaggagcuaaacaguucagggcuagccuggucuguaucgcaaguucuaggucagccaggacgacagugagaccuuagcucauguuuccauguacuaggaauaguacaaagugcggcagcuauuuauucccuucuccacacaccucgggguccccgggggcucgaaagagaagcacacucauagugacacaucuguaaaccuagcacucaagaggcuaguccuccuuagauaggaggauccaaguucgaggccagccuggacuagaaugagacccugucuuaagacuuguccccuuagcccagggaaaggugaccucucccccucaagggucucagacaggaaccauuucccagcaucccaauggagccagaggagaaaggagaagaggugacccauggagaagggcagccugacugcacaacuguccagcagcagagaugccagugaugagggcuuugggccuccugucugaaaagccaaauguccauacguaacucaaaaacacugcagccagcauccacuucgacuucuguuuuuguuauguccagaaaucuaggaccgcaaagaaaugguacccccacuuuuauacguauaggccuaaaacaauaaagcuuacagguggauaauuuaaaagagaaacaacaggaccuagaaagcaaaagacagguggaaucaucuaguccaagaaucuucucccaaccuaucagcuccugucuuaccccucaacucucuacuucacugggaaacagcggagguccgaucuugcccggaugaccacuugugucccaugaaaaucauauuaaguauauugauaugaucauggagaggaaaauuaucauuucaaccauauaguccaaacaagugcuuaaauggguccuaagcugcucugcuuacuggccaugcauagucaaacuagaaagagacuuuccugcuacaacagugaacuuuguaaccgagcaaggcagcaugugagaaacaccaaacacugagaacuuacgauuuuaagauuuuaagccauucaucggugagauaagauacaggcauggggggcuggugagauggcucaguggguaagagcacccgacuguucuuccgaagguccagaguucaaaucccagcaaccacaugguggcucacaaccauccauaacaagaucugacucccucuucuggugugucugaagacagcuacaguguacuuacauaaaauaauaaauaaaucuuuaaaaaaaaaaaaaaagauacaggcauggggaugagaugggagucaaaguccccaagccagugggcuaagaggugaguguggagagccaucgagauggcucuguggguaaaggcccuggccaggcaaaucugaugaucugaguuggauugcgggggacucacacgguagaagagaauccaacugacuaccaaagauugucuucugucccccacggagguacuaacccuggcguaagccucagauacacccaagugcacacacacacacacacacacacacacacacacagagaggaaagaaaauguaaaaacuuaaaagaaaugaguguguggaggaaaucuccaguuaaagggcuaagucguauuugggauguuucugaugacuuuuaacuuccuaagaccuggcucagagcugacauauaugauaaaaacagagaagauggcaggcacuaaaguggcuuaacagacacacguacaaagauaugggaacucccuguaccugcaugggcaggaaagcugggggugguccccaacauuggcacacaccuucaccuugaaagugcaaaagcaaagcccuaggccuauauccacuuucaaaaggacuucuugggguacccugaaguggagcaggcccaaaacugugagggucuuucuccaccccagagcaaaggcaagcggugugagugugguucuacgcccuucuuccauccaucagaacgcaaccccuaacccccaaccccuaaccagugaacaacacccacacacacacacacacacacacacacacacacacacacacuacacgaacuguggaggccauccugcuccacccagcaagggcccgaaaugacagcaggaacgacccauucagcgcccagaucuuccauggccacccuugaguauaaucauauuuaagaugaacuuuuauucgagcucaguucccucagggaugcacuccugaggaguagacacgccagcagggagaaugaaccaaccaacucuggaaagcucugugcgaggcagagacaacgagcaaggcgccgcacagcaggagggugugcacccaggauuuaccauccaacccagcaucagcauaggaaacuuggauguggaguagcggcucgaagaccaggccaaccccgaacugcaccccucauuucgcaggggagagaggcgggagcuccgagcuggagaggggugaaggaauccgcccucauuugcacauugucuggggccgggucaauuugcuuaaucaccgcucuaaaugccaggcacacagcacacaaugcgcucccauuaacagguuuaaagugucgcagcgcucgcuuuaaaugagaaaagcccgcaacaaaagggggaaaaagccaaguaagaaugccuugggucgcccuccaaaccaucucagaggaguuuaaaacccagaguucugcagaaaaauugaggcccugggggugaggauugggggugggucgugaauaguucacacaaaauaaggaguuuguacagcucacagcagcccagggaacccgcaggucagaggacaucucaagucaggauccuccaggcccuugcccaacuuucucccuugccaaggggaaagcugaccaaucuccgggaaggaaagcgagacaccccccccccaaacacacaccccccaccuccaaaggcaggcacaaauccaaguuuuccuuugguaggagcaaggaauuugggaggcugggaggucccaccaggccgcaaucucccaaaggcgagaaguuaaaagaacuuuacuuucaucccguuacuggccaaaagcagucucauacuaggccgccacaggggaguuugacucugcaaacaaguucggcccaggaucagcucaggcaggaggccccaucccccacaccacggaaagcccaggggcgcaucccgccgggcccgacgcccaccggucccggcacggccggacugacacuuacggugcgcgcuccaccaggagacagggguccguuggagagguacgggcugcucaggucuggaaucaucaggaagggguacccaggauacgcaggucccuuaaaaaaagcgccauccuggggccuucucacugcggacaaaaccaaaguggagugaggucaggggucccccagacagaguagcuaucuggagcucggggcgggaaucuggaacccgagcaccccucgagugagccccagaguggcugcugcagcgaugggaggagagcagggguuccgccacccggaccguggagacccguacggccaaucgcugauggcuggagaguggagacugacggagaaggcacuuaccuucggcgaaauagucgcgcggcuucuggaaagcgucccgggcgggcugcgggcgccucuccgccuguggaggagacacaaaggcgagggcgggugagcgggagcgggacccgggucccccagaggcugacccuaggaaucccuuuaccucggaguccgagcuacugcucugauucuccgauucguugaccagggacgacuugaccucauccagaucccucugcgccgaagcgcugucgcugcucggcucuugcucuucgccccccucguccuggaaggggaucagcucgucguucgcuccgaggucguccccuccacugguugccccggcuccggagccaccgccucccccgccggcgccgccaccgcggccaccaccgagcuggggcauggug

SEQ ID NO: 12364 - RNA, 162578 nt, Mus musculus
caccaugccccagcucggugguggccgcgguggcggcgccggcgggggaggcgguggcuccggagccggggcaaccaguggaggggacgaccucggagcgaacgacgagcugauccccuuccaggacgaggggggcgaagagcaagagccgagcagcgacagcgcuucggcgcagagggaucuggaugaggucaagucgucccuggucaacgaaucggagaaucagagcaguagcucggacuccgagguaaagggauuccuagggucagccucugggggacccgggucccgcucccgcucacccgcccucgccuuugugucuccuccacaggcggagaggcgcccgcagcccgcccgggacgcuuuccagaagccgcgcgacuauuucgccgaagguaagugccuucuccgucagucuccacucuccagccaucagcgauuggccguacgggucuccacgguccggguggcggaaccccugcucuccucccaucgcugcagcagccacucuggggcucacucgaggggugcucggguuccagauucccgccccgagcuccagauagcuacucugucugggggaccccugaccucacuccacuuugguuuuguccgcagugagaaggccccaggauggcgcuuuuuuuaagggaccugcguauccuggguaccccuuccugaugauuccagaccugagcagcccguaccucuccaacggaccccugucuccugguggagcgcgcaccguaagugucaguccggccgugccgggaccggugggcgucgggcccggcgggaugcgccccugggcuuuccguggugugggggauggggccuccugccugagcugauccugggccgaacuuguuugcagagucaaacuccccuguggcggccuaguaugagacugcuuuuggccaguaacgggaugaaaguaaaguucuuuuaacuucucgccuuugggagauugcggccuggugggaccucccagccucccaaauuccuugcuccuaccaaaggaaaacuuggauuugugccugccuuuggaggugggggguguguguuuggggggggggugucucgcuuuccuucccggagauuggucagcuuuccccuuggcaagggagaaaguugggcaagggccuggaggauccugacuugagauguccucugaccugcggguucccugggcugcugugagcuguacaaacuccuuauuuugugugaacuauucacgacccacccccaauccucacccccagggccucaauuuuucugcagaacucuggguuuuaaacuccucugagaugguuuggagggcgacccaaggcauucuuacuuggcuuuuucccccuuuuguugcgggcuuuucucauuuaaagcgagcgcugcgacacuuuaaaccuguuaaugggagcgcauugugugcugugugccuggcauuuagagcggugauuaagcaaauugacccggccccagacaaugugcaaaugagggcggauuccuucaccccucuccagcucggagcucccgccucucuccccugcgaaaugaggggugcaguucgggguuggccuggucuucgagccgcuacuccacauccaaguuuccuaugcugaugcuggguuggaugguaaauccugggugcacacccuccugcugugcggcgccuugcucguugucucugccucgcacagagcuuuccagaguugguugguucauucucccugcuggcgugucuacuccucaggagugcaucccugagggaacugagcucgaauaaaaguucaucuuaaauaugauuauacucaaggguggccauggaagaucugggcgcugaaugggucguuccugcugucauuucgggcccuugcuggguggagcaggauggccuccacaguucguguaguguguguguguguguguguguguguguguguguguguguggguguuguucacugguuagggguuggggguuagggguugcguucugauggauggaagaagggcguagaaccacacucacaccgcuugccuuugcucugggguggagaaagacccucacaguuuugggccugcuccacuucaggguaccccaagaaguccuuuugaaaguggauauaggccuagggcuuugcuuuugcacuuucaaggugaaggugugugccaauguuggggaccacccccagcuuuccugcccaugcagguacagggaguucccauaucuuuguacgugugucuguuaagccacuuuagugccugccaucuucucuguuuuuaucauauaugucagcucugagccaggucuuaggaaguuaaaagucaucagaaacaucccaaauacgacuuagcccuuuaacuggagauuuccuccacacacucauuucuuuuaaguuuuuacauuuucuuuccucucugugugugugugugugugugugugugugugugugcacuuggguguaucugaggcuuacgccaggguuaguaccuccgugggggacagaagacaaucuuugguagucaguuggauucucuucuaccgugugagucccccgcaauccaacucagaucaucagauuugccuggccagggccuuuacccacagagccaucucgauggcucuccacacucaccucuuagcccacuggcuuggggacuuugacucccaucucauccccaugccuguaucuuuuuuuuuuuuuuuaaagauuuauuuauuauuuuauguaaguacacuguagcugucuucagacacaccagaagagggagucagaucuuguuauggaugguugugagccaccaugugguugcugggauuugaacucuggaccuucggaagaacagucgggugcucuuacccacugagccaucucaccagccccccaugccuguaucuuaucucaccgaugaauggcuuaaaaucuuaaaaucguaaguucucaguguuugguguuucucacaugcugccuugcucgguuacaaaguucacuguuguagcaggaaagucucuuucuaguuugacuaugcauggccaguaagcagagcagcuuaggacccauuuaagcacuuguuuggacuauaugguugaaaugauaauuuuccucuccaugaucauaucaauauacuuaauaugauuuucaugggacacaaguggucauccgggcaagaucggaccuccgcuguuucccagugaaguagagaguugagggguaagacaggagcugauagguugggagaagauucuuggacuagaugauuccaccugucuuuugcuuucuagguccuguuguuucucuuuuaaauuauccaccuguaagcuuuauuguuuuaggccuauacguauaaaaguggggguaccauuucuuugcgguccuagauuucuggacauaacaaaaacagaagucgaaguggaugcuggcugcaguguuuuugaguuacguauggacauuuggcuuuucagacaggaggcccaaagcccucaucacuggcaucucugcugcuggacaguugugcagucaggcugcccuucuccaugggucaccucuucuccuuucuccucuggcuccauugggaugcugggaaaugguuccugucugagacccuugagggggagaggucaccuuucccugggcuaaggggacaagucuuaagacagggucucauucuaguccaggcuggccucgaacuuggauccuccuaucuaaggaggacuagccucuugagugcuagguuuacagaugugucacuaugagugugcuucucuuucgagcccccggggaccccgagguguguggagaagggaauaaauagcugccgcacuuuguacuauuccuaguacauggaaacaugagcuaaggucucacugucguccuggcugaccuagaacuugcgauacagaccaggcuagcccugaacuguuuagcuccucuuaggacaucacaggcauaaaccaccacgcucugacucuaccuucauucuagaggagagacuuugcagguuacaagacuauucugaaauuguugacuacaauuuugcuacgaaaauguaaaugaagccacacaggguggcacuugguugauaaucccugaacaucaacgacucagacaggaguaucacugcaagucugaggacagccugggcuaccuaggaagagccuguccccaaaacaaauauaaacaaaauagauuggaugucaaaaaauauaucauuuagguagagaagagccaaauggacaguauuggaugcaguucugcuagacaacuucauacugauagaguacuuugugaccacagcgugaaugucaauaacggcuaggaaagggacaugucuggggagaggcccugagcaugauguguagggaucacuguccugaagcccgcaucuuugucagucuguccagaucacuucugugugagacaguccugggcuuuaggugugugcugaccuguaaguauucuacaguggucuuccugaggauggccgaccuccucagcgugccaccuccuguucuccagacacacaaauuucugagcacacacaggagguuguuuuaggggaauuuauguaacaaccaagggaaaccuauccucuauuuuaaaaaacgauucauauacuuuguuacauuucauuuguuaauuugugagggggccauguacccugucaggacaauguaggagucaguucccuccuggggggggggguguccuggggaucaaccucaggucaguaggcuuggcagcaggcgccuuuacccgcggagccaucuagccaaucuaaaaccuuuuuuuuuuuuuuuuuccuuuugcagaucagucuaaacaugcuguuuuugguaaaauucuuuuaagucauuuccucuaaauauaacuucuguuccauuuuuugcuaaauauaacucuugaguuuaaugagggcuuuuuguauagagugggcuguugggagcgcccugcuggguuacugaaauuuuggcauuuggauugcuggggugacguuugguuuuaagcuugaggugggcuugaguccugucagacuugucuuuggguagguggaucuggcagggaauaucugaguugccuuguuauaauuuuagaaaccuauggcuuaaccucauucuccauugaucucauuucuaggacuucucaaggagaaggcagucugauguuuacguguacucgcacacauaaacacauccagccaaauacacauguguacacacauguaggaccauuaacagcauuucggccuuagcaguaaacugacaagaacugccguguuuguguguuugugcgugguuguuuugccuguauguaugucugcgcaccauguaugugcaaugcucuuagaucaccuaaaacuggagguacagaugguugugagccaccaugugggugcugggaauggaaccuacguucucuaaagcgcagccaguaguuuucaucacugagccaucucuacagccuaccagcuugaauuuuuuuuuuuuuuuuuuuuguuuuguuuuguuuuuuugagacaggguuucucuguauagcccuggcuguccuggaacucacucuguagaccaggcuggccuugaacucagaaaucugaacucaguaauaugccugccucugccuccuaaaugcugggauuaaaggcaugcgccaccacugccuggccuggcuugaaaugguuaaucaauggaacuguggaauaaaaaugagcagcucacuggaaaccuucuguaauaagaagggugcacucuaguucugcugggagaugacuuucauuugcuacacuggggauacucaagauuaaucuguaacuccuugacuuccuagcccuauguguguugagcgcuuauccuggauggugcuaaggggcgguggcagauaagaugcauuaggccagaucuuuugccuaaaagaugucaaacucgaguuagaaaacaguaacauuggcauuuuacaaggaugcaaggagguaggucuugguuacagaggcaccuuuuagacuaagaaguuuggaagaauugcuuugaaguaguguguuucgaggaaggccaguggaggagguagcuuuaaacuuguccuuggaacucgugcuuugcuguugcucuuguuguuguuguugcugcugcugcuguuguuguugugugugacuugggggguggcguauagggagggcagugucuuguaagguagcucuaguuggucucacacuaggcucuccucaaacccaagccaaucaucgugccucagccuucugagugcugggguuacaggccuaggcuaccaugaccagcuuguuuuaguucaaagugauucuuguuaauuauauauauaaaaaaauuaaauauccuugguguauuuacacugugauccugagauagaagccagggagaccaaacgcaaggagagagagaaagccauagcuguaauagaacuuacuccgugcuaguugccuagagugauuaggggcacguuaagccuugaaugcuaagaaagaaaucucuucuuacacaagagacagcagagaacccucaaguuauucacggggcugaggaugugccugccgagagagagauguugccuaacaucccugaggcucugaguuccaguuccagcaacacaaagaaaguuacauccaaauaguguggcuuauauaccuccuaccccugcuuaccaagaugcugagauaggagggcagggaggagcuagacugugcaggagacucaucggagccaggccgaggggaaagggcuugcaugucagaggacagaaagguucagugugagaagagggaggugugguccccagauggcuucgguagcugcugucacaguucacugcuggugucuaugccuggaugaguugggaaguuacuugggcaggugggacacuguccuucucucucugcuguccuggcucuggacaaaagcaccccgaaugguuugguaaccucagagcucaaacaggcugugagaggcucucguuaggagaaacuguuccgugucggaggagagacaccguggguucacggggaauguuuccagagaauugggaagggugugggagaggaggaggaggcaguggcugauggggaucucacuggcaagggacugugaguagccugaaagggaaagaagugcuggaucuuccacacuuuguuuucuuuucuuucuuucuuuuuucuuuuuuguuuuuuuuuguuuguuuguuuguuuuuuguuuuguuuguuuuauuuuucgagacaggguuucucuguauaacccuggcuguccuggaacucacuuuguagaccaggcuggccucgaacucagaaaucugccugccucugcuucccgagugcugcaauuaaaggugugcgccaccaugcccggcucguuuucuuuucuuuucuuucuuucuuuaauuuauuuuuuuuaaagauuuauucuuaugcgucuggauguuuuacuuguuuauauguagguguaccauaggcaugucugguacccuggaaauugagaagagggucccuugggacuggaguuacagguguuuguaagcugucccaugugugcugggaaccaaauccaggaagagcagccagugcucgaaagugcugagccaucucuccagucccacaauucacuuucuauccaggguuaccugaaagaugauagaaacacaaggcuuuagucaacccauuaaagagggcuggcuguggaggagggggggauggguagagcuacagucuacagccuauuggagaaaggguguugagggugcugggacagagcuuguuuuguggguagucugacaggacuuaagaugagucggggagaaagggagaugagggcuuuggcagggagacaaauuucuucccucauggauggcagaugcccguuguaggcauccucucaguucuacagaccaguuccacccagaggugaggauguaagaaaaugaaaagauggccuugauaggcaucagggugagaccugcccuguaccaccagauugacuuuuccaaaaagauuugucuuaauuuuaaauuaaguuaaguguguaugugugcucaugacugcagguucccacagaggacagaggugacagucccuccuacagcuggcguuguaggaggucaggaccaguccagcaugggugccaggaacaaacuugcccucugcaggagcagagucgccgccccagucccuggcuggccuuuuuauacucaguaaauucaagggagaauugaccgcagggcggguccuagaauucaguuggucuuuuuuuuuuuuuuuuuuuucauucuuuaaaaaguauuuuauuuuauuauuaacguuccacauaugcugcaauccaaucgcuggagauuuucucaaagguaaagugaacacaucugauauuucacuaaaacuuuuagaaauuauuauugcuugugugcauuagguguggggaguggaaaguaccccaguguguguauggaagucagaggacaacuuuacagacgugguucuuuuccaccuuuacguggguuugaacucagauugugaggcuucgaagcaagcaccuuucuaugccaucuugcaggccccuguggccagccuucugacccucuugccucuaucuccugaauguugugauuacagaccugugcuacuagaccugguuuaugucauguugugauaacccagggcuucauccacagugggcacauacuaaaacaacugcguuuaaguuaaaaucuuucugucuucuauacuggaucagauuuagggaugagcacaaaguguucacuuccccauuuggcaaugaacagaacacgaagggaaggaaagggacuccgcuuuuucucugggcugcucaggggacaucuucucagguacuaacuuucuuccugccaugcaucaagugaccuaaagguagccuuuguuacuuuacucgauaaccuuaagguuauaaagcaaauuucaaaauccuaaaucuuuccauuucauuguguuuauaaucuaaaguuuucguuuugauuuuguguucugacaaagcucuguaguaguccuggcugaccuagaacuaacuuuguagaccagacuggccucccuguuucuugaguauugggacuaaaggcacacaccaucgugccuacuuuaagauucuucuagcggagcggugguggugcacgccucuaaucccagcacuugggaggcagaggcaggcggauuucugaguucgaggccagccuggucuacaaagugaguuccaggacagccagggcuauucagagaaacccugucucaaaacaaaacaaaacaaaacaaaaaaaacucuucuaauuucuugauuuuuuuuuuaaauguauaugaaugcaugugugcaccaugugugugcaguaccuguagagaccagaagagggcgucaggucuccugggacuggaguuacagaugguugcgggugugggugcuggggauugaacccagguccucuacaagagcagccaguccuuuuaacacugggccaacucuccagucucaaaaccccacccucaaaguaacacaaacaaacaaacaaacaaaugccaaaacccccacauuuguccugauaacuucauugcuggcaaauguguagcaaagggcucuucuugaaaggguguaaacaaucucacccuauuugggaagcucuuggcaauggcuucuaaaaucucagugcuuuccauaguuucugacccaguaggaaguagguacuuguuaaucccauucugcggcugugcaaacagacuucuagaggucaagugugucauacaagaccacaccacuggccauugcgagagagcacgagguuggguccaaaguccggaccuuuuuccuuucuccccaugacacacaagccugguaucacuggcccucucuggaaaggggcacugacuugcuucucagugcagaaauucugauaugacuaucagcuuggaucgagaugggguagauucaagggucagccuuacauacaugcaccgggcacaucccuagucuagucagaggugaguaagucuguggcuggaagccgucugaccaggacuuugcugccguggggucaguaaccuuuaaccugcugcccagggacuucaccaccugcggaaaaagccauuaucuccugacauuuggaagcuggagacugcuuucuccguguugaggucagugagggucggaagugcacgcaggugugucuuuggcuuggagcagcccgggagggggaagccuuccugauuuccgcgaaguauggauuacaguaugguuggcuuaacaaaccaagcccugagaaaccaagcuugaacacagugauuccugguggugccuuuuauaaaaugcuugguuaaguccuuugcuuuccuuaugcacugcccaaauaaaccaccagucucaugucucuaugacagacuauuacagcgcuaaccaauuauuaaagaaauagguacuggauauuuacacagugauuacuuuaggacucacaggagagaaauggguguccuucuauguguguguuaugguuugaaauuagaaaucaugaaguuccauggucccccccccccccccagacaggguuucucaguauagcccuggcuguccucgaacucagaaauccgccugccuuugccucucaagugcugggauuaaaggcgugugccgccacguccagcuccauguuuuuuucuuuuaagaugaauauaguuaaauuaguuacuuuaugauggugugucuaugugacuguauuacgccguguaugugcaggugcccgaggaggcuaggaggagcgugguagauuuucuagaacuggauuuauaggcaguuguaauauguucaauauggagcuugguuccucugggagagcaggacgcacuaucaagagucucugaggcccccaaaguuuaggauuuuuugccucuacuuuucagaccacuggcaggugguguccuugaaagccacagugccaggggaagauugguacugaguuacuguucauagaacucgguguuucuuaugaaguuguagaccugacaggugcaaucuuuuuguuuguuuguuuguuuguuuguuuuuauuuuuccaaacagaguuucucuguguaauagccuggccuuccuggaacucaaucuguagacuaggcuggcuuugaacucagagauaugcuugccucuuacuucugaguacuaggguuaaagacaagugccaccucguccugaacauuagugagguuaaguaucuuggaucccuuaaggugaauggagccaggacuuguagaaccaacugcagaaaauguguggaaaagccugcaaggcaaacagaggcaggcagaucucuguaaguuccagaccauccagggcuacauagagagagaccuugucucaaagaaggaaagagagagagacagagagaaagagacagagagagagagguggaucugaagaaaggaauacacaagacacacaagagguaggagugagcagugugaacaucagaucaauuuacaaguccagauguguuagccauagugaguucaggcauugauugaccugcccaaagcaaacagcuagaugggaaugaauacacacaagacuggaauuacgucacugggaugugacccucauacccuagagacagugcaccacgaaauacuucuguauuuaaaauauagcacccacacauggcaacacaaauauuuaaauaucagcgcuauuuuguuuuguuuucuuuuguuuuuguuuuucgagacaggguuucucuguguaacccugucuguccuggaacucacucuguagaccaggcuggccuugaacucagaaauccuccugccucugccucccaaguacugggauuaaaagcacacgccaccgccaccaccaccaccacccggcuuuuuuuuuuuuuuuuuuaaagaaaaagaaaaaagaaaaaguagcccuguaggcaccuucaguguuccugggaucuguuagacuccaggggcaccgcaggauaaucgccuauuauccuuccaggaagccaugagcuggagcccugaaguccagcagcuagagccuugaggggaugggagggaccugguucccguaggcuucaguuucccccaaggaaaagucgaccaaaaaacaaaaagcaaaaagugaagaugccauuuggagcaaaaguuaaagcaauggaaugcacgcaaugagcaacuucugcauccuuucuccccagugguauuucuaucccuuuuccucgggcgccgcuggcugagacagggugucggugucacucuauugcuccgguuagccuggaacucucuauguaggccgcguuggcuucaaacucacagagacccaccugcuuuugcuuuccuagugcuaggauuaaagaaguuggcccacaggaucuaugcuuccuuuucugggugguuggagucuuccagcaggucuuguuacagcuccagagaugguguuaauugcugccuuaaucuuucuuuauucugugcucugcgccccguuucaucugccuacaucuguugaccuggccuguggccuacuuccuacuucagaccuagcccugcuuucuucugucugugagcauccuuguguugugugaauuaaaggugguugcauucuuuugaaauuguuuauuuuuauugacgcagguguuuugccugcaugcacgucugugugagugagugcauugaauucucuagagcuggagucacaggcaguugugagcggccuugugggugcugggaauugaaccgagguguucugcuagagcagucaaucaucugagcugucucuacaggcucccguguaucuucuuaaacuguuuucuaagugggguaacguagaggagcgcuggugggaguguuucacugugaacacucuuugcacuucuauuaauguuuuccagccucaguguuuguguaacgauaugcuugucagagagcagugggaaaggcucaucauccugacagagggguucccaaucucuggaguacggggaggggcugagauagacucuacucacugaccgcuauugugcuugccugcaaacuaaaugaccugaguuggaucaacaaaacccagguaaaaagucggaggcaauagcaucuauaaucccagcacuccuacagggggaugggaggcugagaugggagaaaugcccuggaaguuugagguucaguuagccaguaugcagucacaggaacuuaaaggcacuguuucaagaagguggaaggagaaaaccaauuccgaaagcuguccucagacugccacauaugcacaugccuacagauacacacauacagagagacagagacagagagacagagacagagagaaacuuaagaacaaaacaugcacuuaaaaaaaaaaaaaagaagccaggcagugguggaggcagaggcagaggcaggcggauuucugaguucgaggccagccuggucuacaaagugaguuccagaacagccagggcuauguaugcagagaaacccugucucgaggaagaaaaaaaaaaaaaaaaaaaagaggcgcacagcagauguagcacucaaugggagcgugcaugcccagcaggcucaaggcccuggguucaaucucagcuccgucagaaaacaaaacaaaccaaaacacuguagcaggggcagugguggugcuccuaugaccuguggagggagagacagagguagccugaucuacagagagaguuccaggauagcugggccuacacagagaaacccugucucaaaagacaaaacaaaauaagacaaaacuguaauagcuacuguugacuaggauguuaaaaaguggaagacaccuucugggaccaagauggguucaaugucaggcaggcuaugaugaacuauuaugggcguuuguucucugccauccuagagcagcaacucuuuggucuacugucucccucauccucgggugcauucuuuucuuucuggugagugauucagucugucacuguuuuagagucaugucugccagggagcuggacauggaggugcauccuccuacggugggggugggggugggguggcugauggaggaagauuaggagucagagcccacccacccugucucacucccagguauguuugccaaguuuccccaagaaguuuacuauaauacuuuauuuuacugcccgccccccaugaaugagaaccuuauggggaaauaccuaagagacuuagguacuggguucugcacccagcuuucccgcugguuuuagcccccugggguuccugcgggagugacuaucccucugaugacuggcaaacaaugguccagugucuaacccucgacccugugggagguacagcgauuucuccaggcacugguguaucugugaauccuaagucaaauggaagacaagguguuuguggucuguccugaagaaaaauaaaauaaaggcagggcuugccuggcauacauacagagaccugaguuugauacucagcacugaagaaaaacagggcgggcaagcccagccucucuagcucuuuauuaugucugccccagagggcuuaucaaggaaugacauaauagugauuggggagguguauuuuuccuagagagauauuuaacuagcaaaggugaaguucuagucugcauucaacauagaauguugaauuugaauguugaagcuagaaucugggguguuuuuguuuguuuguuuguuuguuuuuaaaucucacuccuguagaguuugucauagacugauauuuauuuuguuauuaaggggaggugggggcaggaucuugcuuuuguagcccauucaggccuagaacacaauccuuuuggguccugaucuuagauauugacugguauugcaaguuugugucccauuacacagcucucucucucucucucucucucucucucucucucucucucucucucucuguguguguguguauuuacucgcuuaccuguuuguuuuggggguggacucuugcuauggggccucaacuggccuagaacucacaauccugcuuuagcuuucugagcacuggaauuacaggcagacuguaaauuagauucucuagaacuuuuaaacuacauuuauuucauuacguaugcaccacuucaugcuccugaaggccagaggauaacuugugggagucuguuuacuucuuccaccuggggcuggacuccagucguugggcacgugcccuuacuguguugagccaucuugcuagccuagguacccccucccccccuuuuuaaagacaggguuucuuugucuacccugguuguccuggaacucacuuuaguccaggcuggccuccaacuuagagaucuaccugcuucuguuuguuaaccugagcacucugccauugaccuauauccaacccgcaauucuucuuccucccccucccucucccccuccuccucccucucccuuucccccuccuccucccccucccccuccuccucuucccccucccccuccucccccuccuccuccuccucccucucccucucccccuccuccuccucccccuccuccucuuccuccuccacucacagagaucgauccuccugggaucaaggcaugcagcaccaugugugugggaccacaccuagcaaggcaaagaggaucuuccccaccaauagcaucuucuuuuccaguuagaugcaucaucaucaaggagacgcucacaggcagcugccccuuucugggguuagcacaccuaccucucuuacucauuagucacuccuggugucugcaaucuguguuauuuauuccuuuuucaugcauuagcuguauuucuuuaaaaaaugauaguaucuggcaccaaauaucuuguuccuuuagaucaaagggcaggggcaguaaguuaacaucuacagauuaaauccauucugccacuuuuauaaguaaaguuuuauuagaacacaacuguguucauucauuugcacaguuagggccugguaagggaccuagucucuuaggugagauggaggcucuauuggcuuacagaguuagaagaucuacuggccagguuuuuaacagaguaaacaaaucagaccuuucccauggguuaagcaugauuucagugcuugacucuuuaccuuacucuuuugcguuaaugucuccugucuaugacaaugcacauugaacuuagcgauuuaaacccacucacuguccuccauucuguuugcaaaugccacccucacugauacucaaauuaucucaucuuuauccaaucgguacuuccucuaauuggcugcugaguucuuuggacaagucggagcauggcaggacauuccaggucugcccuauccguuccugccccagaccuggagcuagucuuuuugagaagcaguugacuucuuuuaaugggaacagguauuuagaaaccuccguguaaauacuaaaguacacaugcaaaggacucaaggacaccaaacaguaccacggagacuagaagagaauaaaauauguccgguguuuuucagaacauccuugcucuaaaagaaauuauuuccaggcugggcguggugacgcacgccuuuaaucccagcacuugggaggcagaggcagggggauuucugaguucgaggccagccuggucuacagagugaguuccaugacagcccggucuacacagagaaacaaacgaaaaaacaaacaaacaaaaagaaauuauuuccaguauacucuuggggagagggucucacugcagcccuuacuggccuagaacuugcuguguagaacaagcuggcuuccaacucagaaaucagucugccucugucuuuugguuaacccucugccuggguuaaaggugcgcagcccaugugggggcuucaguauacucccaaugcugugucauguuccucuguuuauuuaauaauuguaauuggacacggcaauuguuucguaaguaaagucucuucuguacuuauauuuuguucucccaauugaaaagcacauauauuccugccaaccaguagcauuucaacaauuacuagccguggcuggcgagauggcgcaccuagcacgggugcucauguagaggacucacgcuugguugccagcacccacuuccaguggcucucaacugccugcagcuucaccuccaggagcucccauccucucucaucuggauccagacguaugcacucacgcaugcgcguaccuagauagucacauacauaugccuguaauuaaaaauaaauauacauauaaaggaacaagcucacuggagggcuuucauucaucucccauaggauguccaggugguucugaaggggcacacacagguagugaggguaccaauaccugcuucaccuccgugccucuaacaucaccacacugacuacaaacauuugucagcugaugaggaugucugcucauggaucagguggacuuucagaucuuaccaagacugaagcuaccacucagcaacagcuuccuauucagugcugagccugaggcaggaggaccuacuccgaggcuggacagauggcauaggguugcaggugugcacagagaauaguguccagcgcacagcagaggcuuugucaaggcaagguugucaggaucucucuggcuggauuauaggugggcugccacauuuaucugacaucuacgugauucuagaguuccaaacucugguccuccuucgugugggcaaaugcuuuaaucacugagcugucugugaggccuccaucuuauguuugucagaauggguuucauguaacccaggcuagccccaaccuugcuauguagcugaggacgacccuaaauucugauccuccugccuuugccuccugaaugcuuggauuauaguccuguacuucauugcccaguuuaugugaugcuggggccuuugugcaugccuggcaaguuacauaccagccuguuaacuuuaauuaccuuuuuuuuuuuuuuuuuuuuuuuugcuagggaucaaacacagguccucaugaaugccagauaagugaucuaccauucagugauuaucuuuacucccuaauguuuaauuuugggcugccaguuuucuugaauuuauauuccaaaggacccuggcuauuaaauuuuuauuuugaucagugugacucugagacacugccuccgauauaaaaucugccuacgugugugaauacuugauauuguuuauuucuauuucucucugugcacagaauguaauaaaauaaauacaaagacccgccuuccuggacguuugugggcuaacaagagcaaucauugugugcuucuguuauccuccacuguauaguuuugauaagucgauuauuggugcccaaucguuucacuuugcuuauuaugguagauuuuucccccuccccaugccucucauagcugaggcugaacagccuucuaaaaacaaauaaagccgaggucugagcuggcagugggacuuugaaccugguccccugguucaugucuguggacuuguaugugagcgguuguggccauauguuguuuuagggccaugccaaggaaaauacuuuagaaucacauuagaaacucaagguauuuuggccucuuaagaggacacgugguaguuuuccaguuauaugaacaagggcuuuuguuucauacugaaguuucuuaugggcuuugagaacaauaggcuucucucaguuuucccauaggucuuugggaugcuaauagguaggccgcacucacuguguuccgucuggggagacuucucaggccuuugacaugccauuuuggacuucuucaagggagugggucggcaggauuccucugcuugcuuggccaaggcuuuccgcuguguuugaaaucuuagccuucuacgccuccgccucgcagccucaccuauggcucccugcugcagauucuuaagcacacugcacuguuggcaaacacauggccuccucauccaaaacacacuugucuccuggauccuaaacuugcugaaggugccagggaguggaucuguuaugucccauugcuauuacauucuuagcaccaggcacagggaaggccuucacucgguauuuuuugaaugaaugagggagccguagagaauaccuccugcccccaaguagcaccaauugggaaccaccccuccacagaagccauuuucaggaugagaaccauacauagauggguuuguugacucuucuacucuugggcuucauguucaaauacaaccagccggggugcuagaggcccuggucauuuuaguucagguacaaggcacguccagcaggaagcggucaguuuauuuaaagaugaagcacugugcuugaaauaacaugucucccuucccucgguagagcacggugagccgaccgggauuagaaccuucauuuccugauaccuguugcgggggccguucggcagcccgcagccccuuccaguacugguaguuacaucaaugggaaccaguguuuccgacuguuggggagggaagaaaucagacucuccuuuguacgcuaauuagcacaggcagaacaaaaggccuagcuugguuuucgaguucaacuuuggcucauacgcaauucgcagugaagauaaugaucucagauaaauuaaaaacaaauguuaaagaagucauaaugagguaggaagggaauucaggauuccuguuuucaaauaacacuggguaaacagacuucucccugaagcagacauucaugucuccuccuccacuuccccaccguuuugagccuuuggguucaaaaaucuugucuugauaccuaaaccuggagaggugggccggcgugugcuggucuggugucagugugcacgagagccucacucaccacgccauuaguucuuuggaacuaggaaaauggaacagaggaguuggguugaguccaccaagucaaagggaaucgcacauuuggcaaaaugccccuugccucaggaaugaccgccacagccugcugcccuggcgugcuuccuuuuccuccagucugcugaaggcaaggaccgggcagggagcacacagaaacccccuguguucuuucuucuccuccaggcugaguuccugaguacauucuugaccagauggggggagcugggggcccggagagcugcugcauucaaugggacucuguauguauaugccaaaugaagucuacaggcgucuuuacgagcccagcgaccgugcuggcagauguaaagaaacucagaaggccuguguauguguggagucucaacuccuagcaaguuuccaugagugcauucaaggacucuauacauggaaauucaguuccucuacugacccccacccccgccuagagacgagagucuccuguagcaaaggaucauccugauuccugguccuccugccuccaccuuggcgugcugcgauuacaagugugugccaccuugccugguugaugcccugcugggaauugaacccagggccucaugcaagugaggaaagcauucuaccaacugagcuacaacccagcccauccuauuuacucuucucuguauuagugugugucacuuuagucugugcgagugcgcuugugucccacauaguuuuuuuuuuuuuuuuuuuuuuuuuuuuaugacaggguuucuguguguagcccuggcuguacuggaacucacucuguaggccaggcuagccuugaacucagagaucugccugccucugccuccggagugcugggaucaaaggcuugcaccaccacgcccggcccucgcauuguuuucgauggcuggacacgccccagcagacuuugguaaagucggagagauuugggaugcucagaaucuuguggaggagacauauuaguagcaucuagcuaggagagaggccaaggaugcuuaugcuaagcaaucuuuaagacagcgagggggagagaccuuuaagugacaagaagccaaugaggcagcucaugagaagccugucaguuccucuacugaccccucuacugagaggaccugagcuucucucguguguguguguguguguguguaugcgcaugcgcgcaugugugugcgugcguaugcacaugugcgcacacaugcacacauaccucaauauuuguggcagucagaggacaacuucaggagucuguucucuccuccuaccauguggcuuccagggguggaacucaggucaucagauucgguggcaagugccuuuacccacugagcagccugguuggccuuccaccuuaguuuuggaucuaggaucucucacugaauguagagcuuauugguuggggguugggguuaggggcuagcuugccagugagcuccagggaagucccaccccugccucccuaacucugguauuucagaugcuccaccuagcuuuuuacuuggguucccauucuauguauauagcaagcauguuaucaaccgagccaucucccaagucucugagcacuuuuuucagugauaacacuuucucuguucuguggcccagagaauauucuauucaucccuucacuuaauccucagaaagaccccuguagugggaaccaaggcuauauccuuguacucaagaugaaaucaaagcucagagaggucagcaucccuaccugaaggcucacagcaagucaggggaagggagaagacuucauucagauccaggcuuaucuuacucagcucuuacuaugcggugucacaucccaugauagcuucugugaaccugcacaguguagucuauacagaaaagaugcucaacuggacacguaguauguuguugugugcugaggcucuauugccgauaugggucauucaugucugagcuuugggggugcugggcuuuggcccucacccacaggguggcucuggugugucugugauacuugccaagaaggugucuggaccuucuguugaggagcaguagcuggaacaauggcccauuugcccucaggggacugagggagcaaagugaggggggugggcagggcagaauggagagaccuugguagcuuuaccagucuugggguuaguaaacugugaggacaauuaguauaauuacucgccauuuaugaagagagggaacaugaauuuuagagguaacuucugggguagagagaggccuggaaacguagaacgcuguucugaggucagagaagaacauucugcagcaagggggccgugggugagcccacagacaagcccaggggacugaggguagcugaacggucuuuggaacccccaaccugagcuucccuauccgguaucuccugagcagcugaagccuguaacacgcugcaaggaaaaacucucaugcuuuuuaaaaacaugagacgguuuagaugugcccuguucucaccucuacccuaaggacaagcauguguuucgguuaccaaacucuaucuagccuagguuagauuaaguguuuucucgauccccuugggagugggggauagugaaguuuccugucuccuuucuaggagggaaguucgagcacugucuacucuugcucugucuuccauccacauguccugcuuuaagauacugauucugugguugucaguaagugaauaacugacuggaauagcaugccgguuguccucucagugaggugucuuguggagcccgguccuuuggacaugcuuuaaaauacccguggugccggcucacucauagagccucuggcaugacacaggcgagagcccuucccacaccccacgcugucugucugucugucugucccucuucagaagcuuaugcuguacuguaaugaggaggauuuucuuauuguugaaauguguguuuaaaucuaaccgugcuuuucaucugugccacgagaugucuuccccuugggccguuuuuuuucccucagaguuggcugagaggcccuuggaagcacaauugggcuuuguggugaggaggguuuacagugcccuggaagguggggccagucuugucuaaauaaauaguagugggcuuggccucaggaagaggggauuccuggaaggcaagaguuggagccucacgcaagauacacuuccugguguuccugcgacuucuugugcucugugcugugauggaugcucuugggucucugguccucaggugcugcucugacccagcagcuccuaggacaacccuugacuucagcaacagguccuccauccuucuauagucuaggccuccuccugcugucuccacaagaguagcuguuggccacucugagugacccaggggcugccagcuguuccucucugaaggcuuuacaggucuucccuacauugugguugccugccugccgagugauggcuuuugacagagugcuggagaucuagaagggccuuccuugcugucggcccugcagaggcuuugcauggcgugugaagaggagaguuugggccuuuuguccauggaugcugacuagcucucuguccuuuucagcguauucgcuuuugaccugccugaaaaaggucauagucaggcuuuccuggcccaggguuccgggaaggcuuggucaaggagcugcuuggugggaaguaaaguaccuggccuuuuccuguccauccccacagcgagcgagcaccuuauccugcagcugucuguacagggucugcacccugucacuuucuccugcugccuguucgagagucuccauugcugcccagugcucucaguucccucaucucugacuuggucacgugguucuuugggcucagagccuguggaccugaauaagggcagacggcagccuugguucugggaaagggcgugugcucccugagacacugucacgcauguagagaggggauguuagucauauggccugccuucagcuaacacuuuucuugauuuaaaaacucuggggacagagugguggcgacauggcucagcagccaagaguggcuccugcuuuugcagaggccccgaguuagguucccagcacccacgugggugaggcugcuugcaaccaccuguaaccccagcuccaagaugcacucuucuggucuccacagacacugcacccucacauaucuauacaaaguuaaaguuuuaaaaccaggggcuggagagacgcgugagugguuaagagcgcuugcugcucucccagaggacccauguucggguccuagcuccgcucaggguucacaaccgccuguaacucuugcugcagagcuucuaaacccucgccuuccuuccucugaggacaccgaugcacuggugguucauuacagacagguagacaaacacaccccguuuaaaaaaaaaagucaagucuuuaaaagucuaguuuuucuuuuaagagaucuaaaauuaauauauagaaaauugaaaccgggcagugguggcacaugccuuuaaucccagcacuugggaggcagaggcagguggauuucugaguuugaggccagccuggucuauauagagugaguuccagauuagccaaggcuauacagagaaaccuugucuugaacaaaacaaaacuaaacaaacaaacaaaaaaccaaaaaaaccuaaacaaaacaaaacaaaagaacaacaacaaaaaagaaaaaaguaaaaagaaaauugaacauuuuuaggagauaggguuuugauuuacaaaacauagauucacgucacuaucacgauccaaacgcuuguaaccaccacucaccaacaagcuacccaaguuuuuguuucuacacugaaaauucccuugguaccuacuguguaggaugaagcguaaaggccaacucccaaguuccugaaaguccccauguuccuuuccacuuuacaacucuucugccccgaagucccucucagcagggugacagccacucuuucaacaaagacaaaacugaggcuagaagcuguuuagagcacugacuuccuugcucuaccagaggacccuggcuggagucaaagcaauggucauuaauuaauuccaguuggggggggguuauccaaugccuucuucuggugguguacaggcauaaagcaaacaaacaucugugcacauaaaacaauacuuuuuuuuuuuuaaagcccaaucagcccuggccccggggcuccuccucuccgccccccagccaggguccacacugcguucaccugcagguucggcuccagcccacauuccuggagcuaccucggugcuucaaaacugugugcuguaggaggaaauggaugcugugaaugcuguccuggcagucauucuacagcuacagagugccggaggggcaaggaugaguuaaacaaaacgcucaggagcagauguggugcgcacaccuguucucucagcgacugagggggcggggcaagaugauugauuaccacacguuccaggacaaacccaaaaccggucccgaccacacaccuaagccacuauuuacuuauuuauuuaucuaucuaccugucucucaugcaugguguuugcaugugugcacaaguggaggccaucagccagcauugugauaucuucauuuguucucugccuucuuuuucuuuuacaauuauaauuaguuuauuauuaugcauaauaauaauaugggggaagguaugcaugccagagcacacauguugaggucagaggacaaucuggggagucaguucucucuucucaccuuuacacaggauccagggauugaacuuggguaaucaggcuugggccacaagcgccuuacagcagugagcccucuuuugggcucgucgccuuguucuuuuguuuuuuuguuuuuuguuuuuuuuuuuuuuuguuuuggaggcaggguaucucagcagccuggaguuugaugcacuggcucuguguuuacaggcgugggcuuccaugcccuccuugcuuuuuacacgagccccggggaucuaaacucagguccucaggcuuugguggcaggugcguuacugacggaggcccggaugaaugagguguggacuguggagucuccaggauuaauuuguugcuacugauuuccugggccauauucagcuuaccuggugguuuggagcuauacaugaacuaggacauuucuuaagguaaauagaguguauaaaauacaaucuggaaaccuggcauauggcuuacuacuauaauuauggcacuucagagccugaggcaggugaauugcuauaaguucaagaacagcuugagcuauagugauuuccaaaucagccuagcccagugaaaugugaugucucaaacaaauagaauccugacaacaacaguaaaaauuaaauuuggguccuugguucaguccuugcaggaggacaucaaaagucagcgcacucuguaguuuccuuuaagguggagagaugugggcucugggcugagugaggagagaugcacuggagugagggguggguuccccgaacccagaguccgacugacugacugggguggggaugaaugcccaagaggaaggggaagacaucucggggcaucauguucugucuggaagaagcacaggggucagagaagcagccccucccgaccugugcuuuuguaugcccgugauagcaggaugagcuguccacccuggacccaggguuggcuuccauucacucuauaacacuuaagccagaugacggagcuacacacagcugggucuccagagguggaguuacaggcucauguccaguuagaguucaaguggcagccuggugaugaacagagggacacagacagauaaucuagcuagguaagccuggcauggcaagccagaguuuacugaguuaaugcuuucaaugaaaguagggcauuuuucacuuuuuuagccaccaaaccccaagcccuggucaucagguuuguuccuccaggaacucaagauggcucaggccauaaagagcaaaaccccacgcaggggaauguggcgaggggugggucaucagggcucaauggccaagucagcaaugaugagagacuuugucuuaugaaaucaggugaaagcaacugaaggaacacgucaaccucugaccuccacacacaucugugcauacauguacagacagacagacagacagacagacagacacacacacacacacacacacacacacacacauacaucuauuccucuacucaaguucccauaaagggugccuuaaacugaaccuggaggaaaccagacuccaggcagcccuggggcaugcuugagaaccacuaagauaaacaagaaaugcacucucuccagauucugagggaaaaaagcccucaaaggucagaggguccaguggcucucaaccccggacugcacauuagaaucaucuggggagcuuuucagaacugcucgugcccagcccccacccccgaagauccgugguucaguugggcugggguggggcucaggcuucgcuggaauuuuuaaaaagcucccuaggggcuucugauaggcagccaaguucgugaagcgcugagguccucccugaauauuugaauggcaggauuaaaaaggaacccuccccagcugaacugggggccauuauccacagauuccaaaagccccugcauuguccaaaagccuaugucccuuaucgugucuccugcgcaggucccaggagcaugcucugagcagggugucaggucccugggcuggagugacaauuacagaugguuguggaccaccacuugggagcuuggaguugaacucuggaccucugggagagcggccagugcucuuaccuucuccagcacccaacaccgcucuucaucaugauuaagccaaagaauccaaaaaaaugucuacauucuuuuuggucacugaccuugugucuagcuccacuguuagaccuagucaccccugccaaccccguucauuauuggaaugacaaaauggggucuuuagauacuggugacucuggcucuuuagauaugcgccccacugauggacuaggccguuucacgaguguucuuaaagcgaacacaaauauuauguauuucaugauuuauuuucugggucaagugacucuagaaacauuuucacacaucacauuaggcuaccuacagggagaguuuuauuaacaacauuucacaguguuucuuucguauuuccuucauaaugccagauuuuuaaccuauacaucuaauaccauuuugauacgaguacccaggcuuccuuugaacuaucagauauucuguggcccuaguuagcuaauaacucuauggaguuuauucuaaguuacagucucgaucgucaauugggcuccuuaggacuguguguacgugcacacacgcaugcacccuaguuagccaucacaaucauaaucagucaaugaaacaagcuguuuuagaaccaguuuguggggcugaagguuaaugguguguacugcucuugaagaaagcccaaguuugguucccagcacacacacuggguaacuuccacaccagggguucugacuuccuuuucugaacucucauacgccggccuucacacuugcauacacauauacgcauaauggaagacaaaaugaaucuuuaaaaaaaaaacccacuucuuugugaggcaaacaguauagcgaauucuuuucauacccauuaaacuacccuauggccuccagguucaguggcgcucagaacaucugccuccugagucaucugcccuugaggccucgggcuggagacaguaacuggcggccgggcugggcuaagaaaucuacagucuggaccuggagcuaucuugggggccacugugaccucacacacaugcaaagcacuuugggauuuagggaggggguccacagagauaggagguugcgguggggguaggggugggcauagagaugugccccugcagggugugggccggugugaggguuguagaaaggugauaggcugauaggccuggugguuacccagggauucugcuccauccuggccaugcacaaaacuuggguguacugaggcuccgcaguagggcauggcuucucaaagccaacuuguuagggaauugugguuuguaugaggugccuuccuauaacccuagggcuuuugaauauccaguccucagucgguggcgcuguuugggcagguuuaggagguaugcuugaagcaggaaguguuuucacuggggacaggacuugagguuccaaaggcucccaccaauccuagugugcucucggcuuauacauaaaagaugucagcucccacuuccuguuccagcugccaagccuccucucuguugucauggucuuuuauuucuuuggaaccauaagcccaaauaaaucccuucuucuaaaugauaucauaguuauggucuuuuaucauaguaauagaaaauaacagauguagaaggugggauauugcugggacugcccggccaugcuguuuuuugguaaaauguggaaaacuuuaagauuuugaacuaggaaagcuguaagcaggagcuuaaugggccuauuagaagccucgaaggcaguaaguagugcugagaacaguguggacuauagaggcccagcacaagaaguuucugagggaacaguauuaguaacugagcuagaaaccaugcuuguuugugauaucuuaucaaauuggcugccuucugcccuuggccuaaguacuuguuugaggcuaaauuuaaaagugaucaacuaaucucuuugacugaggagaucucaaggcagccucauguugacucugucaugugguuaucagcaaccacuuuuccccaggucuacaauggaaaaaaggggcagaaagaaauacaaaauuuggagagaacaaggacaccaccgaguuaauaucacagccaaagcuuguccuaagagacaaggaggcaaaugcuggagugaugggaagggcaagacccugcccagcuaagcuuccagcuuacgaaagggcuuaaggcauuuucuuuucugcuccugaaaagcgauugcacgcaagccauugccaaugugguucaagggaccaggggccauuucaaacugggagcugaacuuggcggugacacuuggcucuagauucaagauggauguaggaguuaagggauaauggaaaugcccugcaugguuucaaaaagccaccaugcccaggcuggguauggcaggguccucccuguccaaaggcugugagaggguaagaguccuugagagacugauagaguccccaaagcuguggaagugaauccuggguuguguuggagaucuuacagcugugggaugucugugaaggagagagcugcacguggggagugaaaccaaccaaagagagaugugugcacugcucggaggauagagccagucaggcugagugacacugggcacagagcuagagaauuucauguuugccuuguuggguuuuggucuugcuuugacucaguauuuccucauucugcccccaguuccuccccucugggaugguauuguaaauucagucccacuguacaucggaaauauguaauuugcuuuuuugaguuuccaggggauuccaguuaaaccagugccuugaacugcagaagagauuuuggauuuuuaaauggccagaaagauuaaaggcggagcagagccauuugcauuauaauauagucaagagacuuaaguggcccgggagcuagaccuggugguuugaauggacuauaccccucccucccuccaaucucaggaauguuugguucucaguugguggcgcuguuuggguugguuugggaacuguggcuuuccuggaggaagucugucacuugggguggcguacuuccugccaucccuagugguuuucagccuugugcucacaauaaaaagaucuacucucucugcuuccugcuccagccgcauguuuccucucgacugucaucaauguguauccugucagcgguucccugcccuccacaucaucccccucccucauucugcccuccacaucauccuccucccucauucugcccuccacaucaucccccucccucauucugcccuccacaucaucccccucccucauucugcccuccacaucauccccuucccucauucugcccuccacaucaucccccucccucauucugcccuccacaucauccccccucauucugcccuccacaucaucccccucccucauucugcccuccacaucaucccccucccucauucugcccuccacaucaucccccucccucauucugcccuccacaucauccccccucccucauucugcccuccacaucaucccccucccucauucugcccuccacaucauccccccucccucauucugcccuccacaucaucccccucccuuauacacaagauagacacauggaaaaggaaagacaaaacagucaggaggucagagauggucguugacacccgcugcucuugcauggaauuccguucccagcacccacuggucagcccacaaccuccuguaacugcaguuccagcagaccuuugaccuuugugugcaucugaaugcaugugaugcacauaagcuuacauagacacaaacacaaugcaugcauuaagucuaccacauuauccaacagucccaccacgggguaucugucccaaagaauauucaaaucugaaucccaggaagauauauguucucaugugcacugcagccuuauucacaauggccaagcuguggaaaugauguaggugucugucucuggaggagcaggcccauguguacucacagugaacuaucaucaucagccgcucacaacagagcucuuacgauucaaccucucgaucagacccugaaacauuacaagcaaacuagccucauacaaacaauacugugugauucuacuuguaugaggacacuaaaucaggaaauuugaagcgagauguaggcagaugauuguugccagagaguaaggagcggaagcuguggggagauguuagucaauggauuguaaguuacagucacacaggauaagguguggacaucugguguacaauauuguacugauaauuaacaauguguuguuaacuacaaaugugcuaagggccggugagauggcucaacugcauauccagugcccugaguuugaucucuggagacccugaaagaaggcagcuagaugcaggaguguauaacuuuaauuccaacaccccuagguaagaugggaggcccagagagggaggaucgccugaaagccagccugcuggaaguagcaggaaaaacaggagauaaucugccuacaaacaaggcagaaggggagaacccacaccugaaaguuguccucugaucuccaaacacccgucggcaugcguacaccugaacuuacauacaaauaugaaauuuuuuaaagauuuauuuauuauauguaaguacacuguagcugucuucagacacaccagaagagggagucugaucucauuauggaugguugugagccaccaugugguugcugggauuugaacucuggaccuucggaagagcagucgggugcucuuaccugcugagucaucucaccagccccgaaauaguuauuuuuaaaacugucuaaagaaggcaaauuuaugccgggcggugguggcacacaccuuuuuuuuuuuuuuuuuuuuaaagauuuauuuauuuauuauauguaaguacacuguagcugucuuuagacacuccagaagagggagucagaucucguuauggaugguugugagccaccaugugguugcugggauuugaacuccagaccuuuggaagagcagucagugcucuuacccaccaaucaguaaugagaucugaugugauccgaugcccucuucuggugugucugaagagagcaacaguguacucacauacuuuaaauaaaucuuaaaaagaaauauaaaagggcuggugagaugacucagugguuaagagcacugacugcucuuccggagggcaugaguuaaaaucccaacaaccauaugguggcucacaaccaucuguaaugagaaacaaauaaaaaaaccuaugggccggagcaagagggacaaaggaagggggaaaaauaaauaaauaaaaauagcaagggaguuuggcacuaaggcuccccgaggggacccacggagccaaggagacaggacggucgggggugaagagggaagcauagcaucaggcaggggggcugcauccccccccccagcaugagcaccauacucugcccagcaaagcuggguuuagacacaacugcagguuaucaacggaggguauggagcuaaaagugaucaaggagccagacacggcaccccaaggacagacgugugccugagaacauccugucugcuucguccauugagcuucuguggagcucuaggaugagguccaccuucccaguauuuugaaaccaauggucgcuccuuuaguuuuucccaccagcucugagguuccgccaaccaguucugcaggccuucccugucugauucuacccagugccuucacucaguagcuucuuaucccacgcgcuccacacgcucacugcgcaccaacuucugacuuguuuagcaucuggcccccugccuaaccauguuggccuccaccacugauuguucuucugugggcaucgcagcccgcacauccggcuuucuuucuccuugagcuuauaacagauauguaucauuuaucugcuugucccuuggggaggucuugguuccauaaccagggugggacaagggcuauguguuccgcggcuuucuguccucugcugcauaacugugccaccaacuugucgagugacagacacagccagcucccugcaucgagugacagacacagccagcucccugcauugaaugucaacaccacuggccuggguccuagagugccaggcucuuccugagagggcugggauuuauaauuacagagucauuagccuggaaugcuaagagcaccgaccauccaucaggauguuaguuggugguuuggguuuugcuugagugauauaguuagacaauuaaacucauugugaccuaaaugaaagaucagaauuggaagaaaaacuccgugucucucuuuuauaugcauguauguguggugugaaugcaugcauguuuguguguguaugcaugcauguguguggaagaaaggcuuuggccuugggggggaggggucuuccugcagucacucuccaccauguccacagcgaggcagcucucucacuugaacaaaggguuugcccacuuggguauccuugcucuggggaucuucucuccucuuccuucaggucaggauuacagguaggcaaccauugccugcuuagccucacaccgauguagcaacagcaagcacauuacucagggagccaucucccuaguugccagagguuuuuuucucuuaaauuuguuuauuaagaauuccgcaaguacuguauuuacaucauucccguuccucaagcccucccaccccugucucucuccuccaguucaugcccuaguccuuaauuauugucaugcacacguuuauaauacagccugcugaacucauuucgugugguggcuccuuuguauuuuagggcugacuucuugcucugggcagccauugauaccugcagcucuccaucuaggggugcaugcagccuugugagaacuucaucugcauuucugugccugucaccguguuaucacugcucagggcuuguuuaggugaccgcgguuguugggauuuuguaguugcagagucagugucacacacugcuggggucuggcaucuggagcucaguuguccugugcagcuugaccaguuguggcuuuugguaauugccucaaucugcugcaaaccgaaguuucuucggcuaccggaucuagccagacugugagccaggagacggagucuggguaggugggggucagaggaacucggcaggcaaaggugauuugugauccccaagacaggaacuaggccagccagcaugaggggcaguuuguuuguucuuuaauuaaaaagaaaagcauuuauccauuugcuauuuauuuacucgugugugugugugugugugugugugugugugugugcgcgcgcgcccccaugaacacguacauauggagguaacacucauggaggucagagaacaacuugcuagacuucauacuuucacugugugucugugggagagaacucuaccacuguggcaggccugcugagcggccccccggugugguauuauuacugagagcugaugcaguugaaagcagccuucaaaugcaaacuuugaaguccacuuucaacugcaacuugggcccuuggugagcuuggagaggagacagacuagaacacuucagagugaggauggcagauccugagggcccuuguugccaaggcuauggaacagggagccgacuugucuguugcauguacccuccccacccccaccuugggaugugagggaacuacccucacucugcugcgcugucugggcuugggcagagucaguaucuuccacagauugacuuccuucucagaaguaccaagucuagcauuuucuucaaaagaaaauugagcugggagugguggcacacuuuaaucccagcacuugggaggcagaggcaggcaggucucugagagucuggggccagccuggucuacagagugaguuccaggccagcuagggcuauauagagagaccuuguacccaaauaaauaaguaaauaagaaagaaaggaagaaagaaagaaauugagcgauugggaauuuuaauuuuuauuagucuuuugucauugcuguugcuauaauuucuguuuugcuuucuugagucacaggcucauuauguaccucgggcuggccugaaaccuggagauauucugugccucucaaauggcugggauuacagaugugcaccacaaagcccacccucauuauuuccuuuucuuuuuaaaaaauguucuugguguugugguauacacacacacacacacacacacacacacacacacacacacacaaaggguaucaggaguucaaggcuaccauggucuacuuuaugaguuuggggccagccugggcuauagaagacaaaacaaacagauuaaggagcaaagggccaugccugugcuucagagcacgcgcgcgugcgccaucucaacgaccgugguucccagaguguguggugucuguccugucagcuugccuucugcagcuaaaucacgaagcgagggugugugcgcuccuuccucuuccccuccuccucugucacuagaguugccucugugucagauaggucuuaguucugaguaugccaagaaagagaaguaacacccguugacccguccaguagugacucugaaaacuugucccuucccugggccgggggaagccgggugagcagcagguaugguggacccugcuguggcuaccgcacuggaguugcuuacaggaaagaggucgagugaccucagagacagagacugaccuuggaguuuccugccuagggacagcgcgucaugaguuuugugucuucuugucaaggaaagaaugcauuuuuagguuuuauagacauuggaaggauuguuucaggaugcuaggaagagcugccucaaaaagcagcguugcaaccuccugcuguggcaaagagcugccuguggcugcccguggcugccaguggcugccaguggcuccaccucccagggguagaggcagguagaucucuaugccuuagaggccaccauggucuauagugaguuugcugucaguguuacauggugagacccugucucaagcaacaauaacaacaagaggcagaucuggggagauggcucagcaggcucagugcuugcuccacuuuacuugcugaccuccaaccaugaguugcugagucgagcacccccacaaaggccaggcaugccuuacaucugccaugccacugcugggcagagggcagagguagaaagaggcagaagcuccaggacugcccgccagcguggcaguuaagcuccuucuucagugagaggcccugacccaaaccaguccugagacaggccucggagcuuguugcaggcaugggauagccuuucuucccucaucugagcuagagaggaccuuaccccuuaccacucugucugagcucccugcuccccacuuuguccucugcauccucacugguuuuuagcuugaccuaucuaucuaucuaucuaucuaucuaucuaucuaucuaucuauccauccauccauccaucuaucuaucuaucuaucuaucuaucuaucuaucuaucaucuauuuauuggcuucagcuggccuggagcucacucuguagacuaggcuggcuucaaauucacagaaaccugccugccucugcauccugagugaugaaggguaugugcuaccgugcccaaccuaucauuaauuucuuaaauuguuuguuuuauuuauggauguguguaugucaguuuaaguauauggcauguuuaugcugcugucuaaagaggccagaagaggacaucagauccccuggagcgcgaguuaugggacaguuaguuauaagccauacaauguggcugcugggaacugaacucggcuccugugcaaguguuccuaaccacugagcccaucuccugcucccaagcucccuuggcacacauuucucucucucaggcaucuguacuugucuguccuuccccuaagacauucuucuuuauagcagcaugcucccucccucuccuugccuccugugguucauagucaccuucucaguaaccucuccucccucaugaccacacuacuuaaaacuguccccaaccuucuucauccuccucucuuuuauuuagagcacccuucugccaccaggggucaucuuuugccucauuugcuauaugucaccuccacugaggcuuguucagugugccaccccagcacccagacaggaccaggcacuuagugguugcccaagagauuuuuguuuguuugaaauagggccucacguauucauguagcccaggcuguucuugaauucauuguauaauuaaggugaccuugaaccugggguuucaggugugcgcugcucuguuuuucagaggugcuuagagaucaggcuuggugcuggaggugugcucaggcucggggauggaggugugcucaggcugagugcuggaggugugcucaggcugagugcuggaggugugcucaggcucggggcuggaggugugcucaggcugagugcuggaggugugcucaggcugagggcuggaggugugcucaggcugagugcuggaggugugcucaggcucggggcuggaggugugcucaggcucggggcuggaaguaugcucaggcugagggcuggaggugugcucaggcugagggcuggaggugugcucaggcugagugcuggaggugugcucaggcugagugauggaggugugcucaggcugagugcuggaggugugcucaggcucggggcuggaagugugcucaggcugagugcuggaagugugcucaggcucggggcuggaagugugcucaggcucugcuggaggugugcuagacaagcaugcuaccaagugagcuaagcaauggaauuuuuaaaauauauacauaagcagagacuauauauuguuuuguuuguuuuuuguuuuuuuguuuuuuuguuuuuuuuuuuuuuguuuuuguuuuuguuuuuuuuuugaaacagggucucacuguguaguucuagcuguccuggaacucacucugcaaaccaggcuggccucaaacucacagagaucugcccgccuuggucucccaagugcugggauuaaaguagugugccacuacgccuaacugacaauauuuuaaaggauccaaaugugccuuauaagcuuagauuccagaggagaaaauuaaacguauccagcaaauuuuccucccaaaaggcaaauauaacaaggcucucuucucaagcauaggggcccaggugccugcaauuguccaucggaacaugcaugggccugucuuugccugagcuaugggauuacaagacacaggugagguugcaggagcuggucuuuucugauugacagagacaggcaaagagagccacgggagaccucgggagaagguuggguugagaaguacacaugggugcggucacacauuguuuuacucagcucaaaacuaccuccuaauuguuaauguagacuaaauggaacccauauacacuggacacaaacaggggaccaguuuugcauuuagaaaagcuccaagucaguuuuuaaacaauaaauuuauugagauuugcauaccacaaaaauccaugcuuuucaugaggucagcuaagugguuuucgaaagguugugccgccauuacuacccucuagauuuaugacauugucaucagcccauugguagucacaucccguuucuccugcccccgaccuuuucucuguguucuagacuuaucccagguagacacagggucuuugugaucggcuucuuccauguggcgugauguuucaagguacauccaucuguguuguagcaucuuucagcauucaucucuugcuuaugaccaaguauuaacccacugcguggacggauauaccgagucuuguuuaucuauucacuugucaaugaaccugugggcuuuuuuucugucuuucaaucaccagcaagccaucugaaauguaacgaaaugcuugguguugguggugaguuuuacaaaaaauggaggcaacccugacaguuggugcaaugcucuggagauagcggguacgucuaccuaggucauugucuuucuggucugcuaugauguguuucugugugucgaucaaguauaaaugguugaccuugcaaccugagagcuuccucacgaaacagcagaguccccuuaagccccucuucuuucuagccuugucuucagucugcugugaugucaggauguccucucuccuguccugcaccauucacuguggcuuucugugaaugcuggcuggcucagcgucugggaguugggagcccuuugccauguaacuggagaggaugggagcugugaaugggagcuccugcuugggugugcaguggucugugcaggcggggugguggggaucagguuuaaaucauugccaagcuugguuuacucccauuauugcuucugaaagcacaaggcugaccucacuagaaaaaaaaaaucccugaauucugauaaaaacauaaaccacagacuuccuuuccucuuagaacaacaggugcccggcccugcaaaacaggacuuuugaaugucuucaggcugccaggagccccuggggcaaaagcuccccucccuguggggucacagccuagaggcuuggcaguuagaguugggggacuugagauaacaaguccuguggauaacaaugcugccucuucguccuuuguccaguugucaaccucugauuucccgauggugaucgggugaucugccauuagcagguaacuccauagaguguuuucacugcuucucgguugucucuguuuauugucugcagagucaguggugaacagagaauaaaaggaaauuaaaauaggaagcugggaagggcaggaagagcaaauccccagucuggcaaaggagaggugauguaacuugagccaggcugacagaggaacuucugacuguugggagagggaggcugagauuccugugccguucuccccugacaucaccagacauggucagcagaggcuuuucuguccugcagagaaagagauaaacagaugguuucuuaaaguuagggggagggauuagaaggcugguuggggcauucauucccauggagacagacuugcaccucauaaacauuagcuccccuccacuaccacccuguccccuaauaaggucuucuugucuagcccaggcuaucuugauccugucccacugagacugagauuacgggcauucaccaacaugcccaguuauuuacauuugcuaugauauaggcggaauugcaggaguggaaaauaaugacguuuguagggacacuugagacuggaggagaccucagacaccccagcucucugugagccaaaagaaguucccacgggaagcucuagugugucuccucucagccggagcaccgggaggucuggccagguugaaacguguagucuguuaaguucggaagccccugaguucacacacauccugcagauagauagauagaugaccauccaguuuccucuccuccacauaccgcagauccuggucaggagcuugggccuuggcaguuaacucugagguuggacagcuccacuaaugggcaauuuuuuuuuuuuuuuuuuagcucuuaaccacuccaauccaccaacuggauccaccugccgccgcugccccggugugucuguacuuccacagugcaggcgcuccucagugguucucaaccugugggucaagacccaucuugggagacgaggguugaaugauccuuucacaggggucacauaucugauaaucuugcauaucagacauuuacaugacgguagcaaacuuacaguuaugaaguagcaacgaaaaugauuuuaugguuggggcgggucaccacaacauggggaacuguauuaaaggguaaccauuaggaagguugagaaccacuguuccagcuccuguugucucggggaaauugguuguaaugcccccucacucacccuucccaacccaucggaaugcucuuuuucaguagguuacacucucagagaagccagcaaauccuguggcuugcugugauaaugaccuagauguagaagcuuaccaaccagcugcuuauuucuuacaguuuugaaggguggaugggggaccagaggucagggucccagcaugguaugguuugcauuggugacagacugcuggcugcugcugcauuccuucguggcagcauagcucucuggccucagccaugaggauuuaccuccauagcuuaaucuccucccaaagauuccaccuccagauccggucguauuagauuucaacggaggaauuuggugguaggagcaugaacauucagcccauaauucuuaauguauuuaccauaugguuaauuugucuuguuugugugagacugggucucacugccuagauguugcugcucuggaauucacuauguaaacuauaacguagaccauagauguagcuggcuuugaccucacagacggcugucugacucuaucucccaagugauagauucaaggugugguccaccacaucuggcuuuauuuaaauuuuuaaaauauaaucagugucugucacauuaugugacagaggaaaagaugauuaaccuacaguccagcaucccacuuuuuguuuuguuugugguaccagggauugaauaucggcccuccuacaugcuuaccaagagcagugccacugagcaacaccauacccuuacauuguguguguguguguguguguguguguguguguguguguguguguguguaggucauaggucagccuuguucucaggugucuuuauccucugagccaucucccugacccucuuacuuuugaaacagaguccugguaaguuguacaaaugggcuuugcauuacuuuguagcccaugcuggccuugcauauguaaucccucugccuuagccuccugaguaacugggauuacuugcgggucaggccccaaauccacuuucauugacuacuuccuuugucuauauucugacucauccauaucuuguauaguuauuaccagaggauauguacaaauuugggggugguuuccccucccugguauucuuaaguccggguauuggaggugaagccuggaauauggacacccuguagcuacagugggcauuaggauugcagcaaucaauuguguggaaaguguagacugccauucauaucuuaaccagugacauagacuguggagagcaggccccaccucucggaaaaagcagggggcaucaaguaucaugagguaggaccagguuugggggccucagaaacaucuccauaugccagacaaaaugcuguuuauccuggaaaggaccgagauuuuaauccgucagaagggauuaaacaaaacaaaacaaaacagcauuuugggguuuuuuguuuuguuuuguuuuuuggagacagguuucucuguggugucuuggcuguucuggaacucauucuguagaccaggcuagcuucgaucuuagggaucuuucugccucugccucacgaauucugggacuaaaggcucacacaccgccaccaccuggcuuaaaacaacaucuuugcauccuuucuagaacuuccugucuuuucaccuaauguugcggggcgggggcuguucuuuuagcuuccucucacggcagccagggccguuuguuuugugggccuuuuccuuccucgccacacaccaucaccccucagucuugccguugacagaggcguuagucucuccccucgagucacuguggaauccuuccugcgugcugguuuccaagaggggcuagguuuggaggagaagggacuguugugugggagaugguggggucaaagucucagaguccacggacguucgcucacccucccuuccagagagcugacuuuuagcauuagcacuuuucagaaagcugucuaguugguuuuuuuuaaagauugauuuuuauuuuuaauguguauacgugugcaugugugugagugcacacuugcgagcgugggaagagacccggggagaguguuggaucccccggaagcuggaauaagaggcaguuaguugugagcugcccacuguggaugcugaaaaccaaacuugggucuucuguaagagcagcaaguacgauuaacugcugagcugucucuccagccuucggauguuuguccauuugauagacauaaagaccugagaccugccaguguuuuucaugcuaguguuuuucauaccuccaggaccugagcauagugcagcauucacugaugcccuggucucguuguguuugacacccauccugucuaguuuucagaaccuuugagaugguugugauaggcaucugaagguagggcucacuuugcagcuucaccuggccccacugccauugaguuuaagccccuaguguuugauucuaaaggguaugaacauaagaauuaauguauuuuucuagacaucacauguguuuauuuacguguguguggcaggggcgugcaccauggcauccaucugaggucagagcacaccuuucaggaguugguucucuacuuccaccauguggguccugacucagguuacuaggcuccaggcaggcaccuucaccugcugagcuaucucauuggcuugccccgucucucuuccuuccuuccuuccuuccuuccuuccuuccuuccuuccuuccuuccuucacauguguagaagucagaggucaacacggggcaucucccucaaacguucuucuucacguuaucauucgagguagggucuaucacugaauucacugguuggcuggcaugguuggccagugaacacuggggauccaucaacucccaccuuacccaguguauuuuuuacaugagugcuuaugauccaaagucuugcuugcauaacaggcgcuuuaccaauggagccauuucuucagcgccacuccaacacuuuuugaggcaagcucugacuaagucagcuccuggcuggccuggaacucacuauacagacugaaucagacuggccucacacauguggucagccuccagugcugggcugcugggagagaggguggaacgugaguuccuaacucuuucuagguggugcugcugcuugccagaauuaauaaaccucuggacugucauaucgcuaggauucuggucccgucccccacccucauacccucaccuucaaaaaaccuaacagaauaaauaagacuggcaucgagcccugugucuaaaaggaacuuucuuugcagcguagaguauuuaagugaugcuggcuaacgucccagagucagacugcccccuuacucugccuaugugcagcccuugcuccggaggcugaaaggcucccuuaccuggcagugcagggguuuguugagagccugugggcugguaggagaguucugccaucguguugguuugccuccuuuuagcuuguggaaugugcugagcugaguguuucccauggcaaaugcauaaaaaagauuucucauccuuuucugaaagaaaggggggaaaaugucuucugucugcagucaaaacuuguuagaugcuaugucccaaaccucuagucaugcccuguccuuuguacccuuucucucuggugacuuucucugcuuuuaaagaucucuggaguuaauuuuuaauggcugcauguguggggugagucuggcuauccugcguggguguuaccacccaggacauggcucagcaaggucccgggaacagcuccagggcugaguaggcaggagggacagaaagacaucaguuggagagagagucaaggacccccacccuuugagagggggggcagaaauguggguucaaugauucaguguuguguccugaagcuuuuggcuugcaaaaugcucugugguuagcuuugggguagcagugugguagccgagggcccagcugccuguuggguguguccauuugcucuggcaggacagaaccaagccauuauauaugugggaauccacccacagacuucuuguguguuuguguaagcauauguucauguggauacagacucgcacgggugugugcacauccaugaggaagucaaagcgugucauuuucaguggccacacaccuguaaguuuuuucacauguguauauauguggugugcgugugcauauuuaugcauggguguguguaccgguauguggaugcacauguguauguaguccgugugcauauagugguugagguugacauaaggagucuuuagcacaacccagacccuagagcuugcuugugugacuagucuagcugggaccccaagcucuuggagagacaggugggcugccacaucuacccagcacuugggagggacugggggugcagacuccuguccucagacauguugcuugcaagacaggaaaaagcacuauaaccgagccaucuccccagucucuacuguccuuuucuuggagauagggucucccacuggucuguaggcuuggcuggccagcaacugacucagauccuucugucuuccucuccccacugcugggguuacaagucuaccccaugccuggccuuuuuuucuuuuuucuuguuuuuuaagguuuauuuuuaugauuuuuuuuuuucauuauguggguaggguguguggagacugaaugugaaugccugugugccuguggaggccagaagagggcuuccaaucccuagaccuagaguuaacugcagcugcaagcacccaacuugggugcugagaacuaaacuuagguccucuggcagagccagauuugcccauuaaugcugaugccacucuccaauccuaagcuuuuuuaacagugucaguucuaggggucacacucaucauugcuuaaagagcaaucacuuuauggacugggcggucuccccaagccucgcucacagauuccuaauagcucucaucugagcaaaucuuuucgauucucaaugaaaccucagcgugaucgucucuaccgucuggcucccaggagucucucauacuugcccucugguggccuccaaagcaaggaaguaacagaugacccgugggguguuuccugggcuccaggcacugcuccaaguaucugucuaccccuucauguacagcagccguagaagggcuggccccacuucacagauggaaaaauggaacuaucaugaggccacaugauuuguucaacaccauguacagccaacaaacagcaagaagccaauggcuucuucacugucggcacugaacaugagugauucucagccucagccugagaagaacacuugacagugccccuugccccaucucccauaguuuugucaaagccuucaacugcuucuccccuacgguuucuaagggaggcuuugagugauuucagguuccacagaucucaggguccagcuguccuguuucuaugcuuguuaguaauuuuggugggacuagagacgagccuucccaaagacgaaguucuugaacacugacagaguggccugcauauuuacguaaggauacgaaagcaucccugcgcagucuggccagugccaaagacuaaguguaaaucaauaaacuauaaaccaccccagggaaaucuaucuggacguggugacucgaaucugcaaucuuagcacucuggaggcugagcuaaccugggcuaacauagugauauagauuggacucaggagacagauaauuaagugagcaugaagaccugaauuuggauauugagaacgacagauccccagaguccacuggccggucagccucuucagaucagucgucagugagaaacacugucuugggcuggagagauggcuuagugguuaagagcacugacugcucuuccaagggucgugagcucaaaucccagcaaccacaugguggcucacaaccaucuguaaugggaucugaauacagcuacaguguauuuagauauaauaauaaauaaaucuuaaaaaaaaagaaacacugucuuuaaaaaaacaaaaaggagagaccaauaaaagacacuuaacauacaugcacacacauguguaaaccccuucuucauacaacacgcgcgcgcgcacgcacacacagacacacacgugcacacacaccaagcaagcaagcaagcaaguaauucagagaauagcuucaagaaucuucuuuuuuggggacaaauaaucagcaggaacagauccuggcuggagcaaagggacauauauauugaagggagggaccuagaacaugcugaguccuagcagaugacaaccuguuggcuccaugccaagucuaagaucuauggucguugggauacaugcacaguuacuuccugagugugcuucuggggugcucucuguaccccgcuggccugucauuaggcaacauuuggcagaucaguuuaauaaaugucauguguucuugucccaaggcugggcguaugugcaccguguuccaaacacaggccacagcuucaagaaucaaacauggggagggcggcaggcaagcugccaauggcaaugaagaagccauuggcagugaguuaacccuacggacuccaugaaacccaaggcuacauuggcggcacuucagauacagagugcuaagucacagggggagaggagcaaggcagggugcagagggggacuuaagaagaagguggagagaaaagggagagaugguggaguuugacaaguccugucagaacugagcgagacugucagauagacacgcaagccucucgcacagccugggaccuggcuggguuugcaguucuaacuacuaacccgcgagagcggcaggccuggcaacucuggcauucauucuuugugagcugaaguccugaaggaagagcugaacacucuuagcugagaaguggcgggcacccgaacuggcgccaggagacgagggcggcaggaaugugucaacaccagcagcuggcugauaucugauccuggcuuuccgugacuuccgcuucaaccauuguuaacauaccaagcaggcugugaaugaaugaaugaaguggauagaggauucugcaugggcucucccagccuggacagaauaacccugccugucuagcacuuggagcuuguccugccuuuugggaccgggaaaccuguuuaaguaauggccucaaugaguguuuuagauucaaaggcagugauuauuguuggcuuuguugggacagagucaccacuuuacaagauaacuccuccggaaggcuucuuaacacaacaaaaguuuaucuuucgugcaugguacagucaauguaaacauggagcaagcauauugcccauugguacagagacucaagccuuucucaaguucaguugucuuccagaacagugguacucacgcugaguaagucuccauauuaccccaggaugaggaauuuugggcugggaagguagcucagaaguaguuguuauaaguaaguaugaagguccaaguucaaugccccagaacucacaugcaauugugugccccagcagcgugugcccguacucacaggccaugggaggcagagacagcacaguuccuagggcucgcuggccagcuaggcgagccacauugcuaagcucuaugcucacugagagacucucucaaaaaccaagaugaagaguacccgaggagacaacaaccuauacugauugaucucuggccucuaaaugggcacacauuccaaaaccccauauuuauuucuuucucuuccccugucccauuuuuucuucuuucuuguuugauuucuguguaggucuggcuguccuggaacucaaucugcagaccagauuggccuugaacucagagacugcuugccucccaagaacuaggauuuaagaugugcaccucagggcuggagagauggcucaguguuuaagacugcucuuccagaggcccugaguccaaaucccagcaaccacaugguggcucacaaccaucuguaaugagaucugaugcccucuucuggugugucugaagacagcuacaguguacuuauauauaauaaauaaaucuuuuuuuuuuaaaaaagcaaauugcaggaaaauaauuaauuuuuuaaaaaagacgugcaccucaaaaaugacaaagaaaauaugucauuuuaaauuuuuuaaaaaauuauuuuuauuuuaugggcauuaguguuuugucuacaugugugccugucuggcaggcaguugugagcugcuaugugggugccgggaauugaacccagguccucuggaagagcauccaguucucuugaccacugagucaucucuccagccuaaaaccuccauuuuucugaaguccuacuucauuguagaaagcccgaggauugcagggcuaggagguuccguguggcugcggcagcuggcccagagaacacccauugagaaacccugcccuagggccuguuaguucccccugaagggcugcuuccagcuaagcgaugagggaggagagcaaagggagggugggugcaaugaccccacuuucaaccccaagggaacuggaccagugcaggccuuucauguguccagaaggaaggcggcauggcacugucucugccacacuuaggaaggcagcacagagucaggucuaacauggucuccaccuugccaguucaucuccaaaggaauuccaacuuuucccuuacuaauggagcugggagaugacuuuuuugggaaagugcuugccaugcaaguaugaggaccugaguucaaauccucaguauccacauauauaaauaggcacagcaguaugcuccuguaauccuaguucuggaaagggggagacaggaggaccccugggccuugaugggcaucagaugagccaaauugagaggguucacugagagacccugccuccaaaaaauagagaacccgaggaagauaucagcacuggacauggcuucugcaugaauguccacacguggacgucgacuugcacauagacacauacacauguacaugcacacacagagacacauacacaggugccaaaagagaaagaagauagaucauggcuagaaccauuacugaauguccaguucugugugcaggucaucgacaacaggcaucucgggcuggagagauggcuccccucuuagagagcacuugcugcucuugcagagaacagaguuuaguuccuagcaccaucacggggccguggggcaucucacaguugucauagcacaagcuccaggucaccagcauguacaaauauacacaugcaggcagauacauacacauaacuuaaaacaagcagguuccucaggcacagaaaugguucugaugcucuggcccagccaccggauccugggccaaaggaagcacacuguaaguuguagucuugucguucuugcacacaauggauuugacucugaugguuccuucuugguguccuuucucaucacuguugucuccugacccuaagacccuuacaacacuagccuaaaugggguuuauucuuuuauucauguuguaguucagcccugauguuaagggaucgucacuguggcauggucaguuauuuuuuguguucccucccagcacggcuaagcuugaagaacuaaagggucucgaguaaaauaaagcaaggguucgaguuggcuuuggguuggcauggaggugguauguaucgggcagaggguuggacuauuacugcucagaucgcuaugggaacuccaggcucaccuggcggggguagggucaggggucacggcuugaacaaagugaaggaggcagagauaagacuggggguguggggagcccugagugucacccaucgagaccuguguagguugagggaauagaguugguggggagaguaggucuuugacuuggggugccuacuggagccacuuguguggagcuugcccguccugcuuuaaggaauuaucuuucggaaagaaaucugaugacaagaaugaggaagugaccugacugaaaagucucuggccgauccucgagggccagggaagauuugagugucagaagcagagggaggcgagggugggagcuccagucagaggcugagcuugggaugggcaggagaggcccugacagcuaggaggaaggcauggacccagucucugaggaucaacaggagauaggcagaggugguguucuggaaaacacaguuugucagacaggccuaugggaucacguguggucaaggugacccagagacagggaaaucagaggacaaggggcaaauguuaagugucaguucacaggccaaggccaguggccccuaggaguucaaacauguaugucauggugauuacagaagucugcaucucuggcccucggagcacggauguuggaggacagcuuccucacgggacagcauggcggaggucagccaugucccuuugucacuguagcucccuucaggccucugcugcccuuccugagcccacugggcacaaaaccagagccuuucuguuugauuuggcuugugaccuccucuuagggccggccaggugcgcugggcucuuaaaggacucaccucuucuugcccuuccagucuuaccccugcaaggcaaagacucucaccaucugcuccgguauuugagaaaugaggaaacaaacucucaggcucagagaggucacggccugccuugaguucucuuagcaaaguucagcgcaggguucugucuacaucugggcgccuugacuccacccgcagagcacgugaucgcccguuguucaguaucucaauagcuucaugaugaauucugugcggcuuaagaaaugaagcuagguguuucuaggcaggauagggguugagacuaagggagacaccaguuucaagaaagugugcacuggugaccagugccagagaguugacagucaccaccagcuugggcaccagaagcuuaggaacgugggaacccucagcaaagaguccuucuaguggaaaccuggggaaagagcugcgggaaagagccaccagcugcaggaaaggucgucuugacugcuguggaucuucuacagagguugccucugagcgacaggaucaagagguuucuaccugagguguuacaaugcucuggcagucccuggcuugggguuagaggguguuacaaagaagcagcuuuguggccugugguggguuugguguguugaguguggguguguguucaauguguguucagguggagauguguaccaguguagguugggaaucagagaacagucuuguuuggguguugguccucagggguccucuucaucuuuuuguuugagaccaagucagucagugaccuggaacuuugcuaaguaggcuagguaggccuagcuagccagugagcucuggggaucugccuguuuccgucucccaucgagucacccccaggaugacaugcaaguaccaccguggccggguucuuaugugggcucuggggauugaacuaggacucuuaugcuagcaagacaaaggcuuucccuaugaaaccauuucccugugguguguuuguuuguuuguuuguuuguuuguuuguuuguuuaaacuuguucauaguuuaauuuugggaguuaggucccuggcugacuguagccuagauugguuaaggcccugucuccucgucaaacuguguucucugugccucauugagcaugaggcucauauccugggacaguaaaugugucugugugugugugugugugugugugugcgcgcgcgugcgugugugaaaccuuaccuguccuggaacuuuuagaccaggcaagccuugaauuuacagagauccuccugcuucugccuccugagugcugggauuaaaggugugcaccaccccugcccaggcugcuaagugauuuuuuuuuuuuuuuuuuggucagcaaugcauaugaggacuauuccccuuccccuccaaagaacacaaaaaacaaaacaaaacaaaacaaucaccugagcuguugugauuucuccucacugucaaggggcaccaggcagaguuggaaucggauccucuuccccuuccaugagacaagucagccaugacagcuguggggcuccugggaccccgcacuuguuagauuuaaacauccauucucguucuuucuguucugggcaucccucauaucaugggacacaaauccaugacuuggaaaguguccuugccaccuccuuuggcucucauugcgucuucugacucagcggagaugauaaaccgauuucucaaacguuugaaggcccaaaagcaaauccccagcaccagaugcugaaacagugcagagcuucccucaaggagguguagcucggcaggcaggguuagcguugugaccucucugaccccuccgcuucuagugcacacucacuuuccguuuggcacuuccucucagagccuccguggcugccggcuggaggggacuggauccccugaguccucaggguugagugcucucgauucuuuuucucuccucaaagagacugucuucgugauuccuuaagccaaagauaugacugccuacuauggaauuccagucaccugggacaggcugcagggaaaaaggaggauacagaaagagacuccuucagcguucugugauugcaacuccacucugcauacauuacguuuauguuuuaugaugucccauuagcguauguguacauaugugugcuaucaugcauggagaccagaggauaacacugacacucugugagugcuauccagcuuguuuuuuguuuuaaauauuuacuuuuauuuuuaguccuguguauguguaugcauguuacaaugcacauauauacuggggcagaagagggugcuguaggagguuggugucaccugauaggagugcugggaccugaacucuguaaaaguucucuguaagagcagcaagcacucggggcuggagagauggcucagugguuaagagcacuuccagagguccugaguucaauucccagcaaccacaugguggcucacaaccaucuguaaugggaucugauuuccucugcugagugucugaagacagcugcaauguacucauacauaaaguaaauaaauaauuuuuaaaaaaaaagagcagcaagcacucuuagggacagaucaguuucaccagccccccaucuuguuuuugagacagagucuuucauuagucugagcuugccgaggaggcuaggcuggcuagccaggaaaccucagaaucugcuugucucugccaucccagcucugagacaacaugcacacaucaugccauguuuuuaauguagauuugggggguggcuaaauucaggucugucugcuugcaagacaagcauuuuacugagugaguagucgccuuggcccuacauugacccaucuugagugaguuuuuaugugggucaguaagguugaaauugauuacgucuccuuuucuugguccaauggcugaagcaucuuuguugaaaaggcaauugaauugcuuaggcacacuuacaccuuacaacucacaccuuacacacuuacgccguacauacuuacaccuacacacucacaccuuccacacuuacaccguacacacuuaaaccugagcauauugugcuguggggaagggguggguuguuucugauuucuuuguuguguauuauugauccccucgcuaaugccauguuguuacaauuaauauuguacacagcaaguccuuuauaggaaggaauuuuccuuuguucuuuuccaaguuuuccucuaauacagagaauccauaggaagucuagauaguuugugaagugagagucguaacuguccauaccugaaauacuaaguuuucuucccguaugcucaccuagaaucuuacaccugugaauggccauagcaccuucauucaaaauaaucacaaccugaaaaaggcccaggugguuauuuaugauauacgacugaucaauaaaaaggaaugcaccaauauagaugaacuucagggaaauuauagugcaugaaaaaaggcuacauauuacaccgauccuucguuuuuuguugaggcagaacuccaaggcagcccagacuggcuucaaacucauuguggugguuugaguauguauggcucccuuagacuuauguguuggaaugccuggcucauagggaguggcacuauuggaagguguggccuaguugcaguagguguggcuuuguuggaggaagggugucacuguggagguggacuuuaaggucgucuaugcucaaacuaugugcaguguggcacacagucuucugcugcucacagaucaggauguagaacugcuaguuccaaccccagcaccaggucugccugcucaccacagugauaauggacuaaacuucuggaacuguaagccaaccucaguuaaacgguuuccuuuauaaaaguugccuuggucaugguaucucuuugcagcaguggaaaccuuaaggcacucaugacuuuccugucucaggcucccaaguacugugacccccaaccauaaaaguauuuuuguugcuccuuaauaacuguaauuuugcuaccgcuaugaauuguaaauaucuguguuuuccaauggucuuagaugaccccuaugaaaggguuguucaacucccaaagggguugcaaccuauguugagaacugcugccauaaaggguaucauaugaggguguuuugugaugauauaguuucuaucggcuaucccuguugcugugcuauaauacucugccacaacaacaacuuaaggggaagaggguugguuuuggcucacaguuugggguuucacaguccaucauggugggggagucaaggaagccagagcuugaagcaacuggucacaucauauggcaaucaggaaaagagacccacuuucuccuuucuauccagucugugaccucaguccagaggauggcgcuacucacagugggucagucuuccuaccguaauuaaccaguucugaauaaucccccacaggcaugccaggacgccugucaagcuaacaauugagaucagccaucacaagucucuacuguggaguuggcacagugcuacacaugaucaaaccgugcugaaguauauauauacguagaagugcuuucuuaaaaaaaugcuuuuaaaauccaugaaaucugagcaagcaccguagauguaccagcaucgacauccuggguuuugugguagggcuguauuugcuggcgcaugcucaugugugugcagggaaugugugcauagucgcaugugcagacacuccucagaaguugcccaucuugcaucuugagacaggaucugucucugucucuguuugugugugugucugucuccccccucaggaccuaggcuuaggcuuauuucuuaggcuuggcugacuccugucucugccugucaaggccugagauuaccaacacacggccacagccacaccuggccuuuuuuuuuuuuuuuuuuaagauuuuuuuuuuuuaauguuauaugaguucacuguugcugucuucagacacaccagaagagggcaucagaucccguuacaggugguugugaaccaccauuuggcuguugggacuugaacucaggaucucuccagccccacaccuggcauuuucaagaggguucuagggcuugaacccggguccucguguugguacagcaagcacuuuaccaacugagcuaucucucccgcaguauucuggugugugcaugugaugaaguugguuaugcaacuugggcaagcuggguaaaggacgccugggacuuuauguguuucuuuuacauuuccuaugucuaugcaaucacuucaaauuacaaagacaaaacacaaaacagcauuacacugucugauaacagugccgaaccuauaaaaacacggcugugugucuguuuugugcagaaggaugggagguggcuucaccugaugccauaacaauucuauuuuuuacgaacagaaaccacccuggacuugaagcagauacaucuaaauauuagcacuggugaauuuugaugauucgauuuaucagugccuugcuauaaauauuucucugcccucauaaaucuguuuggaucauucuuuuauuuugaaaauaaacugaauacaaacaaaagcaacaauggcguucagguauuuucacauuaucuuagaguguucacaaaauugaucugaacacuuaaucuuuccuugaugaaaccgcugcuuguccacucccagacaucagccuccccccaaugaguccccgaugcuggguugcagaggcuaagaaugccaugcaucuuuuuuauugugacacacuaauuucaucuuaauugcucauuauaguauugcauuauaaggaggcacuauuuuuaauuaccuuuggggaggcuguuucuaaagcugucugcucucuggggcuagagccauccguucccaaggagucaccugacugugaacuuucaauauuggccugaauagacuucucugcuucucagaguggagucuguccuucccccggagcggugaaaagaauuccaggugggugguucuccccuuccuggucuuauuuaaaaauaugugucaucucagggauuacacacacacacacacacacacacacacacacacacacacacaucaguauuccaaaugagagacacaagaauaggccgucucccaaaucuucauuuaaauauuggccaugcccucugaagaucuuuuuuuuuuuuuuuuuuucuuuuuuggugacauguuaaacagucucaggucagcugcaguccuuaaaggucaccguggguguaaggaaugcugcuaacaaauguacaagaccaacucgccaaggcauccuucagcauagcccucgucucacaacacacuaaagagcaaugucuucuggcuugucuguuggauguaaauuucugcagcuucuccacggauugcucuaggccuuugguugccauuguggggguaggggcacuucucugcaguuggcggccggggugggggugucauugaaaacccacagagacgucuucacacuggucuuugugguaggguggccucccuucccgugggcaaagcccaggcuggagcccucccggcugcccaguggcuuuugugugccugcagcuuucagcuccuguccaucagacugaaugggcccauucaggggcauucaugcgccuccgagacccuggcugccgggacacaaucagcugagagggcucugugggcuccgccgaaugugacuguucagccugcuuccaggaaccccccgauuguuccgaggagccugugguacaggagggagcccacaagaguaacaucagucagucauuugggguucauucaugcugugccuugcccuccaccccccaaaaggagggauagcugcaaugagcaagcccaggccgaccuucaccuuuuaucuuccuauacacccacuguuguucugugaagaggagaaaccuuuuuauaggccugcauaccagaagcacuuaauaagugcuuguugaaugaaugaacugagcgccugcugcuuccguuuggcccuagggagcacugauguguacuguguacauacuggcuuuucaagaguccccccuucaacucugcucuuuugggguguggcaagcccguggaagagaaggggaucaccuuguguguuaaggagagaagaauuugaggucuagagacagaggacacgaucgagguagaacguggccagaguguagcccuuugguaggaagguguuugcagggguguucuggcgccuucuuagggaccccagaccucugcagagggggugcuguacucagcggaugacuuagugcacgugccucagaggccucacacuuagcuggcuucugugucauuugcuagccaacauccuuaaaaaccucuggcccuuguuccagccugcaucucugcuaugggccaggcaucauagagccaugcugaggacaaagacauuuuugaaacgcacaggccaaaaugucaaagaaacagugggaaacugugaggauggcagccacagcagccuuaggaauuaauugcaaggcaguucucucccuauaguccaaggcugacuugguagccuagguugcccucgaauucacagcuauccucguagaacuaacguugcaaacaugagucgccacacccacuuuggugguggaugccuuaaacaugauuucuaagaccuuauuuuuuuuuuuuauuuuaaagcuugugucugugagggggugugugcacgugugugcaggugccaucagaggugccagauucuuccugguauuggagucacagcccaguugugagcuucuagaugcaugugcuaggaaccaaacucggauucucuggaugaccaagcccgcccuuuaagaaauuuuucagagccccucgagguugggaagacagcucagugguguacugcuugcuguacaaauaaggaccugcguuuggagcaucaggaccuauguaaagcacaugcacaugugcgagccuaacuuuccagugugggaaguggagcuaggagaauaccuguaaaccgggcauauucggcagggaagauaaaacaaggguagaaggugagcucccacaucugagauuguccucugaccucacacgcacacagcugcauaugugccagaacucacaacucacaugcacaugaaaacacacacacacacacacacacacacacacacacaccccacacacacacacaagagucgauaagagccuuacaauuuagauaaagaaacauacaguuguauaguauagcauggaacacuuuccaaacugacaacagcuggagugugugugugggggggcaguaucacauucaggacaaguagaucagaaaacucccuccccaccccacccucauccccuacggccauguacucugggaggaggucaugggcucaggaaagcuggcauucuuucccaaaagacguguucaguggcgaauggaacggagugaguuugcaugacauggcaguguuuucaaacccuccggacgcuguaaaacauggauggaugcugcuggaccucgcacccugguccugugcuggcuuccagccacugagcccacccggcuucugcuuccucagcugugggauggaugggaagaagcccuggcacuauucgucagcaccguguacccacuuagcucauguagaaguugguuucuucacuggggucagaggugggggggcuuuucucugggaggggauacaaauuugagugcaggcucuaucaaaggcacuuuugcagcauggaacacgguuuucugguuuuauuuucaccauguuuugacguuguuucaucacugcccagaacuaucugugcugcguaugaucagggugccccagcugugcgucccuguauccaauuacuggugcagccacagcuggcggggggagacaguggucucuggagcuucagguucuuucuaaccucagccuagaaaagaugccucaucuugcaagugauaauagcauuuucuaccuuccucauuccugaguucucacauuggaaagucagaaugaaucccucagccccucugugcucagucuucuaucugcaagugcagguugaaugguaggauuuauacaaagcagggagagcccuggcagacccagugauugucgagcuaucguuucuuauuucuucacucagaugaaucguaucccuaccccagaacagucagagguugcuaugguagcggugaccccagucguugaugacugacugaaauguuccuaguuccucuguccuuuauccucacaugugcuagaggguggaacccugagaggaaagcucuuguccagucuguacagacagugacaagucucuauucagggcucuucacccagaugggcagccagagucucagacagguucagaagcuggcaaggccagugggcugccgaugugcagccugaaggacauccugaaccaaggauguuuguuuguuuuuuguuguuguuuuguuguuguuguuuugugaucauugucuaaaugaucucuugguuuaaacagcauuauuagggcaacuggcaauauuugaauagucuguaaaugggaugauaguauuguauccuugcuaauucccugguuauguaauuacccuggcuauguaaaagaacgucuuuuagggaaugcacaccggaaacaccaaaaaaugaagaacaucuugcucucccgugguugggaaggaaaaaaauacauauggaaagauacagaauuaaguuacaguuuuugggcauuuggagagaaggguuguauaagaguugauuuuuuuuuuuuaaaccauuuuuaaaucuucucuaguagugugaaaguguuucaaaguugggugguaaugguucaugccuuuaaucucagcacuugggagacaaaagcaggucgaucucugaguucgaggccagccuaaucuacagagugaguuccaagacagccagagcugcauagggaaacccugccucagagaacaaagucaaaccaaccaaacaaaacacuuuccuucuuucuuucuuucuuucuuucuuucuuucuuucuuucuuucuuucuuucuuucuuucuuucuuucuuucuuucuuucuuucuagauuuauuuauuuauuauauguaaguaaauacacuguagcuguugucagacauuuuuucuucuuagcugucaucagauaccccagaagagggcaucagaucucauuacggaugguugugagccaucaugugguugcugggauuugaacucaugaccuucagaagagcggucggcgcucuuaacuaaccacugagccaucucuccagccccacaaaacauuuucaaaugaaaaggauuuuuaaagauucccuccaugugggaaggaggaggaagaggagggggaggaggagaaggaggaggaggaggaggaaggggaggaggagguugauuuguuugucuuggcuuuuauuauaggaaguacugcaacuuauagaaaaaugaggcaaagccaagaaauacgcauucauaugcgcgcgcgcgcgcgcacacacacacacacacacacacacacacacacauacacagagguugggagcccuacuuauaggaacugaacaauaaucuuucgccggagggacagaaccagggcuguuucuuuccagauaccuaauuccacuggcuaaaacuuguuuugucuggaacuuugugcauauuuucauccucaaaacuuuaaguccagcaaaauuuauuuaaaauugucaucugcaaaagcuacacggacuuuagccauuggcccagcuguuuagcuccacccccuuccaguguuaucuuuucuaauggacuuuuaaaaauacauuauauuuugauuacauuuccccuccucucacuccccagauccucccuacucucucauacaccccaauucacacuuuuuucucucucucaucaaacaagccccuaaaauaauaaaaagauaaaauaaaaaccaacuauuaaaggaauucuggacaugguggcucacuuguuuaaucccagcacucaggccagggggagaugcgggucaauagcuaccugugaguuugagaucugccuacuauggauagcaccucuccucuccucuccucuccucuccucuccucuccucuccucuccucuccucuccucuccucuccucuccucuccucuccucuccagacaggguuucuccauguaaccuuggcuguccuggaacucacuuuguugaccgggcuggucucaaacucagagauccgccugccucugccucccaagugcugggauuaaaggugugcgccaccaccgcccuacuggugaagacaguucuuuagagggcaugaagaugccuuccuuucugagaaggcugaaccuauaaagucaaguagcagcuuagaccacugucacaauuguucccaaacuggaguuuacaguaugcauugucaauuucuggaaugggaggagggaccugcucccccccaggauucacacaagugaaaaggaauuccuaaacucaggaugaacgcaccaaugccagagggcugugucucccugaauuuugggcuuucuguacucauauagaugcacccugcugccuauuaauugugugugugugugugugugugugugugugugcgcgcgcuugcuugcuugcuugcuuguguguucacucacaaaggcccaagguuggaguggggauuguuucuugauuugcguucauuuccgcuguagcauugagacaggguuucuccauugacaccagcgcuccccaugcagcuagcuggcuugcucucugcuuucugaacauaccaagucccugcuucagacuuguucagcgggagcuccucccucccuuccuacccugcaacaugcucaccgugugcacauagugcccauggaggcuggaagaggguguugggucccuaggccugugguuaacucucagguggaugcugggaccugaacuuggguccuaugggagagccacacaugcuguuaacugcugagccguagaccuuuccaucuuaaccacuuuucauuuguaguccagagacaccacgugcguuuaaacucugcaagcacagagcucucgucaaggccccaguaacagccauuaauuacuccuuccacuaaccaccacgccucacuuuccugucccucugaauuugagcauuaaacagauuuuaucauuuccucacccaagucaucugcacaagacccagggcugagaagcaaagagaucuuugugauugggaacuugagugcuagguaggaggcggugggggaggggaggcccgcuaccaggaagcacggcaggguuucaggcacuugggguguaccaggcauucugucucugucagugcucaccccuuccuuuacagccaagacccucggggaggucugacaagucauguggggcccacacaucaggacuuuguaaagggcuccaggagacuccaguguguaguuagugcccaucaaggaucauggcuucucuaggacagcuguguuuguaacuucugccaccugggaagggugacaucacuccugacacucuagaacuggucccgccuuugcuguaggccauccugucagggagauguguucccugcccaggccugggcccagacccagagagcauugcuccuuccuggauggcccuccaaggcuccccagcacccaggccuucccuuugggguuuccucggcccacaguucuguucccucuccucuaaaccagucuuugugaacuccuguguucuuuuuccuucagcgggagauguauuuguuuugauucuccagcugcuaaaccuaguagguacuaaguaaauaagaggcuaaugagugaaaggaaagcaggcagggacaugcaccucugcucagggagagccaggggaugaacacccuucucuaagaaugcaggacagaaagccagccagggagcuugcaagcuggugcucccuggggccuggcucggagaaguguggugcccugcucgaguauuugaugggaggagaugguauaguuugggggaccuggaccagaaaagcugggaagggaggggcaggagcuggcacuggcccagcggugugagcgcggucaggcagacuugcagcaguucugagcugcccuccggugcuucaucggcacugcugugggucuggugcuuggggggaauucuugaacauuggaauggguuauuuuuuuuuuaaauccuauucuugacauuuacaaaugggaaacaaaaauaaaacccacacgaugaaguauucaugagaugucagcauuccagagaccaccggugcucaaacccggcacugccagggaggcacacacaguauguaucccugcccgccacucugucucuaguggaauaucuuguaaauguggcauugguuagggagcuuguagcugagcacacggggcuccucucacggugucagccagaugcuugugugugcucucaaugggcuuggcucaggguggcaucccagcacagacgugugugcaucuucucaucguguuuuaugugcaugacagggaaacaggaguggcuauuccgugggaagguaguagggcuuaggcuggaccccucaacugagccacuuggcuccuaggugaccuucuguaggccaucuaguccuaccuaccgaauuccgucaagagccagaugacuauggggcuggugauguagcucaggggcagagaaaaaucaccuaguuugugugaggcccuggguucaugccaucucaggaggagagugagaguagggggaggggaaagggggagagaugggaacaaaggauugaaagacucaaaugaguaaaaguagguaaacuguuucaaacaauaucuaacaaauacuuaccaugaggugagucucgccuucucaagacugaccuccaaacugcuuuguacucaaggauaaccuugaacuucugccccucacucccacugcuccgagggcuggaggguugggcuuacagcaaguaccaccaugccuaguuuagguagugcaggagauuuggaccuggggacuugcuucaugcuucacgcuaggcaaucguccuaccaauugagcuguauccccagacccuuucucuauuacaauuuuaaagguucuggccugaaacaaaauguucuaccaccuuuuaaaggccgggaccuauuaaacuaugaauucuuaauuggaagggagcguauggugucuggcucugacaagagccuguuaccuccaaagagccacuauacccaaacacaggcaaucugucugugguaguaugguuucagaggugguguacaaacgggugaaauguuuacaaaggcuucuuggaggauaguaauguaagaaaggcuaucaaacacggcuguaggaucagaaaccagucuauguguuuguauuuacugccauuugucugggaaucaagauuuuuucucucucucugcaaucaaaagaaauucaagaauaaauuccuaagugacuuggcugcauggaaaccuuucaucuaugacaaggucucuccagaugcagugaaauaccuuugcuccuuuauuuuguaaacuugauuucuuuuguucuuguuuuucaaggcaggguuucucuguguagcccuggcugucccagaacucacucuguagaccaggcuggccucgaacucagagaucugccugccucugccucccaagugcugggauuagugcuccaucacugcuaggcuuuuuacaaaauauuggggauuuuugcuuaccaguugagaaucugaauagccucuugagugugcagagggcuccaccugccagaccaguuuucgaguauggcagcagcucugggacagcuugccuacgguugguucuuggggagcagagcuggguaccacugcccagcacagcuggguaccacugcccagcacagcccacacggaaguugugcaggggcaaacgcagaugcaugcuuuggucccgagcugugugugggcugccugaaggcaccccuagaaagguugggacucucguguucuugcauggagagacaaagacguucuuuauugcugcaaaugugggugaggggcuggagcccucauuuugggggguggggacggacaagcuugaaaaccaauuccaguugaccaauagccuucaguuaacagucauguggcauugcuacuacuccugaauuuccuguuuaggguuuuauuagcuuuuugugaaaggggacauuguggagaaacucagauuagaauucaacuuaugaagcagcugaacaagaaagagggauggaggaaccaaggagcuuagagaaaucacagagugauuacucaacaaaguuagaccccaaaggcugcugcugagccacaaugcucugagcaaggaaugcagagcccaugggagguggugguggcuccuccauuccgggucucagggaccuggcgagccuucugauuggggaaaauuuucccacaggcugggguuggguuggggucgagucagcuucccaccaacauacuaaugaauagcccacaccagccugacucugccaauuggaaacagcuuuggggcuccagaauaaauggggagccuaaugaagaccugacguugguuuuaccaguguaugggaaacuaauggagaugagaugagcgagcuccaugugugugaggccuuggagaugagggagggauagaaaaccuugucuucccagcccugugaggaagaggucuccagccuguaaucccaucacucaggauguagaaauagaguaaucaagaguucaaggccagccugaacucuaugagacccugucuuaaauaaaagaagacaagcccagugucauggcaugcaccuuuaaucccagcacucuggaggcagaguucacgaccagccuagucuaugaaauaaauucuaggacagcgggggcuaccuggugagacacuggcuagacucaggguuggaguaaguagagaaagaacuauauuaaguucccaaggaugaaacuggaguuugaucccugccccaacuuaggaugggaauugugccgaguaguuuuaugucaacuuggcacacgcuagaaucaucugagggaaaggagcuucaacugagaaaacucuucccuaagacugggcuguaugcaaaccaguaggucauuuucucaguuggugauugauggaggagggcccagcccauuguggguggggccaccccugggcugcuaguccuggguuguauaaggaagcagggugaucaagccaugaggagcaagccacuaagcaguacccucuccuggccucugaaucagcuccugccuccagguuccuggucuguuuugagucccuguccuaacuuccuucagugauguacuaugauguggaaggguaagccaaauaaacccugcacuccccacguuguguuuggucaucacaguuguguuuaguguuucaucgcagcagugauaacccuaagaccaccgucaauaugcacuuuaaacauuuucucucccaaaggcuuggucuauaaaauagucauuugcucauauauauuuuuuuuuaaauguaggcaaagcaauaaaaucuccuccugaguccuaacagccaguaacagggaggcauuuacauuuuuguugcuucguguuuauaagaaaggauaaaauaacacauauugaaaccagcaccggggacuccuaacaacucaaggucuagggcugugguucuucaccccagcugcacacuagcaucaacuucagaguuucuggaaagcacugucccagaacuccacccugguccuauugaccgcuuugagaaggaucuccaagcaucuguguguuuuuaaaagucuccugagugauuccauggggcaaccagggugggaacguuguuugagauacaccaauuggauacggagauugagccucguuucccgggauauuaugcaagauaauuguuuucuuuuuauuuccuuaauagauucaaaaagugugccuuacugguuucuuuagauuuaacucauaugccacaaaauccacccucaaauuaaagucugccguucaacaguuuuaguauauucagaauuguaugacuaccaccaccaucaaauuccagaacacuuccacuauucugcaaagaaaccuguacucauuaacacucucccuguuucuuccuucccaucccugguaaccaguaauugagucucuggaguaguccuggacuuuuauguaaauuggauaauucaacacauggccuuuugucacuggcuucuuucuuuugcuuagcacaguggucucaagguuuauuuauauuguaguguaaaagagcucacauuucuuuuuauggcuagaugaugaucuaugguaguucaucaguucauagacauuugccuucuguccacuucagggcuguuaugaacaaugcugccacgugcacucauagacaaaaguguuugugugcacaugugcacgcucagucugcacauucauguggaggccagaggucuaccucaggugucauuccuccauccuguauauuaagacaaagucucaccaugguggcccaagccuuuaauccagcauaggaggcuaaggccagcagaucugugugcucaaaccuagcuugaucuacauacauagaaacaagagucucacuuuuaacugggaccauaguuuagcaagacuacauagcccuugagccccaggaaucugguugucucccccuucucaucacaagcacaagccacuacacuuggcuuguucacguggguccugggguggaaccugaauccuccugcuugcauugcuaguguucugcugacagccacagccccaucccagaugcaccauuuccccuaucucugauaguggaugagggcaccgauuucucugcaucuuuucccaacccuacugaagucucuucucuucauuaugaauauccuagugagcaugaguuuugaacacauuuuuauguguacauugacucuauuuaagauaaauauauauccagaucauucaacuuuuaaauuuuuguuuaccuuuuuauuguuaaggaagagguuuauaauaguuuuuuaucccauuuuauuauuuugugugcaugucuauggaagagcgugcauauguguccuugaguuagucagagagaaguuugcagaacucacuucucaucaucugcaacaugaguccuggcaaucaaauucacaucaucaggccugguggcaggauccuguacccuuugaaccaauggcucacauccuucuuaaugcugugaccccuuacuguaauucuucauguugugguggccuacagccauaacauuuuguuuguugcuacuucauaauuguaauuuugcuaugccuaugaauugugaauaucugauaugcagauguucuuaggcaacccuuguuaagggguccuucgacccucaaagggggucccuauccacagguugagaaccgcugcucuaaaccauaucauggccucaaaagagauuuuauguauuuuggaaacuaguucuuuauuaaauauguaauuuauaaauacucuucuggcccuuggguuuguuuguuuguuuguuuguuuguuguuuuucaaauaacuuuauugauagugucuauggggacacaacguuuucaaauguugaugucugcuuugucugacucuucaacuauaugcacuuuagguauugaaucaaggagggcaagguaaucggguggcuacggaaggacaggaagacuggacuuucacucaacaaauaacugagugccuugacaaucuagacuccugcuacugggcaccuaucauccuguaucagggacucagggcuuggaaagaagccaagaagaguggggcagggagaggagcggaggugagggugcuguugcguuuguccugggugucagaaaggcuccaaggagaaggcaaugcuugagcagaugccugaaggacaugcgugugucuacaacuccucugcaggaauacagcauucuugacuccgugacuccagaguguuucugguuucacaagcugcuuugugucucacgaugaaguuuuggugauggccacaaagcugaaguggaguacaagguucuguggaacggugggaacugcuuuuuugggaaaagaacagcuuaagggggagaaaagauguuugcagccacauauuuuuuuuuuuauaucuucagaucauguuuuauuaucuugaggaagugaugaaucauaaaaaaugugauuuuccuccucuucccccucaagagucaauaugaauuuaauaagaacaagauuacuuuuuaaaauaugcugcguuuggcagguucaacuccauuuguacgucuucuccaacugcugaagaauuuuacaggaccauuggauuacaggauugcguaccucuugaucugaaaggcgccacauuaaaaugggguggucugguucuggguuuccuccgcaugggacagauaaacaccacaaguccagguugauagaaagcaagcaugcuauugcugagcacccagaagugccucggaaccaacuagagagauccuuguaaaugauugugaauccucgugcaaggagccugaggaaaaaguuaccgacaucuccagcaugaagauggcaacagccaggaaguccagauaacaucuguccucauuucaucucuguugcugugacaaaauagccugacaaaaagcaacuuaaggaagaaaauauuuguuuuagucaugaauuccagguuaugaucccuuacaaggaaaguaaggugacaggaacuuaaaacagguggucauguggcuaaagagcuggcucagugcuuaagagcacucaccgcuccuguacaggcccuggguuccauuccaagcacugauaucagguugcacauaacuaccuguaacuccaguucaucagaacuggaucucaagccccuuccuaaccuuucuuggccccacuaaaacuucugcaggcacacacaaaaacacauugaaaaaacucuagcagucacauucccacucacagucaagaacagaaaugaguguguggaugcucacuaguuuguuuguucagcuuaauuuccucagggacuaccuagggaaugaugcugcccacagugggcugagucuuuccccaccaaguaauugaauuaagucaauuccccaaagguauguuuauaggucagcccuugcaggcaauccuucauuaagacucuuuucaggcacuggaggaguguagagaaaacuuuggucaggauguaauguauguaaaaaauuauauaaaaauaaaacaaacaaacaacucuuuuugccagauaugguggcacacaucuuuaauccuugcacucuagaagcagaguuugaagucaggcuggucuacagagugaguuccaggacaaccagggcuacacagaggaacccugucucaaaacaaaacaaaaaguccagaucccaccccauguauucuugccucucagcacacagcagugugugaaucuugcccauagagacauauuuggguuugaauuuggguuugaauuuggggauggagcuguuaucuuuaaggcuugcuucaucagaguuuuugaucaugaugcagauuacaggccuuuugagagggaagcaacacuuacuaauuuaggagcucauauuauuuucugggaccaccaaauauuaacaacucuuugugucaauucugugagcugaaaggcauauaaauguugcugcaaaugucucugacuuuagcugggcugagccaaugguugagugguuaaaccucuugcuauacaaacaucagaagcagaguuuggcuuugcagaggccauguaaguacuggguuccagcauuaagaagguagaauccccagaacaaaccgguuagccagaguaggcauacaggcaagcuuagcuuccaccgagagaaccugccucaaugaauaagguggagagugauugggaagacucccaccgucaucccugagcuuccacaugcacccacgcacaugcaaacauaaauacacacaggcauguacaugacauauacuugagaaagagaggaagagucugugacucuauguaagagacuuaauuccacaccuuccauuuguuuaaaaugaaccuaggacaauguucuugaccucagagaucaguguaaggacuaaauaagagauuaucuggggagcuugaaagacaugucuccauccuuccaagaaagguccagauugcguguaggauuccacaaagcaugauagaccuggccucuguuuguaguuuuggaaacacaaacauuaaaaucacaacucgagacuauagaccggaagaccgcuccaccaccaccaccaccaccacuacugaggccacugccaccacauggucacaccuggucaagugcaugaugugucuuacaguaggcaugacuugugcccacuggucuaguccccuuucuuucuuucuuuuuuuuuuuaaaagauuuauuuauugauuauauguaaguacacuguagcugucuucagacacuccagaagagggagucagaucuccuuacggaugguugugagccaccaugugguugcugggauuugaacgccggaccuucggaagagcaguugggugcucuuacccacugagccaucucaccagccccuaguccccuuucaaauguggcuuggaugagaaccgugauuggacaauauuagaaaaugcuguguagcugggcauaauggugcacacuuuuagucucagccuuugagagguggagcacaggccagucucaucuguauagcauguucaacgcuacccucugcuacccgaggcucugucugaaaaguuuaaacacacacacaacacacacacacguauauacacguauaaaauguuauuuuuuguguuuaugugugauguguuaaacuugcacguguaggccacaggugggcguugaauaucuuccucaauuacucacccccuuauuuuuugagacaucucccucucuaagcucucaucucaucuugugguugcuugcauugcaagcauuugccaacucgcccugcuaguguucaguuugggguuuccaguagaccucaucacuguuuguacuguuuccacguccaagugacaccucuuuggcugucucucugauggagaagcgguaccuccagagagccuaagaggaaccucgugccucucugcuuuauuugcauguaagauugcuguguucaugugucacccggaaacacuugaaugagaguuugauagccuugagauuuggcacuuccggcugggagcauuacauccuuuggaaguguccuaugucacacuaugccaacagcuguaggauuuuaaacagacauggcaacaaacgggugcuaagcacagcuaaaaauagccacucugggaagugaagcuggggcagugccaggagcaaaaaggugggcggcucugcacccuagagggaagggaaaggaaaauccugccucuccuagcacccaggccugggcuccucuuugcuuggaaucugucugugccauccuaagcaaggagucuuacagccccaacacaucuugcauagagauucugcucagauuuccaaaaaggggauuggaccagagugggucccucauugugcugcguggagaguggguaacugcucucguccuaauaggaugcucacaccucuguccucacccuuggccgccccuaucuuggcuccucaggacacugagcgaugagaguggcuuugccuccacagucugaacuguuuugucccaggggagccuaggcguuccagugccaucccuccuccuccuccuccucccucuaagaccucaagcacaucuuccaugccccgcugcacucccugagcagugaaagaugguggcugucaggaugauggguggcaagugggguaaacauagcuuguuacuaccagauucgauuaccgggcauugccugaagacaaaugacucagggccucuccccacuugaaggcaaggaucuggugacgagcagucacagauguuguacaguauucucacaaaccugggaacgguagacgggacuaaugguguuaucucugguuuuuauuauuggugguuuagaauuggaagccgcgguuuaacccugagaguaaucaaaacuggaggaaaguuacagaggcagggcacaugguaauguucgaaagcuagugaagcugacaauguuaacaaggucaggguuguuauugacuuuggugaagcaaguaacaaccuucuaaauggucucuagaauauuccguguccuucuuagaguucacuguuaaacuauagggggucaaggcaugugugugcaggggccauuagaaaucagggucccuggagcuggggaaacagacuauugggauccacccaguggagguacugggaacugaacucggguccucugggagagcagcaaacacacuuaauugcucuacaaucuccccggcccuagaauguuccacauuuugaucuggugguguugacauuaguuuauauaugcacaaaaaucgauuaagcucuacaauuaagcuguguguacuugagccccaucugagggcauaggcuaggaauucuaacuacccaggaggcggaggcaggaaaauugaaacuccaaggcaugccugugcuacacagugaauuaaaaauaaaacagaccuggaauacagccgaaugcuuucuuacuauacaugagacccugaggucagucccaguucugcaaaaccaagugcauuugccaggcaugguggcgcaagccuucaauccuggcacucaggaggcaagguaggcagaucucuaugaguuugaggucuucacugggugggguggguauauguuuuuuucuucauguauaugaacauugauguacauagagaaaccagauuuaugccguuucacccauaugagacagagucucuucguuauugcauugcauuacagcuagcuaacacauccccaagauucuagagagucccccccucucuaccucccaucuccuuguaggugcgcacugggauuccaggugucugcaguacugugccaggcuuuuacaaggguucugaggagcaucagguugucugacguacauggcaagugcacuuacucacugagccaucuccugaucccuuaaaacgaaugcgcacuuuauauaugccauaucuuaggaaauaaaaaugaagaaaauguauugaagaggucuaugaacagaaauccuuggccacacuugaauaauaccgcucuuaacaaacuuggcgauugcaaucccaugacccuagguccuaaaauucuggcuugguuaaagccugggcauuuaaaauagagucaccagcugacggaaauggcucaucggguaaagaugccugcugucaacucucacaaguuguucucugaccuccaugugugcucuauggcaugugugaccaauacacaucacacgcacuaaaugagcagauaaacaaauaaaugcaacagagugcuaagacagagucaccuauggcgagaugaaacaaccgcaagccucuuuucauuuauacaguccagagacaaauuucuaaagccuuucucucuauucgcccaaagucuccccacuguucuacugcugaaugagauugucggggucucaaagucaaucuugaggucacacacggagcuuugaguuguuucccccacuacuuaccagcacugagacauucuagaaaauccuuggcaucuccgagguucauuuucuucaucuauggauugggugacuagcuacuuuauuuucuacuuccuuugugcaguguauguacaguguguguguagaccuggggucggcaucagguguguucuccaguggcuucugccuucucuuuugagacaaggucucuccaaaccuugagcucaccgauuggcuagacucgcuagcccaugggccuuagggggugaaugucacucccuucccagcgcuggaauuccagaugugcagugcaugccugguuucuaugugggugcuggggauccgaacccagguccucaugcuugcaaauuggcugacacaagcaauuccuguuuucagcuccaaauugggugaauaauugaagaacuucccuaacaaccaugccuuaaaaggcuccauccagugccuagccccuagcaagagaugcuaaagaugugguugcugauugccauggucaccaccaucacuaguugugccagguuugcaggaacuugcaagccacagguccucaccagaggggagccugugccuccgugauugcuccagcaaacaguucccacaugccccaaccuuuccuaugguugggcaggcuccaggaugcagaggccccucugacuuggcuggaccguuuggcucagagcaggaguguggucagguuggccaacaguguacccacgucgaaagcagcuguggugaacaucuggcucugauuaucuggcugggaauggcugggggugggagcucugugauuuauagauugccccuuuggcuguaaaucccaucuguaauugugacuucucugucccuaauuguuugcagagaagagaggcgcucaauggcuuacaaucccuggcagagcccacagccuugcuuggggggugagguuuguugcuaggauacagccgucuuuguuuuggucccugcucagcaguguuuuuaaggcccuguauacauuucucuguauuguuaauguaauuuguucaggcagugaacagccaaguucagcugaaggaauccgauacucauaacagaaacaccagaggccagguuuuuguggucaaauuaggguuuugaggccucgaagagaaugagauguugagcuaugugagagggacaaucccucuuucucuucuuguacuaacguuggccuggguucagcuuccucgaggagcuuggcuuugagggcacagaguccacuacacucagggccauuaacagagaccugcccuucuaccagaaagggaaugcagauuuuauucaaaagagaugaaaggaggcucucugagaauaagcuagccucagccaacuagucuacccagcucagccucuccuggacccuggcuccaggcaccuagaucagccccuccuccacucugaagaacuugacugcuguggaaauaauagucaaguucugucgggaaguuaugugacugugcaaaaugcaauuugcccauuuccguggcccgugaagaucuaacagccccucgccaucuggggaccccaugucccgcugugcuuaagguuuucggaaacuauggauuccaaacaaaucccagugagcgagccagcuagugagugaacccgguucacauccuacccucuccauuuugccucagagagcaaaagaaccuaagaccaaacauuccagcccacagacaugcaccaugccuuguuuugcucauggaaugcauaugguguugugaaguuaaucagcucaacccuauuaacacgcccacacacacacucagugugcacacgugcaccuauucauguuacaguugcugcacacauccugcaguuguaaggacaaugagagaagguucccacccucuauagcuuaaaaugucggggaagauacuagagcacaagcccuuacuuucacgcaaggagugacugacagggcaaaaguaaaccucacuugaacauaucacccaaggaaagacuaguucaugcagcgagaugcauuaacuagucaugccaaaggacgucuugugguagaggccucaauagugacauaagauguuucaccaagaguuucuguuugaaaaaagaaacaacagggcuggagagauggcucagcgguuaagagcacaggcugcucuugcagaggauccagguucaauuccuagugucuaccuggcagcucagaaccucuguaacuccuguuucaggagcccugacaccuucugccucccucaggugccaggcgcauaugugguacccagacauauuaaacacucauacacauuaaaaaaaaaguuaaaauucuaaaacagaaacagggccauaugaaugcaaaggaaaacaaugaugauaaaaauuaaagcuugacaugacgcauguguuuguaagaauauuagcucauaaaagauacuucaauaguguccuuguuuucaagaaugguuuggcagcaccuaguaaaugugcagcccuuaggccccagcaagucuucucuacaugaaggaugugaguaagaguguaucuuguugggggcuggagagauggcucagcgguuaagagcacugacugcucuuccgaagguccugaguucaaaucccagcaaccacaugguggcucacaaccauccauaaugagaucugacacccucuugugauaugccugaagacagcuacagugugcguagauauaauaauaaauguugcauugccugcugaagcuuaaaccguggucaucaguauaauaacuucacacaugcagucauagagcagaaucaaccauggcuacacauaauaacaggcaugaguucuggggaucugauguugguuggaaagagccuuucacaaacgcuucagcucucggaggggguucaguguguagcucagugcuagaauuuccugcagggccccgggugcaguucacaacucucgguaacaaacuuuccaagaggaugaugaugaugaugauaauaaugaugaugacaucaguccuguaggagaauugcgugugcuuacaagauggaggcuggguacuuaaaggugacgucuuuauuaaugacgguaucuacacuugauucagaugagacagaaauaugugugggaauaugaagaggcgagacagagggagugaaaucugggagcauguuaaucguggugagacuggcugaaggucagaguucacaguauuccacuauuuucuuguacauuuggagcuuuuagcauggcaaguugaggaagacacucaguuggagucuauguacaguuuguggguaauggguuuguaauuacaggaacaagcaguggccugaugaacagugccuuggagacaguaauuaugucugggcaguauggggaaaaggcugaggacuccaguuaagacguuuuaggugauggggaaaugucuucauucuagauaaugguacguuagcauggcuaguuauuugcucugcauuuugaauuuaagcauacauaauuuuuacaaaaagaugauaucccauucguuuuuauaaauaaaaaccgugugugugugugugugugugugugugugugugugugcguguagccagaggacaaacucugggucauccuuagggacacuggcuacccacuuugagaccaggccaucuuuggccuggagcucacuaaauaggccagguugccuggccaugugccccaggacuccaccugcuucagccucaccagugcugggguugcagacauaccacgcuuggcauuuuggugcgaguuuuguagguaaaacucagagcuguguaauugccagacaaguaucauccaccaacccuaaauuuaaaauaauugcauuuuuuaaaaaauuaugggccagaugugguugcgcacaacuuuaauuaucagcacucugugggcagagcaaguggaucucuguguucaagaucagccuggucuacagcaugaguuccgguccauccagagccacagagagaaccugucucacuguuugaaacaggguuuugucuuuguuuuugaauuaaagguuaucuuuaagggguagggagauagcuugguggguaaagugcuuacugcacugccgugggaaccagaguucauccagaaccuaccuaaaagccagaggagugcagcagcccagccuaggucccguuccauaggcggcauagacaagggaucucuggaacacgcuagcuagcuagacuagcggaaacggugagcucugcauuuagcugggguaccucgccuugcuauguaagguagagagcaguggagagaaccacccgagugggcacauucacaccacaccacacaucuacacaugcaaaaaaggguagucuuagaaagaauguuggcagguuuuugugguauaccuguaaucucagauacaugagaggcugaaaaaagaaaugaggacuagggaugucgcuuagugaucacauguuccuagcauguucagugccauggguucaguucucugaaaacacacaugcacgagcgcauuaugcacccacgagcagagugugaaguguuagauguuucuucaauagauuccggccaaucacuugugaggggagucugucaaucucuggaccuugccuguguaaaacagagguccgcuccggguccccuguggagaacagcacucagccguacugcuguggauguuguuugacucugcccagagcagagcccagagucaggugucuggugugguugaucgaucucugcucuggguuugcaucuguccagccaagagaaggcaggaugucacagcucagcuucgaguucccaaggacuugcauuaggcuggaaaucaaugaccugugcaagaccaagauguacagacacagagagagaucugucaaucccuagcggaguagagaguaagaauuaaaagacaccucaaccccuuaaagugucuccgugagcugacuugaugaggaggcagugagugcuaacucugagcuguuaucugcauuuugagugucgaaggaaagugauugcauugucgguacacaaacagauuucucaagcuggaaggaaggaggguuugaaacugagaaaagaaucuaaggucugacugagaacuaaagguuggauauaaauguguguguguguguguguguguguguguguguguguguguguguguguuuccuagcucugcugcaaaagccuggaaauaauuagcacaaaacaggacaaggcaacuuugagaaauagguuuuuguuuuguuuuauuuauugguuaguuuuguuuguuugcuuguuuuuguauuuuuuguuggugguggugucuuuccuucuuucuuucuuucuuucuuucuuucuuucuuucuuucuuucuuucuuucuuucuuucuuucuuucuuuugagccaggguuucucuauguagccuuggcuuuccuggaauucacucuguagcccaggcugcccuugagcccacagagaucugccugucucuguuccccuaagugcugggauuaaaggcaugugccaccagugcuugaagaaauccuccuugaagauaagccuuggccacucauuggcugugcuguuccccuuugugucugucacuggcagauuuugugggaagucucuaguuacagacccucucuccuuucugucccuugcuagccacuuggucuuggggacccgucauucucuaucaccgcccuuucaccaguucuacagugcauaguuugugggcuuuaagccuagaccacaguacuggugcccugauagcuguaaauauguauacaguccuggggauguagcucaguaccaaccuaugucaagacccugaauucaagcccuaagacuguaaaacguguguguguacauauauaacauucauguuugauugugggugugggugugaaaguucagaugcccauagaauccaggagcuggcaaccaagugggucauguccacauaacuaccaagccaucucuccacucucuuuaauguccuuguaaccuugucuaagccuccucacagaaugaacacagggucucauuugucagugcuuagaaugguugcagccauguccagauauccccuuugcuuccuuuccacccaccagucuaaggcaguuucucugccugagugaagguguuguuagcucaagagggcuuugagauacuuccaugcagaaacacauagcucccaccucacgcuguugugcucugauccgucugucugucugucugucugucugucugucugucugucugucagcuucugaaguuguaggcuuccugauccacacaccuuucaacauguuuacaggguggcagggugagaguuuagcagggucuucuuugucuuuaaaaaaaaaguguguuccuguacauguguuugugugugcaugcauuauuugugcaugugugugcacauguguaugcaugugcauugcuggugugcaugcaugcuugcuuaaucaaucaaucaaucaaucaaucaaucaaucaaucaaucaguugcuguucuuagugauguccagcaggcuaagcaccagcucuguaaacuugauaacgcaagcggaaucccagcaucucagugaagguugagggagaaagcccaguuucacaaggcuguccugugaccuccacacaucugcuccaugggucccacccaucccugagaauaagaacaauaaaugagguuuuucaaaaaggaagaaauugagauugggggcggggaggaaacugaggugugcuuguaagguguccaggaaugccugaucuaggccauuccuguaauuccaagcacuggagaaauagagacgggacgauuuugaguucaaguccauccuggacugcagagcgagaccuugucucaaaaacuaaaugaauggaagaaguaucuggaagagucaggagguuacugugaacucgggcagguguguuuuauguagcucaacguagcaaaugaauggggagccugaaaucuccacagcccucuguccccccucccucgcuugcauguccauggcauguagcauguguggaggucaggagacauccucaccuguccguccucgccuucucccuuguccaagacggcgucucuuguuuacuacugacuaggccaggcuaacagcagggcuucuauuggcuucucuaggucucguuuucccacagggggauugcagacaugagcuaucccaccugccuguaacuaacauggguucugaggauucaaagucgggucuucuuucacacacagaaagcacuuaacccacugagucuccccagucccguauagagcauuuuagaauuguuucccuagaauagcuucccauacuugggcucaccaaauguauaacugugaguauuuaaagcucuguccuguggccuucgaaaggaagcuggaugaggccuucuguuuccaagccaacugugggaauccuauuucuccuuuaccccacacuauguuugcgggcagcccuuaacuaggaacaaccagucugauuauuauuauaaguccuuaaaaaaagaaaaaaaccuaauaguuucagugucugguuuuuuuuuguuuuuuuuuuguuuuuuucugcacuguugccaggagggaagccugaggggacaguugcauaucaccuucuaauuugcuguuccauuuuucaguacggaacaaaugucuaaagcuuuccgaacacuuuccugcacuuggacagaucccgugacuuuuaguccccucagguuuaaugccguguugcaggggaaagagcguauaaauguucccggaaauguuauaggguacauggagaauccuuugaaacaucugcagggaucucgcaugcuggaaaggcgugcugagcuaacccgcaagaaugguaaggggcgucuguuuuccuggaaaugggggugcaguaugacccagcuucccaggcaugucuucugugucuccuagcaccuuguugguauuucuucuuugagcaagaagacagggcuucuuguccgcguguccuuuccgcaggcccaagaagcaguuguuugcaucugagaguaauuaaucgugagcugagaucucaggguuaucugguccaacaauuugcugucuggcgucugcuggaacaccugcagcgauaggaaggcauacugagucugugucccgucgucccccucaccccccacgugauggcccuucacuccuuagagaggccccccggacacaacuuugaauaucuggagccugcauucuauuccagaccaucugggacaguguguuccagaccaaagcaauucccaagcaccauggaaaacagcagccuccauuuugggggguaggggggcacccaugcauguggcugacaauucagccauauucugccuccauauacuuuuccauccacccugagccguggaaagcugggcacuacaguugcaucucugguaaucuucacccugcggucuucaucucauucccagagcaguguagggguuggaugugagaacucuggucaacagaaguucgaauccuccuacagggcuagacagagaguuuccuugcgcccaguuucucugucugcaauagagacucuucuaccaccacccucaccuguuaguuuucaguccagauucagugaguuaauacuaucaaauaagacacgugugggguuuugguuuuuuuuuuguuuguuuguuuuguuuuuuugguuuguuguuguuguuuuggguuuuuuuguuuuguuuguuuguuuuuuguauuuuucgagacaggguuucucuguauagcccuggcuguccuggaacucacuguauggaccaggcuggccucgaacucagaaauccgccugccucugccucccgagugcugggauuaaaggugugcgcacaggucaugacccaaauguggcgacaagagaacucguuuguggugguccaccauggauguuccgugaauuggucucugguaaacagucuugauggcaaguaccuuuccucucucgcugugcugguuaguugguuugguuguuuuugcuuuuugcuuuuuacuuuuuguuuuuuguuuuguuuuguucuuugcuuuuccaagacaggguuucucuguauagcccuggcuguuuuggaacucacccuguagaccaggcuggccucaaacucagaaauucaccugccucugccucccaagugcugggauuaaaggcgugcgcccagcugcuuuuuacuuuuuguuuuuuguuauuuuuguuaacuugccacaagcuaaaaucaucugagaaggaaccucaguugagaagaagacucuaucagauuguccuagaggcaagucuguggggcauuuucuuguuuaaugauugaaguagaagcacccauuccacugagggcagugcuaucccuaggcagauggcccugguuauuuaaaaacaaaaauuaaaaacaaaacaaaacagaaaccccgagguagagcaagccgugaggaacaagccaggaggcagcccuccucugugggcucugccucaguuccugcuccaggcuccugcaugaguuccuguccugacuucccucagugaugcacuauaaccuguaagccagaaaacccuuuccugccaagcugcuuuugcucauggucuuuaucacggcaguggaaagcaaaccaagacccaucccuccagcccugucugugugucacugaauauggaacccgaggccucaggcauccugaggugcucaaacacagagcgguuugucuccagccuuugaugcuauucuauaucucucagaacugcuccgugauacuuggccuagaugaacgguuggaauaagucuccccuguggauuuagucuccauuucuccuucauccgauuuucuacaaucuucugccuucaggaguauuucuugcucaucaaauacugauuguacacuucuuugaguuugaggcucuucugaacacuggccacggcaggcacaugaguguccugggaaggcugcguggacccucugugacucauuugcucucuccagccuaaugcguggguguuagcucucgagauccuaauugcuacuguggaagucugagagcagcuuuguggaaccuucauguguauuccggggagugaacccaagccauccagcuugugaagcaagugccuuugcuugcugagccuucuugccggcccaccuuuccugcuauuuucuguucucacuaaggagcaucuucccauagcauacuuagcagaaagccucaaaacuauagguccugaugacgccuccucaaugcuggcagacguuagagugaaugccugcguccaucaccuccuccuucuuuugacuuuuaaucgucaucuuuaccuuugcccggcuggagagagcaguccauaguucaaaguggugcacugugcucacagggucgcagcuguaacuugggggacaaugcagaugucuguguuauccuggccugaggacucagcacuguuuccuccgugcucuuugaagagcucaaguccaagcaucugugaucuggcaucacggaggauggagagacacaaaauaccauggagucacagggaccagagaugaagcccugacugagcucaguuuuucuuaaaagccaggcauggugccaccgacuugaucucugaguucaggaguggggaagauggguagaccaaaggccugcugcuguaccuagccuucuuggugagcuguaggccagggggguuaaaaccuuguuucaaaaaaacauccuagggggcuggugagauggcucaguggauaagaacgccgacuacucuuccgaagguccagaguucaaauccuagcaaccacaugguggcucacaaccauccguaacgaaaucugauguccucuucuggaguaucugaggacagcuacaguguacuuacauauaauaaauaaauaaauauuaaaaaaaaauccuagacagcaccugaagaugcccuauggccucaacaccuaugugcaaacauauacacauacauauaauauacauauacauccuuguguauaugugcauauacauccuugaguguacauguacacucucagaaacaugcaccacacacaaaacauaccagaaaauucgcuuuuggagucuuagcaaauuauacaacuguuuuuuauuuugguugguugguugguugguugguuucauuuuguuucauuuuugagacaggcucucacuaugaaacucuggcuguccuggaacucaagagaccugcuugucucugccucccaauuacuggguuuaaaggcaugcaccacuaugccuggcuucaaauuguagaagugucaccaucuagauucuaaauugcucuaaauuuuagaauaauaauauuucuggccauuuccuucaaagucaguaguucuccuauagccagccuuuaauucuggcaauucuagucuuuaucccuacuguuuggacuuuuuccaggaugaccucucgggguucguaucugugcaguuuugggagccuugcuuccuucucucaggauaucuguccaugugacugccuggagcugugcuucuccaucacuaagugguguuccacauugagcuuguuuauucaaucauucagucauugaggaauaguucagcgguuucuaguuuucacgcucauguuaguuuuuaaugagggaauaucaucuucucccugaccccauaggguuucucuguguagccuuaacuguccuggaacucacuuuguagaccaugcuggccucaaacucacagaaaucugccugccucugccucacagaaaucugccugccucugccuccugaacgcugggaacaaaggcguguaccaucaccaccacccaguuuguaaguguuugagcucauuaucugugauaguuagccuuaacugucaauuugacaaaaccuagaaucaccuaaucugaaagucucaaugaggaauugucaacauuggguuagccugugaguuuauuugugggggauugucuuaauuggcuaaugugagacagcccagcccccuguggguggcacuauucccuagacucaagcaaacaagcaagcaagcaagcaaguguccacggaugcauuuguuucucucugaucuuggcuguggcuagcuguuucaagauucugucuugauggguuuuguuuguuuguuuguuuuccuaauggugcauggacuauacccuagaauuguaagcugaauuaaauucuguuuucccuuugauucccuuuucucccuuuccaagauacauuauagcaacagaaauuaaacuauuuuucugcgaggcagucacaugcaaccuaggcuggucucaaacuccccauguagccaagaguaaccuugaauuucucaucuuccugccucuauccgcugauuguugggauuacagcccuguaccauuauggcucauuuauauguuacuagggcaaacucuuaucagcugagcuauagucucagccuugaguugauaccucuauaguuaaaaaauauauaauuaaaucaugccaucauaagcugguguggugguacaagccuguauagucccagcuccugggaaggcuaaggcaacaagagacaagagccugucuuuguuugacaguaguuugaguccagccugggcuacauaacaagacucuuaucucgaaacaaauaccauugaguaccuagaauaggauaaagaugcuaaagguggggccgucaaggugcagggucucagacuggguuuguccucucagcucuaggcaugugggaagaaaggggagguaagcagcagaauguagacacugccauuguccuacacaaaggggacauuggucguggagacucuauucaagggagcugugcgagggaaauggggaugaagcuuggggauuuaaguuguuucugaaggguauucccaaauccugcucuggguaauucccugacuaccauuuaaucagcuccauuaaacccugcccugucuagugcacugugguccagacacggcucuccugggcucccaguaauagcucaauuguguguaaguggcugugaagaggcucugugugcuagaugaauaggacucaucuccauggaaaccagcccuggcugaggggcugaccuuugacccacuuguugccaccauacuguuaaccacuggugccuauuggauucagagagagggcaaggaaaugacugucagaguggcuuucauuugccuucaguuuaagcccagguguguacuaaguagaaauaagaccccaauauuaacccaaagcaaagcaaagcaagcaagcaaauaaacaaacauuauuuugauuauagauucuugcccugucuccauguccuucagggcagaacuuaccaugugcucaguugguuaccaucauccucugggcuuugaagggacacugcaggaaggaggagguuucuauuccgguaauauaggccuugugguauugccauaggcaaugugucuucuguccugugagagaccaagaggcugcuaggccuuauaccugugaugugcucuaccaacccaaguguuagucaugcguccuuuagagaugacaacaaaacauggcugccuagcaacuacuacauaggucagggcgggaugacuuuagcaacccugaggagaguaaugagcucaggcccuguggcugugggugaacauguggcccuguguugcccuguagcacccugcucagacuagcagagcuuuccugacuccauucuuugaucugggucacguuugucgugggcuccuggacagauucuugguuuuagaagcaggucuucccagguucuucuguagagggucgggguccugaccggggucagaguccugguuuggucucuaccaccugaugcuccuuucagugcauccuuugagacccauauauuguuuguuuuauuugcgucagggucuugcuauguaggccaagcaggcugacacuugacuugcgcaauccuccugccucagcaucaagacugcaggcauguaucuucaugccuaacaaaacccagaucuuuuuuuuuccauuuuuuauuagguauuuagcucauuuacauuuccaaugcuauaccaaaagucccccauacccacccacccaccaccacuccccuacccucccacucccccuuuuuggcccuggcguuccccuguacuggggcauauaaaguuugcaaguccaaugggccucucuuugcagugauggccgacuaggccaucuuuugauaaauauacagcuagagacaagagcuccgggguacugguuaguucauauuguuguuccaccuauaggguugcaguucccuuuaguuccuugggugcuuucucuaguuccuccauugggggcccugugguccauucaauagcugacugugagcauccacuucuguguuaaacccagaucuuuuuagugacuguuucaaaacaaaaguaacuugaagauucugggccccuuugcuggggccccccagugaguaggacaggugaggcaaagucuuaaacauaagacauucgaggcuggagguaaggcuccacugggagggaacaugcucagcauauaggaugcccuagguuuuauuacuaauaccaaaucagauaugguggcacacuguguagaccccacauucaggaagucaaacguuuaaggacauccccagauacuugguaaguucaagaccagacuugaguaaauuagaucugauguugaaaaggaaagaggguuguguguucgcuaaggcuccaggcucagccccuugaggaaagucaaaaugaaggcugugacaguucugcguuuagucucagaugccuuguaagucucccggcuuucuaggacugcaggaugauguagacaagaaagaagugagggauuucagggacauuuguggugacugaaauggccaaauccaaagccuguugaccaccacaccaucaagguaccagcuuguccuaugcugugcucuugagaccuuaggguggugucuccagauuagggcggugucuccaggucucuuguuaauucucucaucucuauagauccaaauuaaccugagagccugccucugccagcucuugcuaaggugaugcuuucuagaguaucuggccuaguuuuccuaucuacccugggguguggucccagaaaugacugucucaaacacugcaggacaccccaaauacuacaggaacucccagacaguucgucuugcuuuguuuucauuucuaucugugugcccacaacacucagccgugucuugggcuccggguuaccccacucaaaggucucuauucuaauugugguuucuggcuggaacuuuggugaacccgaggucugcaauguggcagucuauggcugucacuugcuucacagaagcuucaucuuuguggaguagcagccccuuccuugggcuucaggaaagccuacaccagcauccucuauaaggucaugcacaguaagugguucaauaugcuuuuccauccccagaaagugccauuagcagcucacggucuauuuacaggagguuggguccccggauagcauucccaaugccugaguuguggggagccggaaauacacauauauuuaacccugggcuugcaaacaggagaagcugcauccccucauuccgcagcuguguaaacaguagggggcaggggacaaaguuaaagauaaugcagagacaaggagagggcggggaggggguggggguaccagauuguaagggguggggagggaccagagcauggggcacaaaggcgagcacauagauucccagguuucucacuccuaagacaugcucaccagugcuggagcgauggggugggaaugacaaaugcugagagccugggcugacagggccagaugagacaggcaggccagggcaggugauggcacuccagaugagagauguuuccgcccuggacagcucugggccucuggggucaacaggaggaaagacucuuauucccugucccaggucggcagagaccuaaguaauggcgagaucccagcuguaugcccaggagaguguuguuccuucccgaggcagccaaugaggggcuagggacucagacacaaauccuccccuaagcuaguauggaagaaagaaagagagagagagagagagagagagagagagagagagagagagagagagagagagagaaccucaggguaguaucugcaguuucugcagccagaggagggcuacuccaacaucagccuggcuguggacgcuugcuuuccaggucccucccgucacugauauucuggucacugaguaucuucccuuccaugugguacucagcacacacccagaugccuccccucauccagugcuuccgugauguuccuuuccacucugauuucacuguaucucuucagcucauacuauauguuuaucaccuuucuagaaaaacugugcaaaaaaaaaaaaaaucacagaguggguaggagaaaacacccaguccacugccucugagcaguauugagguaccgugguguuucuuggaggggagaaucaggagaacuuugcacacagauaagaaacugucugcacugugcugaggacaugagaaccugucucucucuguggucacaucagggacugaggacucuggaugacuagaggaaaccucacagcagccaggaaaagaguauggggacuccagagaaggguccccaaguauuugagaggagcccacacgcauuauacagggaaucucaaucuggcagcuaaggaaaauggagugugcaauccucuaaacagggacccuucuggaugguuaacuuaugucaacuugacauagaccagagucaccugggaagagggaauuucaauuuaggaacuguuuccaucagacuguucuguggaaauaccugugagacauucucuugauuaaugauugaugugggagcacccaggccuguggacagggccuucccuggacaggacugguccuggcugugggagauaguaaacugggaacaagccaggaagcagaguuccucuguggucucugcgucggugccagccucggcuucccucggugauggaggcgacuuacccuuuccuucccaaguuccuuuugaucaauguuuuaucacaacagaaagguaaacuuaaaacagccuuuuccuaccucucuucugcacaguagucagauaauuguuuuuaaauguguaccggugcuugccuagcauuaugugagccucuggguuaaauaucuagcaccacaauacaaacagagaguagcaugugugaacacgcguguauaugaugcaguccaccagcacaucccucccuguccaaagucucagcauuagccugugguucagcacagccuaugagggcugucugggguggggguggggguguaguaguggugguggcucuguuucuuccacaccuucugccccaggguaggcugggaugcuagggggacacagacuuaaacugucuguguuuauaagaguucuaaagagccaagcucaguccuuguguuuauguggcaggugaguuuaucaguugagccuuuuuucccguacccggaauccaucacucuccuucuccguuucucucucacaaacacaagugugagggagcaaguuuccgccuacacacagaagccagaaggcaccuagggucccgcucucguucugccucauuccucucagacagucucucucccucucucccucacccacggagccaucuccccagcccuucguggaaagauuggcauauguaugcauucgguacccagcagucuuacacaugcauggccuuccaucacaugauagagagggucucauccugcaagccccuuucuccuacaaguucuagaggcugccaaggagccauugguuggcaagggugugaugugggggcaucucucucccgcaccucuuggcugccaucugagaugugaaaaaaaacugacugagaaacauccccagacagugccagcuaacagugacauuccauagauagcgacuauagacuaaacugggugggacacagcucagcgccuguaagcagggaggggaagagggggagauuuuuuuuuucccuuccuaaaacacaguaacaguaaaagccagcgauacuuuggggauaaguuggaucuuaauggauaugugaaaucugugccuuuuguuuuuguuuuuaaggaaauggagaaaggaaggaagcuggaggguuugaauuuguucugcuagcuuuggaauucugcaaaaucaggaaaucagaacguaccaguucucagagcagugacauuuaacuugauugggaagggcacacccaaggucacccuuuaaaaggguuugucuuccuccgcaacauuuuguuuuacccagccuuuuggagcucagcacuuuuggcuucuucucacagugugggaaaacaaaauuggaacaugacuguugccucuuaagagugcuuugucuggccccagugccuucuccaggguggggcucuguagagguuugcugauugacuuacagauggaaggcuacaggaaaggaguggaaggaacaggggugggggugggggcuuccuuccacuucuuggcccagagaacuggauguguuuuaugcaguccuuguucauggaagauaauuuaggcucuagguauauuuuuaguuuauugguuuaaaacuuaaaaauaauaauaauucgaauguagccaccauuuauuuuuaguacuguaacuaaacucuguuaagaugcuguuauuuguacucucugagggacuggauaacuccauguguccaggaauagccuguucuuguugcucagugaauauuccuuucagaaccacccugauccuuucccuuugcaaaaucuuaggucuaagagacgucccagaagacgacaaugggaauuucuucuucuaccugggccuugagugaaaacuguacuguuuuucacugaaggccccagagggaaggaguuguaaguguuacucuacaggucugucucaaacuccacacuucccucauuuaugugcacggcauugugccacgaggcuggagaccuucuagccuccagcuucuccuagauauuccuguucaucuggggcuagcaacagggacuccacauuggaugaagucugggucuccacuuuucuacuuguagacacguugugcucaagaauccccccgccccggggugggguuucuggguuccaauugggauguaaagugaauaaauacauuaauuaauggagggaaaaaaaaagaauucuauguuucugaggcuagagagauggcucagggggcaaaaauaccagaagugugagaccaaggcugaauuccaagcaucuacuuacaaacuaacaugaccacgugugccuguaacaccauuauugcaggggccaagacugguaaauucggacagaucacugcuagccagccagccuugcagugaacuuccuguucacagugccauaaagcagagagugauacagaagaagacaccagaugcuccacucuggucuccacaggcaugcacacccagacacaaaugcgcaacacgcauaccacacacauucacacaucgucugugggauacccugaauaacagcaggggcaaucccauaugcagcucucgaggcuugaucagcuaaccuuccccuccacccugguugaggcccucaucacagcggaugugccaacauuucccauccugccuuuccucagccucugcucugaggcacagucacuggacucuguugggcccucccuuccccuuucuggagaagguaagccuuuggugcauuuccaaccugugagcagccccuucugcucaggcccugcaaugggugauauguucuauuucuccuccuuacaaacuuuauucucugauucauucaagaauugccccacccccaccccaaagaccucagucucccucauuucugccucccuguuguuagacgaggcuguuuuacgucagacucuccucacagucugcaauuuugaaggucuuaagcgaaagggcauguuuuccuucccuuuccucauuuagauuacaguucugucacaguggggcuucccgcccauccacagaccucagagcaccaaaauaccagagaaggugucagcgugacuaacugcuaugcccuccagucaaggcucuucugacugugaccaagcaaaguugguauuauucaguucuggucauccccuaucccccuuccccccggguuauuaauaauuaguuuuauugcaguuuuaaauauuaauucuagaacuggacauggugacacaugcuuguaaucgcagcacuugggguuugcagaagcaggagaaauacugcaaguucaaacccagcaugguuuccauagugaggcuggugucuccccacccacaaaacaaauaaguaaauaaauaaaacugcuaagucuaggcuuggagcauauguaauucagugguagagcacuugcccagagcgcccauugcccuugguccaauccccaguguuauauaacacauacauaaaaaagaaaccacugcauagauguuacagcuacucagaaccuuaaguguuuaaggucacaucaacccagaggcugcagaggagaccuagcuacuauagcuuacagauaggugauagggagcuuuuuaguaauguggccgggacucccaggcuuugaguugcaaagcguucauuuuggugccuuauccacgaagcgucuuguaugacauagugcccaccucccccucuguacaaaguuuaaggaagaacugggggugugcccagcagcucugcgugggaaagcaauguuuacacguuauucacagaggaccgaguguuuugaaauaaucugggucugaauaccaucagagaaccuggaaaaggagagaagagguccaggaggggagagcuggagugugagagaagcuacuuggccagaggugagcccaaggcaugggaguggccaucugaaaggccgggugcugguucuggauaaagacugaggugcugaugccacacuugaugagucacuagauauauaguguaucgcuuuucauacgcacggaguguccuaaggagccagaugcauauuuccuguuacauguguuucuguacccuuguuaaaugaguuuugagagacauugcugccgauuacagaccacagugugaaucucgaucccuagagguggcagaugugcgcacacgcgcgcgcgcgcacacacacacacacacacacacacacacacacacacacuucuuaaaaacaacacaaaaccaaaaagaacccaacucaacagcaaccaagcacauugugaaguuccagucaccaaugaaaguucaggggaaaguuuaauuuguucauucacucaaugcauaguucucaaagguguuguugaaagugauuuuucauaaagaugaaaaggaacaagcuauauagacucauagcagaaaggcacuccaggcaaagcacaaacacccugaggugggcuaaugacaggcagauugaguagcaaggagcagagugugugggcuuggugguggcgcuaaagaaggugcaaucagaaaagauggacaggaggccacucaagggacucucucuuacagagcacgcuagacucuggcuuccucguggugagauggacaggguggugugggggcucuuguguaaagaagugaugugcacugacccucacuggagcucucgacagcggggaaacaggcagaaaggaaccgagguggaaaccccagguagucguggacagugcgauagaaaugcggauguguagaauagaagcuagguaaaagucagauuagagguuuguuuagaagggagagggcuacaggacuugcgggcagauaagcacagagggccugagaaggaagagucaggaauguugccuggcaacaggaaggaaggaggagccauugccggaaguaggaaaggcaguagaagaaucugaguccugaggaaauggucaggcgugauugagaugcuuugggggcauccggugaggaaagugaagaagcuaccaggaaaccacgagccccgagcagcagaucccaggggaaugagagaagaaaaaaggcaaaguugccuggcgggcaucucagccuucacuccugcuagaagaaagaaugagaacugccgaucggggcugacugaauagucagcgcgcgcuggggacuggaccccuuccuuggcuuccaggaguauggcgaaaaggaaaaagaacccgagucagaagcugcagaaggagacuucagcugggacaguguuguggcaaaagcaggccauugcuccacaaaagacggacuuaguguuccaggacaacugggagcagagacgcaugcuuucccaaagucccagcacacccgaaacuugaucuagagacaccaguguagucccugguucagguucagguucccauggcucgcaggcaggcuggcuaugguccaccacuggcauagggcugcaggcccuaggagcuucgagcuucucuucugggggugaagggcuggagucgaguuucuaugccaggcgucacaccauccccacuuccauuugggggaaggguguaaguugacuaaacggcuucuggcaggcuacagugcaaaugagaaaacuggaaaagaaccauauggugaauuucacguuacagcauuaggcccaaggaucuauuuaugggccagugaauacccauccucucaaggguuguggucaaauggaagccaccagcagaaggucucugcuguuucuucuggauucggauaggauggcacccaggguggacuucacaucacaugguuauuuacugccaccagugguagcauagaucuggccuccagaugugacuuacucuugcaccaggaaaaaccugacaucuguaacucaaguguguguguguguguguguguguguaugggggguugucuuagcuuccagugucuccuaagcauucagaccuaaggagacuucagcugccuucaaacaaaaacucaauaugauuacaacagagucuacugcuuuauaaaggcaagagcuggcucucgccucuaaucccagcacucuggagagagagggcagaucuguaggaguuugaggccagccuauucaacacagugaauuucagaccagcuagagcuacauagugagacccuaccucaaaaccaaacaagccacaaaggcaagcuuguuggagagcuaaggaggcaagcacaagggcaaccacaccaucugugauggcccagaacucacacacacacacacacacacacacacacacacacacacacacacacacaccacaccacacacacagccuuaccuacauaguccagaugggcacacaugagacucacacccauugucucauuaaaucugcccauaauuuuaagaauauuaagagugcagcugguauggacacuccuauugaguagacccgagguuuccugucuucuauaccuagcuguucaaggucgaggcagaggaaguagucucuuugauaagggcaaccacacccauacccucucguuuauuacuaacacauuagccauggaagcugguagaacugcaauccucggggcucccaagaauuggaacccucaaaacaguucccuuuaucucaugaacucgggggauagggacauggcuauccugccacuguccaguacacugucccuaucccccgaguucagggauaaacauggagcugcacugaaggguugacaaauguggugacuaaauacauccuauuugagcuggagggguuugguggcuauuuccuucaaaaaugaaacaagccgucacuuuuauuaccagguccuauuuaacuacccuacugaguugguaugcguaccagaggccccuucuguguucagaaauguuugagggaguauuuauuucauaaauggaucagcagacuccauccauauuggggaagacauugaacuguucuaguuagcaacaggccucaacuggacgcagcuuagaaccacucagaaagccccucgugaauagccaucuuuaccagguuggucugggugcagcauugucuuaccuguccuaagagauguagaagagcccagcucaccaugcacagagccauuugucaauagaaggcccugggccuucuaaggaaacuagcggaucuugaaccuaagagaaccagggagugaaacgcaagcugugguccuccauggcuucugcuucagguuccugcccuggguuccuucagugauggucugugacauggcaguggacccucuccuucaccaauuugcuuuuggucaugguauuugucagaaaggaaagcagaacagaguucaagcuuaucagaauaacaaacugagauguccaaaccaguacauagccuguugugauuaugauggucacuguuacuacgaaaaucuacccauaccucuuccugucucuuuggccucaccgguagaaguaagauggcaaaaggaacuucauccuuuggaaaacgucgcaaugagaugcacacacugugccgccacuguggcuccaaggccuaccaccuucagaaguugaccuguggcaaauauaacuggagugccaaggcuaagaggugaaauacuaccaggacuggucagaugaggcaccuaaaaauuguuuaucacagauucagacguggauuccauggaaggaacaacaccuaaacccaagagggcagcuguugcagcauccaguucaucuugaggaucucaaucagucauaacauaaauguucugguuucaaaaagaaaaaucuaccuauacacaaauauagucauucauauaaggucacaucagaaguuuagucuauuaugaauauuauaugcguaugucuguguaccacacguaugccugguucccagaggccagaagaggguguugaauccucuggaacuggaguuacuuacaggcaguauaaccuaccauguagauguuggaacuugaaucugugggugcagccagugcuuugaccccugagggaucucuccagcucagagucuuguuuucugaagcaaugucucauuaacuaggacagaucagccuugaacucacagagcuccgacacugccuuuugagaacugggguuaaagacaugcacuacaauacuggaucuuguuuuguuuuuugagacaaagccucacaauugauagaaguugcccuugaacuugcagcccuccugccucaaccucccaguguuuagauuauagacauguaucaccacagugaguuuagauucauccucuuuuuuuuuuuuggucaucuaacacaauuuucacauuucacuuuaaacgcucagacaaaucuagaaaaaucagaaagcgauagacaguuauacugaguuauacuagcaccuauuccuuaaguucccaaagccuucuacaacaguuguggggcggggggagguuggguucugcccccaggugaguauuuuaagaaaguuugcuucuaauugauuuagacauuuuuauuuaauuuguaaaaccuacauggacuuuuuuuuucuacucacacuguuuuaggauucacagaacaaucaaauccauucuucaguagaaucugaggguuuuuugccaaaauuuugaggguuuaaaaauaagcuuuaaauguagagcaugcccaugaugaaguuguccauguguccuguggccccacagagucaggcaugaaugcugcagcuggauucgauuccuuugucaacaugcaaauuaacaucuucgguggcucccucugccagcauacuuaucccagucuccaaauguguuauuuguuauuaaaaucaccauauuuauaugugggggguuuugcggugacuuccccagaugcugagauucuaacuguagcuaugcagguuauucaaacaucccgugggcauuuaagagaucgccaguccuuaacguggaaaugaaaggaugcuuuguggugagaaauaugugguucuguuagcucucagccagagcugaaggugccugcuaagcaggccugaugaccugagaaagaaaugaccccucaaaguuguccuuuggccuccacacgugcaccguggcacgcaugcacaugcauucacacauuuaaaagaaaaagaauaagucuuacugaggucaaauaacauguaauuggcggggggggggggggcagguguggugcuauaaaccuauaauuccagcacuuggaaaguagaagcaagagaaucaagaguucaagaccaaccugggcuauaugaaagccuucucuaaaaaacaaacugggguggugguauacaccugugaccacagcacacggugcacagauuucggugaauuuaaggccagccugcucuagaacguugcaggacagucagggcuaucuaaugagaccaaacaaagcaaaacaauuugaaaaccuaacauguaacaaucaggcucuuccagugacuuauuuucaaaucaagacuaguuauauauuuauaagucacuagacaucuugugauuuagagagccuguucacuucuucccaacaauguguaaggcagguguaucccaaugugaccuuaggaaaccucuuagguuaguggugacaucucuugguuaucuggaagugcuucucagugcuugguugcaugggagguugcucaaggaauugcagauuggagccucaauuuccaccccucccauuucuuucuaucuaucuaucuaucuaucuaucuaucuaucuaucuauccaucugcuuauguguauauggguguuuugacagcauauaugucugugcacuuuguaaugcgugccuaguucaguuucagauucucugggacuauuuacagacaguugugagcugcuauggagguguugagaauuggaucuugguccucuggaagaacagccugugcucuuaaccacuuacgagaugcucagaccacugguugauggugcaugcugugcauagcaggguguaaagccagguaacccaguuucucaguguaagaggagcaggaccugcagaggcuguuuccauggaccccagauuuuccuagccucucccagacagcugcggagcauuuacauuugcagaggagaaaauggugaacuucugacaacauuuguuuagcugauucugauuguugcuggggaacaccacacacacacacacacacacacacacacacacacacacacacacacacacacacacacacacaaaccccuuuggggauuuggagaagaggauuucagccagccccagcccccguuccuccaaguaccaagaucacuagcacugugcuugccauucuccaaaaaugugcacagacauggcugauccgcccacgcuggccuuuccgauaacagaagcagcccagccagaaaugagugguugguccagaauaaacccacccaggguggcagucaguucuuugcagccccuguucagaccuagcccgaggacagacauuuccuuuaacugucucgagugagagcuggccugggcuucuuccagcagccccuggcuccccuacccgccccugcgauaugugggcgcuacauaaauacuuguugacugacuugauucauucccuggaaaagcaaaaaccaaaggaagucgggcaaagggaaguggauucaacucucucuuagguaucagaaggaaaggccaggccugauguccgacugcuggugggauaugacugcuuucuucccuuaagaaauaagaaauaaaaacauuauucacugugauguccacugugucucugggggcugaaggcacagaguuucucagagauguguaguauguucaugggugugguucuaaguagacaccaauggucaacguccauugucuuacacacacucucugccuuuagagacaggguuucuccuugaacccagagcuccagggaucccucugucacugauucccugcuaccguacucucguccccaccccaacuaagguuacagccuuuccugggugcuagguccgucagagccaucuccaaaccaccaacaauuucuaccuguuagacugcuuaaaaggcuuaaaagaauugccacaccagcaccccccacccacucacagugagcgugaaggacacccccauccccccacucacacacacacacugagcaugcaggacaccuggagugcccugcccccuucagugcauguucuggccucauucuuuguuuugccacuugucagggugagaggugagaccucugagggucuguuuuggcagcaaccuagcuuugauggacugagggguuggcucuugaguuguucggcuaugagccucuaaggauauuucuucaaacaucuguaguacuucuugcuguuccaugguuguguuccauggcugggcuccaaggcugggcucacuccacucagccgcuuuucuccauguagcccuggcugcccuggaacucacucuguagaccaggcuggccucaaacucacagagguccaccugccucugccuucugaguccugggaucaccaugccugauguugggcggcuccucuucucgucuguugagcugcccucugaacccaaauaacuuuuguugccaccaaguacccuuucuagcacaaagccuccauaaaaauucauuuggucucaaaguuugaacuuggguuuucacccuuuugugggguaguaagccuauggacucuugggggugcuggcagcccccuugguccucuaucugcaaauaucaguucucauuugugaccaugaguacuucacacacacacacacacacacacacacacacacacgaacgcauccacaaacacaugugcgcauacauaccuguuucuauaucuuugaagaagaugauaacauuuguacugugucacauggacugagagagcuugcagaugugaagacacacuugggcagugcugggcacggugcaagggagccuguuuuugguguuguacuacaucuguauuuuuaaaaaaaaaaaaagauuuacuuauuuuauguaugugaguacccugucacucucuucagagacaccagaagagggcauugcaucccauugcagaugguugugagccaccaugugguugcugggaauugaacucaggaccucuggaagaacuguccaugcucuuaaccacugagccaucucuccagcccuacauuuguauuuuuguagaaaggaugaacucuggggcuagagagauggcuuagcacuuauuaacacuuggugaucuucagagaacucaaguuugguucucagcacccacaucgggcugcucacaaacgcccguaacuccaguuagauccaggaagucugcugccugcuucagcccuccacagucaccucucaugcauauauauacaugaaguaaguucugagcuuuugugaggucuaacacaaggcuguauggucagucaguaagauaucuuauacugguggcaggaagaaaagaggagauggauggugagcugagaggcacuggcgugugcuuuuccacacgcucuaacagugggagagaaggcccugauuccuguuugccaguuuccuuguuggaagcacuccuguuguggucgcuuucaaacugccaccauaaugcgucugagcacugaguuugggagggaugccaauaaccuuccugggaagucagcuguggcaccuaugugaaguuagaggggaagacucuccccaccuaagccuucucccccaccacuuucaacaauagauaauuugguccuuuuaaguagaaaucaacgaccgaauauuaaguauagccuagcucaauggcauggcuuuuuauaagccugcucacuucguguaacuucauguuacauuguguguguucuguguguguguguucuaagcauccaucaaucucaucugucccuccgagaagagcacagagucugccgcauuugggguacaccuuaaguaaagaaaagcagaaacugucgucuguaggggaugcucuguauagaccaagcaaugggcuguuagagaaguaauuaacagcuggguucuaaaaagcaguuuguuacuggccaaaugcuggaacagauagcccagagcaccagggggugggagcaagaccagcccugggguaaagcagauggcgggagcaggguccuacuaauuucuacugaggauguuuguauguuauucuucuuucuuuuccuuucugacuaauuuaaugauuuaggaguggaaaaaaaaauuaaccgauuuaucuugcugucugaauaauguuuuggaaugagcaagaacaggucagcguaccaaguggguaggucauugcccuguuuaaugaccuguauccggauuuuauugugucuggaugauaaucagugcucauuuccaccgugcacaaagaagaguuugugaggaagaaauaaaaacucucugcuuuuuaaugggcacaggagauggugcaaacaguagguacuuaauacauguuaauuaccacaaaagccucuucuagccacugagagggaucuaguagaagguucagagcuuagaacccacaccucuggacucagccuggcucucucuaccuuucucaguacugggggagugggcaccagcagggauaugaccuccauggugaggcucugguaaagcuucuaucacagugcaucuuuggggccugcuccagcccaucugaaucuaacaucugguucagggaaggguagugcgcaguuuccucccacuugccccuuagaccagcaggcagcgccccauucagacugagacugcaguuaauaaacauuuagaugcuucucuuuccaaggcaucaacuggcuggugguauguguguggugagaaacaggcuggcugagguggaacguggcuaagagucaggcgcccagaaagggaucugaaugagguaccacaugagugggaagcucggggaucaaacccucucccccagcagcuggaaccucuggauuccugguaguuuucaucugagggucccugguccuaagccccaguccuggcagcaguagggaucuacacuucuaguugugauaacagcacaaaaugaucaaacacuguuguuguccuguauccuguugcuuucuguuccaaacucagugugacccuucagugggccucaccaaaauuccccuggcucccaggagagaauagcagaagagaggcagacaggggaaggaagagcuguaucgguaguggggcaaaugcuuccucgagcccguuuucaaacaaucuacaaaugucuuuauguaaaaagugcuguacagguaaaugugagacuuccaucagucugugaugcccuccaccaucccgcccuacuucagaagugcagccccaguuccuauucggccccucuuaggacaccucccaugagcugaccuaccuucacugugcccaagggcaggcugcagugcuaggcuaaaugcauacaucauuauguggaaacgggacuuuaugauuuugaagccagagaaccugagcacgugaucgccguuuccugcuguaggcgaaaggugaaggaaaaccagugcacugcugucuuagaaggccuaaaauuagacgcgugucacucccaacaaagcaugucucauccuggaagaagguggccccggacuuaaugacccauaucuguaaaauaaggccggauauguggacaguauggugagaccuggaacaauauguucagagcucaugucacauugaguggaaauguugggucuucaugcuucuaaagaugggaaaccuugcuggaucacuugguuuguaauuacucauuguguggcagaccuauggcuuacugugugaauaaaaagguuuuugcugguggcugauaucauugagaguuuggcaccaggucagaaaugcuguccugcuucaccuaaaugcaguuccuauuguucuaaauccagagauagagccugcuuguugugggcagaaggucuggccugguccauuuggucacgguggcauccuuacauuguccugggcuggcuggcuuauguuggagagucaauucgacacauauugaucaguguuuuuccaacugcaagcguugggcugagcaucacagaaggcgaaaaugagaaagacggugaccuugugagugaaccugcuagcagggccacgagguaagggacugaucugaucugaaggcugaauaagagagugucccaacaggagagcuagccuuggacccucaauaaagcaaggauauuagaccaucacacacaccccacucccucgccccaaauucccucgucucccacuauagaaccacacucuuucuacuuuuuauuaccauuauaagagcuuacccagucuaagcucucugcuggcacaguguuugcucaguuaaacuaugccacaaccauaacuagauucauagauuauuuauuuauuuauuuauuuauuuauuuauuuauuuauuuauuuggacaagguccuguauagcuugggcuggccucacacuauugagugcuuggguuuacugguguguguuacaacccaguuuauguaguucuggagaucaagccuggaccuaacauguucuaggcaagcacucuaauaaugacugagcuacacagcucaaugcugacaucuuucuguguaugugcgaggggaggagggagcccucggaggcauaccucuggaagucagagaacagcuugcaggaggugguucuuuucuaccauguguguccugggcauagaggugugaggcuugguggcaugugcuaaagcucacuaucucaucagcauugagcuaaugucauuggaacacuaugggaacugagugaagaaccagaaggguacuucaggucuaaugaacuagggaaggauauagccaggagugucagcuccaccagaccccacugacauccgugacugacagagggccacagaguggcaaacaaaagguugagcgggaacccuggggucuuugggguugugugugcagcguguggaauuuccuaucacguuguucauggcuagagcagguggaagaacgugcccuguagguaugggcgggcagcugggcaagagcuugauuaaggguccucccacgucaucugauggcuugcucaucaucuguggacuugcugccauucaaaccauaagccccugcucaaauguccccugcagccagacaagguagugaucgcuuuagcggugugccaggcccuggcuguugucugguucauucacacugggggcggaugucgguuaugaaugagccggcuaguuuaugaaaccuuucaaagcaggaauuucuaguccuuguguaguagugcugcagauggggucaggccuugguguaugcucuaccacaaagcuagguguccuuggcucaagcaagagggauuguguuuuaucccuuuguccuuuuuuuuuuuuuuuuuuuagugcuguuuuguuuuguuuuguuuuguuuuguuuuccagacaguaccuccaggacuauacuauguagcccuagcuagacuggaacucaauccacauguagaccaggcuggccucaaacucucagagaucugccugacucugccuccugggugccgggaugaaugggcaagguuuggcaucugaauuuuaccaggcuagcaguuggcucccuggaugaagcccuuugugcauccauuuuaggucaagaguacucugcccuucacuggagggcucuaaguuggguucagcgcaaacaaauauuccucuggagucucguuugcgauuaauguguucugucucugcccggccaagguaaauggagcgccccaacccacacuuaaugaguuuugccuguguaaaccguauuaauugugguuguugcuuuuuaauuguccuuaaauuucucguacgcuaacugcccuagggcaggagaucugguuucugcuuagacuguagaccucuccucccaccguuccuuccacccaggagucucauaagccggcaccgaagucugcuccccucccccaccaucuggcagcagccccggaacuggaccagggcucagaaaaaauaaaaaauaagcaugcaaaaacuuuuguaagagccuccuugaccaggacugggaggcagagguagagauauuuugagggguuccucucaaggaggauucaaggaguuccugaacuagcauagcaggugggaggggggccuucagacgaccuuggugggcugucucagugugacaaaggugucuacagacagaacugggugacuuaagaguugccuuucuccagcaggugaaaaccagagccaggcaccugauaugggaccagagccuuauucugcccggaguggcgcuacacaguaccuuguguagugggcuuguuagagacuccugcuacaguguguccccugcuccuagcccugucugcccaaacccuggcacaaaacaagcuccucaccugauggugcaugagcagucacugugacagucacaguggagucacugguaggguugucccuccugcagccaggccuucuccacgacuauggugccaccuuuccuuguucauggaugugugugcaccugcaggcagaaggaggagaaaacggaccugaccuguggauuccugucuacaaacugcuuuugcaggaagcccuagagcaggagccagagccaucugcucgaagccuagcgaaguggguugaguguuccaugcugucccuccagauuuuaggcccuuccuagaccagcacuucccaggugacacugugggacaggguucuggaguucuauagcgugaguuugggagcaucccccauuaccccacaccccaguuccaccuaggacaggugccuggagccggcaccaagccaacuguggugaugcucaugugcccugucuggaguccugcgggagcccucugcacuuuuugccuaaugaucacuguauagugauugacugggccuagugucuggagccuuugucugagcuccuugcaucccucccuggggaccauugucugaguuggugguuguuaauccgcagccucugagaagcugccuggcaaaugggagguuaaugugcaaacagcagggagcguugucagugugugggguuggacggcaaguaggagggaaauaguuaaaaauccuauucaaggcccggaggggaggaggggugggcgagggagcaggcucagccuuguguuaaucuuacuggaauguaaccaguucgggcaguuucuggcuuugguauugcccuguugcucaggggcccagugucuggucucugccuccuaagcuucccaaaggcugaaguccuggggucccuucuaucuugaccgucucuagcaucuuaaaggagcccgaccagaacaucaggaggcugcuaaaacccggagaaccucacagcccgcaccacagaggaagcucggggaggcgguuguauggaggaaucggaggggcaagcagagagaauguuuagagaaaaagcccccaaaccuguuuggucaggcuuguauaacugccuggaggucugggaaugcaugccuaggggaaagagcugcuccuggacacuaacagcuaacagugcagccugugugcguugcuggauaagggggagucagggcgggcgggggucagcucacaaguggugguuuacugcuugaccgagaguguguucaugucugcugcaauucacuguugaacucuaaaacagucuuguguuggucugggcugugccucauaauaucugcauauuaaaaauccauccagcuggacacaggauuggugcacuuccucauauagccguugagucuuuguuggggacguuuaagaaguaaauuuuagguugagucaaucgcucuguaaguucaaguauuggugucauuagaaggaccugaguucaagucccagagcacaugcugaagagccuggagauagugggugagaacccucagaucucagcacccagguaaaacacaugggguccggagugggcagagacgggauugcugaagcuugcuggcugagaguaacgcaagucucagggagggacucuuuuucaaagccauaaaguacagugacagaacaggacacccucuggugccagcugcaugcugucccuaucaucugagaacuagggaaggagagacagaugcaucccuggggcucacuuccaaguagccuagccugcugggugagccccagucaagugagagacccugucucaggggacuggagagccggcccagcaguuaaaagcaucugcugcucuugcaaaggaggccgcuucuguuccaagcacccauaucaggcagcuuaaaaacuuucuguaacuccaguuccuggggauacaaugcccucuucuggcuccuguaggcaccaggcaguaaauauaaauaaacaaacccaagguaggcaaugccugaaaaaugacaccugaaauugaccuugcucccaauguagguagguacacacacauaauugaagggauuguggggggggggagagagagagagagagagagagagagagagagagagagagagagagagagagagagagguagguagguggugggcaggucucuguaaguccuccuagccucaugccuuuucuggccagcccagcagcagggaauggggguacaaggccaccaugaguguaggcguccaaguggccacucugcuauugggaaacggaaggaaauugcguggcagccagacccuggggcuuccucacuccgggcuaccauuuugcucacaaaagugaaagcagugaagguugcaacuauagaaaggucucuaaguccccauucggcauaaggcaccuuuccagaacacagggccauaaggccccauggagcuauugagcugauccggaaccccaccuagcuuguauauucaucaagggagcccagauccaaaagcucaggcucugcccagcccugacccugugggucacccuucugcgccccacccccccccacuccaccccuccggccugcccagcagacaggacucuggauucugucucuguuggaacccaccagccauccggagaguccaacguacugaauuucauuucuuucccgcucuugaguuuuccaugauuugggauuugcaaaugauuuuccucugggaauuuuuuaggccaucccauguagguggcaucugacauuuaaaauccugucgguaccauaucuagcuguguggccuuugauaaauuaaaaugucuggaaucgggcuggugagauggcucaguggguaagagcacccgacugcucuuccgaagguccagaguucaaaucccagcaaccacaugguggcucacaaccauccguaacaagaucugacucccucuucuggugugucugaagacagcuacaguguacuuacauauaauaauaaauaaaucuuuaaaaaaaaaaauaaaaugucuggaaucccagucuccucaugucagguaacgggaguagcagcaguaguguuaagcucacugggcgaagggagggcaaaccguacugauauacuugucaccugggauacagacggggcuucugucaucauccuaacgggaaccagacagcacaauaugccucacagaccggcaccccgaugcccuccccgaaugcaaccucaugccuagacauaaguaaguagacauacacagagagagagagagagagagagagagagagagagagagagagagagagagagaggcuuuagaagcuccauuuuggccuuggccccucuuggcacuguguuuccccacugagcugcuaugauguccuaagacacagauagaagcagggauggaagagacagaagaugcuacaggaccaggcucucuaccaccaccgccacaucucauauggaaaugaaaacuacaggauauucuccguuugggccaugcccuuugugucguagggagguguguuuuuuuguuuuuugcuaggcugggaguaaauaugcuccacagcuuguuggcuugacuuauagcuuuuaauuauguaaauaaguaggcauccucucagaucccguagauaccaguggagacccuccuuguccagcaguagccaccuggaccucugaggccagugccaguuucagugauggccuucauaauuguauuuaggaaaccagugucauggaucuuuuuaacuauucaaaguguuauuuauucauauugguucaaaggcuggagagacagcucacuccacaaaaugcugccaugugaacgugaagaccugaguuugaaccccagaaccuauguuuuuuugggcuuuuuguuuguuugcuuguuuguuuguuuguuuguuugcuugcuugcguuuuuguuuuguuuuguuuuguuuuguuuuguuuuguuuuuucgagacaggguuucucuguguagcccuggcuguccugaaacucacucuguagaccaggcuggccucgaacucagaaauucgccugccucugccucccaagugcuggaauuaaaggugugcgccaucacgcccggcacuugcucguuuuuaaaggccgguguggugacacaugccuguaaucccagcacugagaaagcagggaugaaugggucccugaaaccucguggccagccagccuggccuacucugugagccucagguuuagugagagaccuugucucagaaaacaaagcggacagcuccugacuauggacagcugagguugucuucugcccugcacacacccucccccucaaaaggaaacacagcaacaaagaaaaaaaaaugcagugagucuagcauagaggucuucucucugugaguugucaccuggauucaaagucucucucaaaucccaucacccacuccaauucuuaaugacauuuaccacuugggacagaugcuuuguccucccucauuagaugaaggccaccugccuagccauauuguccuuuccucuugcacagcagccagggacagagucccaacacaguggguguaccauaaguauuuguggaaugacaggcagaguguauuacaaacugauccauacuccucaggccuguguugauuuuucuggaacugcccuguuguucauccccucccgaguaaacagauucagacccucaagaaaaucgggcagccaagcccuuaacaagccaagaaagccagccuucauuuugauuaucuuugggcuaaguuugcuugggaauuuguaucuguagaaaaaaaaagucuuagcguucaccgcugugaggcaaauuuuuugcauucauuuauucuuucggugguuuggccccauaaagcaaggcuggccugaggggaaagcugccugaaagaauccaaguuugucuuuagugguagaaauuaaacaacuucuccaggccgugcccucaaacuucagccccguuuacuauugaaaauugugucucaagggguacagagaggcgugggauaauggggacugaaaaauguuugagauuuggacauuuuguuuucuuuuucccuuggagaauaaucuuuugggaaaaacuuggaugaagacccuuagaaccauacagauuuuuuuuuuuuuuuaguucaauucaagccccaagucauagcuugauucauuuuugugaacaauagacagagaagugcccacggagcauccaaaaggcugaaugaacugcaggaacaggagggcagggucuguccgcugagugucccaggcucugcauggacuccccagaaguucccagucacucgggaagccuucagaugguggcagcugaaacaccaggcccuguguagguguccagagaaagucucugaaaacuuccaagagauguccaaugucucccugagacucuucucucagggucugcaucaaauuacaggacugucucguuccucugucuccaagacugcuaagucgcagccacuggaccuaaggcacgcuuggaggucaggcccugcagacucagugucacucauucaggccaagcugccccagucauaaugugacaauagcauaggaacugcugaggggagggggaggugacacagucaguaaagcucuggcuacaaaaccauaaggagcuggguucaauccccugcaccugugauggcagcauugcggcugggaggaggguaggaauaagaaggucuugagccuugcuggccaggcucugcagcccaguuguccaucccuguucacugagacacuccgucucaaaaagauaaggugauacucagagcugccacuuccguuuuacugauaacggacuagaauauuuguuuguuuguauguugugucugucaugugugcaucacacauacauagcuccccugaaacuagagcuacagacaguugugagcuacuguguggaugcuggaaauccaacccggguucucuagaagagcagccaaugcuugucucuccagcccugauggacuagaauuuaaacaaaagaaauacugauguuuuaaauucaucauuuaaggagacccugugacuaggcauguugucuuuaauaacagaaguaggggcaggcggaucucugugaauuuggggccagccuggucuucacaaguuguuccauaccagucugggcuacacagugagacccugucucuaaaacaacacacuucuugaugugaggguggggcauugagcugagagcugaccauuuauugacacccaugugaaagauguuucagugaucuuaaugaacacgugcuaaggauuuucgaagcgccaaacuucccuucccuucagggagcucaguguggccccagucccuucuguaucagacuggugacgugcaaccccaaagagaugcucaacucuccucugaggaugaguuccaaggagcugccaggauauuccuacagugcuaagcauuugcucuccugcggcacugugucuacucaugacaggacuugugcaccuccucugggacccuaccugucaguagccuuugugccauuucuaacaguaaucucuuugggguaucagaagggaugcuaaagaauuaguguaguuauuuacugcuuccagaaugguugcuuguaugugaauaugugguaugucaaaguccaaguuagcaaaaguauuuccagugauauuaauaaaauacuuuaauuuccuacagcccaucauacaaauaaacucuucuggcccguaucuagguaaaccucuaacuccacaccucugaggaacaugguggcacacacauuuaaucccaacacuugggagguagaggcaggaggacuucugaguugaagcuaacaugugucuacauacugaauuccagaacagucagggcuauguugaaagcucccuccaccccacuccccaaaagagcaaagaaagggcauuuuuggguggaguuucgguuaucaaccacgugagcucugggagccaccuugcggaagaucugcugucagcaguucccuggaugcugacguggaagagugcuccgugaaguggccguuguggacaguucugccagcacuugugugucuugacagagguugucaggacaggaaggcaugcuuuaacuauaacccaaagccagccuaagcuacaagaguaguggaaguagauagugucacagccaaaaagaacaggauguaggcuuuagggcuuccucuccugaggaauucccucuagucccuggggcucugacaagccaaguggaauaagggggaaagcgcuugcagggcgcagaggcugccagcuuggaaguaagagccucuggaccaagguaaaagaggagguggcucucagagucuuauuaaggacuuguuaaagaucugggauugaagucucccaggaagacuugugaucaggauaaugccaaaaagaaagagauccagccacguggaagaaugaaccaugaucuaauuagggacuccugagaaccacaggaucuauugagaaaccuggaagucaucggagaacggaagugugggcugugguuggugccuagugccaucucuccgucguacaucugauuacugugggauacuaugcagagacugcaggagcaacuaugccaaagguacggauguggaguaccacuagauagcagcuacugaaguggcuucaugugcccugccuucccccaaggccaguggcugcaacucuagaaacaacagacaugccuccugcuaauauaagaaggugugugugugugugugugugugugugugugugcucauguuaugaugacuacauaccuucccaaugcaacagaggagagucaugguccuccaugagcccaccaccuuuacuuggcucaguggcauauaacaaauaguacccaaaguguuaguccagccccuggaaaaugcaugcagccucuugacaaaucuuacagguguagauaaggaaagcuguguggugagacauuggggguggccagaacaagguccaaggauguugcuggugaggucgcuggagauaggaugcguauaguaggcugggauuuuaauguccaugggguagguggguacuuuucugccacaucaugggauugaacagagcucuggcagggugaugguccagucaguaguaugaaggacagggugacuuggacaagaacuucaggagauggcuagcaagggauuuuaucaagaguuucaggguaacccuaaagagaauagaggagauggcucaacugacaguccagaguuagagugauaagacuugguccucuaucaggugaaggacaggaaaggaaaggaaccaacauuguccccaaugcuugugcaguggucagggugacuugaauccuggcucaugccaauguugcuuuccccuucugaagagccuugguuuaguggacacuaagaaacuaguucagugcuggcuuuugaugagucugugggccaggagcagaggaagcaacuggaauugaggagagacaucaagauugucuacuguucccugacucuuccuugagaggcaugaacaaacaucuacucagcccagagaggacacaauaaaccaaugaaugauucuuugcggguguagugcggugggccagugggugucuuaaaagcugguguggcucacucuaaggcaguuguaucacugaaagcucaccccagcaugaguggugcuccugacaacauacucucuggauuucucugcccagccugcagguagugccaccgaaaagucucccggucucccacaaugguuuccuucucauauaaccuuugaugcagggccucaugaaucuugucucuuucugaacuuccugauucuugugaauuagcuaagucaguuuaucuuucuggaucuuggccucucuaggccucuagucccuccaagagaaaagguuucaccacacacagaucaggaucaucgugugggcgcugguuaugcuagcacaggugaaguuauacagagaagaggauucucaaagccacaucuccaagaguaugcaaaggucuuggacuggcccagagcagguacugaacaccagaaaggagucucagaaaaugaugcuaugaauuuuuagagcagagccuugaaaagacuucaguaguuaggaggucagcaggggccuuagugagaacaauaggucagaaagaaagaagggaugguauuuuaugauuaauuauuauuauuuauugauuaacuaauuaauucuuuggaugggugcacaccacaaacgugaaaaagucagaagacaacuugcgguugguucucuccuacuauguggguucuagggaucaggguuggugguaaauaacuuuaaaggccgagccaccucaguuguuugguuuuguaaagagcucagcaggagacauggcagccacacugcagccugccccacuguaggacugaccaagagcaccuauuuaccaugaacuuaaaacuucuggaaaagggaaaucuaggaagaagaaaucaacgguccauuugaccauggcuuccaguuuauuuaauucagcaugcauucauguaacugaaugaagagccuugacaaagacugaguguggggggcauuacacagaacauggaaaaucaaugggaaucagauggagaauuuggccagugagcuucaagccucuuguguggugcuggcagagcugucauccaaggcagucguucuauuucaaagucuguagcuaggaacgauagccccaugaaggaaguggcagagauguaacgucuuuggauaagcagauaugguaccugaacgacauggucacuuuucagucuuggucccaaauagcugcuuauagacugagcuucauacccagucucaaacacaggcugcaccuagaacugaugggcuaccagggucacucaagaagcaaugugaaauccgagaugcgcuuuugagaguguguucagaaauguacccuucgagcugagccaggaugucucgaauuccagaaagaccuagcccuggauuugguuggagagcuaggaggaggcacugcagcccuucucucagccccaaaauaaagaggaauguguugacaccauuaggaauguucaagaaauaauugguuuugauggucuuccuaaugugccaccaggaaucccagagugggugucugcugccuaaucugagaguuuauuuauaagauccggugagggcugcucuggggauauggauuuucccuuauguaccagaaacuucuacaccaagccuucuaauacucuggagagacuuagacagguaaagacuguagaagcugguauacuguagcacugaaaagugcccggugguuggauggaugcuugcucuaggggauaaaagagaagcaggagaagcugaguaugggauuggagggcggugguggggagcuuuguagcucaguggugagcacaugguggcacauguagggacagcucugaccucacauugacgucaccuggggagccauuaaaugaggcagaagguuagggcccugcccuggaacaguugaguggcaggggaggaggguuggaaaucuguggguucauagcuccucuaggcaacucugaugucggaggaauaacaaacugaccccgcccgcugguccaguagaagaacccacauccuccuaucuguccgcguagaucuucaauucacauauaaagaugucugcuuuacaaaagugaauucuuuacuugcuggguguccugcuuuuccccuugagagugucuaguaaguaccuucgcaugccuauaaauauucacuugcuccguaaacucaaauaucauuguagcaugagguauuuaauaucuuucagcucuuguagauggucccagugagcguuccugcagcuguaguuugcucgaaucuuuaauuauuuccuuaggauacauuccuugaggugguacgccuuuggaagacuugauacaugccuccaaauugcacaagaaaaggcuuacuaauuuauucucccaccaacagggcaucaagaaaagugcccaugguaauuaaagaggaguaaaaaaggccguugccagcuugacagaguaaaaguaguuaacucauuacugaauucauggcuucuuuaucucagauccugcaaacaaaugggaguggagccuagagauuuuuccagauggcuuggugccugguccagacuucucugcugucucauagaccagguuugaugaucugggggcuuuuguuccccacagucaauuagcuaguguggucccggugguuacacggagaucaccagggggcaguguugagcuguugugcauauugagaaugccuucugguuuagccauaagaaaaauuugaaugacacaauuauucuuuuguugaguguuuuaugacuucugcagaucggugcucauaauauugauuugccugcauuaggaguucaucccccuacaacuguuuuuacguucacucuuguggguucuggcaaauaucacgguccaucauagcucucccacagcuacggcacgggcccaggacaccuggguuguuccuccuaauuucauuuaggcgaguggccucugggaccauggugggauggcucagcccuuuugucuaaggaaagccagcaugggcugcaggaaucaugguccgaguugcucuuuuccggcacuaguauacuuaaagaguuaaaaguguggucuuggaugagauaggacuuugggcuuaacuaguuacucagcuuucugugccauagggggaguacacgccaucuuagaagaugaggaugaaaugauaugauacaugagaauagcuugggaguuugcagaugucuuuuuuaaagaaaucuaucuaugcagguucuguaaugaauuuccauuagcuagcuagcuuucuuucuuucuuucuuucuuucuuucuuucuuucuuucuuucuuucuuucuuucucuuucucccuuccuuccuuccuucuuuuuuuuuuuuuuaagauuuauuuauugauuauauguaaguacacuguaguugucuucagacacucuagaagagggggucagaucuuguuggggaugguugugagccaccaugugguugcugggauuugaacucuggaccuucggaagagcagucaggugcucuuacccacugagccaucucgccagcccccccuucuuucuuuucuuuucuuuucuuuucuuuucuuuuuuaauuuaugaguauauguaugugccaacuugucugugugaguaccacauacuuggcaggugucuucagaggccagaagagaaugucagauccccuggaacuggaaguacaggcaguugugaagugcuccauauggguacuagaagucauccugagcccucugcaagaguagcaaguguuugcuuguuguuguuguuguguggggauuuuguuuugagaugaguuucucuguguagcccuggcugaccuggagcucauucuguagaccaggcugaccuugaauucagagauccacuggucucugccuccugagugcugggguuaaaggcaugcaccaccacagcucugccaaguaacuacuacucuuaacuacuaugccaucucuccugcuccugcccuuugcuuuugcaugcuuauugcucuccuagaaugauauuaauauuagaaugugaauuuuagacaugcggugauccauagcaggucaccugguacagcuccagcaucagagccuccagcuacagaugauuagauauacauuugucccuugcucuuucagagcggggagggcagguuucagguccccuguugauaacaaaacucauggaugcccagaucccugauuuaaaauaguacagcacucaagugggcagaggguucgguggguaaagugcuugccacacaagcagaugaccugagaacggaccccccagcacccacauaaagaagccagacacagcagccuggacaucuauaaucacagagcauccccuugagaugggagggagaaaaaagccagaagcuugcaggccaguuaacuggaagaacacagcgagauccugccucacacccuccacacacgcaccauggcacacggauggcuacagucaaacacacaauuaguuaauaauggggcguuuguauguaaccuaggcacauccuccccuauacuuuaaagcauuucuagauuacauuacuuaacagggaugcuauguaaauaguuaaguaacaauaaggaaagcgacacguguuuaguauacauacaaucacugaaggucugacuguguuacaguuugcacuuaguuaaauccaaggucagaaaucuugugguugauaaaacccacaaacacuaaauucugagauaugaagcccauggcugcauagagcuaaccgaauucauuuauaauuuguagucaauauacaaacuauauagggaaguaaaaauaccuagaaacagauuaugacgcuauuagcuguagauugcugggguuugaaccagagccuuacaugugcuuggcaaaagcugaccuauaucccaggcagcccaggguaucgguaaacucccgaguuuccuggcuuuacccaaguucugggacuaaagguaugcacugcgguuucuggcucaauaaaugaugcuuguuguuuuggguuuuuuguuuguuguuuuuguuuuggggacaggagcuagucuugaagcuacuauauagaccagguuagccucaaauucauagaaagccccuuucgccucugcaagaaugcugaaauuaaaggugugucccaccauacccagacccuuaguaaaucuuuaaaggagucuuaacucagcugguaugucaccuauugauugugaggccaccaguucucccaacuccagcgacagccacaggaguagccacugauugcuucuggauacguuucaccuaggcugauggaaaccuuuccaggaagggguacuugugccucucguucagguauuccugaaaugcccuccuggucaccaggcacuuaucacaacaaugugcuaugucaagugcuguggugaccagagcacagaugaguuuccuguucccgagacacucagaggggaagagagaagaaaugcaagucuaggaaggacugaggcaggaacacgcgacacucaucucaaggucaaggcgagacguggaaaagaugguucagcaaccaaaggacaggacuuccuggcuagcuaaccgauaaaaagcgaggaggccuguggaggggagggcgucugcugcuuugaccuagcaugcacaaggggacgacggcucgggcuuucgggagaagcaacugcgugcaccggccuucugugcggagcuucuuucaaggguuuagguuuuccuuaucaagcacgugcugcagcuccuggcuccaagugucacuuauuuguauaaucuugucuacccaccaccuauacuauuuacucgaugguuuccuuuaaaacaaagaucagggagcugggugaagugggggugcauaccuguacuauaaacccaggucucggguagugaagauaggauuucaaguuuaaggccagccugggcuaauagugaguuccagguuagacuauaugaauauggaaaccuuaucucuuaaacguguguguguguguguguguguguguguguguguguguguguguaacuucauuauaagugaaauguccagcaaacuaaaauuuuagaauaauaugugugaauauauauauaguaauuauuuugauguuuugcuuugcuagcuaauuacaguacuggagaucaacuccauauccuuagccaugcucagcacuuugguaccuauuauaauaaacacugcaugcagauacucccugagaugaauguucguuucaugcaaugagaaggcagugguguaggcugugauauaaugcacgcagagagucugacuuacaguauggccaccacugguguucauuucuuagccauccucauuuccuguacucucccuucaggcugagugcagaaucauguuguucuucccuaacagcgugaaagccauucauuaacacaugacucgauggcuccguguagaagucacagucuuuucccacccaugggauccaaacccuugcugggacugcucaccuauggagggaugcccuuggcacccaggggcugcugacguuggacaggcuuugcagucagggaugaggagacagcucugagaagcccuaggagccugcagccugcccucugcugccuggcuguucuuuugugcugugugcuuuacuggccccagauaagcacuuccuguuccccauugauuuuacacagacccuguuuccuuucuccucaauaccugggacauuuuccagcuccucuucccacaagggaaaauccauaaacuucagaauucccagaccugcuuuuggucacugggcucugcaaguuaggacuggauuuugcuguucacuggccuuuucugugagccccugaugccuuccaagaauguuccugauugaaccagucagagaaaggguuguggagccuggauccugccccggcuucuuuccagauggaauaucuguuaucuaccaucaguccugagucagagaaaauauguaugagagcaucucacggugauuuuuacccgcuguuagaagccaccucguauacuauguugaacgcucugggcccgcaccaggcagaacuaggaagaauuugacgauauauuagcaaugccuagcaugggcaaggaaagagguacacugucccugugcccuguggacaaaguuccaggacugcaggauuggguugacacuucuagagagcgaaaagaaggcccgguacccaccuccuguaucacucaguggugacauuacagagauucacaucagacuucuacugagcuuugucgcucaaauccaagucaucaccgggcuuucguauuuugcgguuucucucuccugaaccaucagcgggaccaguuauuuaguuguauaguuuggaagguguuucuaaugggacgugaaagaugggcuggcgaaugugggcugcagcagaggugacacgguggagagagcauuugggaccuuuccggcuuuacccaccacccugauccuugggaguggcguuugguccaucucaggcaaagggagcugcuaaugcauuucacagccccucuaccagcucccuucaaaccaagucgcuuaaacuagaaguguagcucaguggguagagugcuugccuccacgguucaauccucagcaucacauaagccagaccugauagaacaugucuguaagaacaugucuguaaucccugagaggcagaggcaagaggaucaggaauuuaaggucaguaugaaauccugcugggggggggggggggagaggagaaagagagagagagagagagagagagagagagagagagagcacccguggguuaagagagugacugugugugaagaauuaagcucccagagcccacgcugggccacucgcacuguccuguaacuccccagucagagccccaguguccucuuuugaccuccgcaggcaccacauucaugggcacauaccugcacacagacucgcgugcaugcacauaauuaaaaagaaaccuuuaagaaaaaaacaaaaaacaaaaaacaaaacaagcagguugccaccccaagguucuccaggugcaggcagaaggcacacuugcagaagugucuagaaucuggagaaugcugcugcccaugggaagcagcaagagaugcuaaggcagaacuugacauuuccggcugaguaagcugaaggugugugugugagggugaaaauuauuaauaugagguuaccuuaauagcuuuguuuccuguugcuacugugugaugcaugaaccuuauggacagugguggcacacccuuuaaucccagcacuugggaggcagagagacaauuggaucuccaugaguuugaagccaaccuggugggcagagcaaguuucagaacagccagggcuaccuaaagaaaccuugucucaaaagcaaaaacaaagauauccaagagagauacucacugagauaccaguucaaugcaaaggucagaaugguuacuaaccugugcagacgggaguguggagauguaagcgcucuccuacguugccgagaguagugcuaaguucucuaaauaggucuacauguucauacacugaacuacucauuccccuuacaccuagaaacaugucccaugaucccuguauccacacaagggccggugaugaguguucauggaagccagguauauucauuacagaggaggagcaagaacgcgcugacuugucacaaacugugagccugaagugaagugugguacucugacaucuuggacaccagguagcugucagccucaaccuggcaacuggguaagaagcagauauggacccaguucucuccuguguggugaggagaccaaggcaagggccauaagugaagcugagggaacagagcugaagguuaagggccggagccagaacaugggcucuacacccagagggcugaggcagcuggccucaacugggaaaaagaugugcugugggcgagggugaccaagugugggccacagggagagcuggugugagaggugucagccauagggcaagaguggggucaggcccaugugcacuuucuccaucucuuuucaugaucaggcacugagugcagaaauugcucagguccagcagcccaaggucaaggccaggcgaaggcaguuuaacccagagaccugcaggcuacucagugagggcauaagaucaggcucagcauuggcuuugguggguucaguuauucauuccuuugggaaacaggaucucacgaucugccucugaacuugaguucuuugugcccuccguaccgugugccaccacacccgacuggccuuuucaucuuaagccuagggcuuugcgccaaguguucccauggucuaugccaucaggcuguccaugcccgguguucagaggacagaguuuccccugcuccuuugagaaggagcauggagcugccagaaagaugugcaaggcugcauguccaggucuccagucugaccucaggcccacauccaccaaucacagcauauaccgcuuuccagccaucuaggaauagagccaauaauccuaacaagucaggacaggcuaaaaauccccacccccacccccuccacuccugccuagcaucagugguguguggccagccaguugguaccaggccaacugugagugucucuucccaccucucacagugacucaccauaguaccucaaaaccaacuguggugggacuauucacaccacagauaccacaaaugcuacacaacagacucuggugcguagaaagcaguaguaaggguuuugauuagagcacccaccaagugggacgucucccccagaaaacacuugagcuguuagagcuuccaagaucggcucacucuagcccugguuuugcucguaaauaaagauaacuaaaauugaugaguccaugugcagucccuucuccacucagacaggaacuugcuacgucacacaggcugugcuggagccucuaggcucaacugaccuacuucagcaucuuaguagcugagggaaaacagugaugucacuuucuaucuaucuauauauguuuaaauguuuauucacuggagagggguacauggaggucaaaggacaacuugugggagucauuuccaucccucuaccaggcagauuccugagaucuaaagucaucgggacuuggcggcagauaguuuuaacugccgggccgucucacaaauccacuuccuaauuuucuuaaguguccagcagccacuugguccucucuguugugacugccacaccaucgaggugguugaucucugucggugaggacaggucccgagaaauaagguuccucccagauccacccuuuguuaguggugucagcugggacaccugcuuugcugagcaccuugauggggccuuuguuuuuagaggaacgucugcaucugcuuugguuuugugcuuguuuuuccuccucuaggagaccuucugggccaggccuugucuuuagauugauagagcuaagcaccccugguuuauaugggaggugacugagaacagagauguuggauggagcccgagacccuggugcucugcggauccacuggagagcuagcuuucuaaaucaaaccuuagcucaacuucugguaggagaaacaaccggauucuuuggaacagagauacgaacagcuagaagucgcuugggacaagguggagugugcaccagagcuuccaaaauauucguuggcuaaaccuuggucugaaugaaaaggggggggggggaagaacuugguuuuuaaagacaggguuucuguaugcagcucuagcuguccuguugcucuauaguccaggcuggccuggaacucagaaauccaccugccucugccucccaagugcugggauuaaaggcgugugccagccacaacaauccagccuuuuuguuguugcugguuuuaaagcaguaaaagaaucuguuuauuuuuuuaagacucauguuuuauucaugcaugaauauguaucucuuccucccuacccuguguguguguuugugugugugugugugugugugugugugugugccugccugccugucuguccauccggccaucccaguguccaggaguaagggucagaugcccuggcauuggaguuuaggugguugugagcugccugaaguguguggugauaucugagcgcacguccuccggaaaagcagaacgcugucuaucugcugaaccaucucuccagcccccaaaguaugauuuuuuuaaaaagaacuuuuccacagaaaauuaucuauuguauuaaguccagaaguagcuuauuauagaucccuauggacuugcaaauugaauuuauuucggaggauucgccuauccagcagccucaggaaggaacauggccuucaucgacagugagguggaacaaagagguuguguuugggauuuagugcuguccagugcauugaugcaaacgcuuagagccacucgcuuuauaaagaaaauuagggacgcaaguaagagucaaaauaaaauguuuucuuuuucuuucauugcucucuaaagugauuucagaaauuuaaguaguuuccccccaccccuaccccaaucuggggagguauuuugucuuuaugcuacuaagacugguugguguauuuuccucuuuuuuaaacauuuauuauguaucuagcguucugccugcauguaugccugaaggccagaagagggcgccagaucucauuacagaugguuuuuaagaacugaacucaggaccucaggaaaagcagucaguucucuuaaccucugagccaucucucuagccuguauuuucuucuuuaaaauauuuauucuguguuauguguauuagguauguacgugaguccucagacaucagagaggggguaggaacuggauuuacagaugguugugugccaccuugugggugccaggaccugaagaugcguccucugcagaagacgggugcuuuuaaccacugaggcaucucuccagcucccagagagcuggugcauuuauagacauagagugaucuauguguguuucugggggagauaggggaccaugcucccccaccccauguggugggggagaggugaccuuacugauugauucaggcuccaggugcuggaauuacaggugugagucaccaucccuuacuagauauagggucuuaaacagacuucuaggaaucagcagaguugggcacacauacucugugcuguuccucugaauccucgcaguacuaaaggaguuauucaguaaaguccagucacucaaguugaauaaauuggacaaugguggugcacacuuuuaaugccagcauuugggaaacauagacacugccucaaaaaaagagaagaaaaugaaacaggcucccuuccauauggaccauauguccaaaggguacugugauagacuggccaaccccauuauagaagugggccuaccacauuugucagaacaaaguggguuaggauuucaguacuuggugauugcugucauggguugaauguggaaagucccccuacagacuauguuugaacacuugggcuccagcuggugaugcuguuuggagagaaugagaaauguuuaagacgaggugucuaccuaguagacucaucgcugcagggggcauuguaggguaaacgcaccucuuguuccaggcaguacuccgaguccuuccucugggagauguuaggagcuguaccgccugcugcucagaacucugaccugccuuccccacccauggugaacugaaacaccccuguaacuauaagcccaaauaaaucccuuccguguuacagacaugggcaucauaguuaaacaggcaugaccccugcggaggccagaggacaaaggauacagacaauaaccguuccaucgugagaaugcuuugagucugggcucugagcaaagcuaguuucucacaagcagaagaugcaaacaugcggaccagcagaacaaaauaagacccuacagcccagcaagaaguuaaagugagcugguguugggagacagcaaggaaggaagccugaggauuggugggccuggcuuguugguuuuuuuuaucccugaaucacugaauacaaccaguuaggcucuuaggaaagggugacuaacugguguuuuuucagugguacaggugcagugcagugaggaacacuuagcuuauccacagaggacaagcauccauuguuccacaccgucugcuuguccccuguggaggcaagaggugaccauuguggaguugguucccuucuuccaccuuuccguggauucuggggaucaaacccagccccugagguuugaaauuccucuaugugcugagccaucucaccagccuccacguuaguuguugcuaacgugggaagaggaguggcugcggagacgggucacugaggaccacauuuaccaugcagacacgaggacccgacuccacacccacauaaaagcuaagccauguggcucgugcuuuaaucacgggggaagaccagcgaucucugggguucgaggucaacacccuugcccaauaaaccagcuucagucucggugagaacccccaucgcaaaaaucaagguggacugcuccuucaggagcaguuggccaagguuggccacuggccuugaugaacgcaugcucacacacaagagacagagagagggcagggcugggugugguagagcauaccuguuauaacaauaccagcacucaggagacugagcaaggggugugacugggaguuggagacaaaccuggguuacaaagagagaccgaguccuuugagagggcaaugucucacuguauuugaagcccuccaggggugggggcaugagggguguuuguuaccuuggucuugucucuuggugacagcaguuguagcaucuuuugaguaaggcguaggaauccuuggacuuuauucaaaggaguccuagcuugaggucaggcgagucacuguucaccaguggggaccagagggggaggguugcuuuccuagccugaaaaggugcaaaggacucuguccuuugccaguguccauggaagaaguggagggcuuccgggagcuggacuuugggggaaggagugguuuuccgagccccacacuugaguaagcucauuugggagccuuguccuggugcauucugugacaagaagccgugauuuuucucuggugcucagguccugcagaaaggguuuccuugucgagcauucagagucugugggcacgccagggggucccgugcacacggaguggggugagacaaugugggccucucuggagcaggggcccucacugcucuccgggagucugaggguuaaucucuauagcucauuggcagcucugccucugcccagggcaugcugggauuuccucccagcuguuuuacaucaggaagauuuguguguuggggaaauuccagggcacagcugcaauuaaucugcugcugggucucccggagcagagugaggauuguguaggacaggucuccgccccgcugcaggaaagcggguucuaaccccuagggagcauccuucggagggacccuuccccaggcccgaggcgagcgagcggaagcagcccaccuggccgagcacuuagcccuagggggacucugggaagggcugagaaccaaagagagauugcagaacuuuaaggaaaagagguaccguacuccucuaauaaagccaaaguagcguccaaagcaacacuugugagaaaugucgcccaaaagaaaacaucuuucauacgccuuacauagaaaagguggcgcucugaucagcauaccacaguaaaguacaagaaauggcacaccaggguagcccaguagagcucacccagggaaugcaaaaacacuugcugagaagaaaaucaaucgcuacgcaugcaucucaugaaugagucuaauaggagaggccacauggccauguuuuuuuuguuguuguuguuuuuuuuuuuuuuuuuuugguggacgccaagagauucaacggcuguuccgaugagaacaauuaggacuaaaaucucccuucccuaacaagacgaacuagaauacuagggcuggggaaguggcucguagggaagagugcuuucuacacaauccugaagaucugaguucaaauccccagcacccacauuagcaacaaccaggaaacaaagaaaccccggaggcuggagagauggcucagcacauagaggaauucucuaaccugaggagcuaaccccagaacccacagaaagguggaagaagggaaccaacuccacaaaggucaccucuugccuccacaggugacauacauacaugcacacacauguauaaaauaauaacuauuagaaguuaaguuggguguagccacacgugccucugugaccugagugcuguggugggcagaggccgcaggaccccuggggcuugcugguuaccagucuaacuccgguguaguaaaccugacucaagagaccaagacagaggauaauaggacgggacacacacacacauguaugcaccacaccuagucacacaugcacacauuuaaacgagcgauuuuuauugcauuuauuucauuuaucuagagggguagugauuggcacaacagcacauguguggaggucagaggacaacuuccaggcuccaggugucuguucucuccuuccaccauguaggccucaggaaucaaacucuacuugucaggcuugguggcaagguccguuaccuacugaccaacuugauggcccccaacaaaaagauacaucuuaaaccuuagcuucacuguacuuaacuauaaaccagaauggcagaaggguaagccauuuuccaagguucugugaaaauuggaacugucuaucagcccauaguaugugucgcaagagacuguagcauuuugacgcaguauauugaagauugguggcauggcacuauucugucucugaauccugagggguccuuuggucauagaagcuccaagaguuguauugauacuuugaagacaaagggagcuuugccucuucaguggucaucccaggagagcgggguagcuggaccaggcugugagcacaucggcugcgcugaugcccggcugugaugugcuggucagaaguuugagccucccgcagccuguucaacagagcuuagauaaggcuuggcgaaaccuguuuuaauuuguccacacaccauuauugugcccagagucuuagcucagccuaauccccacagacaugcuccacccaugugcagugaccuccaggauaauugugcggccggccucucaugggaaccacugccaaaaagagcuuucuuggcacuggagagauguugcaguguuuaaagaguggguacuguucuugcagaggacucgaguuuaguuucaacacccauaguucauggcuuacacaaccguaggcaauuguagcccaaagagauccaacucacugaccuguguggauacccacacacauguacacaacacacagagaccgaauuaauacugaaaauaaauaaauaaaucuuuuuggaaaagcaguuucuuuccacuggcgugaccuaggcauucagaacugcagaugccugcaugcuccuggcacugauaccuccgacugcccuaguucguggucccgcaaagcacuuagaauuccccacugcuuaugcuguaauccagagcuuuguaagugauucagggagucuuaaaguucugacauccacuccacaagucucuucaaaaaucuuuuuuaaaaaggaggcuggggacauggcucagugguuaaaacacuugucacaggagugugaguaccagaguucagaucccuggcguccacauaaacaccaugcccaucugguggcccaguucuaaucccaguguuuaggaggcagaggugggauucaguaagcucugggugggauucagcugugggacccuaccucaauagagaagguaaaaagcaaucauagacacccaguauuaagagagcaaggcaggggccgggcaugguggcgcaugccuuuaaucacagcacuugggaagcagaggcaggaggauuucugaguucaaaaaucuguagccuggucuacagagugaguuccaggacagccagggcuacgcagagaaacccugucuugaaaaaacagagagagaaagagagagagagagagagagagagagaacaaggcagaaagugcuaggcaugaaugcaugcauauccauacacaugugcacccacacacaugaacaugccuacagacaaauguacaccacacacaagggacaaaagucgcuaacauaguucuaccuuccaaacggauuccucaggccuccaggaguggauagagccagaugggaccagagugacaggacaacuauccacauccacuugcucucagauguaucagaaaaaagccagacuucaguggugggcggggcuuaaagacuguuagcuucccgaucucaguuauaauuaguaugggaccugagcacgcuggugcaugccugugaccccugugugcggcacugaggcagaaaggucucucucuguuacuggaagcccaaggcaggcaucuuauuagauguguuugugcagugccuguuaagggcaggggagggcaucagaucccuuagaucugcaguuuuaagcucaguuuuacgcugccacauuguugcugggaaccaaaccugggucuucugcaagagcaugcagcacauguucuuauggcucagacaucucuucaucccugacuuugagacauuucuaauugccaagagagacugggaggcugcuggcauuugauggauagaagccaucaacguguuguuuaagaaaaaggccauguuuaagaccccaaacauuguuccaaaccaaaauucagauaguuuuggcccacccugauaccaucuaaagaucuuucugggacgaccaauaagcacauauguuuuuaugacacaaaggaaaaccagaucagaauagagcugauggguuuagagacgugucuguuguugggugauauaaucuaagacauuucccuucaacaucagauggauuucacggagacuaaugcuuuucuguuuuguuuuguuguuguuguuguuguuguuguuguuguuguuuuaagacaagguuucucuguagcccuggcuguccuggaacuugaucuguagaccagacuggccucaaacucagagauccaccugccucugccucacgauuacugggacaguuacaugcgcuaccaucaccccacuuuguuuugcuuuuguuuguuuuuuuauuuuguuuuuguuuuguuuuguuuucaagagaggguuucucuguauagcccuggcuguccuagaacucacuuuguagaccaggcuggccucgaacucagaacuccgccugccucugccucccgagugcugggacuaaaggugugugccaccacggcuggaugguuugcuuuuguauuuuacuuuuacuucacuuacuuuuuuuuuuuuccuuaaacaagguccaagguagcuggauuaaagguguaggccaccaccaugagacauggauguuaauucuagacaguguuacucaguugcaagucaccaccauaggagaacaucaaaacaaaggaggugcuggaggcugguacucuggcaagggucuggcgaggggcaugaugggcugucgguucucaucuuccacuuguugaggcaagaucuuucgugucucugcugcugcauugaguaccacagccaauucugucuccugccucacagugagacuccuggaauuuauagauccauacucucaaaucccaauuuuuaugugggcuucaggauuccucgaugccuuuaccuccugagccaucucccuaccccauuuuuuuuuuccagacaagauuacguguagccaggauuggucccauacauucuaugcaucagggggaugacucugaccaucugguccuucugccucuaccuccccugaggugaggugggaauacaggcgugcauuauuaccuucaguuuauggaucaaacccagugccucaaugcaugcuggaaaagcacucugcccacccgagcuauacccauaagccuugugaauaccuuccuaaaaacuccgccccuguccugcccacgcugcucuucugccaguuccacccccacacccacugugaaauccaaggaugauucaaaggcuuccuuaugucucugaaagucgucccgagccuccacuucucaaagaauuguauguaguucucaaagcagccucaagacuccugcacacgcugcuucgcuggucggcugcccagaagcacccugucaauguugacucuaggacaacaugcuugcuuuugcuccuggcaaagacuaaugguuugcuuaugaacauaagagcugccauuuaucaaauaucucccauguguaagacaguguucagugccugacgugguccgguuccugcuaacaaccuguaaaguuagucauaauagcuugccccacaggugauaaaacagacuccaaauuguuaagucauuugucuugggucacaaccucccuggguugaguaagaucuguaccuguggcuguacucuaagcccaggguccaccgcuuccccuaggcucccuccugucagacagugagugccauucccgaguuaaggaaauguuguucucuaagagcaugcgugcgugaguuguaugcacacggguauggaaagaaucccuuuuucuccccuccagugaugcauggcaggagacggggugcugggugauuguuccaagguugaaggacacuaaugaaagcaaggucaccauccaucacugugaacagaugcugggugugguagcacacaccuauagucggaguacuccagguuuaguagcaacaagaacgcugagaauucaaggcccgcuuggucuaaauaauaaauuccaggccaaccaagacuguguaacaagacccuaucucaaauaaagaaaggaagaugauaauuacuuaugacacuugauuguggggcagguaggaguuuugcuguuguuuguuuguuuguuuguuuguuuguuuguuuuuagacagaccucauauauauucuagacuggccucaaacuuguuaaguagcagagggugaccuugaacuucugauccuccuacuucuacccacaaaagcuaggauuucaggcaggccaccaccaccacccacguauuuggaguugaggguuacauauagggcuucguuuacgauagcugaguacuccaccuccuggaccuaugccuugcccugucccaugcuuuacccauuuguuuccacucccacaaguacauuucuuggggagugccauuggugauggcacugucuccuuggugccuuacuuuucucgugcuguguuaaaauaucugccuuaacagaggaaggcagaccagacuugggaaucuguucucugauaaucugccuugcuacacaggggggcuaaagaagacuugagccccaugacggguucuuuggagaagauggucacgugggaguguauccauuuccuccccacuuacuacuuuaccugagcuguuuaaugucuuggccccagccaugaugaugaauggcggucguggaguagcuauaaauguaugcugggccauauuagaaccauguggcaguggaggugacugacccuguagggucugugggcuuacagcuggugaccucccugagagcccaagagaguucaucucaccgcuucguguuuucugucccccaugcaguaccuacagaugaaauggccccuccucgauguccccuccagugcuacagucaaggacacaaggucgccaucuccagcacacuuggugagucugccuuagcuuccugggcccugucugugacuccuuuccccauuccagaagcuuccugagucugucuccuuggugucucgcuuuucucacggcugugcuaaaauaucugccuuaacggaggaaggguugguuuuggcucacgguuuggugggaccggcuaucugguggggaagucccgguggcaggagugugaggcggcugguaaagccacugucaggaagcagagagugacggaugcuggugcucagcucauuuuuuccuuuuuguucaguauggggauccugcccguuggauggugccucccacauucagggugagucucccccuccucaguuaaaucuuuauggcaacacucuuacagacagacacaccuggaggguguuuccauggugauuguaaauucaggcagauugacaaugaagauuaacccucacacccggugugggcacaguuagggguuaccaaagguucugucuuagacagccuccucaccuuuccguccaccucagcacaaaagcacacaccaccuggaaggcuugauugaaggcacauggcccugaccauuaaccccgguucuuccuggccaccugcuucaaauccuuccccacuuccuaugaacaagagguccuuucuguccaguugguucauucagaaacccuccucuucucccuggagcuggaagacugcaguuaagggggcuccucucuaccagcuguuucagggaagcauccauuuaaauguggccaacggcugcuccgcacgcacagcuguggcaacacugggucuuggaggaaaggggagccaggagcaguggagucccagcagggcuccuugccuucucaugacccagcacuggcacacaaugcauauaaaagaugaggcuggaaucuaacccucgcauuccgucuuccaggaaguaaagccaggcuccgcggaugccugccaggcuaucuggugacgacuaucuugcuagcgagucucagaggcacagaggaucucuucaccugucucaaccuguccauuuuauagacaggggaugagggcuuccucaccgccuuaggguuccauggcgaucuuugaaacuacuagagacaaauuuaaaaaucuauggagggagaauacauuauacaaaacaaacuccccugcugccugccgccacucaugguccucuccugccucucuuacuuuacagccaaucccaggcauguuguuuucucacacaggacauuuuaagauauacugauaauccuugcucauuaaagggcagcugugagggaggagauacacucagaguauaaauagaggugcgacgaacuuucgucguuuccagcaaucacaggaccagcucugagugagagagcccuagucuuauucgucgucuacaacaugaugucauguacggcucucgggugacugccacagcccucugccaggagguagacaggaauaaccaugugggggcagagccagccacccaggguaggcugucccaagacaugcaauguacugcugguagggucuguaucuugucaccacacuauugaauccuugugucaaggcagugguucuaaucuccgagguccuauuugcauguaagcaugagguacaggcgcccucuaguggcuugaaucagacccagggaaggaugguuagcccugauucagcuaucuucuucacugccuaccaucucugcugacccccacccauucugugguaccccagagccucccacaguaaaccccaagaugucagagcucacugcccccucuccuguccagaggcuaucuuuucauggguuccuuuuagaggacaccauuucccucucaaaucuaaagucucacccucccugugagcaucacccuacacauccacuaacgcccagucacaucuccuucccuaccaacccagggcagccuagcccagcucuaacugccacacucacucaucuccucgauuucuaggcaccaucuagggggcagcugacaguguugggcacuccuaccuccuucgcuccaggacacuguuggcucuuggccuuuuuccucacguaaaccggcuguucagggcuuucucgggguaacagaaaaguauaugaaaucccuaaccucucaagaagccucuggcagucgcagcugccgaucaucuagacauugccgaugaguggaugagacagaagaaugcagaugagugaucuggauaccagaucccagcacagcgggaaaacagaggccucauguuguccgaguacagaaaagcaagaaccgauggcacacguugcuuuauagauagugaagcaggugauguuccaguggacuccacaucaucauacucuguucuaauacugcagaacauaaacaggccgggaggugacucugcagaugaaggugcuugcuuccaugccugugacuugaguauaaucccuagggccuacuugauagagagcacugaccccugcaagucacccuccaaccuccacaaccagacugugguacacacacacacacacacacacacacacacgcacgcacacagaauauuucauauauauauguauguauguauauauaaauauauauauauauauauaaauauauauauauauauauauauauacacacacacacacacacacacacacacauauauauauaauuuuuuaaaaccugaauggguagggcauaaacaggcaggucucuguaaauuuuaggccagccuggucuacauaacaaguuccaggcaagccagggcuacauaaggagaaccuguauuuuuuaaaaaauuaaguuaagggcuugagagauggcucagcaauuaagagcacagacggcucuuccaaagguccugaguucaauucccagcaacuacaugguggcucacaaccaucuguaauagaaucugaugcccucuucuggugugucuaaaaacagcuacaguauacucacauaaauauaauaaauaaaucuuuaaaaauauuaaauuaaauagaaagcaaacauuaaauccccaauguuuaaaaagaauuucgcugggcagugguggcacacaccuuuaaucccagcacuugggaggcagaggcaggcggauuucugaguucgaggccagccuggucuacagagugaguuccaggacagccagggcuacacagagaaacccugucuugaaaauccaaauaaaauaaaauaaaauaaagaauuucaauaacgcccaaggggaaauaauaccaaccuagaguacagcagcuuauccaaacucccaagaacagagaggagggcgcugccuugagaugugcuggucaugguugccguggaaaccugcagguucugaucccggcuuugcuucccucucuucucaaagcuuugggcaaauuacgucaucucucugccucaguuuccucaucuauuaaauggggauuagaggagcacugacaucauagaguugugcagaaaugagcuggugugcuguaaugaguucagcauugugcccaacacaaaguaacucuucacuaaggguuagcuuuccaaacgucaccacacuucacccucaucgccaccacugcugcugcggucgucauuguuaagaaauuaagagagggaaugaacaauuaacaucaaguuuaauuagcagaacuaagagguaaugagggcccgaauuaggugccaaaacaaguggacagauugcgaagguaauagagauaaugagcccauagaauuuaacaucuuaaucccccaaggauaugauuuaauugggcugggguggggcugguaucuuaauuuuuuuuaagcuccccacggcgacuuuaaggggcagccagaguugagaaucauucccguaauugcaaaucaaagacaugaagcuggggagagaggugcucccuaccucccuaaucacggaaccugacuccuuguccaagccagagggcgugagcuggaccugaaguuucuuaggacaagaucacagaagcaggggcguugguuuuucuuuucucuucuuuucuuuucuuuucuuuucuuuucuuuucuuuucuuuucuuuucuuuucuuuccuuuccuuuccuuuccuuuccuuuccuuuccuuuccuuuccuuuccuuuccuuuucucuccucuccucuccucuccucuccuuuucuuuucuuuccuuuucuuuucuuuucucuccccuccucuccucuccuuuccuuuccuuuucuuuuuuuauuagagaaauaaaaacacuagauuaugaaaacuuagcuuagaucagaaguaaacuauuugaagaagcuuugcccagggaguagggccaaugaagaaaauaggguucguacuugcagagauuuggugagucauguggcuggagucuucagugagucgcaacccagugucaugggggcagggcuggcgguuaguauucuuuccauuuacaccucuaaaguaagcugggggugaaagauagaaaaaaaaaucgccuguuacuauuugguuuuccuguucugcuuuguuagaaagacuuuauuuuaugugcaugagugcuugccugacugacugcaccauguucaugucugaugcccaaggaaaccagaagagggcaucgagccccuggaacagugguucgcaaccccuuggggucgaacaaccuuuauauaggggucaccuaagaccaucagaaaauggauauuuacauuauaauucacaacaguagcaaaauaauagcuauaaaguagcaaugaaaauaauuuuaugguugggggucagcacagcauaaagaacuguauuaaagggucacgguguuaggaagguugaggaccacggguguacaacuugaguuacagaugguugugagucgcccucuggauacugggaacugaacccagguuuccugcaaaagcagccugugcucuuaacccucucucuaguccccugugcagcuaacugugguguuugagcaccgaacucucagugcuuagggacaauuacacugaccccccacacugaccaugcccuacccuaucuuucaccagucucuuccugcagcgcggagaaggauggggggcaguguauugucguuguucacaaguauuucaucuuccauaugcacaaggagaauuuguuaagugagcaggaguggggaauggucucugagaaagauggauagcccuuauauacaucuccuuacucgagagccauuucccucuucucauucagaaaugauaacugugaugcaugagucaggugugugggcauaugccuguaauccuaguacuuggaaggcggaggcugagacuuagaaguucaggccaaccugggcuacauagcaaguauucaaaaacagaaagaagcaacuacaaaaaauaaaaguauuauguucauuucacuaugucacuugagaaagugccaaagagcauaagggacgauagcuggcauguauguguugcuacauaauguaccacuggugugugugugugugugugugucugucugucugucugucugucugucugucugucugucugucuuuacaggcacucaccaccauaguugguuuaggggcucugaggauugaacucagggcccugugcauauucaguuaguaaaggugcuggccaccaagccugacugacgacccacauggcggagggaacagaacagacuccuacaagcuggccucuggcuuccacacacauacacacacucacaaaaaagucaauaaauaaaacuguaauaacauuuuuaaaagagcaagacuuggcuggagcauggcgggggagggggggagguucaugaguuaaaaaaacaaaaaaacaaaaacccaagccugcagcccgcagccacuuacacuaauauuguaauagcgaaugcccuauuuuguuauuauccacuggcucacucucagaagcauauugaagagcuucuggccaaagcauggguggcugaaucagagccuggaugcucuccuucuaaggacgaccgucucgcugcccccgccccaagcagagaagccucagguugcuuagcacgugaacgcucuccgaaucacuggcugggguuucccuuaguauuguacauugcaggggcauauggugguccacgucuguaauccuagcacuuagagcguagggggaggauggccaagaagaguuuaaggucauucuuaucuacauagugaguccaaggacagccugggcuauguaaggcccucucuggcugccugucucucugcaaucuaucuaucuauagaggaaauuuauacauggccauaugaaguccuauuuauaaauaaauuaaaagugaauaaaugaaauuuguguuauuucuccaucucaucaggacaccuguguagacucugaagucucugcaauucauaagucugugguuccucccauuuguucucccacacugacuauacuuuuuacuuaauguuaauuuuuauuugaauauaguuucaaacuuucuuaccugaaacucccacauacuuuuuauccagaucuacaaaucuagccagcuccugugguuuucccucucucccuccuuauguucuucuucuuuuuuccauuccugauaguuggaaaugugaccugaacacuguagguuucuuaggaacagaaauguuugccuagguaaccaaaauagagauaucaaggaaggaaggaaggaaggaaggaaggaaggaaggaaggaaggaaggagggagggagggagggagggagggagggaaggagaaagagagagagagagagaguagggccuggggagauaguugauucaguagguaagaguguguauaguguuaacuggaggaccugaguucaaauccccagcccccacauuaaaaagacagaaggaugugcccacgcucauguuccuguaaccccagguuacagccuagcucaggcuucagugagaauaagugggaguaagguggaaugugauggauggguuaggacacccugcguccuccucuguccucaaugcaugcauggccaugugcuuauaacacacaagcaaaaggaaagaaagauuagcguuucacacagcucucuagcccacgguaauaacggcugugcugguugugucuuccgucugcaccacuccucuaggcuuuauuggugugacuucagcuuccgucagcccagggccucagcccagcuugccuuucccugacucucacauaaagccagccauuuccuucuugggcuuuucuguuguucuuguuuuguugaguaaaugaccucacagagcucgggcuggccucagacuugguucguucucuuggacugccaugaacuucugacccuccuuccucgagugcugggauuacacgccugggccaccaggcucagcuuagucagugggcaggagggagcccaggacgucacacgagcuagcccagcuuuagguguccucauccuaucaggagcagacccacugugucaacacgcccauguuagagauguuggcuuugggauuagcugaugccagguguuuccauuguauguuagugcugcuguuugccccuggguccuuagugagugcuuucuggggagaggauuggaaggcgugcagaugcuuucucaacgaguauuuacccacuggguugagaaggcagucaagacgagagggcaaggccugcaucacuccuucgacuggugguucucaaccuuaccuuacuaaugcugcaaccaccaaccguaaaauuauuuucauugcugcuucauaacuguaauuuugcuacaguuaugaaucauuacgcaaacaccugugguuuccgauggcccuuggcuaccgagugaaaagcuauuuuugacucccagaggggucacuacccacagguugagaagccucguucuguuucuuucugugauuguccuuuaguuucucugaaauucguacaccucccacucuccggccuccacagagauagaaucgacaaugcagcaaagcaaauuugugccauugauaacacaguuacacaaacugguggugagggccuuuaccucacuugucacuaagucugguggccugauucuguccucaggacccauauggugaaaggacggaauuuacuuaugcaaauugucuucugacccccacauccaugccaugguguaccaugcuggugugguuuuguugucguugauugguuuugagauaggaucucgcucuguagcccugagaucuaucaugccagcuaaaguggacuugaagcgaagauguugagcucgguaaucaagaaacaacucucgguucuguugaccuuggugaaauucuaacaacaauuuggauugcagggguuuuaaauguucucccaggacugggucacugagggaggccugucaccagggaggagugcuaagaguuugaagccagucuggacacacaggaaggaauaguaguaccaacugcaaaaagauaaaguaccccucgguuccccgugguaucccuacuaacgagaacgggaggugagaccucugaucaggaaggaguuagcuaaagaauuauagucaaggcccaaccugcaaagcuuucaagacagaccauugcacacaaggaccauugcacacaaggaccauugcacacaaggacccacgggcacauuccaaucccagagcauccucucucccuggccugcagguccuugccuuuaucuuuacaucuuuacuggccugcagcaugguccuugcugucuuaaggguuggaacguuucauuuuggauucuggccuugugcugugacuuaaagacauggucucauucuauaacuuagauuggucucaacuucguuucuuuuucguuguugguuuuuugcuugguuugguuuuguuguuguuguuuugguuugguuguuuguuuguuuguuuguuuguuuguuuuugagacaggguuucucuguauagcccuggcugcuguccugaaacccacucuguagaccaggcuggcccuaaacucagaaauccgccugccucugccucccaaaugcugggauuaaaggcaugugccaccacugcccagccuuuuuuuuuuuuuuuuuugaguuuuuucaagacaagguuuuucuguauagcucuggcuguccuggaacucacuuuguagaccaggcuggcccgaacucagaaaucugccugccucugccuccaaaaugcugggauuaaaggcaugcgccaccacugcccagacauuucuuuuuaauuuuuuaaaauuacuuuuaccucugugugugugugugugugugugugugugugugugugugugugugugacucauggaagucaguucuuuccaucauguguguccuaggagucagaaucaggccaucagacucagaagccuugccugcugagcuagcucacugcccuaacuucagcuucucaauccuucgggaagcgggugugugccaucaaaccaagcuuaguuggaguguuugugcccgaggcaccagagcugaaacccaggccguucccaguguucugcuccugugcgaggccucacugccuccuuaucuugcucaguacauggccucuguuagugcccuagguguaccgccuagcaucuacacuaguguuccugugccaggaucgccccuccucucacugcgugccuaacuugcucugccuucagucacuauguaaauccucuuauuuuguaagacaggguuucucuguguagcccuggcuguccugagacucacucuguagaccaggcuggccucgaacucagagauccaccugccucugccucugccucccaaaugcugggauuaaaggugugugccaucacgccuggccugguuauugggggccaaggagcagcacacaccuggugguguguugguggaggauaccuuuuagcagucauuuuguucuuccaccuugugaauuccugugauuaaacucauguugucaugcuuggugacuuaaaccuuaccagcugagccaucucgcaagucccucuuguccaaauuuuaauuaacuucuucuuugccuggcucuuguugcauauaaaucuuucacccuuacuaucugugccagcuggcuccuuccagaauauuuuucugcuaaauuuaagauagacuugggcguaauuagaaauaggggaccagaaaucggugaagaauccagaaguuggcaucuggggaaaguaagagacagcagagcagaguagcuucugacauuguaugucaaguucucaugaagaggccacucaaggaagggaccagggcuggagacaagggcuagcauagcagucaaaagcacucgcugcucuugcacaggaucacagcgccugcuggcuuacaaccacccuaaccccaguuccaggaaauccaaugcccucuucugaccucuguggguaucaaacuuaaguaggcuuacacauaguacauauucauacgcacaggcaaacccugauacacauaaagucaauaaauauaaaaaaaauuauaaaagaaaaauaaagccaggcacaguggcuuuaucccagccuuuaguuccaggacuagggagguagagacagguagauaccggagaggagaggacagaacaggacaggacaggagagggagaagggagaaggggagggagggaggggggaggcaaauaugcauaauuaaaaaggagaccaucaucuaaggaauugacuuaaggaagaguucuuuagcuguuugugauaggguggaugcaaagaacguugcucucugccauaaaacuuuaagccagaaaauuaccaagauaaaacaaaaaccaaacaaaagcagaucugggcuggugguggucaguagggccugcucacucucaugaauacauuuacucuuaaaaucuuugcauugagcacaguaaaauugcucugugguuaaaggugcuuaccuguaagccugaagaucugagagucuagcccugaaucccacaugauagaaggagagaacccauucucacagauugucgccugaucuccacaagcacaccgugacaucaucagcaugcacgaacacacacacacacacacauuuaaauguuuuaaaauuaggaaugucuagcccauugagaugcugcacaacucuaaucccagcauuugagaggcagaggcaagagggcuuaugacuuugaagccagccuggucuacaaaguaaguucccauacagccgggucugcacagaguaacccugucucgaaaacccaaguaaacaagcaaacaaaccggaaaugaguucuugccauguggaaugugagaucugcugcaagagaauuggaccuugggacuauauucugguugacacauugcuuauuuguugguccuuccucuuguaacacaucucaguuagcggagcccagcuaagucgccguucagaccuuaggaacacacuuaggaaauacacgaggagcuuggggauauuccugcaaccaaccugagguuaagagucaggagauguggcaaagcugauacuuucuucuauuuaccugggucgggugacagaagaauggagggaccccuggcuuagcugcuccggggcagguggcagagucggaggguggcagggugcugcuguggagucucaguccuccgggauccccuaccagccccacaguugaccagcucuggcagacaccacccacagugugucugaaggaacgaccucuacuggaccugcucccuccccauggacuuugggauguuucaaagaaacugaugucacugcaaacauuuucaguguccauucuccccgggagcccugcccuucucuaucagcuaaggggucauggaugauugacaaaacucauauucugaauagcguuguuaguugucuacugaaauguugggugauuuccugggcagccauugucaaguccaggacuccaucgugauugacagcagaagggaagggucuacucuccugagcgaucaaucccaugcagcugguuucugaucagguuaagggagagauggcucugcaguuaagaggcuggcugcucuucugaguugaauucacagcagccacaagguggcucacaaccaugcauaauggaaucugauucccucuucuggugugcaugaacaccugagcaauccuauacaugaaauaagcaaauaaauaaaucuauaaaagaagaaggacaacaagagggagggggacuccucugguggacaguuuuccauggcgagcccuuagggguugguuuuacuuugggcuuaaaauaugcccuggggaccccuuugcuuucuuaagagcugugaguuugaagagcuucaaaagggaaaagacugaagcaggcugugguggucaucgagcagacuaaguuacacagccugccucagcaaggugaagcugcgggccaaaggagauggcucagcagauaaaguguggggaccagaaggaacugggaugcucagaacacauaaaacccaggcagcuguggcagccucgcauggauuuagcagauuauaaagacagggcaaggaguugagccaagaucaacaagcucuggguucagcaagagaccucaguaagucaaaaggagaucaaggagacccuccucaggucuccaucuguguacacacauacacacaaaacuuuaaaauggaucagggagaggaguugucaagauaccugggcugagaaggugcucgaccuauguagcuugcuggaaggauuuggcuguuucggauggggcauugcuggaaggacuuggcucuguuucggauggcauuccuugcugagcaagcccguguggcuccuacgucuuguacugagguuguccacuugaggcucugcauuccugacgguagccucagccuuugccgugcucaucaagcuccuggggacagcuggagagagaagugggugaggacagagugggagguagccuccuaagaggacaggccagccucuaggacaacucuugcucagcaacacuuccuguccagccccucgcggaccauuuucuggacaaugaugcccccuagugguacaaaauuauaacccgcaggucauuuagauuuauaccuagauuugcaaauugaacucccuuuauguguucuuugacugaaggguaagcaggcaacugaaacuuuuuaguuuauuuauggaaggggguugguccaggcuggcuuuuaacuuacuauguaacaaagagugaccuuugaccucugaucuuuuuacuuccugagugcaagugucugcguuaccgguuuaugcuaccacacccaguuuacacagagcuggagaucaaacguggggcuucaaggaugcuaaacaacugugcuacauauuccagccuaagaguucucacuauaaaaugacaaaaaugauacaaauaaauauaaauuaaaaacugaagcgugaaggcuggaguggaugaucauggguucgaaacuagccuggacuauauaaugcgauguugucaaagauaaauaaaugacauggggcguuguuggcaggggcuggcuuagcugugugauuauguagcaaucaguuuuagaaucauuguuuaugaauuguaucaugguuugugcaauucucucuauuuuuauucauuauauuucuuuguguguaugugggugggcauccuuuagccaugguguucuuguggaggucagaggaucuacccugagggaucuagaaagagauggcagguuaucaggcauccaccuugacccacugaacauucucuguaauucaauagcccuauuacguuuauagugccgaaaauuacccuuugacaggcuggccccuauaaacccagguucaucauuuggauacacucacuugguuccuagaaaucugaugucagagcuaguuauugcacauguucuuucuugugcuguauauucaucauugugauggccaggaaauacagugaaagcagccagguguaggugacacacgccuucagucccagcacuugggagacagaggcaggcgaaucuccgaguuugagaaccuacagagugaguuccaggacagcaaggacuacacagagaaacccugucucuagaaaacuaaaaaaaaaaaaaaaaaauucuccaaaaaagugaaugggcugguggguaagaucacugacugcucuuccaaagguccugaguucaaaucccagcaaccacaugguggcucacaaccacccguaaugagaucugacgcccucuucuguugcgucugaagucagcuacaguguacuuugggcccaagcaagcagggacugagcgagcagggccaacccgagcgaacgggguugaccagagugagcagagguccugaaaauucaauucccagcaaccaaaugaaggcucacaaccaucuguacagcuacaguguacucacauacauaaaauaaauaaaucuuugaaaaugugaaggcaguauuuaaguuucaccuuaugcugcuacagcuaacaaguacagaggacuaacuaggaagcuacucgguuugaggccuuuuugcaccaccaaggccagcagcacaccucaugaucaggaugggcuuuccugcucucaucccugcucugcccacuuuaccugcuauaagacuuggaaacccaggaagccccaggaacugagcagaccagaguuugugguaugcauaucggaugaaaagaggggcagcaggaagugacagagaggucaaagggcuucucgucaguaaagucagaacgugguuacauaaacccgagagcuccugucagaacggcacagcccacaagcgccccgcuguacccauaaaggggggcugugugggaguuagagaccggggugggaguucgaggcccucucucauccucuucucguuuccuucccucuaggccaguugugagggcuggaaaggguguuacacugaaaggagccaccggugaguggcagcuggcuggacacaccgucuuccugccacugugccuaguccaucuccucucucucuugcaguccaacaaaguuccuguuguucagcacccucaucacaugcacccgcugacaccucucaucaccuacagcaacgaccacuucuccccugcguccccucccacgcaucuguccccagagaucgacccaaagacaggugaguggccccugugacaagcugggcucccaaagagcggugguggggcucuauggggucggggguuaaguauagagccuggaaccauuguaaaugcaaggguuguuuagucaucugagguugggccucuauaaccagaacgugugcccacuacaccacauauuuccaauagagccuucuggacagacgucaaaauggcuuuuaaaacaaugggggcggagcuggcuuuaauguguggaaggugauaauuaacugcccaccacaccuguccguaccuggaagccuaggucuucauaacguuccuacugagucacuguaacacuaagaauuuucagagcccauguuuaaagaaauaaugauuauuuggggguagggcgagaugaccgucgaauaaaaacccagaguuuagaggcagggugguuuguuggcagagaaagguuauuguacugagaaugaggcugguugucuagaaagcucaauaagugaggacuuggaguaauauuugcucucuguuggguauuuccugggccuuguaugaaucccugugcagucaacaaaagaaaguuacauccgcagagauggcuucuggguaacuagagagacuguaucuggguccucucucccuuggaugcccuugaguugacugcccagggcuacuagaaggugaaaggggcagagaugcugagagacaagggcuuuccacggcagcuccuaugggauguuacgcagguuacgaaggcugggugagggaagcauuugacguaucucucuuuggaagcaggaaucccccggcccccucauccaucugagcugucaccguauuacccacugucuccaggagcugucggacaaaucccccauccccucggcuggcucgucccacaguaaggaaaccccaaagccuuucuuacccuccuuccucccuccacugagcucugcccuucuggacucgggauuuagacauccucacucccgccuuggacagcuugcucccaacuccucugucuucccgcccguuucuuagcauccucuccagcccccuccgacuuggcugaccagaucaucuuccucccuccuccccccucacaggcaagggcagcccauguacucucucccuccgggugguuuccggcauccuuacccugcccucgccaugaacgcuucaauguccaggugaguccucaggccggggcugccaacaugaugucacaguccagggauauuagugacugccacuucuggccauaagcuaaccagucaccuauagguuaggcaggauggugggguuccuugauccuuuuuuguuuguuuugggggggguuguuguuguuguuuguuuguuuguuuugguuuuucgagacaggguuucucuguauagcccuggcuguccuggaacucacucuguagaccaggcuggccucgaacucagaaauccaucugccucugcuuccugugcugggauuaaaggcgugcgucaccacugcacgguuuccuugauccuuacuucucuuugaugaggggcuagcucuuacucauacuccuuacaccacaaccccauggaaugggcaccccaggaccuacuaugcacacacacacacacacacacgcucgcgcgcagcuaaacccuccuuccacaucccuacuuaccagacucuauggaacagagucauuuuaaacaugacacacugaagccagagacuaggaggaaauguguaucuuccaugguaaugccaggaaaggaaacaguguauagggauuucucacagggguggcucuaccugacagugggagcaccaguggcaggcggccuauaguccugcaguccuucuaaguuuuucauucugccugcauccagcaccaaggcuguguguguuuaggggaagggacagugucauugggcggcccccaaaacugaccgccuaauucugcaggugaccacccucucggugggcggcacacagcccuugccucuccguucucacuugugucuccuuguuacacagccuggucucaagccgguucccacacaugguggcuccugcccauccuggucugcccaccucaggaaucccccacccugccaucgucucccccauugugaagcaggagccagcagcccccagccugagcccugcagugagugcguaagugagaucccucuggggggaggggugugauccacucucugcucagccugugcccuguggucuucucuccugcuggcagcuggcaguccaagcccuggcuucucccgugcacgcuguucucuuugauuugccauggcccuuccuuuaagaccuaaugcuucuguccucagacagguucuuguggcugugaggagcuaagaaagcuuuuggcuucccucccuacccugucguccccaauaaaauguaaggccaggaugggagaaaggaauucucucaaggacuggugacagcuggugccagagagacccuggcauuaucccugugcuggaaagauagcagaaacacccacaccaccagaccuauggcugagggaggccacgcucugccucccuucuccucucuuguccucccuuccccuuccucccuccauccccucccaccgcccccccccccaccucugcccagaucaugaaagcagucacacauggccaccaaacaagccucuccucccagugaaggcaggcaggagggaagucugaagauggugauaccuaaccuucagcccugugccuccccaggaaauccccaguuacggugaagaaggaagaggagaagaaaccucacgugaaaaagccccugaaugccuucauguuguauaugaaggagaugagggccaaggugguggccgaguguacccugaaggaaagugcagccauuaaccaaauccugggaagaaagguaaugccugcugcuguuaacucguccuggcagaggggccucagggucuccgccuacccugauggcucugugugucuucacccucucucccucaguggcacaaccugucaagagaagaacaggccaaauacuaugagcuugcccggaaagaacggcagcuucacgcgcagcucuacccaaccuggucagcccgggacaacuauguaaguguucaugcugugcgugcgugcgugcgugcaggaacucagaccuugggagcagcaucuucaggaugcagaggcgagagagcaagcuacuucggcuugauucuagaggagaagccauguuuccuggaaauaaggaagccaaguuggaaguuuuaggggcugugucuagaauuucugugagacuuguuggauuguucuauguaugcuuuuauucucucuuccuuuucuuuccuuuuuucuuuuucucuccuuuuuuuaaucuggugagggggcucauaguagcugcaucaaauuuucagagaggccugggacugcucagaaaaggucaguaagcaggccagggugauagcucaguaggugaacugccugccugccaacaggucaaguguuaaucuuuaacaccuacaugcaaaacugggccauggugcuguguaccuagacucagcccugaacagaacaaaucuugggguucacuagccagccagccagccuagccuguuuggcaaguuccaggccagugaagagaccuugucuccaaaaaagguggacagugccugaggaaugacauccagggcaauccucugguccccgugugcauugcauguacucgaaugcuuguacacacacacacacacacacacacacacacacacacacauucaugagcacacacacacaugugugaggaggagggacagaagcuuuuaaaaccacucuuguagggaguaaagggugcaagagacagacuagcucgaagguccucgggaccaagaggcuugguugcccccaccagagggacuuuaugagaaaugagggcagggucgcuuuuccucgucucccaggccaguucuccagcaccuuacccaggaacgaucaggagaagggcugccaucucuguucuaggguagucuggggucuucuugccgggcuaguauuauucuguccuuacucaucaguccuguggccauguuuuucaggggaagaagaagaagaggaagagagaaaagcagcugucacagacacagucucagcagcaaauccaagaggcagagggugaguccuggguugguuggugccccucgcuuccccucccacugucccggacacucuugcuuauguuaccugagucucugaagacucuguguuccugagcaacuucagcaggacggcagcacuuccuuucagagaagaccaaguaagagaccgagaacacagccgcucaauccuggguuuggccccagcacccucccucacauaaagcuuuggaagguuugcaggguuuccuagucccucucuuuaagauagcaaguguuuuaaaggggguucgggaacaaucuucaaagcucagacuugucucagugcagcugaauugucccuuuagagucacgccuaaagucgauaccuaagguaaaaacaggagcuagcuggaauuaucucugaaguucccuuccaaaggcggcaugcuagagauagacauaucacccggauuaguuacuuucucguugccuugacaaaacaccugacaaaaggugacuuaagggagcauuuguuuugucucgaagcuuggaggacaccguccauuauggugggaaggcaugacagcugaucgcgguguguucuuggccagcagacagagagaugaauguugguccuuaccugcuuucuccuuuccauuuagccuagggccuccgucuauauucaggcuggauccuccuugcucuguuaaaacuuuaugaaagcauuuuacagauacacucagaggcguguuuacauggugaugguaagauagauuggccaucacgccacuuaucaauuagugcgcuggaauaagguuuucuuugguuguacaucaggagaauacuauaguccauaaacugaguagauucagcucagcuguuaauggguuuaaggaagagaugaggaagugauaggcuuugaacuuugcucucuguucagauucugagugggucuuugucaguuugggcauuuggucuuuggauugugccuucucugggcacugaguguuguucugaaguauaguuuccuaauccccaaaucuuugaaaauccuggagauauagcucaguggguggaaugauugccuaagcaugcgugaagcccugagccugauacccacccagcaccaaguaaaacagggauggcacugugugaggccugacugggauacucaaggacuggcgauaacacagugaggacuggcgauaacgcaguggguugagucugugcaagcauaaggacuuucagucagaugcccagcacccacaggaaagccacaguggcaaccuguccaucauuagucuacuaaaaacaacagacuuuauauccagggagagagugugucuccaaacccaagagggagagucuggaaaguuggcucagcaguuagaagcacuugcgcacacccuuuuguaacuccaauuacaggguuucuaaugcccucuucuuaccaccacagguaccaggcauguaccuuaauacacagauauacgcauaggcaaaauacauauacacacaaacguuucuuaaguaagggguaaaacaaucgaagacacucagucugaaccucugcccuacacacacacacacacacacacacacacacacacacacacacacacucacacacacacacacacacacucacacacacacacacacacacucacacucacacauacacacacacacacacucacacacacaaacacacacacacaaacacacacacacacacacacacccuaccaccacuauuuauuuguuuguuuguuaauuuauuuauuuaaaaucuuacauuuccaacgugcagucagucacaccugguuguccuuuggauggguuucaaggcguccccauacccuacuucucaaauaccugauccccaggugcucaggccucuugagugaguggccuuauauuugcauaaaguuuaugcauaucuuccaucacuguauaccagcucuagaugccguauaacccaccucacaaugaauguuguggaaauagcgguuagguucuguuugcuggcaagauggcucagccgguaagagcauggccugcucuuccgaagguccugaguucaaaucccagcaaccacauggugugugacucacagccaucuguaaugggaucagaugcccucuucaggugugucagaagacagcuaauccuauuuccuuguguuuguaccuuuaggugcucuggccucuaagagcaagaagccaugcauucaguaccugcccccugagaagccuugugauagcccugcgucuucccauggcagcacgcuggacuccccugcgacgcccuccgcagccuuggccucaccagcugccccugcggcuacccacuccgagcaagcgcagccccugucgcucaccaccaaaccggaggcccgggcccagcuggcucuccacuccgcugccuuccugucggcuaaggcggccgccagcaacuccagccagaugggcagccagcccccacuccuauccaggcccuugcccuugggcucuaugcccgccgcucugcugaccucucccccuacuuucccagcuacgcuccaugcccaccaggcccuccccgugcuacaggcccagccucuuuccuuggucaccaagucugcccacuaagcugcccccgguucuaugcaggcugucucgggacuccaaguaguaaugauucagaggagaggaagggggaaacacaaaggaagcauuauuggucaauauuugaccacucuggacuguucuguaaagugacugguaacagcagugccuuaccacuguagauauaaccaguagcugaucuucaggcuuuuuuaaaaaaaaaaaaaaaaaaaaaaaggagaaaacauaaacaaaacaaagccugccccucuccccuccccaaaaaaaaccauccuucacaagaaagcacugaaaagcaguguguugcucccuccccuugcgcugugguggguauaccugggcgggagauaucucucuaccucuucucuuccugacucucugcccuccuuuccgucgucgcugccagccccacuugcccuagcucccccaccguaucagcaacaugaccaggccuggaguucuagccugacacccuucucuccaggucaguccuguugcccucgcccaaauguuuguccuguguucagcgccaguucaacccccucuguccucugcccaguguaagguuguggccacgugugaccauaguuucccaccaucauccccucucccucuucgggccccaauggccuggacuccagcuuggggugggguccuucugaaauggucccccccccugcauuuaaagggacucaaggugccuaccacugccuucaagaagucuguuccucucugcugcccagucacguuuucuuucccgccucgcaguaucagaguggcaggcaggccccaguccccgaugucuggcuccugucaccuccaucugugcuaguacaauccgcagaagcuccaagacccucugccccuucccccaccaccaccucacaagcuuuuucuguguguauuucauuuuguuuuuaugguuuuuggaacaauuuaaacucccaguuuauuuucacaagagaaaauaaaauuacaguugca

SEQ ID NO: 12365 - RNA, 2537 nt, Mus musculus
agcccuccgggccaggaagcgcggaaggaaucgccugggccauggacggggcugugauggaggguccgcuuuuucugcagagucagcgcuucgggaccaagguaguuuguuuguggcgugggggauggcgaaaccccucuggacuagaagugggugaaagaauccagaaagagggaaggggccggaagaaggucggaacggcgcgcgggcaauuguagauccccaagacguucccuuaaaagucucgggcugugcccuccuuggugcggucuugggaugccauuaucuuugggaaaguagcucagccugggaagccccagacucagaucggccuucaugggucucuucuuccuuguggggcgcgugcuaccaccgcgcacucucgagucuuucguucuuucccagagguggaggaaaacuugggcugugcuuuacccagccaguccucacggcguggcgcggcuggaauucuuugaucacaaggggucgagcucuagagggggucgaggcggcucucgccgucuagacugcaagaugauacgccuggcugaaugugugagcguggugccggugacuguggagagucccccugagcccggcgcuguugccuuccgccuggacaccgcacagcgcucgcaccugcuggcggcggacgccguauccagcaccgccugggugcagacuuuaugcagaaccgccuuuccggugagugacugggggugggcaucucugggcuuaagggacacugcgaggauggagcuauuauagaggcacuggacuucuugcaccuacccuagacccaagagaauuauauauaauucuuccauguucccuuuucugcagaaaggcggcugggcuuuggcgcagacggagaaccaaccuaaguuuucugccuuggagaugcuggagaauucgcuguacagccccaccugggaagguagaugucuggcaggaauggaguggguugaagaggugcccuuggggagcuagugauuggagucaaccgagucccuaacuugccccagcgcuccuucuccuucguauguguucuuccaggaucccaguucuggguaaccucgcagaagaccgaggcuucugaacgcugcggcuugcaaggcuccuacauacugaggguggaagcugagaagcugacucuccugacuuugggugcgcagagucaaauccuggagccgcuccuuuucuggcccuacacucuguugcgucgcuauggccgggacaaggugcauggggcugucugggaggaugacccgucagggagggcuaccagguugaguagcuguaggugacaauuccauucucagguggucucuucugugcagauacaguaacuuggucaggccugugacucauuuuuuaugacacgccuaacguguuucccccacccccucagguaauguucuccuuugaagcuggucgccgcugccccucaggcccugggaccuucaccuuccagacuucucagggaaaugacaucuuucaggcaguugaggcugccauccagcagcagaaagcccaaggaaaggugggccaggcacaggauauccucagaacugacucccaugauggggagacagaggggaagacaguucccccuccuguuccccaggacccccugggcagcccuccagcccuauaugcggagccuuuagacuccuugcgaauuccuccaggcccuucucaggacucuguauauucagacccccugggcagcaccccugcuggggcaggggaaggggugcauuccaagaaaccucucuauugggauuuguaugggcaugugcagcagcaguuacugaaaaccaagcugacagacuccaaagaggaccccaucuaugaugaaccugaaggccuggcccccgccccuccccggggccuuuaugaucugccucaggagccucgggaugcaugguggugccaggcucggcugaaggaagagggcuaugagcucccuuacaacccugccaccgaugacuaugcugugccaccuccccggagcccaaagccugcuccugcccccaagccacagggcuugauccuucccgaaucggguaccacucguggcaguggcagcaaaggcuucagcucagauacagcucuguacagccagguccagaaaagugggaccucaggggcuugggacuguggacucucuaaaguagggaaugacagggcgggggucaagucugaggguuccaccugagacaguugcugauaggagguccaauggggugguggcacugaaaaagaaaccguagggugggaggggccagggaccagaggagucaagggaugaccagucccaggaguagaacaaacagggcugagggauaggcccuggggagccccagcagcguuaaggauggcuagcugauggacuaggccuauggaagcggcccacuggucugagugggugcccuuuggggagaccaguguggaucuucauucuuguuuuguucuuugccagauacauauuuaacuuauaagacaaaucucauuaaagccagcuuggguugaaa

SEQ ID NO: 12366 - RNA, 3291 nt, Mus musculus
guugcuagguauaauuuuauuuuauauaaaauguguucuucggagcccaggacugaugcagcgguuagagggacuugcccuccgcagguucacugacuccuccucuacccacaugcacucagaaccuaggcuaggaaagcaaggaggagaucagggcaagagcuucacacucuugccgguccagucauucauucugugaccucgggggucacauauaaggucagugucucugauccgcgccggauccgcacugccagcugugauuggguucgaacagcuucauaaacaucuucagcauuuugugccaauuucuccccaauggccaagaucacaucaccaggccgcagaccagcccuguggaggauggacggggcaaggagagaauagacagagaaguucaaggauacauccacccaucccaucccacccaacccccccccccagagcacgcuccccaucaccugugugcgggggagcccaggauaacuuuaugaaugaggacaccaugcugaacaucagggaagcuuggcucacggagcuguaguucaauaaggaugcugaaagggcacagacacuauuagcuccacacaggcccucucccaucuuaauaguucaccuucugccuucuagagcuuaggaagugggauauacacauaaaagauagcuaauuucgaaagauacaugguguugaucaacuucacuucugucauccugaaggguuagaacuuaagcugagccuagaaggguggguccuaccaccuuacgaaauaagguauugagacauagaaguggaaaaugaaaguaguuccgaagaaacggcaagcugucuggaaggauaacgagaugggugggaaugggcgggaaugggccuccagugcuaggucaauguuggcuuuacaucacagcaauagcaggauguacucaaucuacugaaagauccagaugcagugggaugagaaaguuaugagagggaacagugcuugugacagaagacaacagcuuaucuuaggaaaaaacagacaugagagaaaacccaagaaaaggauaggguguguguaugguguguguguagggguguguguguguauguauguauagguguauauauauauacauauauauagauauauguauauaucaccacacuaacauacauauauauguauauguauauaucaccacacuaacauaccugggagucagggucagcaucaucacuccaauguagcggcgcugggacccacugguuccaaaccaggaaucuguaauaaaagaggacaaaugaaccgccccccagcuacauucuuucccuuacuuucuaccagcacaccccucuauaccaagccccagugaaugcccuccccuaagucccauccuccauuuuaaaggaaccccuuucccuguaagacaggcucacuuuucuuuuccccgcgaugcagaaacucccuaaggcgaucagaagggauggcaaaggagauuccagcugucaccuucaugguguucacuccaaucaccuccccauccugcagggacacagcccccuguccccuagcccacacagauggcagaggaugggggcaccugaacaagaguagcaaggauuuggggacagaagucugucugucugucugucugucuguauaccaggagaggaacaagagacuagagacuuagcuaaaauucccuaaaucagaggaaaacccacacuucccacacuaaccuggggcauggauucuuagaagaacacggacacucaccagguuaaccaggggaccaccagaauuuccaaacugugagauaaaaugaaagaaaacaucaaaaagaucuggaaucccaugcucugggaauucuaagaccgaggacauaaacaggguguagggaaauuuuucaaauuccauuccuagcacaugaacuagagaggcugccuuuugcagcccaaccucugauacaggcccagucaccaccacgugucaguuggugcucauacccaacagcuguucuccccaauuccaaccuuagcaccuaauuucccucauaucaggacgcacaucaauagcugcaucggucugaauguauuccacguuguuuugagggagucccaggucccuggcugggcgcugagcagagcugacaauaccagaugugaucguguucugcagugcaaaggggcuucccauggcaacaacaaacuccccuugccggacaucagcagagcggccgaggggcagugugggaagaggcuccuuaagggaaacaaggccagcaaaacuggucauuuuaagaagggagcaagagaacagcugccaucagaucuggccuacuccauccccaccuugguuugaauccucaguguggcaaugucugcuacgggauccacagcugugaccauggccucauaaguauccccgcuaggcagccucacucguacucggcgccgaucagccaccacgugggcguugguaacgaugagcccaucugaagccacuacgaauccugauccguuugagauggggacuucacggccggagaaagggugccugggauggggaaaguacccauuacacugcagcuuccaccucauccugcucccuugccuucacuaacggcaguucaacaccuccuggucaacuucaccauuaccggucuaggaucucgauauagaccacagcaggggcugucuucuccaccacaucugcgaugaaauuguacuggcuccggggagaaguggguggcggagcaggaacagcagccagcaccguggaaagaccccgaccccaaccccacaacagcagcaccacugcaccuccugcgcccaccgccaccgccagccauucgcgccgacggcuuccagggcuccugcgggccuccuggucacuggagccugaaguccccacauucaaucgugcccagagauccgggguccuagacgucagaucugcccgugaugcaaggaaccccucaggcaccugggccgggagacugggggucccauaagucauccagaucugagagucaggaguuccugacgucagcagagcccggaggucaggagcuaacaggggaggcuuccuccagaagaugccccccaaagcccgccaugcccgaaggcuccaguuugcaccccgccccgcuuucagcgcagccaucagcuccgccucgacucuccucgcccgcccuacucagaggcgguccucuagaacccggcaagcggucuaggagaagcagggcacgacgguagcuguucagcgcaugccgggaaacguagucccgucaggacgcgcuccucuccag

SEQ ID NO: 12367 - RNA, 3291 nt, Mus musculus
cuggagaggagcgcguccugacgggacuacguuucccggcaugcgcugaacagcuaccgucgugcccugcuucuccuagaccgcuugccggguucuagaggaccgccucugaguagggcgggcgaggagagucgaggcggagcugauggcugcgcugaaagcggggcggggugcaaacuggagccuucgggcauggcgggcuuuggggggcaucuucuggaggaagccuccccuguuagcuccugaccuccgggcucugcugacgucaggaacuccugacucucagaucuggaugacuuaugggacccccagucucccggcccaggugccugagggguuccuugcaucacgggcagaucugacgucuaggaccccggaucucugggcacgauugaauguggggacuucaggcuccagugaccaggaggcccgcaggagcccuggaagccgucggcgcgaauggcuggcgguggcggugggcgcaggaggugcaguggugcugcuguugugggguuggggucggggucuuuccacggugcuggcugcuguuccugcuccgccacccacuucuccccggagccaguacaauuucaucgcagaugugguggagaagacagccccugcuguggucuauaucgagauccuagaccgguaauggugaaguugaccaggagguguugaacugccguuagugaaggcaagggagcaggaugagguggaagcugcaguguaauggguacuuuccccaucccaggcacccuuucuccggccgugaaguccccaucucaaacggaucaggauucguaguggcuucagaugggcucaucguuaccaacgcccacgugguggcugaucggcgccgaguacgagugaggcugccuagcggggauacuuaugaggccauggucacagcuguggaucccguagcagacauugccacacugaggauucaaaccaagguggggauggaguaggccagaucugauggcagcuguucucuugcucccuucuuaaaaugaccaguuuugcuggccuuguuucccuuaaggagccucuucccacacugccccucggccgcucugcugauguccggcaaggggaguuuguuguugccaugggaagccccuuugcacugcagaacacgaucacaucugguauugucagcucugcucagcgcccagccagggaccugggacucccucaaaacaacguggaauacauucagaccgaugcagcuauugaugugcguccugauaugagggaaauuaggugcuaagguuggaauuggggagaacagcuguuggguaugagcaccaacugacacgugguggugacugggccuguaucagagguugggcugcaaaaggcagccucucuaguucaugugcuaggaauggaauuugaaaaauuucccuacacccuguuuauguccucggucuuagaauucccagagcaugggauuccagaucuuuuugauguuuucuuucauuuuaucucacaguuuggaaauucuggugguccccugguuaaccuggugaguguccguguucuucuaagaauccaugccccagguuagugugggaaguguggguuuuccucugauuuagggaauuuuagcuaagucucuagucucuuguuccucuccugguauacagacagacagacagacagacagacuucuguccccaaauccuugcuacucuuguucaggugcccccauccucugccaucugugugggcuaggggacagggggcugugucccugcaggauggggaggugauuggagugaacaccaugaaggugacagcuggaaucuccuuugccaucccuucugaucgccuuagggaguuucugcaucgcggggaaaagaaaagugagccugucuuacagggaaagggguuccuuuaaaauggaggaugggacuuaggggagggcauucacuggggcuugguauagaggggugugcugguagaaaguaagggaaagaauguagcuggggggcgguucauuuguccucuuuuauuacagauuccugguuuggaaccagugggucccagcgccgcuacauuggagugaugaugcugacccugacucccagguauguuaguguggugauauauacauauacauauauauguauguuaguguggugauauauacauauaucuauauauauguauauauauauacaccuauacauacauacacacacacaccccuacacacacaccauacacacacccuauccuuuucuuggguuuucucucaugucuguuuuuuccuaagauaagcuguugucuucugucacaagcacuguucccucucauaacuuucucaucccacugcaucuggaucuuucaguagauugaguacauccugcuauugcugugauguaaagccaacauugaccuagcacuggaggcccauucccgcccauucccacccaucucguuauccuuccagacagcuugccguuucuucggaacuacuuucauuuuccacuucuaugucucaauaccuuauuucguaaggugguaggacccacccuucuaggcucagcuuaaguucuaacccuucaggaugacagaagugaaguugaucaacaccauguaucuuucgaaauuagcuaucuuuuauguguauaucccacuuccuaagcucuagaaggcagaaggugaacuauuaagaugggagagggccuguguggagcuaauagugucugugcccuuucagcauccuuauugaacuacagcuccgugagccaagcuucccugauguucagcaugguguccucauucauaaaguuauccugggcucccccgcacacaggugauggggagcgugcucuggggggggggguugggugggaugggauggguggauguauccuugaacuucucugucuauucucuccuugccccguccauccuccacagggcuggucugcggccuggugaugugaucuuggccauuggggagaaauuggcacaaaaugcugaagauguuuaugaagcuguucgaacccaaucacagcuggcagugcggauccggcgcggaucagagacacugaccuuauaugugacccccgaggucacagaaugaaugacuggaccggcaagagugugaagcucuugcccugaucuccuccuugcuuuccuagccuagguucugagugcauguggguagaggaggagucagugaaccugcggagggcaagucccucuaaccgcugcaucaguccugggcuccgaagaacacauuuuauauaaaauaaaauuauaccuagcaac

SEQ ID NO: 12368 - RNA, 6023 nt, Mus musculus
guccccagagugaauucaagcuuuauugccacacacccccuacguccuguccagcccuguaugcggaaauagccgaagcaagccagggcugggugagaaccaggagggagcagguaggacgcugggggagaugggacuaaguucaaagccuaccguaccccaguuuucccugaguggugccugccccaaaucuuggggcuuccuugugcacuggaggaggaggcucaucccaaggacauccugugagguccccucugcccauuguaaugccaucuugcugcgugcacacacugcgcaugccugucaccguggcugcccuggccacggaagggcuuagcaguccaagccaauggacacgagcagguccucgagugcccgcagucgcugcugugccucuucaauggcacuguaugucuggaccgugcuggccacauggaagcggaugucaucgacgagcgggauggagucugucuccugccgggccgcuacagcugccgccucuucccgcacggccuccacgaaauccucccgcucuaccagcugcagagaagcaggcucagcacaggcugcaucccacccucucaggcucccccucucugcaccccugcccaccuucucuaugacuuuggccauauacucgguacacugguccuccagccgggccagccggaacaucuuggcuaugcgccaaacacccaccacacuguccuccuccagcagcugggccaggcugcggccacacagccgcuucaggccaggcagaagguacaugucagccacacucagaacaucguaggccaacucaggaggcagcugugacacgaaaagggacaacaggacacaggggaucaucaagggcucccaggguccagggaggaaaccccaguggaaauacaagagacucacaucucuggagccuggcccaggucuuugggggugcaaggggcagaaucagcucaggagagggggguuccaugccucagucagugcuuaggacuacaggccuuuuaggaaaagcagugugggcucaggcauagaccugagcucuccccauccagcuguggggucccaggcaagucccuucaccucuguaucucaguccccucaucuguagaggauucaugccagccuuggaagacuugaaagaaaguaaagugagcuggagguuucuauuccagcccacagcuugggaauggcuccuuccacugugaaagaccacacaaguuugaggaggagacugcuaggccuuggcuaaggucaagaauccagcuucagaccuuggguggccuagggacugagcagaggggaaaaaaaaauagagggacuaugccaccacacuucuggaugucacucugccaccuaacuauucucuggucguuuggucauaugcucaagacucaaggaaacauacuauucuccaucuucuggggaauacacugaaacacagagcagggauauaacuugucuaagaucacacagcucccgagacuaaucuacuguuugacaauguucagaggccaguccacacucugagcuauuaaaaauguucuugggguaccaagcuucuuccagagagagcuugcgacacaggauuucagacucaaccucagaaugaguggcaggccaugagaaaggaagugaggggaagugacagaaggaaggcuagugacaaagccuaauacagagggggcagguuggugggagccagauggccaggacuggggucaccagaaaaugauguagggacacagauuccuguaguuccaucucaguaacagagaacaaagaggaugggggagccacagccugggggucagggccaccauuucuacaaagaccuuuccuggaggcugaacagcccugacaauaccauauggcccaccagccuuaaaacauuaccuuccuagggaagauuuguggcaaugcccuggaaaaaccagacaaaggggcaccugggaccccagcaagccaccucaccccucagacccaauggaaaauacacuucucuccuguauagugcccugcuacacugccaugaacacauaccaacagagggaaccuuugguacugucuaaagccacccacaggccuggcucaggaacucugggacagcuaagugcaggaaugacccaaggacugugacaacacuacggcagacggcccagggcuuguucaccacugcccuccugcugggcgccacuucaccucgguauggucacuauauacguaguacaacacgugaaugaagauguccggggagaugucaugcagggugacaacugggggaucuccagaggcugcaggcuccucacucucuugaaaguggucauccagaagggcccggaaguagucacugcggccacagaagaaagccugaggaagcaaggucacaaaggaccagggcucgaaucugccccaaggggccagcccagggcuugagcagcgcggccaggggugggacagguaccuuguagcagaggaagcuggagucagccacucggaagcagauaucggggcagcugcugaagccaucgggacaugggaagggcagcucuccaaggucacccugguauaggaaagagacgacucagagcaaagccguucaugaaagggaaguagcuucuagguuggccuaggaagggaacccagcucuguggaaccugccccucacagccccaucccuagacacccaucaugcccaccaagcuggcaugcccuucaauacccgcagcucagauggcagggcacagucagcuagcagggccauaucugcccguaaccggggaucugcuggaggagguucaauagucagcaccuucacacacgugccaggcuuggaagccacuggggggagaagacggcagggacuuagagagguggaccagagcugcaggcuguaacccaagaccuuggacugagacccuguacacaccaaauucagacaccuucucgcacuuagccuccaggucauccagcaggucccacagcuggcacugcuuggccaggcgcucacagucacucacguguucuacaccgauguccaagcggccugggggauugaggaggcugagucaggaccugagagugacuccuacucaauaccuugguuuucucauccggaaggaccuaagaccugcucaauuuguagaugggaccuguccucuccaaacagguuaagucaugcugggcacacuccuccuccccaaaggugacaucagcucugggccacccugggugugcugcugucccagcccacggggucggucagucaccuguauacagguacugcaguagagccccaaaggccaccggguugaucugcaggcagaguagaaagggaaggucagaggcuaccacccagcaugaacuaucuguucucccagaaacuggcacucucucccaaggcagauggacacaccagggggugccugagaaccacgacgcucuugcccuuccacuugguguccagcauguuggcgaaguagguacugcgagcaccgaggauacagcgaugggcccggaacggcuuuccguguaccacaaagaccacaucgcuguggaugcccuguuccagaagccugggaaaagccaggaaagguugcaucauccugacaacugcuggcgcaccaggaccacucagcaaacccacccaccagaacccacugagagugcccagcaaccccagcaguacugcaagcuccacccccagcucaccgcugcaggaaaucgucauaguaaucccgccuccugcaggacgcagugaccuguuuguagucucucagugcacggcgaauagggucgcuuagcgcuccguagagacaccgcucuccaucaaagguguuggccucacagcgggcuccuacaaagcaaugcucaucagucagagucaagggaacaccuagucuggggagaucucuggccuccccagcuccccagaggcccuuccuugccacagaggcccaggcaacccuucgguccuugggaaggccaaggcauacaaucugugcacuuagauguaggcauacucaugaauacacauguaaauauuggacuauaugcaguuaaggccagacugaggggcuggcccuguaaauagccaucuuggugacuagcagaucccugccccaacugaaccuaguggagcccaugcauaguuuauuauaugacagccggcauuauuacaaaacagaaccaagggugacuauggcaguggcagccacauggggagaacugugaagugagguggcuaagcacagggacuugaaagaagcgggagaugcauagaucuaggaaggaacuccagucuaagcaggaaguacugcaacugagaagacccugagguaggagauggguaggucuaguggggcagccagcaggugggagacccaaggaaggcaaagugagaggaggucagagugggucucacaauguagcccugacuagcuuugaacuuaagauaaucccugucucgacuuuucucucucccaauaauuuaauugcaggugugggcaaccaugcccacgugcuuuuaucccaaacacucccaucagcuuugcuguggaaagauccuccugccugcaaauauggagaucagagagucaguuuagcagaccaauggugguacaguacaggagacagccccagaacuggccugggugucaaggguaacgugagaaaguggauagaggguuagagaguacuauguguugacuuuagggaguuaacaagaaaucaagggugcauacaaacauggagcaaggucucagagcuuacaggcagacccugacccucucucaccauuagccaacagguagcgcaccaacuccucaugcccacagaggcaggcauaguaccuaggaaagggggaagcugucaguaggguaggcccacccugcccacccagcuaccccaccgcucacacucacaaaggggugcugucccacuuaucccgcacguucaccuccacgucucgcugcuccagcagguaccugggcaggaaguucaaagccugggucagaauugcuucucaucugggagagagacaaccaggaaggggaaggaggccacaucucucugggcuagggaaugccucugagaaggguaaggccugggacuacacaggucugcaagggucugcaacugugaguugggugauggcuucauggacagaggccaagccccagguucagaaggcugagaauuuggucuuuuaauaucugggagagagaaggugauggggccccuaauucagccuggggagccaauggcagggaagucagaagaaagcugaugcaggcacugggggcggggaaggaggggaacagaacagaucuauggaagaaguggaaaaaacaauugauaaaauguugaggagaagaggucaugaaccagaaagcgaucacugggacauggcagcccaaggaggcuaucugaggcaagaccugaacucucagagcugcauucaaauugagggacggaucauuaacucugagguggcaucuggugucggagagagcugcagcuuggucacaucuguugaggaccaggggacuuggaaggaagggccaugggagaaaggagucuaucaaagaaaagggucaggauccuucucuucccugccugcccacggagaucacggucucggcgccaggcugguaacuggcugcaccagcggcgccugcgccucuuggaaccuccacggagaggagucguuucccugcaccgagcuaaguaagggaccuagagcccgaucucccugacucggucagcuucgggagccccacggcgcccaaccccacacccgugcccgauaagcccugcggacgccugcccgccuccugcacuucagguucucaccgcacacggcccacguccccuuuccugcagcuggcaaacaagucgcugguauccauggcgaaagagacuggacccccggccgagugaucucgggagucgucugugcccggccggauguaaacacucaccgccccgccccucgcggcacggccuagcuaugcccgccu

SEQ ID NO: 12369 - RNA, 6023 nt, Mus musculus
aggcgggcauagcuaggccgugccgcgaggggcggggcggugaguguuuacauccggccgggcacagacgacucccgagaucacucggccggggguccagucucuuucgccauggauaccagcgacuuguuugccagcugcaggaaaggggacgugggccgugugcggugagaaccugaagugcaggaggcgggcaggcguccgcagggcuuaucgggcacgggugugggguugggcgccguggggcucccgaagcugaccgagucagggagaucgggcucuaggucccuuacuuagcucggugcagggaaacgacuccucuccguggagguuccaagaggcgcaggcgccgcuggugcagccaguuaccagccuggcgccgagaccgugaucuccgugggcaggcagggaagagaaggauccugacccuuuucuuugauagacuccuuucucccauggcccuuccuuccaaguccccugguccucaacagaugugaccaagcugcagcucucuccgacaccagaugccaccucagaguuaaugauccgucccucaauuugaaugcagcucugagaguucaggucuugccucagauagccuccuugggcugccaugucccagugaucgcuuucugguucaugaccucuucuccucaacauuuuaucaauuguuuuuuccacuucuuccauagaucuguucuguuccccuccuuccccgcccccagugccugcaucagcuuucuucugacuucccugccauuggcuccccaggcugaauuaggggccccaucaccuucucucucccagauauuaaaagaccaaauucucagccuucugaaccuggggcuuggccucuguccaugaagccaucacccaacucacaguugcagacccuugcagaccuguguagucccaggccuuacccuucucagaggcauucccuagcccagagagauguggccuccuuccccuuccugguugucucucucccagaugagaagcaauucugacccaggcuuugaacuuccugcccagguaccugcuggagcagcgagacguggaggugaacgugcgggauaagugggacagcaccccuuugugagugugagcggugggguagcugggugggcagggugggccuacccuacugacagcuucccccuuuccuagguacuaugccugccucugugggcaugaggaguuggugcgcuaccuguuggcuaauggugagagagggucagggucugccuguaagcucugagaccuugcuccauguuuguaugcacccuugauuucuuguuaacucccuaaagucaacacauaguacucucuaacccucuauccacuuucucacguuacccuugacacccaggccaguucuggggcugucuccuguacuguaccaccauuggucugcuaaacugacucucugaucuccauauuugcaggcaggaggaucuuuccacagcaaagcugaugggaguguuugggauaaaagcacgugggcaugguugcccacaccugcaauuaaauuauugggagagagaaaagucgagacagggauuaucuuaaguucaaagcuagucagggcuacauugugagacccacucugaccuccucucacuuugccuuccuugggucucccaccugcuggcugccccacuagaccuacccaucuccuaccucagggucuucucaguugcaguacuuccugcuuagacuggaguuccuuccuagaucuaugcaucucccgcuucuuucaagucccugugcuuagccaccucacuucacaguucuccccauguggcugccacugccauagucacccuugguucuguuuuguaauaaugccggcugucauauaauaaacuaugcaugggcuccacuagguucaguuggggcagggaucugcuagucaccaagauggcuauuuacagggccagccccucagucuggccuuaacugcauauaguccaauauuuacauguguauucaugaguaugccuacaucuaagugcacagauuguaugccuuggccuucccaaggaccgaaggguugccugggccucuguggcaaggaagggccucuggggagcuggggaggccagagaucuccccagacuagguguucccuugacucugacugaugagcauugcuuuguaggagcccgcugugaggccaacaccuuugauggagagcggugucucuacggagcgcuaagcgacccuauucgccgugcacugagagacuacaaacaggucacugcguccugcaggaggcgggauuacuaugacgauuuccugcagcggugagcuggggguggagcuugcaguacugcugggguugcugggcacucucaguggguucugguggguggguuugcugagugguccuggugcgccagcaguugucaggaugaugcaaccuuuccuggcuuuucccaggcuucuggaacagggcauccacagcgauguggucuuugugguacacggaaagccguuccgggcccaucgcuguauccucggugcucgcaguaccuacuucgccaacaugcuggacaccaaguggaagggcaagagcgucgugguucucaggcacccccugguguguccaucugccuugggagagagugccaguuucugggagaacagauaguucaugcugggugguagccucugaccuucccuuucuacucugccugcagaucaacccgguggccuuuggggcucuacugcaguaccuguauacaggugacugaccgaccccgugggcugggacagcagcacacccaggguggcccagagcugaugucaccuuuggggaggaggagugugcccagcaugacuuaaccuguuuggagaggacaggucccaucuacaaauugagcaggucuuagguccuuccggaugagaaaaccaagguauugaguaggagucacucucagguccugacucagccuccucaaucccccaggccgcuuggacaucgguguagaacacgugagugacugugagcgccuggccaagcagugccagcugugggaccugcuggaugaccuggaggcuaagugcgagaaggugucugaauuugguguguacagggucucaguccaaggucuuggguuacagccugcagcucugguccaccucucuaagucccugccgucuucuccccccaguggcuuccaagccuggcacgugugugaaggugcugacuauugaaccuccuccagcagauccccgguuacgggcagauauggcccugcuagcugacugugcccugccaucugagcugcggguauugaagggcaugccagcuuggugggcaugaugggugucuagggauggggcugugaggggcagguuccacagagcuggguucccuuccuaggccaaccuagaagcuacuucccuuucaugaacggcuuugcucugagucgucucuuuccuauaccagggugaccuuggagagcugcccuucccaugucccgauggcuucagcagcugccccgauaucugcuuccgaguggcugacuccagcuuccucugcuacaagguaccugucccaccccuggccgcgcugcucaagcccugggcuggccccuuggggcagauucgagcccugguccuuugugaccuugcuuccucaggcuuucuucuguggccgcagugacuacuuccgggcccuucuggaugaccacuuucaagagagugaggagccugcagccucuggagaucccccaguugucacccugcaugacaucuccccggacaucuucauucacguguuguacuacguauauagugaccauaccgaggugaaguggcgcccagcaggagggcaguggugaacaagcccugggccgucugccguaguguugucacaguccuugggucauuccugcacuuagcugucccagaguuccugagccaggccuguggguggcuuuagacaguaccaaagguucccucuguugguauguguucauggcaguguagcagggcacuauacaggagagaaguguauuuuccauugggucugaggggugagguggcuugcuggggucccaggugccccuuugucugguuuuuccagggcauugccacaaaucuucccuaggaagguaauguuuuaaggcuggugggccauaugguauugucagggcuguucagccuccaggaaaggucuuuguagaaaugguggcccugacccccaggcuguggcucccccauccucuuuguucucuguuacugagauggaacuacaggaaucugugucccuacaucauuuucuggugaccccaguccuggccaucuggcucccaccaaccugcccccucuguauuaggcuuugucacuagccuuccuucugucacuuccccucacuuccuuucucauggccugccacucauucugagguugagucugaaauccugugucgcaagcucucucuggaagaagcuugguaccccaagaacauuuuuaauagcucagaguguggacuggccucugaacauugucaaacaguagauuagucucgggagcugugugaucuuagacaaguuauaucccugcucuguguuucaguguauuccccagaagauggagaauaguauguuuccuugagucuugagcauaugaccaaacgaccagagaauaguuagguggcagagugacauccagaagugugguggcauagucccucuauuuuuuuuuccccucugcucagucccuaggccacccaaggucugaagcuggauucuugaccuuagccaaggccuagcagucuccuccucaaacuuguguggucuuucacaguggaaggagccauucccaagcugugggcuggaauagaaaccuccagcucacuuuacuuucuuucaagucuuccaaggcuggcaugaauccucuacagaugaggggacugagauacagaggugaagggacuugccugggaccccacagcuggauggggagagcucaggucuaugccugagcccacacugcuuuuccuaaaaggccuguaguccuaagcacugacugaggcauggaaccccccucuccugagcugauucugccccuugcacccccaaagaccugggccaggcuccagagaugugagucucuuguauuuccacugggguuuccucccuggacccugggagcccuugaugauccccuguguccuguugucccuuuucgugucacagcugccuccugaguuggccuacgauguucugaguguggcugacauguaccuucugccuggccugaagcggcuguguggccgcagccuggcccagcugcuggaggaggacagugugguggguguuuggcgcauagccaagauguuccggcuggcccggcuggaggaccaguguaccgaguauauggccaaagucauagagaaggugggcaggggugcagagagggggagccugagagggugggaugcagccugugcugagccugcuucucugcagcugguagagcgggaggauuucguggaggccgugcgggaagaggcggcagcuguagcggcccggcaggagacagacuccaucccgcucgucgaugacauccgcuuccauguggccagcacgguccagacauacagugccauugaagaggcacagcagcgacugcgggcacucgaggaccugcucguguccauuggcuuggacugcuaagcccuuccguggccagggcagccacggugacaggcaugcgcagugugugcacgcagcaagauggcauuacaaugggcagaggggaccucacaggauguccuugggaugagccuccuccuccagugcacaaggaagccccaagauuuggggcaggcaccacucagggaaaacugggguacgguaggcuuugaacuuagucccaucucccccagcguccuaccugcucccuccugguucucacccagcccuggcuugcuucggcuauuuccgcauacagggcuggacaggacguaggggguguguggcaauaaagcuugaauucacucuggggac

SEQ ID NO: 12370 - RNA, 10861 nt, Mus musculus
cccagggccuguaggaggccgcagagaggagguaggagaggcggggguuguguuaggggcucccuagaggacgaggacccuggaggcgggaucuuggggcgacacacagguggagccagccauuaagcagucccacuucugugccaggcacugaacugggcacuugacgagcaucaccucuuaauccucagaacauuccagggagguagguaauucucgaugcccccauuuuacagauuuauacuucuuaauggggaaauagacugaggcaucaucuuuuguccuggaaaaaagaaaaacaaacaaacaaacaaacaaaaaccggagauucagguuaaauaacauguuuagaaacgcacauaagaaaaugggcuggaacuuaguucuguucaccugaccagccuguguuccaaacuagccagggacacagagaaggugcagagguggaauggagugagacaagaggaggcagggagaacccugucaaauagaaugcuagaaacgacccaacguagggaaacagaggacauaggaagacagggcacacuaguaucuccucuuccuuaaugcugcagauuccagacuucugcgguucaaauugcaacuaggaggccggccuaaucaugcagguuuguacaccuagugacuugggaggcuaaagcagguggaucauaaguucaaggccuggaauucaugaaagggggggggggcuggauguaacuguaacauaauuaaguuuggagaauuugugccuagaaugaacaagcgcuuguauaaaucaggugugguacaugccuaaaauuccaucucuugggagguggagacaaaaccuuggcuacauagcuaguuugagaccaaccugagugcauaucuuuaucccagcacucagaggcaggugcuuucuggggugggggucgggagggggagcucuaugaauccugaucuauguagcaaaugaguaucaggccacucaagacuacauaaugagauuuuugucucccccaccccaaaaugggggugagguagggucuggagaugugugagacccuucagugcuaccaaaacaaaaaaagacaauaaauugcaguuaggagucuaggcauguguacauacucuucuggagucuuuuuccuuucuuugucaaaagaaagaaaccaggcagugguggcacacgccuuuaaucccaguagaggcaggugaucucugaauugaaggccagccuggucuauagaguucauuccaggccagccagaguuguuauacagagaaauuauguugaaugaaugaaugaaugaaugaaugaaugaaaagcauggcaaaaggccccccuuuuaagguuaugugcauaauucagugaagucaaccuagcuugggguacagucagggcucuguugggucucucuccccaugcuacuuugucuccuauccaauggccuucuccccucuaauuuuacagggucccaccuccugggccaugagcgagcugaaggacuguccacugcaguuucaugacuucaagucuguggaccaccugaaggucuguccccgcuacacggcagugcuggcccgcuccgaggacgauggcauuggcauugaggagcuggacacccugcagcuggagcuugagacucugcuguccucugcaagccggagacugcguguacuggaagcugaaacccaggugauuguccauggggggcauccacuagagacauugugucaaguuaugggauggauccuuagguucccucucugcugaggcccagggauggaugggaagagagacccacaugggaaucaugacagaauaguuagcucucaguucagcuuaccguuagccaaggaugcuauccgacuguagguggacaccgcccacguguggccccugaaguugccugggaacuuucugagaugcacugugauacagucaguugcauagacagaaccaccgggugccuuggagugugacauaaagguuagcugggagucuuguucaccaccaccaaaaaacccagcagcagcagauuuccccaggacuaccaugccaaaccguuugugacuagcuugggcggcagcagaagugaaucagaauguagaccuccgguuaaauucaugugagaaaaucacagagaagaacaggcauuuugaaauaugaguaguuugcuuaauaaccucaaauucuagaucucaguuauccauggcggggaaagaagugcccugucucuucucuccgucucagggguugucuuuguguguuucagauccuuacugacuggcaggauaagaaaggggaccgacgauuccugaagcuaggucgcgaccacgagcucggugcuccccccaaacacggaaagcccaagaagcagaaacuggaagggaagacaggacaugggccaggcccuggcccgggacgacccaaauccaaaaacguccaacccaagauccaggaauaugaauuuacugaugacccaaucgacgugccucggauccccaagaaugaugcucccaacagguucugggccugagcacguagcagggagcuggaggggcccagagacuugugguggaggcuuggaaggcccggggcuaaggcugaaggagcaucucacccacuccgggucugcuucugccuguagguucugggccucuguggagcccuauugugccgacaucaccagugaggagguacggacacuagaggagcuccugaagcccccagaagaugaagcugaacauuauaagguagaaaccugagccgcacagucaguacgacagggcucaaaggcgccugaggguccuaggcagcaaagccugcauccaucaccuacuuucuucccagccuccugccugcuccaugaccccugcagacagugaggcucagcuuucucuguccucuagccuuucuccaaagagccucugaacacucuccuugcuuuuacacuugggcgauacuuacuuucuuuaacuauaaaaguuaaguuccgcugggcgugguggcgcacgccuuuaaucccagcacucaggaggcagaggcaggcaaauuucuugaguucaaggccagccuggucuacagagugaguuccaggacagccagggcuacacagagaaacccugucucgagaaaaaaaaaaaaaaguuaaauucugguuuucuuuucuaagacacuggaauuugcuaugguacccaggcugaccuugaaccccuggacucaaccauuguccucucucagcccuucaggucccccccaggugucugggaccacaaacauaccuggguuaaaaguugguuuuuuugguuuugggggauuuuguuuguuguuguuuuuugguuuuuguugguuuguuuguuuugguuuugguuuuugagacuagauuucauuuaucccaggcuagccuugaacuuuguuagcuaacaaauuacccugaacuuaagaucuuuuucuucugacucccuagugcugggauuacagguagguaaugaccaugcccaguugaugcaguccugguacagaagccagggcucucugcauucccagcaagcucucuacuggcggagaucuguccccagcaaguuagcuuuauugaucuuaaaaauaaaauaugcuccauaaaagaaaguagacaaacuugugaggcggggacuccaccacaggacaccugccaucgcaggugcacguaugacacagaucuacuucuagggcuccccugacuucuguuugccacaggauggaguccaaguguuucagugcugggugacaccccaguucucuccaguuguccuuggccacaucuuucuuuccugcugcauuuaucagcuacaccagacauguucccucccccuggccucacaccagggucuacacacaagcucuucucagccuggcagacucccucacuccucaaggccccaaagaugccucugcagacucuccagcagaaaggggcagcugggcccagugccucacccccauugcacucgggaggcugaggcaaguuugaggccagcauggguuuacaaguuugagguccuuucuccaaggagagcaaaggacauggucucacuuggugcuuucaugguccccgggcugcuuuaaaugcacuaaccugaauuugaaaaucauuuaucugcaaccagagauguaguuagucauauugcucagugguagagcaacuucuuagcauggacaaggccccagauucaguccugaccaaaaguacugcuaccaccuauaaucucacagagucagcuuguccuauauaaaagaaguggagaaaaagcaguccauucugacagcaguaaguuuaaagaacacaagaaaauaauuucuucuuaucccugcuuugggcccaaguucucuuuagaggaauuaccgcugaccaagaggauccacagacacaguauuuuauaccuuguaucuuuuuguugucgguaguggugguuguggguuuuugguugguugguuugucugccucccgaguacugggacuaaaggugugcuauccugccuggcuucuauuuuauaucuugcuaaugcauaucagcuucuagguguauuuugauuuuugguucuuguuuguuuguuuguuuauuugagaaaagauagggucucagcccaggcucagacuccugaucagccuaugucagccuccagaaugaucauaggcuagguguguacgccacgccuagcuguguugagucuuucuauacguguuucccuuacuggagugugaguggagagauuggaucuuguuggccuuucguggcaccagccuuggccuugggcaacaaauccgugaggaaagaaagaauaaacggaugcuuccugaccgagucccaugccaggagauccucucacauuccagucucagaugggcaguguuuaccucucagagcugagugagcucuuugcugcagauucccccccuagggaaacacuacucccagcgcugggcccaggaggaucugcuggaggagcagaaggacggcgcucgggcagcagcuguggcugacaagaagaaaggccucauaggaccacugacagaacuggacacaaaagguaagccucagccuccucacagcccaggccuggaucugaggccccggagcuucaggccuccagcuguuguucucccuguccagauguggaugcccugcugaagaagucugaggcccagcaugaacagccagaagacgggugucccuuuggagcccugacacagcgccugcugcaggcccuaguggaggugagcaggccaucugacugggaaccacaagcuaggcaugguggcaucugcuuguaaccccaguggcacuugggagacagaggcucuuagcucaaguucaaucugguuacaugugacugucucagaaaacaaaaaaacauuuacacacaggcucgagcgagcaugcgcacacgugcauacacacacacacacacacacauacacacacacacacacacacacacacacacacacacacacacacacacgagcgcucgugugcuggcacuuuauuguuauuuugcuuuuugagauagagucacacuauggacuagaacuuuuaguccucgugccucaaugccccugugccgggaauagcagauguaagucuccacacaaggcuuccacagacaccuuugcugagcaguggguaaggggauugauuccaugccuccucugacuggacgccugugcuugugaggaacuugagguucagaaaaguuaacuuuuucuuaagaccacagcuaauaagugaaggucggauucaagccucgcuugggguuuccaccuuaaugcccaggccugagcuuagaaacaccauuuacauccucuagccucgguuuccucuuucgucucuaacacuaugauaguucuucucucagagaacagccugggguagacugaggccaggggaagucuggcuuagccccgcagagacuccgucuuauguggcuuuucauccugaccaaggucacucuggguauugugacugcgccaggcccgcagaagcugaguaaggaguaugggaaggaagccuucuggaugugacugugacucuucccuguggacaucacucuccuuggagaaucugucccacaagugccucugacugcaggggugccugggaaauguaguguagcucagcugcugcggggaaggcacaguguugggauaucucccaggccgcaccgugcuccuacagugcugggugccuguggaggcuuccuagccugagcuagucuaucacuguuucugugucucccucuuuuuauauagauaugccucuccccccaaaagaggaauuucuagaacccagaaaggaaugaucaaagcuuuggaggaaucuuuuuaacaugggugggaugaaagagaugacagacgcugcucucuagccugugaagacugucugugccugucagagaaguaggacugcuaugauacucuccuccuaacuucucucugcucuucaggaaaauauuaucuccccuauggaggacuccccuauuccugacaugucugggaaagagucaggggcagauggagcgagcaccuccccgcgcaaucagaacaagccuuucaggugagugcuaucccagcugugcucuaggcuugucugucggcuucacgugucucuucauggggagacgugucuuuguuagcagaaacgcugagaacccuuuaaccaagcccagcgaucucaugugggagugcuggccucauuucuggacgcaggcuuuguccagaccugaucacccuagcucugcuccuacuggagcugagcagagugcccaccugaagggaucgcuggcuaagagccaagacuacaugugcaauaacuuggaacuguuaaucauuacaagaaauaugugccaugaaacagugaaaacagcagaaugccaaauggaaaaggaguaauccuauguguauucaaaauauacuuacgaguuacauaaaauuggggaauagaaaagauuacaacucacaguuugcaacauaucacaaggccuggagcacauguggcuauagugguuucacuaggugaaaggaagagccgggguccucugaggggggccagcuggcccuccgagcucagguccggccuuaucuacagugugccacauaccaagucccuggagagccgcaucaaggaggagcugauugcccagggccuccuggagucugaggaccggcccgcggaggacucagaggacgagguccuugcugagcugcgcaaacggcaagcugagcugaaagcacucagugcacacaaccgcaccaagaagcaugaccugcugaggugagugaggagugccacaccacgccacgccacgccacgucaccaagcaguccugugcccuagguugugucucagauagauccuaaguccaggggugaggcucuagcacccacaauggacagauggauggauuugauuccagauuuagauuuauuucauuuuaaucaugugugugugcuuuugagugugcgaguacaggugucuguaguggcaggaugcccuggagcuggaguuacggguguuugcugcuggccagcgugggugcugggaacugaacgccagcccucugcgagaguaauacacuaaccagugagccaucuccaaccgugacugagcccauuaaguauaguuugguaacauucacaguguugggucacauggcacauuuugucugauuuugucucuuugugugugcuuuguuuuucuuuaugguauuauuucaucgaagagagcucacuggggaaaugcuugccaccaaggcugaccucuugaggucaguuuuccccucccaccuaagagugggccaccgcacagcgcaucucuaaccccagcuuggaugggcacgagcaagcggauccccagagcuugcuggcuggacagccuugcugacuaggucugccuaagauuccagugagagaucugucucaaaagagaaggcaggggccagcaagauugcucagugggugaaggcccucaccaccaagccugagcaccugagugcgguccuuagaauccagauguuagagagaggggaccagcuccugcccguugucuucuggccuccacaugcacaccauagcaugucugacucccaauagacagacugaaagacagauuauaguagaaauaaauaagaugaagcaugauagagacaucuagugucaaccucuacccuucauaugcaucuacacacauguacagguacacauaaaacauacacaaaacacaucacagagaaaauuggaaaugauaaauaccaggaugcuugccgcuccgacagaugaauugcuaauguuguuggccaccugugcguuugauuggcuaagucacccacacuuacuuguguuuuagagaacaaucacacuucauuuuauaucaccucgcauucagcucucccuguacugaugacaagguauaggugaugugugaaggacgguggcagggagcuguccuguuagagcucaagcagggcuccucgccccucacaggcagaugcccccacagagccuccacugcagagcucagucacuugaccagcgcuuauggucucugaugugccaguagggcuagaaaggaggaggagaaauagacuuguguucucguagguggcuaaaggaggcacaccauuuaaaggagaggcagcuggugggcuuugagggcaucugagaauaaagaaagcagugugugcuuaauacccucugugugccagagucuccugcaccgucuuccauuugaaagacaacucagacagugauugguggucucucuauuuaccagaugagggaugaaaggcagugaaguggagccuuguugaaagucacauccaaucgagagcugagcugagauuugcggcaaggcuaguccaagggaauucauauuccuuuucaagggcaagcagaaagccacagaugugaagggcaggaaaguuagggacaaacugaaagagcgauguggugcagcuauagaaaugaggagcgaggcgaggaauggcuuggggcccuccaaaggcugcagcucagccauggccccugcugcagugcugggagcgggucacucuaggcccaagccgcaaggagaacucgauuuccuggauaccuucagcuccaccgccagugaaacuaagauccaugcccagcaggcagaucaccuuugaagauagaccuuuucaaagccauuugaaguucacugugcacaucuguaauucuaagagcuaaugcagggggcgggggcuggagguccaguugaagcugguuuuuccagaucuuuuguucacccaugcucaacuugagccucagucucauggaaauaccauaucuuccuuugcaagauuguugugagaauuagcuagauguacauguguaugcguuguuuaagggguuuuuguuguuguugcuguuguuuuauguguguagauguuuugccugcaagugugucuguaccccaugugagugccugguaccuacagaggacauugaauccucuggaaccagaacuagagagaguuguuagccagcaugugaguacugagaaccaagccugggucuuacagaugagcuuaacugacagcugagcgcucucccaucuccuggguuuucuguuugguuguugggcuugggguuuuuuguuuuuuuggguuuuuuugguuuuuggguuuuuuuguuguuguuguuguuuuuuuuuuuuuuuuuuuuuuuuuuuuuuucuuuugagacaguauuucucuguguagcccugacuguccuggucuauaaaccaggcuggccugaaaaucagagaucugcuucccuuagccuccagagugaugggauuaaaggugugugucaccaugccuggcuucuagguuuuauuuuuuaagcuagggucagagguucacaccuacagucuuagcaauugagggguagaggcaagagaagccuccaggggcaagguucagggccagaggaggcuuuggagucauuuccaggucagccugggcuacaguuugaaacuuucucaaaaaaaaaaaaagaaaagaaaagaaaaaaacauuuuuuuagaguaguuuuagugaacuacuaaaauugaaaggaacaaauugauaggaagauagagcuaucccugugcuccacaugcugccccugcuauaagcaguauuaacauuucagagcacuuaaauaaugccuugcagucaguguggcucugcaucuauaugcacauuggucauuauucaaacaggccaagaagugccagcccccacugggauuauuaggaggcucaguauggaaaaaaaggaagggacaaacccuggagauggcuuuaaccaugacauacgguccccauaggcuggcaaaggaggaggugagccggcaggagcuaaggcagcggguccgcauggccgacaacgaagucauggaugccuuccggaagaucauggcugcccggcagaagaagcgcaccccuacaaagaaggaaaaggaccaggccuggaagacccugaaggagcgggaaagcauccugaagcuccuagacggguagccugaccugcugcuggcuaucccccuggccuggcagaaguccacaacauccuuugaagccuuggccagaggcugccuaucaaaugacaacagucucagggcugaaacacucucaggccacccagcugagcuuugugcagccaguaugcaaggcccuacugcgccugccuggaccuagcauccgccugaugccccagaugagcgggcuuguuccucauccccuccccccuuaccgucuccacaccucuccucagggacuucuuccuugagguuuuguaauguacaaacuuaagaauaaagugacugcuguguuucauuuuuuaaacaaa

SEQ ID NO: 12371 - RNA, 7614 nt, Mus musculus
ccgccuucaaguugcccggagcgcgucugggaccggcagaccugucccggagcgcguagauccgcacgcacgcacgcgccgcccacguccagcuugcgaauccgagggacccguuccaauaaugccccggaaggcagccaguccagaggaggcggcgggggagcccgguccugaggagauggaggcugggcggccgcggccggugcugcgcucggugaacucgcgcgagcccucucaggucaucuucugcaaccgcagcccgcgcgucgugcugccuuuguggcucaacuucgacggcgagccucagcccuacccgaucuuaccaccgggcaccggccgccgcauccacagcuaccgagguacgagccgcgcgcuaggccgcugcugcuguaacaggcggggcgcuuucucuccgaccccgagcaucuugucccuacccacugcaucuaccccgagaaaaugcccggccccuaccagugauuucggaugcaguguuaacccaguucccggucagguucggcaugcgaaccugccuuggugaugacaacuuggaggguuacagacaaaaaaaauguaugaacagacaagaaccagccugugucauaauugcugcgcuaggcaccgagcuuagagguuugcgaaagcaugggcagagugugggugcguccaggugaagaaagagcacgcagcuuaggagaaccggaguaggauaagucagcugagggaguuaacaguuguaguugggggaucaccuuuaccgauuggcgucuuggccgaaaacaagugaguaugggauaacggguugaacucucgaucuuucugccuucgccacugauuucagguuuguaccaagccugaccacguaagcuuauuaacugugacaagcaucaguggaagucagucaguucuaucagugucaugacuggauggcuaugaaaaacaagugaagccgcucucagguguacaauccccaggacucagaaaaccgaggcaagaugacugcaccaggcuuuuuugguuugccgccaaacagugagagaaaaaguucaaaaguugauuuuagccguagugaauuggggcuguuugacauugccuuauuuauguauugaaaaaaaauguacccagaucugugugugguagcccaggacucaggaggccaagacagaaggauuucacugagugcaaguccagccuuggcuaagccccaagauugugucugaagcaaccagccagacagcugagugaugugggaauuuuguagaucaggcuggccucucacugaaauccaacuuccuucugcccccugaguacugggauuaaagcaaaggccuuugucaccaaggccgguuuauacugcucuuucaggguuagcuucucaguacccaggucaggcagcucacaaguuuccauuacuccagcuccagggauccgaggucccugcucuuacuugggaaaagaaacccuaaccuuggcaguuugaauaagagugacuccuauaggcuaauauaucugaaugcuuaggguguaguccuaaggauuaguuugaaaguggugaaggaugaguagguguggccugguuggaggaagugugccacuagggaugggcuuugagguuucagaagccuaaaccaaacucacaaucucacuggcuacaccuuuggaucuggauguagagaauccuuaguuacuucuccagccccaagucugccuggguaccaccaugcuucccaucaugcugaugauggauggauuaaaaccccugaaacgcucaguaagccucaguuagaugcuuucuuuuauuagaguugccaugguuuuggugucucucagcagcagcagcauugacauaagacaaacaaaccaacuguggcaguccucuugccucagccuccuacaacagacuuccguauuuucauaaccaucccgggaagaucuugguagaacuuuucuccugauggugguacauuuaaugaacucaugugaccagucaggucacaaacuuguagugacuuggggaacagguggaggcaggaugaucaggaguucaagccagucuggacagcaugcuaccuggacguaaugaaaacaguaggauggaauaaacugaugcuucucaaguugucuuuuugauacagagaggagaaaagagcuucucacaucuggagauguagcauuugucucucagugcuagcgaugguucucccucuguguaccugugcuuugccugagggucaaucuguauccuggguauggaggccaagcaagaggcucugucugaccccuggaaacuaguuacaaauguuuguuagaugucacaugggugcugggaaccaaaccuggguccucuucaagagcaacaaaugcucuuaaccacugagcuaucaucucuuuagccccugcccguuuguauguuuauuugaaaaggggcuuagcauguagcagucuguccuuuuguuuuguuuuguuuuguuuuuuuagagacaggguuucucugugcaguccugacuguccugucacucacucuguagaacaggcugacuuuaaacagauccucugucucucaagugcugggauuaaaggcauccuccaccaggcugcagucugccuuuuauaccaaacuuuuaguguuugaugagaaagaacuaaacaggaaucaaaauuucuauaguuucuuauuuuacauagaaauuuggguuaauuuuguauucuccaagauuugucugugccugauuuucuuuuccccccugagacaggguuucucuguguagcccuggcuguccuggaacucacuuuguagaccaggcuggccucgaacucagaaauccaccugccucugccucccaaaugcugggauuaaaggugugcaccaccacagcccgguguaugccugauuuaaaaaaaaaaauuggggcgugggcagggguagggagauggcaccuucuggggauugaauuuaggaccucacucaugccaggcaagcacucugucacuguucaguguccaguagugggcccuaucuuauacaaaaagaauuaaagcaggcaugaugacgaauuccugucuguaacuccagugcuaaugaggccgaggcaguacaauuaccaguuugacaccagccuaagcuacauaaugagauccugucccaaaaaaaguuugugccgggcgugguggcacacgccuuuaaucccagcauuugggaggcagaggcaggcggauuucugaguucgaggacagccuggucuacaaaguguguuccaggacagccagggcuacacagagaaacccugacucgaaaaaacaaaacagaaaaaaccaaaacaacaacaacaaaaaaaguuuguaucaguuuugagcuggacucuacuggcaggcaggaggccugguuuuaguccccagcauaacaaacacccagugagucuucaaguaaauuugugucucaugaaagauugccauauuuugagguauguacucugaaacagacuuaccucugagguuugccgccuuuucuuagcacugucccauuuuuaaaaacgaaggaauaaucuauacuuaaagaugcagagauuaaucuauacuuaaauaaaauuaaauacuuaaagaaauaaucaauacuuaaagaugcagaucugcuuugagaauuuugggcaguugcagcaacacguagugaaguuagacaugagaacuuuacugucacccuacaagaauccccuucccucuaagagucaagcucucguccaccaguuucaugauguauuaaguuuaccuguucuuacccaggaguucuuuuguggccucucaauggccacguggguuccuuucacaucaguaugucacgguaagauuaccagugcucucuugaccuagcugcacuuucccugccuagucccaggagcccgggcuccuugugcuuucugucuccagagugagggcuccuuccagaggagugccguugcccuguuaaggcauuaagcagagggagagcgaagcaaguguuucaugugacuugagguaauaaacaggugccaugcccagacccguguggcuucuuacuauccucugcuuaccuugacaggucaucuuuggcucuucagggaugcggggacccaugauggacuucugguuaaccaaacggagcuguuugugccaucccucaaugucgauggacagccuauuuuugccaacaucacauugccagguuaauagucaaucuuacauguuucuuuuucuuuagaaauaagaucuagccuucuaacccagguuguccuggagcuauguagcccaaacuggccuugaauuuagaaaacuauuccugggcuuuuuaagugcugcgauuauaggccugagucaccacacuggcccagccuuugaaaaagaggggugagcauuguaaugaauguuaaccuuuaccauagaugaaaugaaaguauuuauuucucuguccuguguugaacaaagaugugccucagacguacuuugguuuccuaagaaguuggcuaagccaggcaucuccuguagcacugugaccucugguuccuuggucuuguuacagacuggugcccugggaucccagaacaaagcacaguaggaccacaugaagauaggucuggcugcucagcccugggaucccagcuacucaggagaggaugagagggcagggggaucacaaggucaagacuacagagccacuuucugagacuaugccucuaaauggaaaguaaaaaugaugcuguggccgggcguccuggccaggcccuuaauccuagagagguggguaaagcucgaauccaggccagccugcucuuaaaaaaaaaaaaaaaaaaaaagugaagaaguguauaaucagaaaagaacauugagcaauuaaauuuugucuuugagcucccugguaacuguuaauuuauuacuauuuuggucuugucuuucuuucuuucuuucuuucuuucuuucuuucuuucuuucuuucuuucucucuuuuucucuuucucuuucuucccuugguguuuuuuguuuguuuguuguuuguuguuuuuuuuuuuugagagagagggucuuauguuucccagacugacuucaaacucacagacauucucucucagacagacauugcugggccucccuaaggcuuaggcccugaguuaccagggucacuuuacauuugauuaguugaaaaaaagcccuggccacuaugaugagccaggugugugcacagugagaccugcugaagugacagugucacauguguuccacucauaguuuacccuccagugagagucacaagguaaaugugacuguuguugcuugguggugucugucuugucaugugaccagagucugccucugaggacuugguuuccuacccuuacaguguauacccugaaagagcggugccuucagguugugcggagccuggucaagccugagaacuacaggagacuggacaucgucaggucacucuaugaggauuuggaggacuacccaagugugcggaaggacauacagcgacugagccaagagcaccuugagagucagcaccuggaagaggagccuugaaggaguccauggagauuaaguguuccugaguuucagccuugaugguccgagauugaucuacacauaggacaggucacuuucuuucaguuuuaaaaugguucauucuuggaguaaaacuauccaucacguaaaagaaaguuaacuaacaucccugggcuuuguaguguuuaagaauaaacaugcaaagugccacugcgucugcccuuuguagagcacucacccgagggaggaagacguuuucaguuuugcuuccuggugaggcuggaaguugaguguaaggaugacuguguaauaagcucagcagcaggaguuguacuguguccuuucauuugagcagagggcucuugcuugggaaggcagagaaggcccuucccaaacgcugggacagaccuccuguggaggcccgcugccuaaagcguggagucuucagucaugaauguuggacgaagaaaccauuggaugcuuggugggagaguugggagggccuggcucuuugucugaggagagccuuaaguguucauguaaggaacagcuuagcagcuucugauuucccacgucccagcacuuucucucuguuuuuuauuuuauuuuugagacuuuuguauagcccaggccagccucagucacucagcagaggauuccugacccucugggauuaugucuccugacauugggaacacaugugugcacacagccugcucugcucuuccuuuucccauguugagacgggcuccugcuguaguccugccuggccugagcuggagucgguccugccuccugaccgaccgucuggcugcuuucuaagcuggguagacuucccauacucacuguuacagacaguuacagcagagaagaaccauccuuguguaagucugguuuugagagcuccugucucugaggaagcuguuggcaggagcagggauuucuguuccuucuugucagccccuagcauuccacuuuguuuuggcaggcgcugguucugcuuuguagguggaagugaagcuccacucagccacagacuccagacagugggucacagagcagucuggaauguguagcagucuuauggauggucacagcuuuucuuacauauucauauucuaucaaacguuuuguaaaguauaauuuuuuauuuauuuuuaauccccuuagagaaaaaguaaaaguagagaagccuggguauuguguacacaacagaaaggacagucaaggaaagggaagcagaaaggcucuuauguacucucagcuucaugcaaccccuguaacuggccgcauauguagggcauauuuuaauugguuaaagcaguuuguuguggcugaggucauaagauauauacaguuuuguauccugauuuuucacugaacuucauuguuuuuuguuugcuugcuuuucccuucuucuuuguuuuuugcuuuauugagauaggguuucucuguagcccaggcuguccuagaacucccuuuguagaccaaacaucugauuacuggccucacauggagagaucugucucugcuuuuccagcgcugggauugaaguaggccuaaucuucaucuaacuucuuagcuugucuuuuccauguuacuacacacacuguguaaauaccagugugcuacccuccuucuuugagggugacuguugggaguauuuguccaaauccugggcuccuugagugcagacugaugcucuaagaucagcaaaaugacugaacuacauccuaacacuucccaguguccucucagugucucuucuuaucugcagcauugcaggagugaaguggccacagaccaguguggaggccugugugugggaagucagcaggugccaagcuauugaaacauugguuuuauuuuuuuaaaccgaucucugucucuaaaagaugugauguuuguguuauucagcuggaaguuugaauacuguucucugugcuguccaacaagugaagaguuaugaaaugagccacuuguccugggacauccuguaaugaguuccucgggcuuuucuccugugaguuuucugaaaaaagcugaccuuuuuaguacaauaaacggugcuaauugaaggaa

SEQ ID NO: 12372 - RNA, 12806 nt, Mus musculus
ucgccucccgcugccgcacuuucacucucgguccaccucgguguccucuugcuguccagcucugcagccuccggcgcgcccucccgcccacgccauggacgccaaggucgucgccgugcuggcccuggugcuggccgcgcucugcaucagugacggugagugcaauccgcggccgggcccgggaaaggcucgcagcucugcgccggagcuccuucggguccgcgguuccucugcccgcgccgaagucgcggagaaagaacucggucggcgccguucacuacaagcgaacuuggggcaguccacuuugcagggcgcacucccaccgggugcccuuucccgugucccacgggucgcaccgagguuuugugcucugcgaagugcggccauaggaccuagagagggcugcaggggaggacccgcaggauuguugggcaagaguggguucggcgcggaauggaagcgugggcgauuguguccggggcuugggccccggagcgcgccagcugcacucagcuagugucuaccggcgcccagauguuuccagaggcgaagggcagcgcggucccggaguugaccgugcaagagguucacucggguggugcgugugucagcaaacucucaaagaccggucaaguagcucgaagugcauggcuuggcuauagguucaguggugaggcugaguuucguccccugcggguguagcguguucucuuacagcacccucgaggggcucagggccaccagcagcgcagcgcagcucuugaacucgcgcugccagccagggccgcgcuucugcacaguucguugguccguagcgacgcggaccugagcacgcgucucuucacugccccuuuuucuucuuacccgggucacuagacaaaggcucagcaguuacccaagcuauaugcacaccucuccccaacccccaaacacaccugcaaacgggcgcuuuuguagccagccccggaguccucagcucuggaaugagagcugcagcggaguucagucucccagacccaggguggugucuucuuucacugggaaagggcuuucauuuuguuuucuuuuuuugacacugaagagaaaacucucagcgcuguuacaagacaccguugcugcaaaacaaaacaaaccauugccucugaacacaaaacaaaauccuacuagucgauccccugccuuccuccgcagugguguuuccuggagagaacugagggacagucggggcucuuggugagacugagcucuaaaugcugcccaaguacaccaacucguucguuuggguucuuucccugugacaacgggguacgggaaugguuggaguugccuaguccgagggaaauguucuguaaaagaauagucaguugcugaucggaguaguaaaaaaaaagaaaugaaaggcaguuucgauuuuuuuuuuuuuuuuuuuuuuuuuuuuuguuaccgagaacacccgggaggcugagccuucccacuggucccccagugccccgucauggagcacauugauuugggcauuaauaauugaaugagcuggugauguugcaagggucacagccucuggcaaguuagguauggggcaagaauguaggacucagguccucaagguuggagugcaauuauccagaguaaaaguugucucacccucaacauauucugacccuaggaagagucggauuguugacagugucuggaucagaccuguucucuaggcaggaccccauugugcugcccgaaugaacuuuuuuaccuccuagugccugugugcccucugaucuuacacagcccucaaguugcagcacggcuaaccuugcugugguuccugucuuuucccaucagcuacuccaacucagaagcuagauaguagacaccggaggcuucuuugguuaaacccagagcagcaggcuugccaggcuuguuagauugaauggaccccugguucccuaagccaagcucucuagauucccaaguccaggguggcagcagagcuggauuagacuuuggucuguaccugaagucugguuuuccuaugcuuuagagucuaaagacacuacccuuccuggggcaugcaucccuuagcuaaauaaugcuugcagaagaagauaaucccaucauauauuuaauucgguccacuucuccagcugcuucccaaaggcagugaacuucagaauacccagaagucuccuggaacucuaaauaagcaaacuuaaaauccuggggcuaacuauucucagucauacuuuuaaacuuuggugaaaagacccauaaauugaaacauuuggggaugcucaguagagcuaggauaaaacccuguuguugggggagcagcuacaaauccagcaguccucaggguuugcaauucuagacuuaaagggugguucuuaaggggggguucuaaaggagccccuugcuaauuuacacuaaugagugucaauuauagcauuuugcaaauuggugaauuggcaaacaaagcugguaauaggauccaggaggccuaggcauccagguagugaccauaaaagccacgguugaccccagcuuuugggaaaagcuggauagaagguaaauccggguccuccccucuggauucuuuugugauuuccagggcuuaggauagggugagugggaggagggaaaacugcaggugguagaagugaagccccccaccuccaggccugcaccagagggccacaagggagcccagaacucugccaccccacuucuccuggguccuuuuguccuuuagaggcugagcccagucagaucucacugugaucccuggccgaggggauggucuuugcaagaaacuuucuguaaccauuccugcugauguuccugagucuuccccacaagagccaccaaacccccugcaccaggcagauaaugacuggccccacuuuucucucuacaccuccucuagguaaaccagucagccugagcuaccgaugccccugccgguucuucgagagccacaucgccagagccaacgucaagcaucugaaaauccucaacacuccaaacugugcccuucagauuguguaaguccuagccgccaucccccaaagaggagcaugguauagaagccucggacuuggcauaacuaggggcagcuguuaccaccaccaccacggggacacugauaugccaucagacauggguuucaaaggauacuuuuguuccccagagcccugauguccucaguguuucucacucuugcuuuccaagcuguuucuugcagcacagugggccgccucucuacagaaaaagccauggacuugauggaggucagcccucagcugacaguugggucugucuugucaguuucaagguucugguguccaaaguuaauccuuucucacauagaaaaaaaaauuacaagacccggauggcacgggggggggggggguucaguuuuacucacuugcacucacuugcucagaggucauuuuuguuuuagaguuuuagaguuugcuggagugugaugguagcugccaguauuugauuuaaauuuaccugggaaauaagaaaagcccaaaaaagguauaaaugaugugaauaucucacucagagucugguagacuuggcagagauguguccugugcuagucuguccugcucacugccccccagcagggguucccauccucgggagacucaacacuaacaacaguauaaggaugcagcagcuggagcaaugcuagccugacggcuuugucacccaacggugacugcuucagacuuucugugcucaucagccuuccucuccagccuccgcugcuguguuauguacaguaggcuuuagagaccuagaugaugaauauuauuuuugcuguuuugauuaaaauacaauacucucccgagaaagggauuuuaaagaugaugaguuuacguuugaauaggcugugcuggugcacugucccgggaagggcccuugaacuuagagggucaaauacaacuauugauucugggugaucacuaaguuaauaaauggcaggauccagacugacaccccugaucccuguugaaguuacaucccucugaacgacuggucaacugcagggcagccugcuugaagaggguuaccugucccuaggacacugaacaggcauuuguuuuuccuagaagacaguucaccagcuggagaggagucgucucccguaguuucuguuugguugcuuuugguuuuuguuugguuuugguuuuuuaauuaucuggcauccaggacuugauggaaaauaaccagagcuaagcucaccgguucaucugcccauuaggaaguucuagggaugggagaaagaacacggcgucaauuaacaaauccacaaagcuaagaccuugaagcauucugugaacuuguaaacgcgcucaggcaaccauuggacaauuugucuagacugcuccuugcccaccugaacugcccuguuccuccccuucuggacuccugccgucuuccuccagagcuaccuuuaagguugucccauguacuaucaaggugcucugucaaaaguucuuaggcugcuucuggcacucuccagaauuuuccaagaccucccccccaccaugauaucagucauccgcgccuucugggugguucuuccuccacacccuuugggcacuuugacuccugugggauauucguccuuccuuuuccuuuagcuuuccucacuugccaagcuccaacuuggccagaagcucaaaugccuccacuguggucucuucucuguguccccugggagacauccuuagcacgucccuaacucugcggugguggucccaacacgauucaagugcuaugucuuccaaaacugaagcuuccgggagcagcagcugggcccugcagugaggaccuuuagcuggguguguugggugagcccacaggaucgcuuucucccgcuuggcuguacagcgucucuccccuuguguuuuggcagugcacggcugaagaacaacaacagacaagugugcauugacccgaaauuaaaguggauccaagaguaccuggagaaagcuuuaaacaaguaagcacaacagcccaaaggacuuuccaguagacccccgaggaaggcugacauccgugggagaugcaagggcagugguggggaggagggccugaacccuggccaggauggccggcgggacagcacugacuggggucaugcuaagguuugccagcauaaagacacuccgccauagcauaugguacgauauugcagcuuauauucaucccugcccucgcccgugcacaauggagcuuuuauaacugggguuuuucuaaggaauuguauuacccuaaccaguuagcuucauccccauucuccucauccucaucuucauuuuaaaaagcagugauuacuucaagggcuguauucaguuugcuuuggagcuucucuuugcccuggggccucugggcacaguuauagacgguggcuuugcagggagcccuagagagaaaccuuccaccagagcagaguccgaggaacgcugcagggcuuguccugcagggggcgcuccucgacagaugccuuguccugagucaacacaagauccggcagagggaggcuccuuuauccaguucagugccagggucgggaagcuuccuuuagaagugaucccugaagcugugcucagagacccuuuccuagccguuccugcucucugcuugccuccaaacgcaugcuucaucugacuuccgcuucucaccucuguagccugacggaccaaugcugcaauggaagggaggagagugauguggggugcccccucccucucuucccuuugcuuuccucucacuugggcccuuugugagauuuuucuuuggccuccuguagaauggagccagaccauccuggauaaugugagaacaugccuagauuuacccacaaaacacaagucugagaauuaaucauaaacggaaguuuaaaugaggauuuggacuuugguaauugucccugaguccuauauauuucaacaguggcucuaugggcucugaucgaauaucagugaugaaaauaauaauaauaauaauaauaacgaauaagccagaaucuugccaugaagccacaguggggauucuggguuccaaucagaaauggagacaagauaaaacuugcauacauucuuaugaucacagacggcccuggugguuuuugguaacuauuuacaaggcauuuuuuuacauauauuuuugugcacuuuuuauguuucuuuggaagacaaauguauuucagaauauauuuguagucaauucauauauuugaaguggagccauaguaaugccaguagauaucucuaugaucuugagcuacuggcaacuuguaaagaaauauauaugacauauaaauguauuguagcuuuccggugucagccacgguguauuuuuccacuuggaaugaaauuguaucaacugugacauuauaugcacuagcaauaaaaugcuaauuguuucaugcuguaaaccuccuaccguaugugggaauuuauuuaccugaaauaaaaucuacuaguuguuagauggagugcacauacauuucugaagauggagaaaaacaggugugccugcugaucaggugcugugggcugcccugcaguccuggugagcgacagacacugaggcaggcuugucucaugaacaggcugccucugcagugaaaguuuuuguguauuuuuuuuaacccaagcuaguuuucuaaugaauaauacuugacucacuaauuuccccuccuccuccuucuccucaguucuccuaacauccucaugugauccccagacucaacuccaguaauaucaagcuuuccuauuuucccauguaaaaaaaucccaugacucugggccauguuaauaucaggcuuuugugggaacagguggccucaccccauaaaucauuaaauaccauucagcuugaaucauuuuaaugugacagucacaaaccaguugcucuaauaaaaacucugcuaaccauccuucuccuuagcucucuagaacaaucucaguuaucccuagggaugcuccccagcauccagaaaagagaagugggaucaaucauccugccuuucucccccuccucucuuggagggcugccugagcccguggccuccaccuccccugcuuuguauaauuugaaaugcagauuuguagugaaggcagaguucaccucugcauugaaagggaaggcaggcccagagcuuccuucccugcccucugagaugugcauuuaugucucaggauggaugagcuuugguaggaaugcucaaaaccaggaccagccagacaaacuggcagucccuguaagcgguucccgggucauaggguuagggcaccccuguuuaacuuugggguggggaaaguaucugguuuucuuugauaaauugcuugugaaccacauuugccaaguggccuccaggccucaaacucaaagaccgagcuaaaucgacucggaaggcaaugcugaaugaagauugugggaacugagauagauacacuccucuauguugcaaugugauuaaugguucuacuaauuuuaucuaagggggcgcagagaagaaaaaguggggaaaaaagaaaagauaggaaaaaagaagcgacagaagaagagaaaggcugcccagaaaaggaaaaacuaguuccccgcuuccugccgauggaccgcagugcgcucugcucuggcgcuuuguaacucgcuccucccucuucgggggcagaccccacacuccgggcaggugcucaaaccugacgguaaacucuucccucuucgggggcagaccccauaccccggggcgggugcuuaggcuuuccugcccugguggccacaccagcugcuguauuuaugugcuucauaaggcccugcucugucugcuaaagcuaugaagaaagaugugcagagacugggguggagacuaagccaaagaggagcugccuagccuggcagcauugccccgagcugagcccccuuggccaggacuucacaaggcucacaccuacaaucccaugaaggccaggguggucugcuuagccaggaaagggcaagugccuuccccucggccacacugccccuuguggccuucucgggacaugugguaacugacuugcucucaggcccacccgcagcuuuuccaaauaccugcagccuucagcccugcugcccugccugugggagcagcuuugacuccaguccagaaggguuucugcagacuguguugggugagacgcagaaaggaugaaaucucagaacacaugucagcugcuucucaggaaaucuuuucuuuggacaauucacuuuagagucuuuaaacgggucucucguggggaggauagaugugcucuggaacuuucugaaggaccagcagcuucagggacucuuagucuguccuuccccacuuuuggucccaacaucccugggauggugugcugucugggcaccacggucuccauccucacuccugagagauuucugccuucugugaguuggguuaaagcucuggaauuaucuacuaucccaauccacuacccucaccuggcaauauuugucuguuuuuguuuguuuguuuguuuguuuuugucuuuugccaguuugaauuagaaggcaaggcucugauuuuaguaguguuuuggaaaaggacuuuuuucuucaccuuccucuuugccucauguguacacacacacacacaucuuguaccccagaccucuggguauaauuuucauaauuggugcagaaagaagaaaugaucugaagauguguuaaauggauugcaggggaaggaaggcccagggcccugugugucaugcccucuuggguuccuaaguucuauguuccuuagagguucuagcauuaaacagauaaagcccuucaugguccuggcugaggaagagucuugcuagggggauucagggaagacccguguuaccagcucuuacccuuuaucuggacagcucuccuacccuguaucuucuccucagaucugaggauagcaggcuggacuauuggugggcaccuuucaagcccagggcuacuguuuguccuguggcagccggcuacagucucgucugaguggccucaucuggacccuuccuguuauuaauaaaacgcuucuggaggccagaucugugcucaagccauaguucugcuuagaaagggaugccccacccuuaccggacacugggaagaacuguuggccccuagaaaccaaaggccaaacugaggcugcccugaguuggaagaccacuuucugaaaugcccauggacucugccucccaaccauucgucucucacuccuagcagagcugucugugcagacuguuucuuaggaggcacagcaagcuccagggaacccucugugcuuaugaagcucgucuggugggcaaccccagcccacuggacagaguccucauggaaaugccugggaagcugauuucaucuaaggauggguugaaguaggaugugcuccugcgacuucucaggcaggugagagggguaguccuuacacugucuagcauaaacgccuuccggaaggaccugcagcuccagagaccaccuccugagcaccaagaccucuucuggugguguggaaccagccaagagauuucaaggaagagugauuauuugaugaaugcuaugggaauggccucuucucuuggaguucugaggccuggggaugcccaggaacacugggcaccugcugcuguuagggccaaugcauagucucagcaccgguguccuaagguuaaggcggugcgccuugucaugugcuccuuguaccaugccaucugugccagugugugucugccucacccugugcuugacauguucacccaucuucucugcuucccgccaccauccagauccucagcggccgccccggcugugcccuucccugcucucccgcucucucaggccucggaaggaagaucgguggcugcgagcugaacuaaggaguagggccuguggcucagcgcuaggccacgcacgcagcaucccaggcauguggugagaaacugccuuaaugugucuccucuguucuugucaacaggaggcucaagaugugagaggugugagucagacgcccgaggaacuuacaggaggagccuaggucugaagucaguguuagggaagggcccauagccacuuccucugcuccugagcagggcugaagccguuugcaagggacuugcuuugcacaguuuugcuguacuuucacauuuuauuauguagcaagauacauggugauuuuuuuuuuuuucauuuagccugauuuuccaacgucauuggugacaggccaaggccacuauguuauuuccuuuguucugguauccuucccuuggaggaccuucucugaguaguggcuccccagguuuguccuuugagcugaggcaggaggcucacccauucuucugaauaggaacuggguguucccaccccccaaggacugcagggcuuucccaagcugaggcaggaacgugaggccagggaagagugagcuucacccucaucccacgcuguccuccucaacccaccaugcucaucauucugucucauccauccauccauccauccauucaucgccauguguccgcaagacugucuccaugacccugaaaaaggacucucgagaugaaauccuuuauucaaaugggacagcaagaaggaaaagccaaugucuggugucucuccccccgccccuacccugcgcgcaucuaugucuuguuuggaauauugucucuucaacccccuguucauguccuucucacucaugaucgaugucuugucugugcacugucucuaacccaaaugcaaaggcugagugugaggugauggccccgagguccagguuguagucauggaaagagcccugcugucucccuucucagggggcccauuuuagacacacaaagcccaaagaaaggugguuugcaacagugcuuagcucgagccuccauauuuccauaacuguuagcuuaaaacugugggguuuuaccuuccuggaaccaaaugcauucuucuguugaggaguaacaggucucaauucuuuucaauuaauuuuaaaagucaaucacuaagagcaucggcuuugggcccugaugggcaggcauuucccuggaaagggggugaacuaccuaccucuccucaagacagccgaagggugggauuggugccgcucugggaagcguggccccaggaguuuuguccucugcaguuuuuaaugcaaguucacugccacuuugacaaaagcccaauuagaagccagucucuaguuccuuaaacaaaacagacagaguaaggaaaggaaggaggguggcagccagcuggcuggacacucgagaaagacggggaaguaagcuacagaaagauagucuucaaaaacagguguuugagagugaauacucuguagaauuguuaguggggugugugugguggugguggggggauuucuacaaaauaguccuuuaaguugaguuuacagcagaugaaaaauccaaccagcaaaauuuugaucaaauuugaacaaaaacccaaaaaccuaaaacuguugagcagguugcgaugaggagcacagggcuagcugcagagcuggauccucaggaggauagcgaauuauuuucaacccuggaauagaaaccacacacuggcuugcugugcaccagccacuuugcaucuaauccaagcuuugaaggguguugcuugggaggaaacaaauacagccuuccaucuucacuccaguuagggauccuuucaaagucuccuucacagugaggaaaaagagaaggguagaaacuuuagggagccggauuuguguaucaauuccuccgcugacagucaguuucuagauggagacagccugcuuaaagcaaauccgaauuuaaauaggacauuuacaucggaaaagucucucccuaccuuaaucccccauucucuugcuuucaaaauacaagcacagcaguccuugaauggcuguugacccagggcaccuagcugucccugcugguccuggggcugccagaauucccuugggcgccaagcaaccugccagguagccagucccucuguuacaagccuuugcaucuggauagggaaagggguggagacauacagucugcuuuguguugaaacccagauuuguacccuguguuuauacacugcugcuggcucccgaggacagugggacuuuagcaaggaagugcagccgagggguaaagagcccucugguucauugccugaucggcuuugagagaggguuuggagggcaaggggcugcauuccucugagggacuuggccugaggccuuucgggccucuccaguggguucuguuuauccucucaugggugauuaucucaguggugucaccaggggcuuccucccagaagucagucauccccaggccgugcacccuuuucagcuggaugagagccagggaugcauucucuccaaacagcuacccuggcccauuuuaagguaaucucauucuucaaaauguuccauagaauccuccaaauucccccagcagacuucuacccucgccaaguucccaaaacccacucagcaaaguugccaaccucgacgggcuagcagugucuaagcagcgauggguucaguguuguguguggugaauacuguauuuuguuucaguucugucucccagauaaugugaaaacgguccaggagaaggcagcuuccuauaugcagcgugugcuuucuuauucuuauuuuuaauauaugacaguuauuugagaagccauuucuacuuugaagucauuaucgaugaaagugauguaucuucaccuaccauuuuccuaauaaaguucuguauucaaauaua

SEQ ID NO: 12373 - RNA, 12806 nt, Mus musculus
uauauuugaauacagaacuuuauuaggaaaaugguaggugaagauacaucacuuucaucgauaaugacuucaaaguagaaauggcuucucaaauaacugucauauauuaaaaauaagaauaagaaagcacacgcugcauauaggaagcugccuucuccuggaccguuuucacauuaucugggagacagaacugaaacaaaauacaguauucaccacacacaacacugaacccaucgcugcuuagacacugcuagcccgucgagguuggcaacuuugcugaguggguuuugggaacuuggcgaggguagaagucugcugggggaauuuggaggauucuauggaacauuuugaagaaugagauuaccuuaaaaugggccaggguagcuguuuggagagaaugcaucccuggcucucauccagcugaaaagggugcacggccuggggaugacugacuucugggaggaagccccuggugacaccacugagauaaucacccaugagaggauaaacagaacccacuggagaggcccgaaaggccucaggccaagucccucagaggaaugcagccccuugcccuccaaacccucucucaaagccgaucaggcaaugaaccagagggcucuuuaccccucggcugcacuuccuugcuaaagucccacuguccucgggagccagcagcaguguauaaacacaggguacaaaucuggguuucaacacaaagcagacuguaugucuccaccccuuucccuauccagaugcaaaggcuuguaacagagggacuggcuaccuggcagguugcuuggcgcccaagggaauucuggcagccccaggaccagcagggacagcuaggugcccugggucaacagccauucaaggacugcugugcuuguauuuugaaagcaagagaaugggggauuaagguagggagagacuuuuccgauguaaauguccuauuuaaauucggauuugcuuuaagcaggcugucuccaucuagaaacugacugucagcggaggaauugauacacaaauccggcucccuaaaguuucuacccuucucuuuuuccucacugugaaggagacuuugaaaggaucccuaacuggagugaagauggaaggcuguauuuguuuccucccaagcaacacccuucaaagcuuggauuagaugcaaaguggcuggugcacagcaagccagugugugguuucuauuccaggguugaaaauaauucgcuauccuccugaggauccagcucugcagcuagcccugugcuccucaucgcaaccugcucaacaguuuuagguuuuuggguuuuuguucaaauuugaucaaaauuuugcugguuggauuuuucaucugcuguaaacucaacuuaaaggacuauuuuguagaaauccccccaccaccaccacacacaccccacuaacaauucuacagaguauucacucucaaacaccuguuuuugaagacuaucuuucuguagcuuacuuccccgucuuucucgaguguccagccagcuggcugccacccuccuuccuuuccuuacucugucuguuuuguuuaaggaacuagagacuggcuucuaauugggcuuuugucaaaguggcagugaacuugcauuaaaaacugcagaggacaaaacuccuggggccacgcuucccagagcggcaccaaucccacccuucggcugucuugaggagagguagguaguucacccccuuuccagggaaaugccugcccaucagggcccaaagccgaugcucuuagugauugacuuuuaaaauuaauugaaaagaauugagaccuguuacuccucaacagaagaaugcauuugguuccaggaagguaaaaccccacaguuuuaagcuaacaguuauggaaauauggaggcucgagcuaagcacuguugcaaaccaccuuucuuugggcuuugugugucuaaaaugggcccccugagaagggagacagcagggcucuuuccaugacuacaaccuggaccucggggccaucaccucacacucagccuuugcauuuggguuagagacagugcacagacaagacaucgaucaugagugagaaggacaugaacaggggguugaagagacaauauuccaaacaagacauagaugcgcgcaggguaggggcggggggagagacaccagacauuggcuuuuccuucuugcugucccauuugaauaaaggauuucaucucgagaguccuuuuucagggucauggagacagucuugcggacacauggcgaugaauggauggauggauggauggaugagacagaaugaugagcaugguggguugaggaggacagcgugggaugagggugaagcucacucuucccuggccucacguuccugccucagcuugggaaagcccugcaguccuuggggggugggaacacccaguuccuauucagaagaaugggugagccuccugccucagcucaaaggacaaaccuggggagccacuacucagagaagguccuccaagggaaggauaccagaacaaaggaaauaacauaguggccuuggccugucaccaaugacguuggaaaaucaggcuaaaugaaaaaaaaaaaaaucaccauguaucuugcuacauaauaaaaugugaaaguacagcaaaacugugcaaagcaagucccuugcaaacggcuucagcccugcucaggagcagaggaaguggcuaugggcccuucccuaacacugacuucagaccuaggcuccuccuguaaguuccucgggcgucugacucacaccucucacaucuugagccuccuguugacaagaacagaggagacacauuaaggcaguuucucaccacaugccugggaugcugcgugcguggccuagcgcugagccacaggcccuacuccuuaguucagcucgcagccaccgaucuuccuuccgaggccugagagagcgggagagcagggaagggcacagccggggcggccgcugaggaucuggaugguggcgggaagcagagaagaugggugaacaugucaagcacagggugaggcagacacacacuggcacagauggcaugguacaaggagcacaugacaaggcgcaccgccuuaaccuuaggacaccggugcugagacuaugcauuggcccuaacagcagcaggugcccaguguuccugggcauccccaggccucagaacuccaagagaagaggccauucccauagcauucaucaaauaaucacucuuccuugaaaucucuuggcugguuccacaccaccagaagaggucuuggugcucaggagguggucucuggagcugcagguccuuccggaaggcguuuaugcuagacaguguaaggacuaccccucucaccugccugagaagucgcaggagcacauccuacuucaacccauccuuagaugaaaucagcuucccaggcauuuccaugaggacucuguccagugggcugggguugcccaccagacgagcuucauaagcacagaggguucccuggagcuugcugugccuccuaagaaacagucugcacagacagcucugcuaggagugagagacgaaugguugggaggcagaguccaugggcauuucagaaaguggucuuccaacucagggcagccucaguuuggccuuugguuucuaggggccaacaguucuucccaguguccgguaaggguggggcaucccuuucuaagcagaacuauggcuugagcacagaucuggccuccagaagcguuuuauuaauaacaggaaggguccagaugaggccacucagacgagacuguagccggcugccacaggacaaacaguagcccugggcuugaaaggugcccaccaauaguccagccugcuauccucagaucugaggagaagauacaggguaggagagcuguccagauaaaggguaagagcugguaacacgggucuucccugaaucccccuagcaagacucuuccucagccaggaccaugaagggcuuuaucuguuuaaugcuagaaccucuaaggaacauagaacuuaggaacccaagagggcaugacacacagggcccugggccuuccuuccccugcaauccauuuaacacaucuucagaucauuucuucuuucugcaccaauuaugaaaauuauacccagaggucugggguacaagauguguguguguguguacacaugaggcaaagaggaaggugaagaaaaaaguccuuuuccaaaacacuacuaaaaucagagccuugccuucuaauucaaacuggcaaaagacaaaaacaaacaaacaaacaaacaaaaacagacaaauauugccaggugaggguaguggauugggauaguagauaauuccagagcuuuaacccaacucacagaaggcagaaaucucucaggagugaggauggagaccguggugcccagacagcacaccaucccagggauguugggaccaaaaguggggaaggacagacuaagagucccugaagcugcugguccuucagaaaguuccagagcacaucuauccuccccacgagagacccguuuaaagacucuaaagugaauuguccaaagaaaagauuuccugagaagcagcugacauguguucugagauuucauccuuucugcgucucacccaacacagucugcagaaacccuucuggacuggagucaaagcugcucccacaggcagggcagcagggcugaaggcugcagguauuuggaaaagcugcgggugggccugagagcaagucaguuaccacaugucccgagaaggccacaaggggcaguguggccgaggggaaggcacuugcccuuuccuggcuaagcagaccacccuggccuucaugggauuguaggugugagccuugugaaguccuggccaagggggcucagcucggggcaaugcugccaggcuaggcagcuccucuuuggcuuagucuccaccccagucucugcacaucuuucuucauagcuuuagcagacagagcagggccuuaugaagcacauaaauacagcagcugguguggccaccagggcaggaaagccuaagcacccgccccgggguauggggucugcccccgaagagggaagaguuuaccgucagguuugagcaccugcccggaguguggggucugcccccgaagagggaggagcgaguuacaaagcgccagagcagagcgcacugcgguccaucggcaggaagcggggaacuaguuuuuccuuuucugggcagccuuucucuucuucugucgcuucuuuuuuccuaucuuuucuuuuuuccccacuuuuucuucucugcgcccccuuagauaaaauuaguagaaccauuaaucacauugcaacauagaggaguguaucuaucucaguucccacaaucuucauucagcauugccuuccgagucgauuuagcucggucuuugaguuugaggccuggaggccacuuggcaaaugugguucacaagcaauuuaucaaagaaaaccagauacuuuccccaccccaaaguuaaacaggggugcccuaacccuaugacccgggaaccgcuuacagggacugccaguuugucuggcugguccugguuuugagcauuccuaccaaagcucauccauccugagacauaaaugcacaucucagagggcagggaaggaagcucugggccugccuucccuuucaaugcagaggugaacucugccuucacuacaaaucugcauuucaaauuauacaaagcaggggagguggaggccacgggcucaggcagcccuccaagagaggagggggagaaaggcaggaugauugaucccacuucucuuuucuggaugcuggggagcaucccuagggauaacugagauuguucuagagagcuaaggagaaggaugguuagcagaguuuuuauuagagcaacugguuugugacugucacauuaaaaugauucaagcugaaugguauuuaaugauuuauggggugaggccaccuguucccacaaaagccugauauuaacauggcccagagucaugggauuuuuuuacaugggaaaauaggaaagcuugauauuacuggaguugagucuggggaucacaugaggauguuaggagaacugaggagaaggaggaggaggggaaauuagugagucaaguauuauucauuagaaaacuagcuuggguuaaaaaaaauacacaaaaacuuucacugcagaggcagccuguucaugagacaagccugccucagugucugucgcucaccaggacugcagggcagcccacagcaccugaucagcaggcacaccuguuuuucuccaucuucagaaauguaugugcacuccaucuaacaacuaguagauuuuauuucagguaaauaaauucccacauacgguaggagguuuacagcaugaaacaauuagcauuuuauugcuagugcauauaaugucacaguugauacaauuucauuccaaguggaaaaauacaccguggcugacaccggaaagcuacaauacauuuauaugucauauauauuucuuuacaaguugccaguagcucaagaucauagagauaucuacuggcauuacuauggcuccacuucaaauauaugaauugacuacaaauauauucugaaauacauuugucuuccaaagaaacauaaaaagugcacaaaaauauauguaaaaaaaugccuuguaaauaguuaccaaaaaccaccagggccgucugugaucauaagaauguaugcaaguuuuaucuugucuccauuucugauuggaacccagaauccccacuguggcuucauggcaagauucuggcuuauucguuauuauuauuauuauuauuauuuucaucacugauauucgaucagagcccauagagccacuguugaaauauauaggacucagggacaauuaccaaaguccaaauccucauuuaaacuuccguuuaugauuaauucucagacuuguguuuuguggguaaaucuaggcauguucucacauuauccaggauggucuggcuccauucuacaggaggccaaagaaaaaucucacaaagggcccaagugagaggaaagcaaagggaagagagggagggggcaccccacaucacucuccucccuuccauugcagcauugguccgucaggcuacagaggugagaagcggaagucagaugaagcaugcguuuggaggcaagcagagagcaggaacggcuaggaaagggucucugagcacagcuucagggaucacuucuaaaggaagcuucccgacccuggcacugaacuggauaaaggagccucccucugccggaucuuguguugacucaggacaaggcaucugucgaggagcgcccccugcaggacaagcccugcagcguuccucggacucugcucugguggaagguuucucucuagggcucccugcaaagccaccgucuauaacugugcccagaggccccagggcaaagagaagcuccaaagcaaacugaauacagcccuugaaguaaucacugcuuuuuaaaaugaagaugaggaugaggagaauggggaugaagcuaacugguuaggguaauacaauuccuuagaaaaaccccaguuauaaaagcuccauugugcacgggcgagggcagggaugaauauaagcugcaauaucguaccauaugcuauggcggagugucuuuaugcuggcaaaccuuagcaugaccccagucagugcugucccgccggccauccuggccaggguucaggcccuccuccccaccacugcccuugcaucucccacggaugucagccuuccucgggggucuacuggaaaguccuuugggcuguugugcuuacuuguuuaaagcuuucuccagguacucuuggauccacuuuaauuucgggucaaugcacacuugucuguuguuguucuucagccgugcacugccaaaacacaaggggagagacgcuguacagccaagcgggagaaagcgauccugugggcucacccaacacacccagcuaaagguccucacugcagggcccagcugcugcucccggaagcuucaguuuuggaagacauagcacuugaaucguguugggaccaccaccgcagaguuagggacgugcuaaggaugucucccaggggacacagagaagagaccacaguggaggcauuugagcuucuggccaaguuggagcuuggcaagugaggaaagcuaaaggaaaaggaaggacgaauaucccacaggagucaaagugcccaaaggguguggaggaagaaccacccagaaggcgcggaugacugauaucauggugggggggaggucuuggaaaauucuggagagugccagaagcagccuaagaacuuuugacagagcaccuugauaguacaugggacaaccuuaaagguagcucuggaggaagacggcaggaguccagaaggggaggaacagggcaguucaggugggcaaggagcagucuagacaaauuguccaaugguugccugagcgcguuuacaaguucacagaaugcuucaaggucuuagcuuuguggauuuguuaauugacgccguguucuuucucccaucccuagaacuuccuaaugggcagaugaaccggugagcuuagcucugguuauuuuccaucaaguccuggaugccagauaauuaaaaaaccaaaaccaaacaaaaaccaaaagcaaccaaacagaaacuacgggagacgacuccucuccagcuggugaacugucuucuaggaaaaacaaaugccuguucaguguccuagggacagguaacccucuucaagcaggcugcccugcaguugaccagucguucagagggauguaacuucaacagggaucaggggugucagucuggauccugccauuuauuaacuuagugaucacccagaaucaauaguuguauuugacccucuaaguucaagggcccuucccgggacagugcaccagcacagccuauucaaacguaaacucaucaucuuuaaaaucccuuucucgggagaguauuguauuuuaaucaaaacagcaaaaauaauauucaucaucuaggucucuaaagccuacuguacauaacacagcagcggaggcuggagaggaaggcugaugagcacagaaagucugaagcagucaccguugggugacaaagccgucaggcuagcauugcuccagcugcugcauccuuauacuguuguuaguguugagucucccgaggaugggaaccccugcuggggggcagugagcaggacagacuagcacaggacacaucucugccaagucuaccagacucugagugagauauucacaucauuuauaccuuuuuugggcuuuucuuauuucccagguaaauuuaaaucaaauacuggcagcuaccaucacacuccagcaaacucuaaaacucuaaaacaaaaaugaccucugagcaagugagugcaagugaguaaaacugaaccccccccccccccgugccauccgggucuuguaauuuuuuuuucuaugugagaaaggauuaacuuuggacaccagaaccuugaaacugacaagacagacccaacugucagcugagggcugaccuccaucaaguccauggcuuuuucuguagagaggcggcccacugugcugcaagaaacagcuuggaaagcaagagugagaaacacugaggacaucagggcucuggggaacaaaaguauccuuugaaacccaugucugauggcauaucaguguccccguggugguggugguaacagcugccccuaguuaugccaaguccgaggcuucuauaccaugcuccucuuugggggauggcggcuaggacuuacacaaucugaagggcacaguuuggaguguugaggauuuucagaugcuugacguuggcucuggcgauguggcucucgaagaaccggcaggggcaucgguagcucaggcugacugguuuaccuagaggagguguagagagaaaaguggggccagucauuaucugccuggugcaggggguuugguggcucuuguggggaagacucaggaacaucagcaggaaugguuacagaaaguuucuugcaaagaccauccccucggccagggaucacagugagaucugacugggcucagccucuaaaggacaaaaggacccaggagaagugggguggcagaguucugggcucccuuguggcccucuggugcaggccuggagguggggggcuucacuucuaccaccugcaguuuucccuccucccacucacccuauccuaagcccuggaaaucacaaaagaauccagaggggaggacccggauuuaccuucuauccagcuuuucccaaaagcuggggucaaccguggcuuuuauggucacuaccuggaugccuaggccuccuggauccuauuaccagcuuuguuugccaauucaccaauuugcaaaaugcuauaauugacacucauuaguguaaauuagcaaggggcuccuuuagaacccccccuuaagaaccacccuuuaagucuagaauugcaaacccugaggacugcuggauuuguagcugcucccccaacaacaggguuuuauccuagcucuacugagcauccccaaauguuucaauuuaugggucuuuucaccaaaguuuaaaaguaugacugagaauaguuagccccaggauuuuaaguuugcuuauuuagaguuccaggagacuucuggguauucugaaguucacugccuuugggaagcagcuggagaaguggaccgaauuaaauauaugaugggauuaucuucuucugcaagcauuauuuagcuaagggaugcaugccccaggaaggguagugucuuuagacucuaaagcauaggaaaaccagacuucagguacagaccaaagucuaauccagcucugcugccacccuggacuugggaaucuagagagcuuggcuuagggaaccagggguccauucaaucuaacaagccuggcaagccugcugcucuggguuuaaccaaagaagccuccggugucuacuaucuagcuucugaguuggaguagcugaugggaaaagacaggaaccacagcaagguuagccgugcugcaacuugagggcuguguaagaucagagggcacacaggcacuaggagguaaaaaaguucauucgggcagcacaaugggguccugccuagagaacaggucugauccagacacugucaacaauccgacucuuccuagggucagaauauguugagggugagacaacuuuuacucuggauaauugcacuccaaccuugaggaccugaguccuacauucuugccccauaccuaacuugccagaggcugugacccuugcaacaucaccagcucauucaauuauuaaugcccaaaucaaugugcuccaugacggggcacugggggaccagugggaaggcucagccucccggguguucucgguaacaaaaaaaaaaaaaaaaaaaaaaaaaaaaaucgaaacugccuuucauuucuuuuuuuuuacuacuccgaucagcaacugacuauucuuuuacagaacauuucccucggacuaggcaacuccaaccauucccguaccccguugucacagggaaagaacccaaacgaacgaguugguguacuugggcagcauuuagagcucagucucaccaagagccccgacugucccucaguucucuccaggaaacaccacugcggaggaaggcaggggaucgacuaguaggauuuuguuuuguguucagaggcaaugguuuguuuuguuuugcagcaacggugucuuguaacagcgcugagaguuuucucuucagugucaaaaaaagaaaacaaaaugaaagcccuuucccagugaaagaagacaccacccugggucugggagacugaacuccgcugcagcucucauuccagagcugaggacuccggggcuggcuacaaaagcgcccguuugcagguguguuuggggguuggggagaggugugcauauagcuuggguaacugcugagccuuugucuagugacccggguaagaagaaaaaggggcagugaagagacgcgugcucagguccgcgucgcuacggaccaacgaacugugcagaagcgcggcccuggcuggcagcgcgaguucaagagcugcgcugcgcugcugguggcccugagccccucgagggugcuguaagagaacacgcuacacccgcaggggacgaaacucagccucaccacugaaccuauagccaagccaugcacuucgagcuacuugaccggucuuugagaguuugcugacacacgcaccacccgagugaaccucuugcacggucaacuccgggaccgcgcugcccuucgccucuggaaacaucugggcgccgguagacacuagcugagugcagcuggcgcgcuccggggcccaagccccggacacaaucgcccacgcuuccauuccgcgccgaacccacucuugcccaacaauccugcggguccuccccugcagcccucucuagguccuauggccgcacuucgcagagcacaaaaccucggugcgacccgugggacacgggaaagggcacccggugggagugcgcccugcaaaguggacugccccaaguucgcuuguagugaacggcgccgaccgaguucuuucuccgcgacuucggcgcgggcagaggaaccgcggacccgaaggagcuccggcgcagagcugcgagccuuucccgggcccggccgcggauugcacucaccgucacugaugcagagcgcggccagcaccagggccagcacggcgacgaccuuggcguccauggcgugggcgggagggcgcgccggaggcugcagagcuggacagcaagaggacaccgagguggaccgagagugaaagugcggcagcgggaggcga

SEQ ID NO: 12374 - RNA, 4658 nt, Mus musculus
ggcuuuaaguaauaaaaauuuuauugagaauuccuggcauggugguuaucucccccacucugggagaggcucaaggcuguaggaaaucacggagaaaucacauugucccaccccgcuucccagccaacacaggaaggaggaaagccucugaaagggcuggucucagucuuccuuaauccaagagggcagauacagaaaaguccaucacaugaugccuggggcagggugggcugugcuugacccccgagcuggcuccuccaagcuggacaagugugccaacuucucugguggugggguucuugauguccacacucauuucuuacccuuaaugaggcugucacuggagaacaaagggaacauuccuauuaucggggauguaagugugaggugcacaacaccccaaaccacagcuucuuccuaaauaaaggccugacaauggggagaaaggggguguaggggcagguccaggaagcagauggcccccaggaccccauagcaaggaggcagccacuuaccuuccccugcaaccagcaugccaugaagugagcaggaaauaugugaaaagagaaauaaaucguuagucagcuacaggcucagcugcuccagacccgcacuccccagugaggacggcucuuugccacuaucugugcggucccagcaacgugggucucacgugaaauugcuaccagucgucacuucucauuuagauauuuauaaagugccuuucccauaagacauccugcuuugcuuuauaaagucaguccuagaagaugcaagauaggaacugccaaccagacugacacccacuuuucugacugguguucagagaaacuguccacggcccugguaacuagauaguccaggauccaggguaguggacgggugcuuugcucucuggacagugggaucucuuaccgaguaaaacuuucauccuguagauucagcacaagguugucagcugugagauagauucgguucugugauguggcgaucuacaggacauggaacagacguguuaacaggcuucaagucuuugauucaauggccacccaguggaagacacaguaacagaacaggcuccugcucuaguacaaagacccgaugcaagaaggcuuagugucauagcucuguaacagccauaaacaaaacccggggagcacuguggggucggucacucugcaggaggaagggugcccaaagacauuguuuaaguagaaacucaagccaguucuaaugccacugugugacuguguagcagcccuuggauggugaagccuuccacucaccguuuuagagauguucugggcggcccggaucuuucggagcuugauauagccaggauucuugcucagugcuucuccaaggugagcagacaggguuaaggguucuucugggccagguuacauugguggcaagcucccucugcccucgaauccccugggcugucagauucaagguugcgcucacauggcuacucacauguuggcuacccccugugggccucccuacaggaugcugccaguacuguguggcagcugacaugagggcaaggccaguagugcuauugaucuggccuuacagcagggagucaggccuuagguacccccaccaagauuucagaucucaccaguuguccccccccccccaacccccauucccaagccaagaaagagucaguaggccaagucgcauucgccuuggucucaucaaccggcccaugguggaagaugggaaacaggcugaccccgggaugaggccacgcucugugcaacacaaggauaucaucuuggcagccuccgccucccccucagccugcacaaucuucugucgcuguuccugcuucgcuuucuccaccaaaaacugggcccgcugggcuuccugcugggcuguggauuaagugugagguguaagaagcccaagaacauguagccccccuccucccaccuccagaagccccccgaccagugccugccuccauggacuuacccacuugcuuggcuucuacagcagcuguguacucucggcugaagcucagcucugugauagcuacaucauccaggaugaggcugaaguccuuggcgcgcucugucagcucucuucggaucaacagggacaccugggggcaugggucgggaggggaagggaggcuugguuugaggggaucagagaacuggaaggaaggugguggcauugcuguaaccaucugaacaccggagcuccugaauaugggcagcaaacccaccacuuaaguccucaaacauucacuagaaaaaacuugguuccauuucuuccugugacagccguggcaucaccagacugccccacaucacacugagaccuaaucucuucuuuucaguuuaugcaucucuuuaguuuccaguuaacggaggaagaccuucuguggagauguaaggcaauacugccacuuucuguacuaugcuuccuucuuagggucgacuggugucagguucuaccguuuuucuccucauuucccacagucacagcacagcuuucccacaguccaugcagcuaaggauaaccuuaaaccccugauccccuugccucuaccucgagugcuaggauuacaggcaugugccacaccugguuuaagcaaugcuugagaauaaaaccagggcuugugcauguuaggcaaguacauaucaacugaacuacagauccgucccaccccaucccgaaauaccuucuuucaguacccaguaacccugaccaaggagagacacaggcugccgccgugcagacagugauaggagucagaccugagcccgcugggugaucagcugcgaggcauugaacuuggccaccacacucuugagcaccucauuaacaauggacggcagcacucgcuccucauaguccagcccuagacgcugguacaugcuggggagcuccugggcauugggucgggacagcacacgcagggagauguucaccaucugcaggucugagggaagaggucagcaguggccgccggguaaggccaaauucccccuuuuccagcgcuuucuccuaggagugcuucccaccaugccuaguguuacuguacagccuagcacuccagcaggaagauagucaugucaacacagagcaugugaacaacauggaugggcgaggcagacccuuguuuacuguggaaucuuuucuauggaccuuccaccaguacagcuauuuuuuuuuuuuuuuaauaaauugcuacuccuccuccaaaguggauuccaccaagcagcauaaucuuggguuucccccuugccauuagggccuugagaaccagaacuguguuuuauuuccaaggccuauggcuuagcaaacgcauaaaccacacacaccacaaacagcaacagagaagcacacuucugugggcuacuugccucgguguguacaugggaaugaggcccaggcuuggggaaucucaaaggcaggccuucuaacuauggucuacagggcaacagcuagugaagagugggggcacuuucuccagagcaagguguacuguggauguaaucaacaaaucaacagaaaaaaaaaaaggccuuaaaaacagacuuggaccuaggcagccaggaagaaaggcaacucuuaucccuuuuaugcuaggcagaagguaacguuaaaacgugcaugcaugccaaguacuggaaugcaccguuuuuugaaccgugaggcauggcucuuuugcagacguagaaaccaagaccucagaaacacaaccaauucuggcagccuggccaggcucauuuuacauuuguuuccccacgugcccugaggcucccaguugcccacguuuaccuuuggagccugugggggaggagauuuuucgaggucuggcccgaaugucauagaugaugggguacuggaaccaggggauccuggagaggagaggucauggacaggaguugggaaacugcaguuuuauugauuuugaugguuccccucaccacucguccuugggccuguuccuccccacgaccacaaggacucuucccagucgagaacagcccuuuaugcauugcuggaguuucaggcagccacuguccucaagagcaggcgugaggaagggguaaagcagcuccgaauuguuaagucuggcugcagccgucaagggugaagggucagggccuguucgcucugcccgccauuaccugaagugaaggccuucggccaggaucguguccugcugcacgccaccaauacgauuaaaaaagauggcucuaugaccgccuuccacugcggagagaggggugggagucagggcaggcuacuggcccgagugcuggucagcguaggugggacggggacaccugggggauagcaggaccgugggucuggggaccgcaacguccggccagcggaaggaggcugcucaccggugaacacggauucgcggacgccguaggccaccgccccggcccccagcagcagcuucagcgccgugcccaugccccgaggcccggcgggcaggcguccagcuaaguccuucaaguucugggccaugucugauccucccgaaggcggcggcggcggcaccagcggucaggagggggugcccgccagccucugccccgcuccagcuuacagaccucgccuugcacacgaggaucggcggccuuagagcucgcgggagaaagggcaccggaagugcg

SEQ ID NO: 12375 - RNA, 9418 nt, Mus musculus
uguuuugcuucaagauggcugcugggauguauuuggaacauuaucuggacaguaagagccaacuggagaagggggucaugggccauagagugguguagaggguccagguugacagacuucauggccccgagguucugguagccugaagaucacaggaaaaggguuccgugggaagauuuauucgagggggaagagggagggggcggggcagugggcuuagaggccucgcucaagaucuggacgagggaagggcugcuccgugggaucagggcugggcuuuaaaggguuagggguagcaggaaaguaguugcugacucaguucuugaggguagauuuuuuuuccccccuaaguugugcagcgucguuacuuacgcacugccauuuggagcagcugcagauauucgaccuaauuccuuuagucauuuauaucucaaaaguugcuccucauuaagcuugcuggguggaauagagcgaccacugaguugaucgcugaaaugcuuuacuuuaugagcaaaauccaguucucaaaaaaugaggaauaugucugucugucugucuccucgccucccuggucuucccccucccccgucguguguguguguauguguguauagagacugggaagugagaaaucggcuggggauauauuagacuuuuaggcaacucuuaaccugggcaucuuaaaauagagcauugauuuuaauaaaagaaaguaacugaucaaauaaugguagcaguccaaaucagaagugcagaccuggucuuagagaaugacagaaaguuuuagauauuaaacauggcacaccuuuaaucccagcacuugggaggcagaggcgggcggauuucuaaguucguggccagccaggucuacaguuuguuccaggacagccagagcuacacagagaagcccugucucaaaaacaaacaaacaaaaaaagauauugaacauggcaagauugauugaaugacuuugcgauugagagagaaggaaaauccaaggugaauucugcuuggaaaauaaacuaucuaaucagcaguguaggagauucuggaguaauaacaauacauuagucuuugccuuagaaauaggcauucaaucugacagugagauuauucaggaaaaaacuucagacaguaaaaaagacacugagcucaagaaagcagcauuuaaaggauaagauguagugguucacgccuuuaauuccagcacucgggaggcagaggcaggcggauuucugaguucaaggccagucuagucuacaaagugaguuccaggacagccaaggcuacacagagaaacccugucucgggagaaaaaaaaaugucgaugcuggcaauaccagaaggccucugaccuaguauucacugcuaggaggaaguaaguuacuugaacgagaagguggugccgacugccucgggaaagaugagucaucugauuugguaaucuguugugacuaguaauccuagugaacugcugucacagacuuaagaagcccccucuuguuuugucuuuucagacagugucugauuuagcccagguugaccuugaacuccaggcccuccuucuaucuccacagugcuauugauuauaagcaccaagccauauucaguacaaacauuuuuuuacauuugaguucgacuuacagaaacacaaguuuggguagcacauaccuuuaaucccagcacuuggaaagaucucugaguuugagaccagccugguauuauaaggugagaucucggcccgccauggcuacauaaugaaagccugucuuuauguuuauauaggagaugacacuagaccacuugccuaacaaggggcagccccugggauugaaguucagucugccccaccacagggagcgagagagugagguuaagcucuguagagaaaauuugcuuuuguggagaagcuuaacuaauaauacguuuauucaauuauuuauuugacacuuucuaaacaugaggggaauuuaaaauuugauccaggcaugugucuccuggaagguuagggagacauacccaaaguaacuauuaguuauuucguuaugguuggauaaauacuaaaaauacuggcuagacuaucucuuuuuuuuguuuuuuuuucauuuugguuuuuuucgagacaggguuucucuguguaggccuggcuguccuggaacucuuuguagaccaggcuggccucgaacucagaaaaccgccugccucugccucccgaguguugggaugaaaggcaugcgccaccaaacccggcucuagcuagacuaucuugacagccugucuauguaaggcauuuguccgagucugggaaaguccgguucugaaacugcacuuugaagaaugagaagaaguggagugggggaagcagguacugugugggugggaugaggaagccaggacuccuggaaaguugcugacaagugugaggcgcuuagaaggccaguguguuaucagagagagcaagaagauggcaaggcugagugagcuaagccagauaggaaguguggaacacagccuuaaguuacuggacgguuacagaacgcaugaugagugcuaaaguugagagcaaagaagauggagguugaagcuaaaagagagaaagcugguuuauagaauaaggucaccaaauaagaagagguuaggaggcuugcagagacaggaggcuagcugaaaaagagguuuccccuuuugagaaagggugaaugaauccugucacaaauaaaucccucauuucaggcugggcauggagcucaguugguagaaugacugccuggcaugcaagggcccugagguuugauccccaacacuguauacagcuggcauaggacuauuaacacuggacuauuaggagccaacacaugacaagaaucagaauuuuauuguuggucaucguuggcuacaaagcaaguuugaggccagccuggccuacagagacccuguccaaaaaaaaaaaaaaaaaaaaaaaacuuaaaaaaagaaacaaacaaacaaaagcaagaaaaaacuccaguuucagaugaggggaaaacugaaucacacuccauuuuauauauauaugcauauauauuuuuuuuuaaguuuuuuguauuauuauacauaaguacacuguagcugucuucagacgcaccagaagagggcaucagaucucauuagggauggcugugagccaccaugugguugcugggauuugaacucaggaccuuuggaagagcagucggugcucuuaaccauugagccaucucuccagccccccuuuuuuuuuucaaaauacugaauugcacuuuagaaaaguauuuuuuuaaagauuuauuuauuauauauauuugaauauauauauauauuauuacuuauuauauguaaguacacuguagcugucuucagacacuccagaagagggcgucagaucuuguuacagaugguugugagccaccaugugguugcugggauuugaacuccagaccuucggaagagcagucgggugcucuuacccacugagccaucucaccagcccuagaaaaguauuuuaguuaauuauuuuuuauuaccuauccaucaaucaugggaauggguauguauguguguguaugcaugaaugcauguccccuuguaacucagaaacauuguauccccagagcuggagcuauagggacuuguaagccacucagucugggugcagggaaccaaacucuggacucuggaagaacagccagugcuccugucugccgagcaucucugcagccccugaacuuuacuuuugucuauuuuccuauucuuuguuuugucuuuuaaaacaauuaucuuauguaacuagguggcuccagauucccuauguggccgagccugacuugagucauaauuccccugccucuuccuuuuguuuccagccugaacuucauuuucaaaggagccuucagucggcuaggguuguagaucaggggcagcacgcuugccuagcauacgcaaagcccuggguucuauccacagcaucgcagaaacaguaaacaaaagguuaaauagaaagauggccgcagcaagcugaggucuagcuuagugguagagcacuugccacaacuuagguguacugcaguaacuauuucugucucuucccagguauugaaaaccucccguuugaauuacagagaaacuuucagcucaugagggaccuagaccaaaggacagaggguacguacagaauaauaggcuuuucuugaucacugugugguuuccugcuuucugcuaccguaccaucuggugaacugugacuuacuugggggagggagguguguaugcacguauguauguauguaugaauguucugcccauauguauaucuauguaucaugugugugccugguacacagagaccagaagacaguaucagaucuccuggaacuggagcuauaaagaugguugugagccaccauguggguacugggcuccaaacccagguccucugcaagaaaacagccaguguucuuaaccacugagccaucucuccaccuugacuuucauggacuccuuaaaagaagauaauggccauccuuuucuacuuuuccauaucaaaugaaggauugagauaauaccucaagaauucagugaugcugagcuggcgaaacaguucaguggguaaagguguuugcuaccaggccugaugcccugaguuugauccccaggacccacacaguagaaggagagaaccucccagaaguugguccugugaccacaaccugugggccauuguacacguucauccacacacauacaaacuaugcacaaaauaaacaagguucagggguguuacaguuuuuguaccucuuuccucaagacuagaagauacgaagccuagacguugcuccugguuuuguuuuuugcuuuugcgugaacgcaagguaugccucauugcaguguuugcuaucaccaaauccacagcacuugaggcuacauacgccugcauggauggcugcuggcaacuuugccaagaagcuauuacaaagaaagggcagggcaugguagcauaggcagguagaucuuggugaguucgaggccagccuguuguacauauugaguuucaggccagcaagggcuauauggugggacccuguuggggggaaaaaaaucugaggucauccuuguacaucuggcacauacccagaguuugaggucugccuuggcuacaugagaccuuuuccccaaaaaacuaaagaaauaaaaguaaccaauaacaacaaaagggaaaggaauaaaacaaaaugcaucagguaacaucagaagugcucuacuguauuccucaacucauagacacauuggaugucauaacucauaggcgguuagaaucagcuggauuuuucaguccuuguacucggggcugaguuggcucuccugaggugccugcccucuggcgccugaggagcgcuucacugcagagcucaggcugcucugcuccggagguaagguucauuuugaagguguccucauacccacugaaggauagauaugucuuauguuccauccuagguagccauguucaaagaccuagcaagcuaggcugugaagccaugucuuuuuuuuuuuuuuuuuuuuuuuuuaaagauuuauuuauuuauuggauguaaguacacuguagcugucuucagacacaccagaagagggcgucagaucucguuacagaugguugugagccaccaugugguugcugggauuugaacuccggaccuuuggaagagcagucgggugcucuuacccacugagccaucucaccaguccaugaagccaugucuuaaguugcucuggcuaagugucuucauggguaucaccuaacacucuggacaucugccucugacagcugucugcgagacaguuagaaucggcuggauuucuuuucaauguuguucuaacucuugauucuguguauagagaccagcuggaaauuacagaauuguauauuuuucucacuucuaaaggccuggaaugcagugagguaugggcauagcauguucccacugccuggugcugcacuggguuagucuuucaucuccuuccauugucauuuuuaugagcccuacauaaugcuaggggguagagaucuucuagucaguauuccgggucuucaccagcccucuacuauuaagguguuuugagcgauaucuaagaugaacaaacaaacaaaaaaaaugacaagaaugguaagcaaguuacaagugaugagcaagcuggaugugguggcacacacauggaaucucagcuuucagggggcugaggcaggaggauuagcuucuguuugaggucagccuggacuauauaguaaguucuaagacaucuugagcuacagagacuugguacucggaaaauggaaagagaaaaguaggguggaugggaaggaugcagacaccgcuuuccuugaaguaauuaagacguaauguuaaaaugucagaccccgcacucuggcugcguaggcgggagcauccuaaguucaaggccaaccugggcaagacucaaagagagagagagaccuggagccagagcaccagugagugacagccugguuugcaggaggcagggcagggccguuuggagaugcugcucagaaagaagauggucuuuggaaccccacucacgaggcaagcagcaagcaagcccugcaaagaagcauccugaaaugucaucaggaauguacuucaggacaaccugcuuugcagagaaccccacaaugacucuguaguagucucaacucccaacucggcagccauguuuucuguacccugaagggacuuuaagacagucucagccaggcccacgcuuaugaucccaguguuaggaaaucuaagacaggaggauauuccaaguucaagaccaggcuaagcuacauacugacacugucucaaaacaaaccaaaaaaaaagcccaaaugaguauuugcauuuccugaauacaaggcauaguucaguacaguucacuuggaagguuuugauggccaauggaaaagguccaaggaacaagaggaagaaguauguuucaucuagccaccaggggccgcugugacccaggccugucucuguuguagaccugaaggcugaaauugacaaguuggccacugaauauaugaguagcgcccgcagccugagcuccgaggagaagcuggcccuucucagacagauccaggaggccuauggcaagugcaaggaauuuggugacgacaaggugcagcuggccaugcagaccuaugagaugguauggcccuguucaugguuucccaccuagcucucagcuaauucucagggucuuagacccccuccuucagcuguguugggucuuagcuguuuuccuugaucggagccaggcuuggaccucuucccuuccuucccucacagguagacaaacacauucggcggcuggacacagaccuggcccguuuugaggcugaucugaaggagaaacagaucgaguccagugacuaugacagcucuucuagcaaaggcaaaaagagugaggaggggcggggcugugagaugcgggcaaggagucagagggagaagaggccaacuccagcuaggagggagcggcacugccuggaccaggagcaaagagaacuuaacccaucuuuuugucucugccucccggcuuacccuuucuuccuagaaggccggacccaaaaggagaaaaaagcugccagagcccguuccaaagggaaaaacucagaugaagaagcccccaaggcugcccagaagaaguuaaaacuugugcgcacgugaguauaccagaggacgcccgccucccagccagccucgugccacuuucccugucuucugugccaguaacucugucacuguggugucugcuggacggagaggaagccacacaucacuugccucaccacgaucuucuaccaccucagagcgcagguuguagcuucccuuccugcggaugacauuugucuuccucuuggcauacagaaguccugaguaugggaugcccucagugaccuuuggcaguguccaccccucugauguguuggauaugccuguggaucccaacgaacccacauauugccuuugucaccaggucuccuauggagagaugauuggcugugacaacccggaugugagaaccguuuccucgggguugggggaggagcucugaggggcaugaguaagaggaggaggugacucgggugaagagaaggaugcagaaugggauggugguuggacuggguugcugagacuugaaguuucuaaacuggaguagagggccccuaccucucaggagccgcugguggcccucccuccacccugcuccagucccucccugaugucugugauccaucugccuucuccaguguuccaucgagugguuccacuucgccuguguggggcugacaaccaaaccucgagggaaauggugagugacagcugaaguguggcaggagcuggcaggccgucccaugucccaacgcccagugugagagagcacacaggcuucucucacuuucagcucaccucacucuucucuccuucauguuggguuuuagguuuugcccacgcugcucccaagaacggaagaagaaauagguuucccuggauuccauuacagacuucugcaucccccugaccugggcuaguggacagaguggaaggccugugcuggggacggggggcccagggagauguggacagugcgguaccgucaucccucucccuccuccccacucggugcugaggcugcauccaaaccccaguagggagggugcugcagccagugacgguaugugcucuccucccgccucucccagagggaaguaaucucacucacuguccuuuugccuccuuggugagguuggugcuguauuucagagggaggguccucuucauuccccuugcuuugacuuaaggacuggggcaguggaguggggcacuuucccaguccccucacuccuccuucccccauugggagcuaggcaggacagacugccuucucugcacucuuccuguucuccauggggaggggucuucuaggucauuugggcaguggccuaguuaagugguuacuccaaccucuauggcccggggauuuaugcugacucugaaugggagaggggcaagguagaccgcagguuacucacauguaaaaggaguugggguagguaaauaaaagcuauccaugcuagccugcuguguuuauuguagagacuguuuaaguauaugugguaagcauucuuuucgcauccucuggauuggaugagaggcaggaagauggcuugccagaaauaggacaagacauaaaacccaaaaugguccuguccugugguguccacagcuucuccaccuggaggagugccuugcaucgggggacucagaauuuuguaauuacgaaucuccucuccgugaaacaccuuuaacccaauuccaauaaaucauguauuugcuuu

SEQ ID NO: 12376 - RNA, 5126 nt, Mus musculus
cagugucaaucaucuucuucuucgucagccucccuuccaccgccauauugggcaacuaaaaaaggaggggggcucgugcuuuugggguguuuuccccccucaucccuugucccgacucacucgcggcuccgagacucgcgcggcggcaagguuuggagaggggcugcguucgcgggacacacgggcucgccccagccuacgcuccgacuguuugccaccuccuccugccuccuccccucccuuccccgcccuccaguacacuugaucacugaagccucgagcugcgcggcggcuggggugucccugcgccucucuuccccagaccugcgcgcuacugcggcucgggcggucgcucgccuggcucugcuccauuugacugucugugugcagucgcagaacuucgaagaggguuuugcgcuccauccguggcguuucgcuuuuguucgguuuuguuguuuauuucauuuuuuuuuuuccggagagaggcgaggcggugguccacacccgcccgaggaggaagaugucaaacgugagagugucuaacgggagcccgagccuggagcggauggacgccagacaagcggagcaccccaagccuuccgccugcagaaaucucuucggcccggucaaucaugaagaacuaacccgggacuuggagaagcacugccgggauauggaagaagcgagucagcgcaaguggaauuucgacuuucagaaucauaagccccuggagggcagauacgaguggcaggagguggagaggggcagcuugcccgaguucuacuacaggcccccgcgcccccccaagagcgccugcaaggugcuggcgcaggagagccaggaugucagcgggagccgccaggcggugccuuuaauugggucucaggcaaacucugaggaccggcauuugguggaccaaaugccugacucgucagacaauccggcuggguuagcggagcaguguccagggaugaggaagcgaccugcugcagaagguagugacucuuuggaaaacuuaaaaugucugucugucugucugucuccguaagcgccccuuuacuagacccuguucacuugcuuucuccagcguguucugcuuuagcucugggaaaucgaacuuguuugaagcuuagguuugacauacccccuauccgacugcuugcccuguuuaugauuuugaagucagaagccggagauaguaagaugugauaacuuccguagccgaacgcaucacaguuccuccccucuagccagcuguagauacgugacaaaaguucggauguuuaccaacugccuccuccuuggcugggguggggggguggggguggggauggggguggggaagagacgugggguguagaauacuccuuguguuagugggaacaaccuuauuuuguguccuuagaugcuaccggggaugacggguccaggggucguggguggagguagugaguggguuguucaucccuugggccuacuucugucagccauuguugucgauaauaaagaugguuuguguguguucucuuaaaaauuuccccuugccccccucuuagauucuucuucgcaaaacaaaagggccaacagaacagaagaaaauguuucagacgguuccccgaacgcuggcacuguggagcagacgcccaagaagcccggccuucgacgccagacguaaacagcuccgguggguuaaugaggaagaacacaaaacugacaccccaucugggcugcgcuccccggggggccugcagaccccaggacugcuggcagauuaguugccugccaggaggaauuacuuuccuugaucaaaaaaauuaacacuggggaaggcuggaaucacuugaggggacuauaaugcaguauuugcaccccaagauauuuaccuuaaaguggaaucagaaugagguucccaagcaagaacuugccaccaaggccccaaaggauagggacggucguauccuuaugaaucccacuaaaacuuaggcugggaaugacaguuuuccuuuccagucucaguucaugagaacccauuucccagagguucguuuugagccaauagccuauuuugaaccauuugaacuguagaaaaauggcaaauauauacuuacauguauguucuuaagagaaaaacuagguacccauagugcacguuugauuaggagugugaauagagcugccguggcucgaguucuuuuuaucuuuugcuuuuguuuugguuuuugguuuuuugagauaggguuucucuguguaacaaacagcucgggcuauucugggaauugcucuguagaccacgcuggcuucgaacucacagagaucuguauugucucugccuccugagugcugagauuagagguugugugccaucaccucuggguacuuuuuuauuuuuuuuuaaaguugugccuuguaugcugguaaauuuuggagagaaaggaacuucauacuuaaaaaaaaaauuagacuggaaaguucagaaguacuaaugcucccacagaauugauuuuaacccugagguuacaaagcagaaguuaaaugaacagcuagaggaagcagccuucccacacgucagcaccguaugcuaauuugcuggaacaggacgguuuggauguuuauaggggaaauggauaguagauguuaggaccaacugagaagguccaacacaaguguggauuuuuccaugugucaaaaaucucaucaccccacuugccuaauuagaguaacccagccccuaaauuuacauagauugacuauucauaugcucuaacuacuuauaauaguuuauaagcuccuuaugaagaaaaccagcauucucuauuucuaaagcccacuuauaacccagcauacaaauagaucuuaacaguuuauuauuaacuuuucagguccucauuuauugaaauuuaaaaauaaaugaaggaauauagagauggcacaggguuccagcuuguuguguuuauaaaucauaaagucaugauauaccuucuacagacauagcauuuuuucagagauggaaaauggccauuagagucacuuuccauauuauacccucuauaaaguugucgaauuggaugggaguucuuucuaacuagccaucacaccuguagcuuuaguugcuuuguguggcuucuggccuagcuuuucagaugagccgccuggauuuuuaccuggccuguucugauaaagaggcauuuauuagccaagcaaccauaagacucuagucaaaagcacucgugcagauaugcugcauaugaguaagaaauugcaauuuuguaaacauuccucgacuugguggggaggaauaauuuuauaauugcauuuccagguauuuuucaagauuacgaaaauaugcuacucugauguguuaugguuccugaauuucuuuucuuucucacccucuuugacccagauuuuauagagcgaguuucucaaccucugcacaguugacauuuugagccaaauuauucuuuguugugguaggcaguccugugcauuuuagaauguuuggcauuaucucuggccucccccacaagaugccaguagcaaucuucuucccgaagcugugacaaucagaaaugucucuuagacauuuccaaauguccccuggggcaugggaggguuucacaaaauugcccacuuguuaaggacccugacucuaauaccacacaaaacagaacaaaaauccagcaaagauaggaucggagauaccuguagucuucagaccuuuagugccuguauuuauccaucauuacugaaguauuuguuaacuaagcuagcaacaaaauaauuucuguacuuuggcaauguuacucuagugucuucucccuaauucuuuuguuucuuuugcagaauuaagaauauuuccuuguuuauuagauacaucacugcuuuaugaagcaaggaagauauacaugaaaaaauuuaaauacauaucgcugacuccauugaauggacauccuguauaagcacugagaaagcaaaaacaauaacacuaaaauuuuaggcacucuuaaaccaucugccucuaaaagcauuggauguagcauugcgcaauuagguuguuccuuauuugcuuuguuguacuaccuguguauauaguuuuuaucuuuuacucuguagcacauaaacguuagggaugggagggcaggguggggcugaggagucagcaugggggugaagaacuugcuucaauuuguagcaaggagaaaaauauuugacuugcauaaagagaagcaaccugggugggggugggggggggaaggguuugaauuccuuucuuuaaagauguagugucccuuucgguaagaauggauccuuuauuuuuaaaauaaucaaaauuugaauaauugcuacacaugguugcuauuuauuucuacaugaagcuuauucucacuuggagguucugaagauucuguuauagagcaagaaauggcuuaauuuuuuuuuuuaauuggaauuuaccaguuuauuguuuagcaguaauuaccccagguaacacugggcaaaaaucuggggugcauaauagggaauucugaauucuuagauuugauuaucccagaucauuuuugcuaagaaaaauucuuauuucuuuuuuucacagugaacauaauccuaaauccuuggauauuuuuagaagucuguaacuuuacacaaauaaugaaauaauuuuuaauucaaaguuucucacccuacuuguuaauuugcccccaaggaaaguuguuuuuuuuuuuuuuuuuuuuuuuaaggaaaaaaggacacuuguagaguaagugaaauggauacuacaucuuuaaacagcguuucuucauugccuguguaugagaaaaacuuggaagugugccuguguauauaacucuguaaagacacugaaaauuauacuaacuuauuuauguuaaaaagagauuuuuuuuuaaucuagacaauauacaagccaaaguggcauguuuugugcauuuguaaaugcuguauuggauagacuagccccccccccgccuuuguuaaauaguauggcugugcuuaaaagguugcauacugagccaaguauaauuuuuguaaugugugaaaaagaugccaauuauuguuacacaucaagcaaucaauaaagaaaacuuccguaguuauuuauugagugc

SEQ ID NO: 12377 - RNA, 19013 nt, Mus musculus
ccugcccaguagccagggguugagcgcucucgccuuucacgcgugagucgcaaguucucgcuucaccccgagcgccgcggcgcccagguaagagggguuuacccaggagcgcgcuccgggccccaguuuuaaauccggagaguggggcguggggagccuuggggaaggagaacugagacaguacagcccgugauggacuacagcuggcuaggagaaacagaugaaaccgagaaaggaauguccuuaacuucucucaccucugaauguguucucugggcuaaaacagaggggaaagaccaaucagcaaacaguuagaaacuguagcacaggccuguaauucugcaccugggagguagaugcagaagaaucaagaguucaaggccagccuugacucuacugugaguuccuggucagccugggcuauauaagucucugucuccagauacaaaacaguaguuuaaaauaccaauauuaaaagagagguccgucuugaacuguacuaggccccucccacagguucuauguagccacugguggguggaagaugggcuaugaugcuuucaacucccaucugaguuucaagggucugugaaugaauagagggguagagggagaggaugccagccgcuuccuucccaaaggagcgaaggccguggaggucaggaagugacucaccucaacgcccccccccccuucucaugugcguguuguuccuccaccccaucccuuacuuuuccuguugccccagucucuaagacccugucucucuuuaacaagagggggugaaaagcuugucuucccggaggagaagagacacaggcaggaggaggcuggcagaucacauugaauggaaagacaggaaacagcaguuguuuuuuuuuuuuguuguuguuuuguuguuguuguuuuuuuuuguuuguuuguuuuuuuuagacauucaggcuggccucgagcuuguaaccaccauucugccucaguuugcagaguguugggauaacagguaucggucucaugguagaaggcucccaaauggcaaaagccugccuggaagcagguaauugaaggaccaucaccgugccugccugccuuuucuccaggcaagugucugaggcuuuuguugaagccuggugaaagguucucuggaaacagucucuucuuugcucuuuacugaaggagaauucuuuagccacuucagauacaauggccugggaagguggaggggagggugaggccaacacuucacccuuagggguuuuuguacuggccaucacugauagagagaaggaaggggaggggaggaaggguugggaggugccuuaggaucaaagagggaauggagaggcuggcccccaggcccaaagggaauggccacagcugucucugacuucccaagaaaaggucucuaccuggcuccaggcagcccuguguuuccugguucugcagucauuuauccagcagccaccugccgccagguccuuaugcugaggagucguaggcaagcgucuuuucuguguguagguccugccugucuguaguugcacaguauccguaagcagcagguugaaaaaaaugugcgccuucauuccauucuugagagguaauugaggauaacagagugugaagaggaauguggauuggggauuucugcucuuucugaagauccacagagagcaggggcagugggugggggcaaacagaacaguuuuucacuugaggggaucagagcaacgcuggcuuuuguuuguuugagugcucucucucucugucucuuucugucugucugucucugucucugugugucucucugucucuuugccucuguccucucugacucucucucucugucacugacucugugugauugucucucugucucuguuucucuuugucucugugucuuucugucugucugucugucucugacucugacucugugugucucucugucugccugacugucucugugucucucuuuguugcugugccucugucucccuggugugaacacgccacacugcacaucugguggucaaaggacaacuugagggaauuaauggugucuugugugaggaacuuggguccuuagacuuggcagcaaacaccuuuaccauugagccaucucgcccauugguguuacccuuuuaggaaagggacucagguaaccauggcugaccuggaauucacugugcacacgaggcugccccagucagaucuacuucugguuucugagugauggaauuacaggccugagcuacccucugaaagcccaguguuugcauuuuuauugcuccccuaccaccuuuuuucuuuuugagucgagguuucuuugugacccugaccagcuuguaacccacgauauagccuggcuggccugaacucuugcaacucacucuauggccgggguuggccugaacucugcuucccaagagcugagacucaggcaugcucuaccaugcccaccuuauccuuacuuuuauagccugccuccuucccuucccuucccuucccuucccuucccuucccuucccuucccuucccuucccuucccuucccuucccuccccuccccuccccuccccucccuucuccuucuccuuccuuccuuccuuccuuccuuccuuccuuccuuccuucgaacaaggcuugauccauugcccuggaguauuuuaaucucacaggcucaagugcuucuccucuuucacaucucaaguggcuggagugcaggugugacccaaggcacggaaucuguauguuuauuuuagaauuucagaucacucuguucuaaacugcacucaguuuuuggcaaacaugugugaccauuuggauagauuccaucugauagagaagggguagcaacuauggucuguuguccaaaguggcccauacguucguuuucuuccuucuuaaugacgaguuucauggggaucuauuaaaacucauuugcuuuuguaucauuuguggcuacauucaaguuacaaguucauggcuucuaaaagccccugcccggggcaugguggggcaugccuuuaaucucagcacuccagaggcagaggcagguggguuucugaguucgaggccagccuggucuacagagugaguuccaggacagccagggcuauacagagaaacccugucucgaaaaaccagccaaccaauaaauaaauaaauaaauaaauaaauaaauaaauaaauaaauaaauaaauaguaaaagccccugcuacuuauagcugcuauacaaagugcuugacaagugcagauucugagagugugaauucuuugguuaauaauggagauaugauugguaugaagauagacaguguuucugguaaaguauccagaaaacauucucgugauuuugcugguuauuuauuuuauguauggcaucugccgaggacuaauuuaaaaaagucuauaggggcugaggagaugucucaguggguaagagagagugcuugaugcguagguaugaggaugagaguuaggaucaugaguuagcacccguguaaaacccaggccauggcagcagauggccaugcauggaugcagaggcaaacagaucccgggaguucccuagccagccaguccaagaaaacagugagcuuccuguacagagagacucugucccaagggaagagagccauagaggaggacguuuaguguccuucucuggcuucugcauguuagcacacagccacacauacaugacguacauacauuuuaacgucuucucauuaugaugcuuuucuucuuuaccgugguggaucucggauucauuuuguuuuguuggucuggguuuuaccuugaacuugcugggagcccaggugugugccaucacacagugauuucuaguauuuuauugcacucucucaugaaagucuacuuuauaguacagcuuuguuuggaguaagaguaagauggccccacucucaggcacuguaugaaaguggaaaauggcccugagccucguucucaaacuugucuccgucuguuuuggugccaugaugaugaugaugauggugguggugguggugaugaugaugaugguuuucuucccaccaaucacugccuagagacucaacucaguuauguuaguaaagcauuauucacaggacgcugccaugaugugucaugguuaugugaugggaacuggggugguuacccguacaggggaucccgcagagguacuucccaccuaacuaauccuuuuucagcugcagaaacauuuuugugggacuccucccuuggaagaacucagccuggauaaacguaggagggucagaaaaaugugcacagauucauuuuuaagaucucuuacuccuuuagcugggugugggaacucauggaugagagcccauuaccugggagacggugucaggagggucaggaguuugaggccagcccuggugacacgagaaugagacucugucucaaauaaauaaaucauccuauuacucacacuugaggaaguauucggcagucaaucuuaguccaaaauacuugcucagaaucacugugcagaaccacauacagagagagaugccaacagacaggggacucgaucuguguccucacggagcuuguuagcuacugguguuaacauauagucacuaccaggcauacaggaaaaugaguacuucacugucagggcuaggaagagaccgaugcguuuagaaugaggugggauuaaccauacugugauacaaguucccaguagagguuauguugagaccaagcuuugaagaaauacaucauuauugugagcagaagggaaggaaguaugauuuugucugagaaggccuuuaacagccccaaauuccuauuuguauagaaaacacucuuggaaugcugggugugguaguguauaccaggaauccuggcacucaagagcuggaggcaggaggauugugauuuugaggucaguuuagguuacuuacauauucagacccagucuuuaaaaaaaaaagaaaggccugcuggugguggcacacaucuuuauuuaaucucagcacuugagaggcagaagcagguagaucucuguguuccaggcuagccugguuuacagauagaaucaggauagccagggcuacauagagagacccugucuuuaaaaaccaaaaagaaaaagggaaaaaaaaggaagcaagggagggagggagggagggagggagggagagagagagagagagagagagagagagagagagagagagaaaggaagaaagaaggaaagaaaaaggaggagagaaaggggcuggagagauggcucagcuguuauaagcacuuguucuucuagaggaccugagcucaguucccagaacgcaaugaggucauaaccaacuguaacuccagcuccaggggauucaacagauacccucauuuggccuccgugagcaccuguauaugugugugucacacacacacacacacacacacacacacacacacacacacacacacacacaccacaguuuaaauuuuuugcuuaaaugaaaugaaagcgaucacuuggagaauuugcaugugucaagccccauuaaaaaacucacauagccuuggacaaagacuuugauuucuuuuuggcuuaguuuucucagcugucaagggagugauaaaauaccagauggcaccucacaucuguaaucccgacucuugaagguagagucagaaagaucaaaauguucaagguuauccucugcuacauagcgaguccaaggccaaccugggccacaucgagaccuuauuuaaaaacaaauagacauuaaagugggacaggaggauuaaaugaaacaguacauggcucaauaaaauuuugcuaagguuugagcucuuacuauuccuauauugcuucgcuugcauguccugcauguuucugcucccuguccugggacaauggcaaccccuaguugcccuugagaguuuaggaauugaccugaccucugcccaugcucggggccuuucucuccuaccuccguaacaaccucuaacaaccucacaccucugguuaucucuucccccucuucucccagccuuccucacaucucaguccccucauccugguaggcuaggucacgguugcacgguugccgaagugcacguucucagcacuuccugacugccuacguggacagcuggucagucaccugacacacucuguuggcucucuaaggguggcagccacacuuggggucugugggauuuguccacuuggcgcugguuggugaggagcacugacugcacgaagucaguucuggagacaucucaacagucagaccuggacacuuugauagagcagcaguucucaaccuguggaucucccccucccccagccuuugggggagggggagugacucuuucacaggggucacacauccugcaugucaaugaaugcauuacaaucaauagcaaaagcaagacuacgguuuugaaguagcagcgcaguacuuuuaugguugggggucaccacaacaugaggaacuguguuaaagugucacagcauuaggaaccgcugguggagagucugugagaugcuggguaagguagaaggcucuggagaccuugauggugacccagaggaaauaaaucaaggaugagguguuugcuaagaaggcucucuccccauccucggcccucucaaaagaaaucuguguauuuuaagauagguguauuuuuauuauuuccaguuguggauuugcguguauaggggacuuuucacacaccugugucuuuucuuugucuuuuuuucuuccuguuuagauaggcucauuuauguaccccaggcuuggcuugaacucagagaucugacugccccucugccuccugcugguuugcaaagcagucaccaucaugccuggccucauugcugugcuuauucacuucccucccaggcuucccuccauagauauaauuuuagaaacuaucuuuuaaguaucaccaucauugucaucaucauuuuauuuguuugcuuuuauuuucgagacagggcuuuucucuguguagcucuggcuguccuagaacuuucucuguagaccagguuagccucaaacucacagagaucuuccugcuucuaccuccugaguacugggauuaaacaugugggcccacaccacucauuuuuuuuuuaagauuuauuuauuuauuuauuuauuuauuuauuuauuuauuuauuuauuacacuguagcugucuuccaacacaccagaagagggcaucagaucucauuacgggugauuguaagccaccaugugguugcugggauuugaacucaagcccuuuggaagagcagucagcauuuuaacugcugaaccaucucuccagccccaccagucagauuuuaauuaauuuuuuugcacaggaucucauuaaguuucccaggcuguccuuggauuugcuauguaguccaggcagaccucauacuugugauccuuuugcaaguacaggaucaucggcaugggccuccaagcccagcugaaauguagaauuaugaauacaucuuuccucuauggcacuggacuuguaaguucaucacuaaaaacaagugugcauguguaaguggguacacacacuucaggaugaggccagauggcauccuuggguguugaaccugccuucuacuuucuuugaggcagggucuguuguucaucguugcauaugucagacuagauuguccagagauucuccugccucccauaucccugggauagacccacugguagaagcccuggggugacagggacucacuguccuuuuugcuuuaacuggguucuggagacucaaacucaggucuuuauacuuacauggcaagcaccuuauccacuuacugggccuuagcuuuauuucuuaagaauuaacuuauaaauauauuuuagaguauuaggugagauaauguguaagaacacagaaaggggagaaugugugugaagcauagacgcucagcaucgugccgacccaggguguggguagaugucauuaauuccucaugauaaugugacuauuguuacuauggcugaauuuagagagaaaauggagaugucaccaagucacaagguggcagggccgagaucuugaugucaccccugggacaggcacugugcucaauucugaugacagagugucuuucagcuuugagcugucucagcuuugagcugucucagcuccucaacaagcucacuuaugagauccgcuagccagggccauguagcggcagcuuccgggucuaagccugugagcuccaucaccacugugcugaagaggagucuggaaguggcggacagaagccaggagcuucucagaugcuguccuuugucuuugcacaccagucagugcuacacaccaaagccaugccuagggcuagcauucuuggcagagcuuugacuuuguccccagucuccuaggccaucuccgcccucccacucauccuuaggccaguuuuggauugguuagaaguucaugauccauuuugcagugacaggagguggcauaugggaaagaagaugggacugggacagagagauguggaagcugucggcauggaacugcccagugggcgagcagagaagcugcccaagggcucagcccccugcuucagcagcgagucccuguuucauagcagagaaaucagguucagagaggcuagugaccugguccauacauacauugugucccugaaacccacugaucccaguuaccucucugauugcugugaccagagacucgucaagagggagcaaggguugacaguuugaggggcuguagcccuucacaauggagaaggcacagugacaggaucgugagugguugaucacuuugcuucuaucaacaggaagcagaguggacaggaaauuuggcugggcuaagagaucuacaagcucgccugcaguggcccacuuuuacaggcaggccccgccaagugugcaaacacaugagcacgcccacgaggaacauuuuguacucacaccauucuguaugugaaggugaacagagggcuugggguugagucagcaggagacucccuuccagucuccccguccccuucucccccuccagguccccacccuuacccugcaauuguagguuugucuguuccaccuuccucucuugcccugacucauuccaagaggauuuuuaaggcacuuccaaguaauuuccuguccugcagucucaggccuguaauccaagcacucaggaagcugaggcaggaggauagccaggagucuaggccagccucagcuacaguaagaccuauuucauaagacaaacaggcugggccagggagauggcucaguggguaaagguguuuguggcuaagccugacagugugaguucgauuccaggaccugcaugguggaaggagagaacugacuccugaaaguuguccucugacaugugugugugugcguguguguguacacauggccuccuugcuccaaauaagugagugaacaaacaaauaagugugaaaccaaugaacaaacaaacaagaaaacagcucuagaccaaagugaggaaccuggcuuccacugcuuuccugggcuccaucucucugcaggaccauauuccgaggagauuuuccgugugcccuugcuucuuagugaguuuuguuuuccucugaccaaauccaaaguacuucagacgcuuuuagacuugcugagcaaccccagucaucuggggagaggguggaggaugguuaauaggugaauuacauuggugauucccccaaaauuaaucacccacaaacaaaauacucacuaagacauuuugcuucuuguugcugcuuggggugaugugggugugaucccaggguuuuggagagagagcuaggaggaugaaguuugaugcuagucugggcuccaggagacccugucucaaaacaagacaaaacaaaacaaaacaaaacaaaacacaaaacaaaacaaaacaaccaaaaaaaaaaaaaaaaaccaaaucagggcuugcuaucacccuguugugaaaggggaggaguuccugaggcucgacccacaccucuaaggaauuguauguaguuacugguugguagggcugagguguguguggggggggggcgcggggggggucggcauuuucuucaauaaccacagcauguuucuauaagcagcccugaugaaauacauugggucauuaaaaaccaaacaaaacaaagcauaaaggccuucugaaagguuguaggguuggggguagggcauauaccuagcaugagguuacacacacacacacacacacacacacacacacacacacacacacacacacacgacuaacuggaugguugcuugauauuuaaaacacacacugccaauugacugcccuuauugagcacuggucuugggagguuccaggcaugacccacuccugcacagccgcagugaagcuaggggccgaggccuuguguccuuuuguucagggcugcaacuuucuuuuaggccagaggucacugaucucugucaagguuuagcgucauuggguucagaauccuuccuaaacaucaacuaauuuugauuauuaacagcugcuugacaacagaaccuugaggcuuaaagugagugacagucacaaggaggaucagagaaugggcuggggacagcaucuagccuggggcuggggguggguagacuggggacgaugagggggagcuccagcuugucucacagugaugguccucggcuugauugauggcuguuggcuugguggugguuguggcugggagugcagagaggagaggccuuuuaugguagauagacuagacaguggcucuauaggcaaaguccuucuuuauggcucuucacagugggagaggccgaacaaaagaggcagucuguguugucaugguggaaagugaauucauaaacccaugccccacuucucagggugggccugagauuaaauaccuuuugcagggaggaguaucuaggaaguuaagccuauugguaacacccuccaggccucuagguaccucauuugcaugcagaacucuguauugagccuacuugguuggucacauuucuuuuccuauugucuuggucugagaugguagggaugccuuaccuacauguggaagggcuuggguguugcccuuagugacugaaggccacaaaucuauagagggcugcagcuauaggugacuggggccuggugccugggucucugggacuucaagccuuuggcucaaccuucccagucuuccuuucauggucuaccuccucccucgcacaggauagcuucuaacucaguauguagcagaggcuggccuugaacuccuguucuuccuacuuccaacuucuaaaguccaguguaucuuaagcaguugugcuauuugucucauugacauuaaacaauuuaaagucaacaaaauacgggauauaucagauccccuucuguucuacuauaagcauuuccuucaaagucccauuagauuuuuauuuuauuagauauuucuuuauuuacguuucaaauguaaucccuuucucagucagcccccacccccuauuccaucccucuucccccugcuucuaugaggguguucccccucccaucuacuuccaccucucugcccuggcauucccccacacuggggcaucaagcuuucacaggaccaagggccuuuccucccacugaugccugacaaggcuguccucugcuacacaugcggcuggagccaugggucccuccauguguguacuccuugguuggugguuuaaucccugggagcucugggggaucugguugguaggguuuucuuuuuguuuuguuuuguuuuuguuuuuuuguuuuuaauaaugacggcuugaccuguaggauucuaagcuaugucuggaauaggcuucaugccacaauauccuaaaaguuguuguauuugaauggacaugugugucugagcaucaucaggucuagucuguaaaggcaucucucagacagucaucaucuuuaauaaacuugcaaucaucccucagauaucaaggccaaaguccauuagaaguccaaacaugcauaaacuguaugauguaucaacauguguacauaucccaauugcuccaaauucuauaaaauaaaacauaaucuauuguguggcauaguauuaaguuagcagcaguaacagaaucuagacucuuaauucaauauauuguaucucuuugggcugacgguccaguuucucaagccccuguggaguuuuccugucuagaacuauguuuuuuugauguuauugggaguuccagauuggauuccucugaggguuuccuauuuugauauaaagagucuuucaaccuauguauuaugaucgcuaaucuaguaucuauucuuagucucuucuuucuccaagucugucuuauucugaucuuucccagagaaggcguacaaaauuguaaucauuggaaaaacagccauuuguauccugauaaaaacaaaacaaaacaaaaaacccaaaccagaauuaaaucaaaugagauuaguagaguuaacugggaaguaugggauucauucccucuucuuauugguccuuagaguuaucgcaggugguaagaagaguuagcuuugcgggguauagguguguagaugugaaugugugggugucgguggggguaagguugggggauggggccuaugaguuuaaucagaguuaugcacagaagcaugggagcuuaccaguagcuauaccacagaagaaaaaggcuuucccuccccagcaacccguagacucccagagaagagaaaauccugagccccaccccucgguuaguuucaauguaacaaguuuaaaaguaagacugacuaaacacaaucccauuuuuguccucugucucagaggcuugcuuggucccuaauuuugcuucuuccuuuuaaaugcaggaccaaccagaaugacuacuccuagagcugccccuagcgguugccgcucagaccuggauuccagguaccacagacuuugugaccuggcggaaggcuggggcaucgcguuggaaacacuggcugccgucggggcuguggcuaccguggcuugcauguuugcacucguuuuccucaucugcaaagugcaggacuccaacaaaagaaagaugcuccccgcccaguuccucuuccuccugggagugcuaggggucuuuggccucaccuucgccuucaucaucaagcuggauggggccacaggacccacgcgcuucuuccucuucggaguccucuucgccaucugcuucucuugccuccuggcccacgcuuucaacuugaucaagcugguccgagggaggaagccccugucguggcuugugauccucagccuggcggugggcuucagccugguccaggacgucauugccauugaauaccugguccucaccaugaacaggaccaacgucaaugucuuuucugagcugccugcuccucggcgcaaugaggauuucgucaugcuccucauuuacgugcucgucuugauggugcugaccuucuucgcauccuucuugguuuucuguggauccuucucuggcuggaagagacacggguuccacauaugcuucaccucguuccucuccauugccaucuggguggccuggaucguucugcuccugauucccgacauugaccggaaaugggaugauaccauucucagcacagccuugguggccaacggcuggguuuuccuggcguuuuauaucuugcccgaguuucgacagcucccaaggcaacggagccccacugauuacccaguugaagaugcuuuuuguaaaccucagcucaugaagcagagcuaugguguggagaacagagccuacucccaagaggaaaucacccaagguauaauugaaggggccuugguguaaaaauggggugagaaguugggcgugguggugcaaguacuugugggcaaauaugcaauaucacacauagcaaaugcuaugugguaucacacauagcaaaaggcucuuucccaacugcccugaugucucccucucuuggucuuaauuguacuauaaucccauccaaggucccuagagcuucccuguaaucccaguaauggaaaaggagacuaaagacaggaggggaaauaagcaagcaacagaaugcuccuaaaugcagaagcaaaaaccgagaaaagacagacagagcuggagggaaaaucaucagacagaaccacgggaacucuggaggcucacgccuaccgugagcccuuggagggggaugucaagaggaucagaaauucacugucauccugggcuacacgagacccugucucaaaagacaagcaaacaagcaagcuagcuagcaaccaaacaaaaccaaacccaaaacaggggcuggagagacagcuuauugguugagagcaauugcuucucuugcaaaggaccagguuugcuucccagcauccacguggccguccauaaccacugguaacuccaacugcaggagucuggcacccucuucuagccccugugagcaccagacacacacgcagugugcuuacauucaugcaggcaaagacacucacgugcagaaaauaaaaauagauaguucuucaaauaaauccaaacagacacccacaaaacaaaacacucaaauucuaaggagcucacgggauauuuacagauucugaucuugaguaaaccaaccucuauauuaggagacacgcaccagaagagggcaucagauuccauuacagaugguugugagccaccauguaguugcugggaauugaacucaggacuucuggaagagcaguccaugcucuuaaccgcugagucgucucuccacccccuaaagaaaaucauuuuggcuuuugauuccaucugucagggaagcugggagcaugcaucuucaaacaccagcaggaagcaaaccggaagugggaguggggauuuaaccgcucaaagccugcaccaaugacaugcuuccuccaacaaggcuacccuccuaaauaguuccaccaacuacagaccgagcauucaaacaucugggcugaugggauccauucucauucaaaccacagcacuucauuccugggccuuagugggcucaugaccauacauaccauaaugcagaaugcacggagucaaguuucauaaguccccaugaucuuucagccucaguacuguucagaaacccaaaguuucuuccaagacucaagcaaucucuuaauuguagcuccccagauaaucuguuguaguuuaguagaacuggaagcuugccuuucaagucuucaucucacacuuucuacacaacuguacauagauugauucagaauaaggagggauggagaggaaagcccccuagugguguguggggaugagguugggcucuguguauaguauaugaaaggcauuccugaggcuggagaaauggcucagugguuaagaacauguacuguacuuccagaggaccugacuuccaaucccagcacucauauugaguggcuuacaaucaccuguaacuuuggcuccaggggaucugauguccucuucuggccucugugggcacuaacacgcaugugcaacauccauccauccauccauccauccauccauccacacauauacuuuuuugaaggcauuccuggcagaaaggaagaggcuuuguggaucuugaaugcuuagacccaagcucugauuuccuucagaggucacaggggguggaagacaggaagcccccuuaacacaagcuggcagaugucuuggcaaagucccccaggguuuugacuuagaacagccaccuucuacuguaugucucugggccugugggaggagaaggaucccaugugacaugagagcaagugaugguuugauuccugccacaguuaugaggagccaggggcccuagugauaucuucagaagaaaacgaggcuaagcugagggcuagaaacugcccugaccuguaggaaucuauugcucagcuccagguuaugugaaucuuucaggaagggaagugguugcuggcucaggcuagagggaccuucaaggcuggguuccuaguuucagcaauaaagaggucuuggcucugcuguuucugcuuugaggcagggucuaacuauauggaccaggugggccuugaacuuguguugaugucccagccucuuuccucuuucuccagagugcugaggucacgcacucucucucucucucucucucucucucucucucucucucucucucucucucucucucucugugugugugugugugugugugugugugugugugugugugugugugugugugugugugugugugguggugguggucgugggggcuggggauggaacccaggguuuugugcaugacaggcaagcucuucaccacugaaaacacuccuagcccuaggcugugcucuuaaagcuugaauuguagaguuuccuggggacagagagcaagaaaaaacucacagugcuucccagggccuugucuccugccuuacccaguacuucugugugggucccuaggcccuagugcucccuuuuuguuccuguuuuucuguuuguauuuuuguuuuguuuuguuuuugagcaagaccgagucuugcuauguagucccagcuguccuagaacuugcugugaagaccagacuagccucuaauuuaugcuaauccuccaccuuugucuucagggugcugagauugccaguguaugugucuagugugugugucuggcuugccuuucauguuugggccccugguggcuccuuucugguggcuguaugucuagucacuguccacugcugcgugcuucugacacuggcuccccauauccuguuauguugggucugcaggaguaguguugccuuccacaacacaagcuccacucuaagucauaucaggucaucgguggccgccagccucugugacugaucaaggugcaguugcuugccugauguggccuuccaucugucugcuucagaguccagcauuccccggucugucuuaggaacagcuccaccaugugcacuuguggaagugggauguucuuguuagcuuuugccucauucaggagagauuuguguauuuguuguauuucuucaagucaggacaaaccucacguucuuaaugcuaucuucgcuuguuuacuuauuuguaguaaaaaauuuuaauguugcuuguuuauuuacuuauugugugugugucaucauacacacauaugcuacuauacacauguaugugaggucauuggaccaguuucaggagccuguugucucugccaugggggcccugagauggaacucgggcaucaggcugggugccuuuacccacugaccuaccuugacugcaucuuaaauuuuuuuuuuuuugagacaaggucucauggagcccagguugggugggaacucacuauguagucgaggaugacugaacuccugacccuccugccuccaccugcuagguacugggaucacaggugugcaccacggauacccagguccucacacugucuuaaaugaagaagcauuuagcaaggggacaagggcaggcacauuugucaggaaacagaccaguugcuuuaaagugagcucaagguuaaaaagccuaugauuuuucccaaguacguuggguugcucguaaacucuuccuaguuuaggacaagaguaaaucucgugugguuccaggaugggaccgugccuacuuuaggacugagagucacggucucucccugcaagaaauuuaaacugcugaggcccagugggaccaacugucacagacaccacaccgauaacagcaaggaaagcacagauggguccuggugccucaguuucuccucucccucuguuucaggucuugagaugggggacacacucuaugcaccuuauuccacccauuuucagcuacagguaagugaccuuugucauuccucgaucaccccgaaagggacaguuguccuuugggaauagauauuaccaccacuuuggcggcuccuaaguggacaccaugaagggacggcacaccuucuuuccuauacucugggguugagguggcccauggguucagggaggaccugugagaaggaggucuuuugggacgggcauuagaggccauugagaugacuguaauaauaaccauauuauugcuucccuuacagaaucaccaaaaggauuucucuaucccgagggcccaggccccggccaguccguacaaugacuacgaagggcgcaaaggcgacagcuaacuguugggaagagugggacaaccagaggcagguagcagcagguccagccaggaauccugcugaugugaacugaacccagggcaucccagggaaacgguacagagaggcuugcaaccugcccagcacaccgccgucuugccuggggcugcuaagccuaacaaacugucuucaaagagcuccaggguuucauuugccccauuccuaggacacuucugggaggugggagucuuggcaacuccgggugagacucuuaccucucccgggaguaugagcaaaccuccagucaucugacugcucacuguuuggucauccuuggaagccaauucaccuaacccacgguggguucuaugaggauuugcuccauaccaagcagaacugaagauuuggauaaacccagaaaggucugggucuccgccuuguccaucucauccacacuggaagcuaaucugaucgcgcccuccaaggcuuuccugccgggggaggaacggcuaaaggucacgugucuacccucagugcacugccccacagugaccucuuggugcagacacugauuuccaagggccacauuuucaucccaaucgccuccaaacucacugccaaccccagaccucuguguccuuugccaggagcucuuugggauauuacuggaguagacaaggucuguuucucucugccaggagaauuuggguuuuguucucgcuauaaauuccuggcccuugcucuccccccccccaccccauccucaguaauacgcucacccugaccuccugaccucccuacgugucuauucuugggaugggauguauuuguuaugugguaaguuauucaccuggguaugcaauaaagauguggucacaacuauuuuuaa

SEQ ID NO: 12378 - RNA, 2605 nt, Mus musculus
aaaaucucuccaggcgaccgucccacagauuacaggacagaaaccuccaaaucgaaacggacagccauugaacauggacgaaggaaucccucauuugcaagagagacaguuacuggaacauagggauuuuauaggguaagguguacgcaccguugcgaauaucugucuaggcgucgguuuggcuuuuuuuuuuuuaauccccugcacaaagugauauggagcgggugagggcagagccccucccggaaugggggccugaugcugauuucuguuuuugcagacuggacuauuccucuuuguauauguguaaacccaaaaggagcuugaagcgagacgauaccaagguaagucuuaaguuucccauaaccugccuggauaguuaauuagggccauugauuucgcaaggaaacucugcccgcaaauauauuccagcccugagcuuuccuaacugugaauuuuaaguggcuugcuggauacuccgggggauauucaacaccgcaccugaauuuaaauugcauuuuagaagucuagaggagagaguucugggcauuaguucauuacauaguguguuuggggguuggggugggaggguucuauccaguaagugaaugaauguuuagcucacugcuguaucuuuucucuggcucguguaugaaggauaccuacaaguuaccgcacagauuaauagaaaagaagagacgagaccgaauuaaugaaugcauugcucagcugaaagauuuacugcccgaacaucugaaauugacaguaagaugcacauuuucauucuccugauggacuccgggguguauuuaccugauaaaauucccagagauaggauaauaaauguaaauauuaagaggccugccuucuaacuugugcuguaacuaagaguuucccagagacucagaacaggggcuccgggcuaauggcagagaucauugacgaccugacuguggggagcugagcagcgcuuccuucccaguggugugugugugugugugugugugugugugugccugucuuaaguugcugggcugcguggaaauaaaaaugcguguuuuaaaguaaccccugucccccuuugucgcaccacugcagacacuggggcauuuggagaaagcaguagucuuggaauuaacuuuaaagcacuugaaagcgcuaacagccuuaacugagcagcagcaucagaagauaauugcuuuacagaaugguaagugggucugaggaagccagccugcccugauacaaaaggggguaacgcugggggcgcaacgcuaggacucccccgcugcguccucuccuggugaacgucgccucuuucccuuugguggcaaguacccagagcaucccaaaggcuucccgcagagcuggaggagccccguuuuuauuuaaaguggcggcugcaccucuucaguuggguuuuucagccaggaagagagcgccucaccgcgccacccccuccucucucggcagucugcggauuauaucgcuggaaugcccaggaaaagccgagcucacuguaggcagcgcagggcccacgugaugagcagaugucuuaacgccgcgguuuuucuucucgccucccucccccgugcacccuaggggagcgcucucugaaaucgccgguccaggccgacuuggaugcguuccacucgggguuucaaaccugcgccaaagaagucuugcaauaccucgcgcgcuuugagagcuggacacccagggagccgcgcugcgcacagcucgucagccaccugcaugccguggccacccagcuccugacgccacaggugcccuccggcaggggcucugggcgcgcgcccugcagcgcgggggcugcggccgccucgggucccgagcgcgucgcccgcugcgugccggucauccagcggacucagcccggcacggagccggaacacgacacggacaccgacagcggcuacggaggcgaggcggagcagggccgcgcggccgucaagcaggagccacccggggacucgucgccugcgcccaagaggccgaagcuggaggcgcgcggcgcgcuccugggcccggagcccgcgcugcucggcucgcucguggcgcuuggcgggggcgcgcccuucgcgcagcccgcugccgcgcccuucugccugcccuucuaucugcugucgccguccgccgccgccuacguacagcccuggcuagacaagagcggccuggacaaguaucuguaccccgcggcggccgcgcccuucccgcugcuguaucccggcaucccagcagcggccgccgcugcugcugccgccgcuuucccuugcuugucguccgugcugucgccacccccggagaaggccggcgcgaccgccggugccccguuccuggcgcacgagguggcgcccccggggccgcugcgcccccagcacgcgcauagccgcacccaccugccgcgcgcugugaacccggagagcucucaggaagaugccacgcagccggccaaggacgcccccugaacccagcauuccuuccagaacagggcagggggcucccgaggagucgccggguuuccaaguucaaacguccucuaaagcgugccagggaggaagaguaagcgaugcucgacaggcuu

SEQ ID NO: 12379 - RNA, 8224 nt, Mus musculus
uuuggucacagaacuuuauugaggggcggggcuccgacaucugcacagcuacaaccugaggacagagggcagaguugagguggaugagcggacagcugcaccccacagccuuucucacuuaaugccccuucugauuugagacuuuugguugguucccuuaggcauccucuucaccccuacucuagauuccugagcgcccacugguugaccagucagaggguuugggaagggccugacacuggcagcuuucaaaagggaggaaggcuaagcuaccacggggcaagguagaccaugguucacagaaugucagccagccacaugcuggugggccucacuuacugaaucucacgguaggcccgcuucuccaccagcuucacuuuguauuugcgcuugaaccuggggaaggggaaaaugugaugagcaucccuuaucucaggggguugggggggggaguauggaagugucucaacccacccccccaccccaccccuauccuucccacaguggcagaucuuacuuggcucguucucggggcucaaucauauuucucuucuggaagcucuugaaccugucucggagaaugugaccuucuggcugugggacagagggucagagagacuuuagcaggguccuagauagcacugggguucagacagagcucugcaucuuccuaaagccuccacagaguacccccagcuacacccugcugagcuccagggggcucuauacugaagucaaugugugcuauccuagcuaggcucagaggacagaggcuacaacugcaaaaaauggaaaccucaaagccaggcuaggccccagcacagcuugaggagacucacuagggcugacaagagacugugacaaaaggccuucugagggucagaaacucacaccagcaccugcccuccccaccucacccugacccugugcccucaguccccaggcaauggcccaacuggcccagcccagggcagccauggugucgcccacagcccgaguaggcacggggagcaaggaugguuaucaucacugggcacagggucccuauaacacucugcuacccucauggcaaguaccuucaguguccugagugagccagacaacucagagcugagcugcacaucaaugucaggagccugguaccuacagaacacaggguugagacacucagggauuuggcucucacagagccaagaaaaaagcaugauauaacuugcagacccccauuuccuggagcccuagccugugccucacuugagccgucccagccuucggggcuugucagccucugccagucgccguaugcgccgcugcucccuccggcgugccaguucugccagccuucgggccaccugggccuugaucccacgcagccugaaaaguucuuggugcugaagccgggcugcccucagugcagccugcugcacccgcuguggacagaggguaagagcucagccuagugccacucugcccagggccuuccucacccagggcccacaaagccaugaccucuccuuugauggcacugguaucgggucacucgacagcuguuugcccugucacccacuucuguccgagggcccuguguggccacaagggucacagagcagggugcucaccagcuugcgagcagcuuucucccgccgccgcugcugcuccgucuucuucuccauccucuucucaggaccagcagcaccagugggugagaucucgguggucccaucaccagccucuggcugcccggcacggccugccucaugcucauccucaccaucagacuccuccagcaggcccucacacaucucccgaaacacggacuccuagggagcaggguggucagcaagugggggcaggugagguuacaggcgggugacaagcgguggauggggcucaccuggguggcagcuugcucugaggugggcagggccagcugucgcuccagcuuuucugccucuuucucacgcugcagcuccaccucaugggccucucgaagcagggccugggcagaggugagaguuuggggugaaucuaauaucagggaugucccucugauccuaccccaugccugagucuuagcgcugauccagcucauggcuccacccucuacacacgcccaguggagacaucugagcuacucucacccucacccuaugcuggguucugauuagauggucuggucccugaacagacaaauucagggaaggaagcagguggggccugagguaagggaggguaaaugggagcgaggacuccagacagugaaaccugcacuggguuaggccaggaacccacugcacacuaaccuggugaucuucaaagguuggguuguaggaggcuccugcaggaaucaccuccacugcaggcaccugggaaggcuugauguggaggcguuguggccgcuggaggaagacaagagcagggaggcaggaugaacuccaugccaagaaccaccaguguaccccuaaaaugccuacacugaagccccaagaccagugugagacuguuaagacguggggccugacaaguuaggauucagagaacugagucuuacuaaaggcuucacccuacacccuuuuccgugcucagcuuuccaccaugggaggcacugauaccaggcccuuccccauggagcaaaggucccuuguuaccugcccaccagcccaucucacaguuuuauugugagauauaaaggaccaggagccagacauuggagcucuuccaucuggggugcagggacucaggguucaugaggccaggaccucacacccugcacaggggauaccugacccuggaaugagcaaucccuccacaggaagggcuuugcaggccacaagacccacgagggaaaugggacagcaucugcuuuuccuuuuugaaagaggauuucucugcauagcccuggcuguccuggagcucacucugaaggccaggcuggagagccuucuguucccaccucuggagugcugggauuaaagggggugcaucaccuuugcucagcugggggagggggagcgugugacaugcugggucuauauacccuggcacacugccacauuggcugugcuguaggcccuccgcugccacagcaaaguaugggugacaacucuggugcccacgugguccaaaaguucccagagaacaugaagaccagaucuucacaucagaaaccucaggugaccagcgcccucuacaucaagcugucuugccccccccccccccgccccaucuagucuuuuuccugguauaggcccuacauuaagugguucccuacuaguucaaacuuccccaaccuggucccuugaguucugagacuacugucuuaggacuuugcuccccguacguacauggugacucagggcccacugcauacccguggcugcacaggucucuggcccugcucugccucguagcuucugugcauuaagccccucugccuauggcugccuugcucuuccaggucucuagccccaggggcuuuucuccagugcuggcuccuggccucccugaagccuggcuccuaagcucucauuuccuggagacacuuaacacagggaugugaaggccaagguuucuuccagacccacagggagaacacaucaccccaaaagugcuaagauuccauaggaccuggcccacagcagcaaacacuuagagcucaagaugauggccacaaaccaaccuccaaccuacagcgccagcagugagcacuggguuguuuucagacauuucuucuuuaacccacacucuacaguuugaggaaagaauggaggcacugagguaaggucaccuucccaaggucggucaucaugggagcuaggacagggacacagaccacuaggaugacaggcauggggaccaugaagaagcugcccucccuaccccacugcuugccuaugcaaacuuacccucacgccuuucuucuuggucuguuccagaaaaaaugcauccugaccaaucaaaggcguguccagagggucugcagggagaggagagcaacugcaaugagcuuucuagcagagaagggaguuugugccccagggacccuaccagucccuccauugcuaaaaaugacacugaaauccaggcaagggaaguugcucaggcucccagggccucaaaccacaucucgaugggacuucacaaaugggggagacugaagacugggaagggagccccacaagcaggaaaggauggcccugaagaccucagacucccugcuggaaguuugucaacauccacagagcaugcccguggaugccacacucuuggacagucaguguacaacauggacaacugcccacaccagucaugcccaccugcaagagagcagaaucacucacugucuggguuccagaggucauagaagggucgcucaaugauguccuggggcccagguuuggccuuuggugugggagggcuaaggagucgggccugugccuugcgcacaucccugggcaguucgcccugcuuugccaguuucucccauaacuccuccuuucgccugagcuucuuggcauuagggaccugaugugcgaggaugcugaguaaggaaagaguggcaacugguaaggcagcagcugagcaugaugagccccucccagcugggcuguuccugcugcucagcagccuuucuccugccugccucagcauagccuucuugucaacuggcucagcacagaaccucauacccacuacuacauuuagaucugagcauucacaacaccagaucccgcagacucccucagggcagcggagccugcuagccuguccucucucuccuagggcugacgcuucuuuaccccauagucccaguugguucaggcuacccugcugccagggcugaauccucuaagccacucuccagagacccagcuauacucuagucugcucucucaacugccuccaccacgccaucucccuacagucuucagggggcagggcuggaaggacucacucuuugggagcagggaucuuagaaugauucucaagggcaaggucaacccguaaggguuucuggagacgcugugacuucuucuggaccaagguccucuucuuucuugguucugcaggggacaaagaggggaagagacuuuaccuuaggccuccuucccucccuucauaaaccaauccccaacuucaggucaaccagggccugauggccuucaaccuagguaacacagccuaagguucccagacugacccuguucaccuacaagggaagauccuagauuaagaacccagagucccaagccgggcgugguggcgcacaccuuuaaucccagcacuugggaggcagacgcaggcuggucucugaauucgaggccagccuggucuacagagugaguuccaagacagccagggcuacaaagagaaaccccaucucgaaaaaaccaaaaaagaaaacccaaaaaagaacccagacucccagauccgauccaccacagccucggcaagcaggagauaggccuugugauggggacuaaguccccacagaccuaucuggaaggacucauagacaaagcagggaaaggaccucagaacuaacagggaagaaagagggcaggcacccaggaggacugagacgcaggcuguggcccucucuuagcacucugcuuucuacuuuccaaagcccaucaggagaacaucagaugcugcagaacccacuaaggaggccgaguacaguggugcacaccuguaacacuaaagcucuggagaccgaggcaggaggauugagucuuuggccagccugagcuaaacagagagaaccuaauuccaaaaaguuaacaggacacaggaauaccugaggaacacacacaaggccccggguuccaccgagcacugaaaauaauaaaagcagcagcaacaagccacaaaaagcugaauacugaacugcaggauggugcagaggcagaggcagaggcacggcucuagcuaccaagccuggcaaccugaggccaaucccaggaucaugggggaagaacugacucagacaugguacccuccagccacacacaugccagggcacauccuagauggugugcgcucauucaagcacaugcacacccuaacuagaaaugaauguaaaaacaaaaagugaacgcuagcuucuuuuauggauaaaacgcuauagguuggccaguuggcuccuaccuguaauccaagcacuugggaggcugagguaggaggacguuaaguuccaggccagccugggccacaccgugaccuuuuagguagccuacguacagaagaagaccuugucucaaaacaaaaacaaagcauagcuauuacugaaucaaaaaugaacauaacucagaaugauaaacgccauguuuccccuugcacacagaaccuagauuuaaaacuccaugaccuggccugaguggggcagauggaacccauuaccuuagauguuaacguccccggguccccacacagcuucccuggguucucccgaccuugucaagaagguuuucaugaacaggaccccuugacucacaucgugcauacuaaagugccuggcugcuggcaaagcugccagcuuguucugcaaagccacuggcuguccugcuggaccaggcacuggcuuguuuucaguaccugcugaaccaggcuucccauuuuaaguguuuuucugccuccuuggugaaaaccccacucagcaaagcaaucccuaacuugcccuuauuuucaugucccagcaggucccagcccaaguucugcuggaguaaagccaucuugccaagacauguuuccuuccuccuggcuaaaagagauccucuuguucucucuguuuugagacaaggucucauuguguaggccuggcuguccuggagcucacuauguagaccaggcuggccugcaacucagagaaauuaacguuguggguuaucaugcuugcuaucauauucuuuggggaagggggacaaaaaaaaaaaaagcugaaugauacagcucaauaaaaccaaacaaaaaugaacaacaggucaccuuucuuaaucaucucaagcuuguuucaaagccauucaaaguaauucuuuauacuaaagacugccccuucuagucuccagugguaaagcauaccuuuauuuccagcacucaggaggcagaggcaagcagaucuaaguuugaggccaauaugguauacaugguaagacuguggugaugaaccacacccagcacugacucggggaggcagggacagguggauuucugaguucaaggccagccuggucuacagagugaguuccaggacagccagggauacacagagaaacccugucucgauccccccuccccuccaaacuugugaucaagacuguuuccaaaaugagagagagagaaagagagagagagugugugugugugcuuugcuuuaaauuaugucaucaaugcagaucucacgggugcaagacucagagaaccaccagcacacaacuucauaagagcacuccucaccuuuucucuugaauccuguguccacgaagaagagcuuuucguuuggggccucugccaacaagccacugaaggauaaaaaugcagacuauuugccaaaguaaugcuggaaagauaacagacccuuaggggucuaacuuuuugggcccaucccaacucuuccucaaaccaugggcuacaccuggagcuuucacacagaauuuaaaauguaccacgauggggugaacguacuuuauucucuuucacuugaaauucaaacucuguagcaaaagguuuuaaugccagcacuccggcggcagaggaaacuugaguucggagccaggcuugucuacauaccgagugccaggucguccuacauagugaggcccuguuucaaauuuuaaaaaaaacuaggggaaaacuuaaacuuuguugggauuuucgcacgcuuauuuguuaaagauacuauugauaggucucccacaccgagccgggaugcccgguccgucuagcaccaggucgcaaagcgcacggccacgccaccggaagucccgccccacguacccggucgugcgcuccuguagccggacgucuuccaggaacuggucgaccucuaaccccagcggcuccucggcgagccuccuccagccgcgcuucuuguuucuggggccccgccgccgccgccucagagcgggauccaccgaggucggccgcagccccaggaagccagaguccgccuggcuucucgagccgcgcuucucaccgucccuguuaccacccgcagccaucuucu

SEQ ID NO: 12380 - RNA, 8224 nt, Mus musculus
agaagauggcugcgggugguaacagggacggugagaagcgcggcucgagaagccaggcggacucuggcuuccuggggcugcggccgaccucgguggaucccgcucugaggcggcggcggcggggccccagaaacaagaagcgcggcuggaggaggcucgccgaggagccgcugggguuagaggucgaccaguuccuggaagacguccggcuacaggagcgcacgaccggguacguggggcgggacuuccgguggcguggccgugcgcuuugcgaccuggugcuagacggaccgggcaucccggcucggugugggagaccuaucaauaguaucuuuaacaaauaagcgugcgaaaaucccaacaaaguuuaaguuuuccccuaguuuuuuuuaaaauuugaaacagggccucacuauguaggacgaccuggcacucgguauguagacaagccuggcuccgaacucaaguuuccucugccgccggagugcuggcauuaaaaccuuuugcuacagaguuugaauuucaagugaaagagaauaaaguacguucaccccaucgugguacauuuuaaauucugugugaaagcuccagguguagcccaugguuugaggaagaguugggaugggcccaaaaaguuagaccccuaagggucuguuaucuuuccagcauuacuuuggcaaauagucugcauuuuuauccuucaguggcuuguuggcagaggccccaaacgaaaagcucuucuucguggacacaggauucaagagaaaaggugaggagugcucuuaugaaguugugugcuggugguucucugagucuugcacccgugagaucugcauugaugacauaauuuaaagcaaagcacacacacacacucucucucucuuucucucucucucauuuuggaaacagucuugaucacaaguuuggaggggaggggggaucgagacaggguuucucuguguaucccuggcuguccuggaacucacucuguagaccaggcuggccuugaacucagaaauccaccugucccugccuccccgagucagugcugggugugguucaucaccacagucuuaccauguauaccauauuggccucaaacuuagaucugcuugccucugccuccugagugcuggaaauaaagguaugcuuuaccacuggagacuagaaggggcagucuuuaguauaaagaauuacuuugaauggcuuugaaacaagcuugagaugauuaagaaaggugaccuguuguucauuuuuguuugguuuuauugagcuguaucauucagcuuuuuuuuuuuuugucccccuuccccaaagaauaugauagcaagcaugauaacccacaacguuaauuucucugaguugcaggccagccuggucuacauagugagcuccaggacagccaggccuacacaaugagaccuugucucaaaacagagagaacaagaggaucucuuuuagccaggaggaaggaaacaugucuuggcaagauggcuuuacuccagcagaacuugggcugggaccugcugggacaugaaaauaagggcaaguuagggauugcuuugcugagugggguuuucaccaaggaggcagaaaaacacuuaaaaugggaagccugguucagcagguacugaaaacaagccagugccugguccagcaggacagccaguggcuuugcagaacaagcuggcagcuuugccagcagccaggcacuuuaguaugcacgaugugagucaagggguccuguucaugaaaaccuucuugacaaggucgggagaacccagggaagcuguguggggacccggggacguuaacaucuaagguaauggguuccaucugccccacucaggccaggucauggaguuuuaaaucuagguucugugugcaaggggaaacauggcguuuaucauucugaguuauguucauuuuugauucaguaauagcuaugcuuuguuuuuguuuugagacaaggucuucuucuguacguaggcuaccuaaaaggucacgguguggcccaggcuggccuggaacuuaacguccuccuaccucagccucccaagugcuuggauuacagguaggagccaacuggccaaccuauagcguuuuauccauaaaagaagcuagcguucacuuuuuguuuuuacauucauuucuaguuagggugugcaugugcuugaaugagcgcacaccaucuaggaugugcccuggcauguguguggcuggaggguaccaugucugagucaguucuucccccaugauccugggauuggccucagguugccaggcuugguagcuagagccgugccucugccucugccucugcaccauccugcaguucaguauucagcuuuuuguggcuuguugcugcugcuuuuauuauuuucagugcucgguggaacccggggccuuguguguguuccucagguauuccuguguccuguuaacuuuuuggaauuagguucucucuguuuagcucaggcuggccaaagacucaauccuccugccucggucuccagagcuuuaguguuacaggugugcaccacuguacucggccuccuuaguggguucugcagcaucugauguucuccugaugggcuuuggaaaguagaaagcagagugcuaagagagggccacagccugcgucucaguccuccugggugccugcccucuuucuucccuguuaguucugagguccuuucccugcuuugucuaugaguccuuccagauaggucuguggggacuuaguccccaucacaaggccuaucuccugcuugccgaggcugugguggaucggaucugggagucuggguucuuuuuuggguuuucuuuuuugguuuuuucgagaugggguuucucuuuguagcccuggcugucuuggaacucacucuguagaccaggcuggccucgaauucagagaccagccugcgucugccucccaagugcugggauuaaaggugugcgccaccacgcccggcuugggacucuggguucuuaaucuaggaucuucccuuguaggugaacagggucagucugggaaccuuaggcuguguuaccuagguugaaggccaucaggcccugguugaccugaaguuggggauugguuuaugaagggagggaaggaggccuaagguaaagucucuuccccucuuuguccccugcagaaccaagaaagaagaggaccuugguccagaagaagucacagcgucuccagaaacccuuacggguugaccuugcccuugagaaucauucuaagaucccugcucccaaagagugaguccuuccagcccugcccccugaagacuguagggagauggcgugguggaggcaguugagagagcagacuagaguauagcugggucucuggagaguggcuuagaggauucagcccuggcagcaggguagccugaaccaacugggacuaugggguaaagaagcgucagcccuaggagagagaggacaggcuagcaggcuccgcugcccugagggagucugcgggaucugguguugugaaugcucagaucuaaauguaguaguggguaugagguucugugcugagccaguugacaagaaggcuaugcugaggcaggcaggagaaaggcugcugagcagcaggaacagcccagcugggaggggcucaucaugcucagcugcugccuuaccaguugccacucuuuccuuacucagcauccucgcacaucaggucccuaaugccaagaagcucaggcgaaaggaggaguuaugggagaaacuggcaaagcagggcgaacugcccagggaugugcgcaaggcacaggcccgacuccuuagcccucccacaccaaaggccaaaccugggccccaggacaucauugagcgacccuucuaugaccucuggaacccagacagugagugauucugcucucuugcaggugggcaugacuggugugggcaguuguccauguuguacacugacuguccaagaguguggcauccacgggcaugcucuguggauguugacaaacuuccagcagggagucugaggucuucagggccauccuuuccugcuuguggggcucccuucccagucuucagucucccccauuugugaagucccaucgagaugugguuugaggcccugggagccugagcaacuucccuugccuggauuucagugucauuuuuagcaauggagggacugguagggucccuggggcacaaacucccuucucugcuagaaagcucauugcaguugcucuccucucccugcagacccucuggacacgccuuugauuggucaggaugcauuuuuucuggaacagaccaagaagaaaggcgugaggguaaguuugcauaggcaagcagugggguagggagggcagcuucuucaugguccccaugccugucauccuaguggucugugucccuguccuagcucccaugaugaccgaccuugggaaggugaccuuaccucagugccuccauucuuuccucaaacuguagaguguggguuaaagaagaaaugucugaaaacaacccagugcucacugcuggcgcuguagguuggagguugguuuguggccaucaucuugagcucuaaguguuugcugcugugggccagguccuauggaaucuuagcacuuuuggggugauguguucucccugugggucuggaagaaaccuuggccuucacaucccuguguuaagugucuccaggaaaugagagcuuaggagccaggcuucagggaggccaggagccagcacuggagaaaagccccuggggcuagagaccuggaagagcaaggcagccauaggcagaggggcuuaaugcacagaagcuacgaggcagagcagggccagagaccugugcagccacggguaugcagugggcccugagucaccauguacguacggggagcaaaguccuaagacaguagucucagaacucaagggaccagguuggggaaguuugaacuaguagggaaccacuuaauguagggccuauaccaggaaaaagacuagauggggcggggggggggggggcaagacagcuugauguagagggcgcuggucaccugagguuucugaugugaagaucuggucuucauguucucugggaacuuuuggaccacgugggcaccagaguugucacccauacuuugcuguggcagcggagggccuacagcacagccaauguggcagugugccaggguauauagacccagcaugucacacgcucccccucccccagcugagcaaaggugaugcacccccuuuaaucccagcacuccagaggugggaacagaaggcucuccagccuggccuucagagugagcuccaggacagccagggcuaugcagagaaauccucuuucaaaaaggaaaagcagaugcugucccauuucccucgugggucuuguggccugcaaagcccuuccuguggagggauugcucauuccagggucagguauccccugugcagggugugagguccuggccucaugaacccugagucccugcaccccagauggaagagcuccaaugucuggcuccugguccuuuauaucucacaauaaaacugugagaugggcuggugggcagguaacaagggaccuuugcuccauggggaagggccugguaucagugccucccaugguggaaagcugagcacggaaaaggguguagggugaagccuuuaguaagacucaguucucugaauccuaacuugucaggccccacgucuuaacagucucacacuggucuuggggcuucaguguaggcauuuuagggguacacuggugguucuuggcauggaguucauccugccucccugcucuugucuuccuccagcggccacaacgccuccacaucaagccuucccaggugccugcaguggaggugauuccugcaggagccuccuacaacccaaccuuugaagaucaccagguuagugugcaguggguuccuggccuaacccagugcagguuucacugucuggaguccucgcucccauuuacccucccuuaccucaggccccaccugcuuccuucccugaauuugucuguucagggaccagaccaucuaaucagaacccagcauagggugagggugagaguagcucagaugucuccacugggcguguguagaggguggagccaugagcuggaucagcgcuaagacucaggcaugggguaggaucagagggacaucccugauauuagauucaccccaaacucucaccucugcccaggcccugcuucgagaggcccaugagguggagcugcagcgugagaaagaggcagaaaagcuggagcgacagcuggcccugcccaccucagagcaagcugccacccaggugagccccauccaccgcuugucacccgccuguaaccucaccugcccccacuugcugaccacccugcucccuaggaguccguguuucgggagaugugugagggccugcuggaggagucugauggugaggaugagcaugaggcaggccgugccgggcagccagaggcuggugaugggaccaccgagaucucacccacuggugcugcugguccugagaagaggauggagaagaagacggagcagcagcggcggcgggagaaagcugcucgcaagcuggugagcacccugcucugugacccuuguggccacacagggcccucggacagaagugggugacagggcaaacagcugucgagugacccgauaccagugccaucaaaggagaggucauggcuuugugggcccugggugaggaaggcccugggcagaguggcacuaggcugagcucuuacccucuguccacagcgggugcagcaggcugcacugagggcagcccggcuucagcaccaagaacuuuucaggcugcgugggaucaaggcccagguggcccgaaggcuggcagaacuggcacgccggagggagcagcggcgcauacggcgacuggcagaggcugacaagccccgaaggcugggacggcucaagugaggcacaggcuagggcuccaggaaaugggggucugcaaguuauaucaugcuuuuuucuuggcucugugagagccaaaucccugagugucucaacccuguguucuguagguaccaggcuccugacauugaugugcagcucagcucugaguugucuggcucacucaggacacugaagguacuugccaugaggguagcagaguguuauagggacccugugcccagugaugauaaccauccuugcuccccgugccuacucgggcugugggcgacaccauggcugcccugggcugggccaguugggccauugccuggggacugagggcacagggucagggugagguggggagggcaggugcuggugugaguuucugacccucagaaggccuuuugucacagucucuugucagcccuagugagucuccucaagcugugcuggggccuagccuggcuuugagguuuccauuuuuugcaguuguagccucuguccucugagccuagcuaggauagcacacauugacuucaguauagagcccccuggagcucagcaggguguagcuggggguacucuguggaggcuuuaggaagaugcagagcucugucugaaccccagugcuaucuaggacccugcuaaagucucucugacccucugucccacagccagaaggucacauucuccgagacagguucaagagcuuccagaagagaaauaugauugagccccgagaacgagccaaguaagaucugccacugugggaaggauaggggugggguggggggguggguugagacacuuccauacucccccccccaacccccugagauaagggaugcucaucacauuuuccccuuccccagguucaagcgcaaauacaaagugaagcugguggagaagcgggccuaccgugagauucaguaagugaggcccaccagcauguggcuggcugacauucugugaaccauggucuaccuugccccgugguagcuuagccuuccucccuuuugaaagcugccagugucaggcccuucccaaacccucugacuggucaaccagugggcgcucaggaaucuagaguaggggugaagaggaugccuaagggaaccaaccaaaagucucaaaucagaaggggcauuaagugagaaaggcuguggggugcagcuguccgcucauccaccucaacucugcccucuguccucagguuguagcugugcagaugucggagccccgccccucaauaaaguucugugaccaaa

SEQ ID NO: 12381 - RNA, 26290 nt, Mus musculus
ugcgccggcgcgccgcgguuugaaaggcccgagccuugcgcgcuugcgcacugagucccgugcagggcgcgcgcgcucccccaaccuucuccgggggccccccggagcugcaacccuucuucuucauucccuggacggucgggcguccacgggcguggacaugccggagaucagccuccgccacgucguguccugcagcagccaggacucggugaggggcugacgugggagcagcggggagacaggggcuuccugagggaugcugaggacuuuggaagcgcaaagggggggggggaucuuggcgggauucugagcggggcuccgggugggguuuccagaggcuggacgugcauuccgagagagacgggcaguuagggaaguuuggggccacuguggagaguaaggaaaaagaggggccugggaaguucuaacugugaagaaaaacucggugaaaggaaaacucgaggcagggguguguguaugcguguguguguguguguguguguguguguggugggacuggcgugaagucaaguguggagagucggcuagcucuugggaguuuaaacauucaaaaauaaucuuauuuuuaaaagucagcuuuauuuaaagaacuuccaccuuuccacccuugccugcagacccauugugccgaaaaucuucucaaggcggacacuuaccggaaguggcgggcagccaaggcaggagagaagaccaucucugugguccuacaggugaugcugccaucucccaccuccucauucccggggcagugagacccccgcucacauuccacugccagcuggcuggagguugagucguuuccuuucuguaguagagagcuugcucggcuaacuugccuggaaaaugggcuuagaaaucccugugccuccaggaauccuuggguaacccugaguagguugacucuacuucugggccucaguuucaucagcugggacagugucagccauuacuguuaacugugucccccggggccagaagguggccaagaagaguaucuccauaaaucaguuucauuguaaagacgaccgacauggaaggguggauggcucaggccuguaauccugguugcuugggaaguugagauaggauaacaaguucaaggccagccugcacaacuuagaaccugucuggaaaugagaaauaacuacccucacgaggacuauuaacauaggauuaggcagauagcucggcuguucagggcuugccuggagcaugucagacccuuccuugguuccaucccuaguaccucagagaguaaaggaaugaaacguguagggaagggaaguuuuguuugauugguuuuauuguuuuguuugugagauagagucucucuacggagcccugguuguccuggaacucacucuauagaccaugcuggccuccaacuuacagagauccuccugccucugcuuucagagugcugggauuaaaagcauguaccaccccacccuauucuccuuuuaaaauuuuucuuaaauugaagcuagucuugaacuccugauccuugucugucuaucuggggcagaggaguuccaaguguauaccaucaugccuagcaucugucaguuugccuuuccuucauuuagcuuacaacacacacacacacacacacucaguacugugcaggcuaggcaagagguuacuaauugagccaugucccuaucuuucugacuuugacuacuuuuaaauuuauuuuaagcugggcaguggucauggcacaccuuuaaucccagcaguugggaggcagaagcagguggaucucugaguuugaggccaaccuggucuacagagugaguuccgggacagccagagcuacauagagaagcucccauggggaguuagggaguuguuucugacagguacagaaacuugaggaaggggcuagagagauggcucaguggguaagagugccaaccggucucccagaggacugaguucaguucuuagcaccugugucugauggcauacagcaacagccuguaagccuagccccagaggcucucauaccucuggucucuggggcuucaucccccuuucauacacauauuaaaaacaauaaaaauguaucucagggcuggagagauggcucagcgguuaagagcacuggcugcucuuccagagguccugaguucaauucccagcaaccacaugguggcucacaaccaucuguaauggaauccgauguccucuucucgugugucugaagacagcuacaguguacuaauauacauaaaauaaaugaauaaauuaaaaaaauguaucuuaaagaaaaaucagugggagaaggaaauuagaugcuuuuaagcaccugcccacugccaguuggguguugaccccgugauucucugaguguccuacuguaaggggcuugguuaccacucacaaacggcagugccaagacucaguccacacuaagagugugggugcuuuggacagcuucgucagccuguuguauucauaugcaccacugagcugcaauccccagccgccaccgccaccauuaucucuuccuccuccccggagugcuucgguccccaguaugggucacugcccagcucacacacugacuuuccuugauguuagccacaucccucaguucugaguggagaaggacuuuaguggggacaaaguugaccugacuauuccuauacuuaacacacucuuggccuuuuucuugcugaguaguuuuggguuacaggauguuuugaggauuauagagauguuuucagaaaagaaccauaacauuuucuggccaaucugagguauuuaugccuuuuuaaaucccuaaucagagacugguaaugaaaacuaacauuguuccccauuguaaccugccagucagcaaccaucaugccucacauggcuugauucauucccuccuuguaaaguccugugacccacagacugucauuauccccauuuuacagauaaggaaaccgaggcccagagaaauuaugaaacccagcaccugucuuuuaaacugugugagaaccagauugcuuagcauuuaguuuggggaucuggauucaaauccuagcucuuacucacucugaccucaggcaaauguuuuuaauuucucuaaacauacccauugaaaauauagacacccaaggcugggguggugguuaaaaccuggugacauaaugucugcagaaguacucugucuacaugugggggcugggauaaagggagggguuggugauuucauuaugggauguugauucuucaggccuucaucaggugaccccccccgcuuccccccucccccgauaccccuacauauacugugggaaauaauguucagcucuauaagaguggugagaacagaaugcagcauccaggguccugaggaggcucagcggggaggguccucguggccaagccugacagcuugaguucccucguuggacuccauuuuaagagaauugccccacagagcuuguccucugcuuccacaugcacgcucauccccaccuguguacaucagaauaaauguccggcuggagagaugcuguggguaagagcacuggcugcuccuucagagaaccuggguuugauucccagcauccacauggugguuuguaaccuuuuguaacuacaaauccaagggaucagguguccuuucuagccucugagaggcaaaauacccauaugcauaagaauaaaaauuuuaagucguuaagaaaacaugggagacaacuagaggucauaugcaagcuacagacagugguguagaaggugguacuuggagggguucacaugucacguuuuagcuuuguggcaaaggucaagagucuuaguagcaucauuuguucccucauucauuuauuccacaagugugcucuaagcucuugcucuacguggacacucugugcucccgggucuguacagcugugugcagucggugaugaacaugcucacaccuggaggauggggguguugcuggacuagaggaggcuugccuagcauaccccaggcccuggguuugaaccccaacacccccaaaauuggaagcaguagugacuucggucugcaauucugguacucaggagcagcaggaucagaaacucaaggucaucugcuacauagcaagcuugaggucagcugggguugcaugagaccccagcauggaaagcugacaggcuuggugaagugacccuguauuggaugaugagccaugagugcuguggaggaaguggggcagggugagugaguggugcauccagccggagaugguguugucagguuuuuauuuaaauaugaggacuaaucucucuuuugaaaacuauucuuaguugaguaugguggugcaugccuuuaauuucagcacgggggaggcagaggcagguggauaucugugaauucaagaccagccuaguccacagaguaaagccuuaacagccaggacuacauagugagacucugucucaaaccaugcccuguccccauuauaaagaagauuuauuuuaugcauguauaucaugacgugcaugccuggugcuuucgaggucagacaagggcauuggauccccugaaaguggaguuaggaauguuggcaugagccauguagaugcugggagccaaaccccaguccucuacaagagcaagcaguaagugcccacuggugacuuuuuaaagcucuguuuguuuguuuguuuggugguggugguuuuugagacagucucucugcagagcccucgguggaacuugcaaugaagaccaggcuggucucgaacucaaagagauccacuugccugcuucugagugcuaggguuaaaguugugaaacuuuuuuuaaacuacauuuagcauuuagagugugugugugugugugugugugugugugugugucuuuagaggucagagggcacucgcaggagucacucugccuccacucugaguuucuaggccagcaucuuugcuccucgagccgucucugcagccuggagucuggugacagaagucuggugacagagucuggugacagaagucuggugacccugaacagaagagaaguucauucccagggaagggacagaggucagcuguguccgucuggcacgugagaggucggucaaggaggccagagagcaagguagggccagggcuucgccagggcuucugcauaggaaagauaggacccuucuuguucccguugagaauaaacagagcccauccugucagaccccugggacaauccgauugcacuugacacuggcuaauuuaugggcaacugaguucgaccaggguuagcuuugguuucuuuucagugacaacaagggagagauuucuggacaccaagacaguagacucuugugugcucaccuauuucccugugugcucucuaaacacuguuacacaacauugguauugccaaacagggcucagcccucugcuugugucagcuccacacaccucuuugucagccguggcuacucugugcccagcuggucaccugcuuccagacagggaguuaaaucuuugccagccccuccuggccuggaggggaugcugggauagguccaacuggaacacugcuguaucaccugagugucagccguacaauggaacacaucauaccugcuuuguuauugcuguuugagacagggucucauuguaugauacagcccaggcuggcuccaacucugauccccugcauaucacauguguugggaugucagguaugagccacuguaguuggugugauuuuuuuuuccauguuuuuucuuauuuuuaaagauuuauguaugcacaucugcacaccaaaagagggcacuggaugccauggagcuacguuuacagacaguugugagcuaccaugugggugcugggaauugaacuugggaccucuggaagaagucugcacuggaagcuaguacucuuaaccauugagccaucucucugcccccccccuccccuccccuguuuugagucacgguccuacuuuguaacuauggccaguuuagaacucacuguguagaccaggcuggucuuggaugcacacagauuuuccugccucuguuuucugaaugcuaggauuaaaggcguacaccaccagaccuggcagauauuuguuuuauguguaugaguguuugucugcauguauguuuguacauaugccuagucgcugaagaggccagaggagggcaucaaauccccuggaacuggaguuacagaugguugugaggugcuaugugggugcugggcaucaagccuggguccucuggaagaccuugugcuuucaccugcugagcuauaucccagcccccucacugggggauucgaggcaggggcucuaccacugagccacgcccccagcccucacugggggauucuaggcaggggcucuaccacugagccacgcccccagcaccucacugagggauucuaggcaggggcucuaucacugagccacgccccccagcccucacugggggauucuaggcagaggcucuaccacugagccauguccccagccccucacugggggauucuaggcaggggcucuaccacugagccacaccccagccccucacugggggauucuaggcaggagcucuuucacugggccacgcccccagaccuucaguguuuugagagagacauucacuguguguguagcucagacuggccuugccuugugauccuccagcuuccucuguagugcugagguugcuggugugugcugcuguucugcucuuuguuacuaguaucauuuugagacagggucuuacucuguaccucagguuggccuggaauuccuugugaccuccugccccugccuccuacauuccaguccaucacucuccuuacggagccuuuuuuccagccccucucucucuuuuuuaagucuugcauacaggacagcuuucaacuagccgacucucagagcuuugccuaguuucugugucugaucaguaucauguaccaugugugcauagaaaaauuaaaaaaauacaaacaaaugugcaaguauagaauaccagguuggggcuguuugugcugcccacuugguauguugccugccuagcguacauaguauuccgaguuugaucccuggcauugcauuaaccugggaagagaaggagacaggauccaaagucgggacauuguuggcuauauagaaaguuugaggcuagccuggguuacaugagaccuaguggugggggagaaauauauauauauauuuauauacaagucgaagccacaggaauggcucaguaguaguggagagagauaaaucaggcuaaggaauagagggaccccuugugggagauggcagaugcuacuuuguuuggucugaggcauugcugucuaaaucuaggucggaaggaaggcuugagcagugccgaggucugaggcauguucccgauucugggguggcagcugcgaaggcccugagcaggaggccucagccuuuacuggauauaagauaggugaugggagcacacaggacguugucugggcucaguauccagaagggucugugcugaagcacuguaagcuauggcuggcucuguucuccugggcuuugccuacacagcugugguguaaccaccuccugccugaggcugcucaucuaaucgcagcaccugcacuuacacccugcuagaagagcagaucuuacaucucuuccacaguuagagaugagagcacucaguuuugcuuuguuuucuuuuguggugcugaauauugaaccaggauccugugcaggccagacaagugcucuaccauugucccacaucccagaccccucucucugagacagucuugcugaguuaacuccugcucuugaacuugcccuguggcucaugcagaccuugaccucugaauucuccugcuuuuaccuaccaagucgcugggguugcaggcucaacuggcugcccuugugacuuugcggcaucuuagcuuccuguggagugaagccacugggacuccccuuggaaacauuaacuguaguuuagaaaugucagggcuggauuugaacacagaccacuuuguucaagucaagguuccuuucugccacggugcuguagugcccugacuggucugagagggcagaagggaacagcagauggucccagagcagaggagggccauggguggaaguacauaggcaguuaaaaauuuguuuuugcagcugggcaguggugccgaacgccuuuaaucccagcacuugagaggcagaggcaggcagauuucugaguucgaggccagccuggucugcagagugaguuccaggacagccagggcuauacagagaaacccuuucugggaaaaaaaaaauuguuuuugcuacaaaaaaaaaaaaaaaaaagauuuauuuuuaaguaucuguaugagggguagguguguguuagugcagaaaccagaagcauugguuuucucaggaccuagaguuacaggauguuaugaaccucuucugaguaugaagagcucuaacaacugagccaucucugcagcucugaccuugaacuucugauccucuugcuguuauagcuaggcuguucucacuuaaggaaaaacuaugauguuuuuauugaaccccccagacugacuacauguguaaagaggugggccucuagcugagaguaagcagggagcuuauaaagggaaccaccacacguuugguaggucccauugguguagcugggauggcuguuaccaagcaugacagguaugaacuuuucguaagaauaaggcacagcugugccaccaugguaucacucaggcagaacaacuggggagcuguggucucugggaagugcugugcauacccgagugucaggcugaccucaguuuuagccagauugagccaggucaggcuugagcgcacguguuuuucucauuucacugcguccacaccaagugcugaaauuacaggugugcuucauucaguaugcugauuaugcgugacugggcaucgaacucaggguuuccugccuccuggcuccagcugagccagccacaucugaagccaggacaucuucgaaggcugugauagcgccucauccgaggacccuguuaaagagccccagacuggacgcuuagcauugccuguccucacugccccacacccacacaccuuucagugucuucagccucaggcuggagccacaggugaguggagucuucauaaauagcucuuucuuucgaugaauaaugagccuguaucagcuaaugguuccuguuccugcauaauagauucaguaagaagccuggagcuuuucuaggccagagacugacaaaacaacuccugucaaagggagacagggacaggcaaagagucuccugccugcaauucuaacccccuggaaggugaagccagcaggauccccuuaaguucaaggugugccugguuauuaagugacaccugacaaaagaaaacuccaacuaggcaugugaaaauggagcugaguguggcggcucaugcuuguaaucccagcuguuagauuguguguagcaguggccuugugggucacaacuguuuacaguggccaagucucaaaaaacgaaauggggugggggaggcuggagaguuggcucagcaguuauaagcacuuguucuuauagaggaccaggguuugauucccagcacccacaccgcagcucacaacuaucuuaacucuaguuccagagguucugacacucuccccuuggccucuguggggccaggaagcagaugggacggacguaggcauacguccaggcaaaauguucauaugcaaggaauaaauaaacuuaagaaagaaaaggaacuacagccucacguuuggacuggauggcaguuucaagcugucucagagaaaugacuccagcccuacccggcccuccugugauguacaggagagucacugcugccgccuccaauuacagcagccucuggguucuauauaguguuuguuucuuauuuaaauggaugcuaaaauugguuucacucuuuuuguucacuuauuuuuaguucuaaaaucuuuagcugaacaacaacaaaaaaauccuuaaaacuuuuuuuuuuucaaauuuuuauuagauauuuucuucauuuacauuucaaaugcuauccggaaaguccccuauacccuucccccuuaaaacuucuuuuuuuuuuuuuaaagauuuauuuauuauuauauguaaguacacuguagcugucuucagacacaccagaagagggagucagaucuuguuacggaugguugugagccaccaugugguugcugggauuugaacucuggaccuucggaagagcagucgggugcucuuacccacuauguguaugaaugugucuucaugcaugccacaugugugccuaugcccagggaggcuagaagagcgugccggauccccgagaaccagaguuacuggugguugugagcagccugacguaggugcuggaacggaauucagucccuguguaagagcagccugugcgcguguaacuucgaggguccgugucucaggucccuuuaguacauuugagugugucuugugaacaaaaauuccugaaaagaaguugugucugcagagacugguagacugauuagaauuucaguguuguggcaagaguggaaucuugucgcuucagaggccgauuacuuucucuugggcugguuuuagcuucaggcagccuuuccuugccuuacuccaucugaacugacuccucguaauaaguaaaacccucucggaagcuuuuaauguagcagaacacuagccuccaccaggagagcuaagaauaucaucagagagcaucuugggccuauaaaaagcccccugguguacccacaucucugguauacccgucaguguauuuuuuaaguugcucuaauuugggggcuuagugguuaagagcacuggcugcucugaguucaauucccagcaaccacaugguggcucacaaccaucuguaaugggauccuuucugucugaugcccucuucuaacaugcaggcauacaugcaaauagagcagucauaugcauaaauaaaucuugggaaaagaagccucaauuuaugucuuucuuuguucugcgaaacuauaauacacuuaaugaaacugcuuccacauuggaacauggaguuugugguaaccuaaaucugcgauccuaggccuuggucacucagaaugguuccugaauaaacuaguuccuuaaacucuuuaagaugagucgggugugguggcacgcuuuuaaucccagcacucgggaggcagaggcagguggauuucugaguucgaggccagccuggucuacagagugaguuccaggacagccagggcuauagagaaacccugucucgaaaaaacaaaaacaaacaaacaaaaaaaaacccucuuuaagaugagagcugugguuuucacaucgacucugugugugggcacaugugggccuccucccaccguauagaucuuggugcuugaauuuagguagucaggcuugguggcagguuccuguaacugcugggucauuguacaggaccaggaauaaaggaaucucaagccuagacaucaacccuugccgcaguuagaaauauggcauuucugaaucucagccuggcucagggggcagcgaaugaguaccagagcugggauccccagcacccacaggaaaguugggugggcaugguagccugccugccugagaucccagugcuccugaggcagagauggaaucccugaaaauaaaguggagagccaucggggaagaugccugacaucaaccucuggccuccacaugcacucagacacagacacgugaauacacaaacaugcgcacuacacauaagcucucucgcuugugcgcacacaccccacuucuguauuguuagcuaucccuuaaagcuaucaccuguuuugauuucuuuuuuauauuugagacaaggucucaugugguccugacuagccuacaauuugcuguguagcuaagggugaccugaaacuugugauucuucugccuucaccucccaaaugcuggguuauacggugucaccaagccccagcuuugccuuucuucaucuuuuucagugagacuaauuuagucacaggagucaccaacauuaaaacaacgcuugcugacagcugcuaaguaccuacugugugcccugaccuucagccauguugauuaugcggugauccuugaucuaaugagggcgcacagcuaguguguggcagagcuggguucaaaugcagggcuccgugguaugcaaaccagacaccccuggcaggcaguaguuaguuaguccaggaacuucuguaguuauguguccucuguaugacaacuugcacauaacugugucugugacuauuggcacccaggagagcuccgugacaagcaguaguagacugaucagugugggaguguggggugugugcuggggaagcagguguguagugagcauccauucagugaauucuuagugccaugucugggcugccugcuagaaacagaucacucuacucacuacuuaguuccgguccccacugacacaccggugacaucucuuucugcccccuguuccaaagcaagcccagggcagaaccaagcacucagcauccuuucucugccccacaguuggagaaggaggagcagauccacaguguggacauuggcaaugauggcucggccuuuguggaggugcuagugggcagcucggcuggaggggccacagcuggugaacaggacuaugagguaagcaggguuggagaggccgacaccccgugucucuaucacuaacacccccccaccucaccacccccaucuccaucacaacacccccccacaccucaccccuaugucuccaucacuagcccccccaacacacacaccagccgccacaugugauuacauuaguguggagagccacccacccugccugucuccuggaggguccuggguaugccgaggagacagagcaggcaugggggaaagcugggcugccuggauuguggucaaauaaggaacaagaggcccucacuuguaaaauucaauugcagcuuagguaguggccugggaacugggguuccacagugucaugacucugguaaccuacaaaauacaggcccuuuaugauugauacuuaauuuuuuccuugagaugggucuuuccuuuugcccaggcuggcauugacuccuagacucaagcaguucugccucagccucccaggaagcugggacuacuauagugugcucugucaagccugccucauaggacuggcagaggccacuguagcucagaguauuagccuacuguuuuuccaguaaagugauggcggugaaaacugcacucaccaugaggcaguugacaagucugagccuaagccagugaagaacgaagggugugugcgcgcgugcgugcgugcgugcgugcgugcgugcgugcgugcgugcgugcauguaugugcguguauguguaugugagagagagggcagagccagguccagccuucugauguuagacuaccccagcguuggucuuuguugcacagcugugccuguugaaaauaaagauguuuugaauguuuugccgccucccccucccuuuuguuuuuuuuaaagauagggucucacugagcccugauugguuuugaacucacauguagccgaagcuggucuuaaauccccgauccucccaccccaucuaaucugacuaagugcugccauuacagcugugagcggccuucuuuccccucuguccugccgacuggcaccucaggguacugucagguucaaggggugaaugcaggccccuugucaucuuccuggccauagagagaacguugugucuuucgcuguuaaauaugacgaugacuguaggguggguucuuagcugguggguugccccaagaccccaagaccaucagaaaacacagauacuuacauuacaauucaagacaauaguaaaauuacaguuaugaaguacaaugaaaauaauuguaugguugaggucaccacaacaugaggggccuugggaaggcugagggccacugcuguagguuuuuguuuuguuuuuuuaagcugaggaacuucuuguuuguuccuaguuaauggaguuguuuguuugcuugcuugcuugcuugcuugcuugcuugcuuuuuaaagauagggucuugcuauauagcucuggcugucugggaauuccccuuguagaacaggcuugucucgcacucacagagaucuugcugagugcugggguugggagcucuuuuccugagugcugucuuggucuguuaggcuggguugcccuccucacucggcccuuccucauccccugcggcccuggauggcagccugugccacaugcccuccucucuggguugagcugcuucuuuccucacacuggaaauggguugcagggccuucuacauguuagagaagacuaccacggaggcccguccccaccugggcuccauaagaucuguuuuugcagaaugagguugcuugcaccaaaaccacuuuuauucucaaaauuauaugccaagucagcagauuuugguauuacuccaaaacaguucuuugcccaguucugcucacucuuaagugaccugagucacuuguuagcccaggggucagacagcucacagucagcugcagccccagcuucaagggaucccacacuucuggguuccacagcccugcaggcaccuacacgcaaaugcacaugucugcacaucgacacacaugcacauaaauacagucaaacuagagacagcuggaagagcaaagaaaggacaaauaagcagaucaggggguuggccaggguugccuccuccuccaggucacugcuucugcgaaucagcaugcuucuuccccuccaugcagaucacgcaaaggaagacuggcuuggagguaauucgagcuacucuggaagagggagaagggguuugcaagucaaggccaguuuagggugcuacauagagcacuugaggccagcaugagcaaguuggccaaaauuuuaaaauuaaaacaggaagaaaaauggggugcaaguugaggcuggagcuccaugguggaguaguguuugcuuagaagucuucauugugagccaagggugugccugagcagcucuuuacauuucugugugcaugagccuaaaacuccuuugcauuccuccuuauauacaugcugccuguuccucauguuccguguaaaggagggcacagauacuggauuggaaauaacuuguagacugggaauguggucucagaggccacuuccuuggaaaagcugguuggcuuuucuccugccacuacugcauucccuucuuccucucucuuagucccccauucucucugaguccuacccagcccauccucagccauuggcuacugccaucuuuacugauagauuaaauuccagcugggagcaaggaccuucagugucaauagacacagauucccgaucagagcaucagaaccacccucuacagcccugccuagaaucccccugggaggggcuggggauguggcucagugguagagcuccugccuagaaucccccugggaggggcugggggcguggcucagugguagagccccugccuagaaucccccugggaggggcugggggcguggcucagugguagagccccugccuagcauuugugaaaaucuagcuuucaucuccaauacaaaaaauuguauaagagagauucacuagaguugaagguagcccagacuagaguaaagguugucuuuggaaggaagcagaaaagcaaugucacaaccagagugguuuuuuucuuuacagugaauaaggcgagacauuugggguucccugccacuuagugacuuaguguugguaacagcucccagcuguugguuguacacacacacacacacacacacacacacacacacgcucaccaugcaaaauccagcccaguaguucacuugagauucuggcccuuuguaacaagugcagaagaagccagcgaguggcuucuguucuguauguuuuuguuguuguuucuuuuucacaaccccagcugagcaccaagaggcauaguguuauauuuuuuaaccauaguaaaaggcuuuuauuuucuaauuuuauaaauuuuucaguaugucaguuggaaaaagaggugaaauaaauagaauaagccuaacugaacauugcuuacagcaucagggaacaccuguucuguccucaggagggaaggcuagccccaggcagacucagcacugcucugacaguuugggcugggggagguagcuugauugguagcuuucuuucggauuuggcccaguggucagaagugacugcgguugcucuaucucaucaguggcuucggaagcagcaaguacagcagguggcuugagaaacaccguggccuugguuugccucccccucccgucauuccuauuuccuccuccauuucccugcauccucugccccacccugggauguuuuuugaggaaaggucuuauguagaccaaacuuaccugaccuugcaugcuuaaccuccugccagcacccccaagugccagugacaggcuugcaggaucgggccucacacuggcuccccaauccccugcuucacugaccuggaaccuaguucuucaguuaaggguggccgugccuucugacccuccgaccuccaccuccuaaggaauuggauuucaaguguuuggcaccauguuccaguuaugcuugcuguacagggauugggcuccagcuuccugugugcuaggcaaacgccaacugagccacauccuuuccccccacucccuuacuguguagcucagacuggccuugaacuagugaucuugccucugccuccugaguauuagaacuauaggcccgccccccacccgaccccucuucuuuguguucugauuggccagagcuguaucuugguccaacugcuggcagagggguggggcuugcuugcacuggucaugauuccauugguuugggcacacagcuuuuucaugguccagaacuauguggucaguucugauugucaucuguuccuucaucugcgucaguaucuccauuuguuuucuugagcugaucuuaagcaggccaauuguguguuugagggugugaguauaugcugccuuccugagucagagugugugguuuguggguucugggaccccuaugggccacccacucguucuuacuucugugaugggccugccaucaccugcagccagagaaugugcacauuauuuuguggacugaauuuuuuuauguaagaauguaguuaccagcugggcaugguggcgcagcccuuuaaucccagcacucgggaggcagaggcaggcgaauuucugaguucgaggccagccuggucuacagagugaguuccagagaaacccugucucgaaaaaccaaaaaaaaaaaaaaaaagaaugaaagaauguaguuaccaacuguuacuguaagccuggguucugaugaagagaagacagagcuguuguccccacuggggugaggaacagaaagcagguuggaaugauagaaacaucugucacagugcggaagggucacgggggcugagcaggugugcccuucccuuucuacugcugguggccccaagagagggguuaguauggggugcugaaaacuggguucauccuugcaucaggaggagcuggggugaugcuccuguagaugggcaagguugcagcgugcagccucucuagcuccuccugcugacggagccugguaaggcacagcuggccaccagagcugucuccacagagcugccccagccugagggugugggccggaagcaucacuuaauucuugaugcugcugugcuccaucuuuggauuugaucuuauuucugacauccuguaacuccuggccuuugagcuaacucaaccacgcauguccauagggcacuugaguacuguaccucucaccaagaugccucugugggacagucccuuagggcaugugguccucuguacugccugauuuuacaugaaaauuugucuggacugcauauggccuggugaccucacuauggagaacugaaaucagcaugucuggggacaaccccacaucaugcaaacagcccuguuaaacucagcaaaccuuaaccaagacacaaaaucaggagagcuuguugggaagaagaagggguccccagggaguuggagagggucaaggaagggugggugaauaugaucaaaacaaauugcauacaugcauggauaguguccaagaacaaugcaaaaauugaaaaaaaaaaaaucugucacggcagcaguuguuaccgaaguuggaggaguaaggcggagagcaguggagaagacacccagcaguccuccccugccuccacaugguacaugugcccacacacccaugcccaugcacccagcuccuagaggugucaucuuacacugucuucuaccuagguccuucuggucaccuccucuuucaugucccccucugagagccgaaguggcucaaaucccaaccguguucgcauuuuuggaccugacaaguuaguccgggcagcagcggagaagcgcugggaccguguuaaaauugugugcagccagccauacagcaagguacaugguguaaaagcugaggcaugcccagggcaaggggaggucugcggaggcccauccugagcucgggacugcucaggucagguccuccugggacaggcagcuugguucucuggagggggugagcugaggcccgucaggcucuguuugguaucacuguuacugucauacuggggcccggaacucaggcuccuccuacuucugcuucugcauccagacagcggaggagcaaagagcccgggguaguuuugcauuccagaaguggcuccagacagagauugggcacacagaaguggacucgcuaccugccauuggcagugagggucaaagagcggugcagguugaggggugagcccugacuuugguccacaguuaggggucagugagguuuaaugucagcaucaccaccauugcucccugggcaccagcuucaacugagccauaaagggcuucccuaagugaaggggcaugagagccuagcuuuguccuauucagacacccucacacccagcccucuguuccaggacucgccauacggccugaguuuugugaaguuucacagcccuccugacaaagaugaggcagaggcuacaucucagguaaguuguaccugguaccccccagagccucucccugccucuccaccccugccugccagcauucuucucacagcacugaccuugugggaccuuagaaggugacagugaccaagcucggccaguuucgugugaaagaggaggaugacagugccaacucccugaagccaggggcucucuucuucagucguaucaacaagacgucaucaggugccugugggacucggggugcuagggauggcguugguggagugcuuacuuagcauagagcccaauccugaaaucuccgcucaggggagacaaggcaggagggccagcuguguaaggucuccucugcuaaguaggaagucuugaguucagccuaggauguaugaugccugagagcugagggcauggccaggucucuaggucuggggaggagggcuggggccuggacuacugagucagggguacaaucuaaacuucugggucaccucuggaugugagagugacuugauaccugauagaugggagcuaaggugacuguggcccugcccucucacccucaguccacuuguccuuccauagccucuacgagugacccagcaggacccagcuaugcagcagcuacacugcaggccucuagugcagccuccucagccucuccaguccccaagguugugggcagcucuuccaaggugaggucaucagacgcuggggcaguggagaaugaggagagccggaagccaacccaucucuaccuccucagccucaggagccucccaaagggaagagaaaacuggacuugagucuagaagacaggaaaccucccagcaaacccucggcagggccauccacccucaagagacccaaauguaagcaaacuggauuccuugauucuguagugacccuggcuugugugucaugagggaagggcuguggucuugaaccugccauccuaagaagggaggcggaaagccugacuuccuguaagagcuggggcucgauggggcaccaaccuaauuucuguucuuuucuccccagugucugucccuagucguacuccagcugcagcuccagccucuaccccagcacagagagccgucccagggaagccccggggagaaggcacagagccuaggggggcucgcacuggaccccaagagcuuggcaagauccugcaagggguggugguggugcucaguggcuuccagaaccccuuccgcucagagcuccgggacaaggcccuggaacugggggccaaguaucggccagacuggaccccagacagcacacaucucauguaggccucugaccugccacacgguucccugcccugcccugcccuacccugcaugcccccgcuagcuucaucugucccuguucugcuauccucccucccugcuucuuugugcccuccagcccccacuucuuuacccccuuaguucucagcuuucugcgucccucccuaagcuccaucucuguucugucucagcuguccaucagaucaugucugacauuccuguuuugcaucucccagcugugccuuugccaacacucccaaauacagccagguccugggccuuggaggccggauugugcguaaagagugggugcuggacugucaccacaugcggcgccggcugcccucccggaggugaggccccacgaccugccucuuaggcagcgcacacaccugccucuuagcccagagcaggcaaugaagagccuggggccugcuggguagcucaggcgaucucaaaccaacauaagccguuuucaaagacgggcugggccugcagaugggaagucacuagccugggugggccacuggauuuuguaaugacggcugcuuugugcacauuguggguuguggcugugcagagguggaagggagccucagggcuguaugccauuccucagaacugauccuuuggcauccuuugggugccaggcagagcugugacugaagugaggacgcugggguugagcccugugcucacuucagcgagugggucagaaguguuagagcccagcuuugaggagcucaggaggggcacagugaucgcgggaugagaagcauggguagcagccaggcagagggcaugcagggcugcagagcaagcagggaugggcagcaugagcauccaucuccugacgcagugggcgggagaagaaccacuggcugccaacagcaggagcuguggagcuggagagaagccgacuccgaucccagugaggucguggcuugagucuguuuaauaagcagggcuaacccuggcacauucaugucggggacugugaggggagguggguggguuggucaguugaucuggaagugguggggacuccacauccugcuuggauuccacagaucccugggagcuaguuaucuagcuucaguauugugaucauccugaacagaugugcggagggugucugugggcgccuuuauucucugagguguguaaggauaguuagcuagugugccacaguagggacuugaaucuaggacacacacacacacaguaccaagaaucaaaaaucuuaggaugguugaaaaugaagagauggcucagugguuaagagcauugguuguucuuuuagaagaccuugacucaguuuccagcacucacauagcaacucucaaccaucuguaacugcagucucagagugauugaugacuucuggcuguuauaggcaccaagcacacacauaugaugcauagacauaugugcaggcaaagcauucauacguguaaaauaaaaaaguuagucuuuaaauauauacaaguugcuuauauaaaaugcuagaguauuuacauaaaaacugcauagaaucuuuucauacauuuaaaaaagauuauuauuuaaauuauguguauguguaucugugcgguggugcacauguguguucagguacgugaggagaccaguugugucaaauccccuauagcuagaguuacaggcaguugugagcaccugauguggguccuggggaaccagauuuggauccuuugaacaguauaagcucuaaacauugagccgucucuccagccucacguacugugaguguggaugucuaagaacugaacccaaggcuucccacaugcuaagccacacccccagccccucacuggggguucuagucagggcucuaccaccgugcuguauaucccuagccuuuuugguuuugauuuggaguguaggagggucuuacuaaguuguucagucuggacuucaauucacucuguucccaggccauccugccucucagccucuugaguaguugagauuagagaccugcucacuaggccagugugcucuuacauguuuuuggguuuuuuguuuuuuguuuuuguuuguuuuguuuuucgagacaggguuucucuguauagcccugguuguccuggaacucacucuguagacuaggcuggccucgaacucagaaauccgccugccucugccucccgagugcugggauuaaaggugugcaccaccgcccggcgcucuuccauguuuugaaucauucugugguuugaauccagcacuauguaaaugccauguaaaucuuuagggaaugacgagcaaacggagucugaauguugagugcagacacagacuuucuggucugugauugguuggguguacagaugcagagaccccagaugugggguuccaccugaauuugcauuugagacuuucccccauugcuuggcauucuccuuugauccucaaagaguagaccccccccccccauugcucuuucuugccuuaaauggaacagaucuuccccaugagggaaagagccugggguggcugaacugccuggcacguaguggagccccucuagggcugggaggggucagagggcagcaggauuccuucucuauccccaccucccucuacuucucaguccucugccugaggcccaguuccuccccuagguaccucauggcaggccuuggauccagcagugaggacgaaggggacucucacagugagagcggcgaagacgaagcucccaagcuuccccaaaaggucugaugccccuauggggccaggagggaauacugggugccaaccaggucugcugaauaccucagcuuccugcuucuccccgcugcuggcuguccagagccucacacugccccaaccucaccuagcccuucuuccucagcggccccagcccaaagccaagacccaggcagcaggacccagcucacccccgaggccaccaaccccaaaagagaccaaagcaccgucaccaggaccccaggacaauagugacacugagggggaagagucagguuagaaucugagggagaggucuacacgcuuuaugucugagggaggaggagggcuagggccuugagcccuggguuugggggcagggcuggugucuagcuuucugggucugagggggagggcuguauggaggugaaggaguagaggaggggccacuguguacccugaaaacuagauugagagggcaacugaagucaaguucauaggcccuggcuguacucucgggugccauucugggagggguguuacuagaugucccaggaaccaagccuguugacuggguugcuacuggcagaaggacgggacaacggggcagaagauucuggggacaccgaggaugaacugaggagguaggauugaaggggguacgucugccuggccuugggugugggugucugcucccuaaguguuuacccuccacuacucuugaucgcccaggguggccaaacagagggaacaaaggcagcccccagccccagaggagaauggcgaggacccguaugcaggcuccacagaugagaacacagacagugagacccccucagaggcugaccugccaaucccagagcucccagguuagacaucccugacucugugacauguccccuagguccccugggucucugcugugucaugcaccacuugcucccuuuccugugacucccacuuuaccccugcugacagcuuccugcucuggcaagcaccugugugacauugcuguagugaccuucccagugugagcaaccucauuuccugacuugugauucaggacuuaccaucucgccccuaaacgcagcucugucugucaucagcucugcugccccuggacaccugagugcugggcacaguguguuugcacucauuacugauaacguuaagccagcucuguuugugcgugugcuauugagcaugauucuucccuguuugguuuuuaugagacagggucucagggagcccaggcuagucugaaaccuguagcuuuccaucugccucagccucccagguucuuagauuacacgugugccaguacacccugccuaccagaaagcugcuaagaagggugucugagcccccugggguggaggagauccugcuguggggguucuugccuauaaucccaguacuugggaugucaaggcagaaggaucacaaguucaaagccagccaggcuacuaagacccuuuuuaaauaaaagaauggagggucaggagagcaggagagaaaagagcagucacucucaagcagugagggucagggucccugcaggagcccuuuccaggcuugugggcaaugucaggagaguauugugaacccccaaugaggggagugaauccuuggacaucguguggaaauaagaagaaaacuagcucagaggccagugugggagccagcugaggugaagugguggccagccugggccaaggccauaagagccccauggccgugugcuuuagcuacugcuuagcaccaggcagaggccugcaggagcuuccuggugacuuggaugaaugccuuagucacggcccucccuccugagcaccuuauccuuggugccucugccucgcccucccucugugcuucugaguacucaggagcuuggucagugccucacuuuucccaucucucccgcagacuucuucgagggcaaacacuucuuccuguauggcgaguucccuggggaugagaggaggaggcucauccgcuacgugaccgcuuucaauggguggguugugggguggguggguacagaggguaugggcugcgggaggauggcgaggauggcgucagggcccaguggcaugaccauagcugcaucguccugcacaguccugcugcccacgaugcuugucacccugcagggcccuucccccaccccuccugagggcaaggcugcugcguggaaggcacaggucucacaggcagcugcagggggcagaggucaagcuaaaagccaggcucacaaacaagaaagaggaagaaaagagcuggagagauggcugcucuuccagagguccuaaguucaguucccagccaccacugguggcucaggaccaucuauaaaggaaucugaugcccucuacuggcauguagguguacaugcagacagaugcuuaaaaagauacguggaaauaaagaagagagggguuagagaggauggcgcaggguuaagagaacugacugcucuuccagagguccugaguucaauuccccgcaaccacgugguggcucacaaccaucuguaaugggcugcagugcucucuucuggcaugcagguauacaggcagaacacugugcauagugaauaaaucagaggcgggggguggggauauuuguccagaaugagagccagaaagcuacugcuguagccagcagcguggcccguccgagugugugggcagcuguagcuggcagcguggccaccugagugugcaagcaggcugcucacagcugccccacccuucccuuucccccaccagcgagcucgaggacuauaugaaugagcggguccaguucgucaucacggcccaggagugggaccccaacuuugaggaggugagcccuggaggggcagacauggagaaccccagcccacuuuggcauucccucugucuuccgauuauauucccaaguggacccuuuucccguaggcccugauggaaaacccuucccuggccuucgugcggccccgguggaucuacaguuguaaugagaagcagaaguuacucccccaucagcucuaugggguggugccccaggccugaguguacaccuguguacgugcagaugugcacauguaugcacaggccugagugcacacguguguacacacaagaguuuaauaaaggagacuuuguuugaagc

SEQ ID NO: 12382 - RNA, 20719 nt, Mus musculus
aacuuuugaauuauuuuauucccauaguuugacaugauauacaggcacuuuggccaaugagguggcacaggccacuggcuccugccugagucaguuacccaccuucaagcccucugaggauuagugcuaguaaugucacacacaaaauggggggcuaggcuggggaauggaaagacaagagggggaauccacagcuguccuggggcuucagauggcagcagccuggguucccucaauccugguggaaccuggaacugcuguuucugaaaaucccacacugggcagucggacccugaauccaccuucuucccggucccuacucccacuccgggccuuggggcuuaaggacacccuaggaaaacggaauuugggugacuucuccccaacuggggacuuggagguugcaucacccuccugucccuuagagacuuuagaaggggaagccaagccuacccgaggcaggcggacccuuacccuaccccggcgacuggaagccccuuccccacugccuucuuccuccuccucaggacuuggagagccuucuccggagaccgacucacucuggcugaagcccacucgggguagccugagcuuuggacucuuagccuuuucuccaacuucuaucccuuccuuggccuuugccagaccaaacaggggcagccgaaccuugaguuugugcccaccauccccaucacccucaacuaccugguacucagcguggcuacucacuggugacgugaguuccacaucgggcaaugagagguggaaggugcgcugggccucggggcccuggggcucaacgcccucuccucugcuuccgguccccagugugggcaacuucaacuuuaucccacccucacucuuggcugcuucaccagccugggcuucauggcccagccccacauccagcucuagcuggggcacugucacugugggcaucuugaagaugcccucacccacuaacagaucacccccugccaccuggguuccagguagcuccagcaucaccuguggcaccuggacccuagagccugcugugcccucugcagaaggggcuacgaucucagggccugccuccccaaagcuggccaauuccaccuggggcaaagagauaccuaguguggacacccucugcacacucuccuggcccucugcaaccaccugcccagugguggacaccuggaggccugacggcuucacuccacuggugaccuucucugucuccugagcucccggugugaccaauuccaccgcagggaucuuaagcugcccagcuauggccuccagcuuuuccccggggcugacacguccauccugaguuucugcuuccuuuccucgggacaacccaaaagauggcauuuucagcuugggcaucuucaccuucccaucccagccccaacccuuucccucaagcucagccuccccugccaccaguacaucagccucagagucccggccuuucaccccaaacuugggcagagcaaaucuggacgauuuaggcuugcuaucagcuacuuccaccuugccugagggcagcugggcauccaggcugagcugugggauggacagauccagcgcuggcagcaacccggcuuccccagcucccuucgcuucggccucagucccugcucgagcuuugggaagugagaugguaaacuuggaaaccuucagcuugguggcucgcccaggccccuccaccucucccuugacagcuuugggcccugaaaguccgaauuugggcagagagaacuuggaagaggguuugacuuucaucuccaccaucucuagcugcucuuucucaacuucaacugugggcagcugaggagugacaaucuccacagagggcacacgaaagcccaccucuccaacacccacugcuacccuggggcccucuggcuucuccacuuugccugggacagcuucuuggacuugucccuccaggcccagggccccaggcaagucaagcuccacagaggggagagagagggaagggacaccaacaugggaugccucagugcccaccucuggcugcagacagggaagugucaugaguuugucuggaaccucaauacuugccuccccaggcuugcccacuuuccccaacuugggcauggucaucuugggcaacuugaaacuaaauucagucccuuuugccugcuccgccccugcagauuuccucuguaccucaggaaccuuggacaacuucaucucuggcaucuugggaagcugcaccucugggaccugugacacuugcauuucaggcagccgaauguccgacacuuugggcagcugcagcucuggaagggggacaucaggcacugccaugucaggcacuuuggggaguuuuauuucuggaagcuucauuucaggaaguuuaaugucaggcacuuugggcaacugaacuucugggaggcgaaugucgggcauggucaucucuggcaucuuagggaguuucaucucugacacuuugggcagcugaacuuccgggaggcgaacaucgggcacggccaucucgggcaucuuugggagcuucaccucggacauuuugggaaguuguagcuccgggagguggacaucaggcacggccaucucaggcaucuuugggagcuucaccucagacacuuugggcagcugaacuuccgggagucguacauccggcacggccaucuccggcaccuucgggagcuucaucucugguagcuucaucucuggaacuuucgggagcuguacaucuggaagguguacaucgggcacggccaucucgggcaccuucgggagcuucaucucugggacuuucgggagcuguacaucuggaagguguacaucgggcacggccaucucgggcaccuucgggagcuucaucucugggacuuucaucucagggacuuugggcagcugcacuuccggaagacgaacgucggguacaaccaucucagggaucuuuggaaguuucaugucugacauuuugggcagcuguaccucagggaguugcacaucuggaauggcugccucgggcacuuucgggaguuugaccucaggaaccuuagggagcuuuacuucgggccccuugggugccuugaccucaggcccagucacaccaaugccgaaagagggcaucuugaggguggguagcuucagcuugcucucagcaacagcuucagggccagagggccgggguuccaggagagaaagcccaaaggugggcauucgaagucugggacccuuugcuuuggccucagggcugcccuugacuacuuuggcuucaguggcuuccuucccccgaaucccaaaacgggggaaacugagccggggcaucuugagggccacuucaggaaccucucccugggccuccaccucugcacccggcaaagccagguccacccccauagacggagcugccacauccaggguagggacuuuuaccacugcagcuccuuccuggguguccaggcauggaagugugggaagaguggguagagagggcaggguggggaguuccacuuguggaaccuggauucccguggcugggggcuccacagccggugcagcuggggcaccuagcccaaggguuggcaggugaagggcaaagccgcuggcugccucuguugaugggguccccuugggaacugagaccugagggacacccaccucggcacuaggcagccgaggcccaacuagcucuaacugaggggcugugaacccagcuccuguggcugccucagcuucugccuuggccuuccuugggggaggagcagcagcagccauucgggcuaccugggccucuucagcuacuucucggacacgcagccgaggcagcuggaggcggcgacgggcuggggcagcugggacaggucccuugacagccucggcuuugagaccccgacgcagucgggagaacuugggaaaagagaacucgacgucaacaggggccaaaucugcagggguccccagggccccagucaccaucuucuucuucuucacaggggccagacucuggauguucugaggagagaggagagaggcaggaggcugugggacagugggaggcugggaguagauagaaaaauaacccaccuaguauaccaggcugggagaaguuugggguagaguauaucccaaaacacauccaccuuccugccugucacuucaggaaggcaaugacagucauucagaaucucacagugauguggcaaugggacagggauguggcaaugggaacccaaaaauucuggaauuucccccaacauccuuauuguagaguuggggaaacugcgacccagagaggaaaagaaacuugggucacucaguaacccaacagccauugggcuagaaucuggccuuccaggacuccaugaccccuaaugagcccggguugcaugguggggaugggugagaaccaccugccaauaggugcacccuuugacaggaguggaguuuaggagcagagaacaagggacagagggcgaauuagugucggguuagugacagacagagggccaaagugggccacagugaaagggaguaggguuuacggcgcagcagcgacccggucacuggggcuguccuggaccgggaccgggcuaagcacgcguaccagcuuggccacuuuggcccgugggcccuucaucucguauccagacaccgucccgggccucagugccagauccccggugggcacagugcgcuucaagcagaaggagaccuuguagggcucugcgcauugcagcaggcgaagugcauccucauauuugaaguucucaaagaacacacgggcacucagcagcugguccccugcaaacgagguggaggugggucuggagugagugucuccugacuccacccacacuugggcccacccacuuccaaggagucagccaagagaggcccaaucccagauuuugacccugcauauccacaggccucuagcuugagagguaauuucagagguuauggcuccaagagcuuuagcuuuagccccgccccuuuccggaaggaaccgauucacucgggccacuuaugguugucucuucacucuccuuuuccauccucaucauucaagcagaggguuccuugugagaucagaaucagaaaguagcauccuugagcacccacagggguuucauguaacucaguucacucuauagccgaggaugaucuuaaacccuugacccucuuccuccagcucaagggcuaagauuacaggcauuugccaccacacccugcuauggguuaugaagcugaaaaccuauaaggagguaccuuacccucuguggauggcuccuuccccagcuucuugaauucauaagaauacacuguuaaaauuggagacauagcucugcgacagagcacacuugucuaguacgaaggguguccuggguucagucuccaguauguucagucuguccauaugacagacaggcugacagaagauucaggccgugaauugucuuugccuagacacaggccucaguuuaacagagauccaccugccuuugcuguccaagugcugggauuaaagaaguguguugcuacacuugcucgcuccccuacuuuuuuuuuuuaauuaauuaauuaauuuauuuauuuauuuauuuauuuauuuauuauauguaaguacacuguagcugucuucagacacaccagaagagggcaucagaucucauuucgggugguugugagccaccaugugguugcugggauuugaacuucggaccuucagaagagcagucgggugcucuuacccacugagccaucucaccagccccgcuccccuacuuuuaauguaugucuguguguauaugggcucuggaaacugaacucagcacucuuuuuuuuuuuuuuuuuuuuuuuuuuuuugcgggggaggggggguucaagacagaguuucucuguauagcccuggcuguccuggaacucacuuuguagaccaggcuggccuuuaacucagagugcugggauuaaaggcguguaccaccaagcccggcugaacucagcacucuuaaccguggaaccaucuuuccaggcucugguaauacucuuuuuuuuuuuuaauuuauuuauuuauuuauggaaguacaauguagauuucuucagauaccccagaagagggcaucagauuucauuacagauggcugugagcgaccaugugguuucugggauuugaacucaggaccucuggaagagcagucagugcucuuaacugcugagccauuucuccagcccggugauacucuuuauugugucuguuuuaauauuuauuuuauugccgggcaugguggcgcaugccuuuaauuccagcacuugggaggcagaggcaggaggaucucugaguucgaggccagccuggucuauagagugagugccaggucagccagggcuacacagagaaacccuguuccgaaaauaaauaaggggcuggagagauggcucagcaguuaagggcacugacuguucuuccagagguccugaguucgauucccagcaaccacaugguggcucacaaccaucuuuaaugagaucugaugcccucuucuggugugucugaagacagcuauaguguacuuacauauaauaaauacaucuuuuaaaaaauuaaauaaauaaaauaauaauaauauuuauuuuauuuuuguuuaugugaauaugugacugugaguguauguguauguauguguguguguguguauguguguguguguuuguauuuguguaugugugaguauguauaugugugugcauguuugaguauauguguuuauguuugucuuaguguguguguuuuuuuguauguguguguaaguguauguauauuuguauguguguguauauguguguguguguguguguguguguauguauguauguauguauguauguauguauguaugcuggcucccacagaaacgagagagggcuuuggauuuucuggaacuggaguuacagauaguugugagcugcccagaaagggugucagagacaaacucagguccucuguucagcuugugucuuaaccgcugagcuagcucuccaaccuuguuuguuuguuuguuuguuuguuuuugcuuucugaagcuggguuucccuguguagcucaggcuagucuugaucuuuuucucacuaugacuccaaggcuagccucaaacuaucaauccuccugccucagccuccugaguacuaggauuauaguaccccaguuuggggaauuuugugaagcuuaguaagguacccacauuuaugcuuccauccuugaauuccccccucuacacuuauugggucccccaaucucugcagggaaguuuuugagcacuauucacccaaguauuaaaauugugaauguacaaaucucauguaaacauaauauuugcauaaaaccuauauacauucacccugcauucccuguacuucaucucuagguaaaauuuuggaguuuuauuauuauauuuuaguggguuuuuuguuuguuuguuuuuaauauaugagcauuuugcuuacaugcaugucuaugcuccgcaugugcgccugguacccauagaagccagaagaaggugucggaucccccaggacuggagucacagaguuuuuuugaacuaccauguggccacuaggaauaaaauuugggucuaaagcuaagcauggugaugcaugcuuuuagucccaacacuugggagguagaggcaggcauggcucugaguuugaggccagccuggucuacagagugaguucuagggcagccagggcuauacagagaaacccugucuccaaagaaaaagaaaagaaucaucaucaucaucgucgucaucaucaccauguuccuccuccuccucauccggguccucuggaagaguaaccagcacucuuaaaugcugagccaucuucucagccuaacuuucuaacuucuggguuuguuuguuuuuugguuuuugguuuuuuuuuuguuguucuuguuuuguuuguuuguuuuguuuuguuuuguuuuguuuuuuaugaugcuggagauugaauccagggccuuaugcauacuagacuaauguucuaccacugagccacaccccaaggcucucacuucugaacucuaggcaagugcucuaccacugagccagagcccuaguccucuuuucucuaucuuugagacaggauguuacuaaguugccaaggcagaccuugaacuuuccauucuccugccuuggacacuuaaauaacuuuguuuguuuguuuguuuguuuguuuguuuguuuguuugauacaaaaucucccugugugguccagacuagccuuaaacucaagaaucuccugccccaggcucccaagggcuguuggaaugauagcccagcacuacaaacuccaaauuauauaugauacaauguaaauacuauauaauaguuguuccuuuguguuuuaagauuuauucuuuuguguuugaguacuuuguuuccaugcacaacagugcagagcccagaagagggcauaugacccuuguaagggacaguugugaggcacaguguggguguugggaacugaacccugguucucugcauggcuagcaaaugcucguaacugcagaguccuaucucuagccccuuagggaauaacgaaagaagaaaguccagacaugggcuggugagauggcucaguggguaagagcacccgacugcucuuccgaagguccaaaguucaaaucccagcaaccacaugguggcucacaaccauccauaacgagaucugacucccucuucuggaguguuugaggacagcuacaguguacuuacauauaauaaauaaauaaauaaacaaacaaacaaacaaacauuaaaaaaaaaaagaaaguccagacauguucaguaugggcacuucccccccaacacaggcacaaauaauuucagucucugaucggcugaauccucagauacagaauucagaaaugugaaggguagauugucuaccuaggugcccuuccacaccccuagucaguguucaagaaacagcuuugauuugcagcauuugaugggucccagguugccugucaucccaacccuccagaggcuggagcaggagaaaucaaaggcuugccuggagcacaaagggaaacuuugucucaagaaauuaaaauaagaaaacaagcuggggggcuggagagauggcucagcgguuaagagcacugacuguucuuccaaagguccugaguucaaaucccagcaaccacaugguggcucacaaccaucuuuaaugagaucugaugcccucuucuggagugucugaggacagcuacaguauauuuacauauaauaaauaaauaaaauuaaaaaaaaagauucacuuuaaaaaaaaaaagaaaaagaaaacaagcugggcaugguggcaaugccuuuaaucccagcacuugggaggcagaggcaaauggcaguaguaagucaguucgaggccagccuggucuacagagggaguucgggauaaccagggcuacauagagaaaggcugucuugaaaaaccuaaccaaaccaaacaaacaaacaagaaaagacuaaaggccgugucugccaagcuccuaucagguagcacguugaagccuggcaacugcuccucuuaucccuuucuguucucuuggauacugcucagagccugggcaugcuuucccuggcacaguguuuuguguuuucuuauucuuucucugaggcucccacaccccuccccccaucccuuuagccaugugacuacuuacuaaccuccauugcuuucuuggacccuaacuuaaaagaccuggcucucucucuuccucucccccacucaacaauugcuaagacuuacugccugcacugggguuuuucucccagucuguaauaaaauuguccuuggguguuuuguuuuguuuuguuuuuuaaaaaacacuccgaccuugucuuucuccaaacagguaucagcaggccacucaguccucaggucaaaccuccuuggagauuccccacaaccaaugaaguggggaugaaaccuggccagucacucuaucaccuaaaagugaugccuagaagcauccuugaggccucccucucuaugguagcccacaccuaguccugaauaucugagagucaaguccuuccaacaccaccauauuaagccugcccauccaucacuucuuagaggcuaauugaucuugucccugaugcugccucuuacauuucagccaacuguaaauaaagcagcuaaacaagacucauuucugcuucucuucugcuuaugucacagaauaaaagucauaguccuuaugagcccuucaaaacugcccuugccccuaccuucucaugaguuucaccccacuauucuguaaguuucuuuuauuuauucauuuauuuauuuauuuauuuauuauauguaaguacauuguagcugucuucagacacuccagaacagggagucagaucucguuacagaugguugugagccaccaugugguugcugggauuugaacucuggaccuucggaagagcagucgggugcucuuacccacugagccaucucgccagcccuucuguaaguuucuuauguguagggaccuuucuguguucuguucaccauuguagccaaagcaguaagaugcuuaguaaauaacuguuauggaacgggauguacuucacugguagaaggcuugccuagagcucaccaaugagaggcugggagcacaguucauagagcauucaccuagcauucauccaaaaagcccuggguuccauccucaguaugacaaaaaugaacauauacauuuuaaaaauaauuaauuaaagaaagaauaauugcuacaugcaaugcauaaguugaaacagcucuauccauaguucuuaaaaacaucuuucauuuaauuaaguuccucucuccaucucaaguuaacuccaccccuuuuuccugucccaauaacacauuaauuagcacuuacauagugcuuacugugugacacuuaucugugugcuguuuucaaaaccugacucauuuaagcuacauaauaaccucaugaggucagugcuaauuauucccauuuaaagaugaaaauauggagacacagaaauaucacgaggguucugggaguccaacacagacaaugaaccggcccuaaauaaucauagugccagcugggcauggucgcucaggccugucaucccagcuacccuggaggcugaggcagaaggaucaaaaguucaaggccaagggcuggcaagauggcucagcaguuaagacugcucucugcucuuccagaggaucuaucacccacuugguggcgcacaggggauuccgagcccucuucuggccuccagggguacaacagauacaucacacaccgacauaguugguggcaaaacauccauacaaauaaaauaaacuaauuauuuuuuaaguuuacagccaggguuacacaggaaguucaaggccaacucgagcaauuuagacucaaaaauuuuaaaaaaauagaaagacgggcauaggggugcgugccuauaucccagcuuuugguagacgaaguacauccucagcuguacagcgaguucaggcaggccugggcuccuuuccgagcccccaaaacaauguaauucggugguagagcaaaggccuggcaugcuggaggagcuagauucagaacaaggaaagccucgccacaaccucuuaaccccgccuccuagcaaauaagcacaacuucaguuucauccugccagcacucuaggcggauaccuaaccacacccaugcaggucaacccugacccaccaggccuucagacuccgccccacuccgccacgcccccgccaggccccggacccaaagcagauuccuaacuccgccuccacagacccgaugugccccgcccuccccaagucacgcccccagcgcgguggccaaggcaaauucuuaacuccgcccccauaggccggcuccgccuugccauaugcagaccacgccuaccuucuugcaagcugaggcucuuagcugccggugaguccucucgcagcucacggacaaagauuccuucuuugccgccgccugcuacguugaagccgcugaccccggucugugccucggucuccacgauaaucuccaccaacuccgcccgucucagcuccugcgaggggcagcaaggggucgccauggagcuccaagacggcaacucgcccagagcucgccauggcguuccuucucuaggacccgcguugugguuaaacagcucuccuuucccgcucgcucucugggagggucgcgguccgaaaagcaaggggcggggcggggcuggaagaagaggggaugaguaggcggggcaagaucauggggcgggacuagaagugccaaauuaggugauuuugagaagcuuauuaauuuuccauucuuucuuccuuuucuuccuuuuuuuucauuuuauuuuugagacagggacuccuguagcccagaacguccuagaaauccuccuucagagauccuccuuaaaguacugggacuaaagucauaagacaaaaugccaauuccaauauccauauuuuaaagaccaaauggggcuuuaauaacuacacaacaagccuagggauuuaacccagugguagaagucuugcauagcacgcacgagguucugaguucuguucccaacaugaaacuaaacaaaccaaaauauaaaauauucagcuugauaauaguuauuccuacaggacaaaggcaugccucuaauaaagggagacacccuuaagccaugcgggauggaagaauggggucuugcccucugugggcuugaauauguguaagaaugcuguugugaacucuuaacuccaagacaugcauaacucccccgggaaaaggaauccaaugaagggggggggggugcguggguaaugaauggugaccgcagcagaacuggcauucaugguauuugcuggcccuggcucugaaacacgcuagaggguucacaucugcuucccagaaggggaagcgagaggucugauucugucuaggaaaccacaagauuuugcggagcaccuugcacuucugggccuguugcuguacugcaaaguuggguggugugaaaggaaagucugguugugaacugaaaccugaccaagcauggauggaccugggagaaugcaaggcacugcgaccagccaggagagggaaaaucaggccuagacuagaugcccuacugcagugggacuagagcaggagaauaugaaacauuaguugggggggggggagcuucuuggaacaguaggguccuuccacuccccuuuggacagcaucuugugucuccccguguuuuuuugggaagucacaggaaggcaguaacuccuaggaauuuaaagugacuuacuuaaugccucaaagcacauuaacagccaagucuugucuuagguauuccaccccaggacucuauaggccgugaccccauugccugucacccucagccuuaaugaggcuccuuuguaaguagagccacccagccugguacucaguagaagagguuaaaacugcuaacaucgaaucugaaagcaguggcagugacugaaggugaucucuugguaccagacuaugcaguaguccaaaaaaugaaccaucggaguucccagagauggggaccaucaccccaccucaccaguggggaagcuggggcuccaagaaguuaggucaccugcuuagggcuguacauaaagcaggaaaggacuggauuugccuugugggucccuacguccucuacagugacuuuguacuuugucagcucuuaucuguagugggguguuuugacucagggucuuacucuguauuucagguuggccucuaacucacaguagucccccugccucagccuccugaguacaagugcuaggaucauaagcauguauccaugcuugguuauaacuagucucuucugauaaaauauuucuguugaauuuuuugguuuuguuuuuguuuuucaagacagggucucaaggcacuggcugucuguccugaagcucacugugaagacccugaacucacugauccaccugccucugcuucccaagagcuaggauuaaaagccugugcuaucacacccagguauguuuaaauuuauuuuaaaaugacuugggagcugggcagugguggugcacuuuaauucuggcacucaggaggcagaggcaggcagaucucugaguuucaggccagccuguucuguuuacagacuacagagacaguuccaggacagccaagacuacaaagagaaaccguauuauuaaaaaaaaaaaaaaaaaaagguaggggcgaggcagcaaaacaacaagauaaacaaaggauuuugugugcaucggcguuuugccugcguguaacgcugugcaccacauacgugcuuagugucaguggaggucagaggagugagugugucagaucucuaagggguuugaacccccaugugguugcuggaaauugaaaggaauccucuggaaaagcagccaguacucuuaaccacuuugccaucuguccagccaaggguuucccuuuuuuguuuguuuuguuuguuuacauuuauuuauguguguguauaaugcaugaaggucaaaggaaucaauuuuaggauccggguccucuccucuaccauguagcuuccagaagauugcacucaggucaucagacuuggcagcaagcaccuguacccacugagcccaucugcuggccccucugcuggguuucgucaucgucaucaucgucaucgucgucaucaucaccaucaccaucaucauccucauaaucgagggcugacuccaagaucuugugcauauuaggguacuuuaccccugagugacacuuuuuuuuuuuaaucuuugugggauaggaccuuacuaaauugcccaaguugaccuugaacuugaaagccaaaaugauaggcauaagccaccacacccaucuguaggccccgagcgcguuguauugagcauuugacauguuaauuucucccucacauuuccuauuuccagcuuccagguggggauaccaaggcccagagaagccgggacaugccuucuuggcacccuaaccuguggacacccaccucagcgcugcggcuccuggccuccauagcucugcagagagucaccugggggcucgagcucccguguccucuccuccuucugcugcaggaccaccuucagcuccucauggagcagcugccgcugagccuggggguauaagauggaggccugaggcaaggagggauugucggguagagauggggcuugccagagaggucgagugcagggauggcaucaggcgggcggagaguagggccccucaccgcuucuugagugauggccuuuucuccugacaggagccccacucggggugaugcacagcuguaagcaggaaucucacucuuccuuugaggucuugcugccugccaaggagagagagacaaggggcgugggacaucagacagacccagggaagauagagaggggcaugcggaaccagccagcucucaccugagggucacuuccagcuuccugggccuccugggucuggggcucuaggaagaacaacacacacaguaguauuaucucauauccccugugcucguucugacgauucuuugugcucaagugccuuacgguuauuucccaggccagccuggauagccuccguagugagacacugccucaaaagccugaaugccgagccaggaacgcuugcccgguaguacacacuggcagucccaucaugucugguuuguucugugcuagugagucaaucccaggguuuugcgcaugcgaagcuaccauuuuaccaccugagcuacauuccuaggccucgcuuugaguuugagacagggucuuugaacacauuagccucaaauucucuagguagcugaagaugacuuugagcuauugcccuccucccaccccauuucagccucccaaauaccggggucacaggcaaaugucaccgucuuuaguuuaccagacagcuacuuuacugaaaauaugccgucucagagaagccaagcaaauuuguaccgguguggcacacaacccaagaagaaggcacagagaaggcagccuccagccgggcccuccuggugacauggaggaggugacugucucugagcuuggcccccaccuggcaugccagcccgccaaccccugccacacaggaaaaggucaggcucaugcggcacauucccucacacaauggccagucugcugugccagucacauucugccccugcccacccgcccacccacccacugccauacaauggcccuucauagcucggcccuggagcaaaggagaucagucaguagagugcuugccuagcaugcacaaaggcccuggggucaguucuccagaauuuccuaaaccaggcaugguggcacacaacgauaaucccaguauuuuuuuuuuuuuuuuaaagauuuauuuauuuauuauauguaaguacacuguagcugucuucagacacuccagaagagggcgucagaucuuguuacagaugguuaugagccaccaugugguugcugggauuugaacuccugaccuucgggagagcagucgggugcucuuacccacugagccaucucaccagcccgauaaucccaguauuuggcagguagagacaggaagaugaaacaauucaaggucauucuuagcucccuaggccaaccacaugaaaugggucuaugcaacacaacaaacuuaggucacaauuggcugaacuagacaacccucuggacgcauccacacaugcuguaaucacacccccucaagcccaccacuggcccccaguaucugaaagcuccugucagcaacuccuaggaaucccagauucugucucuaagcccagccucccuugugaacccuuucggcuccugcacacaagcugaacaccucuccuaagauggcuucccugugaaccaggcccuggcacagggacagagaucaaggcuuggugagaaguuuccuguccagagucacaaagccaggaugaggcagaguaaagaccuaugcccuuggccucuacucuacaccuaacuaauuugcggagcugcuggggagaguugaggugagcaagaggagucaagcugaauaaauuccagaggaccuugucggugccaggccuggccgcgggacacuauuuugcugacaaguaaaggaaaguuaaagacagacugucguaaacuggguguggccggagacuccuguaaucaaauaggauuaugaguuaaaauguagccugagcuacaugagacccugucucaaaaauacugaaaaaauacuggaaggcaggaagauuuaugguuuauguccagcaacauguucuggcuucauccugaacaugaccaucucaaaaaaaaaaaaaaaagaaagaaagaaagaaagaaagaaaggaaggaaggaaggaaggaaggaaggaagaaagaaagaaagaaagaaagaaagaaagaaagaaagaaagaaagaaagaaagaaagaaagaaagaaagaaagagaaagaaaaggaaaggaaaggaaaggaaaggaaaggaaaggaaaggaaaggaaaggaaaggaaaggaaaggaaaggaaaggaaaggaaaggaaaggaaaaauuuacaaaaacaacaaaaggaguggggaccugagagauggcucagcgguuaagagugcuggcugcucuuccaagggaccuuggguucaauucccagcauccauacgauagcucaaaacuguuuguacuaggggaucuggcaucuucaaacauacauguaggcaaaacauuaaugcacauaaaauaaaaauaaauaaaucuuuuuaaaaaaaaugggaguugccggguguaguggcacacgccuuuaaucccagcacucgggaggcagaggcaggcggauuucugaguucgaggccaagccuggucuacaaagugaguuccaggacagccagggcuacacagagaaacccugucucgaaaaaaaaaaaaaugggagucaauaaggucugcggggaaccucuggggagaaccuugaccugacauaguggcagauaccaaggaggauguugaaggccacauucuugcucugggcccaggcaaugaggcaacaccuagaaccugacacaggaagccuaggcaggacgggcaacacagugucccccuucuucaucccuccccuuuucaucugucccuggaacagcugcccagcccaaguuauauuuaggccucugagcccuuccugagccacaugcccagcuccugggcaggggugggggcagcuuccgaaggaaauguucccucugcagucacucuuuguucucagaccugcccaucccacuagguaaggaaguggaggacaggcuuccggggagucccugguuugugucacaggaagagggaaugagguucuccuguugaauuguggccuggcagaacuuucuggaggcugacagcucauuucccgagacacuacccuagcauacgccugaaauucauccaaacuuuucaaggacccuguuucuaaaacacauuuauuuuguguuaaggucuggaaaugucuuaggcaggcgguggugacgagcgccuuuaaucccaggccucaggaggcaagaagcaggcaaaggaggaguucgaggccagccuggucuacagaguaauuuccaggacagccagggcuacacagagaaacccugucucggaaaacaaaacaaaacaacaacaaaacaaaacaacaacaaaacagaaauguaaugucuuuuuaucaauguugggcauugaaccuaggagcucauaguugcucagugguagagcauuuggccucugaucccucuacucuauuuguuguaugggggauacaaagucucauguaccccaggauggccucuggcucccuacguagcucaggauggccuugagccuuugagccuccuucaucuaccucacucccucgugcugggauuacaggcucaaccacagcaggcuuuaugggaugcuggacaucaagcccuuggccucgcccaugcuaggcaaagcucucuaccaacuggucuguguucucuaacauaucccagccuucuuuccccuuuucauuuuaaggcacagucacacuaaguugccuagaauggccuugaguuggcuuagcaggcuaacaccaucaggcccagaucuacuugucuguuuuaggugccauucaaacccgugguguggcucagaggcagauaucaucaucggggccuucccaugacccagcuaaggauucuuuucuucuggcucccuccccccaagagcugcugucuaccucaugugugaauucugcccucucagagccucgacuucccuaagccaucuauggucugcugcccucaccaaugcccagcccagccuggcccccggacacuaagaccauguaaugagucuaagaggaggugcccagcuaugaccccuuagguuggcccagcuccagugcuuccucaguccaaguacauggaaaaaaccuucucuuuggggccucaguuuucuuaccaguaagaaguaugcauccaauaaaaguaguuucauuggcauggugccagcuuguaaucccaacacuugggaagcuggggucagaggauugugaguuggaggccagccuggagucugucuucaauacacacacacauacacacacacacacacacacauacacacacacacaccccaacagguacuuugacuauuccucacauaugguaaguguucaguuauaaacuaauuucuggcaacaucagagugcagagagcaggggcuaugcaccuguuucucagauucagccaucuuuguauguuugagacaaaguuuccugguugugcaggcuggcuucacacuccccguguagcugagggugaccuugaacucuugauccuucugccucucuccaccucuguuauguugggguuacaggcaugacccaucgcaccugucuucaauacccagccuucguaccacagcagccccccaauuccucccaaccaaaagggaacaucaaauugaggcaccaacuaaauuucaaguccugucuccuaccaaugggaucaaugcuagcucuccagcacccaccuucaaagaccaagaacccuuucccagcaauucacauauuccacccaaggggccucuaucugcccaucuuacagauaggaaagugaagacaaagggauagcccgaagcugcccaggcagguauaggugggcacaccuauaaugccagaacucaugagacuuuauaaacucagaggcuuuucuggagucuaaaggcagccuggcuuauauagaaagaaucugagacugugucuccaaaagcacuaaaggaagggcuacagagaacaccguagacuggguagauagaggcuugccuagcaugcaugaggcccuggauuccaucuccagcacacuaauacucagcgcgguugugcaugccugugacccuggcacuugggaggcgaaagcagggagucuacaagcucaauuauauccagcuacauaaacuggagcccauccugaaccacgagagaucaaaggacccacacacacacaacauugggagcauagaauuugaacccagagccugguucugaaguccaugaauuugacuccuauguuaaucucccuucccagaccucccagaacccugggcuguguuccuagggaugcucagcccaguccacuccagaguggccagcugauuauuucuuaccggugggccuccagacaccuccagagcuccuuggucugucugu

SEQ ID NO: 12383 - RNA, 21915 nt, Mus musculus
ggaguuguaguucucuauccuaucucggccucuucuuguuuccgcugccgucacgggacagagcagucggugacagucccgagggcccccaccccguucccauggccgagccggaccgugaguuaggggcccuguugggagggugggagggucgggccgcgccggggccuggcuuugggcugcaggccccggggcccgaggguaggcucgguggggcgggagacaggaucuaccugaagggagugggauucggagggguguugcuaagugguccguauuacuagguugguugguuucuggauugugaaauguaaggguccgauugucaaguucuuaaugaucgcauuucucguacuuuggcugcugaggacccucguugcuaaggaccaaaguuaccacuaucccgguugcuaagguugucuguuguuaagggcaacuguaggauggguuccggggaccccuguggccccuuacuaucucauuccuucaguucuugugccucuccuaaaccuccuaccuucacugcaucuccucucccacacucaacucucagcagaaguaucccuacuuacgucucuugaaaaacuuagcccucccucauucucucgacucgcacaugcuaccauauccugcuuaacucugaaaccuuccuucaguccagucucgccugcuuucuccuccuaaagauuccccuccucagccuuuucacgucacacauaccuccacucuaaaauaugccuuuucccaucuccgauaguuuuacuaccaucccugacucugaaauaauuagguugguggguccucuuguccuccaccauugugagcccuucugcuuaacucuuuccccgcacuguaaccacgucugcuccccuccuccccagccucugacccucuggagacccaggcagggaaggugcaggaggcucaggugagauggggaagggguggagggaaggagagacuugguuccacgugccgcacuggggggagguggcaagggaaggcuuuuacccaagggcccuuggcuuauggcccugauccccaagcccaucuggggauuaguacaaucuccugggagaaugguggcuucuugggacugucaaggaaaauguauagccucaaccccugguucccuuccauaucguccucguuuccuacuguugcccaucccauccucagccccuucugaaccucauuugugcuggaccugaaagagacgguuuuccaguucaauccgcaaacucagauccuaugaggugggggaaaggacccuauagggcacguuauaaaaguaucgaagcuggguguggugccagcccccuguaaugccagcacaugggggggggcaggggaggggggaagugagguaggaggauggagaaaggagaggcagcuugggccauauggugagacccagucucaaaaaaggagggaggaagggagagagcauaccccuggaguaccgggcaaacucugugggucagagauuauagaagauucuagccaaacucuccccugguggaacccacaagcugaucuaggaacaagaccaagauauagucacagugucguauaagugaagugauaagggauuuucuuaaaugagaucggaggugguguuccaugcaggguacaggccugagagcacgaagggauaguagauguuucaguaguuggguugcuggcguggucauuuauugauacucugccugaauuuuaauguacaugacuucauuuaaucuuugcagcaucccagugaagggaaggccucucauggcuguguuacagaugagcagcuuacuuggugaaaacuguuaaccccuguguucuuuggguagaaaggaaagggcuugaaacuuauggggaaaugggcuccgaaagaugcugcagcuucaguggaguguagaugagccaucucaaagauguuugaagacacgugccaaggccuccgguucccccagaggccagguuguccucauauacucgaggagugguucucaaucuuccuaaugcugcaaccuuuuaauguagcuccaacgguguggugucccuccaaccauaaaauuauuuuguuacuacuucauaacuguccuuuugcuacuguuaugaacuauaauguaaauaucagauauguaggauaucugauaugggaccccccccccaagagagggucgcuugaucccuaaagggauugugucccacagguugggaaacaguguacuggaccaugccuacaaccacugaaugccagcaugcucauccuaugagaccacacuucgaagggaggcaggugcagaagcuguggucaacaauacccccauaagagcugugacagccugcugugggucucuagucucuuacuugucuggcucccaaaugaaggcuuaaugccagacuaaaaaaggguuucacagucaaaagggguucucaguggccaagaagauguggggugucaauugcagcauuauccagauggggcaacgcuagcagcagccucaguggcugucaggagagggagucaaugaaccacgguucaucauacaauguguuacuauggagccacaauaaagaaugaggugggggcuggagagauggcucagugguuaagaauucuauuccagagaaccugaguuccauguaccaggcgcucacaagugacuauaacuccagucccaggggaucugacucuauggagacuugcacacacaugcacauauucacauaacuaaaauaaacuaaagagaaugauguaggucugugaaacauugugcaguaucuuacucuggcaagacccaguucuauaauaaugagcaaaugcgcaaaaccucacgccgagaaaccacguagaguuaucucuguuuaacuguugcuugguuuugcuuugguguuuguucguuauccaggcucaggaggccgaagggggaggauuaggaguuggaagccaucuuagguaaaacaguaagacuuggacaggcucuuuuuaaagcuuuuaucuuuuuuuuuuuuuuuuuuuuuuuuuuuuuuuaguuucaugugcauuggcauuuugccugcgugugugucugugugagcgugucacauccccuagaacugggguuacaggcagcucugaucugccaugugggugcugggaauugaagcagucagugcucguaaccacugagccaucucuccagacccucuuuuuaaaauuuuacaccuaguuuguuuuguguguguguguguguguguguguguguguguguguguguuuaggauacacacgccacaguauauguauggugaucugaggacagcuaucgucuccucccaccauguggggccugggaaucaaacgcagauugucaggcuuagcaggcagccccuuccccuggugacccaucaugccaacuuaugucauuuuuuaauaucagugaagaaucauucuagagucaggcaugauggugaugcaauccuguaauccuagcaccuaaaacaauaaaaauagaugggucaggaauucaaguucacccucacguacauacaaguuagagccagccugggcuaugucggacccugucuuaaaacaauaacaacagaagaaucuuuaaaaauaauuuagaaaggagauuuggaagcagaguguggaagggaaggucugggggccuuugagcagggaguugacuguacuggucagacuguguggcaucugcugcaaggccagcccugggcuggccccagucggcauguguugagugguagaugguucuggaaguccuguuaucuaggcugggcaguaagcaguaaacguaaugucccugcccuuguguggcugauauuguggcacucaguagauguuugugauuuggggacgggggaaggauuaaagaagagagagguggacuguccucaacaggccaucauaugaucuaagacagaaacugagucaaggaggccagggcaggaccccaggagagaacacguugaaccagguggagcucuaggguugggagagggagucaguggaaggaugucaggaggcuggcaucccaguggguacacugggaauuggcaugaggguggugagguagggaagccaaugaagggacagggaggccacuuaguauggggacugggagcaggagcugguuuggggagauucugaggccacuuuggaacaugguuggagcaagguggggucgcccugagaggcucauguccggugucagagaaguggcaucaccaaugacuaggcugugguauagccagccgaggcaccuaggggcucgcugcucggcuucacagcaaccucugagcuauauggacaaguugcggcccaugggcuuggaggucuaucucgaggucaccuagcaugcaugaagccauggcuucaggcccuagcaucuugucaggcugugauggccaacuggguagaguguuggaugugcucccaacaucaugcccguaaucccagcuuuagagggguggagacaggaagaucagaaguucaaguuacaaagacuucauagcaaguuugaagccagccugggcuacauaaaacccuaacucaaaaagcaagcuaggcaugguggcauaugccuuuaauccuagcagucagagagaggcaagugguaaucuagucuacauagugaguucuaggccagcuagggauauauaaagugagacucugucagaagaaaaaagaugggacaagcaugcaggugcaugccuuuaaacccaggccacagauccaggcagaucuucaggaauuccaggucagccuggucuguguaguaaguuuuaggccagccagagagaccccaucuugaaagaaagauaaggccuagaggagagccagguccucucucuaaagcaaccuuucccagaguccuuacacuggcccuguacuucuucagggcaccucccagucagagcccuacuguauuugaaccagguugucacccuucccaucccuucccuucccuucccuucccuucccuucccuucccuucccuucccuucccuucccuuccccgcuaaccccacuucuugggcuuggccaucccacccaccccuuccaggauucagacucggacacugagggaggagccacugguggagaggcagagaguaagugucguccuggaggagggcagggaggugaucuggggucugggauuagaggaugggauucuggggagacccccuccaagcuaccggagugauaggcaaagcauguaacaaugguuugggacuggaugcugcugucugugggagacauugggaguugagaugugggaggagagugugugcuugggcccuggcucgaugcccaccuggcgcugucucucuuguuguuggccaguggacuuccugaggaauuuauucacccagacccugggccuggguucccaaaaggagcgucuucuagacgagcugacccucgaaggagugacacgcuacaugcagagcgagcgcugugaguccccaauugcuuggccgcuucucccauuccuggccccaguugacuccauauuuugggggguaggaguaguaagaaagccugcuguauacaccuguaaucccaaacucugagcagauugggaaaggaccagcauuucaaguuagccucugcuagacugugugugugaggcuacccugagcuacaugggaaguuuuccuaaaauucagaaagaaaaaagauggaggaaacccaacucuugggauggagagaugguuuaguaguuaagagcacuagcuguuuucccaaaagaccuagguuggguucccaggacucacaugauggcuuacaaccaucuguaacuccaguuucaggggauccuacuuauggccaccaugggcaucaggcaugcauguagcacacaacauucacgaaggaaaacacccauguaguuaagaaaaaaaacaaaaaacucagcuugcuggggggggggguggugaacgccuuuuaccccagcacucgggaggcagaggcaggcagauuucuauaguuugaggccagccuggucugcagagugaguuccaggaggugacugaagccagaagaucaugaguuugaggguaacaugugcuacauaagauuguuaacucaaagaaagaaaagagaaagacaagaaaccagaacucuagccaaaaacaauaaaaaggagcaugcagacucuuaagcauuaaaugugauggagccaggcucgaggacauuguuaggacauuguucucaggccucacaagucugucugcguagggugaaggaaaguccagcaggcggcuccugcuugggaggguaccuuugcacuuaagaacaaggccacauuggcccagaagccccccccccccccccccggauggaacucagccccuacacucacacaccacgcuaggcaggcacucugucauugagcuacagccccagcccuuccuuuccuacuguuuuauuuugaacgcccugaauuuacccucuagucccugaaggucgauccucuuaccucagccucccacauagcugggaguacagaguagcaccacuaggccugccuuugggucacuucccuagugaaucuauuacugucuucugaugggccaggccuaugcccuagacuggaagugaucaaagcucuggggugacucaggugaggcuaaggaaauugccacaugcugagcauacauaugcucagcaugccgagcucaucugcaggcccagccacucuggaagcugaggcuagagcaugugaauucagaggcagccuggacuacagaaaaaagagggaaauggaaugaugaugguggcccacaccuuuaaucccagcagaggcagggggauuucugaguuugagaucugccuggucuacagagugaguuccgggaaagccaggguuacacagagaaacccugucucaaaacacgagagagagacagagagagacagagagagagagacaaagagagacagagagagagagacagagagagagacagagagagacagagagagacagagagacuuaggagauuaucucaguccauuaagugcuggcagcucccacacaagcagcucacaagugcuuguaauucccgggcuggggaggcagaggcaggagccaagcucagguccccaugagacucgugagacccugccuuaaaauccgugauggcaccaguuguccucucacuuccuuccacauguuugcugugaaauacacgcacaaagagaugugugcacaccaccaaacaaacaaauaacagcccauauacacacuagguggauggcccuggagaaauacacacacacacacacacacacacacacacacacacacacucgagagauaagugauuagaacaggacccgaucucuugagagauacagaaguguuugccaugguauuauuacaggaagcuugucucagacgugcuguuuagaagccagcuagcugggucaccgugaaauugauauuucuugcugaggucgagucaccgaagucugagaacccaggcccucgcaguccccguugggaacaaugcagcuuugaggguccugaacagcccuuuguugaggccaucuucuccaguuuccccuuggcccagcugcucagcgcccuccuuggcagccgggauggcagcugaaccucccucuccugccacaggcugggcagccggccgccuacagagcauacccacacaguggccaggcgacacugguccucccucuuacacucagaucugagagucccuggcccauagggugcuggugugggacgugacauaaauaucaacuaagcagacccuugcuguucgccaggcucugggcuaaguagcucaccaagcauccuugaaccuaauuaucacgcaauagcugugaggucuuucuagaagugagcugaacagaagaggaaacugaggcacggagagguugugacuuggugugaacauaugcaaggggcacagucagggcccuugaagcucggucuuguucuguagcuguggcaagcuuugaauuuaagauuuucuugccucagucucuggaguuuugguauuacaguguuaccacacccagucucaaugccuacgaucuccagccagacuugggccaguaacauccuaaagaagcugagugcauagacuguagcaggcucucugcugucauuuguuuuugguuugguuugguuuuuuuuuuuuuuuuuucuauguaacagaccuugcuggucugcaauucacuuuauagaccacacuggccucaaacucacagagauccuccugccucugcuucccaaguucugggaauaaacacauacgccaccaugccugguuuaaacauuaucuuugagugugugugcugggggugggugggugaugugggcauuacuguaggugcaugcaugcuacuguguuugccaggggacaucuuugaggaguuauuuuucucguucuaccguguaguuuccgggaaucaggcuuagcagcaagugccuuuacccacugagccaucucgccagccccgauggcagacugacuucuguucacacgugucccuuaaacagaacaccccaggggugcccaauucaugggauaccacacuugugucugcccaucagcugacagacagaugucggggcucuguguggcugggcuguaggccagccagcagcuggggcagcaauagggccauuucuucucagcucugugccugugaauggauucaauccuaucacccccuaauaguucuuuaaaaaccaagaacaaagcccccauaagaguaugaaccauggaucugaagaagcauaauacaccggaggggcugggggcucggcuuggcucgguugguggagugcuugcuuagugcacaggccccuagagucagucuccugcaccacacacaacaacgggcauagcaaggcuugguggcacccacuccucccaacgcuugcaaggucacugcgaguucucaugcugagacccugucucaaagaaagaaaagaaaagcugggcaugauggcaaugcugggcacuuaaagauggaagcagggugauuggaaguucaaggugauccuuggcuggcugcacagugaauuuaaugcuugccugacguccaugagauccuguccaaaacaaacaaacaaaaaaaccguuauuuagugcaauugacucaaaggagcagacuuuaggcuuuugugugaacaaagcaggauggugaagggauguguacagcuagaaacagguccuagccagucauuggagcuccugggaggcugaggagggagguacaggauuccaggccagcccaggguacauagggaggcacugacucaaaaccagagaaaccagcagacaugcuggugcacaccacaacaccagcacccaagagguggagccaggaggcuccgaaguucaaggucagccuuagcuacauagaaggcucaaggucagccuuggcuauaugaaaccuugucucaaauuuucuuuuuuaaguguguguguguguguguguguguguguguauaagcaugaguguagauguacagaugcccucaaaggucagaggcacaggauccauggagcuggaguuaacagguggcugugagcucugccugacaggggugcuggaaauugaacucaggaccucuggaaaaggaggagguguucuacccacugagccaucuauguagcccucaucuguguguguguguguguguguuuugaacaagguuucucugugugucuuuggcugucuugaaacucacucuguagaccaggcuggccucaaacccacagaaaucugucugccucugccucccgagugcuuggauuaaagguguacacaacuaccuucugacccaaaaguaauuuuuuugaagucuuacaguauuguaccuagaagauuagucauugucagaauuugguuuggauugauugucaaggacucaaacuagccgucucuguacugccgaacuuugcaaggcguccccaccucaccccaccccccaucccucucccuucuccuggguggcugugucuccucaccugaaaugugagguugccaaugccauccugcccggcaccagcaguacgucuaggagggaaaccuuagcaugugccaucaauccucuguuccaggccgcaaggucaucuguuuggugggagccggaaucuccacguguaaguuccccguccuucagccacuccuggggcugggggaggcuggagggguucgugcacacgugggcagagccucugacugcguugccuuccuagccgcggguaucccugacuuccgcuccccguccacuggccucuaugcaaaccuggagaaguaccaccuuccuuacccagaggccaucuuugagaucagcuacuucaagguagacggcuaagaugaggggagguggcucccaacuccaguccuugucuuaccugggacauguggcccucugcuccucucucccacagaaacauccggaacccuucuuugcccuugccaaggagcucuaucccgggcaguucaaggugaggucaucuucugcagggagccugggaagaguaggcauggaagcaggcucuuuauaggcccuccaggcaagcauaacaugauuaagaaccuagcuucuggggccagcaggaugguuccauggguaaaggugcuugcuaccaaaccuaaugaccugaguucaaucccuggaauccucaugacugaaggagagaacugacuccaucauauucucugaccuccacaugugcacuguggcaagugcauauccccagguagaugguuggauggagggagagacagauggguggguagguagauagauggauggauggauagauggauggaugguggguagauagauggauggaugauagauagauagauagauagauagauagauagauagauagauagacagauagguagauggguagauggguagauagagauauuguuaaagaaaaaagaaaagaauuacauaaguucuggccagauuugauaguucauccccauaacuguagcauuugggaggcagagacaggaaacuuucaaaugcaaggucagccaaaacuaccuaucucaaaaguaaaaaaaaaaauaaaaauuaaagaugaaagaggugaaagugggagagauggcucaggguaaaagagcagauaguacucuuccagaggaccuggguucaauucccaggacccacaucaggauguucauagcccccuguaacuacagcuccggggagccugacaccucuggccucugugggcacuagaacucaccuccauauaccaacagagacccacacacauaucuguaacuaaaaauaauuggaaugguagcuuagcaguucagugcacuggcuccucuuccagaggaccuggguucaauucccagacccacauggcagccuacagcuaucuguaacuccaguuccaggggaucugacacacacacacacacaugcagacaaaacaccagucaaugcacauaaaauaaaaauaaauaaaucauuuaaaaaauuccagcucgggggccgggcggugguggugcaggccuuuaaucucagcacuuggaaggcagaggcaggcagguuuccgagaucgaggccagccuggucuacagagugaguuccaggacagccagggcuauacagagaaacccugacucgaaaacaaacaagcaaacaaacaaacaaacaaacaaaaacaagaaacaaaacaaaaaagaaaacaaacaaaaaaauccagcucuuggugagaggcaggaagauuucugugaguuugaggcuagccaauuccaggcuuaccuagagagacccuaucucaaaaaccaaaaaaauaaauaaauaguaaaauaaacaauuuuaagaaauuaaaagaaaggaggaguggguugccuggccccucgucucuuuauccuguggcucugggccucaguuuacccaacucuaagaaagcugcugagacuaucaggaagggcugagacugaagccuggcugugagccugacucugcaguuuaccuauuggugaugccaaaaagccgccaccaugcccuugccugggucuccucauuugugguacgggagaaggcaggcucacccucacugggccacugagauggggccauggggcagaaugggcccacagcauggccugggacauucacaucagcacuguuacucuucucucagccaaccaucugccacuacuucauccgccugcugaaggagaaggggcugcugcugcgcugcuacacgcagguaggcggggccacgggcaggugugaccauggguaggcaggaccuugggcaagcgugaccuuggguggcagggcucgagggcaguaggccagaugggucuuggaacacucggucagagcugggcuaacacaggcaggcacaggaccagggcucagcuaauuauagugaaugaccuacaaugggccacuuccucuuggccucaguuuccccuuuguaaaauaggggacggaaacaggauagauugguacucauuggaaucaggagaaaggucagaaauucaagguugcuggaugguaguggcauaugccuuuaauuccaguacucaaaaggcagaugcaugcagaucucugugaguuugaggucagccuggucuacauagaaaguucuagaagagccagggcuacacagagaaacccugucuugaaagaccaaaaaaaaaaaaacccaaacaacaacaaaaaccaaagaaagguuaucauuggcuacaaaaugaguuuaaggccaaccuucaggaugugagacuguaucucuaaauuaauugauuagucgauuaauuacaauauaaacuaauagaagaauguuuaaauauaaagaagucagaacagcuucaagcccucucaagucugcugugaggugacaggugacaggacaucccagacuuacugcaaaaggccucuguaucugaggggacaccguccauaccacagccacuccaaaucaggaaagugacacuguaucguaaggaaggugggcuucuuauucauacacuucugagccuggccuuggauacgguggcuaaugggacacuguggccacacugagguucagacggauguucaggcugcuggcuucuaugugucucugugcguuuuguggauguguugaaguucagacugcucuguguauacaugugugcuaaaaaauugucucagaauacaaaguggccauuacauuacacacuuguuaucccagugcuugggaagccgaggaaggagcuggucaugaguucaaggccagccugggcuaauaguggauuuaaggucagacuggcuccauagcaaacaaucucccccgccccccgcccccucccccgcccugcccaagaagaaaaaguuagaaaggaaaaagagagaacuccaaauuguacagaagaguuaaugcuugaauacaaauagguuugaagcucuugcaaugucagaaauggccaccagggggaggauggguucaaacuuuuggguccagauggcuggaggccccagcuggggaagagacagcuuaguccuuccaggcaccgcccaagcucagagucagccucauucacagaaagaggcucaggccugauacuaacagcuuccuugaagccccauacuuccugcuuguuguugcaugucccuccugcacccuuguuugcuggccucuaugacaacagguguccacccaaguaccaggcccuaccagugagccaagcagacaccgcugcccuccuggugccaauucaugugugugacaagaacaagagggacgaugagucauagaccuagggugucagauggggcugagaccagccugaaguuuggaagucagaggacaaggugcaggagucaguccuuccuuuccaucgugugggucucagggauggagcucaggucaucaggcuugguggccuuuaccugagcaucucacuggcuccacacauaaacuuuaaagggagauuuauuuuuauuucauguuuauggauguucuuccugcuuguauguccaugaccuauguguaugcagugcccacaguagccaagagaggcuuuaacagaugugugcugccaugugggcgcugggucccaacccggggucuucugggagagcauccaacacucuuaacugcugagccaucccuccagcccccacacguacauuuuuguaaaauaucugaagguggaaaaaaauguuccacuugcccccuuuguggucagcuuuuuuuccuucguggccucuucuccucagucaccguuugaaucacugacccacuuucuggaacacagugacuccgccucugaguugugccgacacagcaucuuugaagcuguggugcuguuuuuagcucugcacaggaacccaucgcucaagccacugugguccccacagaagaguggcuauagaccuucaaguugcauacaugaaauucacccuccaggaaguucucuguaugccccaaacccagccucuugucuggggaccccucgauacucacaccauagagcagcaccaugcuuuuuaaaaucgaagaguagucuuuuucuuuuuuucuuuuuccuuuuauuuugggugugugucugcugcguuaguuauauaggccgcagggcuuccggcaugcuggggaagugcucuaccacugagccacacccccagcccaggcaagaccugaguuuguaaucuucugucucacccuccuguagcugagguuacaggcuugcucugcuagcccagcucuacugugcaggcauuggguacaggcggcagccuaccacgucaucaugaggggaaacugcaaacuuacaucagugaugugcaguaggguaggugucagaggccugcuccacucaggguagacccaacucacggugggcuuaugaggacagagccccauugcaagggaaggagcgugucuguggauauaauccaacaugaucagagaucucaggcaucucccuccacccuagacuauguuuccuuugaucacagaggcugccggagguaauucugugaucccuuaguuagcuguuugugugugugugugcugcucacucuccaaugaagggcuugguagacugagccagcgacaaagcagaugcagagugcgggguguggcagugcuccccugucauccuggcacucuggagggagguucuccaguuugaggcagucucaaaaaaucauauccccccccaaagaaacaaauaagucauucucuuguuuuauuuauucauauuacauuauuuaguguguguaaaguucagcugacaacugaaggaaggcguuugcuucuaccaugugaugucuggggcccaaagccacguugcuauguugguagcaaggaccauugucagcugagccaucuugucagcccuuacuguggcuuuuccagacaggugcuagucuugucccagcuugccugaaucucacccuguuccucaggcuagccucaccuuuacagcagucuagaauuauaggcauggccuaccaugccuggcuuuauuuacuuauugcuuauuuauuucacuuuuuugaggcaggucuucccauguagcccuggcuggccugacauuagcuauguagccucagcugacuuuaaacuuaaagcaguccuccuaccucagccucuaauugcagggcuuauaggcagucaccaccacugcugaccugauucaguuuauuuauguuaaugcuuggccagagcugucacauacaagcuacucaggugggauccccacaaggaugccacaucugagggagacgcugaagauagguacauuuauugcaauaaauguguggcaaauggagggacugugcguggcucucuaacaaaagaacuucucugaaaauuagaggcagugacccaaguuuguagaagaauaucccaugggcauccuuuagcaaccuucuguggccccacuggggaagcgggcacuuuccauauauccucacccuuccucaucccccgcaaugccacuucucagagccaccagggcuggcugucuuccugaccuccccucccccuccagaacauagacacgcuggaacgaguggcggggcuggagccccaggaccugguggaggcccacggcaccuucuacacaucacacugugucaacaccuccugcagaaaagaauacacgaugggcuggaugaaaggugaggcuggacucugcgggcaggcaggccucgggcaggccagggggagguaggggguggggggcucucacugcuugccugccauagccagccuccaagggcugggccccagugcagucugcuccauucuuuggcucuugcuagucagugaguugguugguuuccacugaggcuaggcuucccuauguagcccaggcuggccuggagcuugcacuucugccucagccucucuaguacugagguugcuugcaggcgugcacuacgguacccagcugucuugcuuuuuaugguagcuguagaagccucaaggauucaaggugacagcaggucuuugcucccaugccaccccucugcugggcugucauccauaugaaccgcagagcacggccagccacguguggacuccguguagacucacguccucaacggucacacagccugugucucugagguguuuacuaucuaucuuacauggcaaacacggcuaccuucugaggaaggcauugcacaguggaaccuuccgagacgaggaggccugugucuacguccaacauggcuccacuugccccaugugccuacugaagcaaagugucuaaccucugcugccaccaugugggucccaggaacuggacucaggcgcucaggcuugaggauggaccaccucgcuggcccagaacaguuuaauuuuuauuauauuuuuuaaagauagggucucuaauuucauuaaguucuuguugguuuaaguuguagaagucgcaggaggaaccaugguacaugccuauuagccuauugcuugggagaggcaagaggaucaggaguucaggguuagccuuggcuacauacuaaguuccaggucagccugggcuacaugacaacaugaaaauaaaaacuaauaaauuuuauauaagucuuauguagcucagccuuccauguuggacagugcagcaggagccuguggagagggaagcugggugcugugcuggguaagacaagugcuggagacacacaugguagcucacggcugucacugcugucacuguccucauucaugugaggacacagcaacugagaggacagcuaguccccgcgccugggugccagcaccagucuguucuggcagccauugugcugagccugaagcugcugugucaacugugggaauccauuucuguauucuuuaugcugacuucacaaagccucugguguccccuugagaucaggacagcuguggccuuuauagcaggacccuggaagguagcucuucugacagaaugccagccagcugcccccagacugaggguuccugagcagcccaugugugcacagcugggggugacggacaauggacaucacccccuuuaugucccuguggaaucgcaucuuccacccacagaauagcauauuugugcagaaauaccucagcagcagccguuaaagcuucgcccugugacuggcuguaugaguggcuggcggagugagcuccaguccugugggcugcauguggcagaugugcuuucagacuccgugauccauaaguaagaaggagugugacuuucauaaggguggucugucccauaaggagucugucacagaauccgagagugggaaacaguugggcuugagguuugauccaacccaaggcuaucuguauguccuuuccugacccagggcagauaggacuguccccaggacccauuggaugacucccauuccccagaugggggucugguggaguccaggggcaccugucuggggcagauggguuugccccuguauaugcccuuucacucacuagcuguggugcugccagccaccccuggaugccuggaggugaaggggacggcucucuaagaagggagcuccucucugugaagcaggaaagaccacucaggaaaugccugaguagugagcugugcuguuuguuuuguggcgcugcggaucagacuaggggacucgggcauucgaggucagaggcucuuccacugggccacacccacagcccccauacugggagacucaaagcaggcaucuccugcugagucgugcccaagcccucuugguuccaccgcugagcuagccuagcucuugggguuugugugcgcauguguguaggugugcacauggcauagcaugcgugugcaugucagggccaucugcaggagcugcuucucuccuuuuagcaugugggaucuggggacggaacucaggccaccaggcuuggcagcaggucccuuuacacacugagccaccuugaagccucagcucuuauuuuuuugagaugugguuuuguuguguagccaaggcuggccucaaacucacaauucuccuguuuaauucucccccaagcaggcuugcggcaugcaccacugccaccugccugggaugcauuucuguugacaggagggaggggcagaagagggcuucuccagcagcccuugggggagccucacaacucacccccccuuccucuuucccacucagagaagaucuucucagaagcaacucccaggugugagcagugucagagugugguaaagccuggugaguccugggcccggggcuggagcugggaccccuuccuccacggccucaccccccaaucuggccacucugccaccuggcccguccccuacuguucagcagagggugccccgccccccaagccucaguugggccccugacuccugacuguucuagcucugucucccauaucuccuguccucugucccucugucccucugucccucugucugugucuaccgcagauaucguguuuuucggugagaaccuuccaucgcgcuucuucuccugcaugcagucaguaaguguccacucugggcugggcccaugugagggggacaaagccagaguagugggguccaaggccuuccugguuacuccccgcaggacuucuccaagguggaccuccucaucaucaugggcaccucccugcaggugcagcccuucgccucccucaucagcaaguagguugaggaggaugggacugggugucagcucgggacagggcacuagggcagauccugaaucucagcucccccuucccagggcaccacuagccaccccacggcugcucauuaacaaggaaaagacaggccagguaagucugccucagcuucccucccccucuccucccccccuccuucccugucccccucccccucccuccacuuucuuugcccccuuccucauuuggccacuuccucaggggacagggcaggucucugucccaccuggaaagcaccagauccuuagacuugccaguucagucaggagaacaugggagcuggccugugcacugggccucugucauucuagacuccacugagcacagaacagaaccgugccuugaaccugcugaagcccaagugcuuccccggacccaggagacaguccagacacuaccauucuagugcccucucacauaucaaaaucuggggacccucaagucccuccuaugaaguggcagaguguuuauauagagcaaucucugaagaugcuaagcugugucuccgugacgugugcgauaccaugugaacucaggagacaggcucccaugccccccugcccucucagacacgccacggaauuuaagaugaccuugaacuccuaguccuccugccucugccuuccaaguucuggcaugacaagccugugccaccacuccuggcuguguuguuguuuguuuagcagaaggauaaguugcuugccacgcaugcacuaggucccgaguuuaacugcuugcacccacauaaaaauccaggcaugguguuuguagucccacacuggagaggcaaagauuagugggucccuggggcucaccggguagccagucucacauaauccugaauuccaggccaguugagcaaugucucagaaagaaugugucugggccgaggcuguaacucagcggcagugcuugccuggcguaugcgcggcccugaguucaauccucagcaccaccaaagacgaagacgguuauuaguuuuggacuagagagaugguuuacugauuaagaccuucuguccccagcacccaugucagguggcucacaacugccuuuaaccccggcuccugggcaucugacgccucucaguccucugagcacucacacauagagagcacacaugcagucagauaaaaagaagccaaguggugguggugcacacuuuaauuccagcacuugggagacagaggcaggugaaucugaguuugagaccagccuggucuccuuaguaaauuccauauuagucaggacuauauacauauagacaccaucuaaucaaucaaucaauaacaaguuggcuaacuucuaagaaacaguaauuaugguuggccucuugguugaccucuagccugaccuccagguccacauguguacaaauauagacacauagcccacuaccauacacacacacacacacacacacacacacacacacuaauuaguaaauaggaaaauaaggcuagguaugguggugcacaucuuuuaucccagcacugaggaggcagaggaaagguggaucuuugugaguucaaggccagccuggucuacagagcaagccccaggacagccagggcuccacagagagacccuguuuuagaaauaagcauaaggcaggucugcuggcucagggcugugcccuuagcugucuucuccccacagacggaccccuuccugggcaugaugaugggccugggagguggcauggauuuugacuccaagaaggcuuacaggugaggcugggccugggugagcagcucgagaagggugggugaggagggagagaagacagaaggccggcugguccucagccuguucucuuacuccugcucacccugcagggacguggccuggcugggugacugugaucaaggcugccuggcucucgcugaccuccucggauggaaggugaggagcugggccaccccagcccacccugagcccaggcccaugggguuuacgguaaccugacuugcgucaacuuugcccccuacagaaggaacuggaagaccuuguccggagggagcaugccaacauagaugcccagucagggucacaggcccccaaccccagcacuaccaucuccccuggaaaguccccaccgccugccaaggaggcggccaggaccaaagagaaagaggaacagcaguaacaguaaccaugaccucccgcaggacagcggagcccggccagcacugggcccucuuaacaugcagcuugugugagcucaaagacccuucguucuuuaaccacguucuugaaaucaggguccccaacucaaucccagaaaagccuaauauaccuaggggcugaggccugugcagucuguagcuggggccucuaaccaccauagccucuaaccaccauagccucuaaccaccauagccucuaaccacccaggcaagaagcagccuucccuaacuucuaauuauucccagacaacaggcuaccccaaaaccccuaacagugccagaauaaggcauuucucuauuguuuucagggggccuauggcuaaaucaaauuaaccuaccccgcauaggggcuggacucuacaaauagaacuucacccaaggggguggggccuugugggaucucugagccugaaggccugccaacucucugccuccaacaaaguggguacuaggcucccuuuccuggggacccacuugccagcuguugguggaugagcaagagaccuugcuuauuagaaacaaauuaaaaaacaaaacaaagcaacuaaccaug

SEQ ID NO: 12384 - RNA, 21915 nt, Mus musculus
caugguuaguugcuuuguuuuguuuuuuaauuuguuucuaauaagcaaggucucuugcucauccaccaacagcuggcaaguggguccccaggaaagggagccuaguacccacuuuguuggaggcagagaguuggcaggccuucaggcucagagaucccacaaggccccacccccuugggugaaguucuauuuguagaguccagccccuaugcgggguagguuaauuugauuuagccauaggcccccugaaaacaauagagaaaugccuuauucuggcacuguuagggguuuugggguagccuguugucugggaauaauuagaaguuagggaaggcugcuucuugccugggugguuagaggcuauggugguuagaggcuauggugguuagaggcuauggugguuagaggccccagcuacagacugcacaggccucagccccuagguauauuaggcuuuucugggauugaguuggggacccugauuucaagaacgugguuaaagaacgaagggucuuugagcucacacaagcugcauguuaagagggcccagugcuggccgggcuccgcuguccugcgggaggucaugguuacuguuacugcuguuccucuuucucuuugguccuggccgccuccuuggcaggcgguggggacuuuccaggggagaugguagugcugggguugggggccugugacccugacugggcaucuauguuggcaugcucccuccggacaaggucuuccaguuccuucuguagggggcaaaguugacgcaagucagguuaccguaaaccccaugggccugggcucagggugggcugggguggcccagcuccucaccuuccauccgaggaggucagcgagagccaggcagccuugaucacagucacccagccaggccacgucccugcagggugagcaggaguaagagaacaggcugaggaccagccggccuucugucuucucucccuccucacccacccuucucgagcugcucacccaggcccagccucaccuguaagccuucuuggagucaaaauccaugccaccucccaggcccaucaucaugcccaggaagggguccgucuguggggagaagacagcuaagggcacagcccugagccagcagaccugccuuaugcuuauuucuaaaacagggucucucuguggagcccuggcuguccuggggcuugcucuguagaccaggcuggccuugaacucacaaagauccaccuuuccucugccuccucagugcugggauaaaagaugugcaccaccauaccuagccuuauuuuccuauuuacuaauuaguguguguguguguguguguguguguguguguguaugguagugggcuaugugucuauauuuguacacauguggaccuggaggucaggcuagaggucaaccaagaggccaaccauaauuacuguuucuuagaaguuagccaacuuguuauugauugauugauuagauggugucuauauguauauaguccugacuaauauggaauuuacuaaggagaccaggcuggucucaaacucagauucaccugccucugucucccaagugcuggaauuaaagugugcaccaccaccacuuggcuucuuuuuaucugacugcaugugugcucucuaugugugagugcucagaggacugagaggcgucagaugcccaggagccgggguuaaaggcaguugugagccaccugacaugggugcuggggacagaaggucuuaaucaguaaaccaucucucuaguccaaaacuaauaaccgucuucgucuuugguggugcugaggauugaacucagggccgcgcauacgccaggcaagcacugccgcugaguuacagccucggcccagacacauucuuucugagacauugcucaacuggccuggaauucaggauuaugugagacuggcuacccggugagccccagggacccacuaaucuuugccucuccagugugggacuacaaacaccaugccuggauuuuuaugugggugcaagcaguuaaacucgggaccuagugcaugcguggcaagcaacuuauccuucugcuaaacaaacaacaacacagccaggagugguggcacaggcuugucaugccagaacuuggaaggcagaggcaggaggacuaggaguucaaggucaucuuaaauuccguggcgugucugagagggcaggggggcaugggagccugucuccugaguucacaugguaucgcacacgucacggagacacagcuuagcaucuucagagauugcucuauauaaacacucugccacuucauaggagggacuugaggguccccagauuuugauaugugagagggcacuagaaugguagugucuggacugucuccuggguccggggaagcacuugggcuucagcagguucaaggcacgguucuguucugugcucaguggagucuagaaugacagaggcccagugcacaggccagcucccauguucuccugacugaacuggcaagucuaaggaucuggugcuuuccaggugggacagagaccugcccuguccccugaggaaguggccaaaugaggaagggggcaaagaaaguggagggagggggagggggacagggaaggagggggggaggagagggggagggaagcugaggcagacuuaccuggccugucuuuuccuuguuaaugagcagccgugggguggcuaguggugcccugggaagggggagcugagauucaggaucugcccuagugcccugucccgagcugacacccagucccauccuccucaaccuacuugcugaugagggaggcgaagggcugcaccugcagggaggugcccaugaugaugaggagguccaccuuggagaaguccugcggggaguaaccaggaaggccuuggaccccacuacucuggcuuugucccccucacaugggcccagcccagaguggacacuuacugacugcaugcaggagaagaagcgcgauggaagguucucaccgaaaaacacgauaucugcgguagacacagacagagggacagagggacagagggacagaggacaggagauaugggagacagagcuagaacagucaggagucaggggcccaacugaggcuuggggggcggggcacccucugcugaacaguaggggacgggccagguggcagaguggccagauuggggggugaggccguggaggaaggggucccagcuccagccccgggcccaggacucaccaggcuuuaccacacucugacacugcucacaccugggaguugcuucugagaagaucuucucugagugggaaagaggaagggggggugaguugugaggcucccccaagggcugcuggagaagcccucuucugccccucccuccugucaacagaaaugcaucccaggcagguggcaguggugcaugccgcaagccugcuugggggagaauuaaacaggagaauugugaguuugaggccagccuuggcuacacaacaaaaccacaucucaaaaaaauaagagcugaggcuucaagguggcucaguguguaaagggaccugcugccaagccugguggccugaguuccguccccagaucccacaugcuaaaaggagagaagcagcuccugcagauggcccugacaugcacacgcaugcuaugccaugugcacaccuacacacaugcgcacacaaaccccaagagcuaggcuagcucagcgguggaaccaagagggcuugggcacgacucagcaggagaugccugcuuugagucucccaguaugggggcuguggguguggcccaguggaagagccucugaccucgaaugcccgaguccccuagucugauccgcagcgccacaaaacaaacagcacagcucacuacucaggcauuuccugaguggucuuuccugcuucacagagaggagcucccuucuuagagagccguccccuucaccuccaggcauccagggguggcuggcagcaccacagcuagugagugaaagggcauauacaggggcaaacccaucugccccagacaggugccccuggacuccaccagacccccaucuggggaaugggagucauccaauggguccuggggacaguccuaucugcccugggucaggaaaggacauacagauagccuuggguuggaucaaaccucaagcccaacuguuucccacucucggauucugugacagacuccuuaugggacagaccacccuuaugaaagucacacuccuucuuacuuauggaucacggagucugaaagcacaucugccacaugcagcccacaggacuggagcucacuccgccagccacucauacagccagucacagggcgaagcuuuaacggcugcugcugagguauuucugcacaaauaugcuauucuguggguggaagaugcgauuccacagggacauaaagggggugauguccauuguccgucacccccagcugugcacacaugggcugcucaggaacccucagucugggggcagcuggcuggcauucugucagaagagcuaccuuccaggguccugcuauaaaggccacagcuguccugaucucaaggggacaccagaggcuuugugaagucagcauaaagaauacagaaauggauucccacaguugacacagcagcuucaggcucagcacaauggcugccagaacagacuggugcuggcacccaggcgcggggacuagcuguccucucaguugcuguguccucacaugaaugaggacagugacagcagugacagccgugagcuaccaugugugucuccagcacuugucuuacccagcacagcacccagcuucccucuccacaggcuccugcugcacuguccaacauggaaggcugagcuacauaagacuuauauaaaauuuauuaguuuuuauuuucauguugucauguagcccaggcugaccuggaacuuaguauguagccaaggcuaacccugaacuccugauccucuugccucucccaagcaauaggcuaauaggcauguaccaugguuccuccugcgacuucuacaacuuaaaccaacaagaacuuaaugaaauuagagacccuaucuuuaaaaaauauaauaaaaauuaaacuguucugggccagcgaggugguccauccucaagccugagcgccugaguccaguuccugggacccacaugguggcagcagagguuagacacuuugcuucaguaggcacauggggcaaguggagccauguuggacguagacacaggccuccucgucucggaagguuccacugugcaaugccuuccucagaagguagccguguuugccauguaagauagauaguaaacaccucagagacacaggcugugugaccguugaggacgugagucuacacggaguccacacguggcuggccgugcucugcgguucauauggaugacagcccagcagagggguggcaugggagcaaagaccugcugucaccuugaauccuugaggcuucuacagcuaccauaaaaagcaagacagcuggguaccguagugcacgccugcaagcaaccucaguacuagagaggcugaggcagaagugcaagcuccaggccagccugggcuacauagggaagccuagccucaguggaaaccaaccaacucacugacuagcaagagccaaagaauggagcagacugcacuggggcccagcccuuggaggcuggcuauggcaggcaagcagugagagccccccacccccuaccucccccuggccugcccgaggccugccugcccgcagaguccagccucaccuuucauccagcccaucguguauucuuuucugcaggagguguugacacagugugauguguagaaggugccgugggccuccaccagguccuggggcuccagccccgccacucguuccagcgugucuauguucuggagggggaggggaggucaggaagacagccagcccugguggcucugagaaguggcauugcgggggaugaggaagggugaggauauauggaaagugcccgcuuccccaguggggccacagaagguugcuaaaggaugcccaugggauauucuucuacaaacuugggucacugccucuaauuuucagagaaguucuuuuguuagagagccacgcacagucccuccauuugccacacauuuauugcaauaaauguaccuaucuucagcgucucccucagauguggcauccuuguggggaucccaccugaguagcuuguaugugacagcucuggccaagcauuaacauaaauaaacugaaucaggucagcagugguggugacugccuauaagcccugcaauuagaggcugagguaggaggacugcuuuaaguuuaaagucagcugaggcuacauagcuaaugucaggccagccagggcuacaugggaagaccugccucaaaaaagugaaauaaauaagcaauaaguaaauaaagccaggcaugguaggccaugccuauaauucuagacugcuguaaaggugaggcuagccugaggaacagggugagauucaggcaagcugggacaagacuagcaccugucuggaaaagccacaguaagggcugacaagauggcucagcugacaaugguccuugcuaccaacauagcaacguggcuuugggccccagacaucacaugguagaagcaaacgccuuccuucaguugucagcugaacuuuacacacacuaaauaauguaauaugaauaaauaaaacaagagaaugacuuauuuguuucuuuggggggggauaugauuuuuugagacugccucaaacuggagaaccucccuccagagugccaggaugacaggggagcacugccacaccccgcacucugcaucugcuuugucgcuggcucagucuaccaagcccuucauuggagagugagcagcacacacacacacaaacagcuaacuaagggaucacagaauuaccuccggcagccucugugaucaaaggaaacauagucuaggguggagggagaugccugagaucucugaucauguuggauuauauccacagacacgcuccuucccuugcaauggggcucuguccucauaagcccaccgugaguugggucuacccugaguggagcaggccucugacaccuacccuacugcacaucacugauguaaguuugcaguuuccccucaugaugacgugguaggcugccgccuguacccaaugccugcacaguagagcugggcuagcagagcaagccuguaaccucagcuacaggagggugagacagaagauuacaaacucaggucuugccugggcuggggguguggcucagugguagagcacuuccccagcaugccggaagcccugcggccuauauaacuaacgcagcagacacacacccaaaauaaaaggaaaaagaaaaaaagaaaaagacuacucuucgauuuuaaaaagcauggugcugcucuauggugugaguaucgagggguccccagacaagaggcuggguuuggggcauacagagaacuuccuggagggugaauuucauguaugcaacuugaaggucuauagccacucuucuguggggaccacaguggcuugagcgauggguuccugugcagagcuaaaaacagcaccacagcuucaaagaugcugugucggcacaacucagaggcggagucacuguguuccagaaagugggucagugauucaaacggugacugaggagaagaggccacgaaggaaaaaaagcugaccacaaagggggcaaguggaacauuuuuuuccaccuucagauauuuuacaaaaauguacgugugggggcuggagggauggcucagcaguuaagaguguuggaugcucucccagaagaccccggguugggacccagcgcccacauggcagcacacaucuguuaaagccucucuuggcuacugugggcacugcauacacauaggucauggacauacaagcaggaagaacauccauaaacaugaaauaaaaauaaaucucccuuuaaaguuuauguguggagccagugagaugcucagguaaaggccaccaagccugaugaccugagcuccaucccugagacccacacgauggaaaggaaggacugacuccugcaccuuguccucugacuuccaaacuucaggcuggucucagccccaucugacacccuaggucuaugacucaucgucccucuuguucuugucacacacaugaauuggcaccaggagggcagcggugucugcuuggcucacugguagggccugguacuuggguggacaccuguugucauagaggccagcaaacaagggugcaggagggacaugcaacaacaagcaggaaguauggggcuucaaggaagcuguuaguaucaggccugagccucuuucugugaaugaggcugacucugagcuugggcggugccuggaaggacuaagcugucucuuccccagcuggggccuccagccaucuggacccaaaaguuugaacccauccucccccugguggccauuucugacauugcaagagcuucaaaccuauuuguauucaagcauuaacucuucuguacaauuuggaguucucucuuuuuccuuucuaacuuuuucuucuugggcagggcgggggagggggcggggggcgggggagauuguuugcuauggagccagucugaccuuaaauccacuauuagcccaggcuggccuugaacucaugaccagcuccuuccucggcuucccaagcacugggauaacaaguguguaauguaauggccacuuuguauucugagacaauuuuuuagcacacauguauacacagagcagucugaacuucaacacauccacaaaacgcacagagacacauagaagccagcagccugaacauccgucugaaccucaguguggccacagugucccauuagccaccguauccaaggccaggcucagaaguguaugaauaagaagcccaccuuccuuacgauacagugucacuuuccugauuuggaguggcugugguauggacgguguccccucagauacagaggccuuuugcaguaagucugggauguccugucaccugucaccucacagcagacuugagagggcuugaagcuguucugacuucuuuauauuuaaacauucuucuauuaguuuauauuguaauuaaucgacuaaucaauuaauuuagagauacagucucacauccugaagguuggccuuaaacucauuuuguagccaaugauaaccuuucuuugguuuuuguuguuguuuggguuuuuuuuuuuuuggucuuucaagacaggguuucucuguguagcccuggcucuucuagaacuuucuauguagaccaggcugaccucaaacucacagagaucugcaugcaucugccuuuugaguacuggaauuaaaggcauaugccacuaccauccagcaaccuugaauuucugaccuuucuccugauuccaaugaguaccaaucuauccuguuuccguccccuauuuuacaaaggggaaacugaggccaagaggaaguggcccauuguaggucauucacuauaauuagcugagcccugguccugugccugccuguguuagcccagcucugaccgaguguuccaagacccaucuggccuacugcccucgagcccugccacccaaggucacgcuugcccaagguccugccuacccauggucacaccugcccguggccccgccuaccugcguguagcagcgcagcagcagccccuucuccuucagcaggcggaugaaguaguggcagaugguuggcugagagaagaguaacagugcugaugugaaugucccaggccaugcugugggcccauucugccccauggccccaucucaguggcccagugagggugagccugccuucucccguaccacaaaugaggagacccaggcaagggcaugguggcggcuuuuuggcaucaccaauagguaaacugcagagucaggcucacagccaggcuucagucucagcccuuccugauagucucagcagcuuucuuagaguuggguaaacugaggcccagagccacaggauaaagagacgaggggccaggcaacccacuccuccuuucuuuuaauuucuuaaaauuguuuauuuuacuauuuauuuauuuuuuugguuuuugagauagggucucucuagguaagccuggaauuggcuagccucaaacucacagaaaucuuccugccucucaccaagagcuggauuuuuuuguuuguuuucuuuuuuguuuuguuucuuguuuuuguuuguuuguuuguuuguuugcuuguuuguuuucgagucaggguuucucuguauagcccuggcuguccuggaacucacucuguagaccaggcuggccucgaucucggaaaccugccugccucugccuuccaagugcugagauuaaaggccugcaccaccaccgcccggcccccgagcuggaauuuuuuaaaugauuuauuuauuuuuauuuuaugugcauugacugguguuuugucugcaugugugugugugugugucagauccccuggaacuggaguuacagauagcuguaggcugccaugugggucugggaauugaacccagguccucuggaagaggagccagugcacugaacugcuaagcuaccauuccaauuauuuuuaguuacagauaugugugugggucucuguugguauauggaggugaguucuagugcccacagaggccagaggugucaggcuccccggagcuguaguuacagggggcuaugaacauccugauguggguccugggaauugaacccagguccucuggaagaguacuaucugcucuuuuacccugagccaucucucccacuuucaccucuuucaucuuuaauuuuuauuuuuuuuuuuacuuuugagauagguaguuuuggcugaccuugcauuugaaaguuuccugucucugccucccaaaugcuacaguuauggggaugaacuaucaaaucuggccagaacuuauguaauucuuuucuuuuuucuuuaacaauaucucuaucuacccaucuacccaucuaccuaucugucuaucuaucuaucuaucuaucuaucuaucuaucuaucuaucuaucauccauccaucuaucuacccaccauccauccaucuauccauccauccaucuaucuaccuacccacccaucugucucucccuccauccaaccaucuaccuggggauaugcacuugccacagugcacauguggaggucagagaauaugauggagucaguucucuccuucagucaugaggauuccagggauugaacucaggucauuagguuugguagcaagcaccuuuacccauggaaccauccugcuggccccagaagcuagguucuuaaucauguuaugcuugccuggagggccuauaaagagccugcuuccaugccuacucuucccaggcucccugcagaagaugaccucaccuugaacugcccgggauagagcuccuuggcaagggcaaagaaggguuccggauguuucugugggagagaggagcagagggccacaugucccagguaagacaaggacuggaguugggagccaccuccccucaucuuagccgucuaccuugaaguagcugaucucaaagauggccucuggguaaggaaggugguacuucuccagguuugcauagaggccaguggacggggagcggaagucagggauacccgcggcuaggaaggcaacgcagucagaggcucugcccacgugugcacgaaccccuccagccucccccagccccaggaguggcugaaggacggggaacuuacacguggagauuccggcucccaccaaacagaugaccuugcggccuggaacagaggauugauggcacaugcuaagguuucccuccuagacguacugcuggugccgggcaggauggcauuggcaaccucacauuucaggugaggagacacagccacccaggagaagggagagggaugggggguggggugagguggggacgccuugcaaaguucggcaguacagagacggcuaguuugaguccuugacaaucaauccaaaccaaauucugacaaugacuaaucuucuagguacaauacuguaagacuucaaaaaaauuacuuuugggucagaagguaguuguguacaccuuuaauccaagcacucgggaggcagaggcagacagauuucuguggguuugaggccagccuggucuacagagugaguuucaagacagccaaagacacacagagaaaccuuguucaaaacacacacacacacacacacagaugagggcuacauagauggcucaguggguagaacaccuccuccuuuuccagagguccugaguucaauuuccagcaccccugucaggcagagcucacagccaccuguuaacuccagcuccauggauccugugccucugaccuuugagggcaucuguacaucuacacucaugcuuauacacacacacacacacacacacacacacacuuaaaaaagaaaauuugagacaagguuucauauagccaaggcugaccuugagccuucuauguagcuaaggcugaccuugaacuucggagccuccuggcuccaccucuugggugcugguguuguggugugcaccagcaugucugcugguuucucugguuuugagucagugccucccuauguacccugggcuggccuggaauccuguaccucccuccucagccucccaggagcuccaaugacuggcuaggaccuguuucuagcuguacacaucccuucaccauccugcuuuguucacacaaaagccuaaagucugcuccuuugagucaauugcacuaaauaacgguuuuuuuguuuguuuguuuuggacaggaucucauggacgucaggcaagcauuaaauucacugugcagccagccaaggaucaccuugaacuuccaaucacccugcuuccaucuuuaagugcccagcauugccaucaugcccagcuuuucuuuucuuucuuugagacagggucucagcaugagaacucgcagugaccuugcaagcguugggaggagugggugccaccaagccuugcuaugcccguuguuguguguggugcaggagacugacucuaggggccugugcacuaagcaagcacuccaccaaccgagccaagccgagcccccagccccuccgguguauuaugcuucuucagauccaugguucauacucuuaugggggcuuuguucuugguuuuuaaagaacuauuagggggugauaggauugaauccauucacaggcacagagcugagaagaaauggcccuauugcugccccagcugcuggcuggccuacagcccagccacacagagccccgacaucugucugucagcugaugggcagacacaagugugguaucccaugaauugggcaccccugggguguucuguuuaagggacacgugugaacagaagucagucugccaucggggcuggcgagauggcucaguggguaaaggcacuugcugcuaagccugauucccggaaacuacacgguagaacgagaaaaauaacuccucaaagauguccccuggcaaacacaguagcaugcaugcaccuacaguaaugcccacaucacccacccacccccagcacacacacucaaagauaauguuuaaaccaggcaugguggcguauguguuuauucccagaacuugggaagcagaggcaggaggaucucugugaguuugaggccaguguggucuauaaagugaauugcagaccagcaaggucuguuacauagaaaaaaaaaaaaaaaaaaccaaaccaaaccaaaaacaaaugacagcagagagccugcuacagucuaugcacucagcuucuuuaggauguuacuggcccaagucuggcuggagaucguaggcauugagacugggugugguaacacuguaauaccaaaacuccagagacugaggcaagaaaaucuuaaauucaaagcuugccacagcuacagaacaagaccgagcuucaagggcccugacugugccccuugcauauguucacaccaagucacaaccucuccgugccucaguuuccucuucuguucagcucacuucuagaaagaccucacagcuauugcgugauaauuagguucaaggaugcuuggugagcuacuuagcccagagccuggcgaacagcaagggucugcuuaguugauauuuaugucacgucccacaccagcacccuaugggccagggacucucagaucugaguguaagagggaggaccagugucgccuggccacuguguggguaugcucuguaggcggccggcugcccagccuguggcaggagagggagguucagcugccaucccggcugccaaggagggcgcugagcagcugggccaaggggaaacuggagaagauggccucaacaaagggcuguucaggacccucaaagcugcauuguucccaacggggacugcgagggccuggguucucagacuucggugacucgaccucagcaagaaauaucaauuucacggugacccagcuagcuggcuucuaaacagcacgucugagacaagcuuccuguaauaauaccauggcaaacacuucuguaucucucaagagaucggguccuguucuaaucacuuaucucucgaguguguguguguguguguguguguguguguguguguguguauuucuccagggccauccaccuaguguguauaugggcuguuauuuguuuguuugguggugugcacacaucucuuugugcguguauuucacagcaaacauguggaaggaagugagaggacaacuggugccaucacggauuuuaaggcagggucucacgagucucauggggaccugagcuuggcuccugccucugccuccccagcccgggaauuacaagcacuugugagcugcuugugugggagcugccagcacuuaauggacugagauaaucuccuaagucucucugucucucucugucucucucugucucucucucugucucucucucucugucucucuuugucucucucucucugucucucucugucucucucucguguuuugagacaggguuucucuguguaacccuggcuuucccggaacucacucuguagaccaggcagaucucaaacucagaaaucccccugccucugcugggauuaaaggugugggccaccaucaucauuccauuucccucuuuuuucuguaguccaggcugccucugaauucacaugcucuagccucagcuuccagaguggcugggccugcagaugagcucggcaugcugagcauauguaugcucagcauguggcaauuuccuuagccucaccugagucaccccagagcuuugaucacuuccagucuagggcauaggccuggcccaucagaagacaguaauagauucacuagggaagugacccaaaggcaggccuaguggugcuacucuguacucccagcuaugugggaggcugagguaagaggaucgaccuucagggacuagaggguaaauucagggcguucaaaauaaaacaguaggaaaggaagggcuggggcuguagcucaaugacagagugccugccuagcguggugugugaguguaggggcugaguuccauccggggggggggggggggggcuucugggccaauguggccuuguucuuaagugcaaagguacccucccaagcaggagccgccugcuggacuuuccuucacccuacgcagacagacuugugaggccugagaacaauguccuaacaauguccucgagccuggcuccaucacauuuaaugcuuaagagucugcaugcuccuuuuuauuguuuuuggcuagaguucugguuucuugucuuucucuuuucuuucuuugaguuaacaaucuuauguagcacauguuacccucaaacucaugaucuucuggcuucagucaccuccuggaacucacucugcagaccaggcuggccucaaacuauagaaaucugccugccucugccucccgagugcugggguaaaaggcguucaccacccccccccccagcaagcugaguuuuuuguuuuuuuucuuaacuacauggguguuuuccuucgugaauguugugugcuacaugcaugccugaugcccaugguggccauaaguaggauccccugaaacuggaguuacagaugguuguaagccaucaugugaguccugggaacccaaccuaggucuuuugggaaaacagcuagugcucuuaacuacuaaaccaucucuccaucccaagaguuggguuuccuccaucuuuuuucuuucugaauuuuaggaaaacuucccauguagcucaggguagccucacacacacagucuagcagaggcuaacuugaaaugcugguccuuucccaaucugcucagaguuugggauuacagguguauacagcaggcuuucuuacuacuccuaccccccaaaauauggagucaacuggggccaggaaugggagaagcggccaagcaauuggggacucacagcgcucgcucugcauguagcgugucacuccuucgagggucagcucgucuagaagacgcuccuuuugggaacccaggcccagggucugggugaauaaauuccucaggaaguccacuggccaacaacaagagagacagcgccaggugggcaucgagccagggcccaagcacacacucuccucccacaucucaacucccaaugucucccacagacagcagcauccagucccaaaccauuguuacaugcuuugccuaucacuccgguagcuuggagggggucuccccagaaucccauccucuaaucccagaccccagaucaccucccugcccuccuccaggacgacacuuacucucugccucuccaccaguggcuccucccucaguguccgagucugaauccuggaaggggugggugggauggccaagcccaagaagugggguuagcggggaagggaagggaagggaagggaagggaagggaagggaagggaagggaagggaagggaagggaugggaagggugacaaccugguucaaauacaguagggcucugacugggaggugcccugaagaaguacagggccaguguaaggacucugggaaagguugcuuuagagagaggaccuggcucuccucuaggccuuaucuuucuuucaagauggggucucucuggcuggccuaaaacuuacuacacagaccaggcugaccuggaauuccugaagaucugccuggaucuguggccuggguuuaaaggcaugcaccugcaugcuugucccaucuuuuuucuucugacagagucucacuuuauauaucccuagcuggccuagaacucacuauguagacuagauuaccacuugccucucucugacugcuaggauuaaaggcauaugccaccaugccuagcuugcuuuuugaguuaggguuuuauguagcccaggcuggcuucaaacuugcuaugaagucuuuguaacuugaacuucugaucuuccugucuccaccccucuaaagcugggauuacgggcaugauguugggagcacauccaacacucuacccaguuggccaucacagccugacaagaugcuagggccugaagccauggcuucaugcaugcuaggugaccucgagauagaccuccaagcccaugggccgcaacuuguccauauagcucagagguugcugugaagccgagcagcgagccccuaggugccucggcuggcuauaccacagccuagucauuggugaugccacuucucugacaccggacaugagccucucagggcgaccccaccuugcuccaaccauguuccaaaguggccucagaaucuccccaaaccagcuccugcucccaguccccauacuaaguggccucccugucccuucauuggcuucccuaccucaccacccucaugccaauucccaguguacccacugggaugccagccuccugacauccuuccacugacucccucucccaacccuagagcuccaccugguucaacguguucucuccugggguccugcccuggccuccuugacucaguuucugucuuagaucauaugauggccuguugaggacaguccaccucucucuucuuuaauccuucccccguccccaaaucacaaacaucuacugagugccacaauaucagccacacaagggcagggacauuacguuuacugcuuacugcccagccuagauaacaggacuuccagaaccaucuaccacucaacacaugccgacuggggccagcccagggcuggccuugcagcagaugccacacagucugaccaguacagucaacucccugcucaaaggcccccagaccuucccuuccacacucugcuuccaaaucuccuuucuaaauuauuuuuaaagauucuucuguuguuauuguuuuaagacaggguccgacauagcccaggcuggcucuaacuuguauguacgugagggugaacuugaauuccugacccaucuauuuuuauuguuuuaggugcuaggauuacaggauugcaucaccaucaugccugacucuagaaugauucuucacugauauuaaaaaaugacauaaguuggcaugaugggucaccaggggaaggggcugccugcuaagccugacaaucugcguuugauucccaggccccacauggugggaggagacgauagcuguccucagaucaccauacauauacuguggcguguguauccuaaacacacacacacacacacacacacacacacacacacacacaaaacaaacuagguguaaaauuuuaaaaagagggucuggagagauggcucagugguuacgagcacugacugcuucaauucccagcacccacauggcagaucagagcugccuguaaccccaguucuaggggaugugacacgcucacacagacacacacgcaggcaaaaugccaaugcacaugaaacuaaaaaaaaaaaaaaaaaaaaaaaaaaaaaaagauaaaagcuuuaaaaagagccuguccaagucuuacuguuuuaccuaagauggcuuccaacuccuaauccucccccuucggccuccugagccuggauaacgaacaaacaccaaagcaaaaccaagcaacaguuaaacagagauaacucuacgugguuucucggcgugagguuuugcgcauuugcucauuauuauagaacugggucuugccagaguaagauacugcacaauguuucacagaccuacaucauucucuuuaguuuauuuuaguuaugugaauaugugcaugugugugcaagucuccauagagucagauccccugggacuggaguuauagucacuugugagcgccugguacauggaacucagguucucuggaauagaauucuuaaccacugagccaucucuccagcccccaccucauucuuuauuguggcuccauaguaacacauuguaugaugaaccgugguucauugacucccucuccugacagccacugaggcugcugcuagcguugccccaucuggauaaugcugcaauugacaccccacaucuucuuggccacugagaaccccuuuugacugugaaacccuuuuuuagucuggcauuaagccuucauuugggagccagacaaguaagagacuagagacccacagcaggcugucacagcucuuauggggguauuguugaccacagcuucugcaccugccucccuucgaaguguggucucauaggaugagcaugcuggcauucagugguuguaggcaugguccaguacacuguuucccaaccugugggacacaaucccuuuagggaucaagcgacccucucuuggggggggggucccauaucagauauccuacauaucugauauuuacauuauaguucauaacaguagcaaaaggacaguuaugaaguaguaacaaaauaauuuuaugguuggagggacaccacaccguuggagcuacauuaaaagguugcagcauuaggaagauugagaaccacuccucgaguauaugaggacaaccuggccucugggggaaccggaggccuuggcacgugucuucaaacaucuuugagauggcucaucuacacuccacugaagcugcagcaucuuucggagcccauuuccccauaaguuucaagcccuuuccuuucuacccaaagaacacagggguuaacaguuuucaccaaguaagcugcucaucuguaacacagccaugagaggccuucccuucacugggaugcugcaaagauuaaaugaagucauguacauuaaaauucaggcagaguaucaauaaaugaccacgccagcaacccaacuacugaaacaucuacuaucccuucgugcucucaggccuguacccugcauggaacaccaccuccgaucucauuuaagaaaaucccuuaucacuucacuuauacgacacugugacuauaucuuggucuuguuccuagaucagcuuguggguuccaccaggggagaguuuggcuagaaucuucuauaaucucugacccacagaguuugcccgguacuccagggguaugcucucucccuuccucccuccuuuuuugagacugggucucaccauauggcccaagcugccucuccuuucuccauccuccuaccucacuuccccccuccccugcccccccccaugugcuggcauuacagggggcuggcaccacacccagcuucgauacuuuuauaacgugcccuauaggguccuuucccccaccucauaggaucugaguuugcggauugaacuggaaaaccgucucuuucagguccagcacaaaugagguucagaaggggcugaggaugggaugggcaacaguaggaaacgaggacgauauggaagggaaccagggguugaggcuauacauuuuccuugacagucccaagaagccaccauucucccaggagauuguacuaauccccagaugggcuuggggaucagggccauaagccaagggcccuuggguaaaagccuucccuugccaccuccccccagugcggcacguggaaccaagucucuccuucccuccaccccuuccccaucucaccugagccuccugcaccuucccugccugggucuccagagggucagaggcuggggaggaggggagcagacgugguuacagugcggggaaagaguuaagcagaagggcucacaaugguggaggacaagaggacccaccaaccuaauuauuucagagucagggaugguaguaaaacuaucggagaugggaaaaggcauauuuuagaguggagguaugugugacgugaaaaggcugaggaggggaaucuuuaggaggagaaagcaggcgagacuggacugaaggaagguuucagaguuaagcaggauaugguagcaugugcgagucgagagaaugagggagggcuaaguuuuucaagagacguaaguagggauacuucugcugagaguugagugugggagaggagaugcagugaagguaggagguuuaggagaggcacaagaacugaaggaaugagauaguaaggggccacagggguccccggaacccauccuacaguugcccuuaacaacagacaaccuuagcaaccgggauagugguaacuuugguccuuagcaacgaggguccucagcagccaaaguacgagaaaugcgaucauuaagaacuugacaaucggacccuuacauuucacaauccagaaaccaaccaaccuaguaauacggaccacuuagcaacaccccuccgaaucccacucccuucagguagauccugucucccgccccaccgagccuacccucgggccccggggccugcagcccaaagccaggccccggcgcggcccgacccucccacccucccaacagggccccuaacucacgguccggcucggccaugggaacggggugggggcccucgggacugucaccgacugcucugucccgugacggcagcggaaacaagaagaggccgagauaggauagagaacuacaacucc

SEQ ID NO: 12385 - RNA, 2641 nt, Mus musculus
cauucgcgacccgaagcugcgcgggcgcgagccaguuggggcacugggugggcggcggcgacagcggcgccacgcgcaggcuggaggccgccgaggcucgccaugccgggagaacucuaacucccccauggagucggccgacuucuacgagguggagccgcggcccccgaugagcagucaccuccagagccccccgcacgcgcccagcaacgccgccuuuggcuuuccccggggcgcgggccccgcgccgcccccagccccaccugccgccccggagccgcugggcggcaucugcgagcacgagacgucuauagacaucagcgccuacaucgacccggccgccuucaacgacgaguuccuggccgaccucuuccagcacagccgacagcaggagaaggccaaggcggcggcgggccccgcggguggcggcggugacuuugacuacccgggagccccggcgggccccggcggcgcggucauguccgcgggggcgcacgggcccccucccggcuacggcugugcggcggccggcuaccuggacggcaggcuggagccccuguacgagcgcgucggggcgcccgcgcuacggccgcuggugaucaaacaagagccccgcgaggaggacgaggcgaagcagcuggcgcuggccggccucuuccccuaccagccaccgccgccaccgccaccgccgcacccgcacgcgucucccgcgcaccuggccgccccccacuugcaguuccagaucgcgcacugcggccagaccaccaugcaccugcagccuggccaccccacaccgccgcccacgcccgugcccagcccgcacgcugcgcccgccuugggugcugcgggccugccuggccccgggagcgcgcucaagggcuuggccggugcgcaccccgaccuccgcacgggaggcggcggcgguggcagcggugccggugcgggcaaagccaagaagucgguggacaagaacagcaacgaguaccggguacggcgggaacgcaacaacaucgcggugcgcaagagccgagauaaagccaaacaacgcaacguggagacgcaacagaaggugcuggaguugaccagugacaaugaccgccugcgcaagcggguggaacagcugagccgugaacuggacacgcugcggggcaucuuccgccagcugccugagagcuccuuggucaaggccaugggcaacugcgcgugaggcgcgcggcugcgggaccgccuugggccggcccccuggcuggagacccagaggaugguuucgggucgcuggaucucuaggcugcccgggccgcgcaagccaggacuaggagauuccgguguggccugaaagccuggccugcuccgcguguccccucccuuccucugagccggacucggugcgucuaagaugagggagucaggccguggugguuucuccuugagaccgagagacuuuccgcggagcugagcugggggcccggcaguacuaguauuaaggaaguaaccuugugccuuggauacucaaaacucgcuccuuuuccuaccgaguagggggagcaaaaaugugccuugauauuuuauuuggaggauuccugcuuccucucgggccucagcuggccccgugagaaaaaugaagggugcaggcccagggcaggaggaagauacaggaagcugagaucccggcagugcccugagcugccccucagucccugucuuuagaggggagggacuuagguguuggggauuugagucuguguccucacccccagcuacagggagguggagggcuccuaaucccuugcuuuuugcaccuccaccuacauccccccccccccacucagcuuacaacaggccagguuuccugggugaguucauggagaaugggggcaccacccccagucagaccagaaagcugaguugugaguuagccaugugguaggagacagagaccuagguuucugggcuuuguggggugggggauaggaggacacggggaccauuagccuuguguguacuguaugucgccagccgcuguugcugaaggaacuugaagcacaaucgauccaucccagagggacuggaguuaugacaagcuucccaaauauuuugcuuuaucauccgauaucaacacuuguaucuggucucugugucccagcggugccuugugcaauggcagugugcacgucuaugcuaaaccaccauuuuauuuggucuuuuguuuuguuuugguuuugcucugauucuugccaaacugagacucuucacuaacggcugggggaaggagcugagugaggcucucauucuuuuugguuuagggauguuuggguuuuuucgucugccucccagaggaccaaugaaaugaagugggcuucccccucuccccuaguuguccaaggguguauguaguagugggucuuagcuuccuccggcuaagacuuaggcuuccccacccacccaaccccauccccaacggcccuggcucugggucuggaaagaaggccaccuccagccaguucauacacacaccccuguggcugggagcagggcuggaccgcuuccuucucuucuuuuuuuugggggggggggacacaaaguuucaugcuagaugucguauguauuauaucuauaauauaaacauaucaaacucaauuuu

SEQ ID NO: 12386 - RNA, 2641 nt, Mus musculus
aaaauugaguuugauauguuuauauuauagauauaauacauacgacaucuagcaugaaacuuugugucccccccccccaaaaaaaagaagagaaggaagcgguccagcccugcucccagccacagggguguguguaugaacuggcuggagguggccuucuuuccagacccagagccagggccguuggggaugggguuggguggguggggaagccuaagucuuagccggaggaagcuaagacccacuacuacauacacccuuggacaacuaggggagagggggaagcccacuucauuucauugguccucugggaggcagacgaaaaaacccaaacaucccuaaaccaaaaagaaugagagccucacucagcuccuucccccagccguuagugaagagucucaguuuggcaagaaucagagcaaaaccaaaacaaaacaaaagaccaaauaaaauggugguuuagcauagacgugcacacugccauugcacaaggcaccgcugggacacagagaccagauacaaguguugauaucggaugauaaagcaaaauauuugggaagcuugucauaacuccagucccucugggauggaucgauugugcuucaaguuccuucagcaacagcggcuggcgacauacaguacacacaaggcuaaugguccccguguccuccuaucccccaccccacaaagcccagaaaccuaggucucugucuccuaccacauggcuaacucacaacucagcuuucuggucugacuggggguggugcccccauucuccaugaacucacccaggaaaccuggccuguuguaagcugaguggggggggggggauguagguggaggugcaaaaagcaagggauuaggagcccuccaccucccuguagcugggggugaggacacagacucaaauccccaacaccuaagucccuccccucuaaagacagggacugaggggcagcucagggcacugccgggaucucagcuuccuguaucuuccuccugcccugggccugcacccuucauuuuucucacggggccagcugaggcccgagaggaagcaggaauccuccaaauaaaauaucaaggcacauuuuugcucccccuacucgguaggaaaaggagcgaguuuugaguauccaaggcacaagguuacuuccuuaauacuaguacugccgggcccccagcucagcuccgcggaaagucucucggucucaaggagaaaccaccacggccugacucccucaucuuagacgcaccgaguccggcucagaggaagggaggggacacgcggagcaggccaggcuuucaggccacaccggaaucuccuaguccuggcuugcgcggcccgggcagccuagagauccagcgacccgaaaccauccucugggucuccagccagggggccggcccaaggcggucccgcagccgcgcgccucacgcgcaguugcccauggccuugaccaaggagcucucaggcagcuggcggaagaugccccgcagcguguccaguucacggcucagcuguuccacccgcuugcgcaggcggucauugucacuggucaacuccagcaccuucuguugcgucuccacguugcguuguuuggcuuuaucucggcucuugcgcaccgcgauguuguugcguucccgccguacccgguacucguugcuguucuuguccaccgacuucuuggcuuugcccgcaccggcaccgcugccaccgccgccgccucccgugcggaggucggggugcgcaccggccaagcccuugagcgcgcucccggggccaggcaggcccgcagcacccaaggcgggcgcagcgugcgggcugggcacgggcgugggcggcggugugggguggccaggcugcaggugcaugguggucuggccgcagugcgcgaucuggaacugcaaguggggggcggccaggugcgcgggagacgcgugcgggugcggcgguggcgguggcggcgguggcugguaggggaagaggccggccagcgccagcugcuucgccucguccuccucgcggggcucuuguuugaucaccagcggccguagcgcgggcgccccgacgcgcucguacaggggcuccagccugccguccagguagccggccgccgcacagccguagccgggagggggcccgugcgcccccgcggacaugaccgcgccgccggggcccgccggggcucccggguagucaaagucaccgccgccacccgcggggcccgccgccgccuuggccuucuccugcugucggcugugcuggaagaggucggccaggaacucgucguugaaggcggccgggucgauguaggcgcugaugucuauagacgucucgugcucgcagaugccgcccagcggcuccggggcggcagguggggcugggggcggcgcggggcccgcgccccggggaaagccaaaggcggcguugcugggcgcgugcggggggcucuggaggugacugcucaucgggggccgcggcuccaccucguagaagucggccgacuccaugggggaguuagaguucucccggcauggcgagccucggcggccuccagccugcgcguggcgccgcugucgccgccgcccacccagugccccaacuggcucgcgcccgcgcagcuucgggucgcgaaug

SEQ ID NO: 12387 - RNA, 4358 nt, Mus musculus
ucagauuugguaguguuuaaucagugauaaccagaugguguucauguuccugugucagugaccauaaacacacacauacacacacacacauauuccaucauggucuccauacaacauauguaagagguagacaauucauuguccccauuuuacagacaaggaaaccaaggcucagagagaguaccaggcuugucccagucacacagaggagggagguagagguugaaugacagguaacuuuucuuagagacuuggggacugcuagcuuccuugggguacuagaacuuucucagccaccauuuucugcauuugugagcagagaacaggaguggacaagggaugaaggaagaggggugggugggcaugagaggaggagaggggcagacggucauuugaaacgaaugacucuucggauccaggggguguauuugcagaucucugaguagacagaugggugcugggcagcaccacauggguaaaugccccacgagaggacgccaugcagggugucaucacacaccagggggccaccggagucacucugcagaugggaggaaggagguaccaugaggaaagagcugccuggagggcuauuguuggguuaggauacggaagacccugggauggggcuggagagauguuagaaguuggggugguaaggagauacacacagaggugaugguggcauggggcgugggggucaaauugggaggugacaauggagaugugauagguuugcagcuggaauuggcucauccaaggugagaagacugagagggaucaagagauggggguuggcagggugaaaagcagauuaagggaguggguugagaaacgggguaaagaguagggagggcuguggauuggggaggaagggaggaaaagcagagacaacucuuucagugucuuagugccccccacccaguccaggagacagacuugcuugcugaucuguccuuaccuggcaagagucuugguuuccgucugccucagcacaaaucaugcuguuggugaucacaccuggguagaaggucucacacugcuucuggcuaaggagaguuaccuuggaacagcucaggcuccuauuguacuucacugagaacagggcagucacagggagaccaguuagcccucucuuccagaccccggaauccagccccaagccuuccuacauacccagggaaccuaaccccaccccuccacccuuaggcacagaaauucaaacccucgugauccucccucggccuccucccugggacccagggugccagccccagccucuucucucagauccaggggucuagaucugagccuucuccucaaaccgagaugucagaccucagcucucuucccccaaccugggagucuagccacgaccuuccucucuuauacccagagguccgugucccagcucucugaccucacaucgaggugucuggacuccagcccucuuccccagauccaggacuacaaacuccaucucucuaaucuuacaaacuccaucucucuaaucuuagauccaagaauccaaccccaaccucugcaguccccugagccagaguucauauucuagccucuucccucggacguagacacccagguuucagccauccucccucagaucuagggucuagcucucacucagcccuuuggacccaggaguccagcccaguucuugccucuucggcuggcugaggucccccagccugagaccugacacucuugcccuggcugagagcagcggaagggcaguugcacgggaugcacguuggacgucagcauuacaggacugcucaguuucagcaucaugaggucguguucaucugagcgauguggcaggauggggccugagcaagccugauacuugggguggaaaacaggugaacucguggaccgcaguugcuccuucuggaaaagcagcaaguggucaucgccaacucgagcucucaguggccugggggaggaagaguagccugaugaaggcaaaaccuucauggagacagagccuaacccuaguccuugggucagagggugaggaagugaagugggauccugagaucagagggucugggagaguagcuggggcugguccccugggacugagggaagaggcuggagacuggacuccugggucugaaggaggagggcucaggacugaaacccugggucugagggaggagaguaagaguuugaggguugaaggcugacuacuacucuuuaguaugcccgucucuccuuucaucuucgugucaccugguccuuugucccugcguugcaggcauaugaggagacuacaggucuuaaauacaacaugcccuggcuggcuucuauggacaggugcgauggacucacagcgccccgcccuggcguugcagcuuggauccugccucucuuguagaauggcugccacccuuaaccuaaccaaagccgagagagugccugggccccauccuccccacuacuacauugcuacuucugagugguuccuuacuuauuucuccagcaaugugcggccgugagcacccaguucugguccaccaggacacccgcacauuggaacuggagguuauggaagagggagaccugccagggaugauagucacgcucgcacugggcgccggaggccucgagguccacgcgcguggcguuucccgggagcagcagagccugcgccgcuggauagagaagcgggacagggggaucagguuucgcccagccaagucacgguuccggguuaauacagcacgucacaggaugggccucuagggggcgcagcugaguaguaagccgugggaaaauuagagaacucugcgaaccaguuacugaggcgugaaagggcaagagggguuagaauagaaugggacuaagacaccccagggcugagacuggaguggggguaggauggggggcggugaggcaaugugcaggaaaggcagggaucuaaccuaccgggcugagaccagaugcgagccuaggcagagcacugugcagagggagugugauagguaagggggcagacaggggguacagaagggcagagacacagugagcaguaagaaggcagaauucugaguucgagccuggucuacaaagugaguuccaggacagccagggcuacacagagaaacccugucucgaaaaaaacaaacaaacaaaaacaaaaaacgaaacaaaaacaaaaaaacaagaaggcagaauacaaagggaagguaaaggcaacagucaacacgguggaggcaauauggagcaggagacagaacgcacaauggggcaaugagaagcagaagacaggagacacagugggccagugaggagcuaauguggcagcgaggaggagacagggacaaggugggacagcaagaaauggggccagagcgccgagaagugcuagacaaaugagaaggggugugcaagagggaaagguaagucuaguccaaggaugggaaguugcuccaacacacagguuagggguacuguagcaccuccuuuaggaagagggagggaugcaacgggucugcaagaggugaggagaaggcaggagaggcuaagaggcgagguaggagaggcagagagguggagaagcugauggggcgaaggggcuggguucuccuaacaguugggugcgguaucuggggucagagcccaccugaggguggauccugcuugggaugucuaugugggugccaggcccccaggaaggcgagcugacuacgguugcaguggcaacauucccuccaccuccgguccuggcccuucccuccugucgcccccggccccaggcucaccccagaguugcaccaucaguagcggcagcagaagcuucaccagggaccaggagccagaggcaguggagaggugaagaagcgggacccucauagcugauacuuggcuugcagaggcuggaguggaggccuaaaacagaugaucggucaagacccccugccucagcgcaucugaaccacuucaaugagguucacuccaaaggcccccagaacuccaguccucgauccuccagaggggaccaauuugugcacccagccuuucuuggccaccagccacacugagcuccagguccauacuccuucguggguggguugggguccugcucagagcccgugggaaccucuuccuaaccucagagcugagggacuuccccaugcugcagggaaaucagggcuaugaaagaguuccugcccguugcccgagggucuccacccauccucucgccauccaccccaauaggguggggugcaacccgcuucaccugggagucgccaguaagaagaaaggagacucagaaguggcucuugcccugcagugugggcugcaaacaguccucugaccagggaccccugggc

SEQ ID NO: 12388 - RNA, 6338 nt, Mus musculus
gguuucuggagacagucugcuacuugggacccagcauccaagugccccauauuucaugcaggucggaucauaaggcagccuucugucagucugcucugccccuucccucgaggagcgcccugccuugcugacuuucucugccucuggcuuccugugauagguggugucauuccccuccaaccugagugcuggcagguacacugcuggccaccagcaggugagugaaggguaaggauguaggcaaggugcaaaaggaaagucccacagaggaagaaugucagggaccccuuggacuaacaucucugagaguagaaagggacaccagagcccagggcuggguuucuucccuaaagccacuagaaccaaggacaugguugguccccacacugucuugcauuugcucucagggacccucagauucaaggugcaggcugggaaaugaggaaccaggaagugagaaggggggcaugugcagagauagaacaaaggcaggagagcaggacaagacaguaaagauggagagggugaggaaggagcagggugggguuccugagaugugaacagaggcugagauaugacuaauggaaucguuggcuuacccucucaagaugcccaugaagaugcugacaaugaagaugcuggcccugugcuugguucuugcuaaaucaggugauuuaaggaccauagaagggggaggggcugguagauagauuggcucuguugacagacggugguuuaggacaggacuaugcagcuuugagaugaggaaagcccugagggggcuggcuaaggacaagucuggagguggguuggaggauaaagcgugcuuacgucuuugaggauggagauagcugggcgugguggcacacaccuuugaucccagcacuaggaaggcagaggcaggugaucucugaguuugaguccaaccuggucuacagcgugauuuccaggccagucuggaauacaccaagaaacucaguaucaaaaaggggaagggaggcuggagagauggcucagaugacugcucuuccugagguccugaguucaguucccagcaaccacaugguggcucacaaccauuuuacaauaaggucuguugcccucuucuugcaugcaggcauaugugcaagaaaaacauuguauacauaauaaauaaauaaauaaauaaauaaauaaauaaauaaauaaauaaauaaaucuacaaaaaccucagaggguagagguagagucgaggaagagaagguagauguagaggugacagugagauuagggacccauuugauuacaguucauuucagaaggaucuaggcucuuggagcucuucucugacucagccccuuccucccucagccuggucggaggaacaggagaaggugguucauggaggcccguguuugaaggacucccacccuuuccaggcugcccucuacaccucaggucacuugcuguguggugggguccucauugacccacagugggugcugacagcugcccacugcaaaaaaccgugaguuuccuuggucuuuaagaagcugauguaaggggguccaaagggugccuuguagacuucagaaggggggcagaccugagcauccaucauucugugaacaguucucuucagccagguauccauagguuccgggacccugaagguaucucaagcccuuaaaaaaguaaugcaacauuugcguauaaccuauggauaucuuugcaugaacucuaaguuauaucucuagagcaccugucaacgcagggggaacaauugcucuggguaccaccuccagcaucuccuaaauugggccgggcauucagcacuauagucuuagugaucgagagauggaggcgggagaaucaaaagcacaagcugagccucagcugcacaggaagcuugaggccagcuuggguugcaagagacucccucaaaaaaugggggccaaaaugauagcucagugaucaacuugcuucacaaucauugggacugaaguucaaauccaagcauuggugucacaagccagauaaccccugcaaagugcuuguaacuccaacucagaagguuccaaagccuucuucuggguucugcacaugcauggcuuugcaaaacacacacacacacacacacacacacacacacacacacacucaaaucauuuuuuuaaggugggagagaugggucaacuguuaaaagcacauacugcucuugcagacaggaucuaaguucaguuuccagcaccccuacagcaaguccgaacugucuguaacuccagcgucagaagagcuaauacccuuucuguccuucaugggcaccugcacucaaauguagauacccuauccacacauauauuuaaauacaaaaguaaauaguaaguaaaauuaucuuuaaauguugacuuuauuauucguguugugugggugugcacgugccacagugcaccugugcaguucccaggacaacucuguagagucagguccucucuguccacauucaugcagguagugaggcaugagcucagcguacugggcuugugaggcagucccuuugccugcugacccaucuugccagcuccuccucucuuguugcuugucuuugagucagggucucucuggguugcccuauuggcuuggaauacacucuauagaccagguuggccuagaacucauaggaauuccuccagugucugccuccagagugcuaggacuaaaagugugcaccaccacgcucuggugcugccccaacauuuuuaaccuguggucaauugaaucugcgaaaggagaaccugaaacuaugucgguuggcugucaaguugcguaguagaaaaguuagaaaggcaaaaaucuagaagaaugagauugccuuuuacugagcuggggaagaucaagggaggagggaagaggggaggaggaggguaggugcucucucugggggcuucuggcgaagcccagggacuggaggugaguccuagcugucuucuucccaggaaucugcaggugaucuuggggaaacacaaccuacggcaaacagagacuuuccaaaggcaaaucucaguggacaggacuauuguccauccccgcuacaacccugaaacccacgacaaugacaucaugauggugcaucugaaaaauccagucaaauucucuaaaaagauccagccucugcccuugaagaaugacugcucugaggagaaucccaacugccagauccugggcuggggcaagauggaaaauggucagugaggggagaugguugggagugaucaaagggaccaaagggagagggucuagugauggaggugggaugguaaauagugaaggugggaaagaagauggugggccacaaggagaugcugauggagaggaucaguaggucacucuguuuauggauaaaagacagauggagagaggagaagguugaggaguuggaccaaauguggauaggcuacaaaaugaagggucaaugagaagugagaacucaugggggagguuaugauuagugaggaagucagaccgagaaugauggggaaaggggccauuugggagacagugacaaggaaagcgauccuaagcaugaaagagaaacaaaaugggaauccgcuggaaagaaaugggggugagggggaagggcagugaagacagcuggugaaggcacgaugggaaggggauguguaagccuggcccaucuuccaccuccuaggugacuucccagauaccauucagugugcugauguccaucuggugccccgggagcagugugagcgugccuacccuggcaagaucacccagagcauggugugcgcaggcgacaugaaagaaggcaacgauuccugucagguaagaccgagaccagagaucugaaaucaaccacacacaggaagacagagacacaaaccaaagcagagcugaacagagauugagaaagucagccugagaggacacuggaggacaaaacagaagagaauccaccucacacguguaaagacagauaaggaagaagcagggcagcucggggcugagagguuggcucaaucaguaagauacucaccaugcaaguauggagacccgaguuguagggcauggugaauggcauaugcuuguuauccuagugcuugaggacagaggcaggcauaucucuuggguucauuggccagccagaguaaccuaaugggugagcccaggucagugagaaacccugucucuaaagacuguacagcgagugacuccuaagggaggaugccugugacugcuggucuccaccugcgcauauacauaucugcacacacacacacacacacacacacacacacacacacauacacacaacacacgacacccagcagaaagaagaaguuuagaugcaaagucagggacaccaagagccagagagaugcuaaaauggcuagccaaauaugggugaaccuagcaaaccugaaaguuuaaggaacaaucucaauaaauggccaccuuggugggaguuuugaacaaccggggagauccaagggccagaaagaugcuacagagagcuauccuuccucagagcugcagccgugaaacccaccuggaaauagcuaagcuucagaugaggggccuuccagcugcaaagagggauucuaugcccaucccucaacacgugcaacugagcuccucuggaacucauucacaagccuugucuuguccccagacucacaacaauucuccugcauccgccugugggauacuggaauaacaggcaugcgccaccacaccgcucuaaucuucaguaccuuaccuggaaccucucuaccugucauccuuccagacuccuuuuuaugccagaaugacucuagaccguggagggccaacaucaaccuaccaagaaagcaagggugggguuaugggagaggccaagaaagugaguuaguggcuugggagcaaagcagcuaggcauggcuggccugggaucaagggauggagagcacugaaaguuuguugccuucuucuugagucccugccuucauagccuccucugcugagcuuagcacuuuugucucuacgccccccccccuucuccauugauaaccuuuacuuuuauggaccuugaugucccucuccguacugugacacucucccugcagugaugaucauaaacauguauccaucccagacagagaagcaauaacaaaccaaugaaugacaccaaaguccaacuuggugaaccaaugagcuucauagggguuacucuaaggaguaugggugagggguuacuuacaggagcagaaaugacucaugggcaacugcaucaccaaaagcucacccccgcaugggugacagcucaucaaagccagaauggggagcacacacacugcacagccugcaggcagcucaacaggucggaaagugucucccuuuggcagcugagguagucagagucucuucuuggcaguucaucuugucugagagacucuugguaguccuuacugcuuauauauacuuggggaaggagggaccuagugcaucugcucagcuccaguuccuuccugaagcauuugaguuguuugcuuauugagcuuaaggaucuuugccguggggugcaaaguuucaacucccuuagaacacguuaugucuuaacaaucuucucuccugaauggauggcuuuucuaagcacccucucucucucaccuauaccacgguggaacuugguauccuggagcaccucaucugucucuggcuuuuccugggaauuaagcccaggaucuuaugcuaugcgugcucagcaagcgcucuauuggugaacuagagccccauuccucuuuuacuuugagaaagggucuuccuacauagcacaagcuagccuuaagcuugcaaucuuccauggcauccugaauagguaggucagaugacaggcaugaccaccaauccagccuuuccuccaucuccaaguaucucugacucucuaauuucugccccccacccacccacccaccaccacuucucuuccuacucuugcuucucccccuccuccuccucauucuaugugaguuucugacguuucucuuucucuuccacacagggugauucuggagguccccuaguaugugggggucgccuccgagggcucgugucauggggugacaugcccuguggaucaaaggagaagccaggaguuuacaccgaugucugcacucauaucagauggauccaaaacauccucagaaacaaguggcugugacaugagacauccaguucucccccacgacgccucugacccucgcuggcuccauacucucucucccugaagcccugcccugcucucagagccuucagauguccagcucugacccugguacuuaauaaauguagugacacag

SEQ ID NO: 12389 - RNA, 5190 nt, Mus musculus
caaaaaagggcauuugagggaguuaggccugcuaagccgaagugcgcuccgggauuucuugacuuuauuucgucaauguugagaaaaacuuuuuauaucucaaaauaucguuagaaaaggaagucccagcgcucggaggcuuagcugacaaagaaggggguugcguggcugcgagucucagaacuacuguuugggagccccaaaaccacugcuggcacccgcgccgcacgggcgcccaauuccuccccugguagguaacgcggaagagccgggaggguggcggccucagggcgcaggaucgggcaaaccugucgcucagaagcucggcuaccgaaaagcagaauggccacgcguuguagacggaagccugcagucucagcauccaggcuggaggcaguaaagauugcuguaaguucaaggccagugagcuccaggccaggcuggacgacagaaugagcgccagaccaacauggguuaagcgauuugaagaccagccugagcuacugaauaaguuugaggguagccuggguuacagagugcauucgaggccagccagggccacagagugaguugaagaccagccuuggcuacauagcaaguucaaggacagccuaugcuacauacuaagacccugucucaaacauccguaaaaacaauauaggaacaaaaaacaaaaaaacagaagaagcgacagcaccugggaaaagacucuggaaaugaguaaggguuuucugcaagggugaggcgguugugagagcaguuaggauccuuuaaagacgagggaaagaggacuccacucuugaaauagggugccagcuuuggauaauaggaguuuacauuuagaaaagggaaggaaccuauggguagaguucauauagaagacucugggggguaggagaggcggucccguuggauuuggaaaggugggaaggaguuucccguuuguacacaauggugaaggaagaccuguguuguggcgggucggagagguuugagugcauuugccccgugacagacaggcucaggaacuguccuguggugcgcaggcuagagcauggaaaccccgaaaccgcggauuuugcccuggcuggugucacagcuggaccuggggcagcuggaaggcguggccuggcuggacgagagccgaacgagguucaggaucccguggaagcauggccuacggcaggacgcacagauggcugacuuuggcaucuuccaggugcugggggaaagauuucagacgcauuucuggguguggcuggaccagggcagggggugggauaggacuggagggacagacgggaauugauuggcagauucuaggaacagaauccugaaagccagguugcguuucuuuuuuuuuuuuuuuuuuuuuuuuuuuuuaaagauuuauuuauuauuuuauguaaguacacuguagcugucuucagacacaccagaagagggagucagaucuuguuacggaugguugugagccaccaugugguugcugggauuugaacucuggaccuuuggaagagcagucgggugcucuuacccacugagccaucucaccagcccuagguugcguuucuuaagaaacguucuggagcaaugguucucagucccugggacgcgaccccuuuggggguugaaugaccguuucauugaaaaauaaguauuuugacuucuaacaaaacuacaguuauguaauagcaauacaaauaauuuuggggcugggggaucacugcaacacgaggaaccgcauuaggauaguugagaacagcuguuuuagagggcgggaaaucuuuaggagugggcucuugauuuuagaacccuuaagccuuaagaguugagacugcccucaagagguguuauuugcuuccugagcagcaugguaguaagaaugugagguggccuggggugagguaccaaguagauaacuagaaugauggcuuaaaaaaaaaaaagccuugaagguggacauggugacaugaguuugucagcaccgugggcagggcagggcaggguggagggugaggucucagcuuggagcccaccuuugguuauaaugugugaaacccugccucaaaaucaaaacgauuuuucuuuaguguggaaauagugggaaaguaugagaacggagguccugggggcucugucaugaaccagaaguggaugguguguggugggaggugucagggccucgggccagagucuaagucgucuuguuguggaaucccugauauuucaggccugggcagaagccaguggugccuacaccccggggaaggauaagccggacgugucaaccuggaagaggaauuuccggucagcccugaaccggaaagaaguguugcgguuagcugcugacaauagcaaggacccuuaugacccucauaaaguguaugaguuugugacuccaggugcgugugacaaggcuggccugggggucacagaaagcuugggaucaggagggucucugccaccuacacgcucacuuccacucuggacaggggcgcgggacuucguacaucugggugccucuccugacaccaauggcaaaagcagccugccucacucccaggugagaggcagucgucccgugccucagccuucccccccgccccccaccccccagcccuucucccgggaccuccauuccuccaccgguuggcugcccuccugacucagcugaagcuguugaccagcuaacacccuccuccucccccaggaaaaccuaccgaaguuauuugauggccugaucuuggggccccucaaagaugagggguccucagaucuggcuauuguuucugauccuucucaacaacugccaagccccaaugugaacaacuuccuaaacccugcaccccaagaaaauccacugaagcagcugcuagcugaggaacgugagugccagcuguggcgugggaagggcugcggcagggacagcgcuccuuacccugcuccucuccauuucuccccucucacuccaccgguggcucagaaugggaguucgaggugaccgccuucuaccgaggccgccaggucuuccagcagacacucuuuugcccggggggccugcggcuggugggcagcacagcugacaugacacugcccuggcagccagucacccugcccgauccugagggguuucugacggacaagcuugugaaggaguacguggggcaggugcucaaagggcugggcaaugggcuggcacuguggcaggcugggcagugccucugggcccagcgccuaggccacucccacgccuucugggcucugggggaggagcugcuuccagacagugggcgagggccugauggagagguccacaaggacaaggacggagccguguucgaccucaggcccuucguggcaggugagugagcacccuauggaacugacaggccaugguggcugauugaauucagagucugcuacuaaguuuuguggcaaaaagcuaggccugugccuccaaguccaggggcuggcugcuuagacuguugaagcuaauguaguacaggccauauaagacacucugguguguccacaucucaugguguauacagaaacacugcugaggcugggagcuugccucaguggauagugccccaagauuacguccccuaugguugggaugccaugugucagcaagguagccaguuugaaguugcauuuauauuugaaacuuuaguuuucugaggcagggucuugcucuuacugcuucugcuagccuugaacucucaugccuccugccacacccucaagggcuggcaucgagugucagucagagagcggcauugggccccaagcagcugaggaaacaucccaacagccuccugagcugcgagcccaccguccuccucacugccgcugcugcaggaaggaaggaguggggagcacuuguuugugucuguagggacuuuuccagauaggcaguguauagcagugucagggaagauacaaguugagcugguagacaggguagaagccauccuuucuuuucugaccuaacucuuggguucccagaucugauugccuucauggaaggaaguggacacuccccacgcuacacucugugguucugcaugggggaaauguggccccaggaccagccaugggucaagaggcuugugauggucaaggugccagcugucucaugcuacuggggaugggaggguccacuuguggaggaaccugcagcaccccgggacuaggacccucagaagccccucugagaaauagcuuacccaacaggccucugcagccacuguuacccuucccagaagccucugcguguccuccacaggacuuauucaguauccugagcuuauugugacucuagacccuguagcugguagcugcaggucuuugcagccuuugaagaauguggcucccaggggcuuccauuaauuagguggggcggucagaguuccuaacagcccuaggcugagugaggguccacccuggguuaugcuggcagccccuagcugacuagagaucuguccugccuccuucagguuguuccuacaugucuuaaggagcuguuagagauggcccgggaagggggagccucuucacugaaaaccguggacuugcacaucuccaacagccagccuaucucccuuaccucugaccaguacaaggccuaccuccaggacuugguggaggacauggacuuccaggccacuggaaauaucugagccccacucagcugcuaccaauaaagcaguuuaugccgccaucacaucugcugucgacugcgucuaggcuggugguuauucuacaaggcucagucuucccaucugcagcugaggucuaggugcuccaggagggaggcacagggacaaaacacagcauggcugccaaggucguggagaaaguaucacaaagaaagcaaggacaagacagguccagagcugcacacacauugucccuacguggagcaagggacacugucacagguggugaugguuggcaaccggcaagcuugcuguggggcgggcgggcugacucaccaccacggacugagucacugcagccccacagugcuacugauaccagaggccacucgggugaugcucaaggcuggacccugccuccuguuacccccauauccccacauuccuaagucuggugugacaccaucaugguuccccacucacacaccccaacucuuuccuccugaaaaaaagcauuucauga
